United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 72

SEQ ID NO: 2593985 - RNA, 15 nt, Escherichia coli CFT073
acucuucaagauuaa

SEQ ID NO: 2593986 - RNA, 17 nt, Escherichia coli CFT073
acucuucaauggcauca

SEQ ID NO: 2593987 - RNA, 19 nt, Escherichia coli CFT073
acucuuccagaccaaacau

SEQ ID NO: 2593988 - RNA, 18 nt, Escherichia coli CFT073
acucuucccuauccggaa

SEQ ID NO: 2593989 - RNA, 11 nt, Escherichia coli CFT073
acucuuccggg

SEQ ID NO: 2593990 - RNA, 19 nt, Escherichia coli CFT073
acucuuccgggaaaacauc

SEQ ID NO: 2593991 - RNA, 13 nt, Escherichia coli CFT073
acugcggccagca

SEQ ID NO: 2593992 - RNA, 22 nt, Escherichia coli CFT073
acugcgggaucuuauccugcgu

SEQ ID NO: 2593993 - RNA, 16 nt, Escherichia coli CFT073
acugcgguguaaacca

SEQ ID NO: 2593994 - RNA, 17 nt, Escherichia coli CFT073
acugcgguguaaaccag

SEQ ID NO: 2593995 - RNA, 22 nt, Escherichia coli CFT073
acugcguggcgaaccgucugaa

SEQ ID NO: 2593996 - RNA, 13 nt, Escherichia coli CFT073
acugcgugugaca

SEQ ID NO: 2593997 - RNA, 12 nt, Escherichia coli CFT073
acugcuccaggg

SEQ ID NO: 2593998 - RNA, 18 nt, Escherichia coli CFT073
acugcuccugcagaaaau

SEQ ID NO: 2593999 - RNA, 22 nt, Escherichia coli CFT073
acugcuccugcagaaaauccag

SEQ ID NO: 2594000 - RNA, 13 nt, Escherichia coli CFT073
acugcucgcagaa

SEQ ID NO: 2594001 - RNA, 22 nt, Escherichia coli CFT073
acugcucguaaagcaucagacu

SEQ ID NO: 2594002 - RNA, 13 nt, Escherichia coli CFT073
acugcugcauccg

SEQ ID NO: 2594003 - RNA, 15 nt, Escherichia coli CFT073
acugcugcgguugaa

SEQ ID NO: 2594004 - RNA, 15 nt, Escherichia coli CFT073
acugcuggaauacug

SEQ ID NO: 2594005 - RNA, 18 nt, Escherichia coli CFT073
acugcuggcuuaaaaaac

SEQ ID NO: 2594006 - RNA, 17 nt, Escherichia coli CFT073
acugcuucgcacaggca

SEQ ID NO: 2594007 - RNA, 14 nt, Escherichia coli CFT073
acugcuugccaccg

SEQ ID NO: 2594008 - RNA, 16 nt, Escherichia coli CFT073
acugcuuuuaaaugcc

SEQ ID NO: 2594009 - RNA, 20 nt, Escherichia coli CFT073
acugcuuuuucaauuuccag

SEQ ID NO: 2594010 - RNA, 19 nt, Escherichia coli CFT073
acuggaaaaccgcacucac

SEQ ID NO: 2594011 - RNA, 15 nt, Escherichia coli CFT073
acuggaaacagccaa

SEQ ID NO: 2594012 - RNA, 13 nt, Escherichia coli CFT073
acuggaaaucaaa

SEQ ID NO: 2594013 - RNA, 18 nt, Escherichia coli CFT073
acuggaaaugaucccaga

SEQ ID NO: 2594014 - RNA, 13 nt, Escherichia coli CFT073
acuggaacaagcc

SEQ ID NO: 2594015 - RNA, 16 nt, Escherichia coli CFT073
acuggaacaguugcag

SEQ ID NO: 2594016 - RNA, 21 nt, Escherichia coli CFT073
acuggaacaguugcagucuca

SEQ ID NO: 2594017 - RNA, 16 nt, Escherichia coli CFT073
acuggacacugaauaa

SEQ ID NO: 2594018 - RNA, 21 nt, Escherichia coli CFT073
acuggagacagauuuauaaaa

SEQ ID NO: 2594019 - RNA, 22 nt, Escherichia coli CFT073
acuggagacagauuuauaaaau

SEQ ID NO: 2594020 - RNA, 15 nt, Escherichia coli CFT073
acuggauaaccuguu

SEQ ID NO: 2594021 - RNA, 13 nt, Escherichia coli CFT073
acuggauacgcug

SEQ ID NO: 2594022 - RNA, 13 nt, Escherichia coli CFT073
acuggaugacgaa

SEQ ID NO: 2594023 - RNA, 17 nt, Escherichia coli CFT073
acuggcaaucgccagcg

SEQ ID NO: 2594024 - RNA, 19 nt, Escherichia coli CFT073
acuggcaaucgccagcggc

SEQ ID NO: 2594025 - RNA, 17 nt, Escherichia coli CFT073
acuggcacaagacugac

SEQ ID NO: 2594026 - RNA, 20 nt, Escherichia coli CFT073
acuggcaccccugcauaauu

SEQ ID NO: 2594027 - RNA, 17 nt, Escherichia coli CFT073
acuggcagggaaagaaa

SEQ ID NO: 2594028 - RNA, 15 nt, Escherichia coli CFT073
acuggccagcggcga

SEQ ID NO: 2594029 - RNA, 19 nt, Escherichia coli CFT073
acuggccuuuauuuuccag

SEQ ID NO: 2594030 - RNA, 19 nt, Escherichia coli CFT073
acuggcgacgccggauauc

SEQ ID NO: 2594031 - RNA, 15 nt, Escherichia coli CFT073
acuggcgacugccag

SEQ ID NO: 2594032 - RNA, 17 nt, Escherichia coli CFT073
acuggcgcagcaguucg

SEQ ID NO: 2594033 - RNA, 19 nt, Escherichia coli CFT073
acuggcgcgccuguugcgg

SEQ ID NO: 2594034 - RNA, 19 nt, Escherichia coli CFT073
acuggcgcuaacguuaauc

SEQ ID NO: 2594035 - RNA, 15 nt, Escherichia coli CFT073
acuggcggaugcggc

SEQ ID NO: 2594036 - RNA, 15 nt, Escherichia coli CFT073
acuggcguuaggcac

SEQ ID NO: 2594037 - RNA, 14 nt, Escherichia coli CFT073
acuggcucuuuuuc

SEQ ID NO: 2594038 - RNA, 18 nt, Escherichia coli CFT073
acuggcuuaauaauuccc

SEQ ID NO: 2594039 - RNA, 17 nt, Escherichia coli CFT073
acugggcuauggcaaca

SEQ ID NO: 2594040 - RNA, 12 nt, Escherichia coli CFT073
acuggggcugga

SEQ ID NO: 2594041 - RNA, 17 nt, Escherichia coli CFT073
acugguaacgauuucau

SEQ ID NO: 2594042 - RNA, 13 nt, Escherichia coli CFT073
acugguagggaua

SEQ ID NO: 2594043 - RNA, 14 nt, Escherichia coli CFT073
acuggugagcggug

SEQ ID NO: 2594044 - RNA, 23 nt, Escherichia coli CFT073
acuggugauccacgguucuccac

SEQ ID NO: 2594045 - RNA, 18 nt, Escherichia coli CFT073
acugguuauaugaauacg

SEQ ID NO: 2594046 - RNA, 15 nt, Escherichia coli CFT073
acugguuaucacgaa

SEQ ID NO: 2594047 - RNA, 14 nt, Escherichia coli CFT073
acugguucccagag

SEQ ID NO: 2594048 - RNA, 18 nt, Escherichia coli CFT073
acugguugaaauaaacca

SEQ ID NO: 2594049 - RNA, 22 nt, Escherichia coli CFT073
acugguuucagcaucccaggca

SEQ ID NO: 2594050 - RNA, 16 nt, Escherichia coli CFT073
acuguaagccaucacc

SEQ ID NO: 2594051 - RNA, 13 nt, Escherichia coli CFT073
acuguacaacaca

SEQ ID NO: 2594052 - RNA, 11 nt, Escherichia coli CFT073
acuguacaaua

SEQ ID NO: 2594053 - RNA, 15 nt, Escherichia coli CFT073
acuguacaauaucga

SEQ ID NO: 2594054 - RNA, 17 nt, Escherichia coli CFT073
acuguagcucgccuaca

SEQ ID NO: 2594055 - RNA, 14 nt, Escherichia coli CFT073
acuguaucccagcc

SEQ ID NO: 2594056 - RNA, 21 nt, Escherichia coli CFT073
acuguaucccagcccagcgga

SEQ ID NO: 2594057 - RNA, 13 nt, Escherichia coli CFT073
acugucaauaaac

SEQ ID NO: 2594058 - RNA, 17 nt, Escherichia coli CFT073
acugucaauaaacgccu

SEQ ID NO: 2594059 - RNA, 19 nt, Escherichia coli CFT073
acuguccacgacagaaccc

SEQ ID NO: 2594060 - RNA, 23 nt, Escherichia coli CFT073
acuguccacgacagaacccggcu

SEQ ID NO: 2594061 - RNA, 14 nt, Escherichia coli CFT073
acugucccauccac

SEQ ID NO: 2594062 - RNA, 12 nt, Escherichia coli CFT073
acuguccgccag

SEQ ID NO: 2594063 - RNA, 13 nt, Escherichia coli CFT073
acuguccgccaga

SEQ ID NO: 2594064 - RNA, 12 nt, Escherichia coli CFT073
acuguccugcgg

SEQ ID NO: 2594065 - RNA, 19 nt, Escherichia coli CFT073
acuguccugcggcguacca

SEQ ID NO: 2594066 - RNA, 20 nt, Escherichia coli CFT073
acuguccugcggcguaccaa

SEQ ID NO: 2594067 - RNA, 14 nt, Escherichia coli CFT073
acugucgcuauuca

SEQ ID NO: 2594068 - RNA, 17 nt, Escherichia coli CFT073
acugucguugugccuuc

SEQ ID NO: 2594069 - RNA, 20 nt, Escherichia coli CFT073
acugucguuuagacgcugcg

SEQ ID NO: 2594070 - RNA, 14 nt, Escherichia coli CFT073
acugucuaaugauu

SEQ ID NO: 2594071 - RNA, 14 nt, Escherichia coli CFT073
acugucuucaccau

SEQ ID NO: 2594072 - RNA, 20 nt, Escherichia coli CFT073
acugugaaguauuaauguca

SEQ ID NO: 2594073 - RNA, 19 nt, Escherichia coli CFT073
acugugaguggcuccaugu

SEQ ID NO: 2594074 - RNA, 14 nt, Escherichia coli CFT073
acugugccaaaucu

SEQ ID NO: 2594075 - RNA, 13 nt, Escherichia coli CFT073
acugugccagacg

SEQ ID NO: 2594076 - RNA, 19 nt, Escherichia coli CFT073
acuguucauuuuguaggcc

SEQ ID NO: 2594077 - RNA, 23 nt, Escherichia coli CFT073
acuguucgagguaauccagcguc

SEQ ID NO: 2594078 - RNA, 14 nt, Escherichia coli CFT073
acuguugagaggac

SEQ ID NO: 2594079 - RNA, 15 nt, Escherichia coli CFT073
acuguugucgagcaa

SEQ ID NO: 2594080 - RNA, 14 nt, Escherichia coli CFT073
acuguuuaagcgaa

SEQ ID NO: 2594081 - RNA, 21 nt, Escherichia coli CFT073
acuguuuauuguugauucgau

SEQ ID NO: 2594082 - RNA, 15 nt, Escherichia coli CFT073
acuguuucgcggcaa

SEQ ID NO: 2594083 - RNA, 18 nt, Escherichia coli CFT073
acuguuugaucugcugcc

SEQ ID NO: 2594084 - RNA, 15 nt, Escherichia coli CFT073
acuguuuuuccagcu

SEQ ID NO: 2594085 - RNA, 22 nt, Escherichia coli CFT073
acuuaaagccgcuuccgggcug

SEQ ID NO: 2594086 - RNA, 16 nt, Escherichia coli CFT073
acuuaacgucacagaa

SEQ ID NO: 2594087 - RNA, 23 nt, Escherichia coli CFT073
acuuaagcgccugauacagccaa

SEQ ID NO: 2594088 - RNA, 12 nt, Escherichia coli CFT073
acuuaagucucc

SEQ ID NO: 2594089 - RNA, 16 nt, Escherichia coli CFT073
acuuaagucuccauuu

SEQ ID NO: 2594090 - RNA, 12 nt, Escherichia coli CFT073
acuuaauaagca

SEQ ID NO: 2594091 - RNA, 17 nt, Escherichia coli CFT073
acuuaaugccaguucag

SEQ ID NO: 2594092 - RNA, 19 nt, Escherichia coli CFT073
acuuaaugguucugcacag

SEQ ID NO: 2594093 - RNA, 21 nt, Escherichia coli CFT073
acuuacgauuuuaauagcuua

SEQ ID NO: 2594094 - RNA, 17 nt, Escherichia coli CFT073
acuuacucauuaaugca

SEQ ID NO: 2594095 - RNA, 22 nt, Escherichia coli CFT073
acuuacuuagugcacuucuuca

SEQ ID NO: 2594096 - RNA, 13 nt, Escherichia coli CFT073
acuuacuuuccua

SEQ ID NO: 2594097 - RNA, 21 nt, Escherichia coli CFT073
acuuaguaggccugauaagcg

SEQ ID NO: 2594098 - RNA, 22 nt, Escherichia coli CFT073
acuuagugcacuucuucacauc

SEQ ID NO: 2594099 - RNA, 23 nt, Escherichia coli CFT073
acuuagugcacuucuucacauca

SEQ ID NO: 2594100 - RNA, 14 nt, Escherichia coli CFT073
acuugccuccagcg

SEQ ID NO: 2594101 - RNA, 14 nt, Escherichia coli CFT073
acuugccugugacc

SEQ ID NO: 2594102 - RNA, 14 nt, Escherichia coli CFT073
acuugcucaagcca

SEQ ID NO: 2594103 - RNA, 23 nt, Escherichia coli CFT073
acuugcucaaucuggcugaugaa

SEQ ID NO: 2594104 - RNA, 14 nt, Escherichia coli CFT073
acuugcugcucuga

SEQ ID NO: 2594105 - RNA, 14 nt, Escherichia coli CFT073
acuuggguaacagc

SEQ ID NO: 2594106 - RNA, 13 nt, Escherichia coli CFT073
acuugguuacgca

SEQ ID NO: 2594107 - RNA, 16 nt, Escherichia coli CFT073
acuugguuacgcaccg

SEQ ID NO: 2594108 - RNA, 20 nt, Escherichia coli CFT073
acuugguuugucggcgugaa

SEQ ID NO: 2594109 - RNA, 19 nt, Escherichia coli CFT073
acuuguaaaaucuucgcca

SEQ ID NO: 2594110 - RNA, 23 nt, Escherichia coli CFT073
acuuguaaaaucuucgccacuuu

SEQ ID NO: 2594111 - RNA, 21 nt, Escherichia coli CFT073
acuuguaaccuguaaaguaca

SEQ ID NO: 2594112 - RNA, 13 nt, Escherichia coli CFT073
acuuguucagcga

SEQ ID NO: 2594113 - RNA, 11 nt, Escherichia coli CFT073
acuuguuuaca

SEQ ID NO: 2594114 - RNA, 22 nt, Escherichia coli CFT073
acuuuaaaaaaauuaauuuuuu

SEQ ID NO: 2594115 - RNA, 14 nt, Escherichia coli CFT073
acuuuaaaauaagc

SEQ ID NO: 2594116 - RNA, 23 nt, Escherichia coli CFT073
acuuuaaaauaagcacaaagcaa

SEQ ID NO: 2594117 - RNA, 20 nt, Escherichia coli CFT073
acuuuaaaaucuuugaaaua

SEQ ID NO: 2594118 - RNA, 16 nt, Escherichia coli CFT073
acuuuaaucaccugcc

SEQ ID NO: 2594119 - RNA, 20 nt, Escherichia coli CFT073
acuuuaauuuugugcagcac

SEQ ID NO: 2594120 - RNA, 21 nt, Escherichia coli CFT073
acuuuaauuuugugcagcaca

SEQ ID NO: 2594121 - RNA, 20 nt, Escherichia coli CFT073
acuuuacccguguuuugcau

SEQ ID NO: 2594122 - RNA, 13 nt, Escherichia coli CFT073
acuuuaccgcaau

SEQ ID NO: 2594123 - RNA, 16 nt, Escherichia coli CFT073
acuuuaccgguuucaa

SEQ ID NO: 2594124 - RNA, 20 nt, Escherichia coli CFT073
acuuuacuaaaaagugauaa

SEQ ID NO: 2594125 - RNA, 21 nt, Escherichia coli CFT073
acuuuacuaaaaagugauaaa

SEQ ID NO: 2594126 - RNA, 17 nt, Escherichia coli CFT073
acuuuagcacaaucgca

SEQ ID NO: 2594127 - RNA, 18 nt, Escherichia coli CFT073
acuuuagcgaaaucuucc

SEQ ID NO: 2594128 - RNA, 16 nt, Escherichia coli CFT073
acuuuagucgcuugca

SEQ ID NO: 2594129 - RNA, 15 nt, Escherichia coli CFT073
acuuuauagaucagg

SEQ ID NO: 2594130 - RNA, 16 nt, Escherichia coli CFT073
acuuuaucugauuuaa

SEQ ID NO: 2594131 - RNA, 18 nt, Escherichia coli CFT073
acuuucaccgguguuccc

SEQ ID NO: 2594132 - RNA, 15 nt, Escherichia coli CFT073
acuuucacgccgcca

SEQ ID NO: 2594133 - RNA, 16 nt, Escherichia coli CFT073
acuuucacuucaguaa

SEQ ID NO: 2594134 - RNA, 13 nt, Escherichia coli CFT073
acuuucagaugca

SEQ ID NO: 2594135 - RNA, 22 nt, Escherichia coli CFT073
acuuucaguggcuuaucuuccu

SEQ ID NO: 2594136 - RNA, 11 nt, Escherichia coli CFT073
acuuucaucaa

SEQ ID NO: 2594137 - RNA, 20 nt, Escherichia coli CFT073
acuuucaugcucaagcugac

SEQ ID NO: 2594138 - RNA, 13 nt, Escherichia coli CFT073
acuuuccagccac

SEQ ID NO: 2594139 - RNA, 15 nt, Escherichia coli CFT073
acuuuccaucuuucc

SEQ ID NO: 2594140 - RNA, 16 nt, Escherichia coli CFT073
acuuuccaugccaucu

SEQ ID NO: 2594141 - RNA, 19 nt, Escherichia coli CFT073
acuuuccgguguaaccgca

SEQ ID NO: 2594142 - RNA, 14 nt, Escherichia coli CFT073
acuuucgacuucaa

SEQ ID NO: 2594143 - RNA, 20 nt, Escherichia coli CFT073
acuuucgccaguucuuccgc

SEQ ID NO: 2594144 - RNA, 16 nt, Escherichia coli CFT073
acuuucggauuacugc

SEQ ID NO: 2594145 - RNA, 20 nt, Escherichia coli CFT073
acuuucucucgaaaaaccug

SEQ ID NO: 2594146 - RNA, 16 nt, Escherichia coli CFT073
acuuucucuucaucua

SEQ ID NO: 2594147 - RNA, 13 nt, Escherichia coli CFT073
acuuucuugccac

SEQ ID NO: 2594148 - RNA, 15 nt, Escherichia coli CFT073
acuuugagaaacguu

SEQ ID NO: 2594149 - RNA, 20 nt, Escherichia coli CFT073
acuuugaucgcguuuuuugu

SEQ ID NO: 2594150 - RNA, 13 nt, Escherichia coli CFT073
acuuugcaaugag

SEQ ID NO: 2594151 - RNA, 18 nt, Escherichia coli CFT073
acuuugcaaugagaucgg

SEQ ID NO: 2594152 - RNA, 24 nt, Escherichia coli CFT073
acuuugccgugaacaauuucagca

SEQ ID NO: 2594153 - RNA, 18 nt, Escherichia coli CFT073
acuuugcuuucagauuca

SEQ ID NO: 2594154 - RNA, 15 nt, Escherichia coli CFT073
acuuuguaccagcgg

SEQ ID NO: 2594155 - RNA, 12 nt, Escherichia coli CFT073
acuuuguaggcc

SEQ ID NO: 2594156 - RNA, 21 nt, Escherichia coli CFT073
acuuuguaggccugauaagac

SEQ ID NO: 2594157 - RNA, 16 nt, Escherichia coli CFT073
acuuugucaucaguca

SEQ ID NO: 2594158 - RNA, 17 nt, Escherichia coli CFT073
acuuugucaucagucag

SEQ ID NO: 2594159 - RNA, 18 nt, Escherichia coli CFT073
acuuuguuccugaauuaa

SEQ ID NO: 2594160 - RNA, 22 nt, Escherichia coli CFT073
acuuuuaguaaacaauugcaua

SEQ ID NO: 2594161 - RNA, 19 nt, Escherichia coli CFT073
acuuuugagccaaaaugcu

SEQ ID NO: 2594162 - RNA, 20 nt, Escherichia coli CFT073
acuuuugagccaaaaugcuu

SEQ ID NO: 2594163 - RNA, 14 nt, Escherichia coli CFT073
acuuuugccagacg

SEQ ID NO: 2594164 - RNA, 11 nt, Escherichia coli CFT073
acuuuugcccu

SEQ ID NO: 2594165 - RNA, 16 nt, Escherichia coli CFT073
acuuuuggaccacgga

SEQ ID NO: 2594166 - RNA, 14 nt, Escherichia coli CFT073
acuuuuguauuuua

SEQ ID NO: 2594167 - RNA, 15 nt, Escherichia coli CFT073
acuuuuuaacuuuaa

SEQ ID NO: 2594168 - RNA, 22 nt, Escherichia coli CFT073
acuuuuuccaguccacguucaa

SEQ ID NO: 2594169 - RNA, 17 nt, Escherichia coli CFT073
acuuuuuucauccagcu

SEQ ID NO: 2594170 - RNA, 16 nt, Escherichia coli CFT073
agaaaaacggaaagca

SEQ ID NO: 2594171 - RNA, 22 nt, Escherichia coli CFT073
agaaaaauaaaaacggcgcuaa

SEQ ID NO: 2594172 - RNA, 23 nt, Escherichia coli CFT073
agaaaacgaaagcgccaucaaug

SEQ ID NO: 2594173 - RNA, 14 nt, Escherichia coli CFT073
agaaaacgccugcu

SEQ ID NO: 2594174 - RNA, 20 nt, Escherichia coli CFT073
agaaaacgguugauauacca

SEQ ID NO: 2594175 - RNA, 22 nt, Escherichia coli CFT073
agaaaagaccagccagcaaugu

SEQ ID NO: 2594176 - RNA, 17 nt, Escherichia coli CFT073
agaaaagaguauuacau

SEQ ID NO: 2594177 - RNA, 13 nt, Escherichia coli CFT073
agaaaagauaagu

SEQ ID NO: 2594178 - RNA, 16 nt, Escherichia coli CFT073
agaaaagccaaccugc

SEQ ID NO: 2594179 - RNA, 11 nt, Escherichia coli CFT073
agaaaaggagu

SEQ ID NO: 2594180 - RNA, 21 nt, Escherichia coli CFT073
agaaaaggaguuuuuccuuuc

SEQ ID NO: 2594181 - RNA, 11 nt, Escherichia coli CFT073
agaaaaucaca

SEQ ID NO: 2594182 - RNA, 17 nt, Escherichia coli CFT073
agaaaauccagcagaau

SEQ ID NO: 2594183 - RNA, 16 nt, Escherichia coli CFT073
agaaaauccaucccaa

SEQ ID NO: 2594184 - RNA, 14 nt, Escherichia coli CFT073
agaaaauccgccaa

SEQ ID NO: 2594185 - RNA, 19 nt, Escherichia coli CFT073
agaaaaucguuggucugca

SEQ ID NO: 2594186 - RNA, 17 nt, Escherichia coli CFT073
agaaaauuauuuuaaau

SEQ ID NO: 2594187 - RNA, 14 nt, Escherichia coli CFT073
agaaacaaaugaaa

SEQ ID NO: 2594188 - RNA, 17 nt, Escherichia coli CFT073
agaaacauccccagcgu

SEQ ID NO: 2594189 - RNA, 19 nt, Escherichia coli CFT073
agaaacaucggcaguaaug

SEQ ID NO: 2594190 - RNA, 12 nt, Escherichia coli CFT073
agaaaccacauc

SEQ ID NO: 2594191 - RNA, 15 nt, Escherichia coli CFT073
agaaaccccggcaca

SEQ ID NO: 2594192 - RNA, 16 nt, Escherichia coli CFT073
agaaacccgcaaagag

SEQ ID NO: 2594193 - RNA, 15 nt, Escherichia coli CFT073
agaaacgccagcagc

SEQ ID NO: 2594194 - RNA, 13 nt, Escherichia coli CFT073
agaaacgccugau

SEQ ID NO: 2594195 - RNA, 24 nt, Escherichia coli CFT073
agaaacgccugaucgagcaguaau

SEQ ID NO: 2594196 - RNA, 17 nt, Escherichia coli CFT073
agaaacgcucauaaauu

SEQ ID NO: 2594197 - RNA, 20 nt, Escherichia coli CFT073
agaaacgcuccaccaccgcg

SEQ ID NO: 2594198 - RNA, 17 nt, Escherichia coli CFT073
agaaacuccgguuauua

SEQ ID NO: 2594199 - RNA, 23 nt, Escherichia coli CFT073
agaaacucuauccacauuaguca

SEQ ID NO: 2594200 - RNA, 16 nt, Escherichia coli CFT073
agaaacugaucauuau

SEQ ID NO: 2594201 - RNA, 18 nt, Escherichia coli CFT073
agaaagccggaugaucau

SEQ ID NO: 2594202 - RNA, 22 nt, Escherichia coli CFT073
agaaaggcgggaauaauuuccc

SEQ ID NO: 2594203 - RNA, 15 nt, Escherichia coli CFT073
agaaagggaagaaca

SEQ ID NO: 2594204 - RNA, 16 nt, Escherichia coli CFT073
agaaaguaaucuauau

SEQ ID NO: 2594205 - RNA, 20 nt, Escherichia coli CFT073
agaaagucgcggaauaucca

SEQ ID NO: 2594206 - RNA, 19 nt, Escherichia coli CFT073
agaaagucguaggccugau

SEQ ID NO: 2594207 - RNA, 19 nt, Escherichia coli CFT073
agaaaguugccagauaaau

SEQ ID NO: 2594208 - RNA, 20 nt, Escherichia coli CFT073
agaaaguugccagauaaaua

SEQ ID NO: 2594209 - RNA, 16 nt, Escherichia coli CFT073
agaaguugugaaacga

SEQ ID NO: 2594210 - RNA, 15 nt, Escherichia coli CFT073
agaauaaagcuuuaa

SEQ ID NO: 2594211 - RNA, 18 nt, Escherichia coli CFT073
agaauaagcuauaaaaaa

SEQ ID NO: 2594212 - RNA, 17 nt, Escherichia coli CFT073
agaauaaugaucccuuc

SEQ ID NO: 2594213 - RNA, 15 nt, Escherichia coli CFT073
agaauacccagcaau

SEQ ID NO: 2594214 - RNA, 22 nt, Escherichia coli CFT073
agaauacccagcaaugccaggc

SEQ ID NO: 2594215 - RNA, 14 nt, Escherichia coli CFT073
agaauacgccccag

SEQ ID NO: 2594216 - RNA, 17 nt, Escherichia coli CFT073
agaauacuucacaugau

SEQ ID NO: 2594217 - RNA, 19 nt, Escherichia coli CFT073
agaauagcggcuucaucuu

SEQ ID NO: 2594218 - RNA, 23 nt, Escherichia coli CFT073
agaauauacggaaugauauuggu

SEQ ID NO: 2594219 - RNA, 13 nt, Escherichia coli CFT073
agaauauaggcac

SEQ ID NO: 2594220 - RNA, 19 nt, Escherichia coli CFT073
agaauaucgccaaggauau

SEQ ID NO: 2594221 - RNA, 22 nt, Escherichia coli CFT073
agaauaucugcggccuccaaca

SEQ ID NO: 2594222 - RNA, 14 nt, Escherichia coli CFT073
agaauauugccauu

SEQ ID NO: 2594223 - RNA, 15 nt, Escherichia coli CFT073
agaauauugugcuca

SEQ ID NO: 2594224 - RNA, 20 nt, Escherichia coli CFT073
agaauauuuuucaguaacgg

SEQ ID NO: 2594225 - RNA, 23 nt, Escherichia coli CFT073
agaauauuuuucaguaacggcgc

SEQ ID NO: 2594226 - RNA, 13 nt, Escherichia coli CFT073
agaaucaacacac

SEQ ID NO: 2594227 - RNA, 20 nt, Escherichia coli CFT073
agaaucaacgaugucaauca

SEQ ID NO: 2594228 - RNA, 16 nt, Escherichia coli CFT073
agaaucaaucucagcg

SEQ ID NO: 2594229 - RNA, 17 nt, Escherichia coli CFT073
agaaucacuucaucgcc

SEQ ID NO: 2594230 - RNA, 17 nt, Escherichia coli CFT073
agaaucaugccaaaaau

SEQ ID NO: 2594231 - RNA, 19 nt, Escherichia coli CFT073
agaauccccacugcauggc

SEQ ID NO: 2594232 - RNA, 18 nt, Escherichia coli CFT073
agaauccccggcaggaag

SEQ ID NO: 2594233 - RNA, 20 nt, Escherichia coli CFT073
agaauccguacgcuuuucca

SEQ ID NO: 2594234 - RNA, 17 nt, Escherichia coli CFT073
agaaucgggauauugcc

SEQ ID NO: 2594235 - RNA, 19 nt, Escherichia coli CFT073
agaaucgggauauugcccu

SEQ ID NO: 2594236 - RNA, 18 nt, Escherichia coli CFT073
agaaucugccgcaguacg

SEQ ID NO: 2594237 - RNA, 19 nt, Escherichia coli CFT073
agaaucuucuucucagcca

SEQ ID NO: 2594238 - RNA, 19 nt, Escherichia coli CFT073
agaaugaaauucgagagaa

SEQ ID NO: 2594239 - RNA, 14 nt, Escherichia coli CFT073
agaaugaaguaaac

SEQ ID NO: 2594240 - RNA, 20 nt, Escherichia coli CFT073
agaaugaaugauacagaaag

SEQ ID NO: 2594241 - RNA, 22 nt, Escherichia coli CFT073
agaaugaaugauacagaaagua

SEQ ID NO: 2594242 - RNA, 16 nt, Escherichia coli CFT073
agaaugacgccguuaa

SEQ ID NO: 2594243 - RNA, 19 nt, Escherichia coli CFT073
agaaugacgccguuaacag

SEQ ID NO: 2594244 - RNA, 21 nt, Escherichia coli CFT073
agaaugauauugauaauaaaa

SEQ ID NO: 2594245 - RNA, 17 nt, Escherichia coli CFT073
agaaugcagcagcaaac

SEQ ID NO: 2594246 - RNA, 17 nt, Escherichia coli CFT073
agaaugcagucaguacg

SEQ ID NO: 2594247 - RNA, 11 nt, Escherichia coli CFT073
agaaugccagc

SEQ ID NO: 2594248 - RNA, 12 nt, Escherichia coli CFT073
agaaugccagca

SEQ ID NO: 2594249 - RNA, 19 nt, Escherichia coli CFT073
agaaugcgcaacaccguaa

SEQ ID NO: 2594250 - RNA, 16 nt, Escherichia coli CFT073
agaaugcgcucaauau

SEQ ID NO: 2594251 - RNA, 20 nt, Escherichia coli CFT073
agaaugcuccccagaccaau

SEQ ID NO: 2594252 - RNA, 17 nt, Escherichia coli CFT073
agaaugcucgcuggcag

SEQ ID NO: 2594253 - RNA, 15 nt, Escherichia coli CFT073
agaauggcuguaggg

SEQ ID NO: 2594254 - RNA, 19 nt, Escherichia coli CFT073
agaaugguaacaccagagu

SEQ ID NO: 2594255 - RNA, 21 nt, Escherichia coli CFT073
agaaugguuucauuccaguaa

SEQ ID NO: 2594256 - RNA, 19 nt, Escherichia coli CFT073
agaauguagauauuaaagc

SEQ ID NO: 2594257 - RNA, 17 nt, Escherichia coli CFT073
agaauuaaccagaaaua

SEQ ID NO: 2594258 - RNA, 14 nt, Escherichia coli CFT073
agaauuaauugcua

SEQ ID NO: 2594259 - RNA, 13 nt, Escherichia coli CFT073
agaauuaucauuu

SEQ ID NO: 2594260 - RNA, 16 nt, Escherichia coli CFT073
agaauuaucauuuuua

SEQ ID NO: 2594261 - RNA, 20 nt, Escherichia coli CFT073
agaauuauuagcaacgauau

SEQ ID NO: 2594262 - RNA, 17 nt, Escherichia coli CFT073
agaauucuauuuugcca

SEQ ID NO: 2594263 - RNA, 21 nt, Escherichia coli CFT073
agaauugcagauaccacauca

SEQ ID NO: 2594264 - RNA, 12 nt, Escherichia coli CFT073
agaauuugcucu

SEQ ID NO: 2594265 - RNA, 17 nt, Escherichia coli CFT073
agaauuuucccuuuuag

SEQ ID NO: 2594266 - RNA, 13 nt, Escherichia coli CFT073
agacaaacagggu

SEQ ID NO: 2594267 - RNA, 21 nt, Escherichia coli CFT073
agacaacaugagaacaguuca

SEQ ID NO: 2594268 - RNA, 19 nt, Escherichia coli CFT073
agacaacauugauuucuua

SEQ ID NO: 2594269 - RNA, 13 nt, Escherichia coli CFT073
agacaauacuugc

SEQ ID NO: 2594270 - RNA, 17 nt, Escherichia coli CFT073
agacaauccccgccagc

SEQ ID NO: 2594271 - RNA, 23 nt, Escherichia coli CFT073
agacaauccccgccagcguugcc

SEQ ID NO: 2594272 - RNA, 16 nt, Escherichia coli CFT073
agacaauguaucuuuc

SEQ ID NO: 2594273 - RNA, 13 nt, Escherichia coli CFT073
agacaauuaacac

SEQ ID NO: 2594274 - RNA, 22 nt, Escherichia coli CFT073
agacaauuacucgccuuucaca

SEQ ID NO: 2594275 - RNA, 20 nt, Escherichia coli CFT073
agacacacugucaaucgcac

SEQ ID NO: 2594276 - RNA, 13 nt, Escherichia coli CFT073
agacaccagcguc

SEQ ID NO: 2594277 - RNA, 15 nt, Escherichia coli CFT073
agacaccggcuuuca

SEQ ID NO: 2594278 - RNA, 16 nt, Escherichia coli CFT073
agacaccggcuuucac

SEQ ID NO: 2594279 - RNA, 21 nt, Escherichia coli CFT073
agacaccguuuccauaucgcu

SEQ ID NO: 2594280 - RNA, 12 nt, Escherichia coli CFT073
agacacgccagu

SEQ ID NO: 2594281 - RNA, 20 nt, Escherichia coli CFT073
agacacgccagugucgcauc

SEQ ID NO: 2594282 - RNA, 17 nt, Escherichia coli CFT073
agacacugcgaucgccc

SEQ ID NO: 2594283 - RNA, 18 nt, Escherichia coli CFT073
agacagaaacaaaugaaa

SEQ ID NO: 2594284 - RNA, 14 nt, Escherichia coli CFT073
agacagauuuauaa

SEQ ID NO: 2594285 - RNA, 15 nt, Escherichia coli CFT073
agacagccuaccaga

SEQ ID NO: 2594286 - RNA, 16 nt, Escherichia coli CFT073
agacagccuaccagac

SEQ ID NO: 2594287 - RNA, 13 nt, Escherichia coli CFT073
agacagccucaag

SEQ ID NO: 2594288 - RNA, 14 nt, Escherichia coli CFT073
agacagcgccaggc

SEQ ID NO: 2594289 - RNA, 21 nt, Escherichia coli CFT073
agacaguugauggaaaauugu

SEQ ID NO: 2594290 - RNA, 15 nt, Escherichia coli CFT073
agacauagcacauaa

SEQ ID NO: 2594291 - RNA, 19 nt, Escherichia coli CFT073
agacaucacucacgacaca

SEQ ID NO: 2594292 - RNA, 14 nt, Escherichia coli CFT073
agacaucgcaggga

SEQ ID NO: 2594293 - RNA, 20 nt, Escherichia coli CFT073
agacauuggcaaaaccaaac

SEQ ID NO: 2594294 - RNA, 22 nt, Escherichia coli CFT073
agaccaaaacgugcagcugccu

SEQ ID NO: 2594295 - RNA, 15 nt, Escherichia coli CFT073
agaccaaaccaucac

SEQ ID NO: 2594296 - RNA, 21 nt, Escherichia coli CFT073
agaccaaacucuucgacaauc

SEQ ID NO: 2594297 - RNA, 13 nt, Escherichia coli CFT073
agaccaauagaaa

SEQ ID NO: 2594298 - RNA, 23 nt, Escherichia coli CFT073
agaccaauccagccggcaaagug

SEQ ID NO: 2594299 - RNA, 23 nt, Escherichia coli CFT073
agaccaaucccgccauaacggcu

SEQ ID NO: 2594300 - RNA, 18 nt, Escherichia coli CFT073
agaccaauccgccagcca

SEQ ID NO: 2594301 - RNA, 13 nt, Escherichia coli CFT073
agaccaauugccg

SEQ ID NO: 2594302 - RNA, 19 nt, Escherichia coli CFT073
agaccacaaucaacgccac

SEQ ID NO: 2594303 - RNA, 16 nt, Escherichia coli CFT073
agaccacauuccaggc

SEQ ID NO: 2594304 - RNA, 20 nt, Escherichia coli CFT073
agaccacccaagcgggaaua

SEQ ID NO: 2594305 - RNA, 17 nt, Escherichia coli CFT073
agaccacucauuuuuuc

SEQ ID NO: 2594306 - RNA, 16 nt, Escherichia coli CFT073
agaccagaaacgccac

SEQ ID NO: 2594307 - RNA, 19 nt, Escherichia coli CFT073
agaccagcaaagugcgcuu

SEQ ID NO: 2594308 - RNA, 19 nt, Escherichia coli CFT073
agaccagcaauaaaaaacc

SEQ ID NO: 2594309 - RNA, 16 nt, Escherichia coli CFT073
agaccagccagcaaug

SEQ ID NO: 2594310 - RNA, 18 nt, Escherichia coli CFT073
agaccagccagcaaugua

SEQ ID NO: 2594311 - RNA, 17 nt, Escherichia coli CFT073
agaccagcgaaaccuga

SEQ ID NO: 2594312 - RNA, 14 nt, Escherichia coli CFT073
agaccaucgucagu

SEQ ID NO: 2594313 - RNA, 21 nt, Escherichia coli CFT073
agaccauuugaucgcuggcag

SEQ ID NO: 2594314 - RNA, 14 nt, Escherichia coli CFT073
agacccagcuucag

SEQ ID NO: 2594315 - RNA, 15 nt, Escherichia coli CFT073
agaccccaguuuuua

SEQ ID NO: 2594316 - RNA, 12 nt, Escherichia coli CFT073
agacccggccau

SEQ ID NO: 2594317 - RNA, 12 nt, Escherichia coli CFT073
agagaacugcug

SEQ ID NO: 2594318 - RNA, 14 nt, Escherichia coli CFT073
agagaagaaagaag

SEQ ID NO: 2594319 - RNA, 21 nt, Escherichia coli CFT073
agagaauauuaacggucauuc

SEQ ID NO: 2594320 - RNA, 17 nt, Escherichia coli CFT073
agagaauuaaccagaaa

SEQ ID NO: 2594321 - RNA, 19 nt, Escherichia coli CFT073
agagacauuggcaaaacca

SEQ ID NO: 2594322 - RNA, 12 nt, Escherichia coli CFT073
agagacuaacau

SEQ ID NO: 2594323 - RNA, 17 nt, Escherichia coli CFT073
agagacuaacauccgaa

SEQ ID NO: 2594324 - RNA, 23 nt, Escherichia coli CFT073
agagacuauuucuucaucgguau

SEQ ID NO: 2594325 - RNA, 14 nt, Escherichia coli CFT073
agagagaagccagg

SEQ ID NO: 2594326 - RNA, 23 nt, Escherichia coli CFT073
agagagauccagcuucgccagcg

SEQ ID NO: 2594327 - RNA, 17 nt, Escherichia coli CFT073
agagagauguugcugcu

SEQ ID NO: 2594328 - RNA, 15 nt, Escherichia coli CFT073
agagagcaacagcag

SEQ ID NO: 2594329 - RNA, 15 nt, Escherichia coli CFT073
agagaggauaugcau

SEQ ID NO: 2594330 - RNA, 16 nt, Escherichia coli CFT073
agagauaaacgaccac

SEQ ID NO: 2594331 - RNA, 15 nt, Escherichia coli CFT073
agagauaacccaacg

SEQ ID NO: 2594332 - RNA, 22 nt, Escherichia coli CFT073
agagauaacuggcaaaaacaag

SEQ ID NO: 2594333 - RNA, 15 nt, Escherichia coli CFT073
agagauaauucagca

SEQ ID NO: 2594334 - RNA, 13 nt, Escherichia coli CFT073
agagaucaaagug

SEQ ID NO: 2594335 - RNA, 15 nt, Escherichia coli CFT073
agagaucaccuugca

SEQ ID NO: 2594336 - RNA, 16 nt, Escherichia coli CFT073
agagaucaccuugcag

SEQ ID NO: 2594337 - RNA, 16 nt, Escherichia coli CFT073
agagaucauacagaug

SEQ ID NO: 2594338 - RNA, 20 nt, Escherichia coli CFT073
agagauccacuacgcuguag

SEQ ID NO: 2594339 - RNA, 13 nt, Escherichia coli CFT073
agagaucgccgcu

SEQ ID NO: 2594340 - RNA, 19 nt, Escherichia coli CFT073
agagauguaaagugaaaua

SEQ ID NO: 2594341 - RNA, 15 nt, Escherichia coli CFT073
agagauguugaagaa

SEQ ID NO: 2594342 - RNA, 14 nt, Escherichia coli CFT073
agagauguugcugc

SEQ ID NO: 2594343 - RNA, 20 nt, Escherichia coli CFT073
agagcaaaaaucgacagcag

SEQ ID NO: 2594344 - RNA, 22 nt, Escherichia coli CFT073
agagcaaaaaucgacagcagga

SEQ ID NO: 2594345 - RNA, 14 nt, Escherichia coli CFT073
agagcaaacaccgc

SEQ ID NO: 2594346 - RNA, 12 nt, Escherichia coli CFT073
agagcaaauaaa

SEQ ID NO: 2594347 - RNA, 13 nt, Escherichia coli CFT073
agagcaaauaaaa

SEQ ID NO: 2594348 - RNA, 15 nt, Escherichia coli CFT073
agagcaaauaaaaca

SEQ ID NO: 2594349 - RNA, 19 nt, Escherichia coli CFT073
agagcaaauaaaacaucac

SEQ ID NO: 2594350 - RNA, 16 nt, Escherichia coli CFT073
agagcaaccagcaaug

SEQ ID NO: 2594351 - RNA, 18 nt, Escherichia coli CFT073
agagcaaccagcaaugcc

SEQ ID NO: 2594352 - RNA, 20 nt, Escherichia coli CFT073
agagcaaccagcaaugccag

SEQ ID NO: 2594353 - RNA, 21 nt, Escherichia coli CFT073
agagcacgaccuugccaaggu

SEQ ID NO: 2594354 - RNA, 15 nt, Escherichia coli CFT073
agagccagagacacu

SEQ ID NO: 2594355 - RNA, 19 nt, Escherichia coli CFT073
agagccccagccgcaaacg

SEQ ID NO: 2594356 - RNA, 21 nt, Escherichia coli CFT073
agagccugaauaaacgccaua

SEQ ID NO: 2594357 - RNA, 15 nt, Escherichia coli CFT073
agagcgaauaucauu

SEQ ID NO: 2594358 - RNA, 13 nt, Escherichia coli CFT073
agagcgacauaca

SEQ ID NO: 2594359 - RNA, 14 nt, Escherichia coli CFT073
agagcgcugcgcag

SEQ ID NO: 2594360 - RNA, 18 nt, Escherichia coli CFT073
agagcgcugcgcaggcaa

SEQ ID NO: 2594361 - RNA, 15 nt, Escherichia coli CFT073
agagcggagcaauga

SEQ ID NO: 2594362 - RNA, 19 nt, Escherichia coli CFT073
agagcgggcagacaaaaca

SEQ ID NO: 2594363 - RNA, 22 nt, Escherichia coli CFT073
agagcuaugaauagucgccagc

SEQ ID NO: 2594364 - RNA, 23 nt, Escherichia coli CFT073
agagcugaaaauugcgcucgcgc

SEQ ID NO: 2594365 - RNA, 17 nt, Escherichia coli CFT073
agagcugaagcauggug

SEQ ID NO: 2594366 - RNA, 14 nt, Escherichia coli CFT073
agagcugauuuccg

SEQ ID NO: 2594367 - RNA, 20 nt, Escherichia coli CFT073
agagcuggaaguuacucaaa

SEQ ID NO: 2594368 - RNA, 16 nt, Escherichia coli CFT073
agagcuggcagccccg

SEQ ID NO: 2594369 - RNA, 16 nt, Escherichia coli CFT073
agagcuguagauauau

SEQ ID NO: 2594370 - RNA, 17 nt, Escherichia coli CFT073
agagcuguagauauauc

SEQ ID NO: 2594371 - RNA, 23 nt, Escherichia coli CFT073
agagcuuuucagccugaagauca

SEQ ID NO: 2594372 - RNA, 15 nt, Escherichia coli CFT073
agaggaauuuaucag

SEQ ID NO: 2594373 - RNA, 23 nt, Escherichia coli CFT073
agaggauauucugcggcuucagc

SEQ ID NO: 2594374 - RNA, 14 nt, Escherichia coli CFT073
agaggccgccgcaa

SEQ ID NO: 2594375 - RNA, 13 nt, Escherichia coli CFT073
agaggcgagggga

SEQ ID NO: 2594376 - RNA, 18 nt, Escherichia coli CFT073
agaggcgauaucuuccgu

SEQ ID NO: 2594377 - RNA, 16 nt, Escherichia coli CFT073
agaggcgcgcggguga

SEQ ID NO: 2594378 - RNA, 22 nt, Escherichia coli CFT073
agaggcguuuuuaucgcugcgc

SEQ ID NO: 2594379 - RNA, 23 nt, Escherichia coli CFT073
agaggcugaaggcgcuccccugc

SEQ ID NO: 2594380 - RNA, 14 nt, Escherichia coli CFT073
agagguaauuuggc

SEQ ID NO: 2594381 - RNA, 14 nt, Escherichia coli CFT073
agaggucuuuucuc

SEQ ID NO: 2594382 - RNA, 15 nt, Escherichia coli CFT073
agaggugauaugaau

SEQ ID NO: 2594383 - RNA, 17 nt, Escherichia coli CFT073
agaggugauaugaauga

SEQ ID NO: 2594384 - RNA, 14 nt, Escherichia coli CFT073
agagguuuucaacu

SEQ ID NO: 2594385 - RNA, 20 nt, Escherichia coli CFT073
agaguaaugguuuguuuggc

SEQ ID NO: 2594386 - RNA, 20 nt, Escherichia coli CFT073
agaguacguucacuuuucuu

SEQ ID NO: 2594387 - RNA, 13 nt, Escherichia coli CFT073
agaguauaaaaaa

SEQ ID NO: 2594388 - RNA, 13 nt, Escherichia coli CFT073
agaguaucgccau

SEQ ID NO: 2594389 - RNA, 18 nt, Escherichia coli CFT073
agagucagcaaugccaga

SEQ ID NO: 2594390 - RNA, 14 nt, Escherichia coli CFT073
agagucauuaugcu

SEQ ID NO: 2594391 - RNA, 13 nt, Escherichia coli CFT073
agagugccaggcc

SEQ ID NO: 2594392 - RNA, 11 nt, Escherichia coli CFT073
agagugcccac

SEQ ID NO: 2594393 - RNA, 13 nt, Escherichia coli CFT073
agagugcgcagca

SEQ ID NO: 2594394 - RNA, 17 nt, Escherichia coli CFT073
agagugcgccagucaca

SEQ ID NO: 2594395 - RNA, 18 nt, Escherichia coli CFT073
agaguggauuaucuucac

SEQ ID NO: 2594396 - RNA, 19 nt, Escherichia coli CFT073
agagugugaauauucagaa

SEQ ID NO: 2594397 - RNA, 14 nt, Escherichia coli CFT073
agaguuacuggcga

SEQ ID NO: 2594398 - RNA, 18 nt, Escherichia coli CFT073
agaguugaaaaucucacg

SEQ ID NO: 2594399 - RNA, 21 nt, Escherichia coli CFT073
agaguugaaaaucucacgcag

SEQ ID NO: 2594400 - RNA, 23 nt, Escherichia coli CFT073
agaguugagcaguccccacauca

SEQ ID NO: 2594401 - RNA, 15 nt, Escherichia coli CFT073
agaguugauuuuguu

SEQ ID NO: 2594402 - RNA, 15 nt, Escherichia coli CFT073
agaguuguaccaccc

SEQ ID NO: 2594403 - RNA, 16 nt, Escherichia coli CFT073
agaguuuccaggcugg

SEQ ID NO: 2594404 - RNA, 20 nt, Escherichia coli CFT073
agaguuugaacucacagggc

SEQ ID NO: 2594405 - RNA, 16 nt, Escherichia coli CFT073
agaguuuuaaacgcag

SEQ ID NO: 2594406 - RNA, 22 nt, Escherichia coli CFT073
agauaaaauaaccgucuuugcu

SEQ ID NO: 2594407 - RNA, 14 nt, Escherichia coli CFT073
agauaaaaugcgaa

SEQ ID NO: 2594408 - RNA, 15 nt, Escherichia coli CFT073
agauaaaaugcgaaa

SEQ ID NO: 2594409 - RNA, 12 nt, Escherichia coli CFT073
agauaaacaacc

SEQ ID NO: 2594410 - RNA, 17 nt, Escherichia coli CFT073
agauaaacgaccacucu

SEQ ID NO: 2594411 - RNA, 19 nt, Escherichia coli CFT073
agauaaacgauuuuuacuc

SEQ ID NO: 2594412 - RNA, 13 nt, Escherichia coli CFT073
agauaaccagagc

SEQ ID NO: 2594413 - RNA, 14 nt, Escherichia coli CFT073
agauaacccagcag

SEQ ID NO: 2594414 - RNA, 19 nt, Escherichia coli CFT073
agauaaccuguuuauuaug

SEQ ID NO: 2594415 - RNA, 23 nt, Escherichia coli CFT073
agauaacgagcaugauacucagc

SEQ ID NO: 2594416 - RNA, 21 nt, Escherichia coli CFT073
agauaacgccuggcaguggug

SEQ ID NO: 2594417 - RNA, 16 nt, Escherichia coli CFT073
agauaacguaaugucu

SEQ ID NO: 2594418 - RNA, 20 nt, Escherichia coli CFT073
agauaacguugaugcaggca

SEQ ID NO: 2594419 - RNA, 20 nt, Escherichia coli CFT073
agauaacuggcaaaaacaag

SEQ ID NO: 2594420 - RNA, 21 nt, Escherichia coli CFT073
agauaacuggcaaaaacaagg

SEQ ID NO: 2594421 - RNA, 22 nt, Escherichia coli CFT073
agauaacuuaguuaaucaguuu

SEQ ID NO: 2594422 - RNA, 14 nt, Escherichia coli CFT073
agauaagaauaaua

SEQ ID NO: 2594423 - RNA, 15 nt, Escherichia coli CFT073
agauaagaccaaucc

SEQ ID NO: 2594424 - RNA, 21 nt, Escherichia coli CFT073
agauaagacgcgucagugucu

SEQ ID NO: 2594425 - RNA, 15 nt, Escherichia coli CFT073
agauaagcaacaaac

SEQ ID NO: 2594426 - RNA, 23 nt, Escherichia coli CFT073
agaugacucgccgcaaaacccag

SEQ ID NO: 2594427 - RNA, 13 nt, Escherichia coli CFT073
agaugauaacccc

SEQ ID NO: 2594428 - RNA, 21 nt, Escherichia coli CFT073
agaugaucaacgaccagaaag

SEQ ID NO: 2594429 - RNA, 22 nt, Escherichia coli CFT073
agaugaucaacgaccagaaaga

SEQ ID NO: 2594430 - RNA, 18 nt, Escherichia coli CFT073
agaugcacaagcggcagu

SEQ ID NO: 2594431 - RNA, 16 nt, Escherichia coli CFT073
agaugcagcauagaag

SEQ ID NO: 2594432 - RNA, 16 nt, Escherichia coli CFT073
agaugcaggaguagaa

SEQ ID NO: 2594433 - RNA, 15 nt, Escherichia coli CFT073
agaugcauuaccgga

SEQ ID NO: 2594434 - RNA, 17 nt, Escherichia coli CFT073
agaugccgcuauccgcu

SEQ ID NO: 2594435 - RNA, 16 nt, Escherichia coli CFT073
agaugcgacggcacca

SEQ ID NO: 2594436 - RNA, 19 nt, Escherichia coli CFT073
agaugcgacggcaccacau

SEQ ID NO: 2594437 - RNA, 22 nt, Escherichia coli CFT073
agaugcgacguuacaaccacau

SEQ ID NO: 2594438 - RNA, 20 nt, Escherichia coli CFT073
agaugcgccagcaucgcauc

SEQ ID NO: 2594439 - RNA, 23 nt, Escherichia coli CFT073
agaugcgcguaguacuuuaacuc

SEQ ID NO: 2594440 - RNA, 20 nt, Escherichia coli CFT073
agaugcggcgugaacgccuu

SEQ ID NO: 2594441 - RNA, 15 nt, Escherichia coli CFT073
agaugcucuucaaaa

SEQ ID NO: 2594442 - RNA, 18 nt, Escherichia coli CFT073
agaugcugugccuccugc

SEQ ID NO: 2594443 - RNA, 19 nt, Escherichia coli CFT073
agaugcugugccuccugcg

SEQ ID NO: 2594444 - RNA, 22 nt, Escherichia coli CFT073
agauggcagccaucauuuuuac

SEQ ID NO: 2594445 - RNA, 14 nt, Escherichia coli CFT073
agauggcggaaaua

SEQ ID NO: 2594446 - RNA, 12 nt, Escherichia coli CFT073
agauggcggcuu

SEQ ID NO: 2594447 - RNA, 18 nt, Escherichia coli CFT073
agauggcuucaucccggu

SEQ ID NO: 2594448 - RNA, 17 nt, Escherichia coli CFT073
agauggcuuugcccuuu

SEQ ID NO: 2594449 - RNA, 20 nt, Escherichia coli CFT073
agauggcuuugcccuuucug

SEQ ID NO: 2594450 - RNA, 21 nt, Escherichia coli CFT073
agaugguaaagcaccugauua

SEQ ID NO: 2594451 - RNA, 22 nt, Escherichia coli CFT073
agauggucuguaccaccagaau

SEQ ID NO: 2594452 - RNA, 15 nt, Escherichia coli CFT073
agauguaaagugaaa

SEQ ID NO: 2594453 - RNA, 15 nt, Escherichia coli CFT073
agauguaauaacgcu

SEQ ID NO: 2594454 - RNA, 13 nt, Escherichia coli CFT073
agauguuuugccu

SEQ ID NO: 2594455 - RNA, 22 nt, Escherichia coli CFT073
agauguuuugccugaaaaauga

SEQ ID NO: 2594456 - RNA, 16 nt, Escherichia coli CFT073
agauuaaaauauaagg

SEQ ID NO: 2594457 - RNA, 15 nt, Escherichia coli CFT073
agauuaaaaucgccc

SEQ ID NO: 2594458 - RNA, 20 nt, Escherichia coli CFT073
agauuaagagaaccagcugc

SEQ ID NO: 2594459 - RNA, 17 nt, Escherichia coli CFT073
agauuaccagagaaaag

SEQ ID NO: 2594460 - RNA, 21 nt, Escherichia coli CFT073
agauuacguaccagauaagca

SEQ ID NO: 2594461 - RNA, 16 nt, Escherichia coli CFT073
agauuauucaaaaaca

SEQ ID NO: 2594462 - RNA, 17 nt, Escherichia coli CFT073
agauuauucaaaaacag

SEQ ID NO: 2594463 - RNA, 19 nt, Escherichia coli CFT073
agauuauucaaaaacagau

SEQ ID NO: 2594464 - RNA, 22 nt, Escherichia coli CFT073
agauuauucaaaaacagauugc

SEQ ID NO: 2594465 - RNA, 12 nt, Escherichia coli CFT073
agauucaaagac

SEQ ID NO: 2594466 - RNA, 17 nt, Escherichia coli CFT073
agauucaacaucucuau

SEQ ID NO: 2594467 - RNA, 23 nt, Escherichia coli CFT073
agauucaacaucucuauuacccu

SEQ ID NO: 2594468 - RNA, 19 nt, Escherichia coli CFT073
agauucaauuuugcagcau

SEQ ID NO: 2594469 - RNA, 16 nt, Escherichia coli CFT073
agauucacuucgcucu

SEQ ID NO: 2594470 - RNA, 22 nt, Escherichia coli CFT073
agauucagcagcguggugcuga

SEQ ID NO: 2594471 - RNA, 16 nt, Escherichia coli CFT073
agauucagcgucgcca

SEQ ID NO: 2594472 - RNA, 17 nt, Escherichia coli CFT073
agauucauccaguucca

SEQ ID NO: 2594473 - RNA, 20 nt, Escherichia coli CFT073
agauucauccaguuccaguu

SEQ ID NO: 2594474 - RNA, 22 nt, Escherichia coli CFT073
agauuccugcgucccuacugca

SEQ ID NO: 2594475 - RNA, 14 nt, Escherichia coli CFT073
agauucgauagaga

SEQ ID NO: 2594476 - RNA, 13 nt, Escherichia coli CFT073
agauucgccagau

SEQ ID NO: 2594477 - RNA, 20 nt, Escherichia coli CFT073
agauucgcccauuaacaacc

SEQ ID NO: 2594478 - RNA, 19 nt, Escherichia coli CFT073
agauucguauuuaaaaccg

SEQ ID NO: 2594479 - RNA, 23 nt, Escherichia coli CFT073
agauucguauuuaaaaccggugu

SEQ ID NO: 2594480 - RNA, 20 nt, Escherichia coli CFT073
agauucucauauaucccuuc

SEQ ID NO: 2594481 - RNA, 19 nt, Escherichia coli CFT073
agauucuccaccugcggca

SEQ ID NO: 2594482 - RNA, 14 nt, Escherichia coli CFT073
agauucuccagcau

SEQ ID NO: 2594483 - RNA, 21 nt, Escherichia coli CFT073
agauugaacgcuggcggcagg

SEQ ID NO: 2594484 - RNA, 18 nt, Escherichia coli CFT073
agauugcaccacaucggu

SEQ ID NO: 2594485 - RNA, 15 nt, Escherichia coli CFT073
agauugcugcugaua

SEQ ID NO: 2594486 - RNA, 21 nt, Escherichia coli CFT073
agauugucaauauccagcagg

SEQ ID NO: 2594487 - RNA, 14 nt, Escherichia coli CFT073
agauuguuauccag

SEQ ID NO: 2594488 - RNA, 18 nt, Escherichia coli CFT073
agauuuaacggcagcaag

SEQ ID NO: 2594489 - RNA, 19 nt, Escherichia coli CFT073
agauuuaacggcagcaagg

SEQ ID NO: 2594490 - RNA, 14 nt, Escherichia coli CFT073
agauuuauaaaauc

SEQ ID NO: 2594491 - RNA, 16 nt, Escherichia coli CFT073
agauuuauaaaaucca

SEQ ID NO: 2594492 - RNA, 20 nt, Escherichia coli CFT073
agauuucguugugucgccag

SEQ ID NO: 2594493 - RNA, 20 nt, Escherichia coli CFT073
agauuucucuaaaaacucau

SEQ ID NO: 2594494 - RNA, 15 nt, Escherichia coli CFT073
agauuugccagauua

SEQ ID NO: 2594495 - RNA, 17 nt, Escherichia coli CFT073
agauuuggugcgaaacg

SEQ ID NO: 2594496 - RNA, 18 nt, Escherichia coli CFT073
agauuuugcagaucacca

SEQ ID NO: 2594497 - RNA, 14 nt, Escherichia coli CFT073
agauuuuuccccac

SEQ ID NO: 2594498 - RNA, 13 nt, Escherichia coli CFT073
agauuuuuugcca

SEQ ID NO: 2594499 - RNA, 13 nt, Escherichia coli CFT073
agcaaaaaaagaa

SEQ ID NO: 2594500 - RNA, 20 nt, Escherichia coli CFT073
agcaaaaauaaaugcuugac

SEQ ID NO: 2594501 - RNA, 18 nt, Escherichia coli CFT073
agcaaaagccuuauccgc

SEQ ID NO: 2594502 - RNA, 21 nt, Escherichia coli CFT073
agcaaaaucguaagcaggaga

SEQ ID NO: 2594503 - RNA, 13 nt, Escherichia coli CFT073
agcaaacaaaaag

SEQ ID NO: 2594504 - RNA, 13 nt, Escherichia coli CFT073
agcaaacaggcug

SEQ ID NO: 2594505 - RNA, 21 nt, Escherichia coli CFT073
agcaaacaggcuggcaacgac

SEQ ID NO: 2594506 - RNA, 14 nt, Escherichia coli CFT073
agcaaacaguucug

SEQ ID NO: 2594507 - RNA, 16 nt, Escherichia coli CFT073
agcaaacgccgaggca

SEQ ID NO: 2594508 - RNA, 17 nt, Escherichia coli CFT073
agcaaacgccgaggcaa

SEQ ID NO: 2594509 - RNA, 17 nt, Escherichia coli CFT073
agcaaacgguuaugaau

SEQ ID NO: 2594510 - RNA, 15 nt, Escherichia coli CFT073
agcaaagagagaucc

SEQ ID NO: 2594511 - RNA, 18 nt, Escherichia coli CFT073
agcaaagagagauccagc

SEQ ID NO: 2594512 - RNA, 13 nt, Escherichia coli CFT073
agcaaaggcgaca

SEQ ID NO: 2594513 - RNA, 20 nt, Escherichia coli CFT073
agcaaauaaaacaucaccaa

SEQ ID NO: 2594514 - RNA, 22 nt, Escherichia coli CFT073
agcaaauaaaacaucaccaaug

SEQ ID NO: 2594515 - RNA, 15 nt, Escherichia coli CFT073
agcaaauaaaacugc

SEQ ID NO: 2594516 - RNA, 16 nt, Escherichia coli CFT073
agcaaauaauucccca

SEQ ID NO: 2594517 - RNA, 18 nt, Escherichia coli CFT073
agcaaauaauuccccacc

SEQ ID NO: 2594518 - RNA, 22 nt, Escherichia coli CFT073
agcaaaucaaauaauuacuucg

SEQ ID NO: 2594519 - RNA, 20 nt, Escherichia coli CFT073
agcaaauuaauuacacaaug

SEQ ID NO: 2594520 - RNA, 17 nt, Escherichia coli CFT073
agcaaauuaucccccag

SEQ ID NO: 2594521 - RNA, 21 nt, Escherichia coli CFT073
agcaaauuaucccccagcacu

SEQ ID NO: 2594522 - RNA, 20 nt, Escherichia coli CFT073
agcaaauuccucaaacgugc

SEQ ID NO: 2594523 - RNA, 19 nt, Escherichia coli CFT073
agcaaauucuaagcugacu

SEQ ID NO: 2594524 - RNA, 19 nt, Escherichia coli CFT073
agcaacaaacucauuaauc

SEQ ID NO: 2594525 - RNA, 18 nt, Escherichia coli CFT073
agcaacaacacgaucaga

SEQ ID NO: 2594526 - RNA, 11 nt, Escherichia coli CFT073
agcaacaacag

SEQ ID NO: 2594527 - RNA, 16 nt, Escherichia coli CFT073
agcaacaaccaccaca

SEQ ID NO: 2594528 - RNA, 20 nt, Escherichia coli CFT073
agcaacaauuugcgguccau

SEQ ID NO: 2594529 - RNA, 14 nt, Escherichia coli CFT073
agcaacacgccagc

SEQ ID NO: 2594530 - RNA, 22 nt, Escherichia coli CFT073
agcaacacgccagcguuauccc

SEQ ID NO: 2594531 - RNA, 13 nt, Escherichia coli CFT073
agcaacagcaaag

SEQ ID NO: 2594532 - RNA, 15 nt, Escherichia coli CFT073
agcaacagcaguuug

SEQ ID NO: 2594533 - RNA, 21 nt, Escherichia coli CFT073
agcaaccacaaccucagcagu

SEQ ID NO: 2594534 - RNA, 21 nt, Escherichia coli CFT073
agcagcguuuuguagaccuga

SEQ ID NO: 2594535 - RNA, 16 nt, Escherichia coli CFT073
agcagcucaaucgccu

SEQ ID NO: 2594536 - RNA, 17 nt, Escherichia coli CFT073
agcagcucaaucgccuc

SEQ ID NO: 2594537 - RNA, 15 nt, Escherichia coli CFT073
agcagcucacgcagc

SEQ ID NO: 2594538 - RNA, 17 nt, Escherichia coli CFT073
agcagcucacgcagcuu

SEQ ID NO: 2594539 - RNA, 13 nt, Escherichia coli CFT073
agcagcuccacuu

SEQ ID NO: 2594540 - RNA, 22 nt, Escherichia coli CFT073
agcagcuccagaauuccgugcc

SEQ ID NO: 2594541 - RNA, 19 nt, Escherichia coli CFT073
agcagcugcucccagcgca

SEQ ID NO: 2594542 - RNA, 21 nt, Escherichia coli CFT073
agcagcugcucccagcgcauu

SEQ ID NO: 2594543 - RNA, 15 nt, Escherichia coli CFT073
agcagcuugagaaaa

SEQ ID NO: 2594544 - RNA, 17 nt, Escherichia coli CFT073
agcaggaaucccaucag

SEQ ID NO: 2594545 - RNA, 21 nt, Escherichia coli CFT073
agcaggcaauuucgccucgcu

SEQ ID NO: 2594546 - RNA, 17 nt, Escherichia coli CFT073
agcaggcaccgcgccca

SEQ ID NO: 2594547 - RNA, 14 nt, Escherichia coli CFT073
agcaggcauccuga

SEQ ID NO: 2594548 - RNA, 16 nt, Escherichia coli CFT073
agcaggcuggcgacga

SEQ ID NO: 2594549 - RNA, 14 nt, Escherichia coli CFT073
agcagggcaaacag

SEQ ID NO: 2594550 - RNA, 14 nt, Escherichia coli CFT073
agcagggcagggaa

SEQ ID NO: 2594551 - RNA, 21 nt, Escherichia coli CFT073
agcagggugaauaaaagaaau

SEQ ID NO: 2594552 - RNA, 14 nt, Escherichia coli CFT073
agcagggugcuauc

SEQ ID NO: 2594553 - RNA, 22 nt, Escherichia coli CFT073
agcaggguuucaucgguggugu

SEQ ID NO: 2594554 - RNA, 20 nt, Escherichia coli CFT073
agcagguagcgccuuuacug

SEQ ID NO: 2594555 - RNA, 16 nt, Escherichia coli CFT073
agcaggugaaucaggc

SEQ ID NO: 2594556 - RNA, 17 nt, Escherichia coli CFT073
agcaggugauacaucaa

SEQ ID NO: 2594557 - RNA, 16 nt, Escherichia coli CFT073
agcagguguaguucac

SEQ ID NO: 2594558 - RNA, 14 nt, Escherichia coli CFT073
agcaguaccgcagc

SEQ ID NO: 2594559 - RNA, 18 nt, Escherichia coli CFT073
agcaguacggcaggucaa

SEQ ID NO: 2594560 - RNA, 16 nt, Escherichia coli CFT073
agcaguccccacauca

SEQ ID NO: 2594561 - RNA, 19 nt, Escherichia coli CFT073
agcaguccccacaucacac

SEQ ID NO: 2594562 - RNA, 17 nt, Escherichia coli CFT073
agcagugaauacccaga

SEQ ID NO: 2594563 - RNA, 20 nt, Escherichia coli CFT073
agcagugaauacccagaauc

SEQ ID NO: 2594564 - RNA, 22 nt, Escherichia coli CFT073
agcagugaauacccagaaucuc

SEQ ID NO: 2594565 - RNA, 19 nt, Escherichia coli CFT073
agcagugauuuauuuuuac

SEQ ID NO: 2594566 - RNA, 13 nt, Escherichia coli CFT073
agcaguggcacua

SEQ ID NO: 2594567 - RNA, 14 nt, Escherichia coli CFT073
agcaguucagcacg

SEQ ID NO: 2594568 - RNA, 14 nt, Escherichia coli CFT073
agcaguucagucag

SEQ ID NO: 2594569 - RNA, 15 nt, Escherichia coli CFT073
agcaguuccagcauc

SEQ ID NO: 2594570 - RNA, 18 nt, Escherichia coli CFT073
agcaguucgccgccgagg

SEQ ID NO: 2594571 - RNA, 13 nt, Escherichia coli CFT073
agcaguugcaggc

SEQ ID NO: 2594572 - RNA, 18 nt, Escherichia coli CFT073
agcaguuuauaaaauucu

SEQ ID NO: 2594573 - RNA, 18 nt, Escherichia coli CFT073
agcaguuucaccagcagu

SEQ ID NO: 2594574 - RNA, 20 nt, Escherichia coli CFT073
agcaguuuuuccccugccag

SEQ ID NO: 2594575 - RNA, 14 nt, Escherichia coli CFT073
agcauaaucaccag

SEQ ID NO: 2594576 - RNA, 22 nt, Escherichia coli CFT073
agcauaauugccguuuccuggg

SEQ ID NO: 2594577 - RNA, 22 nt, Escherichia coli CFT073
agcauacaaugcaauauuuuga

SEQ ID NO: 2594578 - RNA, 13 nt, Escherichia coli CFT073
agcauacugcaug

SEQ ID NO: 2594579 - RNA, 23 nt, Escherichia coli CFT073
agcauagccccagcgcagacggc

SEQ ID NO: 2594580 - RNA, 13 nt, Escherichia coli CFT073
agcauauacgaaa

SEQ ID NO: 2594581 - RNA, 17 nt, Escherichia coli CFT073
agcauaugcacacgcag

SEQ ID NO: 2594582 - RNA, 15 nt, Escherichia coli CFT073
agcauaugcuucuuc

SEQ ID NO: 2594583 - RNA, 21 nt, Escherichia coli CFT073
agcauauuuggcgcuggcuuc

SEQ ID NO: 2594584 - RNA, 17 nt, Escherichia coli CFT073
agcaucaaacuuuuaaa

SEQ ID NO: 2594585 - RNA, 21 nt, Escherichia coli CFT073
agcaucaacaacaauuucacg

SEQ ID NO: 2594586 - RNA, 15 nt, Escherichia coli CFT073
agcaucaagaaaaau

SEQ ID NO: 2594587 - RNA, 13 nt, Escherichia coli CFT073
agcaucaaugacc

SEQ ID NO: 2594588 - RNA, 11 nt, Escherichia coli CFT073
agcaucaccac

SEQ ID NO: 2594589 - RNA, 14 nt, Escherichia coli CFT073
agcaucagacugcu

SEQ ID NO: 2594590 - RNA, 16 nt, Escherichia coli CFT073
agcaucagacugcuuu

SEQ ID NO: 2594591 - RNA, 12 nt, Escherichia coli CFT073
agcaucagcgau

SEQ ID NO: 2594592 - RNA, 12 nt, Escherichia coli CFT073
agcaucagcgcu

SEQ ID NO: 2594593 - RNA, 19 nt, Escherichia coli CFT073
agcaucagcgcuaccagag

SEQ ID NO: 2594594 - RNA, 20 nt, Escherichia coli CFT073
agcaucagcgcuaccagagc

SEQ ID NO: 2594595 - RNA, 12 nt, Escherichia coli CFT073
agcaucaggaug

SEQ ID NO: 2594596 - RNA, 16 nt, Escherichia coli CFT073
agcaucaggaugauac

SEQ ID NO: 2594597 - RNA, 17 nt, Escherichia coli CFT073
agcaucaucucacgcag

SEQ ID NO: 2594598 - RNA, 18 nt, Escherichia coli CFT073
agcaucaucuuccgguag

SEQ ID NO: 2594599 - RNA, 18 nt, Escherichia coli CFT073
agcaucccaggcauccag

SEQ ID NO: 2594600 - RNA, 20 nt, Escherichia coli CFT073
agcaucccaggcauccaguu

SEQ ID NO: 2594601 - RNA, 22 nt, Escherichia coli CFT073
agcauccccggcaaccacaccc

SEQ ID NO: 2594602 - RNA, 14 nt, Escherichia coli CFT073
agcauccugcacuu

SEQ ID NO: 2594603 - RNA, 16 nt, Escherichia coli CFT073
agcaucgaaaaugcca

SEQ ID NO: 2594604 - RNA, 17 nt, Escherichia coli CFT073
agcaucgaccaugcuga

SEQ ID NO: 2594605 - RNA, 13 nt, Escherichia coli CFT073
agcaucgcaucaa

SEQ ID NO: 2594606 - RNA, 19 nt, Escherichia coli CFT073
agcaucgcauccggcacuu

SEQ ID NO: 2594607 - RNA, 19 nt, Escherichia coli CFT073
agcaucgccaucaacaauu

SEQ ID NO: 2594608 - RNA, 16 nt, Escherichia coli CFT073
agcaucgcccccaucg

SEQ ID NO: 2594609 - RNA, 14 nt, Escherichia coli CFT073
agcaucgccgggag

SEQ ID NO: 2594610 - RNA, 15 nt, Escherichia coli CFT073
agcaucggcaacgcc

SEQ ID NO: 2594611 - RNA, 18 nt, Escherichia coli CFT073
agcaucggcaacgccagc

SEQ ID NO: 2594612 - RNA, 20 nt, Escherichia coli CFT073
agcaucgggauagucaaaua

SEQ ID NO: 2594613 - RNA, 21 nt, Escherichia coli CFT073
agcaucggugaggaucaccag

SEQ ID NO: 2594614 - RNA, 23 nt, Escherichia coli CFT073
agcaucgucaacgccgcgugcca

SEQ ID NO: 2594615 - RNA, 16 nt, Escherichia coli CFT073
agcaucucaaauugcu

SEQ ID NO: 2594616 - RNA, 14 nt, Escherichia coli CFT073
agcaucucauccau

SEQ ID NO: 2594617 - RNA, 17 nt, Escherichia coli CFT073
agcaucugcaaaauuuc

SEQ ID NO: 2594618 - RNA, 22 nt, Escherichia coli CFT073
agcaucuguucuuucaacacau

SEQ ID NO: 2594619 - RNA, 18 nt, Escherichia coli CFT073
agcaugaacauugcugcu

SEQ ID NO: 2594620 - RNA, 20 nt, Escherichia coli CFT073
agcaugaaguaacagaagau

SEQ ID NO: 2594621 - RNA, 13 nt, Escherichia coli CFT073
agcaugacaaaaa

SEQ ID NO: 2594622 - RNA, 13 nt, Escherichia coli CFT073
agcaugccgccaa

SEQ ID NO: 2594623 - RNA, 17 nt, Escherichia coli CFT073
agcaugcugccagguga

SEQ ID NO: 2594624 - RNA, 21 nt, Escherichia coli CFT073
agcauggaauagaaucaccgc

SEQ ID NO: 2594625 - RNA, 15 nt, Escherichia coli CFT073
agcauggccgcaaga

SEQ ID NO: 2594626 - RNA, 14 nt, Escherichia coli CFT073
agcauggcuucuuc

SEQ ID NO: 2594627 - RNA, 18 nt, Escherichia coli CFT073
agcauggcuucuuccccg

SEQ ID NO: 2594628 - RNA, 16 nt, Escherichia coli CFT073
agcaugguaacgcccc

SEQ ID NO: 2594629 - RNA, 14 nt, Escherichia coli CFT073
agcauguuccaguu

SEQ ID NO: 2594630 - RNA, 19 nt, Escherichia coli CFT073
agcauuacuuucggugacu

SEQ ID NO: 2594631 - RNA, 22 nt, Escherichia coli CFT073
agcauuauuuuugcuauaugca

SEQ ID NO: 2594632 - RNA, 18 nt, Escherichia coli CFT073
agcauucagacacgccgc

SEQ ID NO: 2594633 - RNA, 20 nt, Escherichia coli CFT073
agcauucagacacgccgcca

SEQ ID NO: 2594634 - RNA, 16 nt, Escherichia coli CFT073
agcauucccgccacca

SEQ ID NO: 2594635 - RNA, 13 nt, Escherichia coli CFT073
agcauugccagca

SEQ ID NO: 2594636 - RNA, 18 nt, Escherichia coli CFT073
agcauugcgccagcgaga

SEQ ID NO: 2594637 - RNA, 22 nt, Escherichia coli CFT073
agcauugucaggaucaccaaua

SEQ ID NO: 2594638 - RNA, 23 nt, Escherichia coli CFT073
agcauuucaaaacggucacggcu

SEQ ID NO: 2594639 - RNA, 19 nt, Escherichia coli CFT073
agcauuucgcgauauugcu

SEQ ID NO: 2594640 - RNA, 18 nt, Escherichia coli CFT073
agcauuucuuccagcguu

SEQ ID NO: 2594641 - RNA, 16 nt, Escherichia coli CFT073
agcauuuucucacugg

SEQ ID NO: 2594642 - RNA, 17 nt, Escherichia coli CFT073
agcauuuucucacuggc

SEQ ID NO: 2594643 - RNA, 23 nt, Escherichia coli CFT073
agccaguuuuucagcgccagcgc

SEQ ID NO: 2594644 - RNA, 17 nt, Escherichia coli CFT073
agccaguuuuucuuuuu

SEQ ID NO: 2594645 - RNA, 15 nt, Escherichia coli CFT073
agccauaaaaucaca

SEQ ID NO: 2594646 - RNA, 19 nt, Escherichia coli CFT073
agccauaaaaucacagguc

SEQ ID NO: 2594647 - RNA, 17 nt, Escherichia coli CFT073
agccauaaaccgagcca

SEQ ID NO: 2594648 - RNA, 13 nt, Escherichia coli CFT073
agccauaaagaaa

SEQ ID NO: 2594649 - RNA, 22 nt, Escherichia coli CFT073
agccauaaagaaaucaccugcc

SEQ ID NO: 2594650 - RNA, 22 nt, Escherichia coli CFT073
agccauaaucacucuuccccgc

SEQ ID NO: 2594651 - RNA, 24 nt, Escherichia coli CFT073
agccauaaucacucuuccccgcuu

SEQ ID NO: 2594652 - RNA, 18 nt, Escherichia coli CFT073
agccauaccgggaucagg

SEQ ID NO: 2594653 - RNA, 17 nt, Escherichia coli CFT073
agccauauuuaacuccu

SEQ ID NO: 2594654 - RNA, 20 nt, Escherichia coli CFT073
agccauauuuaacuccuucu

SEQ ID NO: 2594655 - RNA, 12 nt, Escherichia coli CFT073
agccaucaccau

SEQ ID NO: 2594656 - RNA, 19 nt, Escherichia coli CFT073
agccaucccugcagggcuu

SEQ ID NO: 2594657 - RNA, 15 nt, Escherichia coli CFT073
agccaucgacaccag

SEQ ID NO: 2594658 - RNA, 17 nt, Escherichia coli CFT073
agccaucgacaccagcc

SEQ ID NO: 2594659 - RNA, 19 nt, Escherichia coli CFT073
agccaucgacaccagccag

SEQ ID NO: 2594660 - RNA, 19 nt, Escherichia coli CFT073
agccaucgccacugcaaau

SEQ ID NO: 2594661 - RNA, 15 nt, Escherichia coli CFT073
agccaucuggcuccu

SEQ ID NO: 2594662 - RNA, 22 nt, Escherichia coli CFT073
agccaugccacgcugacaucaa

SEQ ID NO: 2594663 - RNA, 23 nt, Escherichia coli CFT073
agccaugcggcaucuucuccacg

SEQ ID NO: 2594664 - RNA, 20 nt, Escherichia coli CFT073
agccaugguuuaaucgccgu

SEQ ID NO: 2594665 - RNA, 15 nt, Escherichia coli CFT073
agccauuaaacacca

SEQ ID NO: 2594666 - RNA, 17 nt, Escherichia coli CFT073
agccauuaaacaccagu

SEQ ID NO: 2594667 - RNA, 21 nt, Escherichia coli CFT073
agccauuaaacaccaguaccu

SEQ ID NO: 2594668 - RNA, 19 nt, Escherichia coli CFT073
agccauuaaccagccacug

SEQ ID NO: 2594669 - RNA, 16 nt, Escherichia coli CFT073
agccauuccugcaccu

SEQ ID NO: 2594670 - RNA, 15 nt, Escherichia coli CFT073
agccauucuggcgca

SEQ ID NO: 2594671 - RNA, 19 nt, Escherichia coli CFT073
agccauugcccgaugcgca

SEQ ID NO: 2594672 - RNA, 15 nt, Escherichia coli CFT073
agccauuuuuugaac

SEQ ID NO: 2594673 - RNA, 19 nt, Escherichia coli CFT073
agcccaaagagcaagaacc

SEQ ID NO: 2594674 - RNA, 16 nt, Escherichia coli CFT073
agcccagaaauugcga

SEQ ID NO: 2594675 - RNA, 12 nt, Escherichia coli CFT073
agcccaggccau

SEQ ID NO: 2594676 - RNA, 20 nt, Escherichia coli CFT073
agcccagggaaacagccacc

SEQ ID NO: 2594677 - RNA, 22 nt, Escherichia coli CFT073
agcccagggaaacagccaccca

SEQ ID NO: 2594678 - RNA, 17 nt, Escherichia coli CFT073
agcccaguaccgccagu

SEQ ID NO: 2594679 - RNA, 22 nt, Escherichia coli CFT073
agcccaguaccgccagugcagc

SEQ ID NO: 2594680 - RNA, 15 nt, Escherichia coli CFT073
agcccaguucagcgg

SEQ ID NO: 2594681 - RNA, 23 nt, Escherichia coli CFT073
agcccauacuuaaugccaguuca

SEQ ID NO: 2594682 - RNA, 18 nt, Escherichia coli CFT073
agcccaucagguccacgc

SEQ ID NO: 2594683 - RNA, 18 nt, Escherichia coli CFT073
agcccaucaguguccaga

SEQ ID NO: 2594684 - RNA, 18 nt, Escherichia coli CFT073
agcccaucguugaaaaaa

SEQ ID NO: 2594685 - RNA, 20 nt, Escherichia coli CFT073
agcccaucguugaaaaaauu

SEQ ID NO: 2594686 - RNA, 19 nt, Escherichia coli CFT073
agcccaugacaggcagacg

SEQ ID NO: 2594687 - RNA, 21 nt, Escherichia coli CFT073
agcccaugacaggcagacgau

SEQ ID NO: 2594688 - RNA, 19 nt, Escherichia coli CFT073
agcccaugcguuaucgcca

SEQ ID NO: 2594689 - RNA, 23 nt, Escherichia coli CFT073
agcccaugcguuaucgccaucca

SEQ ID NO: 2594690 - RNA, 14 nt, Escherichia coli CFT073
agccccaccagcaa

SEQ ID NO: 2594691 - RNA, 18 nt, Escherichia coli CFT073
agccccagaacucacgca

SEQ ID NO: 2594692 - RNA, 14 nt, Escherichia coli CFT073
agccccagcgcaga

SEQ ID NO: 2594693 - RNA, 12 nt, Escherichia coli CFT073
agccccaguucc

SEQ ID NO: 2594694 - RNA, 14 nt, Escherichia coli CFT073
agcccccacgccau

SEQ ID NO: 2594695 - RNA, 17 nt, Escherichia coli CFT073
agcccccacgccauacc

SEQ ID NO: 2594696 - RNA, 12 nt, Escherichia coli CFT073
agccccgcagcc

SEQ ID NO: 2594697 - RNA, 22 nt, Escherichia coli CFT073
agccccgcgaacggggcugcca

SEQ ID NO: 2594698 - RNA, 21 nt, Escherichia coli CFT073
agccccgcuuuuuucagcgcc

SEQ ID NO: 2594699 - RNA, 20 nt, Escherichia coli CFT073
agccccugaauucucaaacg

SEQ ID NO: 2594700 - RNA, 19 nt, Escherichia coli CFT073
agcccgacgauaccgccgc

SEQ ID NO: 2594701 - RNA, 18 nt, Escherichia coli CFT073
agcccgaugaugaucggc

SEQ ID NO: 2594702 - RNA, 20 nt, Escherichia coli CFT073
agcccgcagcguccagcgcc

SEQ ID NO: 2594703 - RNA, 23 nt, Escherichia coli CFT073
agcccgcagcguccagcgccugg

SEQ ID NO: 2594704 - RNA, 14 nt, Escherichia coli CFT073
agcccgccaauacc

SEQ ID NO: 2594705 - RNA, 14 nt, Escherichia coli CFT073
agcccgccagacca

SEQ ID NO: 2594706 - RNA, 16 nt, Escherichia coli CFT073
agcccgccagaccagc

SEQ ID NO: 2594707 - RNA, 15 nt, Escherichia coli CFT073
agcccgccaucgccc

SEQ ID NO: 2594708 - RNA, 17 nt, Escherichia coli CFT073
agcccgccaucgcccau

SEQ ID NO: 2594709 - RNA, 15 nt, Escherichia coli CFT073
agcccgcccagcuua

SEQ ID NO: 2594710 - RNA, 16 nt, Escherichia coli CFT073
agcccgccggaaagca

SEQ ID NO: 2594711 - RNA, 14 nt, Escherichia coli CFT073
agcccuacaaacca

SEQ ID NO: 2594712 - RNA, 13 nt, Escherichia coli CFT073
agcccuauaauca

SEQ ID NO: 2594713 - RNA, 20 nt, Escherichia coli CFT073
agcccuaucaucgcggcaca

SEQ ID NO: 2594714 - RNA, 19 nt, Escherichia coli CFT073
agcccucaagccacuuccu

SEQ ID NO: 2594715 - RNA, 19 nt, Escherichia coli CFT073
agcccucaccgaagcgagg

SEQ ID NO: 2594716 - RNA, 19 nt, Escherichia coli CFT073
agcccugaucgcgcgccuu

SEQ ID NO: 2594717 - RNA, 21 nt, Escherichia coli CFT073
agcccugcucgcgcagauaga

SEQ ID NO: 2594718 - RNA, 22 nt, Escherichia coli CFT073
agcccuuaguaucgauugauga

SEQ ID NO: 2594719 - RNA, 19 nt, Escherichia coli CFT073
agcccuuauucacgccaaa

SEQ ID NO: 2594720 - RNA, 18 nt, Escherichia coli CFT073
agcccuugcuucgccagu

SEQ ID NO: 2594721 - RNA, 13 nt, Escherichia coli CFT073
agccgaaacacac

SEQ ID NO: 2594722 - RNA, 22 nt, Escherichia coli CFT073
agccgaacagugccagacaaac

SEQ ID NO: 2594723 - RNA, 23 nt, Escherichia coli CFT073
agccgaagccguuggucaucauc

SEQ ID NO: 2594724 - RNA, 16 nt, Escherichia coli CFT073
agccgacaauaccaca

SEQ ID NO: 2594725 - RNA, 14 nt, Escherichia coli CFT073
agccgaccagcacc

SEQ ID NO: 2594726 - RNA, 16 nt, Escherichia coli CFT073
agccgacgccagcguu

SEQ ID NO: 2594727 - RNA, 18 nt, Escherichia coli CFT073
agccgauaaagcgaccaa

SEQ ID NO: 2594728 - RNA, 22 nt, Escherichia coli CFT073
agccgauaaagcgaccaaccau

SEQ ID NO: 2594729 - RNA, 17 nt, Escherichia coli CFT073
agccgauaaaugccacc

SEQ ID NO: 2594730 - RNA, 19 nt, Escherichia coli CFT073
agccgauaaaugccaccac

SEQ ID NO: 2594731 - RNA, 20 nt, Escherichia coli CFT073
agccgauuaaaaucagaauc

SEQ ID NO: 2594732 - RNA, 24 nt, Escherichia coli CFT073
agccgauuaaucuuccagaucacc

SEQ ID NO: 2594733 - RNA, 14 nt, Escherichia coli CFT073
agccgauuuuaugu

SEQ ID NO: 2594734 - RNA, 16 nt, Escherichia coli CFT073
agccgcaaacuccgug

SEQ ID NO: 2594735 - RNA, 21 nt, Escherichia coli CFT073
agccgcaaacuccgugaagcu

SEQ ID NO: 2594736 - RNA, 19 nt, Escherichia coli CFT073
agccgcaaacuuugccaca

SEQ ID NO: 2594737 - RNA, 19 nt, Escherichia coli CFT073
agccgcagcuaucagcgag

SEQ ID NO: 2594738 - RNA, 20 nt, Escherichia coli CFT073
agccgcagcuaucagcgaga

SEQ ID NO: 2594739 - RNA, 22 nt, Escherichia coli CFT073
agccgcagguaaacucaauuca

SEQ ID NO: 2594740 - RNA, 12 nt, Escherichia coli CFT073
agccgcaguaac

SEQ ID NO: 2594741 - RNA, 14 nt, Escherichia coli CFT073
agccgcauuuuuuc

SEQ ID NO: 2594742 - RNA, 14 nt, Escherichia coli CFT073
agccgccaccagaa

SEQ ID NO: 2594743 - RNA, 12 nt, Escherichia coli CFT073
agccgccagaca

SEQ ID NO: 2594744 - RNA, 14 nt, Escherichia coli CFT073
agccgccagacaau

SEQ ID NO: 2594745 - RNA, 19 nt, Escherichia coli CFT073
agccgccagagaaagcccg

SEQ ID NO: 2594746 - RNA, 16 nt, Escherichia coli CFT073
agccgccagcaucuca

SEQ ID NO: 2594747 - RNA, 17 nt, Escherichia coli CFT073
agccgccauuccagcca

SEQ ID NO: 2594748 - RNA, 21 nt, Escherichia coli CFT073
agccgcccagcgaaccgccaa

SEQ ID NO: 2594749 - RNA, 13 nt, Escherichia coli CFT073
agccgcccuguuu

SEQ ID NO: 2594750 - RNA, 23 nt, Escherichia coli CFT073
agccgccgagcaaaccacaggcc

SEQ ID NO: 2594751 - RNA, 17 nt, Escherichia coli CFT073
agccgccuuuacgcaaa

SEQ ID NO: 2594752 - RNA, 17 nt, Escherichia coli CFT073
agccgcgcaguuucuua

SEQ ID NO: 2594753 - RNA, 17 nt, Escherichia coli CFT073
agccgcgguauccggcu

SEQ ID NO: 2594754 - RNA, 15 nt, Escherichia coli CFT073
agccgcgugcgcugg

SEQ ID NO: 2594755 - RNA, 15 nt, Escherichia coli CFT073
agccgcgugcugcga

SEQ ID NO: 2594756 - RNA, 21 nt, Escherichia coli CFT073
agccgcuaacuuccugcuggc

SEQ ID NO: 2594757 - RNA, 14 nt, Escherichia coli CFT073
agccgcuucugcag

SEQ ID NO: 2594758 - RNA, 15 nt, Escherichia coli CFT073
agccgcuuuuucugc

SEQ ID NO: 2594759 - RNA, 23 nt, Escherichia coli CFT073
agccgcuuuuucugcacacacac

SEQ ID NO: 2594760 - RNA, 15 nt, Escherichia coli CFT073
agccggagcuggcgc

SEQ ID NO: 2594761 - RNA, 20 nt, Escherichia coli CFT073
agccggaggaaacuugccuc

SEQ ID NO: 2594762 - RNA, 15 nt, Escherichia coli CFT073
agccggaggugaaaa

SEQ ID NO: 2594763 - RNA, 17 nt, Escherichia coli CFT073
agccggauaagcaaugu

SEQ ID NO: 2594764 - RNA, 17 nt, Escherichia coli CFT073
agccggauaaugcgcca

SEQ ID NO: 2594765 - RNA, 17 nt, Escherichia coli CFT073
agccggaugaucauccg

SEQ ID NO: 2594766 - RNA, 23 nt, Escherichia coli CFT073
agccgggagcggcgucagccagu

SEQ ID NO: 2594767 - RNA, 17 nt, Escherichia coli CFT073
agccgguaaaucaccau

SEQ ID NO: 2594768 - RNA, 16 nt, Escherichia coli CFT073
agccgguaaucaccag

SEQ ID NO: 2594769 - RNA, 13 nt, Escherichia coli CFT073
agccggucauauu

SEQ ID NO: 2594770 - RNA, 17 nt, Escherichia coli CFT073
agccggugccauuucgc

SEQ ID NO: 2594771 - RNA, 17 nt, Escherichia coli CFT073
agccggugcccgccagu

SEQ ID NO: 2594772 - RNA, 12 nt, Escherichia coli CFT073
agccgguuuugg

SEQ ID NO: 2594773 - RNA, 18 nt, Escherichia coli CFT073
agccguaggugaaacggu

SEQ ID NO: 2594774 - RNA, 18 nt, Escherichia coli CFT073
agccgucccuaacaugcc

SEQ ID NO: 2594775 - RNA, 21 nt, Escherichia coli CFT073
agccgucgccaguaccagcag

SEQ ID NO: 2594776 - RNA, 16 nt, Escherichia coli CFT073
agccgucgcccacagu

SEQ ID NO: 2594777 - RNA, 22 nt, Escherichia coli CFT073
agccgugaaaacagcaaccucc

SEQ ID NO: 2594778 - RNA, 16 nt, Escherichia coli CFT073
agccgugaaucacucc

SEQ ID NO: 2594779 - RNA, 18 nt, Escherichia coli CFT073
agccgugaaucacuccau

SEQ ID NO: 2594780 - RNA, 15 nt, Escherichia coli CFT073
agccuaacacagcaa

SEQ ID NO: 2594781 - RNA, 17 nt, Escherichia coli CFT073
agccuaacacagcaaua

SEQ ID NO: 2594782 - RNA, 20 nt, Escherichia coli CFT073
agccuaacacagcaauaaua

SEQ ID NO: 2594783 - RNA, 18 nt, Escherichia coli CFT073
agccuaagccauuuaacu

SEQ ID NO: 2594784 - RNA, 17 nt, Escherichia coli CFT073
agccuaaguuaugcgaa

SEQ ID NO: 2594785 - RNA, 18 nt, Escherichia coli CFT073
agccuaaguuaugcgaaa

SEQ ID NO: 2594786 - RNA, 15 nt, Escherichia coli CFT073
agccuacagaacgcu

SEQ ID NO: 2594787 - RNA, 18 nt, Escherichia coli CFT073
agccuaccagaccgcaca

SEQ ID NO: 2594788 - RNA, 16 nt, Escherichia coli CFT073
agccuaccggcauagu

SEQ ID NO: 2594789 - RNA, 23 nt, Escherichia coli CFT073
agccuauaccuaacacgaucagc

SEQ ID NO: 2594790 - RNA, 15 nt, Escherichia coli CFT073
agccucaaauuccuu

SEQ ID NO: 2594791 - RNA, 22 nt, Escherichia coli CFT073
agccucacagcuaaucaucauc

SEQ ID NO: 2594792 - RNA, 19 nt, Escherichia coli CFT073
agccucccugccuccauga

SEQ ID NO: 2594793 - RNA, 16 nt, Escherichia coli CFT073
agccuccggccacgau

SEQ ID NO: 2594794 - RNA, 22 nt, Escherichia coli CFT073
agccuccucuuuuuccaucacc

SEQ ID NO: 2594795 - RNA, 15 nt, Escherichia coli CFT073
agccucgcugcucac

SEQ ID NO: 2594796 - RNA, 20 nt, Escherichia coli CFT073
agccucugcguuauuuucag

SEQ ID NO: 2594797 - RNA, 15 nt, Escherichia coli CFT073
agccugaaaacgaaa

SEQ ID NO: 2594798 - RNA, 18 nt, Escherichia coli CFT073
agccugaauaaacgccau

SEQ ID NO: 2594799 - RNA, 20 nt, Escherichia coli CFT073
agccugauaacgaauugcug

SEQ ID NO: 2594800 - RNA, 21 nt, Escherichia coli CFT073
agccugauaacgaauugcugc

SEQ ID NO: 2594801 - RNA, 23 nt, Escherichia coli CFT073
agccugaugcgacgcuugccgcg

SEQ ID NO: 2594802 - RNA, 22 nt, Escherichia coli CFT073
agccugauguagcgugauuuug

SEQ ID NO: 2594803 - RNA, 17 nt, Escherichia coli CFT073
agccugcaacuggcaau

SEQ ID NO: 2594804 - RNA, 23 nt, Escherichia coli CFT073
agccugcacgaccggguuuucaa

SEQ ID NO: 2594805 - RNA, 22 nt, Escherichia coli CFT073
agccugccaauggcaggaucug

SEQ ID NO: 2594806 - RNA, 23 nt, Escherichia coli CFT073
agccugccaguggagccaucacc

SEQ ID NO: 2594807 - RNA, 15 nt, Escherichia coli CFT073
agccugcgcuaccag

SEQ ID NO: 2594808 - RNA, 14 nt, Escherichia coli CFT073
agccuggaauuucu

SEQ ID NO: 2594809 - RNA, 13 nt, Escherichia coli CFT073
agccugugccuga

SEQ ID NO: 2594810 - RNA, 14 nt, Escherichia coli CFT073
agccuuaacaagau

SEQ ID NO: 2594811 - RNA, 14 nt, Escherichia coli CFT073
agccuucgccaccg

SEQ ID NO: 2594812 - RNA, 21 nt, Escherichia coli CFT073
agccuucggacguuugccaug

SEQ ID NO: 2594813 - RNA, 17 nt, Escherichia coli CFT073
agccuucuauaucuccc

SEQ ID NO: 2594814 - RNA, 17 nt, Escherichia coli CFT073
agccuugaggccauccg

SEQ ID NO: 2594815 - RNA, 20 nt, Escherichia coli CFT073
agccuugugccucaacccau

SEQ ID NO: 2594816 - RNA, 15 nt, Escherichia coli CFT073
agccuuucacaucag

SEQ ID NO: 2594817 - RNA, 15 nt, Escherichia coli CFT073
agccuuuuucagccg

SEQ ID NO: 2594818 - RNA, 18 nt, Escherichia coli CFT073
agccuuuuuuaauauuuc

SEQ ID NO: 2594819 - RNA, 20 nt, Escherichia coli CFT073
agccuuuuuuaauauuucau

SEQ ID NO: 2594820 - RNA, 22 nt, Escherichia coli CFT073
agccuuuuuuaauauuucauuc

SEQ ID NO: 2594821 - RNA, 22 nt, Escherichia coli CFT073
agcgaaaacgacgagccaccaa

SEQ ID NO: 2594822 - RNA, 21 nt, Escherichia coli CFT073
agcgaaagcgugagugccccu

SEQ ID NO: 2594823 - RNA, 16 nt, Escherichia coli CFT073
agcgaaaucuuccggc

SEQ ID NO: 2594824 - RNA, 20 nt, Escherichia coli CFT073
agcgaacaggaguagcucug

SEQ ID NO: 2594825 - RNA, 21 nt, Escherichia coli CFT073
agcgaacaggaguagcucugg

SEQ ID NO: 2594826 - RNA, 22 nt, Escherichia coli CFT073
agcgaaccaccaaacugcgccc

SEQ ID NO: 2594827 - RNA, 17 nt, Escherichia coli CFT073
agcgaacugguuucaau

SEQ ID NO: 2594828 - RNA, 20 nt, Escherichia coli CFT073
agcgaagguaacaccaguuu

SEQ ID NO: 2594829 - RNA, 17 nt, Escherichia coli CFT073
agcgaauaaaccacacc

SEQ ID NO: 2594830 - RNA, 21 nt, Escherichia coli CFT073
agcgaauaaaccacaccgccu

SEQ ID NO: 2594831 - RNA, 14 nt, Escherichia coli CFT073
agcgaauuccaguu

SEQ ID NO: 2594832 - RNA, 12 nt, Escherichia coli CFT073
agcgaauuuuuc

SEQ ID NO: 2594833 - RNA, 20 nt, Escherichia coli CFT073
agcgacaaacuccggcuuuu

SEQ ID NO: 2594834 - RNA, 13 nt, Escherichia coli CFT073
agcgacaaucccu

SEQ ID NO: 2594835 - RNA, 22 nt, Escherichia coli CFT073
agcgacagcgcacggcgaaaau

SEQ ID NO: 2594836 - RNA, 20 nt, Escherichia coli CFT073
agcgaccacaaauaccccac

SEQ ID NO: 2594837 - RNA, 17 nt, Escherichia coli CFT073
agcgaccauuggugcug

SEQ ID NO: 2594838 - RNA, 23 nt, Escherichia coli CFT073
agcgacgggcuaaucgucaucag

SEQ ID NO: 2594839 - RNA, 14 nt, Escherichia coli CFT073
agcgacucacgaau

SEQ ID NO: 2594840 - RNA, 13 nt, Escherichia coli CFT073
agcgacugugaag

SEQ ID NO: 2594841 - RNA, 15 nt, Escherichia coli CFT073
agcgacugugaagua

SEQ ID NO: 2594842 - RNA, 18 nt, Escherichia coli CFT073
agcgacuuugccuggcgg

SEQ ID NO: 2594843 - RNA, 18 nt, Escherichia coli CFT073
agcgagaacaccgaacca

SEQ ID NO: 2594844 - RNA, 13 nt, Escherichia coli CFT073
agcgagaagucgg

SEQ ID NO: 2594845 - RNA, 14 nt, Escherichia coli CFT073
agcgagaauacaua

SEQ ID NO: 2594846 - RNA, 17 nt, Escherichia coli CFT073
agcgagaguaauuaaac

SEQ ID NO: 2594847 - RNA, 19 nt, Escherichia coli CFT073
agcgagauaaugcgccaga

SEQ ID NO: 2594848 - RNA, 16 nt, Escherichia coli CFT073
agcgagcuggcgcuga

SEQ ID NO: 2594849 - RNA, 21 nt, Escherichia coli CFT073
agcgagcuggcgcugauaaau

SEQ ID NO: 2594850 - RNA, 21 nt, Escherichia coli CFT073
agcgaggcaaucagcaguauc

SEQ ID NO: 2594851 - RNA, 19 nt, Escherichia coli CFT073
agcgagggcuaugcgcauc

SEQ ID NO: 2594852 - RNA, 23 nt, Escherichia coli CFT073
agcgagggcuaugcgcaucaagg

SEQ ID NO: 2594853 - RNA, 19 nt, Escherichia coli CFT073
agcgagugccggggccguu

SEQ ID NO: 2594854 - RNA, 22 nt, Escherichia coli CFT073
agcgaguuccugcucuuccggc

SEQ ID NO: 2594855 - RNA, 14 nt, Escherichia coli CFT073
agcgaguugaucac

SEQ ID NO: 2594856 - RNA, 16 nt, Escherichia coli CFT073
agcgauaaaacgccgc

SEQ ID NO: 2594857 - RNA, 22 nt, Escherichia coli CFT073
agcgauaaaacgccgcugguga

SEQ ID NO: 2594858 - RNA, 21 nt, Escherichia coli CFT073
agcgcguccugaucgacgcgc

SEQ ID NO: 2594859 - RNA, 17 nt, Escherichia coli CFT073
agcgcgugcgccaccgc

SEQ ID NO: 2594860 - RNA, 13 nt, Escherichia coli CFT073
agcgcguucuguu

SEQ ID NO: 2594861 - RNA, 18 nt, Escherichia coli CFT073
agcgcguugcgccaaacg

SEQ ID NO: 2594862 - RNA, 15 nt, Escherichia coli CFT073
agcgcguuucugcgc

SEQ ID NO: 2594863 - RNA, 23 nt, Escherichia coli CFT073
agcgcguuucugcgcuucugcca

SEQ ID NO: 2594864 - RNA, 17 nt, Escherichia coli CFT073
agcgcugcgcaggcaau

SEQ ID NO: 2594865 - RNA, 16 nt, Escherichia coli CFT073
agcgcugcggccugcu

SEQ ID NO: 2594866 - RNA, 19 nt, Escherichia coli CFT073
agcgcugcggccugcugca

SEQ ID NO: 2594867 - RNA, 22 nt, Escherichia coli CFT073
agcgcugcggccugcugcacag

SEQ ID NO: 2594868 - RNA, 23 nt, Escherichia coli CFT073
agcgcuggagagcgccgggcaaa

SEQ ID NO: 2594869 - RNA, 20 nt, Escherichia coli CFT073
agcgcugugaaacaccugca

SEQ ID NO: 2594870 - RNA, 13 nt, Escherichia coli CFT073
agcgcuuauacac

SEQ ID NO: 2594871 - RNA, 20 nt, Escherichia coli CFT073
agcgcuuuugcuacuuuuuu

SEQ ID NO: 2594872 - RNA, 22 nt, Escherichia coli CFT073
agcgcuuuuggcgcguucccuu

SEQ ID NO: 2594873 - RNA, 14 nt, Escherichia coli CFT073
agcgcuuuuuccug

SEQ ID NO: 2594874 - RNA, 14 nt, Escherichia coli CFT073
agcggaaaugcaga

SEQ ID NO: 2594875 - RNA, 20 nt, Escherichia coli CFT073
agcggaaaugcagaggcaua

SEQ ID NO: 2594876 - RNA, 19 nt, Escherichia coli CFT073
agcggacucaccgagcagc

SEQ ID NO: 2594877 - RNA, 19 nt, Escherichia coli CFT073
agcggagaucgccagcccu

SEQ ID NO: 2594878 - RNA, 14 nt, Escherichia coli CFT073
agcggagcaaugau

SEQ ID NO: 2594879 - RNA, 13 nt, Escherichia coli CFT073
agcggagcaauuu

SEQ ID NO: 2594880 - RNA, 11 nt, Escherichia coli CFT073
agcggagcgca

SEQ ID NO: 2594881 - RNA, 14 nt, Escherichia coli CFT073
agcggagguaauaa

SEQ ID NO: 2594882 - RNA, 18 nt, Escherichia coli CFT073
agcggaugacccagcgcg

SEQ ID NO: 2594883 - RNA, 20 nt, Escherichia coli CFT073
agcggaugacccagcgcgau

SEQ ID NO: 2594884 - RNA, 20 nt, Escherichia coli CFT073
agcggcaaaacggugcaggc

SEQ ID NO: 2594885 - RNA, 15 nt, Escherichia coli CFT073
agcggcaacaaugcu

SEQ ID NO: 2594886 - RNA, 14 nt, Escherichia coli CFT073
agcggcaacaucau

SEQ ID NO: 2594887 - RNA, 15 nt, Escherichia coli CFT073
agcggcaacaucauc

SEQ ID NO: 2594888 - RNA, 15 nt, Escherichia coli CFT073
agcggcaaccagcag

SEQ ID NO: 2594889 - RNA, 16 nt, Escherichia coli CFT073
agcggcaaccagcagc

SEQ ID NO: 2594890 - RNA, 18 nt, Escherichia coli CFT073
agcggcaccacgagcggc

SEQ ID NO: 2594891 - RNA, 22 nt, Escherichia coli CFT073
agcggcaccuucgcggcaaaac

SEQ ID NO: 2594892 - RNA, 13 nt, Escherichia coli CFT073
agcggcaggccgu

SEQ ID NO: 2594893 - RNA, 18 nt, Escherichia coli CFT073
agcggcaucaaccgccgg

SEQ ID NO: 2594894 - RNA, 17 nt, Escherichia coli CFT073
agcggccaaagggagca

SEQ ID NO: 2594895 - RNA, 19 nt, Escherichia coli CFT073
agcggccaaagggagcaga

SEQ ID NO: 2594896 - RNA, 20 nt, Escherichia coli CFT073
agcggccagacgcgccgcca

SEQ ID NO: 2594897 - RNA, 22 nt, Escherichia coli CFT073
agcggccccauuuauuucucac

SEQ ID NO: 2594898 - RNA, 14 nt, Escherichia coli CFT073
agcggcgaaacggu

SEQ ID NO: 2594899 - RNA, 22 nt, Escherichia coli CFT073
agcggcgaguauucuugcugau

SEQ ID NO: 2594900 - RNA, 21 nt, Escherichia coli CFT073
agcggcgaguguguggaaaac

SEQ ID NO: 2594901 - RNA, 20 nt, Escherichia coli CFT073
agcggcgcauccgccagcag

SEQ ID NO: 2594902 - RNA, 19 nt, Escherichia coli CFT073
agcggcggcacagcggggu

SEQ ID NO: 2594903 - RNA, 16 nt, Escherichia coli CFT073
agcggcgggcuuuaau

SEQ ID NO: 2594904 - RNA, 17 nt, Escherichia coli CFT073
agcggcgggcuuuaauc

SEQ ID NO: 2594905 - RNA, 24 nt, Escherichia coli CFT073
agcggcgguuucuuuauccgcuuc

SEQ ID NO: 2594906 - RNA, 16 nt, Escherichia coli CFT073
agcggcguaucuucca

SEQ ID NO: 2594907 - RNA, 16 nt, Escherichia coli CFT073
agcggcguuaacggau

SEQ ID NO: 2594908 - RNA, 19 nt, Escherichia coli CFT073
agcggcuauucuggccgcu

SEQ ID NO: 2594909 - RNA, 21 nt, Escherichia coli CFT073
agcggcucauguagccgcuuu

SEQ ID NO: 2594910 - RNA, 23 nt, Escherichia coli CFT073
agcggcucuggcucaucgccuuc

SEQ ID NO: 2594911 - RNA, 15 nt, Escherichia coli CFT073
agcggcugaauaucc

SEQ ID NO: 2594912 - RNA, 14 nt, Escherichia coli CFT073
agcggcugcgcagc

SEQ ID NO: 2594913 - RNA, 22 nt, Escherichia coli CFT073
agcggcuggcacucuuccagac

SEQ ID NO: 2594914 - RNA, 21 nt, Escherichia coli CFT073
agcggcuuaagaagaacggga

SEQ ID NO: 2594915 - RNA, 21 nt, Escherichia coli CFT073
agcggcuuccccaacacagga

SEQ ID NO: 2594916 - RNA, 15 nt, Escherichia coli CFT073
agcggcuuuuuacgc

SEQ ID NO: 2594917 - RNA, 23 nt, Escherichia coli CFT073
agcggcuuuuucgccgagauauu

SEQ ID NO: 2594918 - RNA, 15 nt, Escherichia coli CFT073
agcgggaauagcuca

SEQ ID NO: 2594919 - RNA, 16 nt, Escherichia coli CFT073
agcgggaucagguaag

SEQ ID NO: 2594920 - RNA, 22 nt, Escherichia coli CFT073
agcgggaucggcguacuggcaa

SEQ ID NO: 2594921 - RNA, 20 nt, Escherichia coli CFT073
agcgggauucuccugagaau

SEQ ID NO: 2594922 - RNA, 13 nt, Escherichia coli CFT073
agcgggcgcaaug

SEQ ID NO: 2594923 - RNA, 20 nt, Escherichia coli CFT073
agcgggggcucccaccgcac

SEQ ID NO: 2594924 - RNA, 20 nt, Escherichia coli CFT073
agcgggguucuccugagaac

SEQ ID NO: 2594925 - RNA, 17 nt, Escherichia coli CFT073
agcggguuuuucccuuc

SEQ ID NO: 2594926 - RNA, 17 nt, Escherichia coli CFT073
agcgguaaaauggucag

SEQ ID NO: 2594927 - RNA, 21 nt, Escherichia coli CFT073
agcgguaaaccaaccagcgug

SEQ ID NO: 2594928 - RNA, 22 nt, Escherichia coli CFT073
agcgguaagguugucgaugcca

SEQ ID NO: 2594929 - RNA, 21 nt, Escherichia coli CFT073
agcggucacauguuccagggc

SEQ ID NO: 2594930 - RNA, 17 nt, Escherichia coli CFT073
agcggucauguaccguu

SEQ ID NO: 2594931 - RNA, 18 nt, Escherichia coli CFT073
agcggucgcugacauuaa

SEQ ID NO: 2594932 - RNA, 15 nt, Escherichia coli CFT073
agcggugauaaaccc

SEQ ID NO: 2594933 - RNA, 23 nt, Escherichia coli CFT073
agcggugauaaacccaacggcaa

SEQ ID NO: 2594934 - RNA, 20 nt, Escherichia coli CFT073
agcggugauuuccgccgcca

SEQ ID NO: 2594935 - RNA, 16 nt, Escherichia coli CFT073
agcggugcgguaagcu

SEQ ID NO: 2594936 - RNA, 21 nt, Escherichia coli CFT073
agcgguggguuaacaucaugu

SEQ ID NO: 2594937 - RNA, 22 nt, Escherichia coli CFT073
agcgguggugaaaagagcggua

SEQ ID NO: 2594938 - RNA, 15 nt, Escherichia coli CFT073
agcggugucugccag

SEQ ID NO: 2594939 - RNA, 20 nt, Escherichia coli CFT073
agcgguguuucgggcagccu

SEQ ID NO: 2594940 - RNA, 21 nt, Escherichia coli CFT073
agcgguguuucgggcagccuc

SEQ ID NO: 2594941 - RNA, 16 nt, Escherichia coli CFT073
agcgguuguagccacg

SEQ ID NO: 2594942 - RNA, 20 nt, Escherichia coli CFT073
agcgguuuacccugcucgcu

SEQ ID NO: 2594943 - RNA, 22 nt, Escherichia coli CFT073
agcgguuuugaucacgucgaga

SEQ ID NO: 2594944 - RNA, 17 nt, Escherichia coli CFT073
agcguaaagccagcggc

SEQ ID NO: 2594945 - RNA, 17 nt, Escherichia coli CFT073
agcguaacuuaucaauu

SEQ ID NO: 2594946 - RNA, 13 nt, Escherichia coli CFT073
agcguacaaccgc

SEQ ID NO: 2594947 - RNA, 20 nt, Escherichia coli CFT073
agcguaccaugauccugcaa

SEQ ID NO: 2594948 - RNA, 23 nt, Escherichia coli CFT073
agcguaccaugauccugcaauac

SEQ ID NO: 2594949 - RNA, 17 nt, Escherichia coli CFT073
agcguaccgccaauuac

SEQ ID NO: 2594950 - RNA, 14 nt, Escherichia coli CFT073
agcguaccugccgc

SEQ ID NO: 2594951 - RNA, 19 nt, Escherichia coli CFT073
agcguacugaccgucgccu

SEQ ID NO: 2594952 - RNA, 15 nt, Escherichia coli CFT073
agcguagcgcaucag

SEQ ID NO: 2594953 - RNA, 16 nt, Escherichia coli CFT073
agcguagcgcaucagg

SEQ ID NO: 2594954 - RNA, 16 nt, Escherichia coli CFT073
agcguaggucaugccu

SEQ ID NO: 2594955 - RNA, 20 nt, Escherichia coli CFT073
agcguauagagcagcggcgu

SEQ ID NO: 2594956 - RNA, 16 nt, Escherichia coli CFT073
agcguauccagcauac

SEQ ID NO: 2594957 - RNA, 13 nt, Escherichia coli CFT073
agcguauccauca

SEQ ID NO: 2594958 - RNA, 20 nt, Escherichia coli CFT073
agcgucaaacuuuuaaauug

SEQ ID NO: 2594959 - RNA, 22 nt, Escherichia coli CFT073
agcgucaaacuuuuaaauugaa

SEQ ID NO: 2594960 - RNA, 19 nt, Escherichia coli CFT073
agcgucaacuuuagcaaug

SEQ ID NO: 2594961 - RNA, 22 nt, Escherichia coli CFT073
agcgucaagauggcucucaucc

SEQ ID NO: 2594962 - RNA, 13 nt, Escherichia coli CFT073
agcgucacaucag

SEQ ID NO: 2594963 - RNA, 12 nt, Escherichia coli CFT073
agcgucaccgga

SEQ ID NO: 2594964 - RNA, 13 nt, Escherichia coli CFT073
agcgucagcagca

SEQ ID NO: 2594965 - RNA, 12 nt, Escherichia coli CFT073
agcuccccacac

SEQ ID NO: 2594966 - RNA, 14 nt, Escherichia coli CFT073
agcuccggcucuaa

SEQ ID NO: 2594967 - RNA, 18 nt, Escherichia coli CFT073
agcuccgggcugguuuuc

SEQ ID NO: 2594968 - RNA, 17 nt, Escherichia coli CFT073
agcuccgguacucauca

SEQ ID NO: 2594969 - RNA, 19 nt, Escherichia coli CFT073
agcuccgguacucaucaga

SEQ ID NO: 2594970 - RNA, 15 nt, Escherichia coli CFT073
agcuccguccagcca

SEQ ID NO: 2594971 - RNA, 19 nt, Escherichia coli CFT073
agcuccguccagccaccgc

SEQ ID NO: 2594972 - RNA, 16 nt, Escherichia coli CFT073
agcucgacuccugacu

SEQ ID NO: 2594973 - RNA, 19 nt, Escherichia coli CFT073
agcucgcgauacgcuucaa

SEQ ID NO: 2594974 - RNA, 19 nt, Escherichia coli CFT073
agcucggcgaucuguuccg

SEQ ID NO: 2594975 - RNA, 19 nt, Escherichia coli CFT073
agcucgguggcgauguaau

SEQ ID NO: 2594976 - RNA, 23 nt, Escherichia coli CFT073
agcucguugguuccacggcaucu

SEQ ID NO: 2594977 - RNA, 14 nt, Escherichia coli CFT073
agcucuaucugcac

SEQ ID NO: 2594978 - RNA, 21 nt, Escherichia coli CFT073
agcucuaucugcacugcucau

SEQ ID NO: 2594979 - RNA, 14 nt, Escherichia coli CFT073
agcucucagcauau

SEQ ID NO: 2594980 - RNA, 17 nt, Escherichia coli CFT073
agcucucuuccaguucg

SEQ ID NO: 2594981 - RNA, 11 nt, Escherichia coli CFT073
agcucugccac

SEQ ID NO: 2594982 - RNA, 16 nt, Escherichia coli CFT073
agcucugcgcccugca

SEQ ID NO: 2594983 - RNA, 21 nt, Escherichia coli CFT073
agcucuguagcaacgauaaca

SEQ ID NO: 2594984 - RNA, 17 nt, Escherichia coli CFT073
agcucuuauacgugaaa

SEQ ID NO: 2594985 - RNA, 22 nt, Escherichia coli CFT073
agcucuuccucgcucucgccgc

SEQ ID NO: 2594986 - RNA, 19 nt, Escherichia coli CFT073
agcucuuuauccagcagcc

SEQ ID NO: 2594987 - RNA, 18 nt, Escherichia coli CFT073
agcugaaaauugcgcucg

SEQ ID NO: 2594988 - RNA, 11 nt, Escherichia coli CFT073
agcugaaauca

SEQ ID NO: 2594989 - RNA, 18 nt, Escherichia coli CFT073
agcugaacgcuucaccac

SEQ ID NO: 2594990 - RNA, 22 nt, Escherichia coli CFT073
agcugaauaucacgggcgcgga

SEQ ID NO: 2594991 - RNA, 20 nt, Escherichia coli CFT073
agcugaauggguaaacccgc

SEQ ID NO: 2594992 - RNA, 18 nt, Escherichia coli CFT073
agcugaccagacagucgc

SEQ ID NO: 2594993 - RNA, 13 nt, Escherichia coli CFT073
agcugacuugcuc

SEQ ID NO: 2594994 - RNA, 18 nt, Escherichia coli CFT073
agcugacuugcucaaucu

SEQ ID NO: 2594995 - RNA, 16 nt, Escherichia coli CFT073
agcugaguauuaaccg

SEQ ID NO: 2594996 - RNA, 14 nt, Escherichia coli CFT073
agcugagugcgaaa

SEQ ID NO: 2594997 - RNA, 16 nt, Escherichia coli CFT073
agcugagugcgaaaau

SEQ ID NO: 2594998 - RNA, 18 nt, Escherichia coli CFT073
agcugagugcgaaaauca

SEQ ID NO: 2594999 - RNA, 20 nt, Escherichia coli CFT073
agcugagugcgaaaaucaau

SEQ ID NO: 2595000 - RNA, 22 nt, Escherichia coli CFT073
agcugagugcgaaaaucaauaa

SEQ ID NO: 2595001 - RNA, 16 nt, Escherichia coli CFT073
agcugauaacgccacg

SEQ ID NO: 2595002 - RNA, 20 nt, Escherichia coli CFT073
agcugauaacgccacgccac

SEQ ID NO: 2595003 - RNA, 23 nt, Escherichia coli CFT073
agcugauacgggaggucaucagc

SEQ ID NO: 2595004 - RNA, 14 nt, Escherichia coli CFT073
agcugauaucaccu

SEQ ID NO: 2595005 - RNA, 13 nt, Escherichia coli CFT073
agcugcagccagu

SEQ ID NO: 2595006 - RNA, 14 nt, Escherichia coli CFT073
agcugccagcggua

SEQ ID NO: 2595007 - RNA, 13 nt, Escherichia coli CFT073
agcugccaguugc

SEQ ID NO: 2595008 - RNA, 13 nt, Escherichia coli CFT073
agcugccaguugu

SEQ ID NO: 2595009 - RNA, 18 nt, Escherichia coli CFT073
agcugcgaccaguggcgg

SEQ ID NO: 2595010 - RNA, 20 nt, Escherichia coli CFT073
agcugcgaccaguggcggga

SEQ ID NO: 2595011 - RNA, 15 nt, Escherichia coli CFT073
agcugcggauccuga

SEQ ID NO: 2595012 - RNA, 22 nt, Escherichia coli CFT073
agcugcggauccugagcaaaca

SEQ ID NO: 2595013 - RNA, 19 nt, Escherichia coli CFT073
agcugcgggaaauaacaaa

SEQ ID NO: 2595014 - RNA, 16 nt, Escherichia coli CFT073
agcugcucccagcgca

SEQ ID NO: 2595015 - RNA, 16 nt, Escherichia coli CFT073
agcugcucgauguugu

SEQ ID NO: 2595016 - RNA, 14 nt, Escherichia coli CFT073
agcuggaauaauaa

SEQ ID NO: 2595017 - RNA, 20 nt, Escherichia coli CFT073
agcuggaggaacgcgccucu

SEQ ID NO: 2595018 - RNA, 22 nt, Escherichia coli CFT073
agcuggaggaacgcgccucuuc

SEQ ID NO: 2595019 - RNA, 20 nt, Escherichia coli CFT073
agcuggcaccgcaucaaaga

SEQ ID NO: 2595020 - RNA, 17 nt, Escherichia coli CFT073
agcuggcagccccguuc

SEQ ID NO: 2595021 - RNA, 21 nt, Escherichia coli CFT073
agcuggccugcuuuuucauca

SEQ ID NO: 2595022 - RNA, 14 nt, Escherichia coli CFT073
agcuggcgccaggc

SEQ ID NO: 2595023 - RNA, 15 nt, Escherichia coli CFT073
agcuggcgccaggcu

SEQ ID NO: 2595024 - RNA, 22 nt, Escherichia coli CFT073
agcuggcgcuggcgaucgucca

SEQ ID NO: 2595025 - RNA, 15 nt, Escherichia coli CFT073
agcuggcggcaaaaa

SEQ ID NO: 2595026 - RNA, 16 nt, Escherichia coli CFT073
agcuggcguagccagu

SEQ ID NO: 2595027 - RNA, 20 nt, Escherichia coli CFT073
agcugggcgauuuucuacuu

SEQ ID NO: 2595028 - RNA, 22 nt, Escherichia coli CFT073
agcuggucagcaucgucaacgc

SEQ ID NO: 2595029 - RNA, 13 nt, Escherichia coli CFT073
agcuggugauaac

SEQ ID NO: 2595030 - RNA, 15 nt, Escherichia coli CFT073
agcuguacaucgcgc

SEQ ID NO: 2595031 - RNA, 17 nt, Escherichia coli CFT073
agcuguaccagcaacug

SEQ ID NO: 2595032 - RNA, 23 nt, Escherichia coli CFT073
agcuguccauaccggacuccaga

SEQ ID NO: 2595033 - RNA, 13 nt, Escherichia coli CFT073
agcuguccgauuu

SEQ ID NO: 2595034 - RNA, 22 nt, Escherichia coli CFT073
agcuguccuguaggccugauaa

SEQ ID NO: 2595035 - RNA, 17 nt, Escherichia coli CFT073
agcugucguacccaguc

SEQ ID NO: 2595036 - RNA, 23 nt, Escherichia coli CFT073
agcugugccaggacuucaucacg

SEQ ID NO: 2595037 - RNA, 19 nt, Escherichia coli CFT073
agcuguggugcaauccaca

SEQ ID NO: 2595038 - RNA, 20 nt, Escherichia coli CFT073
agcuguucagauacaccauc

SEQ ID NO: 2595039 - RNA, 15 nt, Escherichia coli CFT073
agcuguuucaucuca

SEQ ID NO: 2595040 - RNA, 17 nt, Escherichia coli CFT073
agcuguuucaucucagu

SEQ ID NO: 2595041 - RNA, 20 nt, Escherichia coli CFT073
agcuguuucaucucagucag

SEQ ID NO: 2595042 - RNA, 18 nt, Escherichia coli CFT073
  misc_feature (5)..(5): n is a, c, g or u
agcungcaggauaaacgc

SEQ ID NO: 2595043 - RNA, 14 nt, Escherichia coli CFT073
agcuuaauucuguc

SEQ ID NO: 2595044 - RNA, 15 nt, Escherichia coli CFT073
agcuuacgcgccaga

SEQ ID NO: 2595045 - RNA, 15 nt, Escherichia coli CFT073
agcuuacguauuucg

SEQ ID NO: 2595046 - RNA, 14 nt, Escherichia coli CFT073
agcuuauccagcaa

SEQ ID NO: 2595047 - RNA, 21 nt, Escherichia coli CFT073
agcuuaucgcaggcuuccugg

SEQ ID NO: 2595048 - RNA, 20 nt, Escherichia coli CFT073
agcuuauuaacagucaguca

SEQ ID NO: 2595049 - RNA, 13 nt, Escherichia coli CFT073
agcuuauuguaca

SEQ ID NO: 2595050 - RNA, 12 nt, Escherichia coli CFT073
agcuucacccgc

SEQ ID NO: 2595051 - RNA, 18 nt, Escherichia coli CFT073
agcuucacccgcagcacg

SEQ ID NO: 2595052 - RNA, 22 nt, Escherichia coli CFT073
agcuucagaauauccggcacgu

SEQ ID NO: 2595053 - RNA, 20 nt, Escherichia coli CFT073
agcuucagauuagccgcagg

SEQ ID NO: 2595054 - RNA, 12 nt, Escherichia coli CFT073
agcuucagauug

SEQ ID NO: 2595055 - RNA, 16 nt, Escherichia coli CFT073
agcuuccagaauccgu

SEQ ID NO: 2595056 - RNA, 21 nt, Escherichia coli CFT073
agcuuccagccgguaauuuau

SEQ ID NO: 2595057 - RNA, 21 nt, Escherichia coli CFT073
agcuucgaauagagccuggcu

SEQ ID NO: 2595058 - RNA, 19 nt, Escherichia coli CFT073
agcuucgacuuccugcaau

SEQ ID NO: 2595059 - RNA, 15 nt, Escherichia coli CFT073
agcuucgaggccgga

SEQ ID NO: 2595060 - RNA, 19 nt, Escherichia coli CFT073
agcuucgccauuucgucgu

SEQ ID NO: 2595061 - RNA, 15 nt, Escherichia coli CFT073
agcuucgcuucccaa

SEQ ID NO: 2595062 - RNA, 21 nt, Escherichia coli CFT073
agcuucuucaaaaaagucaga

SEQ ID NO: 2595063 - RNA, 11 nt, Escherichia coli CFT073
agcuucuuccu

SEQ ID NO: 2595064 - RNA, 19 nt, Escherichia coli CFT073
agcuucuucuccagcugcg

SEQ ID NO: 2595065 - RNA, 14 nt, Escherichia coli CFT073
agcuugauuucagg

SEQ ID NO: 2595066 - RNA, 22 nt, Escherichia coli CFT073
agcuugccgucuucuucccaga

SEQ ID NO: 2595067 - RNA, 12 nt, Escherichia coli CFT073
agcuugccuuca

SEQ ID NO: 2595068 - RNA, 21 nt, Escherichia coli CFT073
agcuugccuucacaggccgcc

SEQ ID NO: 2595069 - RNA, 19 nt, Escherichia coli CFT073
agcuugcgacauacggcau

SEQ ID NO: 2595070 - RNA, 14 nt, Escherichia coli CFT073
agcuugcgauccug

SEQ ID NO: 2595071 - RNA, 18 nt, Escherichia coli CFT073
agcuugcgauccugcaga

SEQ ID NO: 2595072 - RNA, 23 nt, Escherichia coli CFT073
agcuugcugcaguuguuccugau

SEQ ID NO: 2595073 - RNA, 14 nt, Escherichia coli CFT073
aggcaaguuuccuc

SEQ ID NO: 2595074 - RNA, 15 nt, Escherichia coli CFT073
aggcaaucggcgcaa

SEQ ID NO: 2595075 - RNA, 21 nt, Escherichia coli CFT073
aggcaaucuguuuauuugaca

SEQ ID NO: 2595076 - RNA, 13 nt, Escherichia coli CFT073
aggcaauuaaaaa

SEQ ID NO: 2595077 - RNA, 14 nt, Escherichia coli CFT073
aggcaauucuuucc

SEQ ID NO: 2595078 - RNA, 22 nt, Escherichia coli CFT073
aggcaauucuuuccguuuucac

SEQ ID NO: 2595079 - RNA, 14 nt, Escherichia coli CFT073
aggcacaauggcca

SEQ ID NO: 2595080 - RNA, 19 nt, Escherichia coli CFT073
aggcacaauggccagcaca

SEQ ID NO: 2595081 - RNA, 14 nt, Escherichia coli CFT073
aggcacaccagcaa

SEQ ID NO: 2595082 - RNA, 14 nt, Escherichia coli CFT073
aggcacaccgccgc

SEQ ID NO: 2595083 - RNA, 14 nt, Escherichia coli CFT073
aggcacacugccag

SEQ ID NO: 2595084 - RNA, 14 nt, Escherichia coli CFT073
aggcaccagccccu

SEQ ID NO: 2595085 - RNA, 16 nt, Escherichia coli CFT073
aggcaccagccccugg

SEQ ID NO: 2595086 - RNA, 23 nt, Escherichia coli CFT073
aggcaccagccccuggaaaaaau

SEQ ID NO: 2595087 - RNA, 15 nt, Escherichia coli CFT073
aggcacgacacaaug

SEQ ID NO: 2595088 - RNA, 19 nt, Escherichia coli CFT073
aggcacgacacaaugccau

SEQ ID NO: 2595089 - RNA, 18 nt, Escherichia coli CFT073
aggcacuggccuuuucac

SEQ ID NO: 2595090 - RNA, 19 nt, Escherichia coli CFT073
aggcacuggccuuuucaca

SEQ ID NO: 2595091 - RNA, 16 nt, Escherichia coli CFT073
aggcacuuucgcgaau

SEQ ID NO: 2595092 - RNA, 21 nt, Escherichia coli CFT073
aggcagaaacaucauccccau

SEQ ID NO: 2595093 - RNA, 20 nt, Escherichia coli CFT073
aggcagaacaccggcagcgg

SEQ ID NO: 2595094 - RNA, 23 nt, Escherichia coli CFT073
aggcagaacaccggcagcgggau

SEQ ID NO: 2595095 - RNA, 14 nt, Escherichia coli CFT073
aggcagaacgccau

SEQ ID NO: 2595096 - RNA, 19 nt, Escherichia coli CFT073
aggcagagucaucucugcc

SEQ ID NO: 2595097 - RNA, 14 nt, Escherichia coli CFT073
aggcagauaaaaug

SEQ ID NO: 2595098 - RNA, 16 nt, Escherichia coli CFT073
aggcagauccaguuac

SEQ ID NO: 2595099 - RNA, 14 nt, Escherichia coli CFT073
aggcagcaaucacu

SEQ ID NO: 2595100 - RNA, 22 nt, Escherichia coli CFT073
aggcagcuuagaaaggaacaau

SEQ ID NO: 2595101 - RNA, 16 nt, Escherichia coli CFT073
aggcaggcaucaucag

SEQ ID NO: 2595102 - RNA, 21 nt, Escherichia coli CFT073
aggcaggcaucaucagauucu

SEQ ID NO: 2595103 - RNA, 15 nt, Escherichia coli CFT073
aggcagggcgaaacg

SEQ ID NO: 2595104 - RNA, 18 nt, Escherichia coli CFT073
aggcagucugcgcccugg

SEQ ID NO: 2595105 - RNA, 19 nt, Escherichia coli CFT073
aggcaguuuauccagccac

SEQ ID NO: 2595106 - RNA, 22 nt, Escherichia coli CFT073
aggcauaaagcugccuugccag

SEQ ID NO: 2595107 - RNA, 14 nt, Escherichia coli CFT073
aggcauagaaaaag

SEQ ID NO: 2595108 - RNA, 16 nt, Escherichia coli CFT073
aggcauagaaaaagaa

SEQ ID NO: 2595109 - RNA, 13 nt, Escherichia coli CFT073
aggcauauaugaa

SEQ ID NO: 2595110 - RNA, 14 nt, Escherichia coli CFT073
aggcauauaugaau

SEQ ID NO: 2595111 - RNA, 23 nt, Escherichia coli CFT073
aggcauauaugaauauugcugaa

SEQ ID NO: 2595112 - RNA, 13 nt, Escherichia coli CFT073
aggcaucagcaau

SEQ ID NO: 2595113 - RNA, 19 nt, Escherichia coli CFT073
aggcaucgcuaaucuggcg

SEQ ID NO: 2595114 - RNA, 16 nt, Escherichia coli CFT073
aggcaucggcaacgaa

SEQ ID NO: 2595115 - RNA, 18 nt, Escherichia coli CFT073
aggcaucgggaauggcau

SEQ ID NO: 2595116 - RNA, 16 nt, Escherichia coli CFT073
aggcaucuucuucauu

SEQ ID NO: 2595117 - RNA, 14 nt, Escherichia coli CFT073
aggcaucuuuuuca

SEQ ID NO: 2595118 - RNA, 18 nt, Escherichia coli CFT073
aggccaaaagcuaacagc

SEQ ID NO: 2595119 - RNA, 20 nt, Escherichia coli CFT073
aggccaaacagcgugccgcg

SEQ ID NO: 2595120 - RNA, 16 nt, Escherichia coli CFT073
aggccaacauccauca

SEQ ID NO: 2595121 - RNA, 17 nt, Escherichia coli CFT073
aggccaacauccaucag

SEQ ID NO: 2595122 - RNA, 14 nt, Escherichia coli CFT073
aggccaaccgccca

SEQ ID NO: 2595123 - RNA, 20 nt, Escherichia coli CFT073
aggccaccucgcaacaaugu

SEQ ID NO: 2595124 - RNA, 14 nt, Escherichia coli CFT073
aggccacgaaucag

SEQ ID NO: 2595125 - RNA, 15 nt, Escherichia coli CFT073
aggccacggugguuc

SEQ ID NO: 2595126 - RNA, 12 nt, Escherichia coli CFT073
aggccagauaaa

SEQ ID NO: 2595127 - RNA, 15 nt, Escherichia coli CFT073
aggccagauaaaaca

SEQ ID NO: 2595128 - RNA, 19 nt, Escherichia coli CFT073
aggccagauaaaacacauc

SEQ ID NO: 2595129 - RNA, 16 nt, Escherichia coli CFT073
aggccagcaaucccca

SEQ ID NO: 2595130 - RNA, 18 nt, Escherichia coli CFT073
aggccagccagaagaaaa

SEQ ID NO: 2595131 - RNA, 17 nt, Escherichia coli CFT073
aggccagccugauccac

SEQ ID NO: 2595132 - RNA, 17 nt, Escherichia coli CFT073
aggccaggguaaaaacc

SEQ ID NO: 2595133 - RNA, 21 nt, Escherichia coli CFT073
aggccaggguaaaaaccaggg

SEQ ID NO: 2595134 - RNA, 22 nt, Escherichia coli CFT073
aggccagguuuucuuucaccuc

SEQ ID NO: 2595135 - RNA, 15 nt, Escherichia coli CFT073
aggccaguauuucau

SEQ ID NO: 2595136 - RNA, 15 nt, Escherichia coli CFT073
aggccauauuucaca

SEQ ID NO: 2595137 - RNA, 15 nt, Escherichia coli CFT073
aggccaucgccaccg

SEQ ID NO: 2595138 - RNA, 19 nt, Escherichia coli CFT073
aggccauuugcucuaccag

SEQ ID NO: 2595139 - RNA, 20 nt, Escherichia coli CFT073
aggccauuuuuucgauaauc

SEQ ID NO: 2595140 - RNA, 17 nt, Escherichia coli CFT073
aggcccagccgugaaug

SEQ ID NO: 2595141 - RNA, 18 nt, Escherichia coli CFT073
aggccccaucgaaucaaa

SEQ ID NO: 2595142 - RNA, 16 nt, Escherichia coli CFT073
aggccccgucagcaaa

SEQ ID NO: 2595143 - RNA, 18 nt, Escherichia coli CFT073
aggccccgucagcaaaau

SEQ ID NO: 2595144 - RNA, 16 nt, Escherichia coli CFT073
aggcccgucacgcagu

SEQ ID NO: 2595145 - RNA, 14 nt, Escherichia coli CFT073
aggccgaguagcca

SEQ ID NO: 2595146 - RNA, 15 nt, Escherichia coli CFT073
aggccgaguagccag

SEQ ID NO: 2595147 - RNA, 20 nt, Escherichia coli CFT073
aggccgcaugugcccccugc

SEQ ID NO: 2595148 - RNA, 23 nt, Escherichia coli CFT073
aggccgccaguguuggcgucaga

SEQ ID NO: 2595149 - RNA, 22 nt, Escherichia coli CFT073
aggccgccgucaucacgcaggc

SEQ ID NO: 2595150 - RNA, 13 nt, Escherichia coli CFT073
aggccgcuguuuu

SEQ ID NO: 2595151 - RNA, 16 nt, Escherichia coli CFT073
aggccggagccagucg

SEQ ID NO: 2595152 - RNA, 23 nt, Escherichia coli CFT073
aggccggauaagauacgccagca

SEQ ID NO: 2595153 - RNA, 23 nt, Escherichia coli CFT073
aggccggauaagaugcgccagca

SEQ ID NO: 2595154 - RNA, 17 nt, Escherichia coli CFT073
aggccggauaaggcguu

SEQ ID NO: 2595155 - RNA, 11 nt, Escherichia coli CFT073
aggccggugcu

SEQ ID NO: 2595156 - RNA, 18 nt, Escherichia coli CFT073
aggccggugcugcuaccg

SEQ ID NO: 2595157 - RNA, 17 nt, Escherichia coli CFT073
aggccguacagcccagg

SEQ ID NO: 2595158 - RNA, 22 nt, Escherichia coli CFT073
aggccgucgcguagcaccacgg

SEQ ID NO: 2595159 - RNA, 15 nt, Escherichia coli CFT073
aggccgugcaguuug

SEQ ID NO: 2595160 - RNA, 16 nt, Escherichia coli CFT073
aggccuaacaccauca

SEQ ID NO: 2595161 - RNA, 17 nt, Escherichia coli CFT073
aggccuaaugucguggu

SEQ ID NO: 2595162 - RNA, 16 nt, Escherichia coli CFT073
aggccuacaaaggcac

SEQ ID NO: 2595163 - RNA, 19 nt, Escherichia coli CFT073
aggccuacaauuucaguga

SEQ ID NO: 2595164 - RNA, 20 nt, Escherichia coli CFT073
aggccuacauagccccugca

SEQ ID NO: 2595165 - RNA, 21 nt, Escherichia coli CFT073
aggccuacauuggugccggau

SEQ ID NO: 2595166 - RNA, 16 nt, Escherichia coli CFT073
aggccuacuaccagua

SEQ ID NO: 2595167 - RNA, 12 nt, Escherichia coli CFT073
aggccucuccuc

SEQ ID NO: 2595168 - RNA, 15 nt, Escherichia coli CFT073
aggccugauaagaca

SEQ ID NO: 2595169 - RNA, 18 nt, Escherichia coli CFT073
aggccugauaagacgcaa

SEQ ID NO: 2595170 - RNA, 20 nt, Escherichia coli CFT073
aggccugauaagacgcaacc

SEQ ID NO: 2595171 - RNA, 15 nt, Escherichia coli CFT073
aggccugaucagcga

SEQ ID NO: 2595172 - RNA, 21 nt, Escherichia coli CFT073
aggccugauuaaacgccugau

SEQ ID NO: 2595173 - RNA, 19 nt, Escherichia coli CFT073
aggccugcaaaaucuguug

SEQ ID NO: 2595174 - RNA, 17 nt, Escherichia coli CFT073
aggcgaagacaaaacca

SEQ ID NO: 2595175 - RNA, 18 nt, Escherichia coli CFT073
aggcgaauguacgucagg

SEQ ID NO: 2595176 - RNA, 21 nt, Escherichia coli CFT073
aggcgacauaucauuuugcug

SEQ ID NO: 2595177 - RNA, 17 nt, Escherichia coli CFT073
aggcgaccguuuucacc

SEQ ID NO: 2595178 - RNA, 12 nt, Escherichia coli CFT073
aggcgacgguuu

SEQ ID NO: 2595179 - RNA, 19 nt, Escherichia coli CFT073
aggcgacgguuuccaggca

SEQ ID NO: 2595180 - RNA, 21 nt, Escherichia coli CFT073
aggcgauaauuuuucgauaac

SEQ ID NO: 2595181 - RNA, 19 nt, Escherichia coli CFT073
agggugacagcaggaaaau

SEQ ID NO: 2595182 - RNA, 20 nt, Escherichia coli CFT073
agggugacaucaaucagcgg

SEQ ID NO: 2595183 - RNA, 18 nt, Escherichia coli CFT073
aggguggcgucaaaaagc

SEQ ID NO: 2595184 - RNA, 16 nt, Escherichia coli CFT073
aggguggggaaaaaac

SEQ ID NO: 2595185 - RNA, 14 nt, Escherichia coli CFT073
aggguuacgcgcag

SEQ ID NO: 2595186 - RNA, 22 nt, Escherichia coli CFT073
aggguuauuuguucagcaaaug

SEQ ID NO: 2595187 - RNA, 17 nt, Escherichia coli CFT073
aggguuuaauaaucgca

SEQ ID NO: 2595188 - RNA, 23 nt, Escherichia coli CFT073
aggguuucgacggcaccaaaaau

SEQ ID NO: 2595189 - RNA, 23 nt, Escherichia coli CFT073
aggguuucuucaaacugcagcag

SEQ ID NO: 2595190 - RNA, 13 nt, Escherichia coli CFT073
agguaaaacaagu

SEQ ID NO: 2595191 - RNA, 13 nt, Escherichia coli CFT073
agguaaaucagac

SEQ ID NO: 2595192 - RNA, 17 nt, Escherichia coli CFT073
agguaacucucaugcuu

SEQ ID NO: 2595193 - RNA, 22 nt, Escherichia coli CFT073
agguaauauugcguaccugcau

SEQ ID NO: 2595194 - RNA, 20 nt, Escherichia coli CFT073
agguaaugcgcgagccauaa

SEQ ID NO: 2595195 - RNA, 18 nt, Escherichia coli CFT073
agguaauggcguuaucac

SEQ ID NO: 2595196 - RNA, 12 nt, Escherichia coli CFT073
agguacaaagcc

SEQ ID NO: 2595197 - RNA, 14 nt, Escherichia coli CFT073
agguacaaagccaa

SEQ ID NO: 2595198 - RNA, 19 nt, Escherichia coli CFT073
agguacaaagccaacagca

SEQ ID NO: 2595199 - RNA, 18 nt, Escherichia coli CFT073
agguaccgcaaugcagaa

SEQ ID NO: 2595200 - RNA, 18 nt, Escherichia coli CFT073
agguacgcaggcggcugg

SEQ ID NO: 2595201 - RNA, 22 nt, Escherichia coli CFT073
agguagacaccaaggaacugug

SEQ ID NO: 2595202 - RNA, 22 nt, Escherichia coli CFT073
agguagcguuucaccucuuuca

SEQ ID NO: 2595203 - RNA, 21 nt, Escherichia coli CFT073
agguagcuuaucgcaggcuuc

SEQ ID NO: 2595204 - RNA, 21 nt, Escherichia coli CFT073
agguagugcuucuaaaggaag

SEQ ID NO: 2595205 - RNA, 17 nt, Escherichia coli CFT073
agguaguuaaucaguac

SEQ ID NO: 2595206 - RNA, 15 nt, Escherichia coli CFT073
agguaguugccagca

SEQ ID NO: 2595207 - RNA, 12 nt, Escherichia coli CFT073
agguauccagac

SEQ ID NO: 2595208 - RNA, 18 nt, Escherichia coli CFT073
agguaucgcgaaaaaaaa

SEQ ID NO: 2595209 - RNA, 21 nt, Escherichia coli CFT073
agguaucgcgaaaaaaaagau

SEQ ID NO: 2595210 - RNA, 16 nt, Escherichia coli CFT073
agguauucagaaccgc

SEQ ID NO: 2595211 - RNA, 21 nt, Escherichia coli CFT073
agguauugcuaagcucucagc

SEQ ID NO: 2595212 - RNA, 22 nt, Escherichia coli CFT073
agguauugcuaagcucucagca

SEQ ID NO: 2595213 - RNA, 17 nt, Escherichia coli CFT073
agguauuucgucuaagc

SEQ ID NO: 2595214 - RNA, 13 nt, Escherichia coli CFT073
agguauuuuguca

SEQ ID NO: 2595215 - RNA, 15 nt, Escherichia coli CFT073
aggucaaagaaucaa

SEQ ID NO: 2595216 - RNA, 13 nt, Escherichia coli CFT073
aggucaaugcaac

SEQ ID NO: 2595217 - RNA, 18 nt, Escherichia coli CFT073
aggucaccagagauaaaa

SEQ ID NO: 2595218 - RNA, 13 nt, Escherichia coli CFT073
aggucagagagcc

SEQ ID NO: 2595219 - RNA, 20 nt, Escherichia coli CFT073
aggucaggaauagcgaaccg

SEQ ID NO: 2595220 - RNA, 15 nt, Escherichia coli CFT073
aggucauaucaucaa

SEQ ID NO: 2595221 - RNA, 15 nt, Escherichia coli CFT073
aggucauaucuuugc

SEQ ID NO: 2595222 - RNA, 16 nt, Escherichia coli CFT073
aggucaucacauccca

SEQ ID NO: 2595223 - RNA, 14 nt, Escherichia coli CFT073
aggucaucgcaucg

SEQ ID NO: 2595224 - RNA, 16 nt, Escherichia coli CFT073
agguccauaaaccgug

SEQ ID NO: 2595225 - RNA, 19 nt, Escherichia coli CFT073
agguccuguaaguuuggaa

SEQ ID NO: 2595226 - RNA, 15 nt, Escherichia coli CFT073
aggucgaaaauaauc

SEQ ID NO: 2595227 - RNA, 21 nt, Escherichia coli CFT073
aggucgaaccggaaauccagg

SEQ ID NO: 2595228 - RNA, 21 nt, Escherichia coli CFT073
aggucgacaguagccccgcgg

SEQ ID NO: 2595229 - RNA, 21 nt, Escherichia coli CFT073
aggucgcaaaggccagccagg

SEQ ID NO: 2595230 - RNA, 22 nt, Escherichia coli CFT073
aggucgcccccggcagugauca

SEQ ID NO: 2595231 - RNA, 13 nt, Escherichia coli CFT073
aggucgugccaga

SEQ ID NO: 2595232 - RNA, 22 nt, Escherichia coli CFT073
aggucuuuucucguuaccagcg

SEQ ID NO: 2595233 - RNA, 14 nt, Escherichia coli CFT073
aggugaaaaauaaa

SEQ ID NO: 2595234 - RNA, 15 nt, Escherichia coli CFT073
aggugaaaaauaaaa

SEQ ID NO: 2595235 - RNA, 12 nt, Escherichia coli CFT073
aggugaacgcca

SEQ ID NO: 2595236 - RNA, 15 nt, Escherichia coli CFT073
aggugaccaaagaag

SEQ ID NO: 2595237 - RNA, 14 nt, Escherichia coli CFT073
aggugauacaucaa

SEQ ID NO: 2595238 - RNA, 15 nt, Escherichia coli CFT073
aggugauucccagca

SEQ ID NO: 2595239 - RNA, 18 nt, Escherichia coli CFT073
aggugauucccagcaaca

SEQ ID NO: 2595240 - RNA, 23 nt, Escherichia coli CFT073
aggugauuugcgccugcuuaaca

SEQ ID NO: 2595241 - RNA, 14 nt, Escherichia coli CFT073
aggugcauugaagg

SEQ ID NO: 2595242 - RNA, 18 nt, Escherichia coli CFT073
aggugcauugaaggcaau

SEQ ID NO: 2595243 - RNA, 14 nt, Escherichia coli CFT073
aggugccacagcag

SEQ ID NO: 2595244 - RNA, 12 nt, Escherichia coli CFT073
aggugcccgcgu

SEQ ID NO: 2595245 - RNA, 17 nt, Escherichia coli CFT073
aggugcguuuuacgacu

SEQ ID NO: 2595246 - RNA, 18 nt, Escherichia coli CFT073
agguggcaaacgccaccu

SEQ ID NO: 2595247 - RNA, 21 nt, Escherichia coli CFT073
agguggcaaaucgacgccacu

SEQ ID NO: 2595248 - RNA, 17 nt, Escherichia coli CFT073
agguggccgagaggcug

SEQ ID NO: 2595249 - RNA, 15 nt, Escherichia coli CFT073
agguggggcuuuucu

SEQ ID NO: 2595250 - RNA, 15 nt, Escherichia coli CFT073
aggugguguugacga

SEQ ID NO: 2595251 - RNA, 21 nt, Escherichia coli CFT073
aggugugaaaccuuuaugcag

SEQ ID NO: 2595252 - RNA, 17 nt, Escherichia coli CFT073
agguuaaaguacucuuu

SEQ ID NO: 2595253 - RNA, 14 nt, Escherichia coli CFT073
agguuaacccacag

SEQ ID NO: 2595254 - RNA, 16 nt, Escherichia coli CFT073
agguuaacccacagcg

SEQ ID NO: 2595255 - RNA, 13 nt, Escherichia coli CFT073
agguuaauauuuu

SEQ ID NO: 2595256 - RNA, 18 nt, Escherichia coli CFT073
agguuacggucgccguaa

SEQ ID NO: 2595257 - RNA, 22 nt, Escherichia coli CFT073
agguuagaaacgccccagcggc

SEQ ID NO: 2595258 - RNA, 15 nt, Escherichia coli CFT073
agguuagugacauag

SEQ ID NO: 2595259 - RNA, 13 nt, Escherichia coli CFT073
agguuauaaaccc

SEQ ID NO: 2595260 - RNA, 17 nt, Escherichia coli CFT073
agguuauaaacccccug

SEQ ID NO: 2595261 - RNA, 17 nt, Escherichia coli CFT073
agguuaugcaaacgcaa

SEQ ID NO: 2595262 - RNA, 15 nt, Escherichia coli CFT073
agguucaaccgcagc

SEQ ID NO: 2595263 - RNA, 13 nt, Escherichia coli CFT073
agguucagccgag

SEQ ID NO: 2595264 - RNA, 22 nt, Escherichia coli CFT073
agguuccggcaaucaacagaua

SEQ ID NO: 2595265 - RNA, 14 nt, Escherichia coli CFT073
agguucgaaucccg

SEQ ID NO: 2595266 - RNA, 18 nt, Escherichia coli CFT073
agguucugaccagccagc

SEQ ID NO: 2595267 - RNA, 14 nt, Escherichia coli CFT073
agguugaggaacuu

SEQ ID NO: 2595268 - RNA, 18 nt, Escherichia coli CFT073
agguugccggucuuucuu

SEQ ID NO: 2595269 - RNA, 16 nt, Escherichia coli CFT073
agguugguaucgcaca

SEQ ID NO: 2595270 - RNA, 19 nt, Escherichia coli CFT073
agguuguacccaacgcgau

SEQ ID NO: 2595271 - RNA, 20 nt, Escherichia coli CFT073
agguugucgaguagaaagag

SEQ ID NO: 2595272 - RNA, 14 nt, Escherichia coli CFT073
agguugugaaugag

SEQ ID NO: 2595273 - RNA, 17 nt, Escherichia coli CFT073
agguuuaaccaucaggc

SEQ ID NO: 2595274 - RNA, 15 nt, Escherichia coli CFT073
agguuuaccagcagc

SEQ ID NO: 2595275 - RNA, 16 nt, Escherichia coli CFT073
agguuuaccagcagcc

SEQ ID NO: 2595276 - RNA, 19 nt, Escherichia coli CFT073
agguuuaccagcagcccug

SEQ ID NO: 2595277 - RNA, 20 nt, Escherichia coli CFT073
agguuucacguaccagaugc

SEQ ID NO: 2595278 - RNA, 23 nt, Escherichia coli CFT073
agguuucaguaacaucacaugcu

SEQ ID NO: 2595279 - RNA, 21 nt, Escherichia coli CFT073
agguuuuagcaugcaggcugg

SEQ ID NO: 2595280 - RNA, 16 nt, Escherichia coli CFT073
agguuuuaguuucgcc

SEQ ID NO: 2595281 - RNA, 13 nt, Escherichia coli CFT073
agguuuuccuucg

SEQ ID NO: 2595282 - RNA, 20 nt, Escherichia coli CFT073
agguuuuguagcuaaacuga

SEQ ID NO: 2595283 - RNA, 13 nt, Escherichia coli CFT073
agguuuuucagcu

SEQ ID NO: 2595284 - RNA, 19 nt, Escherichia coli CFT073
agguuuuucagcugcccac

SEQ ID NO: 2595285 - RNA, 12 nt, Escherichia coli CFT073
agguuuuuuccu

SEQ ID NO: 2595286 - RNA, 12 nt, Escherichia coli CFT073
aguaaaaaaaca

SEQ ID NO: 2595287 - RNA, 16 nt, Escherichia coli CFT073
aguaaaaaaacaucau

SEQ ID NO: 2595288 - RNA, 17 nt, Escherichia coli CFT073
aguaaaaaaacaucaua

SEQ ID NO: 2595289 - RNA, 14 nt, Escherichia coli CFT073
aguaaaacugcauu

SEQ ID NO: 2595290 - RNA, 14 nt, Escherichia coli CFT073
aguagagcgaaacg

SEQ ID NO: 2595291 - RNA, 20 nt, Escherichia coli CFT073
aguagcaaaguggcgcagag

SEQ ID NO: 2595292 - RNA, 14 nt, Escherichia coli CFT073
aguagcaugaagua

SEQ ID NO: 2595293 - RNA, 20 nt, Escherichia coli CFT073
aguagcaugaaguaacagaa

SEQ ID NO: 2595294 - RNA, 21 nt, Escherichia coli CFT073
aguagcaugaaguaacagaag

SEQ ID NO: 2595295 - RNA, 19 nt, Escherichia coli CFT073
aguagccacgcgacauaaa

SEQ ID NO: 2595296 - RNA, 14 nt, Escherichia coli CFT073
aguagccagcugcc

SEQ ID NO: 2595297 - RNA, 20 nt, Escherichia coli CFT073
aguagccagcugccugccag

SEQ ID NO: 2595298 - RNA, 18 nt, Escherichia coli CFT073
aguagcgcagcagauaaa

SEQ ID NO: 2595299 - RNA, 20 nt, Escherichia coli CFT073
aguagcgcagcagauaaaag

SEQ ID NO: 2595300 - RNA, 22 nt, Escherichia coli CFT073
aguagcgccagacugacaauca

SEQ ID NO: 2595301 - RNA, 16 nt, Escherichia coli CFT073
aguagcgucgccagca

SEQ ID NO: 2595302 - RNA, 19 nt, Escherichia coli CFT073
aguagcgucgccagcaguu

SEQ ID NO: 2595303 - RNA, 15 nt, Escherichia coli CFT073
aguagcucaccagca

SEQ ID NO: 2595304 - RNA, 22 nt, Escherichia coli CFT073
aguagcucaccagcaggcacuu

SEQ ID NO: 2595305 - RNA, 17 nt, Escherichia coli CFT073
aguagcuugaaaucacc

SEQ ID NO: 2595306 - RNA, 17 nt, Escherichia coli CFT073
aguagguagaauauuuu

SEQ ID NO: 2595307 - RNA, 22 nt, Escherichia coli CFT073
aguaguaaugaucacuggaaga

SEQ ID NO: 2595308 - RNA, 20 nt, Escherichia coli CFT073
aguaguacgcgggaauagcu

SEQ ID NO: 2595309 - RNA, 21 nt, Escherichia coli CFT073
aguaguacgcgggaauagcuc

SEQ ID NO: 2595310 - RNA, 19 nt, Escherichia coli CFT073
aguaguggaaaccggcauc

SEQ ID NO: 2595311 - RNA, 13 nt, Escherichia coli CFT073
aguaguggaugaa

SEQ ID NO: 2595312 - RNA, 15 nt, Escherichia coli CFT073
aguaguucauccccu

SEQ ID NO: 2595313 - RNA, 14 nt, Escherichia coli CFT073
aguaguugcucaag

SEQ ID NO: 2595314 - RNA, 14 nt, Escherichia coli CFT073
aguaguuugguuaa

SEQ ID NO: 2595315 - RNA, 16 nt, Escherichia coli CFT073
aguauauauucgucca

SEQ ID NO: 2595316 - RNA, 13 nt, Escherichia coli CFT073
aguauauugcuga

SEQ ID NO: 2595317 - RNA, 13 nt, Escherichia coli CFT073
aguaucaccaacu

SEQ ID NO: 2595318 - RNA, 18 nt, Escherichia coli CFT073
aguaucgaaaacaucaaa

SEQ ID NO: 2595319 - RNA, 18 nt, Escherichia coli CFT073
aguaucguaaucagcacc

SEQ ID NO: 2595320 - RNA, 22 nt, Escherichia coli CFT073
aguaucguguccggcaauaaac

SEQ ID NO: 2595321 - RNA, 19 nt, Escherichia coli CFT073
aguaugacgaguauauucu

SEQ ID NO: 2595322 - RNA, 13 nt, Escherichia coli CFT073
aguaugaucuugc

SEQ ID NO: 2595323 - RNA, 16 nt, Escherichia coli CFT073
aguauguauacaaaau

SEQ ID NO: 2595324 - RNA, 21 nt, Escherichia coli CFT073
aguauucgucgcaccacuuuu

SEQ ID NO: 2595325 - RNA, 20 nt, Escherichia coli CFT073
aguauuuccagcucaaccag

SEQ ID NO: 2595326 - RNA, 16 nt, Escherichia coli CFT073
agucaacauauuaaaa

SEQ ID NO: 2595327 - RNA, 17 nt, Escherichia coli CFT073
agucaaccgccugaauu

SEQ ID NO: 2595328 - RNA, 18 nt, Escherichia coli CFT073
agucaaggaaugaaauau

SEQ ID NO: 2595329 - RNA, 23 nt, Escherichia coli CFT073
agucaaggaaugaaauauuaucu

SEQ ID NO: 2595330 - RNA, 15 nt, Escherichia coli CFT073
agucaauaauauccg

SEQ ID NO: 2595331 - RNA, 14 nt, Escherichia coli CFT073
agucaauauucaau

SEQ ID NO: 2595332 - RNA, 23 nt, Escherichia coli CFT073
agucaaugaaauuacuuuccauc

SEQ ID NO: 2595333 - RNA, 17 nt, Escherichia coli CFT073
agucacaaaauaaguau

SEQ ID NO: 2595334 - RNA, 16 nt, Escherichia coli CFT073
agucaccaaagaagcg

SEQ ID NO: 2595335 - RNA, 19 nt, Escherichia coli CFT073
agucacccgauaaauaaua

SEQ ID NO: 2595336 - RNA, 14 nt, Escherichia coli CFT073
agucaccugcccuc

SEQ ID NO: 2595337 - RNA, 19 nt, Escherichia coli CFT073
agucaccugcggugcagcc

SEQ ID NO: 2595338 - RNA, 21 nt, Escherichia coli CFT073
agucacugccaccauccccac

SEQ ID NO: 2595339 - RNA, 15 nt, Escherichia coli CFT073
agucacuuccugauc

SEQ ID NO: 2595340 - RNA, 16 nt, Escherichia coli CFT073
agucacuuuuuuuccg

SEQ ID NO: 2595341 - RNA, 19 nt, Escherichia coli CFT073
agucagaugcugugcaauc

SEQ ID NO: 2595342 - RNA, 17 nt, Escherichia coli CFT073
agucagcaaugccagag

SEQ ID NO: 2595343 - RNA, 18 nt, Escherichia coli CFT073
agucagcgaacaccagca

SEQ ID NO: 2595344 - RNA, 16 nt, Escherichia coli CFT073
agucagcgcgaaaucg

SEQ ID NO: 2595345 - RNA, 17 nt, Escherichia coli CFT073
agucagcguuauagcgc

SEQ ID NO: 2595346 - RNA, 13 nt, Escherichia coli CFT073
agucaggaagccc

SEQ ID NO: 2595347 - RNA, 15 nt, Escherichia coli CFT073
agucaggggcuucca

SEQ ID NO: 2595348 - RNA, 21 nt, Escherichia coli CFT073
agucaggggcuuccagcaaau

SEQ ID NO: 2595349 - RNA, 16 nt, Escherichia coli CFT073
agucagggucuggugc

SEQ ID NO: 2595350 - RNA, 21 nt, Escherichia coli CFT073
agucagguauuuugucagccc

SEQ ID NO: 2595351 - RNA, 17 nt, Escherichia coli CFT073
agucaguauuuucccug

SEQ ID NO: 2595352 - RNA, 18 nt, Escherichia coli CFT073
agucagucacaggggagg

SEQ ID NO: 2595353 - RNA, 20 nt, Escherichia coli CFT073
agucagugaagccauuaccg

SEQ ID NO: 2595354 - RNA, 14 nt, Escherichia coli CFT073
agucaguucacgcg

SEQ ID NO: 2595355 - RNA, 18 nt, Escherichia coli CFT073
agucauaacguucagcac

SEQ ID NO: 2595356 - RNA, 21 nt, Escherichia coli CFT073
agucauacuuauugaaagcaa

SEQ ID NO: 2595357 - RNA, 16 nt, Escherichia coli CFT073
agucaucacuuucaga

SEQ ID NO: 2595358 - RNA, 20 nt, Escherichia coli CFT073
agucaucacuuucagaccgc

SEQ ID NO: 2595359 - RNA, 13 nt, Escherichia coli CFT073
agucaucgggcgu

SEQ ID NO: 2595360 - RNA, 20 nt, Escherichia coli CFT073
agucaucgggcguuuucuug

SEQ ID NO: 2595361 - RNA, 15 nt, Escherichia coli CFT073
agucauuacucaucc

SEQ ID NO: 2595362 - RNA, 16 nt, Escherichia coli CFT073
agucauuaugcuggaa

SEQ ID NO: 2595363 - RNA, 15 nt, Escherichia coli CFT073
agucauuccugcccc

SEQ ID NO: 2595364 - RNA, 20 nt, Escherichia coli CFT073
agucauuguaaauugcagua

SEQ ID NO: 2595365 - RNA, 21 nt, Escherichia coli CFT073
agucauuguaaauugcaguac

SEQ ID NO: 2595366 - RNA, 16 nt, Escherichia coli CFT073
aguccacaucaaccag

SEQ ID NO: 2595367 - RNA, 16 nt, Escherichia coli CFT073
aguccaccuggccugc

SEQ ID NO: 2595368 - RNA, 18 nt, Escherichia coli CFT073
aguccaccuggccugcga

SEQ ID NO: 2595369 - RNA, 20 nt, Escherichia coli CFT073
aguccagcaccgucaccggu

SEQ ID NO: 2595370 - RNA, 22 nt, Escherichia coli CFT073
aguccagccccgcgcggcgcag

SEQ ID NO: 2595371 - RNA, 14 nt, Escherichia coli CFT073
aguccaggccugau

SEQ ID NO: 2595372 - RNA, 17 nt, Escherichia coli CFT073
aguccaggccugauuaa

SEQ ID NO: 2595373 - RNA, 15 nt, Escherichia coli CFT073
aguccaucggcauua

SEQ ID NO: 2595374 - RNA, 17 nt, Escherichia coli CFT073
aguccauggcagaugau

SEQ ID NO: 2595375 - RNA, 15 nt, Escherichia coli CFT073
agucccaaacagcag

SEQ ID NO: 2595376 - RNA, 17 nt, Escherichia coli CFT073
agucccaaacagcagaa

SEQ ID NO: 2595377 - RNA, 21 nt, Escherichia coli CFT073
agucccaucuucugaaucaga

SEQ ID NO: 2595378 - RNA, 13 nt, Escherichia coli CFT073
agucccguaccca

SEQ ID NO: 2595379 - RNA, 14 nt, Escherichia coli CFT073
agucccuccgcaca

SEQ ID NO: 2595380 - RNA, 23 nt, Escherichia coli CFT073
agucccuccgcacaaacgccacc

SEQ ID NO: 2595381 - RNA, 17 nt, Escherichia coli CFT073
agucccuuucaggucag

SEQ ID NO: 2595382 - RNA, 12 nt, Escherichia coli CFT073
aguccgccagaa

SEQ ID NO: 2595383 - RNA, 23 nt, Escherichia coli CFT073
aguccgccagaauacccgaagcg

SEQ ID NO: 2595384 - RNA, 19 nt, Escherichia coli CFT073
aguccgccauuauuaccga

SEQ ID NO: 2595385 - RNA, 17 nt, Escherichia coli CFT073
aguccggcaccagcgcu

SEQ ID NO: 2595386 - RNA, 23 nt, Escherichia coli CFT073
aguccgucguucaacaagccacg

SEQ ID NO: 2595387 - RNA, 22 nt, Escherichia coli CFT073
aguccguggcacgguaaacucc

SEQ ID NO: 2595388 - RNA, 13 nt, Escherichia coli CFT073
aguccugccagaa

SEQ ID NO: 2595389 - RNA, 18 nt, Escherichia coli CFT073
agucgcaaaacucaccuu

SEQ ID NO: 2595390 - RNA, 20 nt, Escherichia coli CFT073
agucgcaaaucagcggcaga

SEQ ID NO: 2595391 - RNA, 14 nt, Escherichia coli CFT073
agucgccagcucug

SEQ ID NO: 2595392 - RNA, 20 nt, Escherichia coli CFT073
agucgcccaaacgcccagau

SEQ ID NO: 2595393 - RNA, 16 nt, Escherichia coli CFT073
agucgccuaccaucaa

SEQ ID NO: 2595394 - RNA, 19 nt, Escherichia coli CFT073
agucgcgcucaucagcggc

SEQ ID NO: 2595395 - RNA, 21 nt, Escherichia coli CFT073
agucgcgcucaucagcggcga

SEQ ID NO: 2595396 - RNA, 21 nt, Escherichia coli CFT073
agucgcggaauauccaguaac

SEQ ID NO: 2595397 - RNA, 16 nt, Escherichia coli CFT073
agucgcugaucaccgu

SEQ ID NO: 2595398 - RNA, 23 nt, Escherichia coli CFT073
agugcgcaguugccggaugcggc

SEQ ID NO: 2595399 - RNA, 16 nt, Escherichia coli CFT073
agugcgcccaggaagg

SEQ ID NO: 2595400 - RNA, 17 nt, Escherichia coli CFT073
agugcgcgaaccagaga

SEQ ID NO: 2595401 - RNA, 17 nt, Escherichia coli CFT073
agugcgcucuucaacuu

SEQ ID NO: 2595402 - RNA, 19 nt, Escherichia coli CFT073
agugcggcgagcaucgccc

SEQ ID NO: 2595403 - RNA, 21 nt, Escherichia coli CFT073
agugcggcuguuggugccaga

SEQ ID NO: 2595404 - RNA, 21 nt, Escherichia coli CFT073
agugcgggcgagaggaauuua

SEQ ID NO: 2595405 - RNA, 16 nt, Escherichia coli CFT073
agugcgguaaauuuuu

SEQ ID NO: 2595406 - RNA, 18 nt, Escherichia coli CFT073
agugcggugccgcgaacg

SEQ ID NO: 2595407 - RNA, 16 nt, Escherichia coli CFT073
agugcguaagcgcgga

SEQ ID NO: 2595408 - RNA, 20 nt, Escherichia coli CFT073
agugcugcauccugcaccac

SEQ ID NO: 2595409 - RNA, 23 nt, Escherichia coli CFT073
agugcugcuggaaaagguaagga

SEQ ID NO: 2595410 - RNA, 14 nt, Escherichia coli CFT073
agugcugggcuggg

SEQ ID NO: 2595411 - RNA, 16 nt, Escherichia coli CFT073
agugcuuucagcgaaa

SEQ ID NO: 2595412 - RNA, 18 nt, Escherichia coli CFT073
agugcuuucagcgaaaaa

SEQ ID NO: 2595413 - RNA, 17 nt, Escherichia coli CFT073
agugcuuucauuucagc

SEQ ID NO: 2595414 - RNA, 21 nt, Escherichia coli CFT073
aguggaaauccccaucagguu

SEQ ID NO: 2595415 - RNA, 23 nt, Escherichia coli CFT073
aguggaauaucccauuucuccac

SEQ ID NO: 2595416 - RNA, 14 nt, Escherichia coli CFT073
aguggaaucaucac

SEQ ID NO: 2595417 - RNA, 17 nt, Escherichia coli CFT073
aguggagccaucaccau

SEQ ID NO: 2595418 - RNA, 18 nt, Escherichia coli CFT073
aguggauauccuggucaa

SEQ ID NO: 2595419 - RNA, 15 nt, Escherichia coli CFT073
aguggaugcgccaua

SEQ ID NO: 2595420 - RNA, 14 nt, Escherichia coli CFT073
aguggauuaucuuc

SEQ ID NO: 2595421 - RNA, 14 nt, Escherichia coli CFT073
aguggcgcgccugu

SEQ ID NO: 2595422 - RNA, 20 nt, Escherichia coli CFT073
aguggcggcauugacaucag

SEQ ID NO: 2595423 - RNA, 23 nt, Escherichia coli CFT073
aguggcuaagcaggcuggcgacg

SEQ ID NO: 2595424 - RNA, 17 nt, Escherichia coli CFT073
aguggcucaggcucuca

SEQ ID NO: 2595425 - RNA, 18 nt, Escherichia coli CFT073
aguggcuccaugugaguc

SEQ ID NO: 2595426 - RNA, 19 nt, Escherichia coli CFT073
aguggcugcguuucaugua

SEQ ID NO: 2595427 - RNA, 20 nt, Escherichia coli CFT073
aguggcuuaucuuccuguuc

SEQ ID NO: 2595428 - RNA, 21 nt, Escherichia coli CFT073
agugggauuaaggcuuccagc

SEQ ID NO: 2595429 - RNA, 15 nt, Escherichia coli CFT073
agugggcgacaaagu

SEQ ID NO: 2595430 - RNA, 15 nt, Escherichia coli CFT073
aguggguaaugucac

SEQ ID NO: 2595431 - RNA, 13 nt, Escherichia coli CFT073
agugguaccagga

SEQ ID NO: 2595432 - RNA, 18 nt, Escherichia coli CFT073
aguggucgacaaccagca

SEQ ID NO: 2595433 - RNA, 13 nt, Escherichia coli CFT073
aguggugauucag

SEQ ID NO: 2595434 - RNA, 14 nt, Escherichia coli CFT073
aguggugcggcuga

SEQ ID NO: 2595435 - RNA, 21 nt, Escherichia coli CFT073
agugguuaccgaauccagcaa

SEQ ID NO: 2595436 - RNA, 13 nt, Escherichia coli CFT073
aguguaaaccaaa

SEQ ID NO: 2595437 - RNA, 14 nt, Escherichia coli CFT073
aguguaaaugcaaa

SEQ ID NO: 2595438 - RNA, 13 nt, Escherichia coli CFT073
aguguacgaacac

SEQ ID NO: 2595439 - RNA, 14 nt, Escherichia coli CFT073
aguguauucaugcc

SEQ ID NO: 2595440 - RNA, 16 nt, Escherichia coli CFT073
aguguauucaugcccu

SEQ ID NO: 2595441 - RNA, 13 nt, Escherichia coli CFT073
agugucagcacca

SEQ ID NO: 2595442 - RNA, 15 nt, Escherichia coli CFT073
agugucauucagauc

SEQ ID NO: 2595443 - RNA, 14 nt, Escherichia coli CFT073
agugucgccugcag

SEQ ID NO: 2595444 - RNA, 18 nt, Escherichia coli CFT073
agugugaaacaguaaguu

SEQ ID NO: 2595445 - RNA, 17 nt, Escherichia coli CFT073
agugugaauauucagaa

SEQ ID NO: 2595446 - RNA, 22 nt, Escherichia coli CFT073
agugugauuacagccaggcgcu

SEQ ID NO: 2595447 - RNA, 23 nt, Escherichia coli CFT073
agugugauuacagccaggcgcug

SEQ ID NO: 2595448 - RNA, 19 nt, Escherichia coli CFT073
agugugcaaacgauaaaag

SEQ ID NO: 2595449 - RNA, 22 nt, Escherichia coli CFT073
agugugcgaucgagauucaucc

SEQ ID NO: 2595450 - RNA, 14 nt, Escherichia coli CFT073
agugugcgaugcuc

SEQ ID NO: 2595451 - RNA, 14 nt, Escherichia coli CFT073
aguguggccgccag

SEQ ID NO: 2595452 - RNA, 19 nt, Escherichia coli CFT073
agugugggaaaaauuguuu

SEQ ID NO: 2595453 - RNA, 21 nt, Escherichia coli CFT073
aguguggggaaugauauuuuc

SEQ ID NO: 2595454 - RNA, 19 nt, Escherichia coli CFT073
aguguguuauugccuggca

SEQ ID NO: 2595455 - RNA, 17 nt, Escherichia coli CFT073
aguguucgaccaccggu

SEQ ID NO: 2595456 - RNA, 11 nt, Escherichia coli CFT073
aguguugcguu

SEQ ID NO: 2595457 - RNA, 19 nt, Escherichia coli CFT073
aguguuggcggcagaugau

SEQ ID NO: 2595458 - RNA, 21 nt, Escherichia coli CFT073
aguguuggcgucagaccggca

SEQ ID NO: 2595459 - RNA, 17 nt, Escherichia coli CFT073
aguguuuuauaccaaca

SEQ ID NO: 2595460 - RNA, 21 nt, Escherichia coli CFT073
aguguuuuauaccaacaaaaa

SEQ ID NO: 2595461 - RNA, 20 nt, Escherichia coli CFT073
aguuaaaaaaugcagcaaag

SEQ ID NO: 2595462 - RNA, 19 nt, Escherichia coli CFT073
aguuaaacuuucauaaaca

SEQ ID NO: 2595463 - RNA, 19 nt, Escherichia coli CFT073
aguuaaagcaauuccagcg

SEQ ID NO: 2595464 - RNA, 15 nt, Escherichia coli CFT073
aguuaacaccaccgc

SEQ ID NO: 2595465 - RNA, 13 nt, Escherichia coli CFT073
aguuaaccuucuc

SEQ ID NO: 2595466 - RNA, 20 nt, Escherichia coli CFT073
aguuaacuggucgauauuga

SEQ ID NO: 2595467 - RNA, 14 nt, Escherichia coli CFT073
aguuaagauucagc

SEQ ID NO: 2595468 - RNA, 17 nt, Escherichia coli CFT073
aguuaagcccuuaguau

SEQ ID NO: 2595469 - RNA, 20 nt, Escherichia coli CFT073
aguuaaucaguuuaucaauc

SEQ ID NO: 2595470 - RNA, 13 nt, Escherichia coli CFT073
aguuacagcucuc

SEQ ID NO: 2595471 - RNA, 23 nt, Escherichia coli CFT073
aguuaccgccggcuucaucuuua

SEQ ID NO: 2595472 - RNA, 14 nt, Escherichia coli CFT073
aguuacgaaaagga

SEQ ID NO: 2595473 - RNA, 17 nt, Escherichia coli CFT073
aguuacgaaaaggauaa

SEQ ID NO: 2595474 - RNA, 23 nt, Escherichia coli CFT073
aguuacgaaaaggauaaauaaaa

SEQ ID NO: 2595475 - RNA, 21 nt, Escherichia coli CFT073
aguuacgauaaucaggaaugu

SEQ ID NO: 2595476 - RNA, 17 nt, Escherichia coli CFT073
aguuacguuuaugccac

SEQ ID NO: 2595477 - RNA, 22 nt, Escherichia coli CFT073
aguuacucugcaagucuugcug

SEQ ID NO: 2595478 - RNA, 13 nt, Escherichia coli CFT073
aguuacugcaacg

SEQ ID NO: 2595479 - RNA, 21 nt, Escherichia coli CFT073
aguuacuggcgaguauugcuu

SEQ ID NO: 2595480 - RNA, 15 nt, Escherichia coli CFT073
aguuagucgcuuuca

SEQ ID NO: 2595481 - RNA, 17 nt, Escherichia coli CFT073
aguuagucgcuuucauu

SEQ ID NO: 2595482 - RNA, 21 nt, Escherichia coli CFT073
aguuauacagacucaaaccaa

SEQ ID NO: 2595483 - RNA, 21 nt, Escherichia coli CFT073
aguuaucacgauacaccagau

SEQ ID NO: 2595484 - RNA, 15 nt, Escherichia coli CFT073
aguuaucacucugcc

SEQ ID NO: 2595485 - RNA, 19 nt, Escherichia coli CFT073
aguuaucgccgaacgccac

SEQ ID NO: 2595486 - RNA, 21 nt, Escherichia coli CFT073
aguuauucccguggccugcau

SEQ ID NO: 2595487 - RNA, 16 nt, Escherichia coli CFT073
aguuauuggcacugcg

SEQ ID NO: 2595488 - RNA, 22 nt, Escherichia coli CFT073
aguucaaacggcguuuuuucau

SEQ ID NO: 2595489 - RNA, 13 nt, Escherichia coli CFT073
aguucaaguaaaa

SEQ ID NO: 2595490 - RNA, 19 nt, Escherichia coli CFT073
aguucacgcgauuuuucau

SEQ ID NO: 2595491 - RNA, 23 nt, Escherichia coli CFT073
aguucacuugugcgguguggccu

SEQ ID NO: 2595492 - RNA, 21 nt, Escherichia coli CFT073
aguucagacgcucuuucacca

SEQ ID NO: 2595493 - RNA, 16 nt, Escherichia coli CFT073
aguucagacgcugcau

SEQ ID NO: 2595494 - RNA, 20 nt, Escherichia coli CFT073
aguucagcagugacaaucuc

SEQ ID NO: 2595495 - RNA, 13 nt, Escherichia coli CFT073
aguucaggauaau

SEQ ID NO: 2595496 - RNA, 21 nt, Escherichia coli CFT073
aguucaguaaaaccauuacca

SEQ ID NO: 2595497 - RNA, 17 nt, Escherichia coli CFT073
aguucauauugcggcau

SEQ ID NO: 2595498 - RNA, 12 nt, Escherichia coli CFT073
aguucaucaacg

SEQ ID NO: 2595499 - RNA, 20 nt, Escherichia coli CFT073
aguucaucaagcuguuccuc

SEQ ID NO: 2595500 - RNA, 20 nt, Escherichia coli CFT073
aguucauccagacggguaaa

SEQ ID NO: 2595501 - RNA, 23 nt, Escherichia coli CFT073
aguucauccauuaacagcggugc

SEQ ID NO: 2595502 - RNA, 17 nt, Escherichia coli CFT073
aguucauccccucuucc

SEQ ID NO: 2595503 - RNA, 14 nt, Escherichia coli CFT073
aguucaucggauaa

SEQ ID NO: 2595504 - RNA, 18 nt, Escherichia coli CFT073
aguucauuuuucucaacg

SEQ ID NO: 2595505 - RNA, 22 nt, Escherichia coli CFT073
aguuccacaccuacgcccgcca

SEQ ID NO: 2595506 - RNA, 12 nt, Escherichia coli CFT073
aguuuuuucuuc

SEQ ID NO: 2595507 - RNA, 17 nt, Escherichia coli CFT073
aguuuuuucuucccaag

SEQ ID NO: 2595508 - RNA, 21 nt, Escherichia coli CFT073
auaaaaaaagcgggccaguaa

SEQ ID NO: 2595509 - RNA, 16 nt, Escherichia coli CFT073
auaaaaaagaaaagaa

SEQ ID NO: 2595510 - RNA, 20 nt, Escherichia coli CFT073
auaaaaaagccgaugucugc

SEQ ID NO: 2595511 - RNA, 12 nt, Escherichia coli CFT073
auaaaaaauacg

SEQ ID NO: 2595512 - RNA, 13 nt, Escherichia coli CFT073
auaaaaacgauaa

SEQ ID NO: 2595513 - RNA, 21 nt, Escherichia coli CFT073
auaaaaacgauaaauaacgua

SEQ ID NO: 2595514 - RNA, 13 nt, Escherichia coli CFT073
auaaaaagaauga

SEQ ID NO: 2595515 - RNA, 16 nt, Escherichia coli CFT073
auaaaaauaacaguga

SEQ ID NO: 2595516 - RNA, 15 nt, Escherichia coli CFT073
auaaaaaucagauau

SEQ ID NO: 2595517 - RNA, 18 nt, Escherichia coli CFT073
auaaaacaagcagcugcc

SEQ ID NO: 2595518 - RNA, 13 nt, Escherichia coli CFT073
auaaaacacauca

SEQ ID NO: 2595519 - RNA, 13 nt, Escherichia coli CFT073
auaaaacagggcg

SEQ ID NO: 2595520 - RNA, 11 nt, Escherichia coli CFT073
auaaaacauua

SEQ ID NO: 2595521 - RNA, 15 nt, Escherichia coli CFT073
auaaaacgccugaua

SEQ ID NO: 2595522 - RNA, 14 nt, Escherichia coli CFT073
auaaaacgcgcagc

SEQ ID NO: 2595523 - RNA, 21 nt, Escherichia coli CFT073
auaaaacggcgcauugccuga

SEQ ID NO: 2595524 - RNA, 14 nt, Escherichia coli CFT073
auaaaacugccaga

SEQ ID NO: 2595525 - RNA, 15 nt, Escherichia coli CFT073
auaaaagcaauagcc

SEQ ID NO: 2595526 - RNA, 21 nt, Escherichia coli CFT073
auaaaagcaauaucuuuaucu

SEQ ID NO: 2595527 - RNA, 14 nt, Escherichia coli CFT073
auaaaagcauaccg

SEQ ID NO: 2595528 - RNA, 13 nt, Escherichia coli CFT073
auaaaagccugau

SEQ ID NO: 2595529 - RNA, 18 nt, Escherichia coli CFT073
auaaaagccugaucaauc

SEQ ID NO: 2595530 - RNA, 22 nt, Escherichia coli CFT073
auaaaagccugaucaaucauca

SEQ ID NO: 2595531 - RNA, 22 nt, Escherichia coli CFT073
auaaaagcuguacaucgcgcca

SEQ ID NO: 2595532 - RNA, 17 nt, Escherichia coli CFT073
auaaaagggcagcagga

SEQ ID NO: 2595533 - RNA, 18 nt, Escherichia coli CFT073
auaaaagggcagcaggau

SEQ ID NO: 2595534 - RNA, 21 nt, Escherichia coli CFT073
auaaaaguuuccuguuucuca

SEQ ID NO: 2595535 - RNA, 14 nt, Escherichia coli CFT073
auaaaauaucuucu

SEQ ID NO: 2595536 - RNA, 15 nt, Escherichia coli CFT073
auaaaauaucuucua

SEQ ID NO: 2595537 - RNA, 19 nt, Escherichia coli CFT073
auaaaaucaauaugcauaa

SEQ ID NO: 2595538 - RNA, 14 nt, Escherichia coli CFT073
auaaaaucccauaa

SEQ ID NO: 2595539 - RNA, 20 nt, Escherichia coli CFT073
auaaaauccguaaucgcuuu

SEQ ID NO: 2595540 - RNA, 22 nt, Escherichia coli CFT073
auaaaaucuauuauuauuuuug

SEQ ID NO: 2595541 - RNA, 15 nt, Escherichia coli CFT073
auaaaaugcgaaaaa

SEQ ID NO: 2595542 - RNA, 14 nt, Escherichia coli CFT073
auaaacaacaaaau

SEQ ID NO: 2595543 - RNA, 15 nt, Escherichia coli CFT073
auaaacaccagcaau

SEQ ID NO: 2595544 - RNA, 17 nt, Escherichia coli CFT073
auaaacaccagcaauaa

SEQ ID NO: 2595545 - RNA, 18 nt, Escherichia coli CFT073
auaaacaccagcaauaau

SEQ ID NO: 2595546 - RNA, 16 nt, Escherichia coli CFT073
auaaacaccagcagca

SEQ ID NO: 2595547 - RNA, 17 nt, Escherichia coli CFT073
auaaacaccagcagcag

SEQ ID NO: 2595548 - RNA, 13 nt, Escherichia coli CFT073
auaaacacucaca

SEQ ID NO: 2595549 - RNA, 11 nt, Escherichia coli CFT073
auaaacagcag

SEQ ID NO: 2595550 - RNA, 14 nt, Escherichia coli CFT073
auaaacauaucacu

SEQ ID NO: 2595551 - RNA, 20 nt, Escherichia coli CFT073
auaaacauccuuuucaccuu

SEQ ID NO: 2595552 - RNA, 23 nt, Escherichia coli CFT073
auaaacauccuuuucaccuucaa

SEQ ID NO: 2595553 - RNA, 21 nt, Escherichia coli CFT073
auaaacaucgccauaaacacc

SEQ ID NO: 2595554 - RNA, 19 nt, Escherichia coli CFT073
auaaacaucgucaggaaga

SEQ ID NO: 2595555 - RNA, 17 nt, Escherichia coli CFT073
auaaacauuacgcuucg

SEQ ID NO: 2595556 - RNA, 13 nt, Escherichia coli CFT073
auaaacauuacuu

SEQ ID NO: 2595557 - RNA, 18 nt, Escherichia coli CFT073
auaaacccaacggcaaac

SEQ ID NO: 2595558 - RNA, 14 nt, Escherichia coli CFT073
auaaacccggauac

SEQ ID NO: 2595559 - RNA, 21 nt, Escherichia coli CFT073
auaaacccuucacuguaggca

SEQ ID NO: 2595560 - RNA, 23 nt, Escherichia coli CFT073
auaaaccgccgacgcgaagcaca

SEQ ID NO: 2595561 - RNA, 14 nt, Escherichia coli CFT073
auaaacgccgucgc

SEQ ID NO: 2595562 - RNA, 18 nt, Escherichia coli CFT073
auaaacgccgucgccuuc

SEQ ID NO: 2595563 - RNA, 15 nt, Escherichia coli CFT073
auaaacgcuccugcu

SEQ ID NO: 2595564 - RNA, 15 nt, Escherichia coli CFT073
auaaacggaacauac

SEQ ID NO: 2595565 - RNA, 22 nt, Escherichia coli CFT073
auaaacggcacgaucaagagau

SEQ ID NO: 2595566 - RNA, 22 nt, Escherichia coli CFT073
auaaacggucuacauugcucau

SEQ ID NO: 2595567 - RNA, 18 nt, Escherichia coli CFT073
auaaacgguuucagcagu

SEQ ID NO: 2595568 - RNA, 22 nt, Escherichia coli CFT073
auaaacgucuugcugugcagca

SEQ ID NO: 2595569 - RNA, 16 nt, Escherichia coli CFT073
auaaacuccugcacgc

SEQ ID NO: 2595570 - RNA, 21 nt, Escherichia coli CFT073
auaaacuuacugacaucaaac

SEQ ID NO: 2595571 - RNA, 14 nt, Escherichia coli CFT073
auaaagaaaucacc

SEQ ID NO: 2595572 - RNA, 23 nt, Escherichia coli CFT073
auaaagaaugaaauucgagagaa

SEQ ID NO: 2595573 - RNA, 14 nt, Escherichia coli CFT073
auaaagaugaaaac

SEQ ID NO: 2595574 - RNA, 21 nt, Escherichia coli CFT073
auaaagaugaaaacgccacca

SEQ ID NO: 2595575 - RNA, 19 nt, Escherichia coli CFT073
auaaagcccccacaacauu

SEQ ID NO: 2595576 - RNA, 18 nt, Escherichia coli CFT073
auaaagccgguauucaca

SEQ ID NO: 2595577 - RNA, 21 nt, Escherichia coli CFT073
auaaagccguagcguuugcug

SEQ ID NO: 2595578 - RNA, 15 nt, Escherichia coli CFT073
auaaagcgguuuuca

SEQ ID NO: 2595579 - RNA, 21 nt, Escherichia coli CFT073
auaaagcugaucgcauaaccc

SEQ ID NO: 2595580 - RNA, 20 nt, Escherichia coli CFT073
auaaagcugucaccucugca

SEQ ID NO: 2595581 - RNA, 23 nt, Escherichia coli CFT073
auaaaggccgucgccacaaucag

SEQ ID NO: 2595582 - RNA, 23 nt, Escherichia coli CFT073
auaaagggaugcccccagauugu

SEQ ID NO: 2595583 - RNA, 14 nt, Escherichia coli CFT073
auaaaggguaauau

SEQ ID NO: 2595584 - RNA, 22 nt, Escherichia coli CFT073
auaaagguaccgacgaucaaca

SEQ ID NO: 2595585 - RNA, 15 nt, Escherichia coli CFT073
auaaaggucaucaca

SEQ ID NO: 2595586 - RNA, 14 nt, Escherichia coli CFT073
auaaagucugcacc

SEQ ID NO: 2595587 - RNA, 15 nt, Escherichia coli CFT073
auaaaguugaagcug

SEQ ID NO: 2595588 - RNA, 15 nt, Escherichia coli CFT073
auaaauaaaauaacc

SEQ ID NO: 2595589 - RNA, 12 nt, Escherichia coli CFT073
auaaauaacauc

SEQ ID NO: 2595590 - RNA, 13 nt, Escherichia coli CFT073
auaaauaacaucu

SEQ ID NO: 2595591 - RNA, 20 nt, Escherichia coli CFT073
auaaauaaucgaucacguaa

SEQ ID NO: 2595592 - RNA, 15 nt, Escherichia coli CFT073
auaaauauuauuguu

SEQ ID NO: 2595593 - RNA, 11 nt, Escherichia coli CFT073
auaaaucagau

SEQ ID NO: 2595594 - RNA, 21 nt, Escherichia coli CFT073
auaaaucagaucgacgccgau

SEQ ID NO: 2595595 - RNA, 16 nt, Escherichia coli CFT073
auaaaucagcgugaug

SEQ ID NO: 2595596 - RNA, 22 nt, Escherichia coli CFT073
auaaauccuuuguacaggauau

SEQ ID NO: 2595597 - RNA, 23 nt, Escherichia coli CFT073
auaaaucgcacguugccagcaac

SEQ ID NO: 2595598 - RNA, 19 nt, Escherichia coli CFT073
auaaaucggggucugauuu

SEQ ID NO: 2595599 - RNA, 23 nt, Escherichia coli CFT073
auaaaucggggucugauuuacaa

SEQ ID NO: 2595600 - RNA, 16 nt, Escherichia coli CFT073
auaaaugaagaaaaac

SEQ ID NO: 2595601 - RNA, 18 nt, Escherichia coli CFT073
auaaaugaguggugauga

SEQ ID NO: 2595602 - RNA, 21 nt, Escherichia coli CFT073
auaaaugcacgcugccuggug

SEQ ID NO: 2595603 - RNA, 11 nt, Escherichia coli CFT073
auaaaugccaa

SEQ ID NO: 2595604 - RNA, 12 nt, Escherichia coli CFT073
auaaaugccaaa

SEQ ID NO: 2595605 - RNA, 14 nt, Escherichia coli CFT073
auaaaugccaaaga

SEQ ID NO: 2595606 - RNA, 15 nt, Escherichia coli CFT073
auaaaugccgcaaug

SEQ ID NO: 2595607 - RNA, 14 nt, Escherichia coli CFT073
auaaauuaccacca

SEQ ID NO: 2595608 - RNA, 22 nt, Escherichia coli CFT073
auaaauuauagaugcagcauag

SEQ ID NO: 2595609 - RNA, 17 nt, Escherichia coli CFT073
auaaauugcaauuuuua

SEQ ID NO: 2595610 - RNA, 21 nt, Escherichia coli CFT073
auaaauugcgauauguugugu

SEQ ID NO: 2595611 - RNA, 16 nt, Escherichia coli CFT073
auaaauuucaggcaac

SEQ ID NO: 2595612 - RNA, 19 nt, Escherichia coli CFT073
auaacaaauaucuuucuac

SEQ ID NO: 2595613 - RNA, 16 nt, Escherichia coli CFT073
auaacaaucaccaaac

SEQ ID NO: 2595614 - RNA, 21 nt, Escherichia coli CFT073
auaacacuuggcgucaaacga

SEQ ID NO: 2595615 - RNA, 20 nt, Escherichia coli CFT073
auaaggcguuugcgucgcau

SEQ ID NO: 2595616 - RNA, 20 nt, Escherichia coli CFT073
auaaggcguuuuagccgcau

SEQ ID NO: 2595617 - RNA, 22 nt, Escherichia coli CFT073
auaaggguugcugaccaaaucu

SEQ ID NO: 2595618 - RNA, 22 nt, Escherichia coli CFT073
auaagguacggcccguacugaa

SEQ ID NO: 2595619 - RNA, 20 nt, Escherichia coli CFT073
auaagguguucacgccgcau

SEQ ID NO: 2595620 - RNA, 16 nt, Escherichia coli CFT073
auaaguaaacaaacau

SEQ ID NO: 2595621 - RNA, 16 nt, Escherichia coli CFT073
auaaguacguuuucuu

SEQ ID NO: 2595622 - RNA, 15 nt, Escherichia coli CFT073
auaaguacuaaauaa

SEQ ID NO: 2595623 - RNA, 17 nt, Escherichia coli CFT073
auaaguacuaaauaauu

SEQ ID NO: 2595624 - RNA, 21 nt, Escherichia coli CFT073
auaaguacuaaauaauuugaa

SEQ ID NO: 2595625 - RNA, 20 nt, Escherichia coli CFT073
auaaguggcaauauauuugc

SEQ ID NO: 2595626 - RNA, 23 nt, Escherichia coli CFT073
auaaguggugucagaagaaaaaa

SEQ ID NO: 2595627 - RNA, 15 nt, Escherichia coli CFT073
auaaguuagacggaa

SEQ ID NO: 2595628 - RNA, 19 nt, Escherichia coli CFT073
auaauaaaaaagaaaagaa

SEQ ID NO: 2595629 - RNA, 22 nt, Escherichia coli CFT073
auaauaaaaaagaaaagaacua

SEQ ID NO: 2595630 - RNA, 17 nt, Escherichia coli CFT073
auaauaaaaaaggcacc

SEQ ID NO: 2595631 - RNA, 13 nt, Escherichia coli CFT073
auaauaaaaagaa

SEQ ID NO: 2595632 - RNA, 13 nt, Escherichia coli CFT073
auaauaaagcuac

SEQ ID NO: 2595633 - RNA, 12 nt, Escherichia coli CFT073
auaauaaauauu

SEQ ID NO: 2595634 - RNA, 17 nt, Escherichia coli CFT073
auaauaacucgcagcuu

SEQ ID NO: 2595635 - RNA, 16 nt, Escherichia coli CFT073
auaauaaguaaacaaa

SEQ ID NO: 2595636 - RNA, 22 nt, Escherichia coli CFT073
auaauaaguaaggcagagccaa

SEQ ID NO: 2595637 - RNA, 20 nt, Escherichia coli CFT073
auaauacaggcuacucccag

SEQ ID NO: 2595638 - RNA, 14 nt, Escherichia coli CFT073
auaauacccagcaa

SEQ ID NO: 2595639 - RNA, 17 nt, Escherichia coli CFT073
auaauacccagcaacga

SEQ ID NO: 2595640 - RNA, 17 nt, Escherichia coli CFT073
auaauacgcuaaauaaa

SEQ ID NO: 2595641 - RNA, 21 nt, Escherichia coli CFT073
auaauacgcuaaauaaacaau

SEQ ID NO: 2595642 - RNA, 19 nt, Escherichia coli CFT073
auaauacguagcaccaaca

SEQ ID NO: 2595643 - RNA, 19 nt, Escherichia coli CFT073
auaauacugacaaaaccga

SEQ ID NO: 2595644 - RNA, 23 nt, Escherichia coli CFT073
auaauagaccggacgaaaucccc

SEQ ID NO: 2595645 - RNA, 19 nt, Escherichia coli CFT073
auaauaucccaacgcaaaa

SEQ ID NO: 2595646 - RNA, 11 nt, Escherichia coli CFT073
auaauaucuuu

SEQ ID NO: 2595647 - RNA, 18 nt, Escherichia coli CFT073
auaauauuaaucccugcu

SEQ ID NO: 2595648 - RNA, 17 nt, Escherichia coli CFT073
auaauauucggcguaau

SEQ ID NO: 2595649 - RNA, 13 nt, Escherichia coli CFT073
auaauauuucccc

SEQ ID NO: 2595650 - RNA, 15 nt, Escherichia coli CFT073
auaaucaaccauuaa

SEQ ID NO: 2595651 - RNA, 15 nt, Escherichia coli CFT073
auaaucaacccccac

SEQ ID NO: 2595652 - RNA, 14 nt, Escherichia coli CFT073
auaaucaaugccag

SEQ ID NO: 2595653 - RNA, 14 nt, Escherichia coli CFT073
auaaucacaauggu

SEQ ID NO: 2595654 - RNA, 14 nt, Escherichia coli CFT073
auaaucaccacaca

SEQ ID NO: 2595655 - RNA, 13 nt, Escherichia coli CFT073
auaaucaccagua

SEQ ID NO: 2595656 - RNA, 19 nt, Escherichia coli CFT073
auaaucaccaguaccgccg

SEQ ID NO: 2595657 - RNA, 13 nt, Escherichia coli CFT073
auaaucaccauca

SEQ ID NO: 2595658 - RNA, 14 nt, Escherichia coli CFT073
auaaucaccaucag

SEQ ID NO: 2595659 - RNA, 21 nt, Escherichia coli CFT073
auaaucacgcuguucaucccg

SEQ ID NO: 2595660 - RNA, 19 nt, Escherichia coli CFT073
auaaucacucuuccccgcu

SEQ ID NO: 2595661 - RNA, 17 nt, Escherichia coli CFT073
auaaucauacucccagc

SEQ ID NO: 2595662 - RNA, 13 nt, Escherichia coli CFT073
auaaucaucccac

SEQ ID NO: 2595663 - RNA, 14 nt, Escherichia coli CFT073
auaaucaucuguau

SEQ ID NO: 2595664 - RNA, 14 nt, Escherichia coli CFT073
auaaucaucuucau

SEQ ID NO: 2595665 - RNA, 13 nt, Escherichia coli CFT073
auaauccaggcau

SEQ ID NO: 2595666 - RNA, 21 nt, Escherichia coli CFT073
auaauccaggcaucagauugu

SEQ ID NO: 2595667 - RNA, 16 nt, Escherichia coli CFT073
auaaucccgaacacuu

SEQ ID NO: 2595668 - RNA, 17 nt, Escherichia coli CFT073
auaauccgcuguaauug

SEQ ID NO: 2595669 - RNA, 17 nt, Escherichia coli CFT073
auaauccggaaaagccu

SEQ ID NO: 2595670 - RNA, 14 nt, Escherichia coli CFT073
auaauccggcauuu

SEQ ID NO: 2595671 - RNA, 20 nt, Escherichia coli CFT073
auaauccggguucggauaaa

SEQ ID NO: 2595672 - RNA, 15 nt, Escherichia coli CFT073
auaauccguuagcga

SEQ ID NO: 2595673 - RNA, 18 nt, Escherichia coli CFT073
auaauccugccgagauac

SEQ ID NO: 2595674 - RNA, 20 nt, Escherichia coli CFT073
auaauccugccgagauacag

SEQ ID NO: 2595675 - RNA, 15 nt, Escherichia coli CFT073
auaauccuggcagca

SEQ ID NO: 2595676 - RNA, 19 nt, Escherichia coli CFT073
auaauccuggcagcaucag

SEQ ID NO: 2595677 - RNA, 18 nt, Escherichia coli CFT073
auaauccuguagauauuc

SEQ ID NO: 2595678 - RNA, 20 nt, Escherichia coli CFT073
auaaucgaaaacaucauggu

SEQ ID NO: 2595679 - RNA, 18 nt, Escherichia coli CFT073
auaaucgaaaccuucagc

SEQ ID NO: 2595680 - RNA, 22 nt, Escherichia coli CFT073
auaaucgaaccaaacagcgcca

SEQ ID NO: 2595681 - RNA, 21 nt, Escherichia coli CFT073
auaaucgacgaggaaaaugau

SEQ ID NO: 2595682 - RNA, 14 nt, Escherichia coli CFT073
auaaucgcaucaau

SEQ ID NO: 2595683 - RNA, 13 nt, Escherichia coli CFT073
auaaucgccguau

SEQ ID NO: 2595684 - RNA, 17 nt, Escherichia coli CFT073
auaaucgcguuuuacaa

SEQ ID NO: 2595685 - RNA, 12 nt, Escherichia coli CFT073
auaaucgcuuua

SEQ ID NO: 2595686 - RNA, 14 nt, Escherichia coli CFT073
auaaucgggaauac

SEQ ID NO: 2595687 - RNA, 18 nt, Escherichia coli CFT073
auaaucgggaauacagaa

SEQ ID NO: 2595688 - RNA, 19 nt, Escherichia coli CFT073
auaaucggucgacugcgcu

SEQ ID NO: 2595689 - RNA, 14 nt, Escherichia coli CFT073
auaaucguaaucag

SEQ ID NO: 2595690 - RNA, 17 nt, Escherichia coli CFT073
auaaucguaaucagcau

SEQ ID NO: 2595691 - RNA, 21 nt, Escherichia coli CFT073
auaaucguaaucagcaucuca

SEQ ID NO: 2595692 - RNA, 16 nt, Escherichia coli CFT073
auaaucucaccauuuu

SEQ ID NO: 2595693 - RNA, 12 nt, Escherichia coli CFT073
auaaucugaaaa

SEQ ID NO: 2595694 - RNA, 13 nt, Escherichia coli CFT073
auaaucugacuuc

SEQ ID NO: 2595695 - RNA, 14 nt, Escherichia coli CFT073
auaaucugacuucc

SEQ ID NO: 2595696 - RNA, 18 nt, Escherichia coli CFT073
auaaucugacuuccugcc

SEQ ID NO: 2595697 - RNA, 18 nt, Escherichia coli CFT073
auaaucugcccggcauua

SEQ ID NO: 2595698 - RNA, 18 nt, Escherichia coli CFT073
auaaucugcggguaauau

SEQ ID NO: 2595699 - RNA, 16 nt, Escherichia coli CFT073
auaaucuucaaauaaa

SEQ ID NO: 2595700 - RNA, 17 nt, Escherichia coli CFT073
auaaucuucaaauaaac

SEQ ID NO: 2595701 - RNA, 22 nt, Escherichia coli CFT073
auaaucuucuauuuuuucaauu

SEQ ID NO: 2595702 - RNA, 15 nt, Escherichia coli CFT073
auaaucuuuacacca

SEQ ID NO: 2595703 - RNA, 21 nt, Escherichia coli CFT073
auaaugaacgccaccccacac

SEQ ID NO: 2595704 - RNA, 23 nt, Escherichia coli CFT073
auaaugaacgccaccccacacca

SEQ ID NO: 2595705 - RNA, 19 nt, Escherichia coli CFT073
auaaugaaugcguuccagu

SEQ ID NO: 2595706 - RNA, 18 nt, Escherichia coli CFT073
auaaugacggacaguacu

SEQ ID NO: 2595707 - RNA, 19 nt, Escherichia coli CFT073
auaaugacuaaugccgcca

SEQ ID NO: 2595708 - RNA, 23 nt, Escherichia coli CFT073
auaaugacuuccgccaccacgcc

SEQ ID NO: 2595709 - RNA, 12 nt, Escherichia coli CFT073
auaaugauuuug

SEQ ID NO: 2595710 - RNA, 20 nt, Escherichia coli CFT073
auaaugcccagcguuccggc

SEQ ID NO: 2595711 - RNA, 17 nt, Escherichia coli CFT073
auaaugccgcaacgcca

SEQ ID NO: 2595712 - RNA, 19 nt, Escherichia coli CFT073
auaaugccgcaacgccaua

SEQ ID NO: 2595713 - RNA, 14 nt, Escherichia coli CFT073
auaaugccgguauc

SEQ ID NO: 2595714 - RNA, 15 nt, Escherichia coli CFT073
auaaugccuuuaaug

SEQ ID NO: 2595715 - RNA, 16 nt, Escherichia coli CFT073
auaauguaucugaagu

SEQ ID NO: 2595716 - RNA, 18 nt, Escherichia coli CFT073
auaauguaucugaaguaa

SEQ ID NO: 2595717 - RNA, 20 nt, Escherichia coli CFT073
auaaugucgcugguaacauc

SEQ ID NO: 2595718 - RNA, 17 nt, Escherichia coli CFT073
auaaugugccgaaucca

SEQ ID NO: 2595719 - RNA, 15 nt, Escherichia coli CFT073
auaauguguucaacu

SEQ ID NO: 2595720 - RNA, 23 nt, Escherichia coli CFT073
auaauuagugagacucaccaauc

SEQ ID NO: 2595721 - RNA, 21 nt, Escherichia coli CFT073
auaauuagugcugcuggaaaa

SEQ ID NO: 2595722 - RNA, 18 nt, Escherichia coli CFT073
auaauuauaaaucccugc

SEQ ID NO: 2595723 - RNA, 18 nt, Escherichia coli CFT073
auacccggcacacaaaua

SEQ ID NO: 2595724 - RNA, 18 nt, Escherichia coli CFT073
auaccgaagaguaaccaa

SEQ ID NO: 2595725 - RNA, 23 nt, Escherichia coli CFT073
auaccgacgaucgggaacagcca

SEQ ID NO: 2595726 - RNA, 18 nt, Escherichia coli CFT073
auaccgcaucagcaucgg

SEQ ID NO: 2595727 - RNA, 17 nt, Escherichia coli CFT073
auaccggacuccagaca

SEQ ID NO: 2595728 - RNA, 11 nt, Escherichia coli CFT073
auaccggcauc

SEQ ID NO: 2595729 - RNA, 12 nt, Escherichia coli CFT073
auaccggcaucc

SEQ ID NO: 2595730 - RNA, 21 nt, Escherichia coli CFT073
auaccggcgucccaucggcaa

SEQ ID NO: 2595731 - RNA, 15 nt, Escherichia coli CFT073
auaccgggaucaggu

SEQ ID NO: 2595732 - RNA, 16 nt, Escherichia coli CFT073
auaccguaaaacucac

SEQ ID NO: 2595733 - RNA, 22 nt, Escherichia coli CFT073
auaccguaaaacucacaaccag

SEQ ID NO: 2595734 - RNA, 20 nt, Escherichia coli CFT073
auaccguaacgacugcggau

SEQ ID NO: 2595735 - RNA, 13 nt, Escherichia coli CFT073
auaccgucagcga

SEQ ID NO: 2595736 - RNA, 24 nt, Escherichia coli CFT073
auaccgucagcgucuguuuuauca

SEQ ID NO: 2595737 - RNA, 20 nt, Escherichia coli CFT073
auaccgucaggauaaacucc

SEQ ID NO: 2595738 - RNA, 18 nt, Escherichia coli CFT073
auaccgucugcaccgaga

SEQ ID NO: 2595739 - RNA, 23 nt, Escherichia coli CFT073
auaccgugguuuugguaaagcaa

SEQ ID NO: 2595740 - RNA, 18 nt, Escherichia coli CFT073
auaccguucauuaacgcc

SEQ ID NO: 2595741 - RNA, 22 nt, Escherichia coli CFT073
auaccuaacacgaucagccaua

SEQ ID NO: 2595742 - RNA, 17 nt, Escherichia coli CFT073
auaccuaacgccagcgc

SEQ ID NO: 2595743 - RNA, 14 nt, Escherichia coli CFT073
auaccuaccugcag

SEQ ID NO: 2595744 - RNA, 16 nt, Escherichia coli CFT073
auaccugacgcaacug

SEQ ID NO: 2595745 - RNA, 12 nt, Escherichia coli CFT073
auaccugcacca

SEQ ID NO: 2595746 - RNA, 18 nt, Escherichia coli CFT073
auaccuggucugaaccaa

SEQ ID NO: 2595747 - RNA, 22 nt, Escherichia coli CFT073
auaccuucacaaaaugccagca

SEQ ID NO: 2595748 - RNA, 19 nt, Escherichia coli CFT073
auaccuucuuccugcgcca

SEQ ID NO: 2595749 - RNA, 15 nt, Escherichia coli CFT073
auaccuugcugcucc

SEQ ID NO: 2595750 - RNA, 17 nt, Escherichia coli CFT073
auacgacagucaauauu

SEQ ID NO: 2595751 - RNA, 12 nt, Escherichia coli CFT073
auacgacgacgg

SEQ ID NO: 2595752 - RNA, 19 nt, Escherichia coli CFT073
auacgacuuugcgcaggca

SEQ ID NO: 2595753 - RNA, 17 nt, Escherichia coli CFT073
auacgaucaucuggcga

SEQ ID NO: 2595754 - RNA, 16 nt, Escherichia coli CFT073
auacgauccgacaucc

SEQ ID NO: 2595755 - RNA, 23 nt, Escherichia coli CFT073
auacgcaccacaccgucgccuuu

SEQ ID NO: 2595756 - RNA, 13 nt, Escherichia coli CFT073
auacgcaguggcg

SEQ ID NO: 2595757 - RNA, 14 nt, Escherichia coli CFT073
auacgcccgguggc

SEQ ID NO: 2595758 - RNA, 14 nt, Escherichia coli CFT073
auacgccucacaga

SEQ ID NO: 2595759 - RNA, 22 nt, Escherichia coli CFT073
auacgccucacagagcgcuuau

SEQ ID NO: 2595760 - RNA, 22 nt, Escherichia coli CFT073
auacgcggcaacaagauuagcc

SEQ ID NO: 2595761 - RNA, 15 nt, Escherichia coli CFT073
auacgcgguacaccg

SEQ ID NO: 2595762 - RNA, 23 nt, Escherichia coli CFT073
auacgcgucccggaauccuucau

SEQ ID NO: 2595763 - RNA, 18 nt, Escherichia coli CFT073
auacgcuaaauaaacaau

SEQ ID NO: 2595764 - RNA, 19 nt, Escherichia coli CFT073
auacgcuccgcccauuucu

SEQ ID NO: 2595765 - RNA, 17 nt, Escherichia coli CFT073
auacgcuguggcgcugg

SEQ ID NO: 2595766 - RNA, 16 nt, Escherichia coli CFT073
auacgcuuuauccagc

SEQ ID NO: 2595767 - RNA, 20 nt, Escherichia coli CFT073
auacgcuuuauccagcauaa

SEQ ID NO: 2595768 - RNA, 14 nt, Escherichia coli CFT073
auacgcuuucagca

SEQ ID NO: 2595769 - RNA, 17 nt, Escherichia coli CFT073
auacgcuuucagcacuu

SEQ ID NO: 2595770 - RNA, 20 nt, Escherichia coli CFT073
auacgggcuuuuuaauuccu

SEQ ID NO: 2595771 - RNA, 20 nt, Escherichia coli CFT073
auacgguuaaaucaggaaaa

SEQ ID NO: 2595772 - RNA, 21 nt, Escherichia coli CFT073
auacgguuuuuugaacagacc

SEQ ID NO: 2595773 - RNA, 19 nt, Escherichia coli CFT073
auacgucccggggaagcgu

SEQ ID NO: 2595774 - RNA, 14 nt, Escherichia coli CFT073
auacguccgguuuc

SEQ ID NO: 2595775 - RNA, 19 nt, Escherichia coli CFT073
auacgucggcaucaggcaa

SEQ ID NO: 2595776 - RNA, 21 nt, Escherichia coli CFT073
auacgucggcaucaggcaaca

SEQ ID NO: 2595777 - RNA, 18 nt, Escherichia coli CFT073
auacgugaucgcaauucu

SEQ ID NO: 2595778 - RNA, 21 nt, Escherichia coli CFT073
auacgugaucgcaauucuuca

SEQ ID NO: 2595779 - RNA, 13 nt, Escherichia coli CFT073
auacguuauaucu

SEQ ID NO: 2595780 - RNA, 22 nt, Escherichia coli CFT073
auacguugcaaauauuccauca

SEQ ID NO: 2595781 - RNA, 18 nt, Escherichia coli CFT073
auacguuuaugucgcauc

SEQ ID NO: 2595782 - RNA, 13 nt, Escherichia coli CFT073
auacuacaauccu

SEQ ID NO: 2595783 - RNA, 23 nt, Escherichia coli CFT073
auacuacaauccugugcuccagu

SEQ ID NO: 2595784 - RNA, 16 nt, Escherichia coli CFT073
auacucaagcaaccag

SEQ ID NO: 2595785 - RNA, 13 nt, Escherichia coli CFT073
auacucaguccgg

SEQ ID NO: 2595786 - RNA, 17 nt, Escherichia coli CFT073
auacucaucuuccgggc

SEQ ID NO: 2595787 - RNA, 16 nt, Escherichia coli CFT073
auacuccggcggcagc

SEQ ID NO: 2595788 - RNA, 15 nt, Escherichia coli CFT073
auacucgccgaacca

SEQ ID NO: 2595789 - RNA, 19 nt, Escherichia coli CFT073
auacucgccgaaccaaacg

SEQ ID NO: 2595790 - RNA, 18 nt, Escherichia coli CFT073
auacucuaaauaauucga

SEQ ID NO: 2595791 - RNA, 19 nt, Escherichia coli CFT073
auacucuccuccagguuaa

SEQ ID NO: 2595792 - RNA, 21 nt, Escherichia coli CFT073
auacucuuucccggcaaucac

SEQ ID NO: 2595793 - RNA, 21 nt, Escherichia coli CFT073
auacucuuugguauucaaccg

SEQ ID NO: 2595794 - RNA, 22 nt, Escherichia coli CFT073
auacugacgauuacguaauuca

SEQ ID NO: 2595795 - RNA, 23 nt, Escherichia coli CFT073
auacugauaauaaauaacagugc

SEQ ID NO: 2595796 - RNA, 16 nt, Escherichia coli CFT073
auacugaucaucauua

SEQ ID NO: 2595797 - RNA, 18 nt, Escherichia coli CFT073
auacugcaacuucacggc

SEQ ID NO: 2595798 - RNA, 22 nt, Escherichia coli CFT073
auacugcagcggucacauguuc

SEQ ID NO: 2595799 - RNA, 14 nt, Escherichia coli CFT073
auacugcaucagcg

SEQ ID NO: 2595800 - RNA, 15 nt, Escherichia coli CFT073
auacugcaucagcgc

SEQ ID NO: 2595801 - RNA, 18 nt, Escherichia coli CFT073
auacugcauguauggcgc

SEQ ID NO: 2595802 - RNA, 20 nt, Escherichia coli CFT073
auacugccguagugaugcau

SEQ ID NO: 2595803 - RNA, 14 nt, Escherichia coli CFT073
auacugccuuuccc

SEQ ID NO: 2595804 - RNA, 23 nt, Escherichia coli CFT073
auacugcgcauggaagcgcaggu

SEQ ID NO: 2595805 - RNA, 18 nt, Escherichia coli CFT073
auacuguaaauaguauua

SEQ ID NO: 2595806 - RNA, 17 nt, Escherichia coli CFT073
auacuuaaugccaguuc

SEQ ID NO: 2595807 - RNA, 19 nt, Escherichia coli CFT073
auacuuaaugccaguucag

SEQ ID NO: 2595808 - RNA, 15 nt, Escherichia coli CFT073
auacuuauaagcuca

SEQ ID NO: 2595809 - RNA, 17 nt, Escherichia coli CFT073
auacuucaacauaagca

SEQ ID NO: 2595810 - RNA, 21 nt, Escherichia coli CFT073
auacuucuggguuccuuccag

SEQ ID NO: 2595811 - RNA, 22 nt, Escherichia coli CFT073
auacuucuggguuccuuccagu

SEQ ID NO: 2595812 - RNA, 12 nt, Escherichia coli CFT073
auacuugcgaau

SEQ ID NO: 2595813 - RNA, 20 nt, Escherichia coli CFT073
auacuugcgaaucauuaccu

SEQ ID NO: 2595814 - RNA, 18 nt, Escherichia coli CFT073
auagaaauuuaguauuuu

SEQ ID NO: 2595815 - RNA, 16 nt, Escherichia coli CFT073
auagaaccaaaguuug

SEQ ID NO: 2595816 - RNA, 13 nt, Escherichia coli CFT073
auagaaccacgca

SEQ ID NO: 2595817 - RNA, 20 nt, Escherichia coli CFT073
auagaaccuaagaaccagaa

SEQ ID NO: 2595818 - RNA, 22 nt, Escherichia coli CFT073
auagaaccuuccacguugguau

SEQ ID NO: 2595819 - RNA, 21 nt, Escherichia coli CFT073
auagaacugcggcagguugaa

SEQ ID NO: 2595820 - RNA, 13 nt, Escherichia coli CFT073
auagaaucaccgc

SEQ ID NO: 2595821 - RNA, 16 nt, Escherichia coli CFT073
auagacaccaugucca

SEQ ID NO: 2595822 - RNA, 17 nt, Escherichia coli CFT073
auagacacugccgccgu

SEQ ID NO: 2595823 - RNA, 12 nt, Escherichia coli CFT073
auagacagccac

SEQ ID NO: 2595824 - RNA, 14 nt, Escherichia coli CFT073
auagaccaucggcg

SEQ ID NO: 2595825 - RNA, 14 nt, Escherichia coli CFT073
auagaccggagaaa

SEQ ID NO: 2595826 - RNA, 15 nt, Escherichia coli CFT073
auagaccggagaaaa

SEQ ID NO: 2595827 - RNA, 17 nt, Escherichia coli CFT073
auagaccggagaaaaga

SEQ ID NO: 2595828 - RNA, 23 nt, Escherichia coli CFT073
auagacuuuacuaauagcaaaau

SEQ ID NO: 2595829 - RNA, 21 nt, Escherichia coli CFT073
auagagaacgcgugguugguu

SEQ ID NO: 2595830 - RNA, 19 nt, Escherichia coli CFT073
auagagcuugugcaccagc

SEQ ID NO: 2595831 - RNA, 21 nt, Escherichia coli CFT073
auauaccuuccgguuucaaau

SEQ ID NO: 2595832 - RNA, 14 nt, Escherichia coli CFT073
auauagccagccuc

SEQ ID NO: 2595833 - RNA, 21 nt, Escherichia coli CFT073
auauagccgccuuuacgcaaa

SEQ ID NO: 2595834 - RNA, 14 nt, Escherichia coli CFT073
auauaggugauaaa

SEQ ID NO: 2595835 - RNA, 23 nt, Escherichia coli CFT073
auauaggugauaaaguacauuca

SEQ ID NO: 2595836 - RNA, 22 nt, Escherichia coli CFT073
auauaguaagaagcaagguagu

SEQ ID NO: 2595837 - RNA, 13 nt, Escherichia coli CFT073
auauauauuauau

SEQ ID NO: 2595838 - RNA, 14 nt, Escherichia coli CFT073
auauauauuauauc

SEQ ID NO: 2595839 - RNA, 18 nt, Escherichia coli CFT073
auauaucaccuuccagaa

SEQ ID NO: 2595840 - RNA, 15 nt, Escherichia coli CFT073
auauaucagccugaa

SEQ ID NO: 2595841 - RNA, 12 nt, Escherichia coli CFT073
auauaucagcgc

SEQ ID NO: 2595842 - RNA, 22 nt, Escherichia coli CFT073
auauaucagcgccacaucagca

SEQ ID NO: 2595843 - RNA, 24 nt, Escherichia coli CFT073
auauaugccaucgccagcagccau

SEQ ID NO: 2595844 - RNA, 16 nt, Escherichia coli CFT073
auauaugucaccagca

SEQ ID NO: 2595845 - RNA, 23 nt, Escherichia coli CFT073
auauauuccccggucagcagcac

SEQ ID NO: 2595846 - RNA, 23 nt, Escherichia coli CFT073
auauauugagcucgcaauauuuu

SEQ ID NO: 2595847 - RNA, 18 nt, Escherichia coli CFT073
auauauuuaguucauaua

SEQ ID NO: 2595848 - RNA, 19 nt, Escherichia coli CFT073
auaucaaaaacaaauuuug

SEQ ID NO: 2595849 - RNA, 11 nt, Escherichia coli CFT073
auaucaaccag

SEQ ID NO: 2595850 - RNA, 23 nt, Escherichia coli CFT073
auaucaacccgagcgccagcgaa

SEQ ID NO: 2595851 - RNA, 21 nt, Escherichia coli CFT073
auaucaacgcuauuugcugaa

SEQ ID NO: 2595852 - RNA, 14 nt, Escherichia coli CFT073
auaucaagcaugau

SEQ ID NO: 2595853 - RNA, 19 nt, Escherichia coli CFT073
auaucaaguuuaucaacgu

SEQ ID NO: 2595854 - RNA, 14 nt, Escherichia coli CFT073
auaucaauaacaua

SEQ ID NO: 2595855 - RNA, 12 nt, Escherichia coli CFT073
auaucaccagua

SEQ ID NO: 2595856 - RNA, 22 nt, Escherichia coli CFT073
auaucaccaguaacuuccccuu

SEQ ID NO: 2595857 - RNA, 23 nt, Escherichia coli CFT073
auaucaccugcuucgauagaauc

SEQ ID NO: 2595858 - RNA, 21 nt, Escherichia coli CFT073
auaucacucggggcuuuucuc

SEQ ID NO: 2595859 - RNA, 16 nt, Escherichia coli CFT073
auaucacuuuuauaua

SEQ ID NO: 2595860 - RNA, 14 nt, Escherichia coli CFT073
auaucagccugcaa

SEQ ID NO: 2595861 - RNA, 17 nt, Escherichia coli CFT073
auaucagcgccacauca

SEQ ID NO: 2595862 - RNA, 19 nt, Escherichia coli CFT073
auaucagcgccacaucagc

SEQ ID NO: 2595863 - RNA, 15 nt, Escherichia coli CFT073
auaucauaggucagg

SEQ ID NO: 2595864 - RNA, 14 nt, Escherichia coli CFT073
auaucaucaaggcu

SEQ ID NO: 2595865 - RNA, 10 nt, Escherichia coli CFT073
auaucaucau

SEQ ID NO: 2595866 - RNA, 14 nt, Escherichia coli CFT073
auaucaucaucggu

SEQ ID NO: 2595867 - RNA, 22 nt, Escherichia coli CFT073
auaucauccauuaacgucagcg

SEQ ID NO: 2595868 - RNA, 15 nt, Escherichia coli CFT073
auauccacccgcagc

SEQ ID NO: 2595869 - RNA, 13 nt, Escherichia coli CFT073
auauccagaccgc

SEQ ID NO: 2595870 - RNA, 16 nt, Escherichia coli CFT073
auauccagauccaaua

SEQ ID NO: 2595871 - RNA, 12 nt, Escherichia coli CFT073
auauccagccaa

SEQ ID NO: 2595872 - RNA, 15 nt, Escherichia coli CFT073
auauccagcgccaga

SEQ ID NO: 2595873 - RNA, 22 nt, Escherichia coli CFT073
auauccagcgcggcgaaggugc

SEQ ID NO: 2595874 - RNA, 14 nt, Escherichia coli CFT073
auauccauaaaggu

SEQ ID NO: 2595875 - RNA, 17 nt, Escherichia coli CFT073
auauccauguaccagac

SEQ ID NO: 2595876 - RNA, 20 nt, Escherichia coli CFT073
auaucccaccagcgccgccc

SEQ ID NO: 2595877 - RNA, 14 nt, Escherichia coli CFT073
auaucccauuuacu

SEQ ID NO: 2595878 - RNA, 17 nt, Escherichia coli CFT073
auaucccauuucuccac

SEQ ID NO: 2595879 - RNA, 18 nt, Escherichia coli CFT073
auaucccauuucuccacu

SEQ ID NO: 2595880 - RNA, 19 nt, Escherichia coli CFT073
auaucccgccagcaccagc

SEQ ID NO: 2595881 - RNA, 20 nt, Escherichia coli CFT073
auaucccgccagcaccagca

SEQ ID NO: 2595882 - RNA, 19 nt, Escherichia coli CFT073
auaucccggagaauagcgc

SEQ ID NO: 2595883 - RNA, 20 nt, Escherichia coli CFT073
auaucccggagaauagcgcc

SEQ ID NO: 2595884 - RNA, 22 nt, Escherichia coli CFT073
auaucccggagaauagcgccau

SEQ ID NO: 2595885 - RNA, 22 nt, Escherichia coli CFT073
auauccggccuggguauaaauc

SEQ ID NO: 2595886 - RNA, 18 nt, Escherichia coli CFT073
auauccgugcauuccagc

SEQ ID NO: 2595887 - RNA, 13 nt, Escherichia coli CFT073
auauccuccggca

SEQ ID NO: 2595888 - RNA, 20 nt, Escherichia coli CFT073
auauccuccggcauagccgg

SEQ ID NO: 2595889 - RNA, 12 nt, Escherichia coli CFT073
auauccugaccu

SEQ ID NO: 2595890 - RNA, 14 nt, Escherichia coli CFT073
auaucgacauucaa

SEQ ID NO: 2595891 - RNA, 23 nt, Escherichia coli CFT073
auaucgacgccaguuugaccaua

SEQ ID NO: 2595892 - RNA, 17 nt, Escherichia coli CFT073
auaucgagaaucugccg

SEQ ID NO: 2595893 - RNA, 15 nt, Escherichia coli CFT073
auaucgauaaacagc

SEQ ID NO: 2595894 - RNA, 16 nt, Escherichia coli CFT073
auaucgaucgccgcac

SEQ ID NO: 2595895 - RNA, 22 nt, Escherichia coli CFT073
auaucgcauaccauccaggaga

SEQ ID NO: 2595896 - RNA, 19 nt, Escherichia coli CFT073
auaucgccauuaaacaacc

SEQ ID NO: 2595897 - RNA, 23 nt, Escherichia coli CFT073
auaucgccuuuugcccggcaaca

SEQ ID NO: 2595898 - RNA, 15 nt, Escherichia coli CFT073
auaucgcgcagaaau

SEQ ID NO: 2595899 - RNA, 16 nt, Escherichia coli CFT073
auaucgcuggcagaaa

SEQ ID NO: 2595900 - RNA, 16 nt, Escherichia coli CFT073
auaucgcugucgccac

SEQ ID NO: 2595901 - RNA, 20 nt, Escherichia coli CFT073
auaucgcugucgccacccca

SEQ ID NO: 2595902 - RNA, 12 nt, Escherichia coli CFT073
auaucggcagcg

SEQ ID NO: 2595903 - RNA, 14 nt, Escherichia coli CFT073
auaucggcauugcu

SEQ ID NO: 2595904 - RNA, 20 nt, Escherichia coli CFT073
auaucguauccgguuuucca

SEQ ID NO: 2595905 - RNA, 20 nt, Escherichia coli CFT073
auaucgugcgggaccagcac

SEQ ID NO: 2595906 - RNA, 21 nt, Escherichia coli CFT073
auaucgugcgggaccagcacg

SEQ ID NO: 2595907 - RNA, 15 nt, Escherichia coli CFT073
auaucuaaaauguca

SEQ ID NO: 2595908 - RNA, 21 nt, Escherichia coli CFT073
auaucugccagauaauggcug

SEQ ID NO: 2595909 - RNA, 19 nt, Escherichia coli CFT073
auaucugccggaagacaca

SEQ ID NO: 2595910 - RNA, 16 nt, Escherichia coli CFT073
auaucugguuaaaaaa

SEQ ID NO: 2595911 - RNA, 12 nt, Escherichia coli CFT073
auaucugugcuu

SEQ ID NO: 2595912 - RNA, 13 nt, Escherichia coli CFT073
auaucuucuccug

SEQ ID NO: 2595913 - RNA, 22 nt, Escherichia coli CFT073
auaucuucuugcguuuuuugau

SEQ ID NO: 2595914 - RNA, 23 nt, Escherichia coli CFT073
auaucuuucccuuucgauaagac

SEQ ID NO: 2595915 - RNA, 20 nt, Escherichia coli CFT073
auaucuuuccuuaacaaaaa

SEQ ID NO: 2595916 - RNA, 14 nt, Escherichia coli CFT073
auaucuuucucagu

SEQ ID NO: 2595917 - RNA, 17 nt, Escherichia coli CFT073
auaucuuucucagucau

SEQ ID NO: 2595918 - RNA, 14 nt, Escherichia coli CFT073
auaugaaauccggc

SEQ ID NO: 2595919 - RNA, 17 nt, Escherichia coli CFT073
auaugaauauugcugaa

SEQ ID NO: 2595920 - RNA, 14 nt, Escherichia coli CFT073
auaugaucugcaca

SEQ ID NO: 2595921 - RNA, 16 nt, Escherichia coli CFT073
auaugaugaaggacaa

SEQ ID NO: 2595922 - RNA, 15 nt, Escherichia coli CFT073
auaugcaaaucacgc

SEQ ID NO: 2595923 - RNA, 23 nt, Escherichia coli CFT073
auaugcacacgcagcugaugcga

SEQ ID NO: 2595924 - RNA, 16 nt, Escherichia coli CFT073
auaugcagcagccagu

SEQ ID NO: 2595925 - RNA, 14 nt, Escherichia coli CFT073
auaugcauaaaccg

SEQ ID NO: 2595926 - RNA, 13 nt, Escherichia coli CFT073
auaugccaggcuu

SEQ ID NO: 2595927 - RNA, 20 nt, Escherichia coli CFT073
auaugccaggcuucaucggc

SEQ ID NO: 2595928 - RNA, 20 nt, Escherichia coli CFT073
auaugccgccccaaagggcg

SEQ ID NO: 2595929 - RNA, 15 nt, Escherichia coli CFT073
auaugccggcaucaa

SEQ ID NO: 2595930 - RNA, 16 nt, Escherichia coli CFT073
auaugccggcaucaaa

SEQ ID NO: 2595931 - RNA, 18 nt, Escherichia coli CFT073
auaugcgcugucauucau

SEQ ID NO: 2595932 - RNA, 21 nt, Escherichia coli CFT073
auaugcuucuuccugccagca

SEQ ID NO: 2595933 - RNA, 20 nt, Escherichia coli CFT073
auaugcuuguuugcccagaa

SEQ ID NO: 2595934 - RNA, 17 nt, Escherichia coli CFT073
auaugcuuuuuuaaaaa

SEQ ID NO: 2595935 - RNA, 22 nt, Escherichia coli CFT073
auauggaacggaugcagcauca

SEQ ID NO: 2595936 - RNA, 16 nt, Escherichia coli CFT073
auauggacuuuuacug

SEQ ID NO: 2595937 - RNA, 16 nt, Escherichia coli CFT073
auauggcccaucaucu

SEQ ID NO: 2595938 - RNA, 23 nt, Escherichia coli CFT073
auauggcgcgccgauaaaggucg

SEQ ID NO: 2595939 - RNA, 17 nt, Escherichia coli CFT073
aucaaauaagguuccag

SEQ ID NO: 2595940 - RNA, 23 nt, Escherichia coli CFT073
aucaaaucaacaaccugcauuug

SEQ ID NO: 2595941 - RNA, 13 nt, Escherichia coli CFT073
aucaaaucaccau

SEQ ID NO: 2595942 - RNA, 15 nt, Escherichia coli CFT073
aucaaaucauccugc

SEQ ID NO: 2595943 - RNA, 16 nt, Escherichia coli CFT073
aucaaauccaauaacg

SEQ ID NO: 2595944 - RNA, 13 nt, Escherichia coli CFT073
aucaaaucugccg

SEQ ID NO: 2595945 - RNA, 16 nt, Escherichia coli CFT073
aucaaauggcuggcgu

SEQ ID NO: 2595946 - RNA, 14 nt, Escherichia coli CFT073
aucaaauucaagau

SEQ ID NO: 2595947 - RNA, 17 nt, Escherichia coli CFT073
aucaaauuugccagcga

SEQ ID NO: 2595948 - RNA, 18 nt, Escherichia coli CFT073
aucaacaauaaacugcga

SEQ ID NO: 2595949 - RNA, 23 nt, Escherichia coli CFT073
aucaacaauugcgggccaaagac

SEQ ID NO: 2595950 - RNA, 14 nt, Escherichia coli CFT073
aucaacacauugaa

SEQ ID NO: 2595951 - RNA, 22 nt, Escherichia coli CFT073
aucaacaccgacuucaauaacg

SEQ ID NO: 2595952 - RNA, 20 nt, Escherichia coli CFT073
aucaacacuucuuugaugcc

SEQ ID NO: 2595953 - RNA, 19 nt, Escherichia coli CFT073
aucaacagauaaauggcac

SEQ ID NO: 2595954 - RNA, 13 nt, Escherichia coli CFT073
aucaacagcauau

SEQ ID NO: 2595955 - RNA, 14 nt, Escherichia coli CFT073
aucaacaggaacau

SEQ ID NO: 2595956 - RNA, 18 nt, Escherichia coli CFT073
aucaacauaaugccgaca

SEQ ID NO: 2595957 - RNA, 21 nt, Escherichia coli CFT073
aucaacauaaugccgacauca

SEQ ID NO: 2595958 - RNA, 18 nt, Escherichia coli CFT073
aucaacaucacaccauau

SEQ ID NO: 2595959 - RNA, 15 nt, Escherichia coli CFT073
aucaacaucauuaac

SEQ ID NO: 2595960 - RNA, 18 nt, Escherichia coli CFT073
aucaacauguuccugcca

SEQ ID NO: 2595961 - RNA, 14 nt, Escherichia coli CFT073
aucaacauucagau

SEQ ID NO: 2595962 - RNA, 14 nt, Escherichia coli CFT073
aucaaccacggcaa

SEQ ID NO: 2595963 - RNA, 20 nt, Escherichia coli CFT073
aucaaccagcaccuuuucca

SEQ ID NO: 2595964 - RNA, 13 nt, Escherichia coli CFT073
aucaacccgagcg

SEQ ID NO: 2595965 - RNA, 18 nt, Escherichia coli CFT073
aucaacccgcccagugcu

SEQ ID NO: 2595966 - RNA, 19 nt, Escherichia coli CFT073
aucaaccgcgacauacuua

SEQ ID NO: 2595967 - RNA, 22 nt, Escherichia coli CFT073
aucaaccgcgacauacuuaaau

SEQ ID NO: 2595968 - RNA, 17 nt, Escherichia coli CFT073
aucaaccgugagguaug

SEQ ID NO: 2595969 - RNA, 17 nt, Escherichia coli CFT073
aucaaccucuuuuucug

SEQ ID NO: 2595970 - RNA, 22 nt, Escherichia coli CFT073
aucaaccucuuuuucugccuga

SEQ ID NO: 2595971 - RNA, 22 nt, Escherichia coli CFT073
aucaacgacaaaaauaccacca

SEQ ID NO: 2595972 - RNA, 18 nt, Escherichia coli CFT073
aucaacgaugucaaucag

SEQ ID NO: 2595973 - RNA, 16 nt, Escherichia coli CFT073
aucaacgcacuggcgc

SEQ ID NO: 2595974 - RNA, 20 nt, Escherichia coli CFT073
aucaacgccaccaucacuau

SEQ ID NO: 2595975 - RNA, 16 nt, Escherichia coli CFT073
aucaacgccagauaaa

SEQ ID NO: 2595976 - RNA, 18 nt, Escherichia coli CFT073
aucaacgcuacguuauuu

SEQ ID NO: 2595977 - RNA, 19 nt, Escherichia coli CFT073
aucaacggcacguaggcga

SEQ ID NO: 2595978 - RNA, 14 nt, Escherichia coli CFT073
aucaacggcgucag

SEQ ID NO: 2595979 - RNA, 14 nt, Escherichia coli CFT073
aucaacggugccau

SEQ ID NO: 2595980 - RNA, 21 nt, Escherichia coli CFT073
aucaacgguuuuacaaugucc

SEQ ID NO: 2595981 - RNA, 22 nt, Escherichia coli CFT073
aucaacguaguaucguaaucag

SEQ ID NO: 2595982 - RNA, 14 nt, Escherichia coli CFT073
aucaacgucugcgc

SEQ ID NO: 2595983 - RNA, 19 nt, Escherichia coli CFT073
aucaacucaggaacaucag

SEQ ID NO: 2595984 - RNA, 21 nt, Escherichia coli CFT073
aucaacucaggaacaucagca

SEQ ID NO: 2595985 - RNA, 23 nt, Escherichia coli CFT073
aucaacugcgcuauaucgcugau

SEQ ID NO: 2595986 - RNA, 12 nt, Escherichia coli CFT073
aucaagaaaaau

SEQ ID NO: 2595987 - RNA, 19 nt, Escherichia coli CFT073
aucaagaaaaauacugcug

SEQ ID NO: 2595988 - RNA, 18 nt, Escherichia coli CFT073
aucaagaaaugcauguuc

SEQ ID NO: 2595989 - RNA, 15 nt, Escherichia coli CFT073
aucaagaaugcucgc

SEQ ID NO: 2595990 - RNA, 20 nt, Escherichia coli CFT073
aucaagacaugauguuuuaa

SEQ ID NO: 2595991 - RNA, 15 nt, Escherichia coli CFT073
aucaagcaccgccau

SEQ ID NO: 2595992 - RNA, 15 nt, Escherichia coli CFT073
aucaagcaugaucga

SEQ ID NO: 2595993 - RNA, 19 nt, Escherichia coli CFT073
aucaagcauuuucucacug

SEQ ID NO: 2595994 - RNA, 20 nt, Escherichia coli CFT073
aucaagcauuuucucacugg

SEQ ID NO: 2595995 - RNA, 18 nt, Escherichia coli CFT073
aucaagcgaaaucaacac

SEQ ID NO: 2595996 - RNA, 18 nt, Escherichia coli CFT073
aucaagcgccgaguaaaa

SEQ ID NO: 2595997 - RNA, 20 nt, Escherichia coli CFT073
aucaagcggcgcaugcaggc

SEQ ID NO: 2595998 - RNA, 13 nt, Escherichia coli CFT073
aucaagcugagua

SEQ ID NO: 2595999 - RNA, 17 nt, Escherichia coli CFT073
aucaagcugaguauuaa

SEQ ID NO: 2596000 - RNA, 13 nt, Escherichia coli CFT073
aucaagcuggcgc

SEQ ID NO: 2596001 - RNA, 14 nt, Escherichia coli CFT073
aucaagcugugccu

SEQ ID NO: 2596002 - RNA, 17 nt, Escherichia coli CFT073
aucaagcuguuccuccc

SEQ ID NO: 2596003 - RNA, 19 nt, Escherichia coli CFT073
aucaagguugcacaaccaa

SEQ ID NO: 2596004 - RNA, 13 nt, Escherichia coli CFT073
aucaaguaaccuu

SEQ ID NO: 2596005 - RNA, 14 nt, Escherichia coli CFT073
aucaaguauaugau

SEQ ID NO: 2596006 - RNA, 17 nt, Escherichia coli CFT073
aucaaguuccguuucca

SEQ ID NO: 2596007 - RNA, 22 nt, Escherichia coli CFT073
aucaauaacagcgcaaucaccg

SEQ ID NO: 2596008 - RNA, 14 nt, Escherichia coli CFT073
aucaauaaucucuu

SEQ ID NO: 2596009 - RNA, 19 nt, Escherichia coli CFT073
aucaauaccagcuguuuug

SEQ ID NO: 2596010 - RNA, 22 nt, Escherichia coli CFT073
aucaauacccgguccuucaucu

SEQ ID NO: 2596011 - RNA, 20 nt, Escherichia coli CFT073
aucaauacuuuccagcauau

SEQ ID NO: 2596012 - RNA, 21 nt, Escherichia coli CFT073
aucaauacuuuccagcauaug

SEQ ID NO: 2596013 - RNA, 14 nt, Escherichia coli CFT073
aucaauauccacug

SEQ ID NO: 2596014 - RNA, 18 nt, Escherichia coli CFT073
aucaauauuccagucagc

SEQ ID NO: 2596015 - RNA, 17 nt, Escherichia coli CFT073
aucaauauugucuucau

SEQ ID NO: 2596016 - RNA, 14 nt, Escherichia coli CFT073
aucaaucaccucuu

SEQ ID NO: 2596017 - RNA, 14 nt, Escherichia coli CFT073
aucaaucagccccu

SEQ ID NO: 2596018 - RNA, 17 nt, Escherichia coli CFT073
aucaaucagcggaaaug

SEQ ID NO: 2596019 - RNA, 13 nt, Escherichia coli CFT073
aucaaucaucagg

SEQ ID NO: 2596020 - RNA, 13 nt, Escherichia coli CFT073
aucaauccaaaca

SEQ ID NO: 2596021 - RNA, 14 nt, Escherichia coli CFT073
aucaauccugcagc

SEQ ID NO: 2596022 - RNA, 17 nt, Escherichia coli CFT073
aucaauccugcagcagg

SEQ ID NO: 2596023 - RNA, 17 nt, Escherichia coli CFT073
aucaaucgcaaucuggc

SEQ ID NO: 2596024 - RNA, 20 nt, Escherichia coli CFT073
aucaaucgcagccacguuaa

SEQ ID NO: 2596025 - RNA, 20 nt, Escherichia coli CFT073
aucaaucgcggugauuuuac

SEQ ID NO: 2596026 - RNA, 16 nt, Escherichia coli CFT073
aucaaucgcucccagc

SEQ ID NO: 2596027 - RNA, 18 nt, Escherichia coli CFT073
aucaaucgcucccagccc

SEQ ID NO: 2596028 - RNA, 17 nt, Escherichia coli CFT073
aucaaucucagcgauau

SEQ ID NO: 2596029 - RNA, 15 nt, Escherichia coli CFT073
aucaaugccagcaua

SEQ ID NO: 2596030 - RNA, 12 nt, Escherichia coli CFT073
aucaaugccagg

SEQ ID NO: 2596031 - RNA, 22 nt, Escherichia coli CFT073
aucaaugccaggaccacuggcg

SEQ ID NO: 2596032 - RNA, 15 nt, Escherichia coli CFT073
aucaauggauucaug

SEQ ID NO: 2596033 - RNA, 16 nt, Escherichia coli CFT073
aucaaugugcuuucac

SEQ ID NO: 2596034 - RNA, 14 nt, Escherichia coli CFT073
aucaauuaauccuu

SEQ ID NO: 2596035 - RNA, 19 nt, Escherichia coli CFT073
aucaauuacaccaucacgc

SEQ ID NO: 2596036 - RNA, 17 nt, Escherichia coli CFT073
aucaauuagaauuauua

SEQ ID NO: 2596037 - RNA, 14 nt, Escherichia coli CFT073
aucaauuaucuguu

SEQ ID NO: 2596038 - RNA, 22 nt, Escherichia coli CFT073
aucaauugaugcuuuuugcccu

SEQ ID NO: 2596039 - RNA, 20 nt, Escherichia coli CFT073
aucaauugcgucggugagcu

SEQ ID NO: 2596040 - RNA, 20 nt, Escherichia coli CFT073
aucaauugcguuaaaaucag

SEQ ID NO: 2596041 - RNA, 19 nt, Escherichia coli CFT073
aucaauugcuucaauaauc

SEQ ID NO: 2596042 - RNA, 21 nt, Escherichia coli CFT073
aucaauuuaucguauuggccg

SEQ ID NO: 2596043 - RNA, 23 nt, Escherichia coli CFT073
aucaauuuccggcuuaccaaaua

SEQ ID NO: 2596044 - RNA, 17 nt, Escherichia coli CFT073
aucaauuucuucaggau

SEQ ID NO: 2596045 - RNA, 18 nt, Escherichia coli CFT073
aucaauuugccaucccca

SEQ ID NO: 2596046 - RNA, 17 nt, Escherichia coli CFT073
aucaauuugcuucuggc

SEQ ID NO: 2596047 - RNA, 21 nt, Escherichia coli CFT073
aucagacuugugcgcuuguuc

SEQ ID NO: 2596048 - RNA, 23 nt, Escherichia coli CFT073
aucagagcuggaaguuacucaaa

SEQ ID NO: 2596049 - RNA, 18 nt, Escherichia coli CFT073
aucagaguacagauucaa

SEQ ID NO: 2596050 - RNA, 19 nt, Escherichia coli CFT073
aucagaguacagauucaau

SEQ ID NO: 2596051 - RNA, 14 nt, Escherichia coli CFT073
aucagaguuugcca

SEQ ID NO: 2596052 - RNA, 23 nt, Escherichia coli CFT073
aucagauaauauuuaucuuccca

SEQ ID NO: 2596053 - RNA, 15 nt, Escherichia coli CFT073
aucagauaugcgcug

SEQ ID NO: 2596054 - RNA, 13 nt, Escherichia coli CFT073
aucagauccgcac

SEQ ID NO: 2596055 - RNA, 16 nt, Escherichia coli CFT073
aucagauccgcacccg

SEQ ID NO: 2596056 - RNA, 18 nt, Escherichia coli CFT073
aucagaucguugaacccg

SEQ ID NO: 2596057 - RNA, 23 nt, Escherichia coli CFT073
aucagaucguugaacccggcauc

SEQ ID NO: 2596058 - RNA, 16 nt, Escherichia coli CFT073
aucagauggcggcugg

SEQ ID NO: 2596059 - RNA, 15 nt, Escherichia coli CFT073
aucagauucagcagc

SEQ ID NO: 2596060 - RNA, 17 nt, Escherichia coli CFT073
aucagauugagaguuac

SEQ ID NO: 2596061 - RNA, 22 nt, Escherichia coli CFT073
aucagauugaugcgaguaauca

SEQ ID NO: 2596062 - RNA, 18 nt, Escherichia coli CFT073
aucagauuguugaucgua

SEQ ID NO: 2596063 - RNA, 14 nt, Escherichia coli CFT073
aucagcaaaauggc

SEQ ID NO: 2596064 - RNA, 23 nt, Escherichia coli CFT073
aucagcaaacugguugaaauaaa

SEQ ID NO: 2596065 - RNA, 13 nt, Escherichia coli CFT073
aucagcaaauaau

SEQ ID NO: 2596066 - RNA, 19 nt, Escherichia coli CFT073
aucagcaauaaaaaaauga

SEQ ID NO: 2596067 - RNA, 18 nt, Escherichia coli CFT073
aucagcacacauaacagc

SEQ ID NO: 2596068 - RNA, 19 nt, Escherichia coli CFT073
aucagcacgcggaagaugg

SEQ ID NO: 2596069 - RNA, 15 nt, Escherichia coli CFT073
aucagcagcaacaaa

SEQ ID NO: 2596070 - RNA, 18 nt, Escherichia coli CFT073
aucagcagcguucccagc

SEQ ID NO: 2596071 - RNA, 13 nt, Escherichia coli CFT073
aucagcaguucac

SEQ ID NO: 2596072 - RNA, 17 nt, Escherichia coli CFT073
aucagcaguucacagcg

SEQ ID NO: 2596073 - RNA, 21 nt, Escherichia coli CFT073
aucagcaguuuuuccccugcc

SEQ ID NO: 2596074 - RNA, 18 nt, Escherichia coli CFT073
aucagcauaaucaccagu

SEQ ID NO: 2596075 - RNA, 20 nt, Escherichia coli CFT073
aucagcauacuccagccgac

SEQ ID NO: 2596076 - RNA, 20 nt, Escherichia coli CFT073
aucagcauauuuggcgcugg

SEQ ID NO: 2596077 - RNA, 20 nt, Escherichia coli CFT073
aucagcauccauaucgccau

SEQ ID NO: 2596078 - RNA, 11 nt, Escherichia coli CFT073
aucagcaugac

SEQ ID NO: 2596079 - RNA, 16 nt, Escherichia coli CFT073
aucagcaugacaaaaa

SEQ ID NO: 2596080 - RNA, 17 nt, Escherichia coli CFT073
aucagcaugacaaaaaa

SEQ ID NO: 2596081 - RNA, 19 nt, Escherichia coli CFT073
aucagcaugacaaaaaagc

SEQ ID NO: 2596082 - RNA, 22 nt, Escherichia coli CFT073
aucagcaugacaaaaaagccaa

SEQ ID NO: 2596083 - RNA, 21 nt, Escherichia coli CFT073
aucagccacaguuuuccgcca

SEQ ID NO: 2596084 - RNA, 12 nt, Escherichia coli CFT073
aucagccacuuc

SEQ ID NO: 2596085 - RNA, 22 nt, Escherichia coli CFT073
aucagccacuucaaccagcggc

SEQ ID NO: 2596086 - RNA, 23 nt, Escherichia coli CFT073
aucagccacuucaaccagcggcg

SEQ ID NO: 2596087 - RNA, 14 nt, Escherichia coli CFT073
aucagccacuuccu

SEQ ID NO: 2596088 - RNA, 19 nt, Escherichia coli CFT073
aucagccacuuccugcucg

SEQ ID NO: 2596089 - RNA, 18 nt, Escherichia coli CFT073
aucagccauaauaaccuc

SEQ ID NO: 2596090 - RNA, 19 nt, Escherichia coli CFT073
aucagcccaaaaauugccc

SEQ ID NO: 2596091 - RNA, 14 nt, Escherichia coli CFT073
aucagcccaaccac

SEQ ID NO: 2596092 - RNA, 13 nt, Escherichia coli CFT073
aucagcccagccc

SEQ ID NO: 2596093 - RNA, 22 nt, Escherichia coli CFT073
aucagcccagcccugaaccauc

SEQ ID NO: 2596094 - RNA, 16 nt, Escherichia coli CFT073
aucagcccugcccaga

SEQ ID NO: 2596095 - RNA, 14 nt, Escherichia coli CFT073
aucagccguuucac

SEQ ID NO: 2596096 - RNA, 19 nt, Escherichia coli CFT073
aucagcgaagcgcaucagg

SEQ ID NO: 2596097 - RNA, 20 nt, Escherichia coli CFT073
aucagcgcauuuaccaggcg

SEQ ID NO: 2596098 - RNA, 15 nt, Escherichia coli CFT073
aucagcgccaccaca

SEQ ID NO: 2596099 - RNA, 14 nt, Escherichia coli CFT073
aucagcgccagcgc

SEQ ID NO: 2596100 - RNA, 15 nt, Escherichia coli CFT073
aucagcgccagcgcg

SEQ ID NO: 2596101 - RNA, 17 nt, Escherichia coli CFT073
aucagcgccaucgccag

SEQ ID NO: 2596102 - RNA, 14 nt, Escherichia coli CFT073
aucagcgcuaccag

SEQ ID NO: 2596103 - RNA, 17 nt, Escherichia coli CFT073
aucagcgcuaccagagc

SEQ ID NO: 2596104 - RNA, 16 nt, Escherichia coli CFT073
aucagcgcuuuaucau

SEQ ID NO: 2596105 - RNA, 16 nt, Escherichia coli CFT073
aucagcggacgcugcu

SEQ ID NO: 2596106 - RNA, 22 nt, Escherichia coli CFT073
aucagcggcggcgcaaccauca

SEQ ID NO: 2596107 - RNA, 17 nt, Escherichia coli CFT073
aucagcggcguagggca

SEQ ID NO: 2596108 - RNA, 18 nt, Escherichia coli CFT073
aucagcggcguagggcag

SEQ ID NO: 2596109 - RNA, 22 nt, Escherichia coli CFT073
aucagcggugccgcgauaccac

SEQ ID NO: 2596110 - RNA, 16 nt, Escherichia coli CFT073
aucagcguaacggguc

SEQ ID NO: 2596111 - RNA, 17 nt, Escherichia coli CFT073
aucagcguaugcagcca

SEQ ID NO: 2596112 - RNA, 21 nt, Escherichia coli CFT073
aucagcgucgcguuuuucucu

SEQ ID NO: 2596113 - RNA, 22 nt, Escherichia coli CFT073
aucagcguuugcgacaguaagc

SEQ ID NO: 2596114 - RNA, 12 nt, Escherichia coli CFT073
aucagcuacacc

SEQ ID NO: 2596115 - RNA, 17 nt, Escherichia coli CFT073
aucagcuacaccgauca

SEQ ID NO: 2596116 - RNA, 18 nt, Escherichia coli CFT073
aucagcuacaccgaucac

SEQ ID NO: 2596117 - RNA, 22 nt, Escherichia coli CFT073
aucagcuccgggcuaacacccg

SEQ ID NO: 2596118 - RNA, 22 nt, Escherichia coli CFT073
aucagcuggcgucguuaccacu

SEQ ID NO: 2596119 - RNA, 13 nt, Escherichia coli CFT073
aucagcuuaucca

SEQ ID NO: 2596120 - RNA, 14 nt, Escherichia coli CFT073
aucagcuuauccag

SEQ ID NO: 2596121 - RNA, 18 nt, Escherichia coli CFT073
aucagcuuauccagcaac

SEQ ID NO: 2596122 - RNA, 20 nt, Escherichia coli CFT073
aucagcuuccuugcugauuu

SEQ ID NO: 2596123 - RNA, 22 nt, Escherichia coli CFT073
aucagcuucugcacgaugcugc

SEQ ID NO: 2596124 - RNA, 21 nt, Escherichia coli CFT073
aucagcuuuuccauaucaagc

SEQ ID NO: 2596125 - RNA, 23 nt, Escherichia coli CFT073
aucaggaaaacgugccacugaca

SEQ ID NO: 2596126 - RNA, 17 nt, Escherichia coli CFT073
aucaggacgaauacaag

SEQ ID NO: 2596127 - RNA, 23 nt, Escherichia coli CFT073
aucaggacgaauacaagaaauau

SEQ ID NO: 2596128 - RNA, 17 nt, Escherichia coli CFT073
aucaggcaacaucgcca

SEQ ID NO: 2596129 - RNA, 14 nt, Escherichia coli CFT073
aucaggcaacccgc

SEQ ID NO: 2596130 - RNA, 15 nt, Escherichia coli CFT073
aucaggcaacccgca

SEQ ID NO: 2596131 - RNA, 22 nt, Escherichia coli CFT073
aucaggcaagacgcauaaucca

SEQ ID NO: 2596132 - RNA, 13 nt, Escherichia coli CFT073
aucaggcauauuc

SEQ ID NO: 2596133 - RNA, 23 nt, Escherichia coli CFT073
aucaggcaugagggugacaucaa

SEQ ID NO: 2596134 - RNA, 12 nt, Escherichia coli CFT073
aucaggcauuag

SEQ ID NO: 2596135 - RNA, 18 nt, Escherichia coli CFT073
aucaggccaaccgcccau

SEQ ID NO: 2596136 - RNA, 22 nt, Escherichia coli CFT073
aucaggccuacaugauuucugc

SEQ ID NO: 2596137 - RNA, 20 nt, Escherichia coli CFT073
aucaggcgacacuucguuaa

SEQ ID NO: 2596138 - RNA, 15 nt, Escherichia coli CFT073
aucaggcguugauug

SEQ ID NO: 2596139 - RNA, 17 nt, Escherichia coli CFT073
aucaggcuacgcagcau

SEQ ID NO: 2596140 - RNA, 20 nt, Escherichia coli CFT073
aucaggcuaucuucgauaaa

SEQ ID NO: 2596141 - RNA, 18 nt, Escherichia coli CFT073
aucaggcuuguguaccug

SEQ ID NO: 2596142 - RNA, 17 nt, Escherichia coli CFT073
aucaggcuuuauucuga

SEQ ID NO: 2596143 - RNA, 18 nt, Escherichia coli CFT073
aucagggaagggucuuuu

SEQ ID NO: 2596144 - RNA, 18 nt, Escherichia coli CFT073
aucagggccaaucaacga

SEQ ID NO: 2596145 - RNA, 17 nt, Escherichia coli CFT073
aucagggcgaaacagag

SEQ ID NO: 2596146 - RNA, 20 nt, Escherichia coli CFT073
aucagguaguugccagcagc

SEQ ID NO: 2596147 - RNA, 15 nt, Escherichia coli CFT073
aucagguauaccgaa

SEQ ID NO: 2596148 - RNA, 22 nt, Escherichia coli CFT073
aucagguauaccgaaaucgcca

SEQ ID NO: 2596149 - RNA, 23 nt, Escherichia coli CFT073
aucagguauaccgaaaucgccau

SEQ ID NO: 2596150 - RNA, 16 nt, Escherichia coli CFT073
aucaggucgaaaauaa

SEQ ID NO: 2596151 - RNA, 14 nt, Escherichia coli CFT073
aucaggucuuucag

SEQ ID NO: 2596152 - RNA, 18 nt, Escherichia coli CFT073
aucaggucuuucagggug

SEQ ID NO: 2596153 - RNA, 16 nt, Escherichia coli CFT073
aucaggucuuucugaa

SEQ ID NO: 2596154 - RNA, 11 nt, Escherichia coli CFT073
aucagguugag

SEQ ID NO: 2596155 - RNA, 18 nt, Escherichia coli CFT073
auccacguuucuucuaau

SEQ ID NO: 2596156 - RNA, 20 nt, Escherichia coli CFT073
auccacuacuuaauaagcag

SEQ ID NO: 2596157 - RNA, 15 nt, Escherichia coli CFT073
auccacugaaacaug

SEQ ID NO: 2596158 - RNA, 21 nt, Escherichia coli CFT073
auccacugaaacaugaacauc

SEQ ID NO: 2596159 - RNA, 13 nt, Escherichia coli CFT073
auccacuggaauu

SEQ ID NO: 2596160 - RNA, 13 nt, Escherichia coli CFT073
auccagaaaaaaa

SEQ ID NO: 2596161 - RNA, 14 nt, Escherichia coli CFT073
auccagacugcgca

SEQ ID NO: 2596162 - RNA, 18 nt, Escherichia coli CFT073
auccagauccaauaccgc

SEQ ID NO: 2596163 - RNA, 17 nt, Escherichia coli CFT073
auccagauuuuucagua

SEQ ID NO: 2596164 - RNA, 14 nt, Escherichia coli CFT073
auccagcaacaaca

SEQ ID NO: 2596165 - RNA, 15 nt, Escherichia coli CFT073
auccagcaacaacag

SEQ ID NO: 2596166 - RNA, 23 nt, Escherichia coli CFT073
auccagcaccacuacagcggaac

SEQ ID NO: 2596167 - RNA, 24 nt, Escherichia coli CFT073
auccagcagaauaacaucguccau

SEQ ID NO: 2596168 - RNA, 21 nt, Escherichia coli CFT073
auccagcagagauacaggcca

SEQ ID NO: 2596169 - RNA, 13 nt, Escherichia coli CFT073
auccagcagugga

SEQ ID NO: 2596170 - RNA, 17 nt, Escherichia coli CFT073
auccagcaguggaucga

SEQ ID NO: 2596171 - RNA, 11 nt, Escherichia coli CFT073
auccagcaugc

SEQ ID NO: 2596172 - RNA, 19 nt, Escherichia coli CFT073
auccagcauucccgccacc

SEQ ID NO: 2596173 - RNA, 11 nt, Escherichia coli CFT073
auccagccaaa

SEQ ID NO: 2596174 - RNA, 16 nt, Escherichia coli CFT073
auccagccagcgccgc

SEQ ID NO: 2596175 - RNA, 13 nt, Escherichia coli CFT073
auccagccaggcg

SEQ ID NO: 2596176 - RNA, 22 nt, Escherichia coli CFT073
auccagccuacagaacgcugca

SEQ ID NO: 2596177 - RNA, 19 nt, Escherichia coli CFT073
auccagcgaaauaaaagug

SEQ ID NO: 2596178 - RNA, 16 nt, Escherichia coli CFT073
auccagcgcaaaggga

SEQ ID NO: 2596179 - RNA, 18 nt, Escherichia coli CFT073
auccagcgcaguuuuucc

SEQ ID NO: 2596180 - RNA, 11 nt, Escherichia coli CFT073
auccagcgccc

SEQ ID NO: 2596181 - RNA, 16 nt, Escherichia coli CFT073
auccagcgcccgcuuc

SEQ ID NO: 2596182 - RNA, 20 nt, Escherichia coli CFT073
auccagcgcggcgaaggugc

SEQ ID NO: 2596183 - RNA, 22 nt, Escherichia coli CFT073
auccagcgcggcgaaggugccu

SEQ ID NO: 2596184 - RNA, 23 nt, Escherichia coli CFT073
auccagcggcgagcuuuucugga

SEQ ID NO: 2596185 - RNA, 22 nt, Escherichia coli CFT073
auccagcgguuggagcacaaug

SEQ ID NO: 2596186 - RNA, 13 nt, Escherichia coli CFT073
auccagcgucgcc

SEQ ID NO: 2596187 - RNA, 15 nt, Escherichia coli CFT073
auccagcguuaccgg

SEQ ID NO: 2596188 - RNA, 20 nt, Escherichia coli CFT073
auccagcucgcguucuguca

SEQ ID NO: 2596189 - RNA, 17 nt, Escherichia coli CFT073
auccagcugccaggcac

SEQ ID NO: 2596190 - RNA, 20 nt, Escherichia coli CFT073
auccagcuuuuagaucacuc

SEQ ID NO: 2596191 - RNA, 16 nt, Escherichia coli CFT073
auccaggacauaucag

SEQ ID NO: 2596192 - RNA, 22 nt, Escherichia coli CFT073
auccaggcaaugacaucgcccu

SEQ ID NO: 2596193 - RNA, 22 nt, Escherichia coli CFT073
auccaggcacuggccuuuucac

SEQ ID NO: 2596194 - RNA, 19 nt, Escherichia coli CFT073
auccagggaucaacauuca

SEQ ID NO: 2596195 - RNA, 21 nt, Escherichia coli CFT073
auccagggguuguuauuuccg

SEQ ID NO: 2596196 - RNA, 15 nt, Escherichia coli CFT073
auccaggguuuuauu

SEQ ID NO: 2596197 - RNA, 21 nt, Escherichia coli CFT073
auccaggguuuuauuauucca

SEQ ID NO: 2596198 - RNA, 14 nt, Escherichia coli CFT073
auccaguaacgcgu

SEQ ID NO: 2596199 - RNA, 17 nt, Escherichia coli CFT073
auccaguacgccuucac

SEQ ID NO: 2596200 - RNA, 16 nt, Escherichia coli CFT073
auccagugauuccagu

SEQ ID NO: 2596201 - RNA, 11 nt, Escherichia coli CFT073
auccagugccg

SEQ ID NO: 2596202 - RNA, 16 nt, Escherichia coli CFT073
auccaguuccacaccu

SEQ ID NO: 2596203 - RNA, 22 nt, Escherichia coli CFT073
auccaguuccacaccuacgccc

SEQ ID NO: 2596204 - RNA, 14 nt, Escherichia coli CFT073
auccaguuccaguu

SEQ ID NO: 2596205 - RNA, 15 nt, Escherichia coli CFT073
auccaguuccuucaa

SEQ ID NO: 2596206 - RNA, 17 nt, Escherichia coli CFT073
auccauaaucacgcugu

SEQ ID NO: 2596207 - RNA, 14 nt, Escherichia coli CFT073
auccauaccagcac

SEQ ID NO: 2596208 - RNA, 15 nt, Escherichia coli CFT073
auccauaccagcaca

SEQ ID NO: 2596209 - RNA, 18 nt, Escherichia coli CFT073
auccauaccagcacauaa

SEQ ID NO: 2596210 - RNA, 15 nt, Escherichia coli CFT073
auccauacucuuucc

SEQ ID NO: 2596211 - RNA, 18 nt, Escherichia coli CFT073
auccauaucgauuucuac

SEQ ID NO: 2596212 - RNA, 20 nt, Escherichia coli CFT073
auccauauuuuuugaaaaau

SEQ ID NO: 2596213 - RNA, 12 nt, Escherichia coli CFT073
auccaucaccag

SEQ ID NO: 2596214 - RNA, 21 nt, Escherichia coli CFT073
auccaucagacuuugcgccau

SEQ ID NO: 2596215 - RNA, 21 nt, Escherichia coli CFT073
auccaucguugaauacauuca

SEQ ID NO: 2596216 - RNA, 22 nt, Escherichia coli CFT073
auccaucguugaauacauucau

SEQ ID NO: 2596217 - RNA, 18 nt, Escherichia coli CFT073
auccaucucgguuuucag

SEQ ID NO: 2596218 - RNA, 13 nt, Escherichia coli CFT073
auccaugaagcaa

SEQ ID NO: 2596219 - RNA, 18 nt, Escherichia coli CFT073
auccaugacaucuccagc

SEQ ID NO: 2596220 - RNA, 13 nt, Escherichia coli CFT073
auccaugccacag

SEQ ID NO: 2596221 - RNA, 12 nt, Escherichia coli CFT073
auccaugcggca

SEQ ID NO: 2596222 - RNA, 14 nt, Escherichia coli CFT073
auccauuaaaacug

SEQ ID NO: 2596223 - RNA, 15 nt, Escherichia coli CFT073
auccauucaucacgc

SEQ ID NO: 2596224 - RNA, 16 nt, Escherichia coli CFT073
auccauugaaaucaaa

SEQ ID NO: 2596225 - RNA, 22 nt, Escherichia coli CFT073
auccauugaaaucaaaaucacc

SEQ ID NO: 2596226 - RNA, 12 nt, Escherichia coli CFT073
auccauuuucga

SEQ ID NO: 2596227 - RNA, 16 nt, Escherichia coli CFT073
aucccaaaauacggca

SEQ ID NO: 2596228 - RNA, 23 nt, Escherichia coli CFT073
aucccaacugaucugccagcaga

SEQ ID NO: 2596229 - RNA, 11 nt, Escherichia coli CFT073
aucccacacug

SEQ ID NO: 2596230 - RNA, 23 nt, Escherichia coli CFT073
aucccacauauguuuaaccggca

SEQ ID NO: 2596231 - RNA, 18 nt, Escherichia coli CFT073
aucccaccagcgccgccc

SEQ ID NO: 2596232 - RNA, 18 nt, Escherichia coli CFT073
aucccacgggucgccuug

SEQ ID NO: 2596233 - RNA, 13 nt, Escherichia coli CFT073
aucccacucauca

SEQ ID NO: 2596234 - RNA, 19 nt, Escherichia coli CFT073
aucccagccaaugcaggca

SEQ ID NO: 2596235 - RNA, 19 nt, Escherichia coli CFT073
aucccaguccucaucaucc

SEQ ID NO: 2596236 - RNA, 20 nt, Escherichia coli CFT073
aucccagugaauuaaaaaca

SEQ ID NO: 2596237 - RNA, 18 nt, Escherichia coli CFT073
aucccaucgcagaaacga

SEQ ID NO: 2596238 - RNA, 22 nt, Escherichia coli CFT073
aucccaucgcagaaacgacacc

SEQ ID NO: 2596239 - RNA, 17 nt, Escherichia coli CFT073
aucccauuucuccacug

SEQ ID NO: 2596240 - RNA, 21 nt, Escherichia coli CFT073
aucccauuucuccacugggag

SEQ ID NO: 2596241 - RNA, 19 nt, Escherichia coli CFT073
auccccaccaaaacagcga

SEQ ID NO: 2596242 - RNA, 20 nt, Escherichia coli CFT073
auccccaccaaaacagcgac

SEQ ID NO: 2596243 - RNA, 22 nt, Escherichia coli CFT073
auccccaccaaaacagcgacac

SEQ ID NO: 2596244 - RNA, 14 nt, Escherichia coli CFT073
auccccagaaugcc

SEQ ID NO: 2596245 - RNA, 18 nt, Escherichia coli CFT073
auccccagccuaagccau

SEQ ID NO: 2596246 - RNA, 19 nt, Escherichia coli CFT073
auccccagcgucagcagca

SEQ ID NO: 2596247 - RNA, 17 nt, Escherichia coli CFT073
aucccccacuuuuaaau

SEQ ID NO: 2596248 - RNA, 17 nt, Escherichia coli CFT073
auccccccaagcggggg

SEQ ID NO: 2596249 - RNA, 21 nt, Escherichia coli CFT073
aucccccgauaaaacauuacu

SEQ ID NO: 2596250 - RNA, 17 nt, Escherichia coli CFT073
aucccccgcacacucca

SEQ ID NO: 2596251 - RNA, 15 nt, Escherichia coli CFT073
auccccgcagcaaac

SEQ ID NO: 2596252 - RNA, 15 nt, Escherichia coli CFT073
auccccgccagcacg

SEQ ID NO: 2596253 - RNA, 14 nt, Escherichia coli CFT073
auccccgccagcgu

SEQ ID NO: 2596254 - RNA, 13 nt, Escherichia coli CFT073
auccccggcaacc

SEQ ID NO: 2596255 - RNA, 23 nt, Escherichia coli CFT073
auccccgucaacggugcuuuaau

SEQ ID NO: 2596256 - RNA, 18 nt, Escherichia coli CFT073
auccccuacucucugugc

SEQ ID NO: 2596257 - RNA, 22 nt, Escherichia coli CFT073
auccccuccagcgagcuggcgc

SEQ ID NO: 2596258 - RNA, 17 nt, Escherichia coli CFT073
auccccucuucagccgc

SEQ ID NO: 2596259 - RNA, 17 nt, Escherichia coli CFT073
auccccugcccgauaaa

SEQ ID NO: 2596260 - RNA, 22 nt, Escherichia coli CFT073
auccccugcccgauaaaagcaa

SEQ ID NO: 2596261 - RNA, 20 nt, Escherichia coli CFT073
auccccuucucaaucccuuu

SEQ ID NO: 2596262 - RNA, 21 nt, Escherichia coli CFT073
auccccuucucaaucccuuuc

SEQ ID NO: 2596263 - RNA, 18 nt, Escherichia coli CFT073
auccggugauugcugccg

SEQ ID NO: 2596264 - RNA, 13 nt, Escherichia coli CFT073
auccgguguggca

SEQ ID NO: 2596265 - RNA, 14 nt, Escherichia coli CFT073
auccgguuaucaga

SEQ ID NO: 2596266 - RNA, 14 nt, Escherichia coli CFT073
auccgguuucauca

SEQ ID NO: 2596267 - RNA, 16 nt, Escherichia coli CFT073
auccgguuuuccagaa

SEQ ID NO: 2596268 - RNA, 17 nt, Escherichia coli CFT073
auccguacgcuuuucca

SEQ ID NO: 2596269 - RNA, 17 nt, Escherichia coli CFT073
auccguaugacaaacug

SEQ ID NO: 2596270 - RNA, 13 nt, Escherichia coli CFT073
auccguccgcaaa

SEQ ID NO: 2596271 - RNA, 23 nt, Escherichia coli CFT073
auccgucgccguaauuaacaccu

SEQ ID NO: 2596272 - RNA, 21 nt, Escherichia coli CFT073
auccguggcaaauugcccaag

SEQ ID NO: 2596273 - RNA, 22 nt, Escherichia coli CFT073
auccgugguggcagccagccau

SEQ ID NO: 2596274 - RNA, 21 nt, Escherichia coli CFT073
auccguuagcgaguugaucac

SEQ ID NO: 2596275 - RNA, 15 nt, Escherichia coli CFT073
auccguuauguuuca

SEQ ID NO: 2596276 - RNA, 17 nt, Escherichia coli CFT073
auccguucuucggcgcu

SEQ ID NO: 2596277 - RNA, 13 nt, Escherichia coli CFT073
auccguugaucgc

SEQ ID NO: 2596278 - RNA, 18 nt, Escherichia coli CFT073
auccguugaucgcucaua

SEQ ID NO: 2596279 - RNA, 22 nt, Escherichia coli CFT073
auccguuucagcuuauucauca

SEQ ID NO: 2596280 - RNA, 19 nt, Escherichia coli CFT073
auccucaaucggaaaacaa

SEQ ID NO: 2596281 - RNA, 15 nt, Escherichia coli CFT073
auccucagaaaucag

SEQ ID NO: 2596282 - RNA, 23 nt, Escherichia coli CFT073
auccucagaaaucagauaaaaca

SEQ ID NO: 2596283 - RNA, 16 nt, Escherichia coli CFT073
auccucauaaauugcu

SEQ ID NO: 2596284 - RNA, 21 nt, Escherichia coli CFT073
auccucccggaugcaccaucu

SEQ ID NO: 2596285 - RNA, 18 nt, Escherichia coli CFT073
auccuccgcagccaugag

SEQ ID NO: 2596286 - RNA, 12 nt, Escherichia coli CFT073
auccucuguaaa

SEQ ID NO: 2596287 - RNA, 18 nt, Escherichia coli CFT073
auccugaaagcugagaaa

SEQ ID NO: 2596288 - RNA, 20 nt, Escherichia coli CFT073
auccugaaagcugagaaaau

SEQ ID NO: 2596289 - RNA, 22 nt, Escherichia coli CFT073
auccugaaauuccugagaggau

SEQ ID NO: 2596290 - RNA, 19 nt, Escherichia coli CFT073
auccugagcaaacagucgc

SEQ ID NO: 2596291 - RNA, 15 nt, Escherichia coli CFT073
auccugauacagacc

SEQ ID NO: 2596292 - RNA, 22 nt, Escherichia coli CFT073
auccugaugcuucagauaccaa

SEQ ID NO: 2596293 - RNA, 21 nt, Escherichia coli CFT073
auccugcaaauaacgcuucag

SEQ ID NO: 2596294 - RNA, 22 nt, Escherichia coli CFT073
auccugcaaauaacgcuucagc

SEQ ID NO: 2596295 - RNA, 15 nt, Escherichia coli CFT073
auccugcaaauucaa

SEQ ID NO: 2596296 - RNA, 16 nt, Escherichia coli CFT073
auccugcaacaacacc

SEQ ID NO: 2596297 - RNA, 21 nt, Escherichia coli CFT073
auccugcaccacaacaccuuu

SEQ ID NO: 2596298 - RNA, 15 nt, Escherichia coli CFT073
auccugcacuguccc

SEQ ID NO: 2596299 - RNA, 21 nt, Escherichia coli CFT073
auccugcacuucaaauuucau

SEQ ID NO: 2596300 - RNA, 22 nt, Escherichia coli CFT073
auccugccagggucaguuucac

SEQ ID NO: 2596301 - RNA, 17 nt, Escherichia coli CFT073
auccugccaugcgcaau

SEQ ID NO: 2596302 - RNA, 22 nt, Escherichia coli CFT073
auccugccauuggcaggcucug

SEQ ID NO: 2596303 - RNA, 17 nt, Escherichia coli CFT073
auccugccggugaugag

SEQ ID NO: 2596304 - RNA, 18 nt, Escherichia coli CFT073
auccugccggugaugagc

SEQ ID NO: 2596305 - RNA, 21 nt, Escherichia coli CFT073
auccugcgguuugucaucauu

SEQ ID NO: 2596306 - RNA, 20 nt, Escherichia coli CFT073
auccugcugcacgcccugau

SEQ ID NO: 2596307 - RNA, 13 nt, Escherichia coli CFT073
auccuggcacagc

SEQ ID NO: 2596308 - RNA, 16 nt, Escherichia coli CFT073
auccuggcagcaucag

SEQ ID NO: 2596309 - RNA, 14 nt, Escherichia coli CFT073
auccugggcgagga

SEQ ID NO: 2596310 - RNA, 18 nt, Escherichia coli CFT073
auccuggggauucaucac

SEQ ID NO: 2596311 - RNA, 21 nt, Escherichia coli CFT073
auccuggggauucaucaccac

SEQ ID NO: 2596312 - RNA, 14 nt, Escherichia coli CFT073
auccuggucaaagu

SEQ ID NO: 2596313 - RNA, 15 nt, Escherichia coli CFT073
auccuggugaaaguu

SEQ ID NO: 2596314 - RNA, 16 nt, Escherichia coli CFT073
auccugugcuccagua

SEQ ID NO: 2596315 - RNA, 19 nt, Escherichia coli CFT073
auccugugcuccaguaccu

SEQ ID NO: 2596316 - RNA, 16 nt, Escherichia coli CFT073
auccuguggacgcagc

SEQ ID NO: 2596317 - RNA, 12 nt, Escherichia coli CFT073
auccuucaucuu

SEQ ID NO: 2596318 - RNA, 13 nt, Escherichia coli CFT073
auccuuccagcuc

SEQ ID NO: 2596319 - RNA, 14 nt, Escherichia coli CFT073
auccuuccagcucc

SEQ ID NO: 2596320 - RNA, 19 nt, Escherichia coli CFT073
auccuucccccaccaccau

SEQ ID NO: 2596321 - RNA, 21 nt, Escherichia coli CFT073
auccuucccccaccaccaucg

SEQ ID NO: 2596322 - RNA, 16 nt, Escherichia coli CFT073
auccuucccugcagua

SEQ ID NO: 2596323 - RNA, 11 nt, Escherichia coli CFT073
auccuuccgcc

SEQ ID NO: 2596324 - RNA, 23 nt, Escherichia coli CFT073
auccuugcagauauugcacccca

SEQ ID NO: 2596325 - RNA, 15 nt, Escherichia coli CFT073
auccuuuaucugccc

SEQ ID NO: 2596326 - RNA, 11 nt, Escherichia coli CFT073
auccuuuccuu

SEQ ID NO: 2596327 - RNA, 12 nt, Escherichia coli CFT073
auccuuuccuua

SEQ ID NO: 2596328 - RNA, 15 nt, Escherichia coli CFT073
auccuuucgaaaaac

SEQ ID NO: 2596329 - RNA, 22 nt, Escherichia coli CFT073
aucgaaaaagaaucgauuaucu

SEQ ID NO: 2596330 - RNA, 14 nt, Escherichia coli CFT073
aucgaaaaugccac

SEQ ID NO: 2596331 - RNA, 14 nt, Escherichia coli CFT073
aucgaaaccuucag

SEQ ID NO: 2596332 - RNA, 17 nt, Escherichia coli CFT073
aucgaaaccuucagcau

SEQ ID NO: 2596333 - RNA, 20 nt, Escherichia coli CFT073
aucgaaaccuucagcaucga

SEQ ID NO: 2596334 - RNA, 15 nt, Escherichia coli CFT073
aucgaaaucaaagua

SEQ ID NO: 2596335 - RNA, 15 nt, Escherichia coli CFT073
aucgaacgcagaggu

SEQ ID NO: 2596336 - RNA, 14 nt, Escherichia coli CFT073
aucgaacgcagcaa

SEQ ID NO: 2596337 - RNA, 15 nt, Escherichia coli CFT073
aucgaacguuuucac

SEQ ID NO: 2596338 - RNA, 23 nt, Escherichia coli CFT073
aucgaagauuacgccgaugucau

SEQ ID NO: 2596339 - RNA, 15 nt, Escherichia coli CFT073
aucgaaucaaacaug

SEQ ID NO: 2596340 - RNA, 20 nt, Escherichia coli CFT073
aucgacaaaacuuuuaucaa

SEQ ID NO: 2596341 - RNA, 15 nt, Escherichia coli CFT073
aucgacaccagccag

SEQ ID NO: 2596342 - RNA, 15 nt, Escherichia coli CFT073
aucgacagacgccag

SEQ ID NO: 2596343 - RNA, 21 nt, Escherichia coli CFT073
aucgacagguugaagaucaug

SEQ ID NO: 2596344 - RNA, 16 nt, Escherichia coli CFT073
aucgacaguugcugcg

SEQ ID NO: 2596345 - RNA, 14 nt, Escherichia coli CFT073
aucgacauucaaca

SEQ ID NO: 2596346 - RNA, 21 nt, Escherichia coli CFT073
aucgacauucaacauauccag

SEQ ID NO: 2596347 - RNA, 20 nt, Escherichia coli CFT073
aucgaccaggccaucagcag

SEQ ID NO: 2596348 - RNA, 22 nt, Escherichia coli CFT073
aucgaccaggccaucagcagcg

SEQ ID NO: 2596349 - RNA, 23 nt, Escherichia coli CFT073
aucgaccaugcugaugcuaccca

SEQ ID NO: 2596350 - RNA, 21 nt, Escherichia coli CFT073
aucgacguggugaaaucgccg

SEQ ID NO: 2596351 - RNA, 20 nt, Escherichia coli CFT073
aucgacuaacuucugaucua

SEQ ID NO: 2596352 - RNA, 21 nt, Escherichia coli CFT073
aucgacucgcaauuauaauac

SEQ ID NO: 2596353 - RNA, 20 nt, Escherichia coli CFT073
aucgacuguuuauuguugau

SEQ ID NO: 2596354 - RNA, 17 nt, Escherichia coli CFT073
aucgacuucgaagguuc

SEQ ID NO: 2596355 - RNA, 14 nt, Escherichia coli CFT073
aucgagcaguaauc

SEQ ID NO: 2596356 - RNA, 14 nt, Escherichia coli CFT073
aucgagccgauuaa

SEQ ID NO: 2596357 - RNA, 16 nt, Escherichia coli CFT073
aucgagccgauuaaaa

SEQ ID NO: 2596358 - RNA, 22 nt, Escherichia coli CFT073
aucgagcgcagcaacaucacgc

SEQ ID NO: 2596359 - RNA, 19 nt, Escherichia coli CFT073
aucgagcguugcuucgcca

SEQ ID NO: 2596360 - RNA, 22 nt, Escherichia coli CFT073
aucgagcugccugcggaugcgc

SEQ ID NO: 2596361 - RNA, 18 nt, Escherichia coli CFT073
aucgaggccauauuucac

SEQ ID NO: 2596362 - RNA, 19 nt, Escherichia coli CFT073
aucgaggccauauuucaca

SEQ ID NO: 2596363 - RNA, 24 nt, Escherichia coli CFT073
aucgagugcggcgagcaucgccca

SEQ ID NO: 2596364 - RNA, 13 nt, Escherichia coli CFT073
aucgauaaacagc

SEQ ID NO: 2596365 - RNA, 20 nt, Escherichia coli CFT073
aucgauaaacaguuccgcaa

SEQ ID NO: 2596366 - RNA, 14 nt, Escherichia coli CFT073
aucgauaacugcuc

SEQ ID NO: 2596367 - RNA, 15 nt, Escherichia coli CFT073
aucgauaacugcucu

SEQ ID NO: 2596368 - RNA, 19 nt, Escherichia coli CFT073
aucgauaacugcucuccca

SEQ ID NO: 2596369 - RNA, 17 nt, Escherichia coli CFT073
aucgauaaucaguaaug

SEQ ID NO: 2596370 - RNA, 18 nt, Escherichia coli CFT073
aucgauagaacggauauc

SEQ ID NO: 2596371 - RNA, 23 nt, Escherichia coli CFT073
aucgcgucgucgguguuaacaau

SEQ ID NO: 2596372 - RNA, 13 nt, Escherichia coli CFT073
aucgcguuuuaca

SEQ ID NO: 2596373 - RNA, 22 nt, Escherichia coli CFT073
aucgcuagauaggucaccagag

SEQ ID NO: 2596374 - RNA, 18 nt, Escherichia coli CFT073
aucgcuagauauauauua

SEQ ID NO: 2596375 - RNA, 13 nt, Escherichia coli CFT073
aucgcuaucaguc

SEQ ID NO: 2596376 - RNA, 22 nt, Escherichia coli CFT073
aucgcuauuaacccgcaacagc

SEQ ID NO: 2596377 - RNA, 18 nt, Escherichia coli CFT073
aucgcucacaacaauauc

SEQ ID NO: 2596378 - RNA, 16 nt, Escherichia coli CFT073
aucgcucccaaaccgc

SEQ ID NO: 2596379 - RNA, 19 nt, Escherichia coli CFT073
aucgcucccaaaccgccca

SEQ ID NO: 2596380 - RNA, 16 nt, Escherichia coli CFT073
aucgcugaacgcaccu

SEQ ID NO: 2596381 - RNA, 21 nt, Escherichia coli CFT073
aucgcugaacgcaccuuccag

SEQ ID NO: 2596382 - RNA, 20 nt, Escherichia coli CFT073
aucgcugaacgggccaucca

SEQ ID NO: 2596383 - RNA, 23 nt, Escherichia coli CFT073
aucgcugaacgggccauccauca

SEQ ID NO: 2596384 - RNA, 17 nt, Escherichia coli CFT073
aucgcugacacgggaaa

SEQ ID NO: 2596385 - RNA, 13 nt, Escherichia coli CFT073
aucgcugauauac

SEQ ID NO: 2596386 - RNA, 23 nt, Escherichia coli CFT073
aucgcuguacucaccaacgcaga

SEQ ID NO: 2596387 - RNA, 19 nt, Escherichia coli CFT073
aucgcuguuguucuuuuuc

SEQ ID NO: 2596388 - RNA, 16 nt, Escherichia coli CFT073
aucgcuucaauaccac

SEQ ID NO: 2596389 - RNA, 12 nt, Escherichia coli CFT073
aucgcuucaauc

SEQ ID NO: 2596390 - RNA, 16 nt, Escherichia coli CFT073
aucgcuucaucgccca

SEQ ID NO: 2596391 - RNA, 22 nt, Escherichia coli CFT073
aucgcuucaucgcccacaucau

SEQ ID NO: 2596392 - RNA, 21 nt, Escherichia coli CFT073
aucgcuuccauauuggcgcgg

SEQ ID NO: 2596393 - RNA, 22 nt, Escherichia coli CFT073
aucgcuuuaggguucgcgagau

SEQ ID NO: 2596394 - RNA, 23 nt, Escherichia coli CFT073
aucgcuuucaaaagccccugaau

SEQ ID NO: 2596395 - RNA, 14 nt, Escherichia coli CFT073
aucgcuuucaacgu

SEQ ID NO: 2596396 - RNA, 15 nt, Escherichia coli CFT073
aucgcuuuuucugca

SEQ ID NO: 2596397 - RNA, 19 nt, Escherichia coli CFT073
aucggaaaacaaccgccau

SEQ ID NO: 2596398 - RNA, 23 nt, Escherichia coli CFT073
aucggaagaucuguuuauugagg

SEQ ID NO: 2596399 - RNA, 16 nt, Escherichia coli CFT073
aucggaccauuggcau

SEQ ID NO: 2596400 - RNA, 22 nt, Escherichia coli CFT073
aucggagaacugcaacucaccu

SEQ ID NO: 2596401 - RNA, 15 nt, Escherichia coli CFT073
aucggagccaaaauc

SEQ ID NO: 2596402 - RNA, 18 nt, Escherichia coli CFT073
aucggaucaauccccaga

SEQ ID NO: 2596403 - RNA, 14 nt, Escherichia coli CFT073
aucggcaaucacgc

SEQ ID NO: 2596404 - RNA, 18 nt, Escherichia coli CFT073
aucggcacccaucgccag

SEQ ID NO: 2596405 - RNA, 14 nt, Escherichia coli CFT073
aucggcaccgccag

SEQ ID NO: 2596406 - RNA, 22 nt, Escherichia coli CFT073
aucggcaccgccagcaggaacg

SEQ ID NO: 2596407 - RNA, 14 nt, Escherichia coli CFT073
aucggcaccgccgc

SEQ ID NO: 2596408 - RNA, 16 nt, Escherichia coli CFT073
aucggcaccgccgcca

SEQ ID NO: 2596409 - RNA, 12 nt, Escherichia coli CFT073
aucggcagcaug

SEQ ID NO: 2596410 - RNA, 18 nt, Escherichia coli CFT073
aucggcaguuugagauug

SEQ ID NO: 2596411 - RNA, 19 nt, Escherichia coli CFT073
aucggcauacagcgacaga

SEQ ID NO: 2596412 - RNA, 18 nt, Escherichia coli CFT073
aucggcaucaggccaaac

SEQ ID NO: 2596413 - RNA, 13 nt, Escherichia coli CFT073
aucggcauucaca

SEQ ID NO: 2596414 - RNA, 14 nt, Escherichia coli CFT073
aucggcauugcucc

SEQ ID NO: 2596415 - RNA, 20 nt, Escherichia coli CFT073
aucggccaucgguacacauu

SEQ ID NO: 2596416 - RNA, 14 nt, Escherichia coli CFT073
aucggcccggcuuu

SEQ ID NO: 2596417 - RNA, 22 nt, Escherichia coli CFT073
aucggcgcauucgaucaccgca

SEQ ID NO: 2596418 - RNA, 19 nt, Escherichia coli CFT073
aucggcggcacucgcugac

SEQ ID NO: 2596419 - RNA, 14 nt, Escherichia coli CFT073
aucggcguaaucac

SEQ ID NO: 2596420 - RNA, 22 nt, Escherichia coli CFT073
aucggcguacuggcaaucgcca

SEQ ID NO: 2596421 - RNA, 19 nt, Escherichia coli CFT073
aucggcucauaaaaacucc

SEQ ID NO: 2596422 - RNA, 15 nt, Escherichia coli CFT073
aucggcugaacgugc

SEQ ID NO: 2596423 - RNA, 13 nt, Escherichia coli CFT073
aucggcuuuggca

SEQ ID NO: 2596424 - RNA, 16 nt, Escherichia coli CFT073
aucgggauauugcccu

SEQ ID NO: 2596425 - RNA, 14 nt, Escherichia coli CFT073
aucgggaugagcau

SEQ ID NO: 2596426 - RNA, 20 nt, Escherichia coli CFT073
aucgggaugguguucacuca

SEQ ID NO: 2596427 - RNA, 19 nt, Escherichia coli CFT073
aucgggccgacaaaaucag

SEQ ID NO: 2596428 - RNA, 17 nt, Escherichia coli CFT073
aucgggcgacagcugcg

SEQ ID NO: 2596429 - RNA, 22 nt, Escherichia coli CFT073
aucgggcuauuuuuauugugcc

SEQ ID NO: 2596430 - RNA, 15 nt, Escherichia coli CFT073
aucgggucaccugcc

SEQ ID NO: 2596431 - RNA, 11 nt, Escherichia coli CFT073
aucgguaauug

SEQ ID NO: 2596432 - RNA, 14 nt, Escherichia coli CFT073
aucgguagcaccag

SEQ ID NO: 2596433 - RNA, 14 nt, Escherichia coli CFT073
aucgguauaaccaa

SEQ ID NO: 2596434 - RNA, 22 nt, Escherichia coli CFT073
aucgguauagccguagcuggca

SEQ ID NO: 2596435 - RNA, 13 nt, Escherichia coli CFT073
aucggucagcgca

SEQ ID NO: 2596436 - RNA, 19 nt, Escherichia coli CFT073
aucggucauuaaggcauaa

SEQ ID NO: 2596437 - RNA, 23 nt, Escherichia coli CFT073
aucgguccgccacauaccacggc

SEQ ID NO: 2596438 - RNA, 21 nt, Escherichia coli CFT073
aucggucgaugcggauacggc

SEQ ID NO: 2596439 - RNA, 20 nt, Escherichia coli CFT073
aucggugagacgcacccuca

SEQ ID NO: 2596440 - RNA, 13 nt, Escherichia coli CFT073
aucggugauaaau

SEQ ID NO: 2596441 - RNA, 20 nt, Escherichia coli CFT073
aucggugguguaaccuucac

SEQ ID NO: 2596442 - RNA, 20 nt, Escherichia coli CFT073
aucggugugagaauauugcc

SEQ ID NO: 2596443 - RNA, 21 nt, Escherichia coli CFT073
aucgguuuuaacaccacucuu

SEQ ID NO: 2596444 - RNA, 15 nt, Escherichia coli CFT073
aucgguuuuuuucga

SEQ ID NO: 2596445 - RNA, 20 nt, Escherichia coli CFT073
aucguaccaggagucacgca

SEQ ID NO: 2596446 - RNA, 16 nt, Escherichia coli CFT073
aucguacucaaucccu

SEQ ID NO: 2596447 - RNA, 19 nt, Escherichia coli CFT073
aucguagauuucauccggc

SEQ ID NO: 2596448 - RNA, 20 nt, Escherichia coli CFT073
aucguaguuuuugcccauca

SEQ ID NO: 2596449 - RNA, 14 nt, Escherichia coli CFT073
aucguauuucagac

SEQ ID NO: 2596450 - RNA, 23 nt, Escherichia coli CFT073
aucgucaauaaucaugcagcgca

SEQ ID NO: 2596451 - RNA, 22 nt, Escherichia coli CFT073
aucgucaaugccgucaccagca

SEQ ID NO: 2596452 - RNA, 14 nt, Escherichia coli CFT073
aucgucacgcauca

SEQ ID NO: 2596453 - RNA, 15 nt, Escherichia coli CFT073
aucgucacgcaucac

SEQ ID NO: 2596454 - RNA, 17 nt, Escherichia coli CFT073
aucgucacgcaucacga

SEQ ID NO: 2596455 - RNA, 18 nt, Escherichia coli CFT073
aucgucacgcaucacgac

SEQ ID NO: 2596456 - RNA, 18 nt, Escherichia coli CFT073
aucgucagcaucucugca

SEQ ID NO: 2596457 - RNA, 17 nt, Escherichia coli CFT073
aucgucagccaaaucgc

SEQ ID NO: 2596458 - RNA, 22 nt, Escherichia coli CFT073
aucgucaggaagaagcccauca

SEQ ID NO: 2596459 - RNA, 14 nt, Escherichia coli CFT073
aucgucaucagcgc

SEQ ID NO: 2596460 - RNA, 16 nt, Escherichia coli CFT073
aucgucaucagcgcca

SEQ ID NO: 2596461 - RNA, 16 nt, Escherichia coli CFT073
aucguccagcagcaau

SEQ ID NO: 2596462 - RNA, 16 nt, Escherichia coli CFT073
aucguccagcgucagg

SEQ ID NO: 2596463 - RNA, 15 nt, Escherichia coli CFT073
aucguccagcugccu

SEQ ID NO: 2596464 - RNA, 20 nt, Escherichia coli CFT073
aucguccuccgaauaaauuu

SEQ ID NO: 2596465 - RNA, 15 nt, Escherichia coli CFT073
aucgucgccagacca

SEQ ID NO: 2596466 - RNA, 12 nt, Escherichia coli CFT073
aucgucugcggu

SEQ ID NO: 2596467 - RNA, 15 nt, Escherichia coli CFT073
aucgugaauuuuagg

SEQ ID NO: 2596468 - RNA, 23 nt, Escherichia coli CFT073
aucgugacaauaauucccagcac

SEQ ID NO: 2596469 - RNA, 14 nt, Escherichia coli CFT073
aucgugacagcaua

SEQ ID NO: 2596470 - RNA, 20 nt, Escherichia coli CFT073
aucgugcagcaccgccgcca

SEQ ID NO: 2596471 - RNA, 22 nt, Escherichia coli CFT073
aucgugcagcaccgccgccagg

SEQ ID NO: 2596472 - RNA, 20 nt, Escherichia coli CFT073
aucgugccaggaccauucac

SEQ ID NO: 2596473 - RNA, 18 nt, Escherichia coli CFT073
aucgugcgggaccagcac

SEQ ID NO: 2596474 - RNA, 17 nt, Escherichia coli CFT073
aucgugcucgacagcgc

SEQ ID NO: 2596475 - RNA, 20 nt, Escherichia coli CFT073
aucgugcuucacuucagcga

SEQ ID NO: 2596476 - RNA, 19 nt, Escherichia coli CFT073
aucguggccugcucacgca

SEQ ID NO: 2596477 - RNA, 15 nt, Escherichia coli CFT073
aucguguccggcaau

SEQ ID NO: 2596478 - RNA, 21 nt, Escherichia coli CFT073
aucguguggauaauccauccc

SEQ ID NO: 2596479 - RNA, 14 nt, Escherichia coli CFT073
aucugcugcguuug

SEQ ID NO: 2596480 - RNA, 21 nt, Escherichia coli CFT073
aucugcuggaaaggccgcgaa

SEQ ID NO: 2596481 - RNA, 19 nt, Escherichia coli CFT073
aucugcuguaaagucugga

SEQ ID NO: 2596482 - RNA, 23 nt, Escherichia coli CFT073
aucugcuugcgauguucuucacc

SEQ ID NO: 2596483 - RNA, 21 nt, Escherichia coli CFT073
aucugcuuuucauacaaucgg

SEQ ID NO: 2596484 - RNA, 19 nt, Escherichia coli CFT073
aucuggcaagccugaaaac

SEQ ID NO: 2596485 - RNA, 15 nt, Escherichia coli CFT073
aucuggcgagaacac

SEQ ID NO: 2596486 - RNA, 19 nt, Escherichia coli CFT073
aucuggcgagaacaccgag

SEQ ID NO: 2596487 - RNA, 15 nt, Escherichia coli CFT073
aucuggucagaugcg

SEQ ID NO: 2596488 - RNA, 16 nt, Escherichia coli CFT073
aucuggucaguuaaca

SEQ ID NO: 2596489 - RNA, 21 nt, Escherichia coli CFT073
aucuggucgaggaucucugca

SEQ ID NO: 2596490 - RNA, 23 nt, Escherichia coli CFT073
aucuggucgaggaucucugcaag

SEQ ID NO: 2596491 - RNA, 15 nt, Escherichia coli CFT073
aucuggugccagcgc

SEQ ID NO: 2596492 - RNA, 20 nt, Escherichia coli CFT073
aucuggugccagcgccagca

SEQ ID NO: 2596493 - RNA, 22 nt, Escherichia coli CFT073
aucuggugccagcgccagcacu

SEQ ID NO: 2596494 - RNA, 19 nt, Escherichia coli CFT073
aucugguguucuuuuacgc

SEQ ID NO: 2596495 - RNA, 17 nt, Escherichia coli CFT073
aucugguuuuugguuuc

SEQ ID NO: 2596496 - RNA, 21 nt, Escherichia coli CFT073
aucugguuuuugguuucacua

SEQ ID NO: 2596497 - RNA, 24 nt, Escherichia coli CFT073
aucuguacaggacgcaauguccau

SEQ ID NO: 2596498 - RNA, 17 nt, Escherichia coli CFT073
aucuguaucguuauuaa

SEQ ID NO: 2596499 - RNA, 19 nt, Escherichia coli CFT073
aucugucugauaaaaaacc

SEQ ID NO: 2596500 - RNA, 14 nt, Escherichia coli CFT073
aucugugaacucag

SEQ ID NO: 2596501 - RNA, 17 nt, Escherichia coli CFT073
aucugugcuugcagaua

SEQ ID NO: 2596502 - RNA, 22 nt, Escherichia coli CFT073
aucugugcuuguaaaacagcca

SEQ ID NO: 2596503 - RNA, 23 nt, Escherichia coli CFT073
aucugugcuuguaaaacagccaa

SEQ ID NO: 2596504 - RNA, 22 nt, Escherichia coli CFT073
aucugugggcaugcuucacuga

SEQ ID NO: 2596505 - RNA, 23 nt, Escherichia coli CFT073
aucugugggcaugcuucacugaa

SEQ ID NO: 2596506 - RNA, 18 nt, Escherichia coli CFT073
aucuguucaucagucagg

SEQ ID NO: 2596507 - RNA, 14 nt, Escherichia coli CFT073
aucuguuccggcuu

SEQ ID NO: 2596508 - RNA, 14 nt, Escherichia coli CFT073
aucuguucuggaaa

SEQ ID NO: 2596509 - RNA, 14 nt, Escherichia coli CFT073
aucuguucuuuuau

SEQ ID NO: 2596510 - RNA, 19 nt, Escherichia coli CFT073
aucuguugaaaaaaggcuu

SEQ ID NO: 2596511 - RNA, 14 nt, Escherichia coli CFT073
aucuguugaaauua

SEQ ID NO: 2596512 - RNA, 17 nt, Escherichia coli CFT073
aucuguugaaauuauug

SEQ ID NO: 2596513 - RNA, 21 nt, Escherichia coli CFT073
aucuguugauuuaacagcaaa

SEQ ID NO: 2596514 - RNA, 16 nt, Escherichia coli CFT073
aucuguugugccacau

SEQ ID NO: 2596515 - RNA, 22 nt, Escherichia coli CFT073
aucuguuuaucgcgcaaccaca

SEQ ID NO: 2596516 - RNA, 17 nt, Escherichia coli CFT073
aucuguuucucaugcag

SEQ ID NO: 2596517 - RNA, 12 nt, Escherichia coli CFT073
aucuguuuucaa

SEQ ID NO: 2596518 - RNA, 21 nt, Escherichia coli CFT073
aucuguuuuccgucugucaaa

SEQ ID NO: 2596519 - RNA, 18 nt, Escherichia coli CFT073
aucuuaauagcugccagc

SEQ ID NO: 2596520 - RNA, 13 nt, Escherichia coli CFT073
aucuuacguuuaa

SEQ ID NO: 2596521 - RNA, 15 nt, Escherichia coli CFT073
aucuuacguuuaaua

SEQ ID NO: 2596522 - RNA, 19 nt, Escherichia coli CFT073
aucuuacguuuaauauuac

SEQ ID NO: 2596523 - RNA, 13 nt, Escherichia coli CFT073
aucuuacugcaac

SEQ ID NO: 2596524 - RNA, 14 nt, Escherichia coli CFT073
aucuuacugcaacu

SEQ ID NO: 2596525 - RNA, 17 nt, Escherichia coli CFT073
aucuuagacaucaaaau

SEQ ID NO: 2596526 - RNA, 18 nt, Escherichia coli CFT073
aucuuagacaucaaaauu

SEQ ID NO: 2596527 - RNA, 16 nt, Escherichia coli CFT073
aucuuauucccacuuu

SEQ ID NO: 2596528 - RNA, 22 nt, Escherichia coli CFT073
aucuuauugaaagaucacaaug

SEQ ID NO: 2596529 - RNA, 18 nt, Escherichia coli CFT073
aucuuauugccauuuuca

SEQ ID NO: 2596530 - RNA, 23 nt, Escherichia coli CFT073
aucuucaacuacggcuuuuuuca

SEQ ID NO: 2596531 - RNA, 18 nt, Escherichia coli CFT073
aucuucaaucagaugugc

SEQ ID NO: 2596532 - RNA, 13 nt, Escherichia coli CFT073
aucuucacacaca

SEQ ID NO: 2596533 - RNA, 15 nt, Escherichia coli CFT073
aucuucacacacauc

SEQ ID NO: 2596534 - RNA, 15 nt, Escherichia coli CFT073
aucuucacaucauca

SEQ ID NO: 2596535 - RNA, 16 nt, Escherichia coli CFT073
aucuucacuaccaccu

SEQ ID NO: 2596536 - RNA, 13 nt, Escherichia coli CFT073
aucuucacugcgg

SEQ ID NO: 2596537 - RNA, 19 nt, Escherichia coli CFT073
aucuucaggaguagaaaua

SEQ ID NO: 2596538 - RNA, 17 nt, Escherichia coli CFT073
aucuucagucaggcgau

SEQ ID NO: 2596539 - RNA, 15 nt, Escherichia coli CFT073
aucuucagucgcauc

SEQ ID NO: 2596540 - RNA, 13 nt, Escherichia coli CFT073
aucuucaucaucu

SEQ ID NO: 2596541 - RNA, 20 nt, Escherichia coli CFT073
aucuucauccgccccggcuu

SEQ ID NO: 2596542 - RNA, 22 nt, Escherichia coli CFT073
aucuucauccgccccggcuuca

SEQ ID NO: 2596543 - RNA, 19 nt, Escherichia coli CFT073
aucuucaugcuccagcaga

SEQ ID NO: 2596544 - RNA, 13 nt, Escherichia coli CFT073
aucuucauugugc

SEQ ID NO: 2596545 - RNA, 17 nt, Escherichia coli CFT073
aucuucauugugcgguc

SEQ ID NO: 2596546 - RNA, 14 nt, Escherichia coli CFT073
aucuuccaccacca

SEQ ID NO: 2596547 - RNA, 17 nt, Escherichia coli CFT073
aucuuccagaucaccgc

SEQ ID NO: 2596548 - RNA, 21 nt, Escherichia coli CFT073
aucuuccagaucaccgcagaa

SEQ ID NO: 2596549 - RNA, 15 nt, Escherichia coli CFT073
aucuuccagcgcauc

SEQ ID NO: 2596550 - RNA, 18 nt, Escherichia coli CFT073
aucuuccagcggccagac

SEQ ID NO: 2596551 - RNA, 18 nt, Escherichia coli CFT073
aucuuccagggugacaaa

SEQ ID NO: 2596552 - RNA, 14 nt, Escherichia coli CFT073
aucuuccaguggca

SEQ ID NO: 2596553 - RNA, 13 nt, Escherichia coli CFT073
aucuucccagccc

SEQ ID NO: 2596554 - RNA, 19 nt, Escherichia coli CFT073
aucuucccagcccagcgcu

SEQ ID NO: 2596555 - RNA, 15 nt, Escherichia coli CFT073
aucuuccccuuuugc

SEQ ID NO: 2596556 - RNA, 18 nt, Escherichia coli CFT073
aucuucccgcgccagcgc

SEQ ID NO: 2596557 - RNA, 20 nt, Escherichia coli CFT073
aucuuccggcgggcaaacgg

SEQ ID NO: 2596558 - RNA, 17 nt, Escherichia coli CFT073
aucuuccggcguggcgu

SEQ ID NO: 2596559 - RNA, 18 nt, Escherichia coli CFT073
aucuuccgggcaacaauc

SEQ ID NO: 2596560 - RNA, 17 nt, Escherichia coli CFT073
aucuuccugauaaccuu

SEQ ID NO: 2596561 - RNA, 20 nt, Escherichia coli CFT073
aucuucgccugaaacagaag

SEQ ID NO: 2596562 - RNA, 18 nt, Escherichia coli CFT073
aucuucgucaaagauauu

SEQ ID NO: 2596563 - RNA, 20 nt, Escherichia coli CFT073
aucuucgucaaagauauuau

SEQ ID NO: 2596564 - RNA, 15 nt, Escherichia coli CFT073
aucuucguuauccca

SEQ ID NO: 2596565 - RNA, 20 nt, Escherichia coli CFT073
aucuucguuaucccaggcgu

SEQ ID NO: 2596566 - RNA, 14 nt, Escherichia coli CFT073
aucuucuccacgcc

SEQ ID NO: 2596567 - RNA, 16 nt, Escherichia coli CFT073
aucuucucucauccgc

SEQ ID NO: 2596568 - RNA, 14 nt, Escherichia coli CFT073
aucuucucuucccc

SEQ ID NO: 2596569 - RNA, 19 nt, Escherichia coli CFT073
aucuucugaagcaaacuug

SEQ ID NO: 2596570 - RNA, 22 nt, Escherichia coli CFT073
aucuucugaaucagaucaaguu

SEQ ID NO: 2596571 - RNA, 19 nt, Escherichia coli CFT073
aucuucugccaauuuuucg

SEQ ID NO: 2596572 - RNA, 20 nt, Escherichia coli CFT073
aucuucugccaauuuuucgc

SEQ ID NO: 2596573 - RNA, 21 nt, Escherichia coli CFT073
aucuucugccaauuuuucgcu

SEQ ID NO: 2596574 - RNA, 16 nt, Escherichia coli CFT073
aucuucuguugcaggg

SEQ ID NO: 2596575 - RNA, 14 nt, Escherichia coli CFT073
aucuucuucuaugc

SEQ ID NO: 2596576 - RNA, 20 nt, Escherichia coli CFT073
aucuucuugcagcuuaauca

SEQ ID NO: 2596577 - RNA, 16 nt, Escherichia coli CFT073
aucuucuuuauaucua

SEQ ID NO: 2596578 - RNA, 19 nt, Escherichia coli CFT073
aucuucuuucucggccacc

SEQ ID NO: 2596579 - RNA, 20 nt, Escherichia coli CFT073
aucuucuuugcgccagcggg

SEQ ID NO: 2596580 - RNA, 19 nt, Escherichia coli CFT073
aucuugauuugcuuguuuc

SEQ ID NO: 2596581 - RNA, 16 nt, Escherichia coli CFT073
aucuuguucauagugc

SEQ ID NO: 2596582 - RNA, 13 nt, Escherichia coli CFT073
aucuuuaaucgcu

SEQ ID NO: 2596583 - RNA, 17 nt, Escherichia coli CFT073
aucuuuaucaaucaccg

SEQ ID NO: 2596584 - RNA, 13 nt, Escherichia coli CFT073
aucuuucacgccc

SEQ ID NO: 2596585 - RNA, 17 nt, Escherichia coli CFT073
aucuuucacuuuugcca

SEQ ID NO: 2596586 - RNA, 16 nt, Escherichia coli CFT073
aucuuuccagccucug

SEQ ID NO: 2596587 - RNA, 17 nt, Escherichia coli CFT073
augagaacuccuggcga

SEQ ID NO: 2596588 - RNA, 18 nt, Escherichia coli CFT073
augagaaucuacaaaggg

SEQ ID NO: 2596589 - RNA, 11 nt, Escherichia coli CFT073
augagaaugcg

SEQ ID NO: 2596590 - RNA, 17 nt, Escherichia coli CFT073
augagacaaaacgacca

SEQ ID NO: 2596591 - RNA, 14 nt, Escherichia coli CFT073
augagauaaucaaa

SEQ ID NO: 2596592 - RNA, 15 nt, Escherichia coli CFT073
augagauacauuggu

SEQ ID NO: 2596593 - RNA, 19 nt, Escherichia coli CFT073
augagauccgcuucacuga

SEQ ID NO: 2596594 - RNA, 19 nt, Escherichia coli CFT073
augagcaagagcaccgcug

SEQ ID NO: 2596595 - RNA, 14 nt, Escherichia coli CFT073
augagcacaacaua

SEQ ID NO: 2596596 - RNA, 18 nt, Escherichia coli CFT073
augagcacaacauacuga

SEQ ID NO: 2596597 - RNA, 23 nt, Escherichia coli CFT073
augagcgugagguuaucgcccug

SEQ ID NO: 2596598 - RNA, 19 nt, Escherichia coli CFT073
augagcuauguuugaacca

SEQ ID NO: 2596599 - RNA, 23 nt, Escherichia coli CFT073
augagcugcaacuggcggcggcg

SEQ ID NO: 2596600 - RNA, 19 nt, Escherichia coli CFT073
augaggcguuaacagcgca

SEQ ID NO: 2596601 - RNA, 20 nt, Escherichia coli CFT073
augaggcguuuucgccgcau

SEQ ID NO: 2596602 - RNA, 18 nt, Escherichia coli CFT073
augaggcuuuaauaccug

SEQ ID NO: 2596603 - RNA, 20 nt, Escherichia coli CFT073
augaggcuuuaauaccugcc

SEQ ID NO: 2596604 - RNA, 15 nt, Escherichia coli CFT073
augagggaugggcga

SEQ ID NO: 2596605 - RNA, 18 nt, Escherichia coli CFT073
augagguucagccgagca

SEQ ID NO: 2596606 - RNA, 20 nt, Escherichia coli CFT073
augaguaaacuucaacgcug

SEQ ID NO: 2596607 - RNA, 13 nt, Escherichia coli CFT073
augagugccagau

SEQ ID NO: 2596608 - RNA, 20 nt, Escherichia coli CFT073
augaguuagcacaaccauca

SEQ ID NO: 2596609 - RNA, 19 nt, Escherichia coli CFT073
augaguuauacagaguguu

SEQ ID NO: 2596610 - RNA, 14 nt, Escherichia coli CFT073
augauaauaaaaac

SEQ ID NO: 2596611 - RNA, 16 nt, Escherichia coli CFT073
augauaccgauuacuc

SEQ ID NO: 2596612 - RNA, 12 nt, Escherichia coli CFT073
augauacucagc

SEQ ID NO: 2596613 - RNA, 20 nt, Escherichia coli CFT073
augauacuccacaucauuga

SEQ ID NO: 2596614 - RNA, 18 nt, Escherichia coli CFT073
augauacucgccgaacca

SEQ ID NO: 2596615 - RNA, 22 nt, Escherichia coli CFT073
augauacucgccgaaccaaacg

SEQ ID NO: 2596616 - RNA, 14 nt, Escherichia coli CFT073
augauagccaggcg

SEQ ID NO: 2596617 - RNA, 22 nt, Escherichia coli CFT073
augauaucagccugcaaacgcu

SEQ ID NO: 2596618 - RNA, 14 nt, Escherichia coli CFT073
augauaucccugcu

SEQ ID NO: 2596619 - RNA, 21 nt, Escherichia coli CFT073
augauaucgcuggcaggcaaa

SEQ ID NO: 2596620 - RNA, 18 nt, Escherichia coli CFT073
augauauguuuauuagcc

SEQ ID NO: 2596621 - RNA, 23 nt, Escherichia coli CFT073
augaucaaaaaaaucuucacuga

SEQ ID NO: 2596622 - RNA, 19 nt, Escherichia coli CFT073
augaucagcgguuuugcca

SEQ ID NO: 2596623 - RNA, 20 nt, Escherichia coli CFT073
augaucagcgguuuugccag

SEQ ID NO: 2596624 - RNA, 16 nt, Escherichia coli CFT073
augaucccagaaccag

SEQ ID NO: 2596625 - RNA, 16 nt, Escherichia coli CFT073
augauccugaucgggu

SEQ ID NO: 2596626 - RNA, 15 nt, Escherichia coli CFT073
augaucgacaggcuu

SEQ ID NO: 2596627 - RNA, 13 nt, Escherichia coli CFT073
augaucgccgcca

SEQ ID NO: 2596628 - RNA, 18 nt, Escherichia coli CFT073
augaucggcguacccagc

SEQ ID NO: 2596629 - RNA, 15 nt, Escherichia coli CFT073
augaucuccauugcc

SEQ ID NO: 2596630 - RNA, 22 nt, Escherichia coli CFT073
augaucugcgcccaauauccug

SEQ ID NO: 2596631 - RNA, 14 nt, Escherichia coli CFT073
augaugauugacca

SEQ ID NO: 2596632 - RNA, 21 nt, Escherichia coli CFT073
augaugauugaccauauuaac

SEQ ID NO: 2596633 - RNA, 23 nt, Escherichia coli CFT073
augaugcaccaccugauugcugc

SEQ ID NO: 2596634 - RNA, 18 nt, Escherichia coli CFT073
augaugcacuucagggcg

SEQ ID NO: 2596635 - RNA, 19 nt, Escherichia coli CFT073
augaugccacaaacuggcu

SEQ ID NO: 2596636 - RNA, 20 nt, Escherichia coli CFT073
augaugcccgguugcuuuuc

SEQ ID NO: 2596637 - RNA, 22 nt, Escherichia coli CFT073
augaugccgaagugaaucggau

SEQ ID NO: 2596638 - RNA, 15 nt, Escherichia coli CFT073
augaugccggaauca

SEQ ID NO: 2596639 - RNA, 18 nt, Escherichia coli CFT073
augaugccgucuuuaucg

SEQ ID NO: 2596640 - RNA, 22 nt, Escherichia coli CFT073
augaugcuacagcaacagggga

SEQ ID NO: 2596641 - RNA, 14 nt, Escherichia coli CFT073
augaugcuccgcca

SEQ ID NO: 2596642 - RNA, 16 nt, Escherichia coli CFT073
augaugucgaauuucu

SEQ ID NO: 2596643 - RNA, 14 nt, Escherichia coli CFT073
augauuaccagcau

SEQ ID NO: 2596644 - RNA, 15 nt, Escherichia coli CFT073
augauuaccagcauc

SEQ ID NO: 2596645 - RNA, 19 nt, Escherichia coli CFT073
augauuaccggagcugcag

SEQ ID NO: 2596646 - RNA, 21 nt, Escherichia coli CFT073
augauuacucccuugccugca

SEQ ID NO: 2596647 - RNA, 16 nt, Escherichia coli CFT073
augauuaucaugcccu

SEQ ID NO: 2596648 - RNA, 21 nt, Escherichia coli CFT073
augauuccgcagauauucguu

SEQ ID NO: 2596649 - RNA, 18 nt, Escherichia coli CFT073
augauugaccauauuaac

SEQ ID NO: 2596650 - RNA, 24 nt, Escherichia coli CFT073
augauugaccauauuaacgcagca

SEQ ID NO: 2596651 - RNA, 15 nt, Escherichia coli CFT073
augauugcgccgccg

SEQ ID NO: 2596652 - RNA, 19 nt, Escherichia coli CFT073
augauugcgccgccgccca

SEQ ID NO: 2596653 - RNA, 17 nt, Escherichia coli CFT073
augauuguaaguuuuca

SEQ ID NO: 2596654 - RNA, 15 nt, Escherichia coli CFT073
augauuuccaggaug

SEQ ID NO: 2596655 - RNA, 21 nt, Escherichia coli CFT073
augauuuucaucuuuugcgau

SEQ ID NO: 2596656 - RNA, 15 nt, Escherichia coli CFT073
augauuuuccugagg

SEQ ID NO: 2596657 - RNA, 13 nt, Escherichia coli CFT073
augauuuugcgcc

SEQ ID NO: 2596658 - RNA, 17 nt, Escherichia coli CFT073
augauuuugcgccagug

SEQ ID NO: 2596659 - RNA, 16 nt, Escherichia coli CFT073
augcaaaaaaugagua

SEQ ID NO: 2596660 - RNA, 17 nt, Escherichia coli CFT073
augcaaaaaggcgugca

SEQ ID NO: 2596661 - RNA, 17 nt, Escherichia coli CFT073
augcaaacgauuaucaa

SEQ ID NO: 2596662 - RNA, 23 nt, Escherichia coli CFT073
augcaaacgauuaucaacacauu

SEQ ID NO: 2596663 - RNA, 23 nt, Escherichia coli CFT073
augcaaauucaauauauugcaug

SEQ ID NO: 2596664 - RNA, 12 nt, Escherichia coli CFT073
augcaaauuucc

SEQ ID NO: 2596665 - RNA, 17 nt, Escherichia coli CFT073
augcaacugcccaggca

SEQ ID NO: 2596666 - RNA, 15 nt, Escherichia coli CFT073
augcaacuguuuuac

SEQ ID NO: 2596667 - RNA, 20 nt, Escherichia coli CFT073
augcaacuguuuuaccaaau

SEQ ID NO: 2596668 - RNA, 17 nt, Escherichia coli CFT073
augcaauaaaaaagccg

SEQ ID NO: 2596669 - RNA, 22 nt, Escherichia coli CFT073
augcaauagcgccugcugcugu

SEQ ID NO: 2596670 - RNA, 14 nt, Escherichia coli CFT073
augcaaucacugcc

SEQ ID NO: 2596671 - RNA, 15 nt, Escherichia coli CFT073
augcaauucacacag

SEQ ID NO: 2596672 - RNA, 17 nt, Escherichia coli CFT073
augcaauucacacagug

SEQ ID NO: 2596673 - RNA, 22 nt, Escherichia coli CFT073
augcaauucacacagugaaucu

SEQ ID NO: 2596674 - RNA, 17 nt, Escherichia coli CFT073
augcacacaaaauugcc

SEQ ID NO: 2596675 - RNA, 18 nt, Escherichia coli CFT073
augcacaggagacaccag

SEQ ID NO: 2596676 - RNA, 20 nt, Escherichia coli CFT073
augcacaggagacaccagcg

SEQ ID NO: 2596677 - RNA, 22 nt, Escherichia coli CFT073
augcacaggagacaccagcguc

SEQ ID NO: 2596678 - RNA, 15 nt, Escherichia coli CFT073
augcaccaucucuua

SEQ ID NO: 2596679 - RNA, 20 nt, Escherichia coli CFT073
augcacccgcaaaugaucau

SEQ ID NO: 2596680 - RNA, 17 nt, Escherichia coli CFT073
augcaccgacaauccag

SEQ ID NO: 2596681 - RNA, 18 nt, Escherichia coli CFT073
augcaccgacaauccagu

SEQ ID NO: 2596682 - RNA, 18 nt, Escherichia coli CFT073
augcaccuuuaccagacg

SEQ ID NO: 2596683 - RNA, 22 nt, Escherichia coli CFT073
augcaccuuuaccagacgggca

SEQ ID NO: 2596684 - RNA, 20 nt, Escherichia coli CFT073
augcacgcaaaaacgcauac

SEQ ID NO: 2596685 - RNA, 18 nt, Escherichia coli CFT073
augcacggcagauaaaca

SEQ ID NO: 2596686 - RNA, 23 nt, Escherichia coli CFT073
augcacguuccguauaccgucag

SEQ ID NO: 2596687 - RNA, 13 nt, Escherichia coli CFT073
augcagacucauu

SEQ ID NO: 2596688 - RNA, 14 nt, Escherichia coli CFT073
augcagagcaucca

SEQ ID NO: 2596689 - RNA, 14 nt, Escherichia coli CFT073
augcagauaacuua

SEQ ID NO: 2596690 - RNA, 15 nt, Escherichia coli CFT073
augcagauaacuuag

SEQ ID NO: 2596691 - RNA, 16 nt, Escherichia coli CFT073
augcagcauagaagaa

SEQ ID NO: 2596692 - RNA, 20 nt, Escherichia coli CFT073
augcagcauagaagaaauaa

SEQ ID NO: 2596693 - RNA, 14 nt, Escherichia coli CFT073
augcagcauccagc

SEQ ID NO: 2596694 - RNA, 17 nt, Escherichia coli CFT073
augcagccacugcugcg

SEQ ID NO: 2596695 - RNA, 13 nt, Escherichia coli CFT073
augcgaccgccgc

SEQ ID NO: 2596696 - RNA, 21 nt, Escherichia coli CFT073
augcgacgcagguuucgauua

SEQ ID NO: 2596697 - RNA, 14 nt, Escherichia coli CFT073
augcgacgcgggcc

SEQ ID NO: 2596698 - RNA, 18 nt, Escherichia coli CFT073
augcgacgcuugacgcgu

SEQ ID NO: 2596699 - RNA, 14 nt, Escherichia coli CFT073
augcgacgcuugcc

SEQ ID NO: 2596700 - RNA, 19 nt, Escherichia coli CFT073
augcgacgcuugccgcguc

SEQ ID NO: 2596701 - RNA, 18 nt, Escherichia coli CFT073
augcgacguuacaaccac

SEQ ID NO: 2596702 - RNA, 15 nt, Escherichia coli CFT073
augcgacguuuaccg

SEQ ID NO: 2596703 - RNA, 21 nt, Escherichia coli CFT073
augcgacguuuaccgcauccg

SEQ ID NO: 2596704 - RNA, 20 nt, Escherichia coli CFT073
augcgaguaaacaggggcug

SEQ ID NO: 2596705 - RNA, 18 nt, Escherichia coli CFT073
augcgagucaggccagga

SEQ ID NO: 2596706 - RNA, 18 nt, Escherichia coli CFT073
augcgagugucauucaga

SEQ ID NO: 2596707 - RNA, 17 nt, Escherichia coli CFT073
augcgauguucccccag

SEQ ID NO: 2596708 - RNA, 18 nt, Escherichia coli CFT073
augcgauuuauaucgcau

SEQ ID NO: 2596709 - RNA, 18 nt, Escherichia coli CFT073
augcgcaaccguaaacga

SEQ ID NO: 2596710 - RNA, 20 nt, Escherichia coli CFT073
augcgcaacgcaauccccuc

SEQ ID NO: 2596711 - RNA, 21 nt, Escherichia coli CFT073
augcgcacggaguaacaaaug

SEQ ID NO: 2596712 - RNA, 15 nt, Escherichia coli CFT073
augcgcagaagcaua

SEQ ID NO: 2596713 - RNA, 20 nt, Escherichia coli CFT073
augcgcaucaaggccaggca

SEQ ID NO: 2596714 - RNA, 21 nt, Escherichia coli CFT073
augcgccaacaucaauggaug

SEQ ID NO: 2596715 - RNA, 20 nt, Escherichia coli CFT073
augcgccagacgugcacgca

SEQ ID NO: 2596716 - RNA, 21 nt, Escherichia coli CFT073
augcgccagcugcauuucaua

SEQ ID NO: 2596717 - RNA, 16 nt, Escherichia coli CFT073
augcgccaguugcaua

SEQ ID NO: 2596718 - RNA, 15 nt, Escherichia coli CFT073
augcgccauaccaug

SEQ ID NO: 2596719 - RNA, 17 nt, Escherichia coli CFT073
augcgccauaccaugca

SEQ ID NO: 2596720 - RNA, 19 nt, Escherichia coli CFT073
augcgccgucagaguggcg

SEQ ID NO: 2596721 - RNA, 23 nt, Escherichia coli CFT073
augcgccuauaaacguucccgga

SEQ ID NO: 2596722 - RNA, 16 nt, Escherichia coli CFT073
augcgcgagguaacaa

SEQ ID NO: 2596723 - RNA, 15 nt, Escherichia coli CFT073
augcgcuaucgccug

SEQ ID NO: 2596724 - RNA, 14 nt, Escherichia coli CFT073
augcgcucaucggc

SEQ ID NO: 2596725 - RNA, 21 nt, Escherichia coli CFT073
augcgcucuguugguaaaugc

SEQ ID NO: 2596726 - RNA, 22 nt, Escherichia coli CFT073
augcgcugggcgguaauguuuu

SEQ ID NO: 2596727 - RNA, 22 nt, Escherichia coli CFT073
augcgcugucauucauucagau

SEQ ID NO: 2596728 - RNA, 21 nt, Escherichia coli CFT073
augcgcuucgcuuaccaugcc

SEQ ID NO: 2596729 - RNA, 15 nt, Escherichia coli CFT073
augcgcuugcagacg

SEQ ID NO: 2596730 - RNA, 15 nt, Escherichia coli CFT073
augcgcuuuaucguc

SEQ ID NO: 2596731 - RNA, 21 nt, Escherichia coli CFT073
augcggaugagauacauuggu

SEQ ID NO: 2596732 - RNA, 20 nt, Escherichia coli CFT073
augcggcagagaucgccgcu

SEQ ID NO: 2596733 - RNA, 22 nt, Escherichia coli CFT073
augcggcaucuucuccacgcca

SEQ ID NO: 2596734 - RNA, 16 nt, Escherichia coli CFT073
augcggcgugauaaaa

SEQ ID NO: 2596735 - RNA, 14 nt, Escherichia coli CFT073
augcgggauguauc

SEQ ID NO: 2596736 - RNA, 22 nt, Escherichia coli CFT073
augcgguacugaccaucagcag

SEQ ID NO: 2596737 - RNA, 14 nt, Escherichia coli CFT073
augcggucgcugcc

SEQ ID NO: 2596738 - RNA, 20 nt, Escherichia coli CFT073
augcggugcgccacaccgca

SEQ ID NO: 2596739 - RNA, 16 nt, Escherichia coli CFT073
augcguaccauuucuu

SEQ ID NO: 2596740 - RNA, 16 nt, Escherichia coli CFT073
augcgucuuccgugcc

SEQ ID NO: 2596741 - RNA, 18 nt, Escherichia coli CFT073
augcgucuuccgugccug

SEQ ID NO: 2596742 - RNA, 17 nt, Escherichia coli CFT073
augcgugcuucauucac

SEQ ID NO: 2596743 - RNA, 16 nt, Escherichia coli CFT073
augcguuccagcagaa

SEQ ID NO: 2596744 - RNA, 13 nt, Escherichia coli CFT073
augcuaauaauca

SEQ ID NO: 2596745 - RNA, 13 nt, Escherichia coli CFT073
augcuauaaaaau

SEQ ID NO: 2596746 - RNA, 13 nt, Escherichia coli CFT073
augcuaugcgcca

SEQ ID NO: 2596747 - RNA, 12 nt, Escherichia coli CFT073
augcucaagcau

SEQ ID NO: 2596748 - RNA, 15 nt, Escherichia coli CFT073
augcuccccagacca

SEQ ID NO: 2596749 - RNA, 22 nt, Escherichia coli CFT073
augcuccugauuggcagguggc

SEQ ID NO: 2596750 - RNA, 24 nt, Escherichia coli CFT073
augcucgcgaaaagaaacugugau

SEQ ID NO: 2596751 - RNA, 23 nt, Escherichia coli CFT073
augcucgcugcgaaguuuuuccg

SEQ ID NO: 2596752 - RNA, 16 nt, Escherichia coli CFT073
augcucgcuggcaggc

SEQ ID NO: 2596753 - RNA, 15 nt, Escherichia coli CFT073
augcucucccaaaua

SEQ ID NO: 2596754 - RNA, 14 nt, Escherichia coli CFT073
augcucugccagcg

SEQ ID NO: 2596755 - RNA, 20 nt, Escherichia coli CFT073
augcugaaauuacgcggugc

SEQ ID NO: 2596756 - RNA, 14 nt, Escherichia coli CFT073
augcugaauuagcc

SEQ ID NO: 2596757 - RNA, 18 nt, Escherichia coli CFT073
augcugacgugugauaau

SEQ ID NO: 2596758 - RNA, 19 nt, Escherichia coli CFT073
augcugcaccccacaaaca

SEQ ID NO: 2596759 - RNA, 15 nt, Escherichia coli CFT073
augcugccacacugc

SEQ ID NO: 2596760 - RNA, 17 nt, Escherichia coli CFT073
augcugccacacugccu

SEQ ID NO: 2596761 - RNA, 23 nt, Escherichia coli CFT073
augcugccgguuuauggaaaagu

SEQ ID NO: 2596762 - RNA, 15 nt, Escherichia coli CFT073
augcugccuucggug

SEQ ID NO: 2596763 - RNA, 17 nt, Escherichia coli CFT073
augcugcgggcgaucau

SEQ ID NO: 2596764 - RNA, 21 nt, Escherichia coli CFT073
augcugcgggcgaucauaucc

SEQ ID NO: 2596765 - RNA, 22 nt, Escherichia coli CFT073
augcugcuccagcguaccugcc

SEQ ID NO: 2596766 - RNA, 22 nt, Escherichia coli CFT073
augcugcucgcaaaauaaaaac

SEQ ID NO: 2596767 - RNA, 18 nt, Escherichia coli CFT073
augcugcuguuuuugaaa

SEQ ID NO: 2596768 - RNA, 21 nt, Escherichia coli CFT073
augcugcuuuaucagaucacg

SEQ ID NO: 2596769 - RNA, 22 nt, Escherichia coli CFT073
augcugcuuuaucagaucacgc

SEQ ID NO: 2596770 - RNA, 14 nt, Escherichia coli CFT073
augcuggaaccaca

SEQ ID NO: 2596771 - RNA, 18 nt, Escherichia coli CFT073
augcuggaaccacagcgc

SEQ ID NO: 2596772 - RNA, 22 nt, Escherichia coli CFT073
augcuggaggagauauugcgca

SEQ ID NO: 2596773 - RNA, 23 nt, Escherichia coli CFT073
augcuggcgcauuaacucacugg

SEQ ID NO: 2596774 - RNA, 18 nt, Escherichia coli CFT073
augcugggcgaucggcag

SEQ ID NO: 2596775 - RNA, 20 nt, Escherichia coli CFT073
augcugggcgaucggcagga

SEQ ID NO: 2596776 - RNA, 15 nt, Escherichia coli CFT073
augcugguuacugga

SEQ ID NO: 2596777 - RNA, 14 nt, Escherichia coli CFT073
augcugguuuugug

SEQ ID NO: 2596778 - RNA, 13 nt, Escherichia coli CFT073
augcugugcuccu

SEQ ID NO: 2596779 - RNA, 15 nt, Escherichia coli CFT073
augcuuaacgccaga

SEQ ID NO: 2596780 - RNA, 23 nt, Escherichia coli CFT073
augcuucacugaaacagauaaaa

SEQ ID NO: 2596781 - RNA, 13 nt, Escherichia coli CFT073
augcuucagauac

SEQ ID NO: 2596782 - RNA, 22 nt, Escherichia coli CFT073
augcuucagccagaggcggcaa

SEQ ID NO: 2596783 - RNA, 19 nt, Escherichia coli CFT073
augcuucaucgugacaauc

SEQ ID NO: 2596784 - RNA, 18 nt, Escherichia coli CFT073
augcuucgcucucuuuca

SEQ ID NO: 2596785 - RNA, 17 nt, Escherichia coli CFT073
augcuucuucugugaag

SEQ ID NO: 2596786 - RNA, 18 nt, Escherichia coli CFT073
augcuucuucugugaagc

SEQ ID NO: 2596787 - RNA, 20 nt, Escherichia coli CFT073
augcuuguuuauuaucaauu

SEQ ID NO: 2596788 - RNA, 23 nt, Escherichia coli CFT073
augcuuguuuauuaucaauuuua

SEQ ID NO: 2596789 - RNA, 20 nt, Escherichia coli CFT073
augcuuuacguauccguucc

SEQ ID NO: 2596790 - RNA, 12 nt, Escherichia coli CFT073
augcuuucagua

SEQ ID NO: 2596791 - RNA, 15 nt, Escherichia coli CFT073
augcuuucaguacug

SEQ ID NO: 2596792 - RNA, 19 nt, Escherichia coli CFT073
augcuuuuuccugagucag

SEQ ID NO: 2596793 - RNA, 19 nt, Escherichia coli CFT073
augcuuuuuuaaaaacaga

SEQ ID NO: 2596794 - RNA, 13 nt, Escherichia coli CFT073
auggaaacagcac

SEQ ID NO: 2596795 - RNA, 18 nt, Escherichia coli CFT073
auggaaacagcaccaucc

SEQ ID NO: 2596796 - RNA, 22 nt, Escherichia coli CFT073
auggaaauagaacguuuaucug

SEQ ID NO: 2596797 - RNA, 18 nt, Escherichia coli CFT073
auggaaaucacccagcga

SEQ ID NO: 2596798 - RNA, 14 nt, Escherichia coli CFT073
auggaauaacgaua

SEQ ID NO: 2596799 - RNA, 21 nt, Escherichia coli CFT073
auggaauucgcagcgaucugc

SEQ ID NO: 2596800 - RNA, 14 nt, Escherichia coli CFT073
auggacgauuauca

SEQ ID NO: 2596801 - RNA, 15 nt, Escherichia coli CFT073
auggacgcagaccaa

SEQ ID NO: 2596802 - RNA, 17 nt, Escherichia coli CFT073
auggacuuuuacugucu

SEQ ID NO: 2596803 - RNA, 12 nt, Escherichia coli CFT073
auguaaaucaau

SEQ ID NO: 2596804 - RNA, 13 nt, Escherichia coli CFT073
auguaaaucaauu

SEQ ID NO: 2596805 - RNA, 23 nt, Escherichia coli CFT073
auguaaccguuuguuuuuuaagg

SEQ ID NO: 2596806 - RNA, 13 nt, Escherichia coli CFT073
auguaacugccuu

SEQ ID NO: 2596807 - RNA, 20 nt, Escherichia coli CFT073
auguaagcgcauaaucaauc

SEQ ID NO: 2596808 - RNA, 16 nt, Escherichia coli CFT073
auguaaguaauuauua

SEQ ID NO: 2596809 - RNA, 16 nt, Escherichia coli CFT073
auguaauaaaccugcu

SEQ ID NO: 2596810 - RNA, 16 nt, Escherichia coli CFT073
auguaaugcauggccu

SEQ ID NO: 2596811 - RNA, 21 nt, Escherichia coli CFT073
auguaauuaagcgcaaaggcc

SEQ ID NO: 2596812 - RNA, 12 nt, Escherichia coli CFT073
auguaauucggc

SEQ ID NO: 2596813 - RNA, 14 nt, Escherichia coli CFT073
auguaccagacuga

SEQ ID NO: 2596814 - RNA, 15 nt, Escherichia coli CFT073
auguaccagacugac

SEQ ID NO: 2596815 - RNA, 21 nt, Escherichia coli CFT073
auguaccagacugacauguua

SEQ ID NO: 2596816 - RNA, 17 nt, Escherichia coli CFT073
auguaccagucaauaau

SEQ ID NO: 2596817 - RNA, 23 nt, Escherichia coli CFT073
auguacgcguaaaauauugcugc

SEQ ID NO: 2596818 - RNA, 14 nt, Escherichia coli CFT073
auguacuaaccaug

SEQ ID NO: 2596819 - RNA, 16 nt, Escherichia coli CFT073
auguacucaauugcuu

SEQ ID NO: 2596820 - RNA, 13 nt, Escherichia coli CFT073
auguagcgugauu

SEQ ID NO: 2596821 - RNA, 12 nt, Escherichia coli CFT073
auguagucaucu

SEQ ID NO: 2596822 - RNA, 23 nt, Escherichia coli CFT073
auguaguguuuuauaccaacaaa

SEQ ID NO: 2596823 - RNA, 16 nt, Escherichia coli CFT073
auguauacaaaaucug

SEQ ID NO: 2596824 - RNA, 13 nt, Escherichia coli CFT073
auguauaucggcc

SEQ ID NO: 2596825 - RNA, 21 nt, Escherichia coli CFT073
auguauauuauccaucaaagg

SEQ ID NO: 2596826 - RNA, 19 nt, Escherichia coli CFT073
auguaucgcccuuaccauu

SEQ ID NO: 2596827 - RNA, 20 nt, Escherichia coli CFT073
auguaucugaaguaaagaaa

SEQ ID NO: 2596828 - RNA, 18 nt, Escherichia coli CFT073
auguauuauaaguacuuu

SEQ ID NO: 2596829 - RNA, 21 nt, Escherichia coli CFT073
auguauuauaaguacuuucca

SEQ ID NO: 2596830 - RNA, 13 nt, Escherichia coli CFT073
auguauucuuuga

SEQ ID NO: 2596831 - RNA, 17 nt, Escherichia coli CFT073
auguauuucaucaucag

SEQ ID NO: 2596832 - RNA, 21 nt, Escherichia coli CFT073
augucacaaucccuuccaccg

SEQ ID NO: 2596833 - RNA, 13 nt, Escherichia coli CFT073
augucaccagcau

SEQ ID NO: 2596834 - RNA, 18 nt, Escherichia coli CFT073
augucacccacuguggua

SEQ ID NO: 2596835 - RNA, 20 nt, Escherichia coli CFT073
augucaccuaauuuaaaauu

SEQ ID NO: 2596836 - RNA, 22 nt, Escherichia coli CFT073
augucaccuaauuuaaaauuga

SEQ ID NO: 2596837 - RNA, 19 nt, Escherichia coli CFT073
augucagaaagaaauuucg

SEQ ID NO: 2596838 - RNA, 15 nt, Escherichia coli CFT073
augucagguauugcc

SEQ ID NO: 2596839 - RNA, 19 nt, Escherichia coli CFT073
augucaguaauugccgcgu

SEQ ID NO: 2596840 - RNA, 18 nt, Escherichia coli CFT073
augucaguugcauaccau

SEQ ID NO: 2596841 - RNA, 22 nt, Escherichia coli CFT073
augucauacaugguuugaucgc

SEQ ID NO: 2596842 - RNA, 17 nt, Escherichia coli CFT073
augucauacuauugcca

SEQ ID NO: 2596843 - RNA, 18 nt, Escherichia coli CFT073
augucaucccuuccugcc

SEQ ID NO: 2596844 - RNA, 20 nt, Escherichia coli CFT073
augucaucccuuccugcccu

SEQ ID NO: 2596845 - RNA, 18 nt, Escherichia coli CFT073
auguccauauauaaaauc

SEQ ID NO: 2596846 - RNA, 15 nt, Escherichia coli CFT073
auguccauuuccgga

SEQ ID NO: 2596847 - RNA, 22 nt, Escherichia coli CFT073
auguccguaacauaacagccau

SEQ ID NO: 2596848 - RNA, 20 nt, Escherichia coli CFT073
augucgaauuucucguaaau

SEQ ID NO: 2596849 - RNA, 19 nt, Escherichia coli CFT073
augucgacauaaucaaggu

SEQ ID NO: 2596850 - RNA, 18 nt, Escherichia coli CFT073
augucgauaucaggcaaa

SEQ ID NO: 2596851 - RNA, 16 nt, Escherichia coli CFT073
augucgcgcacugggu

SEQ ID NO: 2596852 - RNA, 12 nt, Escherichia coli CFT073
augucgcggaaa

SEQ ID NO: 2596853 - RNA, 20 nt, Escherichia coli CFT073
augucgcggaaauucacuuc

SEQ ID NO: 2596854 - RNA, 14 nt, Escherichia coli CFT073
augucgcugcacuu

SEQ ID NO: 2596855 - RNA, 17 nt, Escherichia coli CFT073
augucguagacgggcgu

SEQ ID NO: 2596856 - RNA, 17 nt, Escherichia coli CFT073
augucgucccuuucugg

SEQ ID NO: 2596857 - RNA, 22 nt, Escherichia coli CFT073
augucucgguagagaaaaccac

SEQ ID NO: 2596858 - RNA, 16 nt, Escherichia coli CFT073
augucucucagagaau

SEQ ID NO: 2596859 - RNA, 22 nt, Escherichia coli CFT073
augucugaugcgacgcggcagc

SEQ ID NO: 2596860 - RNA, 23 nt, Escherichia coli CFT073
augucugcaagagggacuccgga

SEQ ID NO: 2596861 - RNA, 20 nt, Escherichia coli CFT073
augucuggcgagcuccaggg

SEQ ID NO: 2596862 - RNA, 16 nt, Escherichia coli CFT073
augucuguucuggugu

SEQ ID NO: 2596863 - RNA, 17 nt, Escherichia coli CFT073
augucuucacaaccgcc

SEQ ID NO: 2596864 - RNA, 18 nt, Escherichia coli CFT073
augucuugccucccugca

SEQ ID NO: 2596865 - RNA, 14 nt, Escherichia coli CFT073
augugaacugacuc

SEQ ID NO: 2596866 - RNA, 18 nt, Escherichia coli CFT073
augugacuggaaaucaaa

SEQ ID NO: 2596867 - RNA, 22 nt, Escherichia coli CFT073
augugagucagaugcugugcaa

SEQ ID NO: 2596868 - RNA, 17 nt, Escherichia coli CFT073
augugaucgaauauauc

SEQ ID NO: 2596869 - RNA, 22 nt, Escherichia coli CFT073
augugaucgaauauaucagccu

SEQ ID NO: 2596870 - RNA, 19 nt, Escherichia coli CFT073
augugaugccgcauccggc

SEQ ID NO: 2596871 - RNA, 14 nt, Escherichia coli CFT073
augugcagcagugc

SEQ ID NO: 2596872 - RNA, 16 nt, Escherichia coli CFT073
augugcccggccaguc

SEQ ID NO: 2596873 - RNA, 18 nt, Escherichia coli CFT073
augugccggaugcaucac

SEQ ID NO: 2596874 - RNA, 20 nt, Escherichia coli CFT073
augugccugaugugcuccgc

SEQ ID NO: 2596875 - RNA, 20 nt, Escherichia coli CFT073
augugcuccgcucaucaggc

SEQ ID NO: 2596876 - RNA, 14 nt, Escherichia coli CFT073
augugcuuuuccuc

SEQ ID NO: 2596877 - RNA, 19 nt, Escherichia coli CFT073
augugguuaccaucaacca

SEQ ID NO: 2596878 - RNA, 15 nt, Escherichia coli CFT073
augugguuagcugga

SEQ ID NO: 2596879 - RNA, 20 nt, Escherichia coli CFT073
augugguuagcuggagaguu

SEQ ID NO: 2596880 - RNA, 19 nt, Escherichia coli CFT073
auguguacuucucugugac

SEQ ID NO: 2596881 - RNA, 13 nt, Escherichia coli CFT073
auguguuagcccu

SEQ ID NO: 2596882 - RNA, 16 nt, Escherichia coli CFT073
auguguuggcaccauc

SEQ ID NO: 2596883 - RNA, 17 nt, Escherichia coli CFT073
auguguuggcaccaucc

SEQ ID NO: 2596884 - RNA, 19 nt, Escherichia coli CFT073
auguguuggcaccaucccu

SEQ ID NO: 2596885 - RNA, 17 nt, Escherichia coli CFT073
auguguuuauaagccau

SEQ ID NO: 2596886 - RNA, 14 nt, Escherichia coli CFT073
auguuaauuauuuu

SEQ ID NO: 2596887 - RNA, 17 nt, Escherichia coli CFT073
auguuacaaccuccucc

SEQ ID NO: 2596888 - RNA, 18 nt, Escherichia coli CFT073
auguuacgaccuuccuga

SEQ ID NO: 2596889 - RNA, 12 nt, Escherichia coli CFT073
auguuauucaug

SEQ ID NO: 2596890 - RNA, 17 nt, Escherichia coli CFT073
auguucaauaaaagcau

SEQ ID NO: 2596891 - RNA, 17 nt, Escherichia coli CFT073
auguucaggauauuuau

SEQ ID NO: 2596892 - RNA, 18 nt, Escherichia coli CFT073
auguucauaucaaaaccu

SEQ ID NO: 2596893 - RNA, 15 nt, Escherichia coli CFT073
auguucaucaagcug

SEQ ID NO: 2596894 - RNA, 20 nt, Escherichia coli CFT073
auguucaucaagcugugccu

SEQ ID NO: 2596895 - RNA, 21 nt, Escherichia coli CFT073
auguucccccagccagaugcc

SEQ ID NO: 2596896 - RNA, 22 nt, Escherichia coli CFT073
auguuccggguuugccacaucg

SEQ ID NO: 2596897 - RNA, 15 nt, Escherichia coli CFT073
auguucguugcauuc

SEQ ID NO: 2596898 - RNA, 23 nt, Escherichia coli CFT073
auguucuucaauggucagccaca

SEQ ID NO: 2596899 - RNA, 22 nt, Escherichia coli CFT073
auguugauaaagaagugcucuu

SEQ ID NO: 2596900 - RNA, 22 nt, Escherichia coli CFT073
auguugaucaggugauggcagc

SEQ ID NO: 2596901 - RNA, 15 nt, Escherichia coli CFT073
auguugaucccugca

SEQ ID NO: 2596902 - RNA, 17 nt, Escherichia coli CFT073
auguugauuugcuggaa

SEQ ID NO: 2596903 - RNA, 14 nt, Escherichia coli CFT073
auguugcagaugcu

SEQ ID NO: 2596904 - RNA, 12 nt, Escherichia coli CFT073
auguugcagggc

SEQ ID NO: 2596905 - RNA, 20 nt, Escherichia coli CFT073
auguugcagggcauuccauc

SEQ ID NO: 2596906 - RNA, 17 nt, Escherichia coli CFT073
auguugcaguacucgca

SEQ ID NO: 2596907 - RNA, 23 nt, Escherichia coli CFT073
auguugcgcagaguuuccaggcu

SEQ ID NO: 2596908 - RNA, 20 nt, Escherichia coli CFT073
auguugcguucaucaguucc

SEQ ID NO: 2596909 - RNA, 17 nt, Escherichia coli CFT073
auguugcuuuaaaucgu

SEQ ID NO: 2596910 - RNA, 17 nt, Escherichia coli CFT073
auguuggagauaacaac

SEQ ID NO: 2596911 - RNA, 13 nt, Escherichia coli CFT073
auuaccaaucugc

SEQ ID NO: 2596912 - RNA, 14 nt, Escherichia coli CFT073
auuaccaaucugcu

SEQ ID NO: 2596913 - RNA, 14 nt, Escherichia coli CFT073
auuaccacaacaaa

SEQ ID NO: 2596914 - RNA, 14 nt, Escherichia coli CFT073
auuaccaccaccuu

SEQ ID NO: 2596915 - RNA, 12 nt, Escherichia coli CFT073
auuaccaccagc

SEQ ID NO: 2596916 - RNA, 23 nt, Escherichia coli CFT073
auuaccacugaggcgauagcauc

SEQ ID NO: 2596917 - RNA, 19 nt, Escherichia coli CFT073
auuaccagagaaaagauaa

SEQ ID NO: 2596918 - RNA, 14 nt, Escherichia coli CFT073
auuaccagcaucac

SEQ ID NO: 2596919 - RNA, 16 nt, Escherichia coli CFT073
auuaccagcaucaccg

SEQ ID NO: 2596920 - RNA, 14 nt, Escherichia coli CFT073
auuacccaguuuac

SEQ ID NO: 2596921 - RNA, 16 nt, Escherichia coli CFT073
auuaccccauccauug

SEQ ID NO: 2596922 - RNA, 22 nt, Escherichia coli CFT073
auuaccccguggugggguuccc

SEQ ID NO: 2596923 - RNA, 16 nt, Escherichia coli CFT073
auuacccucaaacgcc

SEQ ID NO: 2596924 - RNA, 20 nt, Escherichia coli CFT073
auuaccgaagggaucuucca

SEQ ID NO: 2596925 - RNA, 21 nt, Escherichia coli CFT073
auuaccgauaucaauaacaua

SEQ ID NO: 2596926 - RNA, 21 nt, Escherichia coli CFT073
auuaccgcaccaccagcagcu

SEQ ID NO: 2596927 - RNA, 21 nt, Escherichia coli CFT073
auuaccgccguacgucagcgc

SEQ ID NO: 2596928 - RNA, 15 nt, Escherichia coli CFT073
auuaccggagcugca

SEQ ID NO: 2596929 - RNA, 15 nt, Escherichia coli CFT073
auuaccggugucuuu

SEQ ID NO: 2596930 - RNA, 16 nt, Escherichia coli CFT073
auuaccgugaaucgga

SEQ ID NO: 2596931 - RNA, 15 nt, Escherichia coli CFT073
auuaccuaccaacgc

SEQ ID NO: 2596932 - RNA, 17 nt, Escherichia coli CFT073
auuaccuucaauacugg

SEQ ID NO: 2596933 - RNA, 18 nt, Escherichia coli CFT073
auuaccuucaauacuggc

SEQ ID NO: 2596934 - RNA, 22 nt, Escherichia coli CFT073
auuacgaaguuuaauucuuuga

SEQ ID NO: 2596935 - RNA, 20 nt, Escherichia coli CFT073
auuacgacggugaucaucaa

SEQ ID NO: 2596936 - RNA, 21 nt, Escherichia coli CFT073
auuacgacggugaucaucaaa

SEQ ID NO: 2596937 - RNA, 22 nt, Escherichia coli CFT073
auuacgcgaucgcgaaaccacg

SEQ ID NO: 2596938 - RNA, 11 nt, Escherichia coli CFT073
auuacgcgccu

SEQ ID NO: 2596939 - RNA, 17 nt, Escherichia coli CFT073
auuacgcgcuucguuga

SEQ ID NO: 2596940 - RNA, 18 nt, Escherichia coli CFT073
auuacgcggcuucaacuu

SEQ ID NO: 2596941 - RNA, 18 nt, Escherichia coli CFT073
auuacgcucgcugcaaaa

SEQ ID NO: 2596942 - RNA, 15 nt, Escherichia coli CFT073
auuacgcuucggcaa

SEQ ID NO: 2596943 - RNA, 23 nt, Escherichia coli CFT073
auuacgcuucggcaauuucagug

SEQ ID NO: 2596944 - RNA, 21 nt, Escherichia coli CFT073
auuacgggcgaaguucgccau

SEQ ID NO: 2596945 - RNA, 20 nt, Escherichia coli CFT073
auuacgggucacaaacauca

SEQ ID NO: 2596946 - RNA, 21 nt, Escherichia coli CFT073
auuacgggucacaaacaucau

SEQ ID NO: 2596947 - RNA, 15 nt, Escherichia coli CFT073
auuacguaccagaua

SEQ ID NO: 2596948 - RNA, 15 nt, Escherichia coli CFT073
auuacguccaccaga

SEQ ID NO: 2596949 - RNA, 19 nt, Escherichia coli CFT073
auuacguccaucacaauca

SEQ ID NO: 2596950 - RNA, 19 nt, Escherichia coli CFT073
auuacgugccgcguuaaug

SEQ ID NO: 2596951 - RNA, 15 nt, Escherichia coli CFT073
auuacuacaaacaau

SEQ ID NO: 2596952 - RNA, 17 nt, Escherichia coli CFT073
auuacuacaaacaaugc

SEQ ID NO: 2596953 - RNA, 14 nt, Escherichia coli CFT073
auuacucauuaauc

SEQ ID NO: 2596954 - RNA, 15 nt, Escherichia coli CFT073
auuacuccacuuccu

SEQ ID NO: 2596955 - RNA, 20 nt, Escherichia coli CFT073
auuacugaccuccaguccca

SEQ ID NO: 2596956 - RNA, 17 nt, Escherichia coli CFT073
auuacugccagcucacc

SEQ ID NO: 2596957 - RNA, 20 nt, Escherichia coli CFT073
auuacuggccuuuauuuucc

SEQ ID NO: 2596958 - RNA, 17 nt, Escherichia coli CFT073
auuacuggcuguauaua

SEQ ID NO: 2596959 - RNA, 20 nt, Escherichia coli CFT073
auuacuggcuguauauaaua

SEQ ID NO: 2596960 - RNA, 19 nt, Escherichia coli CFT073
auuacuguaggccaguauu

SEQ ID NO: 2596961 - RNA, 21 nt, Escherichia coli CFT073
auuacuucuugaugcggauaa

SEQ ID NO: 2596962 - RNA, 21 nt, Escherichia coli CFT073
auuacuuucggugacuucaaa

SEQ ID NO: 2596963 - RNA, 21 nt, Escherichia coli CFT073
auuagaauuauuagcaacgau

SEQ ID NO: 2596964 - RNA, 15 nt, Escherichia coli CFT073
auuagcaaugcccug

SEQ ID NO: 2596965 - RNA, 21 nt, Escherichia coli CFT073
auuagcaucaagaaaaauacu

SEQ ID NO: 2596966 - RNA, 22 nt, Escherichia coli CFT073
auuagcaucaagaaaaauacug

SEQ ID NO: 2596967 - RNA, 20 nt, Escherichia coli CFT073
auuagccgguaaaucaccau

SEQ ID NO: 2596968 - RNA, 20 nt, Escherichia coli CFT073
auuagcgauaaaacgccgcu

SEQ ID NO: 2596969 - RNA, 17 nt, Escherichia coli CFT073
auuagcggccagcgggc

SEQ ID NO: 2596970 - RNA, 16 nt, Escherichia coli CFT073
auuagcgucaccaucc

SEQ ID NO: 2596971 - RNA, 15 nt, Escherichia coli CFT073
auuagcuuaucaauc

SEQ ID NO: 2596972 - RNA, 13 nt, Escherichia coli CFT073
auuauaauaaaua

SEQ ID NO: 2596973 - RNA, 14 nt, Escherichia coli CFT073
auuauaauaaauau

SEQ ID NO: 2596974 - RNA, 17 nt, Escherichia coli CFT073
auuauacugcgcuuuua

SEQ ID NO: 2596975 - RNA, 16 nt, Escherichia coli CFT073
auuaucaaaucaccau

SEQ ID NO: 2596976 - RNA, 17 nt, Escherichia coli CFT073
auuaucaacguagaaua

SEQ ID NO: 2596977 - RNA, 22 nt, Escherichia coli CFT073
auuaucaacguagaauaaaagc

SEQ ID NO: 2596978 - RNA, 22 nt, Escherichia coli CFT073
auuaucaauugcuucaauaauc

SEQ ID NO: 2596979 - RNA, 12 nt, Escherichia coli CFT073
auuaucacauca

SEQ ID NO: 2596980 - RNA, 14 nt, Escherichia coli CFT073
auuaucacaucagc

SEQ ID NO: 2596981 - RNA, 20 nt, Escherichia coli CFT073
auuaucacccugaucaauaa

SEQ ID NO: 2596982 - RNA, 13 nt, Escherichia coli CFT073
auuauccagccag

SEQ ID NO: 2596983 - RNA, 14 nt, Escherichia coli CFT073
auuauccagcgccc

SEQ ID NO: 2596984 - RNA, 19 nt, Escherichia coli CFT073
auuaucccccgauaaaaca

SEQ ID NO: 2596985 - RNA, 13 nt, Escherichia coli CFT073
auuaucgagcugc

SEQ ID NO: 2596986 - RNA, 19 nt, Escherichia coli CFT073
auuaucggagaaauucugc

SEQ ID NO: 2596987 - RNA, 16 nt, Escherichia coli CFT073
auuaucuggcaagccu

SEQ ID NO: 2596988 - RNA, 16 nt, Escherichia coli CFT073
auuaucuggucaguua

SEQ ID NO: 2596989 - RNA, 18 nt, Escherichia coli CFT073
auuaucuggucaguuaac

SEQ ID NO: 2596990 - RNA, 16 nt, Escherichia coli CFT073
auuaugaaacaagaag

SEQ ID NO: 2596991 - RNA, 21 nt, Escherichia coli CFT073
auuaugcacaccccgcgccgc

SEQ ID NO: 2596992 - RNA, 19 nt, Escherichia coli CFT073
auuaugcagccuucauuca

SEQ ID NO: 2596993 - RNA, 19 nt, Escherichia coli CFT073
auuaugcguagccaggcuu

SEQ ID NO: 2596994 - RNA, 18 nt, Escherichia coli CFT073
auuaugcguuuugaucuu

SEQ ID NO: 2596995 - RNA, 21 nt, Escherichia coli CFT073
auuauggaucaauuucguuga

SEQ ID NO: 2596996 - RNA, 14 nt, Escherichia coli CFT073
auuauggugacaaa

SEQ ID NO: 2596997 - RNA, 16 nt, Escherichia coli CFT073
auuauuaccgucagaa

SEQ ID NO: 2596998 - RNA, 16 nt, Escherichia coli CFT073
auuauuacguccacca

SEQ ID NO: 2596999 - RNA, 23 nt, Escherichia coli CFT073
auuauuacguccaccagaacgac

SEQ ID NO: 2597000 - RNA, 14 nt, Escherichia coli CFT073
auuauuauuuuugu

SEQ ID NO: 2597001 - RNA, 15 nt, Escherichia coli CFT073
auuauucaaaaacag

SEQ ID NO: 2597002 - RNA, 17 nt, Escherichia coli CFT073
auuauucaaaaacagau

SEQ ID NO: 2597003 - RNA, 17 nt, Escherichia coli CFT073
auuauucauaaugccca

SEQ ID NO: 2597004 - RNA, 20 nt, Escherichia coli CFT073
auuauuccauccugcucaag

SEQ ID NO: 2597005 - RNA, 22 nt, Escherichia coli CFT073
auuauucccgcgcuaccacuuc

SEQ ID NO: 2597006 - RNA, 21 nt, Escherichia coli CFT073
auuauuccugcguuauacauu

SEQ ID NO: 2597007 - RNA, 16 nt, Escherichia coli CFT073
auuauucugacacugc

SEQ ID NO: 2597008 - RNA, 13 nt, Escherichia coli CFT073
auuauugagcgca

SEQ ID NO: 2597009 - RNA, 20 nt, Escherichia coli CFT073
auuauugagcgcaaauugcu

SEQ ID NO: 2597010 - RNA, 19 nt, Escherichia coli CFT073
auuauugccuugaugaaaa

SEQ ID NO: 2597011 - RNA, 23 nt, Escherichia coli CFT073
auuauuggcaucguauuucagac

SEQ ID NO: 2597012 - RNA, 12 nt, Escherichia coli CFT073
auuauuuauuca

SEQ ID NO: 2597013 - RNA, 14 nt, Escherichia coli CFT073
auuauuuuaaauuu

SEQ ID NO: 2597014 - RNA, 19 nt, Escherichia coli CFT073
auuauuuuugugaagaaua

SEQ ID NO: 2597015 - RNA, 22 nt, Escherichia coli CFT073
auuauuuuugugaagaauaaau

SEQ ID NO: 2597016 - RNA, 13 nt, Escherichia coli CFT073
auucaaaaacaga

SEQ ID NO: 2597017 - RNA, 17 nt, Escherichia coli CFT073
auucaaaaacagauugc

SEQ ID NO: 2597018 - RNA, 21 nt, Escherichia coli CFT073
auucaaaggugacguccagaa

SEQ ID NO: 2597019 - RNA, 18 nt, Escherichia coli CFT073
auucccccaccgccgccg

SEQ ID NO: 2597020 - RNA, 21 nt, Escherichia coli CFT073
auuccccggagcccuacaaac

SEQ ID NO: 2597021 - RNA, 19 nt, Escherichia coli CFT073
auuccccggucagcagcac

SEQ ID NO: 2597022 - RNA, 18 nt, Escherichia coli CFT073
auuccccugccagaagca

SEQ ID NO: 2597023 - RNA, 13 nt, Escherichia coli CFT073
auucccgccagau

SEQ ID NO: 2597024 - RNA, 19 nt, Escherichia coli CFT073
auucccgcgaacuaaacaa

SEQ ID NO: 2597025 - RNA, 13 nt, Escherichia coli CFT073
auucccgugcugc

SEQ ID NO: 2597026 - RNA, 19 nt, Escherichia coli CFT073
auucccuacgccuaccacc

SEQ ID NO: 2597027 - RNA, 22 nt, Escherichia coli CFT073
auucccuacgcgauaaaaaacc

SEQ ID NO: 2597028 - RNA, 14 nt, Escherichia coli CFT073
auucccuugucgca

SEQ ID NO: 2597029 - RNA, 14 nt, Escherichia coli CFT073
auuccgaauuucau

SEQ ID NO: 2597030 - RNA, 16 nt, Escherichia coli CFT073
auuccgcaacgccgcc

SEQ ID NO: 2597031 - RNA, 17 nt, Escherichia coli CFT073
auuccgcaacgccgcca

SEQ ID NO: 2597032 - RNA, 18 nt, Escherichia coli CFT073
auuccgcaacgccgccaa

SEQ ID NO: 2597033 - RNA, 18 nt, Escherichia coli CFT073
auuccgcaccugccagcg

SEQ ID NO: 2597034 - RNA, 19 nt, Escherichia coli CFT073
auuccgggaauucgaagcu

SEQ ID NO: 2597035 - RNA, 17 nt, Escherichia coli CFT073
auuccgggccaccaugc

SEQ ID NO: 2597036 - RNA, 21 nt, Escherichia coli CFT073
auuccgggccaccaugcccag

SEQ ID NO: 2597037 - RNA, 16 nt, Escherichia coli CFT073
auuccgugccagcacc

SEQ ID NO: 2597038 - RNA, 14 nt, Escherichia coli CFT073
auuccuaaaccauc

SEQ ID NO: 2597039 - RNA, 21 nt, Escherichia coli CFT073
auuccucaaacgugcggcagg

SEQ ID NO: 2597040 - RNA, 19 nt, Escherichia coli CFT073
auuccugaaucagccagua

SEQ ID NO: 2597041 - RNA, 20 nt, Escherichia coli CFT073
auuccugaaucagccaguaa

SEQ ID NO: 2597042 - RNA, 17 nt, Escherichia coli CFT073
auuccugacccagcacc

SEQ ID NO: 2597043 - RNA, 21 nt, Escherichia coli CFT073
auuccugacccagcaccagua

SEQ ID NO: 2597044 - RNA, 23 nt, Escherichia coli CFT073
auuccugacccagcaccaguacc

SEQ ID NO: 2597045 - RNA, 19 nt, Escherichia coli CFT073
auuccuggggucaucagca

SEQ ID NO: 2597046 - RNA, 15 nt, Escherichia coli CFT073
auuccuuaugcugcu

SEQ ID NO: 2597047 - RNA, 19 nt, Escherichia coli CFT073
auucgacacauucagaauu

SEQ ID NO: 2597048 - RNA, 15 nt, Escherichia coli CFT073
auucgacgcaaacaa

SEQ ID NO: 2597049 - RNA, 17 nt, Escherichia coli CFT073
auucgacuuucucuggc

SEQ ID NO: 2597050 - RNA, 20 nt, Escherichia coli CFT073
auucgacuuucucuggcugu

SEQ ID NO: 2597051 - RNA, 20 nt, Escherichia coli CFT073
auucgagagaauuaaccaga

SEQ ID NO: 2597052 - RNA, 21 nt, Escherichia coli CFT073
auucgagagaauuaaccagaa

SEQ ID NO: 2597053 - RNA, 13 nt, Escherichia coli CFT073
auucgauagagaa

SEQ ID NO: 2597054 - RNA, 18 nt, Escherichia coli CFT073
auucgcaauacauaagca

SEQ ID NO: 2597055 - RNA, 16 nt, Escherichia coli CFT073
auucgcagcgaucugc

SEQ ID NO: 2597056 - RNA, 20 nt, Escherichia coli CFT073
auucgccacugcgacaccag

SEQ ID NO: 2597057 - RNA, 19 nt, Escherichia coli CFT073
auucgccagcacggcgcag

SEQ ID NO: 2597058 - RNA, 18 nt, Escherichia coli CFT073
auucgccgaauuaaacaa

SEQ ID NO: 2597059 - RNA, 19 nt, Escherichia coli CFT073
auucgccguuaccagcacc

SEQ ID NO: 2597060 - RNA, 18 nt, Escherichia coli CFT073
auucgcgcacggugcauc

SEQ ID NO: 2597061 - RNA, 21 nt, Escherichia coli CFT073
auucgcgcacggugcaucuuc

SEQ ID NO: 2597062 - RNA, 21 nt, Escherichia coli CFT073
auucgcgcagaauuuggugaa

SEQ ID NO: 2597063 - RNA, 22 nt, Escherichia coli CFT073
auucgcuguaauucuucaagug

SEQ ID NO: 2597064 - RNA, 14 nt, Escherichia coli CFT073
auucgcuucaauac

SEQ ID NO: 2597065 - RNA, 17 nt, Escherichia coli CFT073
auucgcuuccuccacca

SEQ ID NO: 2597066 - RNA, 19 nt, Escherichia coli CFT073
auucgcuugcaaaagcagg

SEQ ID NO: 2597067 - RNA, 15 nt, Escherichia coli CFT073
auucggauccagcac

SEQ ID NO: 2597068 - RNA, 16 nt, Escherichia coli CFT073
auucggcaagauaaau

SEQ ID NO: 2597069 - RNA, 14 nt, Escherichia coli CFT073
auucggcaaucaca

SEQ ID NO: 2597070 - RNA, 12 nt, Escherichia coli CFT073
auucggcaaugg

SEQ ID NO: 2597071 - RNA, 21 nt, Escherichia coli CFT073
auucggcaaugguuucccugc

SEQ ID NO: 2597072 - RNA, 18 nt, Escherichia coli CFT073
auucgggcuuacuugcug

SEQ ID NO: 2597073 - RNA, 15 nt, Escherichia coli CFT073
auucguacaaacgcu

SEQ ID NO: 2597074 - RNA, 21 nt, Escherichia coli CFT073
auucguacaaacgcuuuacuc

SEQ ID NO: 2597075 - RNA, 22 nt, Escherichia coli CFT073
auucguacaaacgcuuuacuca

SEQ ID NO: 2597076 - RNA, 19 nt, Escherichia coli CFT073
auucgugugguaaaaccuu

SEQ ID NO: 2597077 - RNA, 16 nt, Escherichia coli CFT073
auucguuaacggcauu

SEQ ID NO: 2597078 - RNA, 18 nt, Escherichia coli CFT073
auucguugcaguaaaauu

SEQ ID NO: 2597079 - RNA, 23 nt, Escherichia coli CFT073
auucguuuuccagggccaguaca

SEQ ID NO: 2597080 - RNA, 17 nt, Escherichia coli CFT073
auucguuuucgcgcuua

SEQ ID NO: 2597081 - RNA, 22 nt, Escherichia coli CFT073
auucuacgaacugagacugucu

SEQ ID NO: 2597082 - RNA, 22 nt, Escherichia coli CFT073
auucuauuuugccaggcuaacc

SEQ ID NO: 2597083 - RNA, 16 nt, Escherichia coli CFT073
auucucacugauuacc

SEQ ID NO: 2597084 - RNA, 23 nt, Escherichia coli CFT073
auucuccaaacgucucuauuuca

SEQ ID NO: 2597085 - RNA, 12 nt, Escherichia coli CFT073
auucuccagcau

SEQ ID NO: 2597086 - RNA, 14 nt, Escherichia coli CFT073
auucucccgccugc

SEQ ID NO: 2597087 - RNA, 17 nt, Escherichia coli CFT073
auucuccggcaggaaau

SEQ ID NO: 2597088 - RNA, 13 nt, Escherichia coli CFT073
auucucgccagug

SEQ ID NO: 2597089 - RNA, 18 nt, Escherichia coli CFT073
auucucgucuugcguuuc

SEQ ID NO: 2597090 - RNA, 19 nt, Escherichia coli CFT073
auucugacacugccacuuu

SEQ ID NO: 2597091 - RNA, 13 nt, Escherichia coli CFT073
auucugacgccac

SEQ ID NO: 2597092 - RNA, 17 nt, Escherichia coli CFT073
auucugacgccaccauu

SEQ ID NO: 2597093 - RNA, 22 nt, Escherichia coli CFT073
auucugcaaggcaaaauacguu

SEQ ID NO: 2597094 - RNA, 16 nt, Escherichia coli CFT073
auucugcggccauuuu

SEQ ID NO: 2597095 - RNA, 21 nt, Escherichia coli CFT073
auucuggaguaaugcaugacu

SEQ ID NO: 2597096 - RNA, 22 nt, Escherichia coli CFT073
auucuggcuaaccaaacuucag

SEQ ID NO: 2597097 - RNA, 22 nt, Escherichia coli CFT073
auucuguaacucgaauuauuca

SEQ ID NO: 2597098 - RNA, 22 nt, Escherichia coli CFT073
auucuguucaguacgaaauaac

SEQ ID NO: 2597099 - RNA, 13 nt, Escherichia coli CFT073
auucuguuucauu

SEQ ID NO: 2597100 - RNA, 20 nt, Escherichia coli CFT073
auucuguuucauuaacccgc

SEQ ID NO: 2597101 - RNA, 12 nt, Escherichia coli CFT073
auucuucaacaa

SEQ ID NO: 2597102 - RNA, 18 nt, Escherichia coli CFT073
auucuugaauuguugaug

SEQ ID NO: 2597103 - RNA, 14 nt, Escherichia coli CFT073
auucuuugaucgcc

SEQ ID NO: 2597104 - RNA, 20 nt, Escherichia coli CFT073
auucuuuuuugauuccagua

SEQ ID NO: 2597105 - RNA, 20 nt, Escherichia coli CFT073
auugaaaauuacucaguaug

SEQ ID NO: 2597106 - RNA, 18 nt, Escherichia coli CFT073
auugaaagaucacaaugu

SEQ ID NO: 2597107 - RNA, 23 nt, Escherichia coli CFT073
auugaacggcaccgguacaggca

SEQ ID NO: 2597108 - RNA, 19 nt, Escherichia coli CFT073
auugaagcaauccauacca

SEQ ID NO: 2597109 - RNA, 21 nt, Escherichia coli CFT073
auugaagcagaucuucaggag

SEQ ID NO: 2597110 - RNA, 21 nt, Escherichia coli CFT073
auugaauguugacgcuaugug

SEQ ID NO: 2597111 - RNA, 15 nt, Escherichia coli CFT073
auugaauuaaaaugu

SEQ ID NO: 2597112 - RNA, 14 nt, Escherichia coli CFT073
auugaauuuucaau

SEQ ID NO: 2597113 - RNA, 18 nt, Escherichia coli CFT073
auugaccauauuaacgca

SEQ ID NO: 2597114 - RNA, 14 nt, Escherichia coli CFT073
auugacuaucugac

SEQ ID NO: 2597115 - RNA, 17 nt, Escherichia coli CFT073
auugagaaacagaaaaa

SEQ ID NO: 2597116 - RNA, 17 nt, Escherichia coli CFT073
auugagauccauuauga

SEQ ID NO: 2597117 - RNA, 16 nt, Escherichia coli CFT073
auugagauccugccag

SEQ ID NO: 2597118 - RNA, 20 nt, Escherichia coli CFT073
auugagaucgcuuaacagaa

SEQ ID NO: 2597119 - RNA, 23 nt, Escherichia coli CFT073
auugagaucuuucgcuuuaugau

SEQ ID NO: 2597120 - RNA, 23 nt, Escherichia coli CFT073
auugagcaaagacgcguucaucu

SEQ ID NO: 2597121 - RNA, 15 nt, Escherichia coli CFT073
auugagcaggaugac

SEQ ID NO: 2597122 - RNA, 12 nt, Escherichia coli CFT073
auugagcugccc

SEQ ID NO: 2597123 - RNA, 15 nt, Escherichia coli CFT073
auugaggccuuuaga

SEQ ID NO: 2597124 - RNA, 17 nt, Escherichia coli CFT073
auugaggcgcugaaugu

SEQ ID NO: 2597125 - RNA, 23 nt, Escherichia coli CFT073
auugagguaaacaggaauucggc

SEQ ID NO: 2597126 - RNA, 13 nt, Escherichia coli CFT073
auuggcaacagcc

SEQ ID NO: 2597127 - RNA, 14 nt, Escherichia coli CFT073
auuggcaacagcca

SEQ ID NO: 2597128 - RNA, 21 nt, Escherichia coli CFT073
auuggcaauugccauaaaaac

SEQ ID NO: 2597129 - RNA, 16 nt, Escherichia coli CFT073
auuggcaauuuugcug

SEQ ID NO: 2597130 - RNA, 20 nt, Escherichia coli CFT073
auuggcacaucuagccugau

SEQ ID NO: 2597131 - RNA, 21 nt, Escherichia coli CFT073
auuggcaccgacaucaggcga

SEQ ID NO: 2597132 - RNA, 23 nt, Escherichia coli CFT073
auuggcacugcgaccagugaaaa

SEQ ID NO: 2597133 - RNA, 18 nt, Escherichia coli CFT073
auuggcagguggcauguu

SEQ ID NO: 2597134 - RNA, 24 nt, Escherichia coli CFT073
auuggcauccgugguggcagccag

SEQ ID NO: 2597135 - RNA, 21 nt, Escherichia coli CFT073
auuggccgcgcaauugcugaa

SEQ ID NO: 2597136 - RNA, 17 nt, Escherichia coli CFT073
auuggcgcaaaggcgga

SEQ ID NO: 2597137 - RNA, 13 nt, Escherichia coli CFT073
auuggcgcgggcg

SEQ ID NO: 2597138 - RNA, 20 nt, Escherichia coli CFT073
auuggcgcgggcgucgaaaa

SEQ ID NO: 2597139 - RNA, 16 nt, Escherichia coli CFT073
auuggcguauuuccgg

SEQ ID NO: 2597140 - RNA, 14 nt, Escherichia coli CFT073
auuggcugggguac

SEQ ID NO: 2597141 - RNA, 15 nt, Escherichia coli CFT073
auugggaagauaaaa

SEQ ID NO: 2597142 - RNA, 17 nt, Escherichia coli CFT073
auugggauguugauuaa

SEQ ID NO: 2597143 - RNA, 21 nt, Escherichia coli CFT073
auuggggaugacgaauaauug

SEQ ID NO: 2597144 - RNA, 17 nt, Escherichia coli CFT073
auuggggucaucgcccu

SEQ ID NO: 2597145 - RNA, 14 nt, Escherichia coli CFT073
auuggguucaucug

SEQ ID NO: 2597146 - RNA, 16 nt, Escherichia coli CFT073
auugguaauacccaga

SEQ ID NO: 2597147 - RNA, 22 nt, Escherichia coli CFT073
auugguaauacccagacuuuuc

SEQ ID NO: 2597148 - RNA, 13 nt, Escherichia coli CFT073
auuggucagagca

SEQ ID NO: 2597149 - RNA, 20 nt, Escherichia coli CFT073
auuggugcuaauuugaaaug

SEQ ID NO: 2597150 - RNA, 13 nt, Escherichia coli CFT073
auugguggugugu

SEQ ID NO: 2597151 - RNA, 18 nt, Escherichia coli CFT073
auuggugguguguuugau

SEQ ID NO: 2597152 - RNA, 18 nt, Escherichia coli CFT073
auugguucagacgccacu

SEQ ID NO: 2597153 - RNA, 17 nt, Escherichia coli CFT073
auugguuucacccaguc

SEQ ID NO: 2597154 - RNA, 14 nt, Escherichia coli CFT073
auugguuucgucgu

SEQ ID NO: 2597155 - RNA, 13 nt, Escherichia coli CFT073
auuguacauuucc

SEQ ID NO: 2597156 - RNA, 18 nt, Escherichia coli CFT073
auuguacuuuaaaauaag

SEQ ID NO: 2597157 - RNA, 14 nt, Escherichia coli CFT073
auuguagaaaaucu

SEQ ID NO: 2597158 - RNA, 21 nt, Escherichia coli CFT073
auuguaucuagggacauagua

SEQ ID NO: 2597159 - RNA, 22 nt, Escherichia coli CFT073
auuguaugucggugcauuuucu

SEQ ID NO: 2597160 - RNA, 18 nt, Escherichia coli CFT073
auuguauugagauccugc

SEQ ID NO: 2597161 - RNA, 19 nt, Escherichia coli CFT073
auugucaauauccagcagg

SEQ ID NO: 2597162 - RNA, 17 nt, Escherichia coli CFT073
auugucaggaucaccaa

SEQ ID NO: 2597163 - RNA, 20 nt, Escherichia coli CFT073
auugucgagguuauaaaccc

SEQ ID NO: 2597164 - RNA, 16 nt, Escherichia coli CFT073
auugucgauacgccuc

SEQ ID NO: 2597165 - RNA, 18 nt, Escherichia coli CFT073
auugucgcggcuaacucc

SEQ ID NO: 2597166 - RNA, 19 nt, Escherichia coli CFT073
auugucugaacguucugcu

SEQ ID NO: 2597167 - RNA, 13 nt, Escherichia coli CFT073
auugucugcgccg

SEQ ID NO: 2597168 - RNA, 13 nt, Escherichia coli CFT073
auugucugcguug

SEQ ID NO: 2597169 - RNA, 23 nt, Escherichia coli CFT073
auugucugugucugauauuuuau

SEQ ID NO: 2597170 - RNA, 23 nt, Escherichia coli CFT073
auugucuuaaaccggacaauaaa

SEQ ID NO: 2597171 - RNA, 20 nt, Escherichia coli CFT073
auugucuucaucgaugcugc

SEQ ID NO: 2597172 - RNA, 16 nt, Escherichia coli CFT073
auugugaaguauuuaa

SEQ ID NO: 2597173 - RNA, 18 nt, Escherichia coli CFT073
auugugaaguauuuaaaa

SEQ ID NO: 2597174 - RNA, 15 nt, Escherichia coli CFT073
auugugauaaaaauc

SEQ ID NO: 2597175 - RNA, 21 nt, Escherichia coli CFT073
auugugauuaccgcaaaucac

SEQ ID NO: 2597176 - RNA, 21 nt, Escherichia coli CFT073
auugugcacagguaaacgcau

SEQ ID NO: 2597177 - RNA, 23 nt, Escherichia coli CFT073
auugugucgacauagccaucccu

SEQ ID NO: 2597178 - RNA, 14 nt, Escherichia coli CFT073
auugugugacacuu

SEQ ID NO: 2597179 - RNA, 17 nt, Escherichia coli CFT073
auugugugacacuucuu

SEQ ID NO: 2597180 - RNA, 20 nt, Escherichia coli CFT073
auuguuaaagcccugcucgc

SEQ ID NO: 2597181 - RNA, 14 nt, Escherichia coli CFT073
auuguuaaucacau

SEQ ID NO: 2597182 - RNA, 17 nt, Escherichia coli CFT073
auuguuauaccagucca

SEQ ID NO: 2597183 - RNA, 17 nt, Escherichia coli CFT073
auuguuaucagcaauaa

SEQ ID NO: 2597184 - RNA, 17 nt, Escherichia coli CFT073
auuguucaacgaaaaua

SEQ ID NO: 2597185 - RNA, 12 nt, Escherichia coli CFT073
auuguucugcaa

SEQ ID NO: 2597186 - RNA, 12 nt, Escherichia coli CFT073
auuguugauucg

SEQ ID NO: 2597187 - RNA, 15 nt, Escherichia coli CFT073
auuguugccggagaa

SEQ ID NO: 2597188 - RNA, 22 nt, Escherichia coli CFT073
auuguuggucacaaugcguaaa

SEQ ID NO: 2597189 - RNA, 12 nt, Escherichia coli CFT073
auuguuuuaaau

SEQ ID NO: 2597190 - RNA, 19 nt, Escherichia coli CFT073
auuguuuuuaucccggcaa

SEQ ID NO: 2597191 - RNA, 16 nt, Escherichia coli CFT073
auuuaaacccuuucug

SEQ ID NO: 2597192 - RNA, 11 nt, Escherichia coli CFT073
auuuaaacucg

SEQ ID NO: 2597193 - RNA, 13 nt, Escherichia coli CFT073
auuuaaacugaag

SEQ ID NO: 2597194 - RNA, 13 nt, Escherichia coli CFT073
auuuaacagcaaa

SEQ ID NO: 2597195 - RNA, 13 nt, Escherichia coli CFT073
auuuaacaucauu

SEQ ID NO: 2597196 - RNA, 18 nt, Escherichia coli CFT073
auuuaacccuucaagaau

SEQ ID NO: 2597197 - RNA, 14 nt, Escherichia coli CFT073
auuuaaccgcuuuc

SEQ ID NO: 2597198 - RNA, 18 nt, Escherichia coli CFT073
auuuaaccgcuuucaccg

SEQ ID NO: 2597199 - RNA, 14 nt, Escherichia coli CFT073
auuuaacggcagca

SEQ ID NO: 2597200 - RNA, 22 nt, Escherichia coli CFT073
auuuaacucaccgaugaucgcc

SEQ ID NO: 2597201 - RNA, 19 nt, Escherichia coli CFT073
auuuaagccacuuccagca

SEQ ID NO: 2597202 - RNA, 18 nt, Escherichia coli CFT073
auuuaagguuaugcaagu

SEQ ID NO: 2597203 - RNA, 21 nt, Escherichia coli CFT073
auuuaaugacgaaucagcaaa

SEQ ID NO: 2597204 - RNA, 12 nt, Escherichia coli CFT073
auuuaaugccaa

SEQ ID NO: 2597205 - RNA, 22 nt, Escherichia coli CFT073
auuuaauugguuuugcaggccg

SEQ ID NO: 2597206 - RNA, 17 nt, Escherichia coli CFT073
auuuaccagcacaucuu

SEQ ID NO: 2597207 - RNA, 18 nt, Escherichia coli CFT073
auuuaccagcacaucuua

SEQ ID NO: 2597208 - RNA, 22 nt, Escherichia coli CFT073
auuuaccgaccucaacaaaaua

SEQ ID NO: 2597209 - RNA, 19 nt, Escherichia coli CFT073
auuuaccucgguuaacagc

SEQ ID NO: 2597210 - RNA, 19 nt, Escherichia coli CFT073
auuuacgauggcagggcag

SEQ ID NO: 2597211 - RNA, 15 nt, Escherichia coli CFT073
auuuacgccgcaucc

SEQ ID NO: 2597212 - RNA, 20 nt, Escherichia coli CFT073
auuuacgccgcauccggcaa

SEQ ID NO: 2597213 - RNA, 19 nt, Escherichia coli CFT073
auuuacgcgucaguuuuuc

SEQ ID NO: 2597214 - RNA, 23 nt, Escherichia coli CFT073
auuuacgcugucuuuugaucaaa

SEQ ID NO: 2597215 - RNA, 15 nt, Escherichia coli CFT073
auuuacguucuuaca

SEQ ID NO: 2597216 - RNA, 14 nt, Escherichia coli CFT073
auuuacguuuuucu

SEQ ID NO: 2597217 - RNA, 13 nt, Escherichia coli CFT073
auuuacugcaugg

SEQ ID NO: 2597218 - RNA, 12 nt, Escherichia coli CFT073
auuuacuuucuu

SEQ ID NO: 2597219 - RNA, 16 nt, Escherichia coli CFT073
auuuagcgacccuggu

SEQ ID NO: 2597220 - RNA, 17 nt, Escherichia coli CFT073
auuuagcgaucuguuca

SEQ ID NO: 2597221 - RNA, 20 nt, Escherichia coli CFT073
auuuagcguuaaaauuucac

SEQ ID NO: 2597222 - RNA, 22 nt, Escherichia coli CFT073
auuuagcguuaaaauuucacau

SEQ ID NO: 2597223 - RNA, 14 nt, Escherichia coli CFT073
auuuaguauuuuau

SEQ ID NO: 2597224 - RNA, 19 nt, Escherichia coli CFT073
auuuaguauuuuauggcag

SEQ ID NO: 2597225 - RNA, 22 nt, Escherichia coli CFT073
auuuaguucauauaauuauuuu

SEQ ID NO: 2597226 - RNA, 14 nt, Escherichia coli CFT073
auuuauaaaaucca

SEQ ID NO: 2597227 - RNA, 21 nt, Escherichia coli CFT073
auuuaucgccugaugcgacac

SEQ ID NO: 2597228 - RNA, 22 nt, Escherichia coli CFT073
auuuaucggauaggccauaauc

SEQ ID NO: 2597229 - RNA, 18 nt, Escherichia coli CFT073
auuuaucucgucacuuuu

SEQ ID NO: 2597230 - RNA, 14 nt, Escherichia coli CFT073
auuuaucuucacca

SEQ ID NO: 2597231 - RNA, 17 nt, Escherichia coli CFT073
auuuaucuucaccaaau

SEQ ID NO: 2597232 - RNA, 12 nt, Escherichia coli CFT073
auuuaucuuccc

SEQ ID NO: 2597233 - RNA, 15 nt, Escherichia coli CFT073
auuuaucuucccagc

SEQ ID NO: 2597234 - RNA, 21 nt, Escherichia coli CFT073
auuugaucaagcucaucaaug

SEQ ID NO: 2597235 - RNA, 15 nt, Escherichia coli CFT073
auuugaugaauuuua

SEQ ID NO: 2597236 - RNA, 12 nt, Escherichia coli CFT073
auuugcaccacu

SEQ ID NO: 2597237 - RNA, 20 nt, Escherichia coli CFT073
auuugcaucacuccagucca

SEQ ID NO: 2597238 - RNA, 13 nt, Escherichia coli CFT073
auuugccagcgua

SEQ ID NO: 2597239 - RNA, 20 nt, Escherichia coli CFT073
auuugcccaucaggccaggc

SEQ ID NO: 2597240 - RNA, 23 nt, Escherichia coli CFT073
auuugcgacaaagcucaccugag

SEQ ID NO: 2597241 - RNA, 21 nt, Escherichia coli CFT073
auuugcgcucaauaaucaauc

SEQ ID NO: 2597242 - RNA, 18 nt, Escherichia coli CFT073
auuugcggugaagccacc

SEQ ID NO: 2597243 - RNA, 20 nt, Escherichia coli CFT073
auuugcggugaagccaccag

SEQ ID NO: 2597244 - RNA, 15 nt, Escherichia coli CFT073
auuugcguaaaaccu

SEQ ID NO: 2597245 - RNA, 13 nt, Escherichia coli CFT073
auuugcuccagaa

SEQ ID NO: 2597246 - RNA, 13 nt, Escherichia coli CFT073
auuugcuccgcca

SEQ ID NO: 2597247 - RNA, 22 nt, Escherichia coli CFT073
auuugcucuaccagccccauca

SEQ ID NO: 2597248 - RNA, 15 nt, Escherichia coli CFT073
auuugcugcuggcau

SEQ ID NO: 2597249 - RNA, 22 nt, Escherichia coli CFT073
auuugcugcuggcaucaccaaa

SEQ ID NO: 2597250 - RNA, 21 nt, Escherichia coli CFT073
auuugcuguagaugacacuca

SEQ ID NO: 2597251 - RNA, 14 nt, Escherichia coli CFT073
auuugcuugccgga

SEQ ID NO: 2597252 - RNA, 20 nt, Escherichia coli CFT073
auuugcuuguuucauuacuc

SEQ ID NO: 2597253 - RNA, 15 nt, Escherichia coli CFT073
auuugguagaauuug

SEQ ID NO: 2597254 - RNA, 17 nt, Escherichia coli CFT073
auuuguacucuuccggu

SEQ ID NO: 2597255 - RNA, 17 nt, Escherichia coli CFT073
auuuguaggccugauaa

SEQ ID NO: 2597256 - RNA, 19 nt, Escherichia coli CFT073
auuugucucaaaacugaaa

SEQ ID NO: 2597257 - RNA, 18 nt, Escherichia coli CFT073
auuugugcgucauuuuca

SEQ ID NO: 2597258 - RNA, 14 nt, Escherichia coli CFT073
auuuguggcgaugg

SEQ ID NO: 2597259 - RNA, 13 nt, Escherichia coli CFT073
auuuguucagcaa

SEQ ID NO: 2597260 - RNA, 13 nt, Escherichia coli CFT073
auuuguucaugcc

SEQ ID NO: 2597261 - RNA, 13 nt, Escherichia coli CFT073
auuuguucuggug

SEQ ID NO: 2597262 - RNA, 17 nt, Escherichia coli CFT073
auuuguugagcuggaag

SEQ ID NO: 2597263 - RNA, 14 nt, Escherichia coli CFT073
auuuguugccggau

SEQ ID NO: 2597264 - RNA, 13 nt, Escherichia coli CFT073
auuuguuggcgcu

SEQ ID NO: 2597265 - RNA, 21 nt, Escherichia coli CFT073
auuuguuuuucaggaaauaaa

SEQ ID NO: 2597266 - RNA, 22 nt, Escherichia coli CFT073
auuuguuuuucaggaaauaaau

SEQ ID NO: 2597267 - RNA, 13 nt, Escherichia coli CFT073
auuuuaaaaccac

SEQ ID NO: 2597268 - RNA, 15 nt, Escherichia coli CFT073
auuuuaaaggauuua

SEQ ID NO: 2597269 - RNA, 15 nt, Escherichia coli CFT073
auuuuacgcccgcga

SEQ ID NO: 2597270 - RNA, 22 nt, Escherichia coli CFT073
auuuuacugguugauuuuaaag

SEQ ID NO: 2597271 - RNA, 19 nt, Escherichia coli CFT073
auuuuacuguuuaagcgaa

SEQ ID NO: 2597272 - RNA, 13 nt, Escherichia coli CFT073
auuuuacuuccca

SEQ ID NO: 2597273 - RNA, 23 nt, Escherichia coli CFT073
auuuuaggaugcugcaauaaaau

SEQ ID NO: 2597274 - RNA, 14 nt, Escherichia coli CFT073
auuuuaguuuacau

SEQ ID NO: 2597275 - RNA, 19 nt, Escherichia coli CFT073
auuuuauauuacgccucag

SEQ ID NO: 2597276 - RNA, 16 nt, Escherichia coli CFT073
auuuuauccauauuuu

SEQ ID NO: 2597277 - RNA, 21 nt, Escherichia coli CFT073
auuuuauccauauuuuuugaa

SEQ ID NO: 2597278 - RNA, 23 nt, Escherichia coli CFT073
auuuuauccauauuuuuugaaaa

SEQ ID NO: 2597279 - RNA, 19 nt, Escherichia coli CFT073
auuuuauccgcaaagauuu

SEQ ID NO: 2597280 - RNA, 17 nt, Escherichia coli CFT073
auuuuauggcagaauac

SEQ ID NO: 2597281 - RNA, 16 nt, Escherichia coli CFT073
auuuuauuucaaaauu

SEQ ID NO: 2597282 - RNA, 14 nt, Escherichia coli CFT073
auuuucaauaacug

SEQ ID NO: 2597283 - RNA, 18 nt, Escherichia coli CFT073
auuuucaauugauaauaa

SEQ ID NO: 2597284 - RNA, 15 nt, Escherichia coli CFT073
auuuucaccagcauc

SEQ ID NO: 2597285 - RNA, 16 nt, Escherichia coli CFT073
auuuucaccaucgcca

SEQ ID NO: 2597286 - RNA, 22 nt, Escherichia coli CFT073
auuuucaccgugaauugcacuu

SEQ ID NO: 2597287 - RNA, 13 nt, Escherichia coli CFT073
auuuucagcgugc

SEQ ID NO: 2597288 - RNA, 13 nt, Escherichia coli CFT073
auuuucaucuuuu

SEQ ID NO: 2597289 - RNA, 14 nt, Escherichia coli CFT073
auuuuccagcucuu

SEQ ID NO: 2597290 - RNA, 15 nt, Escherichia coli CFT073
auuuuccccacaauc

SEQ ID NO: 2597291 - RNA, 23 nt, Escherichia coli CFT073
auuuucccugcguauuuuugcug

SEQ ID NO: 2597292 - RNA, 17 nt, Escherichia coli CFT073
auuuucccuucccgcaa

SEQ ID NO: 2597293 - RNA, 21 nt, Escherichia coli CFT073
auuuucccuucccgcaaugca

SEQ ID NO: 2597294 - RNA, 12 nt, Escherichia coli CFT073
auuuuccugcgc

SEQ ID NO: 2597295 - RNA, 16 nt, Escherichia coli CFT073
auuuuccuugaaaaag

SEQ ID NO: 2597296 - RNA, 14 nt, Escherichia coli CFT073
auuuucgccacuuc

SEQ ID NO: 2597297 - RNA, 13 nt, Escherichia coli CFT073
auuuucgccgccg

SEQ ID NO: 2597298 - RNA, 16 nt, Escherichia coli CFT073
auuuucgccgccgcgg

SEQ ID NO: 2597299 - RNA, 22 nt, Escherichia coli CFT073
auuuucguuccaggacuggcga

SEQ ID NO: 2597300 - RNA, 19 nt, Escherichia coli CFT073
auuuucuaugcugccacac

SEQ ID NO: 2597301 - RNA, 14 nt, Escherichia coli CFT073
auuuucucacuggc

SEQ ID NO: 2597302 - RNA, 17 nt, Escherichia coli CFT073
auuuucucgugccgcca

SEQ ID NO: 2597303 - RNA, 21 nt, Escherichia coli CFT073
auuuucucgugccgccaguac

SEQ ID NO: 2597304 - RNA, 19 nt, Escherichia coli CFT073
auuuucugcgcauuuccca

SEQ ID NO: 2597305 - RNA, 22 nt, Escherichia coli CFT073
auuuucuuccaguagcacaauc

SEQ ID NO: 2597306 - RNA, 21 nt, Escherichia coli CFT073
auuuucuugccggaugcggcg

SEQ ID NO: 2597307 - RNA, 17 nt, Escherichia coli CFT073
auuuugaaggaaaaauc

SEQ ID NO: 2597308 - RNA, 22 nt, Escherichia coli CFT073
auuuugacuuuuaauuucaucc

SEQ ID NO: 2597309 - RNA, 21 nt, Escherichia coli CFT073
auuuugaugauaucagccugc

SEQ ID NO: 2597310 - RNA, 20 nt, Escherichia coli CFT073
auuuugcacauuccagaugc

SEQ ID NO: 2597311 - RNA, 22 nt, Escherichia coli CFT073
auuuugcagcauucaucacaaa

SEQ ID NO: 2597312 - RNA, 14 nt, Escherichia coli CFT073
auuuugccagccgc

SEQ ID NO: 2597313 - RNA, 13 nt, Escherichia coli CFT073
auuuugccaguua

SEQ ID NO: 2597314 - RNA, 21 nt, Escherichia coli CFT073
auuuugccucgcccaccgggc

SEQ ID NO: 2597315 - RNA, 23 nt, Escherichia coli CFT073
auuuugcgagcagcauuccggca

SEQ ID NO: 2597316 - RNA, 22 nt, Escherichia coli CFT073
auuuugcgccagugccugacga

SEQ ID NO: 2597317 - RNA, 21 nt, Escherichia coli CFT073
auuuugcuuauuuaaacugaa

SEQ ID NO: 2597318 - RNA, 21 nt, Escherichia coli CFT073
auuuugcuuuaaguucagcca

SEQ ID NO: 2597319 - RNA, 19 nt, Escherichia coli CFT073
auuuugggcgggaucucca

SEQ ID NO: 2597320 - RNA, 22 nt, Escherichia coli CFT073
auuuugguaauucgccagccaa

SEQ ID NO: 2597321 - RNA, 19 nt, Escherichia coli CFT073
auuuuguaugcggcgaagg

SEQ ID NO: 2597322 - RNA, 16 nt, Escherichia coli CFT073
auuuugucagcccuuu

SEQ ID NO: 2597323 - RNA, 14 nt, Escherichia coli CFT073
auuuugugauuuau

SEQ ID NO: 2597324 - RNA, 14 nt, Escherichia coli CFT073
auuuuguuuaacgg

SEQ ID NO: 2597325 - RNA, 23 nt, Escherichia coli CFT073
auuuuuaacuucgcguucugugg

SEQ ID NO: 2597326 - RNA, 23 nt, Escherichia coli CFT073
auuuuuacaguugguauggcugu

SEQ ID NO: 2597327 - RNA, 16 nt, Escherichia coli CFT073
auuuuuacgaaacaga

SEQ ID NO: 2597328 - RNA, 23 nt, Escherichia coli CFT073
auuuuuacucuucuuuaauuaau

SEQ ID NO: 2597329 - RNA, 13 nt, Escherichia coli CFT073
auuuuuauaacua

SEQ ID NO: 2597330 - RNA, 21 nt, Escherichia coli CFT073
auuuuuaucguugugguuaaa

SEQ ID NO: 2597331 - RNA, 22 nt, Escherichia coli CFT073
auuuuuaucucaaaaauuacuc

SEQ ID NO: 2597332 - RNA, 23 nt, Escherichia coli CFT073
auuuuuaugaugcacuucagggc

SEQ ID NO: 2597333 - RNA, 14 nt, Escherichia coli CFT073
auuuuuauuaaaua

SEQ ID NO: 2597334 - RNA, 19 nt, Escherichia coli CFT073
auuuuuauuaaauauuaua

SEQ ID NO: 2597335 - RNA, 13 nt, Escherichia coli CFT073
auuuuucauaauc

SEQ ID NO: 2597336 - RNA, 15 nt, Escherichia coli CFT073
auuuuuccacuggau

SEQ ID NO: 2597337 - RNA, 16 nt, Escherichia coli CFT073
auuuuuccagcauuuc

SEQ ID NO: 2597338 - RNA, 23 nt, Escherichia coli CFT073
auuuuucgcgcgggcagaugcca

SEQ ID NO: 2597339 - RNA, 22 nt, Escherichia coli CFT073
auuuuugcauaugcgauacggu

SEQ ID NO: 2597340 - RNA, 19 nt, Escherichia coli CFT073
auuuuugccaucaaucacu

SEQ ID NO: 2597341 - RNA, 19 nt, Escherichia coli CFT073
auuuuugcgccaucaugau

SEQ ID NO: 2597342 - RNA, 12 nt, Escherichia coli CFT073
caaaauuuuugc

SEQ ID NO: 2597343 - RNA, 15 nt, Escherichia coli CFT073
caaacaaaaaaccua

SEQ ID NO: 2597344 - RNA, 19 nt, Escherichia coli CFT073
caaacaacggcacuucaau

SEQ ID NO: 2597345 - RNA, 15 nt, Escherichia coli CFT073
caaacaaugccagaa

SEQ ID NO: 2597346 - RNA, 12 nt, Escherichia coli CFT073
caaacaccagcu

SEQ ID NO: 2597347 - RNA, 18 nt, Escherichia coli CFT073
caaacaccgaaccagaga

SEQ ID NO: 2597348 - RNA, 22 nt, Escherichia coli CFT073
caaacacugcuuuuaaaugccc

SEQ ID NO: 2597349 - RNA, 23 nt, Escherichia coli CFT073
caaacagaauauugugcucacua

SEQ ID NO: 2597350 - RNA, 13 nt, Escherichia coli CFT073
caaacagaauuau

SEQ ID NO: 2597351 - RNA, 18 nt, Escherichia coli CFT073
caaacagaauuaucauuu

SEQ ID NO: 2597352 - RNA, 11 nt, Escherichia coli CFT073
caaacagacca

SEQ ID NO: 2597353 - RNA, 16 nt, Escherichia coli CFT073
caaacagcacggucag

SEQ ID NO: 2597354 - RNA, 13 nt, Escherichia coli CFT073
caaacagcagaac

SEQ ID NO: 2597355 - RNA, 14 nt, Escherichia coli CFT073
caaacagcgccugu

SEQ ID NO: 2597356 - RNA, 21 nt, Escherichia coli CFT073
caaacagggugcagcgagugc

SEQ ID NO: 2597357 - RNA, 14 nt, Escherichia coli CFT073
caaacaguaaccca

SEQ ID NO: 2597358 - RNA, 15 nt, Escherichia coli CFT073
caaacaguaacccag

SEQ ID NO: 2597359 - RNA, 23 nt, Escherichia coli CFT073
caaacagucacuuucgagcaauu

SEQ ID NO: 2597360 - RNA, 16 nt, Escherichia coli CFT073
caaacagucgcccgac

SEQ ID NO: 2597361 - RNA, 17 nt, Escherichia coli CFT073
caaacagucgcccgacc

SEQ ID NO: 2597362 - RNA, 22 nt, Escherichia coli CFT073
caaacagugaccaucuuccagc

SEQ ID NO: 2597363 - RNA, 16 nt, Escherichia coli CFT073
caaacaguugcugaua

SEQ ID NO: 2597364 - RNA, 18 nt, Escherichia coli CFT073
caaacauaaagccugaua

SEQ ID NO: 2597365 - RNA, 21 nt, Escherichia coli CFT073
caaacaucaugccggccagcg

SEQ ID NO: 2597366 - RNA, 15 nt, Escherichia coli CFT073
caaacauccaucugc

SEQ ID NO: 2597367 - RNA, 17 nt, Escherichia coli CFT073
caaacaucggcuuauuc

SEQ ID NO: 2597368 - RNA, 18 nt, Escherichia coli CFT073
caaacauugcugccagaa

SEQ ID NO: 2597369 - RNA, 23 nt, Escherichia coli CFT073
caaaccagauaauaaaaaaggca

SEQ ID NO: 2597370 - RNA, 23 nt, Escherichia coli CFT073
caaaccagccgccaacuccacca

SEQ ID NO: 2597371 - RNA, 13 nt, Escherichia coli CFT073
caaaccaucacaa

SEQ ID NO: 2597372 - RNA, 22 nt, Escherichia coli CFT073
caaaccaucugauucuucccau

SEQ ID NO: 2597373 - RNA, 16 nt, Escherichia coli CFT073
caaacccuucuucaau

SEQ ID NO: 2597374 - RNA, 13 nt, Escherichia coli CFT073
caaaccgacgcug

SEQ ID NO: 2597375 - RNA, 16 nt, Escherichia coli CFT073
caaaccgacgcugucc

SEQ ID NO: 2597376 - RNA, 14 nt, Escherichia coli CFT073
caaaccgcccagca

SEQ ID NO: 2597377 - RNA, 23 nt, Escherichia coli CFT073
caaaccgcccagcagcgccgcgc

SEQ ID NO: 2597378 - RNA, 14 nt, Escherichia coli CFT073
caaaccguaaagca

SEQ ID NO: 2597379 - RNA, 19 nt, Escherichia coli CFT073
caaaccguuaauccgcccu

SEQ ID NO: 2597380 - RNA, 19 nt, Escherichia coli CFT073
caaaccugcaaugauguca

SEQ ID NO: 2597381 - RNA, 19 nt, Escherichia coli CFT073
caaaccuucguuagcuaau

SEQ ID NO: 2597382 - RNA, 13 nt, Escherichia coli CFT073
caaaccuuucgcc

SEQ ID NO: 2597383 - RNA, 15 nt, Escherichia coli CFT073
caaacgaaugcaggc

SEQ ID NO: 2597384 - RNA, 22 nt, Escherichia coli CFT073
caaacgacacugcucgcagaaa

SEQ ID NO: 2597385 - RNA, 17 nt, Escherichia coli CFT073
caaacgauuaucaacac

SEQ ID NO: 2597386 - RNA, 17 nt, Escherichia coli CFT073
caaacgauucggcaauc

SEQ ID NO: 2597387 - RNA, 17 nt, Escherichia coli CFT073
caaacgcaaaacugccu

SEQ ID NO: 2597388 - RNA, 16 nt, Escherichia coli CFT073
caaacgcaaacaccag

SEQ ID NO: 2597389 - RNA, 23 nt, Escherichia coli CFT073
caaacgcacuuuuaacgccucgu

SEQ ID NO: 2597390 - RNA, 17 nt, Escherichia coli CFT073
caaacgcaucgccaaac

SEQ ID NO: 2597391 - RNA, 19 nt, Escherichia coli CFT073
caaacgccaacucaacgcc

SEQ ID NO: 2597392 - RNA, 12 nt, Escherichia coli CFT073
caaacgccagau

SEQ ID NO: 2597393 - RNA, 13 nt, Escherichia coli CFT073
caaacgcccagcu

SEQ ID NO: 2597394 - RNA, 16 nt, Escherichia coli CFT073
caaacgccggauggca

SEQ ID NO: 2597395 - RNA, 18 nt, Escherichia coli CFT073
caaacgccggauggcaca

SEQ ID NO: 2597396 - RNA, 22 nt, Escherichia coli CFT073
caaacgccggauggcacaugac

SEQ ID NO: 2597397 - RNA, 18 nt, Escherichia coli CFT073
caaacgcguccaucacua

SEQ ID NO: 2597398 - RNA, 21 nt, Escherichia coli CFT073
caaacgcuucuggcgacaucu

SEQ ID NO: 2597399 - RNA, 16 nt, Escherichia coli CFT073
caaacgcuuuacucaa

SEQ ID NO: 2597400 - RNA, 23 nt, Escherichia coli CFT073
caaacggcguuuuuucaucacug

SEQ ID NO: 2597401 - RNA, 19 nt, Escherichia coli CFT073
caaacgguaucuuuccagc

SEQ ID NO: 2597402 - RNA, 20 nt, Escherichia coli CFT073
caaacgugacauucugacug

SEQ ID NO: 2597403 - RNA, 16 nt, Escherichia coli CFT073
caaacguggugccauu

SEQ ID NO: 2597404 - RNA, 16 nt, Escherichia coli CFT073
caaacucauaaaccag

SEQ ID NO: 2597405 - RNA, 22 nt, Escherichia coli CFT073
caaacucauaaaccagcggcac

SEQ ID NO: 2597406 - RNA, 19 nt, Escherichia coli CFT073
caaacuccccgcaaaccag

SEQ ID NO: 2597407 - RNA, 19 nt, Escherichia coli CFT073
caaacuccgagagauccug

SEQ ID NO: 2597408 - RNA, 15 nt, Escherichia coli CFT073
caaacuccgcgacca

SEQ ID NO: 2597409 - RNA, 17 nt, Escherichia coli CFT073
caaacuccgcgaccaca

SEQ ID NO: 2597410 - RNA, 19 nt, Escherichia coli CFT073
caaacugaaaaaggcgccg

SEQ ID NO: 2597411 - RNA, 21 nt, Escherichia coli CFT073
caaacugaagauugaacagca

SEQ ID NO: 2597412 - RNA, 19 nt, Escherichia coli CFT073
caaacuggaauagcgccac

SEQ ID NO: 2597413 - RNA, 21 nt, Escherichia coli CFT073
caaacuggaauagcgccacgc

SEQ ID NO: 2597414 - RNA, 20 nt, Escherichia coli CFT073
caaacuggcugaugcuggca

SEQ ID NO: 2597415 - RNA, 18 nt, Escherichia coli CFT073
caaacuggcuggcgugac

SEQ ID NO: 2597416 - RNA, 20 nt, Escherichia coli CFT073
caaacuggggcauuuuuucc

SEQ ID NO: 2597417 - RNA, 19 nt, Escherichia coli CFT073
caaacugguauugagcgac

SEQ ID NO: 2597418 - RNA, 22 nt, Escherichia coli CFT073
caaacugguauugagcgaccgc

SEQ ID NO: 2597419 - RNA, 20 nt, Escherichia coli CFT073
caaacugguugaaauaaacc

SEQ ID NO: 2597420 - RNA, 22 nt, Escherichia coli CFT073
caaacugguugaaauaaaccag

SEQ ID NO: 2597421 - RNA, 19 nt, Escherichia coli CFT073
caaacugugcaaugaaaaa

SEQ ID NO: 2597422 - RNA, 13 nt, Escherichia coli CFT073
caaacuucacgca

SEQ ID NO: 2597423 - RNA, 13 nt, Escherichia coli CFT073
caaacuuccagaa

SEQ ID NO: 2597424 - RNA, 13 nt, Escherichia coli CFT073
caaacuuccggca

SEQ ID NO: 2597425 - RNA, 16 nt, Escherichia coli CFT073
caaacuucgccacagc

SEQ ID NO: 2597426 - RNA, 13 nt, Escherichia coli CFT073
caaacuucuucag

SEQ ID NO: 2597427 - RNA, 13 nt, Escherichia coli CFT073
caaacuuuuaaau

SEQ ID NO: 2597428 - RNA, 19 nt, Escherichia coli CFT073
caaagaaacggaagcccca

SEQ ID NO: 2597429 - RNA, 20 nt, Escherichia coli CFT073
caaagaacguaaucaacgcc

SEQ ID NO: 2597430 - RNA, 16 nt, Escherichia coli CFT073
caaagaacucacgcgc

SEQ ID NO: 2597431 - RNA, 15 nt, Escherichia coli CFT073
caaagaacuuaucga

SEQ ID NO: 2597432 - RNA, 13 nt, Escherichia coli CFT073
caaagaauuggcu

SEQ ID NO: 2597433 - RNA, 22 nt, Escherichia coli CFT073
caaagacaucgcuggaggcauc

SEQ ID NO: 2597434 - RNA, 15 nt, Escherichia coli CFT073
caaagagagaagcca

SEQ ID NO: 2597435 - RNA, 23 nt, Escherichia coli CFT073
caaagagagauccagcuucgcca

SEQ ID NO: 2597436 - RNA, 14 nt, Escherichia coli CFT073
caaagagauaacgc

SEQ ID NO: 2597437 - RNA, 16 nt, Escherichia coli CFT073
caaagagcaagaaccc

SEQ ID NO: 2597438 - RNA, 22 nt, Escherichia coli CFT073
caaagauaaugacuuccgccac

SEQ ID NO: 2597439 - RNA, 21 nt, Escherichia coli CFT073
caaagauauuauuaaaugcug

SEQ ID NO: 2597440 - RNA, 16 nt, Escherichia coli CFT073
caaagauuuuaccaau

SEQ ID NO: 2597441 - RNA, 17 nt, Escherichia coli CFT073
caaagcaaaggcgacaa

SEQ ID NO: 2597442 - RNA, 18 nt, Escherichia coli CFT073
caaagcaaaggcgacaau

SEQ ID NO: 2597443 - RNA, 21 nt, Escherichia coli CFT073
caaagcauucguaaugaaugu

SEQ ID NO: 2597444 - RNA, 14 nt, Escherichia coli CFT073
caaagccaacagca

SEQ ID NO: 2597445 - RNA, 15 nt, Escherichia coli CFT073
caaagccaacagcag

SEQ ID NO: 2597446 - RNA, 21 nt, Escherichia coli CFT073
caaagcccaucaccgccaggc

SEQ ID NO: 2597447 - RNA, 14 nt, Escherichia coli CFT073
caaagcccgaugcg

SEQ ID NO: 2597448 - RNA, 20 nt, Escherichia coli CFT073
caaagcccgaugcgcgacca

SEQ ID NO: 2597449 - RNA, 17 nt, Escherichia coli CFT073
caaagccgcgugcgcug

SEQ ID NO: 2597450 - RNA, 15 nt, Escherichia coli CFT073
caacaacgcaacucc

SEQ ID NO: 2597451 - RNA, 15 nt, Escherichia coli CFT073
caacaacuucagguu

SEQ ID NO: 2597452 - RNA, 12 nt, Escherichia coli CFT073
caacaagcaccg

SEQ ID NO: 2597453 - RNA, 21 nt, Escherichia coli CFT073
caacaagcagcuugagaaaau

SEQ ID NO: 2597454 - RNA, 19 nt, Escherichia coli CFT073
caacaagccgcuugcgaua

SEQ ID NO: 2597455 - RNA, 17 nt, Escherichia coli CFT073
caacaaggguaugcugu

SEQ ID NO: 2597456 - RNA, 20 nt, Escherichia coli CFT073
caacaauaaaaagcggcagg

SEQ ID NO: 2597457 - RNA, 20 nt, Escherichia coli CFT073
caacaauaaaaggugcguua

SEQ ID NO: 2597458 - RNA, 14 nt, Escherichia coli CFT073
caacaauaaacugc

SEQ ID NO: 2597459 - RNA, 14 nt, Escherichia coli CFT073
caacaauucccagc

SEQ ID NO: 2597460 - RNA, 22 nt, Escherichia coli CFT073
caacaauugaagaauaucuucu

SEQ ID NO: 2597461 - RNA, 17 nt, Escherichia coli CFT073
caacaauuucacgcgcu

SEQ ID NO: 2597462 - RNA, 13 nt, Escherichia coli CFT073
caacaauuuccgc

SEQ ID NO: 2597463 - RNA, 21 nt, Escherichia coli CFT073
caacaauuuccgcagcuccag

SEQ ID NO: 2597464 - RNA, 22 nt, Escherichia coli CFT073
caacaauuuccgcagcuccagc

SEQ ID NO: 2597465 - RNA, 16 nt, Escherichia coli CFT073
caacacaauuuguggc

SEQ ID NO: 2597466 - RNA, 14 nt, Escherichia coli CFT073
caacacaggccggc

SEQ ID NO: 2597467 - RNA, 14 nt, Escherichia coli CFT073
caacacauaaccgu

SEQ ID NO: 2597468 - RNA, 20 nt, Escherichia coli CFT073
caacacaucgccuucgcgca

SEQ ID NO: 2597469 - RNA, 12 nt, Escherichia coli CFT073
caacacauuacu

SEQ ID NO: 2597470 - RNA, 22 nt, Escherichia coli CFT073
caacaccacuugcugguugugg

SEQ ID NO: 2597471 - RNA, 19 nt, Escherichia coli CFT073
caacaccgauagaaccaaa

SEQ ID NO: 2597472 - RNA, 22 nt, Escherichia coli CFT073
caacaccgcucccggauacccc

SEQ ID NO: 2597473 - RNA, 23 nt, Escherichia coli CFT073
caacaccgguacuaacagguugc

SEQ ID NO: 2597474 - RNA, 13 nt, Escherichia coli CFT073
caacaccguaaga

SEQ ID NO: 2597475 - RNA, 23 nt, Escherichia coli CFT073
caacaccguuucguggaaaacac

SEQ ID NO: 2597476 - RNA, 20 nt, Escherichia coli CFT073
caacacgccagcguuauccc

SEQ ID NO: 2597477 - RNA, 19 nt, Escherichia coli CFT073
caacacuuuaucugccauu

SEQ ID NO: 2597478 - RNA, 14 nt, Escherichia coli CFT073
caacagaaacgcca

SEQ ID NO: 2597479 - RNA, 13 nt, Escherichia coli CFT073
caacagauaaaug

SEQ ID NO: 2597480 - RNA, 18 nt, Escherichia coli CFT073
caacagauaaauggcaca

SEQ ID NO: 2597481 - RNA, 22 nt, Escherichia coli CFT073
caacagauuucgaaucuucuga

SEQ ID NO: 2597482 - RNA, 19 nt, Escherichia coli CFT073
caacagauuuugcaggccu

SEQ ID NO: 2597483 - RNA, 21 nt, Escherichia coli CFT073
caacagauuuugcaggccuga

SEQ ID NO: 2597484 - RNA, 20 nt, Escherichia coli CFT073
caacagcaaagagagcagcg

SEQ ID NO: 2597485 - RNA, 16 nt, Escherichia coli CFT073
caacagcagccacacc

SEQ ID NO: 2597486 - RNA, 16 nt, Escherichia coli CFT073
caacagccacucuuaa

SEQ ID NO: 2597487 - RNA, 20 nt, Escherichia coli CFT073
caacagccagguuuugcucu

SEQ ID NO: 2597488 - RNA, 22 nt, Escherichia coli CFT073
caacagcgugaacugggccugc

SEQ ID NO: 2597489 - RNA, 11 nt, Escherichia coli CFT073
caacaggaaca

SEQ ID NO: 2597490 - RNA, 22 nt, Escherichia coli CFT073
caacaggcgcugaucgucagca

SEQ ID NO: 2597491 - RNA, 12 nt, Escherichia coli CFT073
caacagguauca

SEQ ID NO: 2597492 - RNA, 19 nt, Escherichia coli CFT073
caacaguaaggccugguuc

SEQ ID NO: 2597493 - RNA, 22 nt, Escherichia coli CFT073
caacaguaaggccugguucauc

SEQ ID NO: 2597494 - RNA, 19 nt, Escherichia coli CFT073
caacaguaauaaugcccau

SEQ ID NO: 2597495 - RNA, 12 nt, Escherichia coli CFT073
caacagugaaau

SEQ ID NO: 2597496 - RNA, 20 nt, Escherichia coli CFT073
caacagugccgaugccgcua

SEQ ID NO: 2597497 - RNA, 22 nt, Escherichia coli CFT073
caacagugccgaugccgcuaca

SEQ ID NO: 2597498 - RNA, 22 nt, Escherichia coli CFT073
caacagugccggucagacagcg

SEQ ID NO: 2597499 - RNA, 20 nt, Escherichia coli CFT073
caacagugcgcgguucauuc

SEQ ID NO: 2597500 - RNA, 13 nt, Escherichia coli CFT073
caacaguucaugg

SEQ ID NO: 2597501 - RNA, 13 nt, Escherichia coli CFT073
caacaguuccagc

SEQ ID NO: 2597502 - RNA, 19 nt, Escherichia coli CFT073
caacauagcuaaaaauaau

SEQ ID NO: 2597503 - RNA, 19 nt, Escherichia coli CFT073
caacauagcuuggcagagc

SEQ ID NO: 2597504 - RNA, 22 nt, Escherichia coli CFT073
caacauaguuauuauucauaaa

SEQ ID NO: 2597505 - RNA, 19 nt, Escherichia coli CFT073
caacauauuucucgccuga

SEQ ID NO: 2597506 - RNA, 14 nt, Escherichia coli CFT073
caacaucaacagac

SEQ ID NO: 2597507 - RNA, 15 nt, Escherichia coli CFT073
caacaucacaccaua

SEQ ID NO: 2597508 - RNA, 14 nt, Escherichia coli CFT073
caacaucacaccug

SEQ ID NO: 2597509 - RNA, 11 nt, Escherichia coli CFT073
caacaucaccg

SEQ ID NO: 2597510 - RNA, 21 nt, Escherichia coli CFT073
caacaucaucacgcagagcau

SEQ ID NO: 2597511 - RNA, 17 nt, Escherichia coli CFT073
caacaucauuaacgccu

SEQ ID NO: 2597512 - RNA, 11 nt, Escherichia coli CFT073
caacaucgaca

SEQ ID NO: 2597513 - RNA, 15 nt, Escherichia coli CFT073
caacaucgacauaau

SEQ ID NO: 2597514 - RNA, 15 nt, Escherichia coli CFT073
caacaucgguacaca

SEQ ID NO: 2597515 - RNA, 20 nt, Escherichia coli CFT073
caacaucgguacacaaaaau

SEQ ID NO: 2597516 - RNA, 15 nt, Escherichia coli CFT073
caacaugagaacagu

SEQ ID NO: 2597517 - RNA, 20 nt, Escherichia coli CFT073
caacaugccgaauccgggaa

SEQ ID NO: 2597518 - RNA, 21 nt, Escherichia coli CFT073
caacaugcggugauuuugccu

SEQ ID NO: 2597519 - RNA, 19 nt, Escherichia coli CFT073
caacauggucaucaucauu

SEQ ID NO: 2597520 - RNA, 21 nt, Escherichia coli CFT073
caacauuaccgaauccuggua

SEQ ID NO: 2597521 - RNA, 20 nt, Escherichia coli CFT073
caacauuaucugaugcgcuu

SEQ ID NO: 2597522 - RNA, 11 nt, Escherichia coli CFT073
caacauucaga

SEQ ID NO: 2597523 - RNA, 13 nt, Escherichia coli CFT073
caacauuuccagc

SEQ ID NO: 2597524 - RNA, 13 nt, Escherichia coli CFT073
caaccaacgcgcc

SEQ ID NO: 2597525 - RNA, 15 nt, Escherichia coli CFT073
caaccaagacuauua

SEQ ID NO: 2597526 - RNA, 22 nt, Escherichia coli CFT073
caaccaagacuauuaauauaua

SEQ ID NO: 2597527 - RNA, 12 nt, Escherichia coli CFT073
caaccaaucgcg

SEQ ID NO: 2597528 - RNA, 16 nt, Escherichia coli CFT073
caaccaaucgcggcga

SEQ ID NO: 2597529 - RNA, 14 nt, Escherichia coli CFT073
caaccacacccaca

SEQ ID NO: 2597530 - RNA, 14 nt, Escherichia coli CFT073
caaccaccacaccu

SEQ ID NO: 2597531 - RNA, 19 nt, Escherichia coli CFT073
caaccaccacaccugccac

SEQ ID NO: 2597532 - RNA, 17 nt, Escherichia coli CFT073
caaccaccggcaccacu

SEQ ID NO: 2597533 - RNA, 19 nt, Escherichia coli CFT073
caaccaccucaguacccgc

SEQ ID NO: 2597534 - RNA, 21 nt, Escherichia coli CFT073
caaccaccugauacgagcaaa

SEQ ID NO: 2597535 - RNA, 17 nt, Escherichia coli CFT073
caaccacggcaacgccg

SEQ ID NO: 2597536 - RNA, 20 nt, Escherichia coli CFT073
caaccacuacgugaucgucu

SEQ ID NO: 2597537 - RNA, 17 nt, Escherichia coli CFT073
caaccacuucggcaucu

SEQ ID NO: 2597538 - RNA, 22 nt, Escherichia coli CFT073
caaccacuucggcaucuuuuau

SEQ ID NO: 2597539 - RNA, 12 nt, Escherichia coli CFT073
caaccagaaagu

SEQ ID NO: 2597540 - RNA, 20 nt, Escherichia coli CFT073
caaccagauucggcgcaaug

SEQ ID NO: 2597541 - RNA, 12 nt, Escherichia coli CFT073
caaccagcaaug

SEQ ID NO: 2597542 - RNA, 13 nt, Escherichia coli CFT073
caaccagcaaugc

SEQ ID NO: 2597543 - RNA, 19 nt, Escherichia coli CFT073
caaccagcagcaucaccac

SEQ ID NO: 2597544 - RNA, 11 nt, Escherichia coli CFT073
caaccagcagg

SEQ ID NO: 2597545 - RNA, 12 nt, Escherichia coli CFT073
caaccagcaggg

SEQ ID NO: 2597546 - RNA, 23 nt, Escherichia coli CFT073
caaccagcggcgcauccgccagc

SEQ ID NO: 2597547 - RNA, 18 nt, Escherichia coli CFT073
caaccagcgucgcaucag

SEQ ID NO: 2597548 - RNA, 14 nt, Escherichia coli CFT073
caaccaggaugaua

SEQ ID NO: 2597549 - RNA, 23 nt, Escherichia coli CFT073
caaccaggccuuccggguuuucu

SEQ ID NO: 2597550 - RNA, 20 nt, Escherichia coli CFT073
caaccaguugugcaccacca

SEQ ID NO: 2597551 - RNA, 13 nt, Escherichia coli CFT073
caaccaucagcgu

SEQ ID NO: 2597552 - RNA, 14 nt, Escherichia coli CFT073
caaccaucaguacc

SEQ ID NO: 2597553 - RNA, 16 nt, Escherichia coli CFT073
caaccauccccaaaaa

SEQ ID NO: 2597554 - RNA, 14 nt, Escherichia coli CFT073
caaccaugccgccc

SEQ ID NO: 2597555 - RNA, 15 nt, Escherichia coli CFT073
caaccaugguuucaa

SEQ ID NO: 2597556 - RNA, 17 nt, Escherichia coli CFT073
caaccaugguuucaaac

SEQ ID NO: 2597557 - RNA, 17 nt, Escherichia coli CFT073
caacccaaccugccaga

SEQ ID NO: 2597558 - RNA, 12 nt, Escherichia coli CFT073
caacccacaaaa

SEQ ID NO: 2597559 - RNA, 17 nt, Escherichia coli CFT073
caacguagccugccauu

SEQ ID NO: 2597560 - RNA, 15 nt, Escherichia coli CFT073
caacguaucaucgcu

SEQ ID NO: 2597561 - RNA, 22 nt, Escherichia coli CFT073
caacguccucgucgagcagaau

SEQ ID NO: 2597562 - RNA, 15 nt, Escherichia coli CFT073
caacguccuggcgcu

SEQ ID NO: 2597563 - RNA, 21 nt, Escherichia coli CFT073
caacgucgucgucuucaacgu

SEQ ID NO: 2597564 - RNA, 13 nt, Escherichia coli CFT073
caacgucugccug

SEQ ID NO: 2597565 - RNA, 20 nt, Escherichia coli CFT073
caacgugacguuucaucgca

SEQ ID NO: 2597566 - RNA, 20 nt, Escherichia coli CFT073
caacgugguuuaccaccagc

SEQ ID NO: 2597567 - RNA, 18 nt, Escherichia coli CFT073
caacguguaggccugaua

SEQ ID NO: 2597568 - RNA, 23 nt, Escherichia coli CFT073
caacguguauaucaccaguaacu

SEQ ID NO: 2597569 - RNA, 18 nt, Escherichia coli CFT073
caacguguugcugcaugu

SEQ ID NO: 2597570 - RNA, 14 nt, Escherichia coli CFT073
caacucaacgccug

SEQ ID NO: 2597571 - RNA, 20 nt, Escherichia coli CFT073
caacucaccauucugggcuc

SEQ ID NO: 2597572 - RNA, 14 nt, Escherichia coli CFT073
caacucaggaacau

SEQ ID NO: 2597573 - RNA, 21 nt, Escherichia coli CFT073
caacucauuacuguaggccag

SEQ ID NO: 2597574 - RNA, 16 nt, Escherichia coli CFT073
caacuccaccaauaau

SEQ ID NO: 2597575 - RNA, 20 nt, Escherichia coli CFT073
caacuccagcuuaacauccc

SEQ ID NO: 2597576 - RNA, 15 nt, Escherichia coli CFT073
caacuccaucaagcu

SEQ ID NO: 2597577 - RNA, 17 nt, Escherichia coli CFT073
caacuccgucgcggugu

SEQ ID NO: 2597578 - RNA, 17 nt, Escherichia coli CFT073
caacucgccacgaucgg

SEQ ID NO: 2597579 - RNA, 22 nt, Escherichia coli CFT073
caacucucgucgguucagagca

SEQ ID NO: 2597580 - RNA, 17 nt, Escherichia coli CFT073
caacucuucaagauuaa

SEQ ID NO: 2597581 - RNA, 18 nt, Escherichia coli CFT073
caacucuuuaauagauaa

SEQ ID NO: 2597582 - RNA, 18 nt, Escherichia coli CFT073
caacugacgaccaugcgc

SEQ ID NO: 2597583 - RNA, 22 nt, Escherichia coli CFT073
caacugacggucgguaaacccg

SEQ ID NO: 2597584 - RNA, 18 nt, Escherichia coli CFT073
caacugacugacgugaug

SEQ ID NO: 2597585 - RNA, 17 nt, Escherichia coli CFT073
caacugaucugccagca

SEQ ID NO: 2597586 - RNA, 13 nt, Escherichia coli CFT073
caacugcccaggc

SEQ ID NO: 2597587 - RNA, 23 nt, Escherichia coli CFT073
caacugcgcuauaucgcugauau

SEQ ID NO: 2597588 - RNA, 22 nt, Escherichia coli CFT073
caacugcuggacgauuucaccc

SEQ ID NO: 2597589 - RNA, 18 nt, Escherichia coli CFT073
caacugcuuuuugcucuc

SEQ ID NO: 2597590 - RNA, 19 nt, Escherichia coli CFT073
caacuggcggucaugacga

SEQ ID NO: 2597591 - RNA, 20 nt, Escherichia coli CFT073
caacugguauaggccaugcu

SEQ ID NO: 2597592 - RNA, 22 nt, Escherichia coli CFT073
caacuguacgccgacgcccugc

SEQ ID NO: 2597593 - RNA, 22 nt, Escherichia coli CFT073
caacugugcggcaauuagcggc

SEQ ID NO: 2597594 - RNA, 22 nt, Escherichia coli CFT073
caacuguggaauaugcgccacu

SEQ ID NO: 2597595 - RNA, 21 nt, Escherichia coli CFT073
caacuuaagucuccauuuuuu

SEQ ID NO: 2597596 - RNA, 20 nt, Escherichia coli CFT073
caacuuaaucaucaaugcca

SEQ ID NO: 2597597 - RNA, 19 nt, Escherichia coli CFT073
caacuuaucgggauggugu

SEQ ID NO: 2597598 - RNA, 16 nt, Escherichia coli CFT073
caacuucaacaguggc

SEQ ID NO: 2597599 - RNA, 19 nt, Escherichia coli CFT073
caacuucaaggucaacauu

SEQ ID NO: 2597600 - RNA, 16 nt, Escherichia coli CFT073
caacuucacggcugua

SEQ ID NO: 2597601 - RNA, 15 nt, Escherichia coli CFT073
caacuucagcagcag

SEQ ID NO: 2597602 - RNA, 16 nt, Escherichia coli CFT073
caacuucagcagcagc

SEQ ID NO: 2597603 - RNA, 14 nt, Escherichia coli CFT073
caacuucagcuucg

SEQ ID NO: 2597604 - RNA, 12 nt, Escherichia coli CFT073
caacuucaguuu

SEQ ID NO: 2597605 - RNA, 13 nt, Escherichia coli CFT073
caacuucaugacc

SEQ ID NO: 2597606 - RNA, 20 nt, Escherichia coli CFT073
caacuucauguauucuggcu

SEQ ID NO: 2597607 - RNA, 23 nt, Escherichia coli CFT073
caacuucgaguacauccacugca

SEQ ID NO: 2597608 - RNA, 19 nt, Escherichia coli CFT073
caacuucugucacgcuggc

SEQ ID NO: 2597609 - RNA, 14 nt, Escherichia coli CFT073
caacuuuacuaaaa

SEQ ID NO: 2597610 - RNA, 16 nt, Escherichia coli CFT073
caacuuuacuaaaaag

SEQ ID NO: 2597611 - RNA, 14 nt, Escherichia coli CFT073
caacuuucacgcgc

SEQ ID NO: 2597612 - RNA, 16 nt, Escherichia coli CFT073
caacuuuguauucagu

SEQ ID NO: 2597613 - RNA, 21 nt, Escherichia coli CFT073
caacuuuguauucaguucauc

SEQ ID NO: 2597614 - RNA, 12 nt, Escherichia coli CFT073
caacuuuuucuu

SEQ ID NO: 2597615 - RNA, 14 nt, Escherichia coli CFT073
caagaaaaauacug

SEQ ID NO: 2597616 - RNA, 12 nt, Escherichia coli CFT073
caagaaagcuuu

SEQ ID NO: 2597617 - RNA, 14 nt, Escherichia coli CFT073
caagaaauaugaau

SEQ ID NO: 2597618 - RNA, 14 nt, Escherichia coli CFT073
caagaaccccagcc

SEQ ID NO: 2597619 - RNA, 18 nt, Escherichia coli CFT073
caagaaggauauaaaaau

SEQ ID NO: 2597620 - RNA, 20 nt, Escherichia coli CFT073
caagaaggauauaaaaauaa

SEQ ID NO: 2597621 - RNA, 22 nt, Escherichia coli CFT073
caagaaggauauaaaaauaaca

SEQ ID NO: 2597622 - RNA, 22 nt, Escherichia coli CFT073
caagaaucacuucaucgccgcu

SEQ ID NO: 2597623 - RNA, 13 nt, Escherichia coli CFT073
caagaaucaugcc

SEQ ID NO: 2597624 - RNA, 16 nt, Escherichia coli CFT073
caagaaucaugccaaa

SEQ ID NO: 2597625 - RNA, 19 nt, Escherichia coli CFT073
caagaaucaugccaaaaau

SEQ ID NO: 2597626 - RNA, 20 nt, Escherichia coli CFT073
caagaaucaugccaaaaaua

SEQ ID NO: 2597627 - RNA, 19 nt, Escherichia coli CFT073
caagaauccuuauuuuuau

SEQ ID NO: 2597628 - RNA, 21 nt, Escherichia coli CFT073
caagaauccuuauuuuuauaa

SEQ ID NO: 2597629 - RNA, 23 nt, Escherichia coli CFT073
caagaaucgagcaauaaacacug

SEQ ID NO: 2597630 - RNA, 17 nt, Escherichia coli CFT073
caagaaugaccgccugc

SEQ ID NO: 2597631 - RNA, 21 nt, Escherichia coli CFT073
caagaaugauacggaaauccu

SEQ ID NO: 2597632 - RNA, 20 nt, Escherichia coli CFT073
caagaaugcucgcuggcagg

SEQ ID NO: 2597633 - RNA, 16 nt, Escherichia coli CFT073
caagaauuaaaauauc

SEQ ID NO: 2597634 - RNA, 17 nt, Escherichia coli CFT073
caagaauuaaaauauca

SEQ ID NO: 2597635 - RNA, 17 nt, Escherichia coli CFT073
caagaauuacuucuuga

SEQ ID NO: 2597636 - RNA, 16 nt, Escherichia coli CFT073
caagacugacaaucaa

SEQ ID NO: 2597637 - RNA, 12 nt, Escherichia coli CFT073
caagacuuugua

SEQ ID NO: 2597638 - RNA, 19 nt, Escherichia coli CFT073
caagaguaaacaucuucuu

SEQ ID NO: 2597639 - RNA, 15 nt, Escherichia coli CFT073
caagagugaacacgu

SEQ ID NO: 2597640 - RNA, 19 nt, Escherichia coli CFT073
caagauaacgccuggcagu

SEQ ID NO: 2597641 - RNA, 23 nt, Escherichia coli CFT073
caagauacgcaucgcgcaccagc

SEQ ID NO: 2597642 - RNA, 16 nt, Escherichia coli CFT073
caagauacugcauaau

SEQ ID NO: 2597643 - RNA, 18 nt, Escherichia coli CFT073
caagaucagcauccauau

SEQ ID NO: 2597644 - RNA, 19 nt, Escherichia coli CFT073
caagaucagcauccauauc

SEQ ID NO: 2597645 - RNA, 16 nt, Escherichia coli CFT073
caagaucgcccugagg

SEQ ID NO: 2597646 - RNA, 21 nt, Escherichia coli CFT073
caagaucggagccaaaaucaa

SEQ ID NO: 2597647 - RNA, 18 nt, Escherichia coli CFT073
caagaugcgcguaguacu

SEQ ID NO: 2597648 - RNA, 21 nt, Escherichia coli CFT073
caagaugcggggauuuucgca

SEQ ID NO: 2597649 - RNA, 12 nt, Escherichia coli CFT073
caagauggggaa

SEQ ID NO: 2597650 - RNA, 13 nt, Escherichia coli CFT073
caagauuaaaaua

SEQ ID NO: 2597651 - RNA, 22 nt, Escherichia coli CFT073
caagauuaaagcagguagcgcc

SEQ ID NO: 2597652 - RNA, 14 nt, Escherichia coli CFT073
caagauuggccuga

SEQ ID NO: 2597653 - RNA, 15 nt, Escherichia coli CFT073
caagcaaggccaggu

SEQ ID NO: 2597654 - RNA, 14 nt, Escherichia coli CFT073
caagcacagggcaa

SEQ ID NO: 2597655 - RNA, 17 nt, Escherichia coli CFT073
caagcacccaaugccau

SEQ ID NO: 2597656 - RNA, 20 nt, Escherichia coli CFT073
caagcaccggcaccgaggug

SEQ ID NO: 2597657 - RNA, 22 nt, Escherichia coli CFT073
caagcacggcgcgacucagcgg

SEQ ID NO: 2597658 - RNA, 13 nt, Escherichia coli CFT073
caagcagagagac

SEQ ID NO: 2597659 - RNA, 22 nt, Escherichia coli CFT073
caagcagagagacgaucgccac

SEQ ID NO: 2597660 - RNA, 12 nt, Escherichia coli CFT073
caagcagcugcc

SEQ ID NO: 2597661 - RNA, 13 nt, Escherichia coli CFT073
caagcagcugcca

SEQ ID NO: 2597662 - RNA, 17 nt, Escherichia coli CFT073
caagcagcuugagaaaa

SEQ ID NO: 2597663 - RNA, 14 nt, Escherichia coli CFT073
caagcauaacaaaa

SEQ ID NO: 2597664 - RNA, 16 nt, Escherichia coli CFT073
caagcauuauuuuugc

SEQ ID NO: 2597665 - RNA, 22 nt, Escherichia coli CFT073
caagcauugauuuuaauaaauc

SEQ ID NO: 2597666 - RNA, 20 nt, Escherichia coli CFT073
caagcauuuucucacuggcg

SEQ ID NO: 2597667 - RNA, 23 nt, Escherichia coli CFT073
caauaauucuuccuucacaucca

SEQ ID NO: 2597668 - RNA, 21 nt, Escherichia coli CFT073
caauaauugacgaauauagcg

SEQ ID NO: 2597669 - RNA, 13 nt, Escherichia coli CFT073
caauaauuucuca

SEQ ID NO: 2597670 - RNA, 14 nt, Escherichia coli CFT073
caauaauuucucag

SEQ ID NO: 2597671 - RNA, 20 nt, Escherichia coli CFT073
caauacaaaauaggcaaaaa

SEQ ID NO: 2597672 - RNA, 12 nt, Escherichia coli CFT073
caauacaaauga

SEQ ID NO: 2597673 - RNA, 17 nt, Escherichia coli CFT073
caauacagccagccagc

SEQ ID NO: 2597674 - RNA, 16 nt, Escherichia coli CFT073
caauacauaagcaccg

SEQ ID NO: 2597675 - RNA, 22 nt, Escherichia coli CFT073
caauacauagaagcucauaugc

SEQ ID NO: 2597676 - RNA, 20 nt, Escherichia coli CFT073
caauacauagccaucugccu

SEQ ID NO: 2597677 - RNA, 15 nt, Escherichia coli CFT073
caauaccagcaucag

SEQ ID NO: 2597678 - RNA, 18 nt, Escherichia coli CFT073
caauaccagcaucaggau

SEQ ID NO: 2597679 - RNA, 23 nt, Escherichia coli CFT073
caauacccguacgguuuagugcc

SEQ ID NO: 2597680 - RNA, 20 nt, Escherichia coli CFT073
caauacccguccacacggca

SEQ ID NO: 2597681 - RNA, 13 nt, Escherichia coli CFT073
caauacccugacc

SEQ ID NO: 2597682 - RNA, 15 nt, Escherichia coli CFT073
caauacccugaccca

SEQ ID NO: 2597683 - RNA, 19 nt, Escherichia coli CFT073
caauaccgaucaguaccag

SEQ ID NO: 2597684 - RNA, 19 nt, Escherichia coli CFT073
caauaccgccugcaaauaa

SEQ ID NO: 2597685 - RNA, 21 nt, Escherichia coli CFT073
caauaccgccugcaaauaaau

SEQ ID NO: 2597686 - RNA, 16 nt, Escherichia coli CFT073
caauaccuucugcgcc

SEQ ID NO: 2597687 - RNA, 17 nt, Escherichia coli CFT073
caauaccuucugcgccc

SEQ ID NO: 2597688 - RNA, 16 nt, Escherichia coli CFT073
caauacgauuaacgcc

SEQ ID NO: 2597689 - RNA, 20 nt, Escherichia coli CFT073
caauacgauuaacgccagac

SEQ ID NO: 2597690 - RNA, 19 nt, Escherichia coli CFT073
caauacguuucuuccacac

SEQ ID NO: 2597691 - RNA, 13 nt, Escherichia coli CFT073
caauacuugcgaa

SEQ ID NO: 2597692 - RNA, 18 nt, Escherichia coli CFT073
caauacuugugccgcacu

SEQ ID NO: 2597693 - RNA, 16 nt, Escherichia coli CFT073
caauacuuuccagcau

SEQ ID NO: 2597694 - RNA, 19 nt, Escherichia coli CFT073
caauacuuugcagaucgcg

SEQ ID NO: 2597695 - RNA, 18 nt, Escherichia coli CFT073
caauagaaagugacagcc

SEQ ID NO: 2597696 - RNA, 14 nt, Escherichia coli CFT073
caauagauauucau

SEQ ID NO: 2597697 - RNA, 20 nt, Escherichia coli CFT073
caauagcaaagccuuuuuag

SEQ ID NO: 2597698 - RNA, 14 nt, Escherichia coli CFT073
caauagccgccaua

SEQ ID NO: 2597699 - RNA, 14 nt, Escherichia coli CFT073
caauagccugaugu

SEQ ID NO: 2597700 - RNA, 18 nt, Escherichia coli CFT073
caauagccugauguagcg

SEQ ID NO: 2597701 - RNA, 18 nt, Escherichia coli CFT073
caauaggcauauagccgc

SEQ ID NO: 2597702 - RNA, 21 nt, Escherichia coli CFT073
caauagguguuaauggaauaa

SEQ ID NO: 2597703 - RNA, 18 nt, Escherichia coli CFT073
caauagucaguauuuucc

SEQ ID NO: 2597704 - RNA, 19 nt, Escherichia coli CFT073
caauagucaguauuuuccc

SEQ ID NO: 2597705 - RNA, 14 nt, Escherichia coli CFT073
caauagucauuaaa

SEQ ID NO: 2597706 - RNA, 20 nt, Escherichia coli CFT073
caauagugaacugacugauu

SEQ ID NO: 2597707 - RNA, 21 nt, Escherichia coli CFT073
caauagugauguucuggcgaa

SEQ ID NO: 2597708 - RNA, 18 nt, Escherichia coli CFT073
caauaguguugccgccac

SEQ ID NO: 2597709 - RNA, 14 nt, Escherichia coli CFT073
caauauaaacagcc

SEQ ID NO: 2597710 - RNA, 22 nt, Escherichia coli CFT073
caauauaaacagccccuccgga

SEQ ID NO: 2597711 - RNA, 20 nt, Escherichia coli CFT073
caauauagcgcauggcagcc

SEQ ID NO: 2597712 - RNA, 22 nt, Escherichia coli CFT073
caauauauugcauggcuugugu

SEQ ID NO: 2597713 - RNA, 16 nt, Escherichia coli CFT073
caauaucaaagcguuu

SEQ ID NO: 2597714 - RNA, 16 nt, Escherichia coli CFT073
caauaucaaaugcguu

SEQ ID NO: 2597715 - RNA, 15 nt, Escherichia coli CFT073
caauaucaaucuucu

SEQ ID NO: 2597716 - RNA, 13 nt, Escherichia coli CFT073
caauaucagcaau

SEQ ID NO: 2597717 - RNA, 14 nt, Escherichia coli CFT073
caauaucaucaucc

SEQ ID NO: 2597718 - RNA, 22 nt, Escherichia coli CFT073
caauaucaucauccgcaauaac

SEQ ID NO: 2597719 - RNA, 14 nt, Escherichia coli CFT073
caauauccagcagg

SEQ ID NO: 2597720 - RNA, 13 nt, Escherichia coli CFT073
caauauccagcgc

SEQ ID NO: 2597721 - RNA, 14 nt, Escherichia coli CFT073
caauauccagcgcg

SEQ ID NO: 2597722 - RNA, 19 nt, Escherichia coli CFT073
caauauccauguaccagac

SEQ ID NO: 2597723 - RNA, 13 nt, Escherichia coli CFT073
caauaucgccagc

SEQ ID NO: 2597724 - RNA, 21 nt, Escherichia coli CFT073
caauaucgccuuuugcccggc

SEQ ID NO: 2597725 - RNA, 12 nt, Escherichia coli CFT073
caauaucuuccu

SEQ ID NO: 2597726 - RNA, 16 nt, Escherichia coli CFT073
caauaucuuuaucugc

SEQ ID NO: 2597727 - RNA, 16 nt, Escherichia coli CFT073
caauaugaauuacccc

SEQ ID NO: 2597728 - RNA, 14 nt, Escherichia coli CFT073
caauauuaaauauc

SEQ ID NO: 2597729 - RNA, 23 nt, Escherichia coli CFT073
caauauucaagauaacgccuggc

SEQ ID NO: 2597730 - RNA, 19 nt, Escherichia coli CFT073
caauauuccagucagcacc

SEQ ID NO: 2597731 - RNA, 21 nt, Escherichia coli CFT073
caauauucuuuugcagcagcg

SEQ ID NO: 2597732 - RNA, 21 nt, Escherichia coli CFT073
caauauugucuucaucgaugc

SEQ ID NO: 2597733 - RNA, 18 nt, Escherichia coli CFT073
caaucaaaagaacacaac

SEQ ID NO: 2597734 - RNA, 12 nt, Escherichia coli CFT073
caaucaaaugac

SEQ ID NO: 2597735 - RNA, 21 nt, Escherichia coli CFT073
caaucaagcccugguaacugc

SEQ ID NO: 2597736 - RNA, 21 nt, Escherichia coli CFT073
caaucaauccggcaaucaaca

SEQ ID NO: 2597737 - RNA, 15 nt, Escherichia coli CFT073
caaucaauucucgcc

SEQ ID NO: 2597738 - RNA, 18 nt, Escherichia coli CFT073
caaucacacaaccaugca

SEQ ID NO: 2597739 - RNA, 13 nt, Escherichia coli CFT073
caaucacacugac

SEQ ID NO: 2597740 - RNA, 16 nt, Escherichia coli CFT073
caaucacaucaccaua

SEQ ID NO: 2597741 - RNA, 15 nt, Escherichia coli CFT073
caaucaccaaaccaa

SEQ ID NO: 2597742 - RNA, 15 nt, Escherichia coli CFT073
caaucaccaccagcg

SEQ ID NO: 2597743 - RNA, 22 nt, Escherichia coli CFT073
caaucacccgauacuccacgcu

SEQ ID NO: 2597744 - RNA, 14 nt, Escherichia coli CFT073
caaucaccgccaac

SEQ ID NO: 2597745 - RNA, 15 nt, Escherichia coli CFT073
caaucaccgccagcg

SEQ ID NO: 2597746 - RNA, 16 nt, Escherichia coli CFT073
caaucaccgccagcgg

SEQ ID NO: 2597747 - RNA, 17 nt, Escherichia coli CFT073
caaucaccgccagcggc

SEQ ID NO: 2597748 - RNA, 19 nt, Escherichia coli CFT073
caaucaccgccagcggcgu

SEQ ID NO: 2597749 - RNA, 13 nt, Escherichia coli CFT073
caaucacgcccgc

SEQ ID NO: 2597750 - RNA, 18 nt, Escherichia coli CFT073
caaucacgcccgccagau

SEQ ID NO: 2597751 - RNA, 19 nt, Escherichia coli CFT073
caaucacgcccgccagaua

SEQ ID NO: 2597752 - RNA, 19 nt, Escherichia coli CFT073
caaucacuacuacaucugc

SEQ ID NO: 2597753 - RNA, 15 nt, Escherichia coli CFT073
caaucacugccacca

SEQ ID NO: 2597754 - RNA, 14 nt, Escherichia coli CFT073
caaucacugccaga

SEQ ID NO: 2597755 - RNA, 17 nt, Escherichia coli CFT073
caaucacugccagaaua

SEQ ID NO: 2597756 - RNA, 17 nt, Escherichia coli CFT073
caaucacuuucugcgcc

SEQ ID NO: 2597757 - RNA, 21 nt, Escherichia coli CFT073
caaucacuuucugcgccagcg

SEQ ID NO: 2597758 - RNA, 21 nt, Escherichia coli CFT073
caaucacuuugcgcucgcuga

SEQ ID NO: 2597759 - RNA, 15 nt, Escherichia coli CFT073
caaucagcacacaua

SEQ ID NO: 2597760 - RNA, 12 nt, Escherichia coli CFT073
caaucagcaccg

SEQ ID NO: 2597761 - RNA, 12 nt, Escherichia coli CFT073
caaucagccccu

SEQ ID NO: 2597762 - RNA, 19 nt, Escherichia coli CFT073
caaucagcgcagcacccag

SEQ ID NO: 2597763 - RNA, 13 nt, Escherichia coli CFT073
caaucagcggcgu

SEQ ID NO: 2597764 - RNA, 19 nt, Escherichia coli CFT073
caaucagcggcguaucuuc

SEQ ID NO: 2597765 - RNA, 21 nt, Escherichia coli CFT073
caaucagcggcguaucuucca

SEQ ID NO: 2597766 - RNA, 21 nt, Escherichia coli CFT073
caaucagcguaaaggccggaa

SEQ ID NO: 2597767 - RNA, 14 nt, Escherichia coli CFT073
caaucagcgucgcg

SEQ ID NO: 2597768 - RNA, 21 nt, Escherichia coli CFT073
caaucagcguuugcgacagua

SEQ ID NO: 2597769 - RNA, 24 nt, Escherichia coli CFT073
caaucaggcuaucgaacaugcggg

SEQ ID NO: 2597770 - RNA, 20 nt, Escherichia coli CFT073
caaucagguaagcgaaggug

SEQ ID NO: 2597771 - RNA, 21 nt, Escherichia coli CFT073
caaucagguaagcgaaggugc

SEQ ID NO: 2597772 - RNA, 23 nt, Escherichia coli CFT073
caaucagguaagcgauaaaaaua

SEQ ID NO: 2597773 - RNA, 22 nt, Escherichia coli CFT073
caaucaggucuuucagggugau

SEQ ID NO: 2597774 - RNA, 19 nt, Escherichia coli CFT073
caaucaguacguuaucacc

SEQ ID NO: 2597775 - RNA, 16 nt, Escherichia coli CFT073
caaugcccgguguucc

SEQ ID NO: 2597776 - RNA, 21 nt, Escherichia coli CFT073
caaugcccgguguucccgcgc

SEQ ID NO: 2597777 - RNA, 13 nt, Escherichia coli CFT073
caaugcccuguga

SEQ ID NO: 2597778 - RNA, 22 nt, Escherichia coli CFT073
caaugccgagauauagccccau

SEQ ID NO: 2597779 - RNA, 23 nt, Escherichia coli CFT073
caaugccgcauacauaacagaau

SEQ ID NO: 2597780 - RNA, 18 nt, Escherichia coli CFT073
caaugccgcuucgagcug

SEQ ID NO: 2597781 - RNA, 16 nt, Escherichia coli CFT073
caaugccguaaccagc

SEQ ID NO: 2597782 - RNA, 19 nt, Escherichia coli CFT073
caaugccguaaccagcgca

SEQ ID NO: 2597783 - RNA, 22 nt, Escherichia coli CFT073
caaugccguaaccagcgcagac

SEQ ID NO: 2597784 - RNA, 23 nt, Escherichia coli CFT073
caaugccugaugcgcuucgcuua

SEQ ID NO: 2597785 - RNA, 22 nt, Escherichia coli CFT073
caaugcgaucccgacaaucauc

SEQ ID NO: 2597786 - RNA, 16 nt, Escherichia coli CFT073
caaugcgcaagcugcu

SEQ ID NO: 2597787 - RNA, 12 nt, Escherichia coli CFT073
caaugcgccggc

SEQ ID NO: 2597788 - RNA, 16 nt, Escherichia coli CFT073
caaugcguagcugggc

SEQ ID NO: 2597789 - RNA, 18 nt, Escherichia coli CFT073
caaugcguuccagcagaa

SEQ ID NO: 2597790 - RNA, 19 nt, Escherichia coli CFT073
caaugcguucguagccacg

SEQ ID NO: 2597791 - RNA, 17 nt, Escherichia coli CFT073
caaugcuucagaaaauu

SEQ ID NO: 2597792 - RNA, 21 nt, Escherichia coli CFT073
caauggaauagcgaagaauac

SEQ ID NO: 2597793 - RNA, 12 nt, Escherichia coli CFT073
caauggcacugu

SEQ ID NO: 2597794 - RNA, 11 nt, Escherichia coli CFT073
caauggcaucc

SEQ ID NO: 2597795 - RNA, 22 nt, Escherichia coli CFT073
caauggccagcacauuaaaaug

SEQ ID NO: 2597796 - RNA, 18 nt, Escherichia coli CFT073
caauggcccauucagcau

SEQ ID NO: 2597797 - RNA, 15 nt, Escherichia coli CFT073
caauggcccgccgca

SEQ ID NO: 2597798 - RNA, 20 nt, Escherichia coli CFT073
caauggcgaccacugaccgc

SEQ ID NO: 2597799 - RNA, 19 nt, Escherichia coli CFT073
caauggcgcggcuauaccg

SEQ ID NO: 2597800 - RNA, 15 nt, Escherichia coli CFT073
caauggcuccgggug

SEQ ID NO: 2597801 - RNA, 15 nt, Escherichia coli CFT073
caauggucagccaca

SEQ ID NO: 2597802 - RNA, 13 nt, Escherichia coli CFT073
caauggugaacug

SEQ ID NO: 2597803 - RNA, 13 nt, Escherichia coli CFT073
caauggugccgac

SEQ ID NO: 2597804 - RNA, 19 nt, Escherichia coli CFT073
caaugguggcaaucugaau

SEQ ID NO: 2597805 - RNA, 21 nt, Escherichia coli CFT073
caauguagccacggaucacac

SEQ ID NO: 2597806 - RNA, 16 nt, Escherichia coli CFT073
caauguaggccugaua

SEQ ID NO: 2597807 - RNA, 22 nt, Escherichia coli CFT073
caauguauugaauuugcgauac

SEQ ID NO: 2597808 - RNA, 13 nt, Escherichia coli CFT073
caaugucaaguga

SEQ ID NO: 2597809 - RNA, 15 nt, Escherichia coli CFT073
caaugugaaaacccu

SEQ ID NO: 2597810 - RNA, 15 nt, Escherichia coli CFT073
caauguggagagcaa

SEQ ID NO: 2597811 - RNA, 18 nt, Escherichia coli CFT073
caauguggagagcaacau

SEQ ID NO: 2597812 - RNA, 20 nt, Escherichia coli CFT073
caauguguugauaaucguuu

SEQ ID NO: 2597813 - RNA, 20 nt, Escherichia coli CFT073
caauguuaacuguuuaucgu

SEQ ID NO: 2597814 - RNA, 23 nt, Escherichia coli CFT073
caauguuaacuguuuaucgucac

SEQ ID NO: 2597815 - RNA, 20 nt, Escherichia coli CFT073
caauguuaccgaucgccagc

SEQ ID NO: 2597816 - RNA, 23 nt, Escherichia coli CFT073
caauguuaccgaucgccagcagg

SEQ ID NO: 2597817 - RNA, 19 nt, Escherichia coli CFT073
caauguuauccggcuauau

SEQ ID NO: 2597818 - RNA, 23 nt, Escherichia coli CFT073
caauguuuuucuccuacacccca

SEQ ID NO: 2597819 - RNA, 24 nt, Escherichia coli CFT073
caauguuuuucuccuacaccccag

SEQ ID NO: 2597820 - RNA, 21 nt, Escherichia coli CFT073
caauguuuuucucugccgccg

SEQ ID NO: 2597821 - RNA, 21 nt, Escherichia coli CFT073
caauuaagucaacaccaucuu

SEQ ID NO: 2597822 - RNA, 12 nt, Escherichia coli CFT073
caauuaauacaa

SEQ ID NO: 2597823 - RNA, 18 nt, Escherichia coli CFT073
caauuaaugccuucaaau

SEQ ID NO: 2597824 - RNA, 14 nt, Escherichia coli CFT073
caauuacaaaaagu

SEQ ID NO: 2597825 - RNA, 15 nt, Escherichia coli CFT073
caauuacaaaaagua

SEQ ID NO: 2597826 - RNA, 15 nt, Escherichia coli CFT073
caauuacaaaaugac

SEQ ID NO: 2597827 - RNA, 14 nt, Escherichia coli CFT073
caauuaccacugag

SEQ ID NO: 2597828 - RNA, 12 nt, Escherichia coli CFT073
caauuaccuucc

SEQ ID NO: 2597829 - RNA, 13 nt, Escherichia coli CFT073
caauuaccuuuuu

SEQ ID NO: 2597830 - RNA, 20 nt, Escherichia coli CFT073
caauuacgccgagcgccagc

SEQ ID NO: 2597831 - RNA, 15 nt, Escherichia coli CFT073
caauuacgccugccc

SEQ ID NO: 2597832 - RNA, 17 nt, Escherichia coli CFT073
caauuacgccugcccaa

SEQ ID NO: 2597833 - RNA, 22 nt, Escherichia coli CFT073
caauuacgccugcccaauauac

SEQ ID NO: 2597834 - RNA, 13 nt, Escherichia coli CFT073
caauuacuucugg

SEQ ID NO: 2597835 - RNA, 15 nt, Escherichia coli CFT073
caauuacuucuggca

SEQ ID NO: 2597836 - RNA, 18 nt, Escherichia coli CFT073
caauuagcuggaauaaua

SEQ ID NO: 2597837 - RNA, 21 nt, Escherichia coli CFT073
caauuaucuguucuuuuauau

SEQ ID NO: 2597838 - RNA, 13 nt, Escherichia coli CFT073
caauuaugcccuc

SEQ ID NO: 2597839 - RNA, 16 nt, Escherichia coli CFT073
caauuaugcccucagc

SEQ ID NO: 2597840 - RNA, 22 nt, Escherichia coli CFT073
caauucaauuaauucuccgcac

SEQ ID NO: 2597841 - RNA, 23 nt, Escherichia coli CFT073
caauucacacagugaaucucuua

SEQ ID NO: 2597842 - RNA, 20 nt, Escherichia coli CFT073
caauucacacucugccagcg

SEQ ID NO: 2597843 - RNA, 21 nt, Escherichia coli CFT073
caauucacacucugccagcga

SEQ ID NO: 2597844 - RNA, 13 nt, Escherichia coli CFT073
caauucauggugu

SEQ ID NO: 2597845 - RNA, 15 nt, Escherichia coli CFT073
caauucauuccuuga

SEQ ID NO: 2597846 - RNA, 16 nt, Escherichia coli CFT073
caauucccaguaccug

SEQ ID NO: 2597847 - RNA, 16 nt, Escherichia coli CFT073
caauucccgacaaugg

SEQ ID NO: 2597848 - RNA, 14 nt, Escherichia coli CFT073
caauuccgcagcgc

SEQ ID NO: 2597849 - RNA, 17 nt, Escherichia coli CFT073
caauucgagcaucaucu

SEQ ID NO: 2597850 - RNA, 13 nt, Escherichia coli CFT073
caauucggcuuuu

SEQ ID NO: 2597851 - RNA, 21 nt, Escherichia coli CFT073
caauucgugugguaaaaccuu

SEQ ID NO: 2597852 - RNA, 14 nt, Escherichia coli CFT073
caauucuagaaacu

SEQ ID NO: 2597853 - RNA, 23 nt, Escherichia coli CFT073
caauucuuccuggguacgcaugu

SEQ ID NO: 2597854 - RNA, 21 nt, Escherichia coli CFT073
caauucuuuccguuuucaccc

SEQ ID NO: 2597855 - RNA, 12 nt, Escherichia coli CFT073
caauucuuuuuc

SEQ ID NO: 2597856 - RNA, 13 nt, Escherichia coli CFT073
caauucuuuuucu

SEQ ID NO: 2597857 - RNA, 15 nt, Escherichia coli CFT073
caauucuuuuucuga

SEQ ID NO: 2597858 - RNA, 20 nt, Escherichia coli CFT073
caauugaagaauaucuucug

SEQ ID NO: 2597859 - RNA, 19 nt, Escherichia coli CFT073
caauugaugcuuuuugccc

SEQ ID NO: 2597860 - RNA, 20 nt, Escherichia coli CFT073
caauugaugcuuuuugcccu

SEQ ID NO: 2597861 - RNA, 17 nt, Escherichia coli CFT073
caauugccauaaaaacg

SEQ ID NO: 2597862 - RNA, 18 nt, Escherichia coli CFT073
caauugccauaaaaacga

SEQ ID NO: 2597863 - RNA, 23 nt, Escherichia coli CFT073
caauugcgcaccagcuugcgaca

SEQ ID NO: 2597864 - RNA, 18 nt, Escherichia coli CFT073
caauugcgggccaaagac

SEQ ID NO: 2597865 - RNA, 13 nt, Escherichia coli CFT073
caauugcuucaau

SEQ ID NO: 2597866 - RNA, 15 nt, Escherichia coli CFT073
caauugguaaauaag

SEQ ID NO: 2597867 - RNA, 17 nt, Escherichia coli CFT073
caauuguauccaugcgc

SEQ ID NO: 2597868 - RNA, 21 nt, Escherichia coli CFT073
caauuuaccgaccucaacaaa

SEQ ID NO: 2597869 - RNA, 17 nt, Escherichia coli CFT073
caauuucacgcucaccc

SEQ ID NO: 2597870 - RNA, 12 nt, Escherichia coli CFT073
caauuuccaguu

SEQ ID NO: 2597871 - RNA, 20 nt, Escherichia coli CFT073
caauuuccgcuuucaacgcg

SEQ ID NO: 2597872 - RNA, 14 nt, Escherichia coli CFT073
caauuugccaggcu

SEQ ID NO: 2597873 - RNA, 12 nt, Escherichia coli CFT073
caauuugccauc

SEQ ID NO: 2597874 - RNA, 20 nt, Escherichia coli CFT073
caauuugcuuaagccgcucu

SEQ ID NO: 2597875 - RNA, 20 nt, Escherichia coli CFT073
caauuuugcguuuggcauca

SEQ ID NO: 2597876 - RNA, 13 nt, Escherichia coli CFT073
caauuuugcugug

SEQ ID NO: 2597877 - RNA, 15 nt, Escherichia coli CFT073
caauuuuucccucuu

SEQ ID NO: 2597878 - RNA, 15 nt, Escherichia coli CFT073
cacaaaaacaccgcu

SEQ ID NO: 2597879 - RNA, 16 nt, Escherichia coli CFT073
cacaaaaacaccgcug

SEQ ID NO: 2597880 - RNA, 17 nt, Escherichia coli CFT073
cacaaaaacaccgcugu

SEQ ID NO: 2597881 - RNA, 15 nt, Escherichia coli CFT073
cacaaaaacccgcuc

SEQ ID NO: 2597882 - RNA, 14 nt, Escherichia coli CFT073
cacaaaacuguauc

SEQ ID NO: 2597883 - RNA, 18 nt, Escherichia coli CFT073
cacagcaccuuaugcggg

SEQ ID NO: 2597884 - RNA, 15 nt, Escherichia coli CFT073
cacagcaguugugug

SEQ ID NO: 2597885 - RNA, 18 nt, Escherichia coli CFT073
cacagcauucagcuucca

SEQ ID NO: 2597886 - RNA, 22 nt, Escherichia coli CFT073
cacagccagccuccaacccaca

SEQ ID NO: 2597887 - RNA, 19 nt, Escherichia coli CFT073
cacagccagcgcaggcagu

SEQ ID NO: 2597888 - RNA, 15 nt, Escherichia coli CFT073
cacagcccgccgcca

SEQ ID NO: 2597889 - RNA, 14 nt, Escherichia coli CFT073
cacagcgacaagcu

SEQ ID NO: 2597890 - RNA, 19 nt, Escherichia coli CFT073
cacagcgacaagcucucuu

SEQ ID NO: 2597891 - RNA, 14 nt, Escherichia coli CFT073
cacagcgcaccaac

SEQ ID NO: 2597892 - RNA, 16 nt, Escherichia coli CFT073
cacagcgccagacacu

SEQ ID NO: 2597893 - RNA, 20 nt, Escherichia coli CFT073
cacagcgccagacacuggaa

SEQ ID NO: 2597894 - RNA, 21 nt, Escherichia coli CFT073
cacagcuuucggguggccagc

SEQ ID NO: 2597895 - RNA, 15 nt, Escherichia coli CFT073
cacaggagacaccag

SEQ ID NO: 2597896 - RNA, 21 nt, Escherichia coli CFT073
cacaggcagcaaucacugcca

SEQ ID NO: 2597897 - RNA, 14 nt, Escherichia coli CFT073
cacaggcaucguga

SEQ ID NO: 2597898 - RNA, 15 nt, Escherichia coli CFT073
cacaggcauucagau

SEQ ID NO: 2597899 - RNA, 15 nt, Escherichia coli CFT073
cacaggccauuuccc

SEQ ID NO: 2597900 - RNA, 12 nt, Escherichia coli CFT073
cacaggccgcca

SEQ ID NO: 2597901 - RNA, 11 nt, Escherichia coli CFT073
cacaggcgcga

SEQ ID NO: 2597902 - RNA, 13 nt, Escherichia coli CFT073
cacaggcuggcgu

SEQ ID NO: 2597903 - RNA, 22 nt, Escherichia coli CFT073
cacagggcugcugaugcgccgc

SEQ ID NO: 2597904 - RNA, 21 nt, Escherichia coli CFT073
cacaggucgcccccggcagug

SEQ ID NO: 2597905 - RNA, 22 nt, Escherichia coli CFT073
cacaggucgcccccggcaguga

SEQ ID NO: 2597906 - RNA, 17 nt, Escherichia coli CFT073
cacaguaauuuccugcc

SEQ ID NO: 2597907 - RNA, 13 nt, Escherichia coli CFT073
cacagucugcucc

SEQ ID NO: 2597908 - RNA, 20 nt, Escherichia coli CFT073
cacagucuggagaugggugu

SEQ ID NO: 2597909 - RNA, 16 nt, Escherichia coli CFT073
cacagugaaucucuua

SEQ ID NO: 2597910 - RNA, 22 nt, Escherichia coli CFT073
cacagugacccgcagccagcac

SEQ ID NO: 2597911 - RNA, 13 nt, Escherichia coli CFT073
cacagugucauug

SEQ ID NO: 2597912 - RNA, 16 nt, Escherichia coli CFT073
cacaguuuuacugcag

SEQ ID NO: 2597913 - RNA, 15 nt, Escherichia coli CFT073
cacaguuuuccgcca

SEQ ID NO: 2597914 - RNA, 23 nt, Escherichia coli CFT073
cacaguuuugagugauuccguuc

SEQ ID NO: 2597915 - RNA, 20 nt, Escherichia coli CFT073
cacauaaaguagccaauccc

SEQ ID NO: 2597916 - RNA, 13 nt, Escherichia coli CFT073
cacauaaauaaca

SEQ ID NO: 2597917 - RNA, 22 nt, Escherichia coli CFT073
cacauaacagcgggacaacaaa

SEQ ID NO: 2597918 - RNA, 20 nt, Escherichia coli CFT073
cacauaaccguacaaccguu

SEQ ID NO: 2597919 - RNA, 17 nt, Escherichia coli CFT073
cacauaagaucaucggc

SEQ ID NO: 2597920 - RNA, 16 nt, Escherichia coli CFT073
cacauacauguauaaa

SEQ ID NO: 2597921 - RNA, 19 nt, Escherichia coli CFT073
cacauaccacggcauuucc

SEQ ID NO: 2597922 - RNA, 20 nt, Escherichia coli CFT073
cacauagcgugacaccagca

SEQ ID NO: 2597923 - RNA, 16 nt, Escherichia coli CFT073
cacauauguuuaaccg

SEQ ID NO: 2597924 - RNA, 12 nt, Escherichia coli CFT073
cacauauucauu

SEQ ID NO: 2597925 - RNA, 17 nt, Escherichia coli CFT073
cacauauucauuacuua

SEQ ID NO: 2597926 - RNA, 23 nt, Escherichia coli CFT073
cacauauugcaccagaucuucca

SEQ ID NO: 2597927 - RNA, 15 nt, Escherichia coli CFT073
cacauauugcagcuu

SEQ ID NO: 2597928 - RNA, 15 nt, Escherichia coli CFT073
cacaucaaaucccca

SEQ ID NO: 2597929 - RNA, 15 nt, Escherichia coli CFT073
cacaucaacccagaa

SEQ ID NO: 2597930 - RNA, 12 nt, Escherichia coli CFT073
cacaucaacccg

SEQ ID NO: 2597931 - RNA, 21 nt, Escherichia coli CFT073
cacaucacgccgcuggcauac

SEQ ID NO: 2597932 - RNA, 13 nt, Escherichia coli CFT073
cacaucagcaacg

SEQ ID NO: 2597933 - RNA, 17 nt, Escherichia coli CFT073
cacaucaggacgaauac

SEQ ID NO: 2597934 - RNA, 21 nt, Escherichia coli CFT073
cacaucaggcacaucggcuaa

SEQ ID NO: 2597935 - RNA, 20 nt, Escherichia coli CFT073
cacaucaggcccacuacacc

SEQ ID NO: 2597936 - RNA, 16 nt, Escherichia coli CFT073
cacaucauaaauaaga

SEQ ID NO: 2597937 - RNA, 14 nt, Escherichia coli CFT073
cacaucaucaucgc

SEQ ID NO: 2597938 - RNA, 16 nt, Escherichia coli CFT073
cacaucaucaucgcgg

SEQ ID NO: 2597939 - RNA, 23 nt, Escherichia coli CFT073
cacaucauccggcacuuuuucau

SEQ ID NO: 2597940 - RNA, 16 nt, Escherichia coli CFT073
cacaucauuacaacgc

SEQ ID NO: 2597941 - RNA, 22 nt, Escherichia coli CFT073
cacaucauugagacguuugaga

SEQ ID NO: 2597942 - RNA, 18 nt, Escherichia coli CFT073
cacauccagaugucuuua

SEQ ID NO: 2597943 - RNA, 16 nt, Escherichia coli CFT073
cacauccagcggcaga

SEQ ID NO: 2597944 - RNA, 19 nt, Escherichia coli CFT073
cacauccaucgccaguuca

SEQ ID NO: 2597945 - RNA, 18 nt, Escherichia coli CFT073
cacaucccagcagagauc

SEQ ID NO: 2597946 - RNA, 22 nt, Escherichia coli CFT073
cacauccgguaagcgauaacgc

SEQ ID NO: 2597947 - RNA, 11 nt, Escherichia coli CFT073
cacauccgucc

SEQ ID NO: 2597948 - RNA, 14 nt, Escherichia coli CFT073
cacauccugccagu

SEQ ID NO: 2597949 - RNA, 21 nt, Escherichia coli CFT073
cacauccugccaguaagcagu

SEQ ID NO: 2597950 - RNA, 20 nt, Escherichia coli CFT073
cacaucgcugacacgggaaa

SEQ ID NO: 2597951 - RNA, 20 nt, Escherichia coli CFT073
cacaucggcaggaacagaua

SEQ ID NO: 2597952 - RNA, 20 nt, Escherichia coli CFT073
cacaucgguuugcgcagcuu

SEQ ID NO: 2597953 - RNA, 22 nt, Escherichia coli CFT073
cacaugaauucgacuuucucug

SEQ ID NO: 2597954 - RNA, 20 nt, Escherichia coli CFT073
cacaugaucauucaccagcc

SEQ ID NO: 2597955 - RNA, 15 nt, Escherichia coli CFT073
cacaugaugauggcu

SEQ ID NO: 2597956 - RNA, 19 nt, Escherichia coli CFT073
cacaugcaagucgaacggu

SEQ ID NO: 2597957 - RNA, 18 nt, Escherichia coli CFT073
cacaugcacauccacgcc

SEQ ID NO: 2597958 - RNA, 15 nt, Escherichia coli CFT073
cacaugcggcgugcc

SEQ ID NO: 2597959 - RNA, 16 nt, Escherichia coli CFT073
cacaugcugacuacuu

SEQ ID NO: 2597960 - RNA, 19 nt, Escherichia coli CFT073
cacaugcugacuacuuuca

SEQ ID NO: 2597961 - RNA, 15 nt, Escherichia coli CFT073
cacauguugcagggc

SEQ ID NO: 2597962 - RNA, 12 nt, Escherichia coli CFT073
cacauuaaaaug

SEQ ID NO: 2597963 - RNA, 22 nt, Escherichia coli CFT073
cacauuaaaaugaauaacuucc

SEQ ID NO: 2597964 - RNA, 23 nt, Escherichia coli CFT073
cacauuaaaaugaauaacuuccu

SEQ ID NO: 2597965 - RNA, 14 nt, Escherichia coli CFT073
cacauuaucaaacg

SEQ ID NO: 2597966 - RNA, 14 nt, Escherichia coli CFT073
cacauucagcagcc

SEQ ID NO: 2597967 - RNA, 21 nt, Escherichia coli CFT073
cacauucagcagcccggcaac

SEQ ID NO: 2597968 - RNA, 14 nt, Escherichia coli CFT073
cacauuccagaugc

SEQ ID NO: 2597969 - RNA, 15 nt, Escherichia coli CFT073
cacauuccagaugcg

SEQ ID NO: 2597970 - RNA, 15 nt, Escherichia coli CFT073
cacauucccuaugcu

SEQ ID NO: 2597971 - RNA, 18 nt, Escherichia coli CFT073
cacauucccuaugcugau

SEQ ID NO: 2597972 - RNA, 21 nt, Escherichia coli CFT073
cacauucccugcagucaccug

SEQ ID NO: 2597973 - RNA, 22 nt, Escherichia coli CFT073
cacauucugcauugcgcugaac

SEQ ID NO: 2597974 - RNA, 23 nt, Escherichia coli CFT073
cacauucugcauugcgcugaaca

SEQ ID NO: 2597975 - RNA, 17 nt, Escherichia coli CFT073
cacauuguuaaagcccu

SEQ ID NO: 2597976 - RNA, 16 nt, Escherichia coli CFT073
cacauuucccggccac

SEQ ID NO: 2597977 - RNA, 16 nt, Escherichia coli CFT073
cacauuucucugucag

SEQ ID NO: 2597978 - RNA, 14 nt, Escherichia coli CFT073
cacauuuuccauca

SEQ ID NO: 2597979 - RNA, 14 nt, Escherichia coli CFT073
caccaaaauaccac

SEQ ID NO: 2597980 - RNA, 14 nt, Escherichia coli CFT073
caccaaacugcucg

SEQ ID NO: 2597981 - RNA, 19 nt, Escherichia coli CFT073
caccaaacuggaauagcgc

SEQ ID NO: 2597982 - RNA, 23 nt, Escherichia coli CFT073
caccaaagaugucaccauuggca

SEQ ID NO: 2597983 - RNA, 22 nt, Escherichia coli CFT073
caccaaauaaaaaaacgccaga

SEQ ID NO: 2597984 - RNA, 17 nt, Escherichia coli CFT073
caccaaaugccugcugu

SEQ ID NO: 2597985 - RNA, 17 nt, Escherichia coli CFT073
caccaaauuguuuugcu

SEQ ID NO: 2597986 - RNA, 18 nt, Escherichia coli CFT073
caccaaauuguuuugcua

SEQ ID NO: 2597987 - RNA, 18 nt, Escherichia coli CFT073
caccaacaucgacauaau

SEQ ID NO: 2597988 - RNA, 16 nt, Escherichia coli CFT073
caccaacgauuuuuuc

SEQ ID NO: 2597989 - RNA, 20 nt, Escherichia coli CFT073
caccaacgauuuuuuccgca

SEQ ID NO: 2597990 - RNA, 19 nt, Escherichia coli CFT073
caccaacgcaccaaaguua

SEQ ID NO: 2597991 - RNA, 19 nt, Escherichia coli CFT073
caccagcgccugcgcggca

SEQ ID NO: 2597992 - RNA, 22 nt, Escherichia coli CFT073
caccagcgcugcggccugcugc

SEQ ID NO: 2597993 - RNA, 13 nt, Escherichia coli CFT073
caccagcggaaug

SEQ ID NO: 2597994 - RNA, 14 nt, Escherichia coli CFT073
caccagcguaccga

SEQ ID NO: 2597995 - RNA, 22 nt, Escherichia coli CFT073
caccagcgucaguucgccagca

SEQ ID NO: 2597996 - RNA, 13 nt, Escherichia coli CFT073
caccagcgucgcg

SEQ ID NO: 2597997 - RNA, 21 nt, Escherichia coli CFT073
caccagcugaauggguaaacc

SEQ ID NO: 2597998 - RNA, 19 nt, Escherichia coli CFT073
caccagcuuguuguccggu

SEQ ID NO: 2597999 - RNA, 17 nt, Escherichia coli CFT073
caccaggaacgcgccaa

SEQ ID NO: 2598000 - RNA, 17 nt, Escherichia coli CFT073
caccaggaacucagcgu

SEQ ID NO: 2598001 - RNA, 19 nt, Escherichia coli CFT073
caccaggaagccuuccgca

SEQ ID NO: 2598002 - RNA, 21 nt, Escherichia coli CFT073
caccaggcaagaauccgcccc

SEQ ID NO: 2598003 - RNA, 14 nt, Escherichia coli CFT073
caccaggccgcgca

SEQ ID NO: 2598004 - RNA, 15 nt, Escherichia coli CFT073
caccaggccgcgcag

SEQ ID NO: 2598005 - RNA, 17 nt, Escherichia coli CFT073
caccaggcuaaauugca

SEQ ID NO: 2598006 - RNA, 22 nt, Escherichia coli CFT073
caccaggcucuuugaacaguuu

SEQ ID NO: 2598007 - RNA, 22 nt, Escherichia coli CFT073
caccagggaaauaaucgggaau

SEQ ID NO: 2598008 - RNA, 22 nt, Escherichia coli CFT073
caccaggguggcaaaugcauag

SEQ ID NO: 2598009 - RNA, 23 nt, Escherichia coli CFT073
caccagguuuucgucguacugac

SEQ ID NO: 2598010 - RNA, 15 nt, Escherichia coli CFT073
caccaguaaaacggg

SEQ ID NO: 2598011 - RNA, 20 nt, Escherichia coli CFT073
caccaguaacgcucccugga

SEQ ID NO: 2598012 - RNA, 20 nt, Escherichia coli CFT073
caccaguaaggcaucuucuu

SEQ ID NO: 2598013 - RNA, 21 nt, Escherichia coli CFT073
caccaguaaggcaucuucuuc

SEQ ID NO: 2598014 - RNA, 18 nt, Escherichia coli CFT073
caccaguaccauuuucgc

SEQ ID NO: 2598015 - RNA, 15 nt, Escherichia coli CFT073
caccaguaccgccgc

SEQ ID NO: 2598016 - RNA, 22 nt, Escherichia coli CFT073
caccagucagcgaacaccagca

SEQ ID NO: 2598017 - RNA, 15 nt, Escherichia coli CFT073
caccagugcaggcac

SEQ ID NO: 2598018 - RNA, 23 nt, Escherichia coli CFT073
caccagugguuaccgaauccagc

SEQ ID NO: 2598019 - RNA, 16 nt, Escherichia coli CFT073
caccaguucaccaccu

SEQ ID NO: 2598020 - RNA, 13 nt, Escherichia coli CFT073
caccaguucacgc

SEQ ID NO: 2598021 - RNA, 23 nt, Escherichia coli CFT073
caccaguugguagguccagccgc

SEQ ID NO: 2598022 - RNA, 14 nt, Escherichia coli CFT073
caccaguuuccagu

SEQ ID NO: 2598023 - RNA, 20 nt, Escherichia coli CFT073
caccaguuuccagucacccu

SEQ ID NO: 2598024 - RNA, 16 nt, Escherichia coli CFT073
caccauaauauaagga

SEQ ID NO: 2598025 - RNA, 15 nt, Escherichia coli CFT073
caccauaaugaccaa

SEQ ID NO: 2598026 - RNA, 17 nt, Escherichia coli CFT073
caccauauucagcagca

SEQ ID NO: 2598027 - RNA, 18 nt, Escherichia coli CFT073
caccaucaaacagccccu

SEQ ID NO: 2598028 - RNA, 19 nt, Escherichia coli CFT073
caccaucaaacagccccug

SEQ ID NO: 2598029 - RNA, 14 nt, Escherichia coli CFT073
caccaucagcagca

SEQ ID NO: 2598030 - RNA, 20 nt, Escherichia coli CFT073
caccaucagcagcaacaaaa

SEQ ID NO: 2598031 - RNA, 18 nt, Escherichia coli CFT073
caccauccagcaacaaca

SEQ ID NO: 2598032 - RNA, 19 nt, Escherichia coli CFT073
caccauccccaccaaaaca

SEQ ID NO: 2598033 - RNA, 17 nt, Escherichia coli CFT073
caccauccgcccacacc

SEQ ID NO: 2598034 - RNA, 22 nt, Escherichia coli CFT073
caccaucgauaaaaucguuaaa

SEQ ID NO: 2598035 - RNA, 17 nt, Escherichia coli CFT073
caccaucgcaaacagca

SEQ ID NO: 2598036 - RNA, 15 nt, Escherichia coli CFT073
caccaucgcgaucca

SEQ ID NO: 2598037 - RNA, 17 nt, Escherichia coli CFT073
caccaucggacggaaga

SEQ ID NO: 2598038 - RNA, 21 nt, Escherichia coli CFT073
caccaucguugcuaacggcca

SEQ ID NO: 2598039 - RNA, 17 nt, Escherichia coli CFT073
caccaugccagaaaagg

SEQ ID NO: 2598040 - RNA, 15 nt, Escherichia coli CFT073
caccaugccgauggc

SEQ ID NO: 2598041 - RNA, 16 nt, Escherichia coli CFT073
caccauugccggaugc

SEQ ID NO: 2598042 - RNA, 18 nt, Escherichia coli CFT073
caccauuggcauacacgu

SEQ ID NO: 2598043 - RNA, 23 nt, Escherichia coli CFT073
caccauuuaaugacaaaaagagu

SEQ ID NO: 2598044 - RNA, 12 nt, Escherichia coli CFT073
caccauuuuuau

SEQ ID NO: 2598045 - RNA, 13 nt, Escherichia coli CFT073
cacccaaaucugc

SEQ ID NO: 2598046 - RNA, 16 nt, Escherichia coli CFT073
cacccaaucccugacc

SEQ ID NO: 2598047 - RNA, 14 nt, Escherichia coli CFT073
cacccacaccaccg

SEQ ID NO: 2598048 - RNA, 13 nt, Escherichia coli CFT073
cacccacaccgca

SEQ ID NO: 2598049 - RNA, 14 nt, Escherichia coli CFT073
cacccagaacgccg

SEQ ID NO: 2598050 - RNA, 15 nt, Escherichia coli CFT073
cacccagacuaauau

SEQ ID NO: 2598051 - RNA, 13 nt, Escherichia coli CFT073
cacccagccccgg

SEQ ID NO: 2598052 - RNA, 15 nt, Escherichia coli CFT073
cacccagcgaagcaa

SEQ ID NO: 2598053 - RNA, 23 nt, Escherichia coli CFT073
cacccagcgaagcaaaccaggcc

SEQ ID NO: 2598054 - RNA, 18 nt, Escherichia coli CFT073
cacccaguacgggcagcg

SEQ ID NO: 2598055 - RNA, 22 nt, Escherichia coli CFT073
cacccagucccaccaucagacc

SEQ ID NO: 2598056 - RNA, 21 nt, Escherichia coli CFT073
cacccagugcggugccgcgaa

SEQ ID NO: 2598057 - RNA, 15 nt, Escherichia coli CFT073
cacccauagcccaug

SEQ ID NO: 2598058 - RNA, 19 nt, Escherichia coli CFT073
cacccaucgccguaccuuu

SEQ ID NO: 2598059 - RNA, 20 nt, Escherichia coli CFT073
cacccauuacacugaaaaaa

SEQ ID NO: 2598060 - RNA, 16 nt, Escherichia coli CFT073
caccccauagccagcg

SEQ ID NO: 2598061 - RNA, 23 nt, Escherichia coli CFT073
caccccgguaaagcgcaugaugu

SEQ ID NO: 2598062 - RNA, 22 nt, Escherichia coli CFT073
cacccgacgugcagcaucgaug

SEQ ID NO: 2598063 - RNA, 16 nt, Escherichia coli CFT073
cacccgagcuaacaau

SEQ ID NO: 2598064 - RNA, 15 nt, Escherichia coli CFT073
cacccgcaacgcccu

SEQ ID NO: 2598065 - RNA, 19 nt, Escherichia coli CFT073
cacccgcaaucaucgacgc

SEQ ID NO: 2598066 - RNA, 22 nt, Escherichia coli CFT073
cacccgcagcaagcguuugagc

SEQ ID NO: 2598067 - RNA, 13 nt, Escherichia coli CFT073
cacccgcagccau

SEQ ID NO: 2598068 - RNA, 21 nt, Escherichia coli CFT073
cacccgcagugauugccgcga

SEQ ID NO: 2598069 - RNA, 15 nt, Escherichia coli CFT073
cacccgucguugcaa

SEQ ID NO: 2598070 - RNA, 22 nt, Escherichia coli CFT073
cacccgugcagggugagggcaa

SEQ ID NO: 2598071 - RNA, 18 nt, Escherichia coli CFT073
cacccguugaucuucucu

SEQ ID NO: 2598072 - RNA, 19 nt, Escherichia coli CFT073
cacccuaacccucucccca

SEQ ID NO: 2598073 - RNA, 19 nt, Escherichia coli CFT073
cacccugacuguuuuucca

SEQ ID NO: 2598074 - RNA, 23 nt, Escherichia coli CFT073
cacccugacuguuuuuccagcuu

SEQ ID NO: 2598075 - RNA, 18 nt, Escherichia coli CFT073
cacccugaugcccaaaaa

SEQ ID NO: 2598076 - RNA, 16 nt, Escherichia coli CFT073
cacccugcacggguga

SEQ ID NO: 2598077 - RNA, 12 nt, Escherichia coli CFT073
cacccugugucg

SEQ ID NO: 2598078 - RNA, 14 nt, Escherichia coli CFT073
caccgaaguuaugc

SEQ ID NO: 2598079 - RNA, 19 nt, Escherichia coli CFT073
caccgaaguucguacaccc

SEQ ID NO: 2598080 - RNA, 20 nt, Escherichia coli CFT073
caccgacaaccggugcugcg

SEQ ID NO: 2598081 - RNA, 14 nt, Escherichia coli CFT073
caccgacaauccag

SEQ ID NO: 2598082 - RNA, 16 nt, Escherichia coli CFT073
caccgacgggccugca

SEQ ID NO: 2598083 - RNA, 20 nt, Escherichia coli CFT073
caccgagagaaauagagaaa

SEQ ID NO: 2598084 - RNA, 23 nt, Escherichia coli CFT073
caccgagauaaugguuuccagca

SEQ ID NO: 2598085 - RNA, 15 nt, Escherichia coli CFT073
caccgagcguggcga

SEQ ID NO: 2598086 - RNA, 16 nt, Escherichia coli CFT073
caccgaugacagaauc

SEQ ID NO: 2598087 - RNA, 23 nt, Escherichia coli CFT073
caccgaugacagaaucagcagcg

SEQ ID NO: 2598088 - RNA, 14 nt, Escherichia coli CFT073
caccgaugcacaga

SEQ ID NO: 2598089 - RNA, 19 nt, Escherichia coli CFT073
caccgauucuuugacagaa

SEQ ID NO: 2598090 - RNA, 15 nt, Escherichia coli CFT073
caccgauugcaggaa

SEQ ID NO: 2598091 - RNA, 21 nt, Escherichia coli CFT073
caccgauuuugccuucauacu

SEQ ID NO: 2598092 - RNA, 17 nt, Escherichia coli CFT073
caccgcaaacugcuguu

SEQ ID NO: 2598093 - RNA, 22 nt, Escherichia coli CFT073
caccgcaaagaaacgcgcggca

SEQ ID NO: 2598094 - RNA, 16 nt, Escherichia coli CFT073
caccgcaaagucggca

SEQ ID NO: 2598095 - RNA, 19 nt, Escherichia coli CFT073
caccgcaaccgccaacagc

SEQ ID NO: 2598096 - RNA, 12 nt, Escherichia coli CFT073
caccgcacuggu

SEQ ID NO: 2598097 - RNA, 18 nt, Escherichia coli CFT073
caccgcagaacagauccc

SEQ ID NO: 2598098 - RNA, 19 nt, Escherichia coli CFT073
caccgcagagaucgccccg

SEQ ID NO: 2598099 - RNA, 19 nt, Escherichia coli CFT073
caccugauugaccgccagc

SEQ ID NO: 2598100 - RNA, 21 nt, Escherichia coli CFT073
caccugcaacggcaucgccaa

SEQ ID NO: 2598101 - RNA, 20 nt, Escherichia coli CFT073
caccugcacaggcauucaga

SEQ ID NO: 2598102 - RNA, 15 nt, Escherichia coli CFT073
caccugcaucacgcu

SEQ ID NO: 2598103 - RNA, 14 nt, Escherichia coli CFT073
caccugccaccagc

SEQ ID NO: 2598104 - RNA, 16 nt, Escherichia coli CFT073
caccugccagcaucuc

SEQ ID NO: 2598105 - RNA, 18 nt, Escherichia coli CFT073
caccugccagcaucucca

SEQ ID NO: 2598106 - RNA, 14 nt, Escherichia coli CFT073
caccugccagcgcc

SEQ ID NO: 2598107 - RNA, 14 nt, Escherichia coli CFT073
caccugcgcuggca

SEQ ID NO: 2598108 - RNA, 21 nt, Escherichia coli CFT073
caccugcggaaucaccggcaa

SEQ ID NO: 2598109 - RNA, 20 nt, Escherichia coli CFT073
caccugcggugcagccggag

SEQ ID NO: 2598110 - RNA, 13 nt, Escherichia coli CFT073
caccugcgguucg

SEQ ID NO: 2598111 - RNA, 13 nt, Escherichia coli CFT073
caccugcucagca

SEQ ID NO: 2598112 - RNA, 20 nt, Escherichia coli CFT073
caccuggcggcguguuaucc

SEQ ID NO: 2598113 - RNA, 14 nt, Escherichia coli CFT073
caccugggcaaugg

SEQ ID NO: 2598114 - RNA, 21 nt, Escherichia coli CFT073
caccugggcaauggugaacug

SEQ ID NO: 2598115 - RNA, 20 nt, Escherichia coli CFT073
caccuguaaaaaaggcagcc

SEQ ID NO: 2598116 - RNA, 15 nt, Escherichia coli CFT073
caccuguucacgacc

SEQ ID NO: 2598117 - RNA, 14 nt, Escherichia coli CFT073
caccuguuccauga

SEQ ID NO: 2598118 - RNA, 17 nt, Escherichia coli CFT073
caccuguuccaugacgu

SEQ ID NO: 2598119 - RNA, 15 nt, Escherichia coli CFT073
caccuuauccggccu

SEQ ID NO: 2598120 - RNA, 19 nt, Escherichia coli CFT073
caccuucaaaauuuaacau

SEQ ID NO: 2598121 - RNA, 21 nt, Escherichia coli CFT073
caccuucagcgaagcccacac

SEQ ID NO: 2598122 - RNA, 22 nt, Escherichia coli CFT073
caccuucagcgaagcccacacc

SEQ ID NO: 2598123 - RNA, 13 nt, Escherichia coli CFT073
caccuucauucag

SEQ ID NO: 2598124 - RNA, 13 nt, Escherichia coli CFT073
caccuuccucuuc

SEQ ID NO: 2598125 - RNA, 20 nt, Escherichia coli CFT073
caccuucguccagcaucaua

SEQ ID NO: 2598126 - RNA, 13 nt, Escherichia coli CFT073
caccuucuccggc

SEQ ID NO: 2598127 - RNA, 19 nt, Escherichia coli CFT073
caccuucuccggccuacaa

SEQ ID NO: 2598128 - RNA, 16 nt, Escherichia coli CFT073
caccuucuguaacugg

SEQ ID NO: 2598129 - RNA, 20 nt, Escherichia coli CFT073
caccuugcaguuguaaucac

SEQ ID NO: 2598130 - RNA, 22 nt, Escherichia coli CFT073
caccuuguggaaauuccagcgg

SEQ ID NO: 2598131 - RNA, 17 nt, Escherichia coli CFT073
caccuuucaccagcgcc

SEQ ID NO: 2598132 - RNA, 19 nt, Escherichia coli CFT073
caccuuuccccggcagcau

SEQ ID NO: 2598133 - RNA, 22 nt, Escherichia coli CFT073
caccuuuccccggcagcaucag

SEQ ID NO: 2598134 - RNA, 13 nt, Escherichia coli CFT073
caccuuuuuaauc

SEQ ID NO: 2598135 - RNA, 13 nt, Escherichia coli CFT073
cacgaaacugcug

SEQ ID NO: 2598136 - RNA, 14 nt, Escherichia coli CFT073
cacgaaacugcugg

SEQ ID NO: 2598137 - RNA, 14 nt, Escherichia coli CFT073
cacgaaaucccaca

SEQ ID NO: 2598138 - RNA, 19 nt, Escherichia coli CFT073
cacgaaaucccacauccga

SEQ ID NO: 2598139 - RNA, 23 nt, Escherichia coli CFT073
cacgaaaugaauaaucugaaaac

SEQ ID NO: 2598140 - RNA, 22 nt, Escherichia coli CFT073
cacgaacguuccccggaaaauu

SEQ ID NO: 2598141 - RNA, 16 nt, Escherichia coli CFT073
cacgaauaccaagcag

SEQ ID NO: 2598142 - RNA, 23 nt, Escherichia coli CFT073
cacgaauacguaaugucggugaa

SEQ ID NO: 2598143 - RNA, 18 nt, Escherichia coli CFT073
cacgacaaaugcgccgcc

SEQ ID NO: 2598144 - RNA, 19 nt, Escherichia coli CFT073
cacgacaaaugcgccgcca

SEQ ID NO: 2598145 - RNA, 20 nt, Escherichia coli CFT073
cacgacaaaugcgccgccaa

SEQ ID NO: 2598146 - RNA, 16 nt, Escherichia coli CFT073
cacgacacauaaauaa

SEQ ID NO: 2598147 - RNA, 18 nt, Escherichia coli CFT073
cacgacacauaaauaaca

SEQ ID NO: 2598148 - RNA, 23 nt, Escherichia coli CFT073
cacgacaugacccggcguaugcc

SEQ ID NO: 2598149 - RNA, 17 nt, Escherichia coli CFT073
cacgaccggguuuucaa

SEQ ID NO: 2598150 - RNA, 13 nt, Escherichia coli CFT073
cacgaccuugcca

SEQ ID NO: 2598151 - RNA, 16 nt, Escherichia coli CFT073
cacgaccuugccaagg

SEQ ID NO: 2598152 - RNA, 12 nt, Escherichia coli CFT073
cacgacgccagc

SEQ ID NO: 2598153 - RNA, 17 nt, Escherichia coli CFT073
cacgacgcgccagcagc

SEQ ID NO: 2598154 - RNA, 19 nt, Escherichia coli CFT073
cacgacggaauuucauaug

SEQ ID NO: 2598155 - RNA, 15 nt, Escherichia coli CFT073
cacgacgguucauug

SEQ ID NO: 2598156 - RNA, 22 nt, Escherichia coli CFT073
cacgacucauucccauaccuuu

SEQ ID NO: 2598157 - RNA, 20 nt, Escherichia coli CFT073
cacgacuuguaccuucagcg

SEQ ID NO: 2598158 - RNA, 22 nt, Escherichia coli CFT073
cacgaggugccaccagugcagg

SEQ ID NO: 2598159 - RNA, 20 nt, Escherichia coli CFT073
cacgagucauuccugccccg

SEQ ID NO: 2598160 - RNA, 20 nt, Escherichia coli CFT073
  misc_feature (9)..(9): n is a, c, g or u
cacgauaangcuugcgcauc

SEQ ID NO: 2598161 - RNA, 12 nt, Escherichia coli CFT073
cacgauaucaau

SEQ ID NO: 2598162 - RNA, 19 nt, Escherichia coli CFT073
cacgauaucgauaugacca

SEQ ID NO: 2598163 - RNA, 16 nt, Escherichia coli CFT073
cacgaucaagagaucc

SEQ ID NO: 2598164 - RNA, 18 nt, Escherichia coli CFT073
cacgaucugacauuugca

SEQ ID NO: 2598165 - RNA, 13 nt, Escherichia coli CFT073
cacgaucuucacg

SEQ ID NO: 2598166 - RNA, 13 nt, Escherichia coli CFT073
cacgaugcagcgu

SEQ ID NO: 2598167 - RNA, 18 nt, Escherichia coli CFT073
cacgaugccucaucacaa

SEQ ID NO: 2598168 - RNA, 19 nt, Escherichia coli CFT073
cacgauuggguaacgcacg

SEQ ID NO: 2598169 - RNA, 20 nt, Escherichia coli CFT073
cacgauuugcguaaaaccug

SEQ ID NO: 2598170 - RNA, 21 nt, Escherichia coli CFT073
cacgauuugcguaaaaccugc

SEQ ID NO: 2598171 - RNA, 17 nt, Escherichia coli CFT073
cacgcaaaccaccuggc

SEQ ID NO: 2598172 - RNA, 13 nt, Escherichia coli CFT073
cacgcaaacuucg

SEQ ID NO: 2598173 - RNA, 17 nt, Escherichia coli CFT073
cacgcaaacuucgguua

SEQ ID NO: 2598174 - RNA, 12 nt, Escherichia coli CFT073
cacgcaaagcac

SEQ ID NO: 2598175 - RNA, 21 nt, Escherichia coli CFT073
cacgcaaagcacgccaggugg

SEQ ID NO: 2598176 - RNA, 20 nt, Escherichia coli CFT073
cacgcaacccgcucaacagc

SEQ ID NO: 2598177 - RNA, 15 nt, Escherichia coli CFT073
cacgcacagcccgcc

SEQ ID NO: 2598178 - RNA, 14 nt, Escherichia coli CFT073
cacgcagacaauaa

SEQ ID NO: 2598179 - RNA, 12 nt, Escherichia coli CFT073
cacgcagaccaa

SEQ ID NO: 2598180 - RNA, 15 nt, Escherichia coli CFT073
cacgcagaccaaccg

SEQ ID NO: 2598181 - RNA, 16 nt, Escherichia coli CFT073
cacgcagagcaucauu

SEQ ID NO: 2598182 - RNA, 18 nt, Escherichia coli CFT073
cacgcagaucgguugcca

SEQ ID NO: 2598183 - RNA, 24 nt, Escherichia coli CFT073
cacgcagcuucucgugaaauucac

SEQ ID NO: 2598184 - RNA, 14 nt, Escherichia coli CFT073
cacgcagucagcac

SEQ ID NO: 2598185 - RNA, 13 nt, Escherichia coli CFT073
cacgcaucacgac

SEQ ID NO: 2598186 - RNA, 14 nt, Escherichia coli CFT073
cacgcaucugcaca

SEQ ID NO: 2598187 - RNA, 16 nt, Escherichia coli CFT073
cacgcaucugcacaau

SEQ ID NO: 2598188 - RNA, 13 nt, Escherichia coli CFT073
cacgcauuaauaa

SEQ ID NO: 2598189 - RNA, 14 nt, Escherichia coli CFT073
cacgcauuaauaag

SEQ ID NO: 2598190 - RNA, 15 nt, Escherichia coli CFT073
cacgcauugccgcca

SEQ ID NO: 2598191 - RNA, 14 nt, Escherichia coli CFT073
cacgcauuugcagc

SEQ ID NO: 2598192 - RNA, 20 nt, Escherichia coli CFT073
cacgcauuugcagcaaauag

SEQ ID NO: 2598193 - RNA, 13 nt, Escherichia coli CFT073
cacgccaacaaau

SEQ ID NO: 2598194 - RNA, 13 nt, Escherichia coli CFT073
cacgccaaccacc

SEQ ID NO: 2598195 - RNA, 18 nt, Escherichia coli CFT073
cacgccaaccaccggaau

SEQ ID NO: 2598196 - RNA, 21 nt, Escherichia coli CFT073
cacgccaacguguugcugcau

SEQ ID NO: 2598197 - RNA, 19 nt, Escherichia coli CFT073
cacgccaagaaacuggcug

SEQ ID NO: 2598198 - RNA, 14 nt, Escherichia coli CFT073
cacgccaccagcgu

SEQ ID NO: 2598199 - RNA, 18 nt, Escherichia coli CFT073
cacgccaccagcgucauc

SEQ ID NO: 2598200 - RNA, 19 nt, Escherichia coli CFT073
cacgccaccagcgucauca

SEQ ID NO: 2598201 - RNA, 16 nt, Escherichia coli CFT073
cacgccagccgccagc

SEQ ID NO: 2598202 - RNA, 19 nt, Escherichia coli CFT073
cacgccagcguugaugcuc

SEQ ID NO: 2598203 - RNA, 20 nt, Escherichia coli CFT073
cacgccagugcgccccaggu

SEQ ID NO: 2598204 - RNA, 21 nt, Escherichia coli CFT073
cacgccagugucgcaucaggc

SEQ ID NO: 2598205 - RNA, 20 nt, Escherichia coli CFT073
cacgccaguguuucgacaau

SEQ ID NO: 2598206 - RNA, 18 nt, Escherichia coli CFT073
cacgccauacccgcacaa

SEQ ID NO: 2598207 - RNA, 13 nt, Escherichia coli CFT073
cacgcccaguccg

SEQ ID NO: 2598208 - RNA, 18 nt, Escherichia coli CFT073
cacguuuuucauccagcg

SEQ ID NO: 2598209 - RNA, 20 nt, Escherichia coli CFT073
cacguuuuucauccagcggc

SEQ ID NO: 2598210 - RNA, 23 nt, Escherichia coli CFT073
cacguuuuucauccagcggcaac

SEQ ID NO: 2598211 - RNA, 19 nt, Escherichia coli CFT073
cacuaacaugacaccaagc

SEQ ID NO: 2598212 - RNA, 13 nt, Escherichia coli CFT073
cacuaacugcgcg

SEQ ID NO: 2598213 - RNA, 18 nt, Escherichia coli CFT073
cacuaaggguaaaacgac

SEQ ID NO: 2598214 - RNA, 18 nt, Escherichia coli CFT073
cacuaaucgggccgacaa

SEQ ID NO: 2598215 - RNA, 20 nt, Escherichia coli CFT073
cacuaaucgggccgacaaaa

SEQ ID NO: 2598216 - RNA, 17 nt, Escherichia coli CFT073
cacuaauuaagacugau

SEQ ID NO: 2598217 - RNA, 14 nt, Escherichia coli CFT073
cacuaauuccugca

SEQ ID NO: 2598218 - RNA, 16 nt, Escherichia coli CFT073
cacuaauuccugcaaa

SEQ ID NO: 2598219 - RNA, 17 nt, Escherichia coli CFT073
cacuacaaauuuagccc

SEQ ID NO: 2598220 - RNA, 12 nt, Escherichia coli CFT073
cacuacaacaac

SEQ ID NO: 2598221 - RNA, 14 nt, Escherichia coli CFT073
cacuacaaucaggc

SEQ ID NO: 2598222 - RNA, 12 nt, Escherichia coli CFT073
cacuacacccca

SEQ ID NO: 2598223 - RNA, 19 nt, Escherichia coli CFT073
cacuacaccguacucccga

SEQ ID NO: 2598224 - RNA, 22 nt, Escherichia coli CFT073
cacuacaccguacucccgagga

SEQ ID NO: 2598225 - RNA, 15 nt, Escherichia coli CFT073
cacuaccaaaacgga

SEQ ID NO: 2598226 - RNA, 17 nt, Escherichia coli CFT073
cacuaccaccuuuuuaa

SEQ ID NO: 2598227 - RNA, 23 nt, Escherichia coli CFT073
cacuaccagugccagaacagaaa

SEQ ID NO: 2598228 - RNA, 18 nt, Escherichia coli CFT073
cacuaccccaauaauucu

SEQ ID NO: 2598229 - RNA, 15 nt, Escherichia coli CFT073
cacuaccgccgagca

SEQ ID NO: 2598230 - RNA, 19 nt, Escherichia coli CFT073
cacuaccgccgagcacaaa

SEQ ID NO: 2598231 - RNA, 22 nt, Escherichia coli CFT073
cacuaccguuuuacucaaaaug

SEQ ID NO: 2598232 - RNA, 14 nt, Escherichia coli CFT073
cacuacgcccgcug

SEQ ID NO: 2598233 - RNA, 15 nt, Escherichia coli CFT073
cacuacggcucagca

SEQ ID NO: 2598234 - RNA, 16 nt, Escherichia coli CFT073
cacuacggucacgcca

SEQ ID NO: 2598235 - RNA, 14 nt, Escherichia coli CFT073
cacuacgugaucgu

SEQ ID NO: 2598236 - RNA, 15 nt, Escherichia coli CFT073
cacuagucccuccgc

SEQ ID NO: 2598237 - RNA, 18 nt, Escherichia coli CFT073
cacuagucccuccgcaca

SEQ ID NO: 2598238 - RNA, 20 nt, Escherichia coli CFT073
cacuagucccuccgcacaaa

SEQ ID NO: 2598239 - RNA, 20 nt, Escherichia coli CFT073
cacuauacaaccagauaacc

SEQ ID NO: 2598240 - RNA, 18 nt, Escherichia coli CFT073
cacuauaucucaaucaaa

SEQ ID NO: 2598241 - RNA, 21 nt, Escherichia coli CFT073
cacuaucaaccacggcaacgc

SEQ ID NO: 2598242 - RNA, 17 nt, Escherichia coli CFT073
cacuaucaaugaauaag

SEQ ID NO: 2598243 - RNA, 18 nt, Escherichia coli CFT073
cacuaucgccaucaggca

SEQ ID NO: 2598244 - RNA, 21 nt, Escherichia coli CFT073
cacuauuuaccgccaacgcaa

SEQ ID NO: 2598245 - RNA, 16 nt, Escherichia coli CFT073
cacucaacagccagaa

SEQ ID NO: 2598246 - RNA, 20 nt, Escherichia coli CFT073
cacucaacuuauugaucauc

SEQ ID NO: 2598247 - RNA, 15 nt, Escherichia coli CFT073
cacucacccgccagc

SEQ ID NO: 2598248 - RNA, 15 nt, Escherichia coli CFT073
cacucaccgccguua

SEQ ID NO: 2598249 - RNA, 21 nt, Escherichia coli CFT073
cacucacgauagugacucauu

SEQ ID NO: 2598250 - RNA, 15 nt, Escherichia coli CFT073
cacucacgccaggca

SEQ ID NO: 2598251 - RNA, 13 nt, Escherichia coli CFT073
cacucacgcugcg

SEQ ID NO: 2598252 - RNA, 21 nt, Escherichia coli CFT073
cacucacgcugcguacagcgc

SEQ ID NO: 2598253 - RNA, 18 nt, Escherichia coli CFT073
cacucacugaugccguuu

SEQ ID NO: 2598254 - RNA, 17 nt, Escherichia coli CFT073
cacucagccagccgaac

SEQ ID NO: 2598255 - RNA, 13 nt, Escherichia coli CFT073
cacucaucaagca

SEQ ID NO: 2598256 - RNA, 17 nt, Escherichia coli CFT073
cacucaucaagcauuuu

SEQ ID NO: 2598257 - RNA, 18 nt, Escherichia coli CFT073
cacucaucacuccccgca

SEQ ID NO: 2598258 - RNA, 14 nt, Escherichia coli CFT073
cacucauuuucucu

SEQ ID NO: 2598259 - RNA, 22 nt, Escherichia coli CFT073
cacuccacugcgcauaauccac

SEQ ID NO: 2598260 - RNA, 14 nt, Escherichia coli CFT073
cacuccaguccacc

SEQ ID NO: 2598261 - RNA, 22 nt, Escherichia coli CFT073
cacucccccauuauuaacaaga

SEQ ID NO: 2598262 - RNA, 16 nt, Escherichia coli CFT073
cacuccccgcaacagu

SEQ ID NO: 2598263 - RNA, 14 nt, Escherichia coli CFT073
cacucccgcgcuuc

SEQ ID NO: 2598264 - RNA, 20 nt, Escherichia coli CFT073
cacucccuuucugccacgcc

SEQ ID NO: 2598265 - RNA, 19 nt, Escherichia coli CFT073
cacuccgccacgucaucag

SEQ ID NO: 2598266 - RNA, 21 nt, Escherichia coli CFT073
cacuccgguaauaucgcgcag

SEQ ID NO: 2598267 - RNA, 23 nt, Escherichia coli CFT073
cacuccgguaauaucgcgcagaa

SEQ ID NO: 2598268 - RNA, 17 nt, Escherichia coli CFT073
cacuccgucaugucucu

SEQ ID NO: 2598269 - RNA, 16 nt, Escherichia coli CFT073
cacuccuuauucagcg

SEQ ID NO: 2598270 - RNA, 21 nt, Escherichia coli CFT073
cacucgaagauacggauucuu

SEQ ID NO: 2598271 - RNA, 17 nt, Escherichia coli CFT073
cacucgacgcagcagac

SEQ ID NO: 2598272 - RNA, 20 nt, Escherichia coli CFT073
cacucgcaugguagaacagu

SEQ ID NO: 2598273 - RNA, 15 nt, Escherichia coli CFT073
cacucuauccagccu

SEQ ID NO: 2598274 - RNA, 19 nt, Escherichia coli CFT073
cacucucugucguuaucag

SEQ ID NO: 2598275 - RNA, 17 nt, Escherichia coli CFT073
cacucugaaaacgcugu

SEQ ID NO: 2598276 - RNA, 13 nt, Escherichia coli CFT073
cacucugaccugu

SEQ ID NO: 2598277 - RNA, 22 nt, Escherichia coli CFT073
cacucugccguaccaucgccag

SEQ ID NO: 2598278 - RNA, 13 nt, Escherichia coli CFT073
cacucugcgcaug

SEQ ID NO: 2598279 - RNA, 13 nt, Escherichia coli CFT073
cacucugcgccuu

SEQ ID NO: 2598280 - RNA, 17 nt, Escherichia coli CFT073
cacucugcgccuuugau

SEQ ID NO: 2598281 - RNA, 12 nt, Escherichia coli CFT073
cacucuucaaca

SEQ ID NO: 2598282 - RNA, 14 nt, Escherichia coli CFT073
cacucuuggcaccg

SEQ ID NO: 2598283 - RNA, 15 nt, Escherichia coli CFT073
cacucuuucagcacc

SEQ ID NO: 2598284 - RNA, 17 nt, Escherichia coli CFT073
cacugaaaaucaccuca

SEQ ID NO: 2598285 - RNA, 17 nt, Escherichia coli CFT073
cacugaaacagauaaaa

SEQ ID NO: 2598286 - RNA, 22 nt, Escherichia coli CFT073
cacugaaagagucgccagcugc

SEQ ID NO: 2598287 - RNA, 12 nt, Escherichia coli CFT073
cacugaaaucuc

SEQ ID NO: 2598288 - RNA, 22 nt, Escherichia coli CFT073
cacugaauaaacagcagauggc

SEQ ID NO: 2598289 - RNA, 21 nt, Escherichia coli CFT073
cacugaauaccguaaaacuca

SEQ ID NO: 2598290 - RNA, 20 nt, Escherichia coli CFT073
cacugacacaggcagcaauc

SEQ ID NO: 2598291 - RNA, 14 nt, Escherichia coli CFT073
cacugacaccagca

SEQ ID NO: 2598292 - RNA, 19 nt, Escherichia coli CFT073
cacugacaggccgugcagu

SEQ ID NO: 2598293 - RNA, 14 nt, Escherichia coli CFT073
cacugacauacagc

SEQ ID NO: 2598294 - RNA, 21 nt, Escherichia coli CFT073
cacugaccaccaccaccugca

SEQ ID NO: 2598295 - RNA, 17 nt, Escherichia coli CFT073
cacugaccgcccggccc

SEQ ID NO: 2598296 - RNA, 12 nt, Escherichia coli CFT073
cacugacgcgca

SEQ ID NO: 2598297 - RNA, 21 nt, Escherichia coli CFT073
cacugacgcgcuuuucaccga

SEQ ID NO: 2598298 - RNA, 18 nt, Escherichia coli CFT073
cacugacgcgucuuaucu

SEQ ID NO: 2598299 - RNA, 20 nt, Escherichia coli CFT073
cacugacuuuaccugccuga

SEQ ID NO: 2598300 - RNA, 15 nt, Escherichia coli CFT073
cacugagcccgcuuc

SEQ ID NO: 2598301 - RNA, 23 nt, Escherichia coli CFT073
cacugagguaacucucaugcuuc

SEQ ID NO: 2598302 - RNA, 22 nt, Escherichia coli CFT073
cacugauaagcugagcacaaaa

SEQ ID NO: 2598303 - RNA, 17 nt, Escherichia coli CFT073
cacugauagugcugcca

SEQ ID NO: 2598304 - RNA, 21 nt, Escherichia coli CFT073
cacugauauggugguaacuac

SEQ ID NO: 2598305 - RNA, 16 nt, Escherichia coli CFT073
cacugaugacaggcua

SEQ ID NO: 2598306 - RNA, 19 nt, Escherichia coli CFT073
cacugaugccacuggaugu

SEQ ID NO: 2598307 - RNA, 19 nt, Escherichia coli CFT073
cacugaugcggugacagag

SEQ ID NO: 2598308 - RNA, 19 nt, Escherichia coli CFT073
cacugauggaauuucauca

SEQ ID NO: 2598309 - RNA, 12 nt, Escherichia coli CFT073
cacugauuuccc

SEQ ID NO: 2598310 - RNA, 17 nt, Escherichia coli CFT073
cacugcacaguguuugu

SEQ ID NO: 2598311 - RNA, 22 nt, Escherichia coli CFT073
cacugcacgaugccucaucaca

SEQ ID NO: 2598312 - RNA, 18 nt, Escherichia coli CFT073
cacugcaucaguaaagua

SEQ ID NO: 2598313 - RNA, 16 nt, Escherichia coli CFT073
cacugcauggcggcgu

SEQ ID NO: 2598314 - RNA, 18 nt, Escherichia coli CFT073
cacugccaccauccccac

SEQ ID NO: 2598315 - RNA, 14 nt, Escherichia coli CFT073
cacugccacuuuuu

SEQ ID NO: 2598316 - RNA, 19 nt, Escherichia coli CFT073
cacuuuuuccggugccauc

SEQ ID NO: 2598317 - RNA, 20 nt, Escherichia coli CFT073
cacuuuuuccggugccaucu

SEQ ID NO: 2598318 - RNA, 17 nt, Escherichia coli CFT073
cagaaaaaacaaacggc

SEQ ID NO: 2598319 - RNA, 22 nt, Escherichia coli CFT073
cagaaaaaucccucuucgguaa

SEQ ID NO: 2598320 - RNA, 23 nt, Escherichia coli CFT073
cagaaaaaucccucuucgguaau

SEQ ID NO: 2598321 - RNA, 12 nt, Escherichia coli CFT073
cagaaaaggagu

SEQ ID NO: 2598322 - RNA, 17 nt, Escherichia coli CFT073
cagaaaauacucagcac

SEQ ID NO: 2598323 - RNA, 18 nt, Escherichia coli CFT073
cagaaaauacucagcacc

SEQ ID NO: 2598324 - RNA, 20 nt, Escherichia coli CFT073
cagaaaauccagcagaauaa

SEQ ID NO: 2598325 - RNA, 20 nt, Escherichia coli CFT073
cagaaacaaaugaaauauug

SEQ ID NO: 2598326 - RNA, 17 nt, Escherichia coli CFT073
cagaaacagaguauaaa

SEQ ID NO: 2598327 - RNA, 15 nt, Escherichia coli CFT073
cagaaacauccccag

SEQ ID NO: 2598328 - RNA, 18 nt, Escherichia coli CFT073
cagaaaccaggucaaugc

SEQ ID NO: 2598329 - RNA, 18 nt, Escherichia coli CFT073
cagaaacgccauccagcc

SEQ ID NO: 2598330 - RNA, 16 nt, Escherichia coli CFT073
cagaaacgcucauaaa

SEQ ID NO: 2598331 - RNA, 23 nt, Escherichia coli CFT073
cagaaacgcuggugaaaucagcc

SEQ ID NO: 2598332 - RNA, 23 nt, Escherichia coli CFT073
cagaaagacgguuaacgccagcc

SEQ ID NO: 2598333 - RNA, 23 nt, Escherichia coli CFT073
cagaaagacugaauugccagcau

SEQ ID NO: 2598334 - RNA, 22 nt, Escherichia coli CFT073
cagaaagcgacccgguucaauu

SEQ ID NO: 2598335 - RNA, 21 nt, Escherichia coli CFT073
cagaaagcgacuuugccuggc

SEQ ID NO: 2598336 - RNA, 18 nt, Escherichia coli CFT073
cagaaagcgccagcaaga

SEQ ID NO: 2598337 - RNA, 16 nt, Escherichia coli CFT073
cagaaagggaagaaca

SEQ ID NO: 2598338 - RNA, 23 nt, Escherichia coli CFT073
cagaaagggaagaacaucacugc

SEQ ID NO: 2598339 - RNA, 20 nt, Escherichia coli CFT073
cagaaagguauuuagcgaau

SEQ ID NO: 2598340 - RNA, 16 nt, Escherichia coli CFT073
cagaaaguggcacaca

SEQ ID NO: 2598341 - RNA, 22 nt, Escherichia coli CFT073
cagaaauaaucaccugaugccc

SEQ ID NO: 2598342 - RNA, 18 nt, Escherichia coli CFT073
cagaaauaccccgccagc

SEQ ID NO: 2598343 - RNA, 17 nt, Escherichia coli CFT073
cagaaauagaaagugac

SEQ ID NO: 2598344 - RNA, 18 nt, Escherichia coli CFT073
cagaaauagaaagugacu

SEQ ID NO: 2598345 - RNA, 23 nt, Escherichia coli CFT073
cagaaauagaccggagaaaagac

SEQ ID NO: 2598346 - RNA, 20 nt, Escherichia coli CFT073
cagaaauagagaaagagugc

SEQ ID NO: 2598347 - RNA, 22 nt, Escherichia coli CFT073
cagaaauagagaaagagugcgc

SEQ ID NO: 2598348 - RNA, 14 nt, Escherichia coli CFT073
cagaaaucagaguu

SEQ ID NO: 2598349 - RNA, 16 nt, Escherichia coli CFT073
cagaaaucggccuucc

SEQ ID NO: 2598350 - RNA, 18 nt, Escherichia coli CFT073
cagaaaucggccuuccau

SEQ ID NO: 2598351 - RNA, 14 nt, Escherichia coli CFT073
cagaaaugaugggg

SEQ ID NO: 2598352 - RNA, 16 nt, Escherichia coli CFT073
cagaaauuaaacuguc

SEQ ID NO: 2598353 - RNA, 18 nt, Escherichia coli CFT073
cagaaauucguaauccau

SEQ ID NO: 2598354 - RNA, 18 nt, Escherichia coli CFT073
cagaacaauuccugugcc

SEQ ID NO: 2598355 - RNA, 19 nt, Escherichia coli CFT073
cagaacaccggcagcggga

SEQ ID NO: 2598356 - RNA, 13 nt, Escherichia coli CFT073
cagaacacgccgu

SEQ ID NO: 2598357 - RNA, 19 nt, Escherichia coli CFT073
cagaacacgccguggccga

SEQ ID NO: 2598358 - RNA, 21 nt, Escherichia coli CFT073
cagaacacuucuucuguuucu

SEQ ID NO: 2598359 - RNA, 15 nt, Escherichia coli CFT073
cagaacaggcgcgaa

SEQ ID NO: 2598360 - RNA, 13 nt, Escherichia coli CFT073
cagaaccagcaac

SEQ ID NO: 2598361 - RNA, 16 nt, Escherichia coli CFT073
cagaaccagcaaccac

SEQ ID NO: 2598362 - RNA, 20 nt, Escherichia coli CFT073
cagaaccgcguaacuuuugc

SEQ ID NO: 2598363 - RNA, 15 nt, Escherichia coli CFT073
cagaaccgcuucuuc

SEQ ID NO: 2598364 - RNA, 15 nt, Escherichia coli CFT073
cagaacgaugaaguc

SEQ ID NO: 2598365 - RNA, 14 nt, Escherichia coli CFT073
cagaacgccaugcc

SEQ ID NO: 2598366 - RNA, 22 nt, Escherichia coli CFT073
cagaacgccaugccaaagaagg

SEQ ID NO: 2598367 - RNA, 17 nt, Escherichia coli CFT073
cagaacgcgauauacgu

SEQ ID NO: 2598368 - RNA, 17 nt, Escherichia coli CFT073
cagaacgcgugcgccuu

SEQ ID NO: 2598369 - RNA, 13 nt, Escherichia coli CFT073
cagaacgcugccu

SEQ ID NO: 2598370 - RNA, 17 nt, Escherichia coli CFT073
cagaacgcuuucgcaca

SEQ ID NO: 2598371 - RNA, 19 nt, Escherichia coli CFT073
cagaacggugagcgugcgg

SEQ ID NO: 2598372 - RNA, 16 nt, Escherichia coli CFT073
cagaacggugcgacca

SEQ ID NO: 2598373 - RNA, 20 nt, Escherichia coli CFT073
cagaacucaucuucuuuuuc

SEQ ID NO: 2598374 - RNA, 16 nt, Escherichia coli CFT073
cagaacucccuguucc

SEQ ID NO: 2598375 - RNA, 18 nt, Escherichia coli CFT073
cagaacugacgcccaguu

SEQ ID NO: 2598376 - RNA, 20 nt, Escherichia coli CFT073
cagaacugguagcgcauuuc

SEQ ID NO: 2598377 - RNA, 13 nt, Escherichia coli CFT073
cagaacuucgcua

SEQ ID NO: 2598378 - RNA, 22 nt, Escherichia coli CFT073
cagaacuucgcuaacaaucuca

SEQ ID NO: 2598379 - RNA, 11 nt, Escherichia coli CFT073
cagaagaaaac

SEQ ID NO: 2598380 - RNA, 17 nt, Escherichia coli CFT073
cagaagaaagccggaug

SEQ ID NO: 2598381 - RNA, 18 nt, Escherichia coli CFT073
cagaagaaagccggauga

SEQ ID NO: 2598382 - RNA, 11 nt, Escherichia coli CFT073
cagaagaaccg

SEQ ID NO: 2598383 - RNA, 19 nt, Escherichia coli CFT073
cagaagaauaaaacauagc

SEQ ID NO: 2598384 - RNA, 16 nt, Escherichia coli CFT073
cagaagacgagccguc

SEQ ID NO: 2598385 - RNA, 21 nt, Escherichia coli CFT073
cagaagagaagaaagaagccg

SEQ ID NO: 2598386 - RNA, 18 nt, Escherichia coli CFT073
cagaagaucaugccgaca

SEQ ID NO: 2598387 - RNA, 16 nt, Escherichia coli CFT073
cagaagauuaagagaa

SEQ ID NO: 2598388 - RNA, 20 nt, Escherichia coli CFT073
cagaagauucgaaaucuguu

SEQ ID NO: 2598389 - RNA, 17 nt, Escherichia coli CFT073
cagaagcaucggugugu

SEQ ID NO: 2598390 - RNA, 16 nt, Escherichia coli CFT073
cagaagcccaguuuuc

SEQ ID NO: 2598391 - RNA, 21 nt, Escherichia coli CFT073
cagaaggccagugguaaaaaa

SEQ ID NO: 2598392 - RNA, 17 nt, Escherichia coli CFT073
cagaagggccuuuggca

SEQ ID NO: 2598393 - RNA, 17 nt, Escherichia coli CFT073
cagaaggugacccguuu

SEQ ID NO: 2598394 - RNA, 11 nt, Escherichia coli CFT073
cagaagguuua

SEQ ID NO: 2598395 - RNA, 18 nt, Escherichia coli CFT073
cagaagguuuauauagua

SEQ ID NO: 2598396 - RNA, 17 nt, Escherichia coli CFT073
cagaagguuucgccgcu

SEQ ID NO: 2598397 - RNA, 19 nt, Escherichia coli CFT073
cagaaguaguugcugucga

SEQ ID NO: 2598398 - RNA, 17 nt, Escherichia coli CFT073
cagaaguugcacccagu

SEQ ID NO: 2598399 - RNA, 17 nt, Escherichia coli CFT073
cagaauaacgcggcagg

SEQ ID NO: 2598400 - RNA, 18 nt, Escherichia coli CFT073
cagaauaacgcggcagga

SEQ ID NO: 2598401 - RNA, 14 nt, Escherichia coli CFT073
cagaauacccagca

SEQ ID NO: 2598402 - RNA, 19 nt, Escherichia coli CFT073
cagaauacccagcaaugcc

SEQ ID NO: 2598403 - RNA, 17 nt, Escherichia coli CFT073
cagaauacuucacauga

SEQ ID NO: 2598404 - RNA, 19 nt, Escherichia coli CFT073
cagaauagcggcuucaucu

SEQ ID NO: 2598405 - RNA, 14 nt, Escherichia coli CFT073
cagaauauauaaag

SEQ ID NO: 2598406 - RNA, 14 nt, Escherichia coli CFT073
cagaauauccggca

SEQ ID NO: 2598407 - RNA, 22 nt, Escherichia coli CFT073
cagaauaucugcggccuccaac

SEQ ID NO: 2598408 - RNA, 15 nt, Escherichia coli CFT073
cagaauauugccauu

SEQ ID NO: 2598409 - RNA, 19 nt, Escherichia coli CFT073
cagaaucagauugaugcga

SEQ ID NO: 2598410 - RNA, 22 nt, Escherichia coli CFT073
cagaaucagauugaugcgagua

SEQ ID NO: 2598411 - RNA, 13 nt, Escherichia coli CFT073
cagaaucagcagc

SEQ ID NO: 2598412 - RNA, 14 nt, Escherichia coli CFT073
cagaaucagcagcg

SEQ ID NO: 2598413 - RNA, 17 nt, Escherichia coli CFT073
cagaaucaucauaucgu

SEQ ID NO: 2598414 - RNA, 16 nt, Escherichia coli CFT073
cagaauccccacaaac

SEQ ID NO: 2598415 - RNA, 20 nt, Escherichia coli CFT073
cagaauccccacaaaccacc

SEQ ID NO: 2598416 - RNA, 22 nt, Escherichia coli CFT073
cagaauccccacaaaccaccga

SEQ ID NO: 2598417 - RNA, 18 nt, Escherichia coli CFT073
cagaauccccacugcaug

SEQ ID NO: 2598418 - RNA, 16 nt, Escherichia coli CFT073
cagaauccccggcagg

SEQ ID NO: 2598419 - RNA, 19 nt, Escherichia coli CFT073
cagaauccccggcaggaag

SEQ ID NO: 2598420 - RNA, 22 nt, Escherichia coli CFT073
cagaauccggcgcucaucaggc

SEQ ID NO: 2598421 - RNA, 20 nt, Escherichia coli CFT073
cagaauccggugauugcugc

SEQ ID NO: 2598422 - RNA, 20 nt, Escherichia coli CFT073
cagaauccguacgcuuuucc

SEQ ID NO: 2598423 - RNA, 21 nt, Escherichia coli CFT073
cagaauccguacgcuuuucca

SEQ ID NO: 2598424 - RNA, 14 nt, Escherichia coli CFT073
cagauaaacuacag

SEQ ID NO: 2598425 - RNA, 16 nt, Escherichia coli CFT073
cagauaaauggcacag

SEQ ID NO: 2598426 - RNA, 13 nt, Escherichia coli CFT073
cagauaaccacua

SEQ ID NO: 2598427 - RNA, 21 nt, Escherichia coli CFT073
cagauaaccacuggcacaaga

SEQ ID NO: 2598428 - RNA, 15 nt, Escherichia coli CFT073
cagauaaccagagcg

SEQ ID NO: 2598429 - RNA, 13 nt, Escherichia coli CFT073
cagauaacccagc

SEQ ID NO: 2598430 - RNA, 17 nt, Escherichia coli CFT073
cagauaacccagcagcc

SEQ ID NO: 2598431 - RNA, 19 nt, Escherichia coli CFT073
cagauaaccgucugcgccu

SEQ ID NO: 2598432 - RNA, 10 nt, Escherichia coli CFT073
cagauaagac

SEQ ID NO: 2598433 - RNA, 12 nt, Escherichia coli CFT073
cagauaagacca

SEQ ID NO: 2598434 - RNA, 14 nt, Escherichia coli CFT073
cagauaagaccaau

SEQ ID NO: 2598435 - RNA, 16 nt, Escherichia coli CFT073
cagauaagaccaaucc

SEQ ID NO: 2598436 - RNA, 17 nt, Escherichia coli CFT073
cagauaaggcguucacg

SEQ ID NO: 2598437 - RNA, 23 nt, Escherichia coli CFT073
cagauaaggcguucacgccgcau

SEQ ID NO: 2598438 - RNA, 23 nt, Escherichia coli CFT073
cagauaaggcguuuacgccgcau

SEQ ID NO: 2598439 - RNA, 17 nt, Escherichia coli CFT073
cagauaauaaaaaagaa

SEQ ID NO: 2598440 - RNA, 17 nt, Escherichia coli CFT073
cagauaauaauguguuc

SEQ ID NO: 2598441 - RNA, 22 nt, Escherichia coli CFT073
cagauaauagcguuucagcggu

SEQ ID NO: 2598442 - RNA, 22 nt, Escherichia coli CFT073
cagauaauauuuaucuucccag

SEQ ID NO: 2598443 - RNA, 20 nt, Escherichia coli CFT073
cagauaaucaacccccaccu

SEQ ID NO: 2598444 - RNA, 16 nt, Escherichia coli CFT073
cagauacaaccaaucg

SEQ ID NO: 2598445 - RNA, 23 nt, Escherichia coli CFT073
cagauacacggugcgaugcaaaa

SEQ ID NO: 2598446 - RNA, 14 nt, Escherichia coli CFT073
cagauacauugcca

SEQ ID NO: 2598447 - RNA, 17 nt, Escherichia coli CFT073
cagauacauugccacca

SEQ ID NO: 2598448 - RNA, 16 nt, Escherichia coli CFT073
cagauaccaacccugg

SEQ ID NO: 2598449 - RNA, 17 nt, Escherichia coli CFT073
cagauaccacaucaacc

SEQ ID NO: 2598450 - RNA, 17 nt, Escherichia coli CFT073
cagauaccaccagcgcc

SEQ ID NO: 2598451 - RNA, 18 nt, Escherichia coli CFT073
cagauaccaccagcgcca

SEQ ID NO: 2598452 - RNA, 21 nt, Escherichia coli CFT073
cagauacggcgcaucaguuuc

SEQ ID NO: 2598453 - RNA, 22 nt, Escherichia coli CFT073
cagauacugaugaacgcgcaga

SEQ ID NO: 2598454 - RNA, 13 nt, Escherichia coli CFT073
cagauacuggaag

SEQ ID NO: 2598455 - RNA, 20 nt, Escherichia coli CFT073
cagauagaggucauuaggcc

SEQ ID NO: 2598456 - RNA, 21 nt, Escherichia coli CFT073
cagauagccgccagagaaagc

SEQ ID NO: 2598457 - RNA, 15 nt, Escherichia coli CFT073
cagauagccuauacc

SEQ ID NO: 2598458 - RNA, 17 nt, Escherichia coli CFT073
cagauaggcaucagcaa

SEQ ID NO: 2598459 - RNA, 20 nt, Escherichia coli CFT073
cagauaggcaucagcaauug

SEQ ID NO: 2598460 - RNA, 20 nt, Escherichia coli CFT073
cagauagggcgagaaauuga

SEQ ID NO: 2598461 - RNA, 14 nt, Escherichia coli CFT073
cagauaguuaccgu

SEQ ID NO: 2598462 - RNA, 19 nt, Escherichia coli CFT073
cagauaguucgcaaucgcg

SEQ ID NO: 2598463 - RNA, 21 nt, Escherichia coli CFT073
cagauaucccgccagcaccag

SEQ ID NO: 2598464 - RNA, 17 nt, Escherichia coli CFT073
cagauaucgcggauaug

SEQ ID NO: 2598465 - RNA, 22 nt, Escherichia coli CFT073
cagauauuaagcggcaccaucc

SEQ ID NO: 2598466 - RNA, 23 nt, Escherichia coli CFT073
cagaucaaaaugguagccgcccu

SEQ ID NO: 2598467 - RNA, 14 nt, Escherichia coli CFT073
cagaucaccaauau

SEQ ID NO: 2598468 - RNA, 17 nt, Escherichia coli CFT073
cagaucagccacuuccu

SEQ ID NO: 2598469 - RNA, 14 nt, Escherichia coli CFT073
cagaucauccaucg

SEQ ID NO: 2598470 - RNA, 16 nt, Escherichia coli CFT073
cagaucauccggcacg

SEQ ID NO: 2598471 - RNA, 21 nt, Escherichia coli CFT073
cagauccaaaccgacugccug

SEQ ID NO: 2598472 - RNA, 13 nt, Escherichia coli CFT073
cagauccaccaga

SEQ ID NO: 2598473 - RNA, 23 nt, Escherichia coli CFT073
cagauccagugcucauccuucag

SEQ ID NO: 2598474 - RNA, 19 nt, Escherichia coli CFT073
cagauccaguuacccagcg

SEQ ID NO: 2598475 - RNA, 21 nt, Escherichia coli CFT073
cagauccaguuacccagcgga

SEQ ID NO: 2598476 - RNA, 15 nt, Escherichia coli CFT073
cagaucccacauaug

SEQ ID NO: 2598477 - RNA, 15 nt, Escherichia coli CFT073
cagauccgcacccgc

SEQ ID NO: 2598478 - RNA, 18 nt, Escherichia coli CFT073
cagauccgguucgccaug

SEQ ID NO: 2598479 - RNA, 23 nt, Escherichia coli CFT073
cagauccugauccugcaacaaca

SEQ ID NO: 2598480 - RNA, 16 nt, Escherichia coli CFT073
cagaucgaaaucuuuu

SEQ ID NO: 2598481 - RNA, 22 nt, Escherichia coli CFT073
cagaucgaaaucuuuuuacugc

SEQ ID NO: 2598482 - RNA, 23 nt, Escherichia coli CFT073
cagaucgccagagucagcacgag

SEQ ID NO: 2598483 - RNA, 20 nt, Escherichia coli CFT073
cagaucgccccggucaucaa

SEQ ID NO: 2598484 - RNA, 13 nt, Escherichia coli CFT073
cagaucgcgaccg

SEQ ID NO: 2598485 - RNA, 14 nt, Escherichia coli CFT073
cagaucggcaaucg

SEQ ID NO: 2598486 - RNA, 17 nt, Escherichia coli CFT073
cagaucggcaaucgccu

SEQ ID NO: 2598487 - RNA, 16 nt, Escherichia coli CFT073
cagaucgguugccaua

SEQ ID NO: 2598488 - RNA, 23 nt, Escherichia coli CFT073
cagaucguguuuugcaaucaucg

SEQ ID NO: 2598489 - RNA, 13 nt, Escherichia coli CFT073
cagaucguuaaug

SEQ ID NO: 2598490 - RNA, 22 nt, Escherichia coli CFT073
cagaucuaacguuggcgugaca

SEQ ID NO: 2598491 - RNA, 23 nt, Escherichia coli CFT073
cagaucugaauauucggcuccag

SEQ ID NO: 2598492 - RNA, 20 nt, Escherichia coli CFT073
cagaucugacgauuauuuuc

SEQ ID NO: 2598493 - RNA, 14 nt, Escherichia coli CFT073
cagaucuucaucac

SEQ ID NO: 2598494 - RNA, 14 nt, Escherichia coli CFT073
cagaucuuccagcg

SEQ ID NO: 2598495 - RNA, 20 nt, Escherichia coli CFT073
cagaugaacggcuuuuucug

SEQ ID NO: 2598496 - RNA, 18 nt, Escherichia coli CFT073
cagaugaagauuuaaaca

SEQ ID NO: 2598497 - RNA, 22 nt, Escherichia coli CFT073
cagaugacucgccgcaaaaccc

SEQ ID NO: 2598498 - RNA, 23 nt, Escherichia coli CFT073
cagaugaucuaccaguuccagcg

SEQ ID NO: 2598499 - RNA, 15 nt, Escherichia coli CFT073
cagaugccauuuugc

SEQ ID NO: 2598500 - RNA, 23 nt, Escherichia coli CFT073
cagaugcgacguuacaaccacau

SEQ ID NO: 2598501 - RNA, 18 nt, Escherichia coli CFT073
cagaugcgucuucugcag

SEQ ID NO: 2598502 - RNA, 17 nt, Escherichia coli CFT073
cagaugcucuucaaaac

SEQ ID NO: 2598503 - RNA, 19 nt, Escherichia coli CFT073
cagaugcucuucaaaacga

SEQ ID NO: 2598504 - RNA, 16 nt, Escherichia coli CFT073
cagaugcugugcaauc

SEQ ID NO: 2598505 - RNA, 13 nt, Escherichia coli CFT073
cagauggacaaaa

SEQ ID NO: 2598506 - RNA, 16 nt, Escherichia coli CFT073
cagauggaucagcguu

SEQ ID NO: 2598507 - RNA, 14 nt, Escherichia coli CFT073
cagauggaugagca

SEQ ID NO: 2598508 - RNA, 22 nt, Escherichia coli CFT073
cagauggcagccaucauuuuua

SEQ ID NO: 2598509 - RNA, 17 nt, Escherichia coli CFT073
cagauggcggcuggcgc

SEQ ID NO: 2598510 - RNA, 15 nt, Escherichia coli CFT073
cagauggcuuuccac

SEQ ID NO: 2598511 - RNA, 13 nt, Escherichia coli CFT073
cagaugggcuggc

SEQ ID NO: 2598512 - RNA, 14 nt, Escherichia coli CFT073
cagauguuccgcca

SEQ ID NO: 2598513 - RNA, 18 nt, Escherichia coli CFT073
cagauuacguaccagaua

SEQ ID NO: 2598514 - RNA, 14 nt, Escherichia coli CFT073
cagauuagccggua

SEQ ID NO: 2598515 - RNA, 15 nt, Escherichia coli CFT073
cagauuagcuggccu

SEQ ID NO: 2598516 - RNA, 18 nt, Escherichia coli CFT073
cagauuagcuggccugcu

SEQ ID NO: 2598517 - RNA, 19 nt, Escherichia coli CFT073
cagauuauucaaaaacaga

SEQ ID NO: 2598518 - RNA, 20 nt, Escherichia coli CFT073
cagauuauucaaaaacagau

SEQ ID NO: 2598519 - RNA, 14 nt, Escherichia coli CFT073
cagauucaacauaa

SEQ ID NO: 2598520 - RNA, 14 nt, Escherichia coli CFT073
cagauucagcagcg

SEQ ID NO: 2598521 - RNA, 19 nt, Escherichia coli CFT073
cagauucagcgcacuuuca

SEQ ID NO: 2598522 - RNA, 22 nt, Escherichia coli CFT073
cagauucagcgucgccagcagc

SEQ ID NO: 2598523 - RNA, 17 nt, Escherichia coli CFT073
cagauucggauccagca

SEQ ID NO: 2598524 - RNA, 23 nt, Escherichia coli CFT073
cagauucucauauaucccuucca

SEQ ID NO: 2598525 - RNA, 14 nt, Escherichia coli CFT073
cagauucuccaccu

SEQ ID NO: 2598526 - RNA, 16 nt, Escherichia coli CFT073
cagauugaagauagag

SEQ ID NO: 2598527 - RNA, 23 nt, Escherichia coli CFT073
cagauugaugcgaguaaucaggc

SEQ ID NO: 2598528 - RNA, 21 nt, Escherichia coli CFT073
cagauugauguuaccaacacu

SEQ ID NO: 2598529 - RNA, 14 nt, Escherichia coli CFT073
cagauugcugacaa

SEQ ID NO: 2598530 - RNA, 13 nt, Escherichia coli CFT073
cagauugcugcug

SEQ ID NO: 2598531 - RNA, 20 nt, Escherichia coli CFT073
cagauugugugacacuucuu

SEQ ID NO: 2598532 - RNA, 17 nt, Escherichia coli CFT073
cagcaccgggccaaaaa

SEQ ID NO: 2598533 - RNA, 22 nt, Escherichia coli CFT073
cagcaccgucgcaccgguaucu

SEQ ID NO: 2598534 - RNA, 18 nt, Escherichia coli CFT073
cagcaccgucuggcagau

SEQ ID NO: 2598535 - RNA, 17 nt, Escherichia coli CFT073
cagcaccugcaucacgc

SEQ ID NO: 2598536 - RNA, 19 nt, Escherichia coli CFT073
cagcaccuuaugcgggcca

SEQ ID NO: 2598537 - RNA, 22 nt, Escherichia coli CFT073
cagcacgaucccuucgauaucc

SEQ ID NO: 2598538 - RNA, 15 nt, Escherichia coli CFT073
cagcacgcaggcauc

SEQ ID NO: 2598539 - RNA, 17 nt, Escherichia coli CFT073
cagcacgcaggcaucuu

SEQ ID NO: 2598540 - RNA, 18 nt, Escherichia coli CFT073
cagcacgcaggcaucuuu

SEQ ID NO: 2598541 - RNA, 21 nt, Escherichia coli CFT073
cagcacgcaggcaucuuuuuc

SEQ ID NO: 2598542 - RNA, 14 nt, Escherichia coli CFT073
cagcacgcagugag

SEQ ID NO: 2598543 - RNA, 20 nt, Escherichia coli CFT073
cagcacgcugaacacgguag

SEQ ID NO: 2598544 - RNA, 21 nt, Escherichia coli CFT073
cagcacgcuuuuaacacguug

SEQ ID NO: 2598545 - RNA, 14 nt, Escherichia coli CFT073
cagcacggagagac

SEQ ID NO: 2598546 - RNA, 23 nt, Escherichia coli CFT073
cagcacgguggcuggcgcggcgc

SEQ ID NO: 2598547 - RNA, 16 nt, Escherichia coli CFT073
cagcacguuuuauccg

SEQ ID NO: 2598548 - RNA, 17 nt, Escherichia coli CFT073
cagcacucacgccaggc

SEQ ID NO: 2598549 - RNA, 20 nt, Escherichia coli CFT073
cagcacucugugcgucugcu

SEQ ID NO: 2598550 - RNA, 23 nt, Escherichia coli CFT073
cagcacugauaaucccggcggcg

SEQ ID NO: 2598551 - RNA, 18 nt, Escherichia coli CFT073
cagcacugauuuuuucca

SEQ ID NO: 2598552 - RNA, 23 nt, Escherichia coli CFT073
cagcacugauuuuuuccaacagg

SEQ ID NO: 2598553 - RNA, 18 nt, Escherichia coli CFT073
cagcacuuaucucuuccg

SEQ ID NO: 2598554 - RNA, 23 nt, Escherichia coli CFT073
cagcacuucacccaucgccagau

SEQ ID NO: 2598555 - RNA, 15 nt, Escherichia coli CFT073
cagcacuucauagug

SEQ ID NO: 2598556 - RNA, 21 nt, Escherichia coli CFT073
cagcacuucauagugcgcggu

SEQ ID NO: 2598557 - RNA, 22 nt, Escherichia coli CFT073
cagcacuugagauaaaaacuca

SEQ ID NO: 2598558 - RNA, 14 nt, Escherichia coli CFT073
cagcacuuuucgca

SEQ ID NO: 2598559 - RNA, 19 nt, Escherichia coli CFT073
cagcacuuuucgcacugca

SEQ ID NO: 2598560 - RNA, 19 nt, Escherichia coli CFT073
cagcagaagggccuuuggc

SEQ ID NO: 2598561 - RNA, 21 nt, Escherichia coli CFT073
cagcagaaucauccaggcuuu

SEQ ID NO: 2598562 - RNA, 19 nt, Escherichia coli CFT073
cagcagaaugacaucaucg

SEQ ID NO: 2598563 - RNA, 12 nt, Escherichia coli CFT073
cagcagacacau

SEQ ID NO: 2598564 - RNA, 20 nt, Escherichia coli CFT073
cagcagacagccuaccagac

SEQ ID NO: 2598565 - RNA, 11 nt, Escherichia coli CFT073
cagcagaccag

SEQ ID NO: 2598566 - RNA, 17 nt, Escherichia coli CFT073
cagcagacgcugcaccu

SEQ ID NO: 2598567 - RNA, 15 nt, Escherichia coli CFT073
cagcagagcaaaaau

SEQ ID NO: 2598568 - RNA, 16 nt, Escherichia coli CFT073
cagcagagcaugguua

SEQ ID NO: 2598569 - RNA, 23 nt, Escherichia coli CFT073
cagcagauaucccgccagcacca

SEQ ID NO: 2598570 - RNA, 14 nt, Escherichia coli CFT073
cagcagauccaucg

SEQ ID NO: 2598571 - RNA, 19 nt, Escherichia coli CFT073
cagcagauccgguucgcca

SEQ ID NO: 2598572 - RNA, 15 nt, Escherichia coli CFT073
cagcagaucgaucuu

SEQ ID NO: 2598573 - RNA, 13 nt, Escherichia coli CFT073
cagcagauuaacc

SEQ ID NO: 2598574 - RNA, 17 nt, Escherichia coli CFT073
cagcagauuaaccgcuu

SEQ ID NO: 2598575 - RNA, 18 nt, Escherichia coli CFT073
cagcagauugcgaauaug

SEQ ID NO: 2598576 - RNA, 14 nt, Escherichia coli CFT073
cagcagcaaccauu

SEQ ID NO: 2598577 - RNA, 12 nt, Escherichia coli CFT073
cagcagcaauau

SEQ ID NO: 2598578 - RNA, 16 nt, Escherichia coli CFT073
cagcagcaauauguug

SEQ ID NO: 2598579 - RNA, 23 nt, Escherichia coli CFT073
cagcagcaauauguugauaauca

SEQ ID NO: 2598580 - RNA, 14 nt, Escherichia coli CFT073
cagcagcaccaccg

SEQ ID NO: 2598581 - RNA, 15 nt, Escherichia coli CFT073
cagcagcaccaccgc

SEQ ID NO: 2598582 - RNA, 12 nt, Escherichia coli CFT073
cagcagcacccg

SEQ ID NO: 2598583 - RNA, 16 nt, Escherichia coli CFT073
cagcagcagacagccu

SEQ ID NO: 2598584 - RNA, 11 nt, Escherichia coli CFT073
cagcagcagcg

SEQ ID NO: 2598585 - RNA, 14 nt, Escherichia coli CFT073
cagcagcagcgaau

SEQ ID NO: 2598586 - RNA, 21 nt, Escherichia coli CFT073
cagcagcagcgguugagagaa

SEQ ID NO: 2598587 - RNA, 18 nt, Escherichia coli CFT073
cagcagccacaccaauca

SEQ ID NO: 2598588 - RNA, 23 nt, Escherichia coli CFT073
cagcagccacaccaaucaacaau

SEQ ID NO: 2598589 - RNA, 12 nt, Escherichia coli CFT073
cagcagccagag

SEQ ID NO: 2598590 - RNA, 14 nt, Escherichia coli CFT073
cagcagcccgagca

SEQ ID NO: 2598591 - RNA, 23 nt, Escherichia coli CFT073
cagcagcccuugcuucgccaguu

SEQ ID NO: 2598592 - RNA, 19 nt, Escherichia coli CFT073
cagcagcgaaucagcccag

SEQ ID NO: 2598593 - RNA, 13 nt, Escherichia coli CFT073
cagcagcgccgcg

SEQ ID NO: 2598594 - RNA, 14 nt, Escherichia coli CFT073
cagcagcgccgcgc

SEQ ID NO: 2598595 - RNA, 16 nt, Escherichia coli CFT073
cagcagcggagaaaug

SEQ ID NO: 2598596 - RNA, 16 nt, Escherichia coli CFT073
cagcagcgucagcacu

SEQ ID NO: 2598597 - RNA, 17 nt, Escherichia coli CFT073
cagcagcucacgcagcu

SEQ ID NO: 2598598 - RNA, 20 nt, Escherichia coli CFT073
cagcagcugcucccagcgca

SEQ ID NO: 2598599 - RNA, 18 nt, Escherichia coli CFT073
cagcagcuugcgccgccc

SEQ ID NO: 2598600 - RNA, 21 nt, Escherichia coli CFT073
cagcagcuugcgccgcccgcc

SEQ ID NO: 2598601 - RNA, 17 nt, Escherichia coli CFT073
cagcaggaacgagaacu

SEQ ID NO: 2598602 - RNA, 19 nt, Escherichia coli CFT073
cagcaggaaucccaucaga

SEQ ID NO: 2598603 - RNA, 23 nt, Escherichia coli CFT073
cagcagggcaauacgcuccgccc

SEQ ID NO: 2598604 - RNA, 21 nt, Escherichia coli CFT073
cagcagggcaaucgcgccaac

SEQ ID NO: 2598605 - RNA, 18 nt, Escherichia coli CFT073
cagcaggguuucaucggu

SEQ ID NO: 2598606 - RNA, 16 nt, Escherichia coli CFT073
cagcaggugcgccagc

SEQ ID NO: 2598607 - RNA, 21 nt, Escherichia coli CFT073
cagcaggugcgccagcgauug

SEQ ID NO: 2598608 - RNA, 17 nt, Escherichia coli CFT073
cagcagguguaguucac

SEQ ID NO: 2598609 - RNA, 19 nt, Escherichia coli CFT073
cagcagguuuugacgaguc

SEQ ID NO: 2598610 - RNA, 16 nt, Escherichia coli CFT073
cagcaguaaaccaccc

SEQ ID NO: 2598611 - RNA, 18 nt, Escherichia coli CFT073
cagcaguaaaccacccac

SEQ ID NO: 2598612 - RNA, 14 nt, Escherichia coli CFT073
cagcaguacgccau

SEQ ID NO: 2598613 - RNA, 21 nt, Escherichia coli CFT073
cagcaguacgccgagaauaaa

SEQ ID NO: 2598614 - RNA, 20 nt, Escherichia coli CFT073
cagcagugacaaucuccuuc

SEQ ID NO: 2598615 - RNA, 19 nt, Escherichia coli CFT073
cagcagugccaucccaggg

SEQ ID NO: 2598616 - RNA, 12 nt, Escherichia coli CFT073
cagcagugucca

SEQ ID NO: 2598617 - RNA, 19 nt, Escherichia coli CFT073
cagcaguguuuccggcauu

SEQ ID NO: 2598618 - RNA, 15 nt, Escherichia coli CFT073
cagcaguucagucag

SEQ ID NO: 2598619 - RNA, 14 nt, Escherichia coli CFT073
cagcaguucugcca

SEQ ID NO: 2598620 - RNA, 22 nt, Escherichia coli CFT073
cagcaguuuuuccccugccaga

SEQ ID NO: 2598621 - RNA, 23 nt, Escherichia coli CFT073
cagcaguuuuuccccugccagau

SEQ ID NO: 2598622 - RNA, 23 nt, Escherichia coli CFT073
  misc_feature (6)..(6): n is a, c, g or u
cagcanuaucgucuggcgcguga

SEQ ID NO: 2598623 - RNA, 18 nt, Escherichia coli CFT073
cagcauaaauuucucgcc

SEQ ID NO: 2598624 - RNA, 16 nt, Escherichia coli CFT073
cagcauaaucaccauc

SEQ ID NO: 2598625 - RNA, 19 nt, Escherichia coli CFT073
cagcauaaucaccaucagc

SEQ ID NO: 2598626 - RNA, 22 nt, Escherichia coli CFT073
cagcauaaucaccaucagcagc

SEQ ID NO: 2598627 - RNA, 21 nt, Escherichia coli CFT073
cagcauaauugccguuuccug

SEQ ID NO: 2598628 - RNA, 15 nt, Escherichia coli CFT073
cagcauaccuucaca

SEQ ID NO: 2598629 - RNA, 18 nt, Escherichia coli CFT073
cagcauaccuucacaaaa

SEQ ID NO: 2598630 - RNA, 15 nt, Escherichia coli CFT073
cagcauaccuuccag

SEQ ID NO: 2598631 - RNA, 16 nt, Escherichia coli CFT073
cagcauaccuuccagc

SEQ ID NO: 2598632 - RNA, 12 nt, Escherichia coli CFT073
cagcauacgcca

SEQ ID NO: 2598633 - RNA, 14 nt, Escherichia coli CFT073
cagcauacgccaca

SEQ ID NO: 2598634 - RNA, 19 nt, Escherichia coli CFT073
cagcauaugcacacgcagc

SEQ ID NO: 2598635 - RNA, 10 nt, Escherichia coli CFT073
cagcaucaau

SEQ ID NO: 2598636 - RNA, 12 nt, Escherichia coli CFT073
cagcaucaccac

SEQ ID NO: 2598637 - RNA, 15 nt, Escherichia coli CFT073
cagcaucacgcccgc

SEQ ID NO: 2598638 - RNA, 17 nt, Escherichia coli CFT073
cagcaucagaguaugua

SEQ ID NO: 2598639 - RNA, 21 nt, Escherichia coli CFT073
cagcaucagcaaauagauaaa

SEQ ID NO: 2598640 - RNA, 17 nt, Escherichia coli CFT073
cagccauuccugcaccu

SEQ ID NO: 2598641 - RNA, 15 nt, Escherichia coli CFT073
cagcccagaucagac

SEQ ID NO: 2598642 - RNA, 12 nt, Escherichia coli CFT073
cagcccaggaag

SEQ ID NO: 2598643 - RNA, 14 nt, Escherichia coli CFT073
cagcccaggaagcc

SEQ ID NO: 2598644 - RNA, 22 nt, Escherichia coli CFT073
cagccccagacguuucgccagc

SEQ ID NO: 2598645 - RNA, 14 nt, Escherichia coli CFT073
cagccccaguuccu

SEQ ID NO: 2598646 - RNA, 14 nt, Escherichia coli CFT073
cagccccaucagcg

SEQ ID NO: 2598647 - RNA, 17 nt, Escherichia coli CFT073
cagccccaucagcgcca

SEQ ID NO: 2598648 - RNA, 18 nt, Escherichia coli CFT073
cagccccaucagcgccau

SEQ ID NO: 2598649 - RNA, 18 nt, Escherichia coli CFT073
cagccccauugguugccg

SEQ ID NO: 2598650 - RNA, 23 nt, Escherichia coli CFT073
cagccccggcaaaugacgaugca

SEQ ID NO: 2598651 - RNA, 13 nt, Escherichia coli CFT073
cagccccucagcg

SEQ ID NO: 2598652 - RNA, 15 nt, Escherichia coli CFT073
cagccccucagcggu

SEQ ID NO: 2598653 - RNA, 12 nt, Escherichia coli CFT073
cagccccuccgg

SEQ ID NO: 2598654 - RNA, 19 nt, Escherichia coli CFT073
cagccccugugccagcucg

SEQ ID NO: 2598655 - RNA, 19 nt, Escherichia coli CFT073
cagcccgccaaugccgcgc

SEQ ID NO: 2598656 - RNA, 14 nt, Escherichia coli CFT073
cagcccgccgagaa

SEQ ID NO: 2598657 - RNA, 21 nt, Escherichia coli CFT073
cagcccggcaagugucgccug

SEQ ID NO: 2598658 - RNA, 22 nt, Escherichia coli CFT073
cagcccggcaagugucgccugc

SEQ ID NO: 2598659 - RNA, 22 nt, Escherichia coli CFT073
cagcccggguuugccgcuggca

SEQ ID NO: 2598660 - RNA, 19 nt, Escherichia coli CFT073
cagcccuaaaaacaguacc

SEQ ID NO: 2598661 - RNA, 14 nt, Escherichia coli CFT073
cagcccuaucaucg

SEQ ID NO: 2598662 - RNA, 22 nt, Escherichia coli CFT073
cagcccuaucaucgcggcacac

SEQ ID NO: 2598663 - RNA, 17 nt, Escherichia coli CFT073
cagcccuucccggugcg

SEQ ID NO: 2598664 - RNA, 14 nt, Escherichia coli CFT073
cagcccuucuuuca

SEQ ID NO: 2598665 - RNA, 19 nt, Escherichia coli CFT073
cagcccuucuuucacuuca

SEQ ID NO: 2598666 - RNA, 17 nt, Escherichia coli CFT073
cagccgacaauaccaca

SEQ ID NO: 2598667 - RNA, 19 nt, Escherichia coli CFT073
cagccgacaauaccacaaa

SEQ ID NO: 2598668 - RNA, 17 nt, Escherichia coli CFT073
cagccgauaucuuuccg

SEQ ID NO: 2598669 - RNA, 19 nt, Escherichia coli CFT073
cagccgauaucuuuccggc

SEQ ID NO: 2598670 - RNA, 13 nt, Escherichia coli CFT073
cagccgaucagcg

SEQ ID NO: 2598671 - RNA, 17 nt, Escherichia coli CFT073
cagccgcaaacgacacu

SEQ ID NO: 2598672 - RNA, 17 nt, Escherichia coli CFT073
cagccgccaacuccacc

SEQ ID NO: 2598673 - RNA, 19 nt, Escherichia coli CFT073
cagccgccaucgcugacga

SEQ ID NO: 2598674 - RNA, 22 nt, Escherichia coli CFT073
cagccgcccagcgaaccgccaa

SEQ ID NO: 2598675 - RNA, 18 nt, Escherichia coli CFT073
cagccgccgcuccucauc

SEQ ID NO: 2598676 - RNA, 20 nt, Escherichia coli CFT073
cagccgccucgccucacgaa

SEQ ID NO: 2598677 - RNA, 21 nt, Escherichia coli CFT073
cagccgccugggcaagcaccu

SEQ ID NO: 2598678 - RNA, 21 nt, Escherichia coli CFT073
cagccgcgauuuuugcucccg

SEQ ID NO: 2598679 - RNA, 13 nt, Escherichia coli CFT073
cagccgcgucuga

SEQ ID NO: 2598680 - RNA, 19 nt, Escherichia coli CFT073
cagccgcgucugaauauca

SEQ ID NO: 2598681 - RNA, 22 nt, Escherichia coli CFT073
cagccgcuaacuuccugcuggc

SEQ ID NO: 2598682 - RNA, 23 nt, Escherichia coli CFT073
cagccggagcuucacccgcagca

SEQ ID NO: 2598683 - RNA, 13 nt, Escherichia coli CFT073
cagccggcaaagu

SEQ ID NO: 2598684 - RNA, 22 nt, Escherichia coli CFT073
cagccggggaucagguacugca

SEQ ID NO: 2598685 - RNA, 23 nt, Escherichia coli CFT073
cagccgucgccaguaccagcagc

SEQ ID NO: 2598686 - RNA, 17 nt, Escherichia coli CFT073
cagccguuuaauugccu

SEQ ID NO: 2598687 - RNA, 18 nt, Escherichia coli CFT073
cagccguuuaauugccuc

SEQ ID NO: 2598688 - RNA, 15 nt, Escherichia coli CFT073
cagccguuucaccac

SEQ ID NO: 2598689 - RNA, 19 nt, Escherichia coli CFT073
cagccguuuguucugcauc

SEQ ID NO: 2598690 - RNA, 20 nt, Escherichia coli CFT073
cagccucaagcacccgccgc

SEQ ID NO: 2598691 - RNA, 19 nt, Escherichia coli CFT073
cagccuccaacccacaaaa

SEQ ID NO: 2598692 - RNA, 14 nt, Escherichia coli CFT073
cagccucugucuuc

SEQ ID NO: 2598693 - RNA, 15 nt, Escherichia coli CFT073
cagccucuuccagag

SEQ ID NO: 2598694 - RNA, 23 nt, Escherichia coli CFT073
cagccugauaacgaauugcugcg

SEQ ID NO: 2598695 - RNA, 17 nt, Escherichia coli CFT073
cagccugcaaacgcuuu

SEQ ID NO: 2598696 - RNA, 17 nt, Escherichia coli CFT073
cagccuuaacaagauau

SEQ ID NO: 2598697 - RNA, 15 nt, Escherichia coli CFT073
cagccuuaccggaga

SEQ ID NO: 2598698 - RNA, 17 nt, Escherichia coli CFT073
cagccuucgccaccgug

SEQ ID NO: 2598699 - RNA, 21 nt, Escherichia coli CFT073
cagccuucuguaaccuuuucc

SEQ ID NO: 2598700 - RNA, 19 nt, Escherichia coli CFT073
cagccuugaggccauccgc

SEQ ID NO: 2598701 - RNA, 22 nt, Escherichia coli CFT073
cagccuugugccucaacccauu

SEQ ID NO: 2598702 - RNA, 16 nt, Escherichia coli CFT073
cagccuuucacaucag

SEQ ID NO: 2598703 - RNA, 14 nt, Escherichia coli CFT073
cagccuuuccagca

SEQ ID NO: 2598704 - RNA, 21 nt, Escherichia coli CFT073
cagccuuuucauccuccccca

SEQ ID NO: 2598705 - RNA, 15 nt, Escherichia coli CFT073
cagccuuuuucucug

SEQ ID NO: 2598706 - RNA, 14 nt, Escherichia coli CFT073
cagcgaaaucacgc

SEQ ID NO: 2598707 - RNA, 17 nt, Escherichia coli CFT073
cagcgaaccguucauuu

SEQ ID NO: 2598708 - RNA, 19 nt, Escherichia coli CFT073
cagcgaacgacauccgcca

SEQ ID NO: 2598709 - RNA, 20 nt, Escherichia coli CFT073
cagcgaagcccacaccgccc

SEQ ID NO: 2598710 - RNA, 22 nt, Escherichia coli CFT073
cagcgaagcccacaccgcccag

SEQ ID NO: 2598711 - RNA, 16 nt, Escherichia coli CFT073
cagcgaagcgcaucag

SEQ ID NO: 2598712 - RNA, 23 nt, Escherichia coli CFT073
cagcgaagguaacaccaguuucc

SEQ ID NO: 2598713 - RNA, 13 nt, Escherichia coli CFT073
cagcgaagucaca

SEQ ID NO: 2598714 - RNA, 20 nt, Escherichia coli CFT073
cagcgaagucacaaaauucg

SEQ ID NO: 2598715 - RNA, 15 nt, Escherichia coli CFT073
cagcgaaucagccca

SEQ ID NO: 2598716 - RNA, 16 nt, Escherichia coli CFT073
cagcgaaucagcccag

SEQ ID NO: 2598717 - RNA, 16 nt, Escherichia coli CFT073
cagcgaauggguugua

SEQ ID NO: 2598718 - RNA, 14 nt, Escherichia coli CFT073
cagcgacaccagcc

SEQ ID NO: 2598719 - RNA, 18 nt, Escherichia coli CFT073
cagcgacagauucagcgc

SEQ ID NO: 2598720 - RNA, 22 nt, Escherichia coli CFT073
cagcgacauacucagcgccugc

SEQ ID NO: 2598721 - RNA, 23 nt, Escherichia coli CFT073
cagcgacauacucagcgccugcu

SEQ ID NO: 2598722 - RNA, 20 nt, Escherichia coli CFT073
cagcgacgaccguuuuacgc

SEQ ID NO: 2598723 - RNA, 20 nt, Escherichia coli CFT073
cagcgacgacuggcgcggca

SEQ ID NO: 2598724 - RNA, 20 nt, Escherichia coli CFT073
cagcgagaaauacgcccuga

SEQ ID NO: 2598725 - RNA, 12 nt, Escherichia coli CFT073
cagcgagaaguc

SEQ ID NO: 2598726 - RNA, 20 nt, Escherichia coli CFT073
cagcgagaagucggcuuuua

SEQ ID NO: 2598727 - RNA, 22 nt, Escherichia coli CFT073
cagcgagcuggcgcugauaaau

SEQ ID NO: 2598728 - RNA, 17 nt, Escherichia coli CFT073
cagcgagcuggcggcaa

SEQ ID NO: 2598729 - RNA, 20 nt, Escherichia coli CFT073
cagcgagggcuaugcgcauc

SEQ ID NO: 2598730 - RNA, 23 nt, Escherichia coli CFT073
cagcgauagcuucugcguucucu

SEQ ID NO: 2598731 - RNA, 17 nt, Escherichia coli CFT073
cagcgauuaacugcgcg

SEQ ID NO: 2598732 - RNA, 20 nt, Escherichia coli CFT073
cagcgauuaacugcgcggua

SEQ ID NO: 2598733 - RNA, 19 nt, Escherichia coli CFT073
cagcgcaaacggcagcaug

SEQ ID NO: 2598734 - RNA, 12 nt, Escherichia coli CFT073
cagcgcaacuug

SEQ ID NO: 2598735 - RNA, 22 nt, Escherichia coli CFT073
cagcgcaacuugugcucgcguu

SEQ ID NO: 2598736 - RNA, 17 nt, Escherichia coli CFT073
cagcgcaaggcgcgaca

SEQ ID NO: 2598737 - RNA, 16 nt, Escherichia coli CFT073
cagcgcaauagccuga

SEQ ID NO: 2598738 - RNA, 18 nt, Escherichia coli CFT073
cagcgcaauagccugaug

SEQ ID NO: 2598739 - RNA, 13 nt, Escherichia coli CFT073
cagcgcaaucacc

SEQ ID NO: 2598740 - RNA, 15 nt, Escherichia coli CFT073
cagcgcaaucaccgg

SEQ ID NO: 2598741 - RNA, 22 nt, Escherichia coli CFT073
cagcgcaaucugcuucuuacca

SEQ ID NO: 2598742 - RNA, 14 nt, Escherichia coli CFT073
cagcgcaauucgcg

SEQ ID NO: 2598743 - RNA, 20 nt, Escherichia coli CFT073
cagcgcaccacacaucggca

SEQ ID NO: 2598744 - RNA, 14 nt, Escherichia coli CFT073
cagcgcaccagaaa

SEQ ID NO: 2598745 - RNA, 17 nt, Escherichia coli CFT073
cagcgcaccagcgucau

SEQ ID NO: 2598746 - RNA, 18 nt, Escherichia coli CFT073
cagcgcaccgugaccacc

SEQ ID NO: 2598747 - RNA, 13 nt, Escherichia coli CFT073
cagcgcacgggca

SEQ ID NO: 2598748 - RNA, 15 nt, Escherichia coli CFT073
cagcguaauagccug

SEQ ID NO: 2598749 - RNA, 16 nt, Escherichia coli CFT073
cagcguaauagccuga

SEQ ID NO: 2598750 - RNA, 18 nt, Escherichia coli CFT073
cagcguaauagccugaug

SEQ ID NO: 2598751 - RNA, 13 nt, Escherichia coli CFT073
cagcguaccauga

SEQ ID NO: 2598752 - RNA, 21 nt, Escherichia coli CFT073
cagcguaccaugauccugcaa

SEQ ID NO: 2598753 - RNA, 15 nt, Escherichia coli CFT073
cagcguaccugccgc

SEQ ID NO: 2598754 - RNA, 17 nt, Escherichia coli CFT073
cagcguaccugccgcgc

SEQ ID NO: 2598755 - RNA, 20 nt, Escherichia coli CFT073
cagcguaccugccgcgccuu

SEQ ID NO: 2598756 - RNA, 13 nt, Escherichia coli CFT073
cagcguacguuca

SEQ ID NO: 2598757 - RNA, 15 nt, Escherichia coli CFT073
cagcguauuccaccg

SEQ ID NO: 2598758 - RNA, 21 nt, Escherichia coli CFT073
cagcgucacaucaggccaucc

SEQ ID NO: 2598759 - RNA, 14 nt, Escherichia coli CFT073
cagcgucagaaaca

SEQ ID NO: 2598760 - RNA, 13 nt, Escherichia coli CFT073
cagcgucagcagc

SEQ ID NO: 2598761 - RNA, 16 nt, Escherichia coli CFT073
cagcgucaguucucug

SEQ ID NO: 2598762 - RNA, 19 nt, Escherichia coli CFT073
cagcgucaucaauccugca

SEQ ID NO: 2598763 - RNA, 18 nt, Escherichia coli CFT073
cagcgucaucggccacgc

SEQ ID NO: 2598764 - RNA, 16 nt, Escherichia coli CFT073
cagcguccagcccucc

SEQ ID NO: 2598765 - RNA, 15 nt, Escherichia coli CFT073
cagcgucgcaucagg

SEQ ID NO: 2598766 - RNA, 20 nt, Escherichia coli CFT073
cagcgucgcauccgacauuu

SEQ ID NO: 2598767 - RNA, 22 nt, Escherichia coli CFT073
cagcgucgccaauggaauagcg

SEQ ID NO: 2598768 - RNA, 14 nt, Escherichia coli CFT073
cagcgucgccagca

SEQ ID NO: 2598769 - RNA, 18 nt, Escherichia coli CFT073
cagcgucgcguuuuucuc

SEQ ID NO: 2598770 - RNA, 16 nt, Escherichia coli CFT073
cagcgucgguuccuga

SEQ ID NO: 2598771 - RNA, 19 nt, Escherichia coli CFT073
cagcgucguauccagcguu

SEQ ID NO: 2598772 - RNA, 21 nt, Escherichia coli CFT073
cagcgucuccagacaauccgc

SEQ ID NO: 2598773 - RNA, 17 nt, Escherichia coli CFT073
cagcgucugacuguuga

SEQ ID NO: 2598774 - RNA, 14 nt, Escherichia coli CFT073
cagcgucuguuuua

SEQ ID NO: 2598775 - RNA, 15 nt, Escherichia coli CFT073
cagcgugaacugggc

SEQ ID NO: 2598776 - RNA, 15 nt, Escherichia coli CFT073
cagcgugaagcuacc

SEQ ID NO: 2598777 - RNA, 17 nt, Escherichia coli CFT073
cagcgugccgaagaaca

SEQ ID NO: 2598778 - RNA, 19 nt, Escherichia coli CFT073
cagcgugccgcgaucccag

SEQ ID NO: 2598779 - RNA, 22 nt, Escherichia coli CFT073
cagcgugcugguggucagcagc

SEQ ID NO: 2598780 - RNA, 17 nt, Escherichia coli CFT073
cagcguggugacgagga

SEQ ID NO: 2598781 - RNA, 20 nt, Escherichia coli CFT073
cagcguggugcugauacgcg

SEQ ID NO: 2598782 - RNA, 17 nt, Escherichia coli CFT073
cagcgugguuuucucaa

SEQ ID NO: 2598783 - RNA, 22 nt, Escherichia coli CFT073
cagcguguuaaugcccaucagu

SEQ ID NO: 2598784 - RNA, 22 nt, Escherichia coli CFT073
cagcguguucgugacgauaucu

SEQ ID NO: 2598785 - RNA, 15 nt, Escherichia coli CFT073
cagcguguugaggaa

SEQ ID NO: 2598786 - RNA, 17 nt, Escherichia coli CFT073
cagcguguugaggaagc

SEQ ID NO: 2598787 - RNA, 18 nt, Escherichia coli CFT073
cagcguguugaggaagcg

SEQ ID NO: 2598788 - RNA, 17 nt, Escherichia coli CFT073
cagcguguugcggcgcu

SEQ ID NO: 2598789 - RNA, 11 nt, Escherichia coli CFT073
cagcguuaauu

SEQ ID NO: 2598790 - RNA, 18 nt, Escherichia coli CFT073
cagcguuaauuuccucuu

SEQ ID NO: 2598791 - RNA, 19 nt, Escherichia coli CFT073
cagcguuauaaaacacauu

SEQ ID NO: 2598792 - RNA, 16 nt, Escherichia coli CFT073
cagcguuauagcgcau

SEQ ID NO: 2598793 - RNA, 17 nt, Escherichia coli CFT073
cagcguucaaacaccag

SEQ ID NO: 2598794 - RNA, 15 nt, Escherichia coli CFT073
cagcguuccccagaa

SEQ ID NO: 2598795 - RNA, 18 nt, Escherichia coli CFT073
cagcguugcagagaguca

SEQ ID NO: 2598796 - RNA, 16 nt, Escherichia coli CFT073
cagcguuuccagcacc

SEQ ID NO: 2598797 - RNA, 16 nt, Escherichia coli CFT073
cagcguuucgccauaa

SEQ ID NO: 2598798 - RNA, 16 nt, Escherichia coli CFT073
cagcguuucgccgccc

SEQ ID NO: 2598799 - RNA, 21 nt, Escherichia coli CFT073
cagcguuugcagcuuacgcgc

SEQ ID NO: 2598800 - RNA, 23 nt, Escherichia coli CFT073
cagcguuugcagcuuacgcgcca

SEQ ID NO: 2598801 - RNA, 16 nt, Escherichia coli CFT073
cagcguuugcggcgcu

SEQ ID NO: 2598802 - RNA, 14 nt, Escherichia coli CFT073
cagcguuugcugaa

SEQ ID NO: 2598803 - RNA, 15 nt, Escherichia coli CFT073
cagcguuugcugaaa

SEQ ID NO: 2598804 - RNA, 13 nt, Escherichia coli CFT073
cagcuaacuccuu

SEQ ID NO: 2598805 - RNA, 19 nt, Escherichia coli CFT073
cagcuaaucaucaucagcg

SEQ ID NO: 2598806 - RNA, 14 nt, Escherichia coli CFT073
cagcuaaugccaac

SEQ ID NO: 2598807 - RNA, 15 nt, Escherichia coli CFT073
cagcuaaugccaacg

SEQ ID NO: 2598808 - RNA, 16 nt, Escherichia coli CFT073
cagcuaccguuucaac

SEQ ID NO: 2598809 - RNA, 19 nt, Escherichia coli CFT073
cagcuacgaaggugcauug

SEQ ID NO: 2598810 - RNA, 18 nt, Escherichia coli CFT073
cagcuacgcaucaugccg

SEQ ID NO: 2598811 - RNA, 23 nt, Escherichia coli CFT073
cagcuacgcaucaugccgcccag

SEQ ID NO: 2598812 - RNA, 12 nt, Escherichia coli CFT073
cagcuaucagcg

SEQ ID NO: 2598813 - RNA, 13 nt, Escherichia coli CFT073
cagcuaucagcga

SEQ ID NO: 2598814 - RNA, 16 nt, Escherichia coli CFT073
cagcuauccugccggu

SEQ ID NO: 2598815 - RNA, 20 nt, Escherichia coli CFT073
cagcucaaucaacuccauua

SEQ ID NO: 2598816 - RNA, 17 nt, Escherichia coli CFT073
cagcucaccucaccuuu

SEQ ID NO: 2598817 - RNA, 17 nt, Escherichia coli CFT073
cagcucacgcgccagcu

SEQ ID NO: 2598818 - RNA, 20 nt, Escherichia coli CFT073
cagcucacggccagucauuu

SEQ ID NO: 2598819 - RNA, 20 nt, Escherichia coli CFT073
cagcucacuucgauccagug

SEQ ID NO: 2598820 - RNA, 15 nt, Escherichia coli CFT073
cagcucauaggccug

SEQ ID NO: 2598821 - RNA, 17 nt, Escherichia coli CFT073
cagcucauauuccugca

SEQ ID NO: 2598822 - RNA, 18 nt, Escherichia coli CFT073
cagcucauauuccugcau

SEQ ID NO: 2598823 - RNA, 16 nt, Escherichia coli CFT073
cagcuccagaauuccg

SEQ ID NO: 2598824 - RNA, 22 nt, Escherichia coli CFT073
cagcuccagaguaacuucacca

SEQ ID NO: 2598825 - RNA, 13 nt, Escherichia coli CFT073
cagcuccagcagu

SEQ ID NO: 2598826 - RNA, 11 nt, Escherichia coli CFT073
cagcuccagcc

SEQ ID NO: 2598827 - RNA, 19 nt, Escherichia coli CFT073
cagcuccagcccgcgucgu

SEQ ID NO: 2598828 - RNA, 16 nt, Escherichia coli CFT073
cagcuccagcgcuucu

SEQ ID NO: 2598829 - RNA, 22 nt, Escherichia coli CFT073
cagcuccgccagcuccgggcug

SEQ ID NO: 2598830 - RNA, 13 nt, Escherichia coli CFT073
cagcuccggcagc

SEQ ID NO: 2598831 - RNA, 14 nt, Escherichia coli CFT073
cagcuccggcucua

SEQ ID NO: 2598832 - RNA, 20 nt, Escherichia coli CFT073
cagcuccgggcuaacacccg

SEQ ID NO: 2598833 - RNA, 17 nt, Escherichia coli CFT073
cagcuccguccagccac

SEQ ID NO: 2598834 - RNA, 20 nt, Escherichia coli CFT073
cagcuccguccagccaccgc

SEQ ID NO: 2598835 - RNA, 16 nt, Escherichia coli CFT073
cagcucgugcagaaca

SEQ ID NO: 2598836 - RNA, 17 nt, Escherichia coli CFT073
cagcucuaucugcacug

SEQ ID NO: 2598837 - RNA, 19 nt, Escherichia coli CFT073
cagcucuaucugcacugcu

SEQ ID NO: 2598838 - RNA, 22 nt, Escherichia coli CFT073
cagcucuaucugcacugcucau

SEQ ID NO: 2598839 - RNA, 23 nt, Escherichia coli CFT073
cagcucugcgcccugcaucacug

SEQ ID NO: 2598840 - RNA, 22 nt, Escherichia coli CFT073
cagcucugcugucaccgaagcg

SEQ ID NO: 2598841 - RNA, 18 nt, Escherichia coli CFT073
cagcucuguagcaacgau

SEQ ID NO: 2598842 - RNA, 21 nt, Escherichia coli CFT073
cagcucuguagcaacgauaac

SEQ ID NO: 2598843 - RNA, 21 nt, Escherichia coli CFT073
cagcucuuuauccagcagcca

SEQ ID NO: 2598844 - RNA, 19 nt, Escherichia coli CFT073
cagcucuuucucgcucagu

SEQ ID NO: 2598845 - RNA, 21 nt, Escherichia coli CFT073
cagcugaaaucaccgccacca

SEQ ID NO: 2598846 - RNA, 18 nt, Escherichia coli CFT073
cagcugaccgguugcugg

SEQ ID NO: 2598847 - RNA, 14 nt, Escherichia coli CFT073
cagcugcacgccac

SEQ ID NO: 2598848 - RNA, 16 nt, Escherichia coli CFT073
cagcugcacgccacga

SEQ ID NO: 2598849 - RNA, 15 nt, Escherichia coli CFT073
cagcugcaguaccag

SEQ ID NO: 2598850 - RNA, 15 nt, Escherichia coli CFT073
cagcugccugccagu

SEQ ID NO: 2598851 - RNA, 16 nt, Escherichia coli CFT073
cagcugcgcguuaucu

SEQ ID NO: 2598852 - RNA, 17 nt, Escherichia coli CFT073
cagcugcucauuacagu

SEQ ID NO: 2598853 - RNA, 17 nt, Escherichia coli CFT073
cagcugcucgcgauggc

SEQ ID NO: 2598854 - RNA, 14 nt, Escherichia coli CFT073
cagcuggcugucga

SEQ ID NO: 2598855 - RNA, 19 nt, Escherichia coli CFT073
cagcugguugaugcgcccu

SEQ ID NO: 2598856 - RNA, 20 nt, Escherichia coli CFT073
caggcaaauuauuaauuaaa

SEQ ID NO: 2598857 - RNA, 15 nt, Escherichia coli CFT073
caggcaacaaaaaac

SEQ ID NO: 2598858 - RNA, 20 nt, Escherichia coli CFT073
caggcaacagauaauaaaaa

SEQ ID NO: 2598859 - RNA, 17 nt, Escherichia coli CFT073
caggcaacccagaagaa

SEQ ID NO: 2598860 - RNA, 19 nt, Escherichia coli CFT073
caggcaacggugacuggcu

SEQ ID NO: 2598861 - RNA, 18 nt, Escherichia coli CFT073
caggcaacuucaagguca

SEQ ID NO: 2598862 - RNA, 19 nt, Escherichia coli CFT073
caggcaacuucaaggucaa

SEQ ID NO: 2598863 - RNA, 22 nt, Escherichia coli CFT073
caggcaagaauccgccccgcgu

SEQ ID NO: 2598864 - RNA, 22 nt, Escherichia coli CFT073
caggcaagccgcuaacagcagc

SEQ ID NO: 2598865 - RNA, 23 nt, Escherichia coli CFT073
caggcaagccuugcagccagaac

SEQ ID NO: 2598866 - RNA, 18 nt, Escherichia coli CFT073
caggcaaguagcgccaga

SEQ ID NO: 2598867 - RNA, 22 nt, Escherichia coli CFT073
caggcaaguagcgccagacuga

SEQ ID NO: 2598868 - RNA, 20 nt, Escherichia coli CFT073
caggcaaucaguaaucgcgc

SEQ ID NO: 2598869 - RNA, 15 nt, Escherichia coli CFT073
caggcacaccgccgc

SEQ ID NO: 2598870 - RNA, 16 nt, Escherichia coli CFT073
caggcacacugccagu

SEQ ID NO: 2598871 - RNA, 15 nt, Escherichia coli CFT073
caggcaccagccccu

SEQ ID NO: 2598872 - RNA, 17 nt, Escherichia coli CFT073
caggcacuucuuccgcc

SEQ ID NO: 2598873 - RNA, 21 nt, Escherichia coli CFT073
caggcacuucuuccgccagca

SEQ ID NO: 2598874 - RNA, 22 nt, Escherichia coli CFT073
caggcacuucuuccgccagcau

SEQ ID NO: 2598875 - RNA, 21 nt, Escherichia coli CFT073
caggcacuugguuugcuggua

SEQ ID NO: 2598876 - RNA, 17 nt, Escherichia coli CFT073
caggcacuugucaccaa

SEQ ID NO: 2598877 - RNA, 17 nt, Escherichia coli CFT073
caggcagacgaugaugc

SEQ ID NO: 2598878 - RNA, 18 nt, Escherichia coli CFT073
caggcagauccaguuacc

SEQ ID NO: 2598879 - RNA, 14 nt, Escherichia coli CFT073
caggcagcaaucac

SEQ ID NO: 2598880 - RNA, 16 nt, Escherichia coli CFT073
caggcagcacugcuua

SEQ ID NO: 2598881 - RNA, 11 nt, Escherichia coli CFT073
caggcagugaa

SEQ ID NO: 2598882 - RNA, 18 nt, Escherichia coli CFT073
caggcagugaauuucuac

SEQ ID NO: 2598883 - RNA, 14 nt, Escherichia coli CFT073
caggcaguggaaua

SEQ ID NO: 2598884 - RNA, 22 nt, Escherichia coli CFT073
caggcaguucgcggauaucuuu

SEQ ID NO: 2598885 - RNA, 18 nt, Escherichia coli CFT073
caggcaguuuauccagcc

SEQ ID NO: 2598886 - RNA, 14 nt, Escherichia coli CFT073
caggcaucacuuua

SEQ ID NO: 2598887 - RNA, 16 nt, Escherichia coli CFT073
caggcaucagauuguu

SEQ ID NO: 2598888 - RNA, 13 nt, Escherichia coli CFT073
caggcaucgugca

SEQ ID NO: 2598889 - RNA, 15 nt, Escherichia coli CFT073
caggcaucuuuuuca

SEQ ID NO: 2598890 - RNA, 18 nt, Escherichia coli CFT073
caggcaugauacgccaau

SEQ ID NO: 2598891 - RNA, 13 nt, Escherichia coli CFT073
caggcaugcaaua

SEQ ID NO: 2598892 - RNA, 14 nt, Escherichia coli CFT073
caggcaugcaauau

SEQ ID NO: 2598893 - RNA, 21 nt, Escherichia coli CFT073
caggcauuguguagggcagcg

SEQ ID NO: 2598894 - RNA, 19 nt, Escherichia coli CFT073
caggcauuuaucgccugau

SEQ ID NO: 2598895 - RNA, 23 nt, Escherichia coli CFT073
caggccaaaagcuaacagcgccg

SEQ ID NO: 2598896 - RNA, 20 nt, Escherichia coli CFT073
caggccaacauccaucagcg

SEQ ID NO: 2598897 - RNA, 13 nt, Escherichia coli CFT073
caggccaacggcc

SEQ ID NO: 2598898 - RNA, 22 nt, Escherichia coli CFT073
caggccaguuuuggcauaaccg

SEQ ID NO: 2598899 - RNA, 19 nt, Escherichia coli CFT073
caggccccgucagcaaaau

SEQ ID NO: 2598900 - RNA, 14 nt, Escherichia coli CFT073
caggcccgucacgc

SEQ ID NO: 2598901 - RNA, 20 nt, Escherichia coli CFT073
caggccgauagacacugccg

SEQ ID NO: 2598902 - RNA, 19 nt, Escherichia coli CFT073
caggccgaugccugcuuau

SEQ ID NO: 2598903 - RNA, 13 nt, Escherichia coli CFT073
caggccgcgcagu

SEQ ID NO: 2598904 - RNA, 17 nt, Escherichia coli CFT073
caggccggaguuaaucu

SEQ ID NO: 2598905 - RNA, 11 nt, Escherichia coli CFT073
caggccggaug

SEQ ID NO: 2598906 - RNA, 22 nt, Escherichia coli CFT073
caggccggaugagacgcggcac

SEQ ID NO: 2598907 - RNA, 13 nt, Escherichia coli CFT073
caggccggucauc

SEQ ID NO: 2598908 - RNA, 16 nt, Escherichia coli CFT073
caggccgucgcguagc

SEQ ID NO: 2598909 - RNA, 22 nt, Escherichia coli CFT073
caggccgucgcguagcaccacg

SEQ ID NO: 2598910 - RNA, 14 nt, Escherichia coli CFT073
caggccguggauca

SEQ ID NO: 2598911 - RNA, 16 nt, Escherichia coli CFT073
caggccuaacacaugc

SEQ ID NO: 2598912 - RNA, 18 nt, Escherichia coli CFT073
caggccuaacaccaucag

SEQ ID NO: 2598913 - RNA, 15 nt, Escherichia coli CFT073
caggccuacaauccc

SEQ ID NO: 2598914 - RNA, 14 nt, Escherichia coli CFT073
caggccuccgguga

SEQ ID NO: 2598915 - RNA, 22 nt, Escherichia coli CFT073
caggccugauuaagaucgugca

SEQ ID NO: 2598916 - RNA, 16 nt, Escherichia coli CFT073
caggcgaagacaaaac

SEQ ID NO: 2598917 - RNA, 14 nt, Escherichia coli CFT073
caggcgagcugcca

SEQ ID NO: 2598918 - RNA, 16 nt, Escherichia coli CFT073
caggcgagcugccagu

SEQ ID NO: 2598919 - RNA, 15 nt, Escherichia coli CFT073
caggcgaucuucccg

SEQ ID NO: 2598920 - RNA, 13 nt, Escherichia coli CFT073
caggcgcgccugg

SEQ ID NO: 2598921 - RNA, 21 nt, Escherichia coli CFT073
caggcgcgugaaugccugagg

SEQ ID NO: 2598922 - RNA, 15 nt, Escherichia coli CFT073
caggcgcugcuggag

SEQ ID NO: 2598923 - RNA, 21 nt, Escherichia coli CFT073
caggcgcuuaucgucccaggc

SEQ ID NO: 2598924 - RNA, 16 nt, Escherichia coli CFT073
caggcggcuaugcugg

SEQ ID NO: 2598925 - RNA, 16 nt, Escherichia coli CFT073
caggcggcuucgcauc

SEQ ID NO: 2598926 - RNA, 14 nt, Escherichia coli CFT073
caggcgucgcauca

SEQ ID NO: 2598927 - RNA, 15 nt, Escherichia coli CFT073
caggcgucgcaucag

SEQ ID NO: 2598928 - RNA, 20 nt, Escherichia coli CFT073
caggcguggauacaggcggg

SEQ ID NO: 2598929 - RNA, 18 nt, Escherichia coli CFT073
caggcuaaccaguaaaaa

SEQ ID NO: 2598930 - RNA, 17 nt, Escherichia coli CFT073
caggcuaccgcagugaa

SEQ ID NO: 2598931 - RNA, 21 nt, Escherichia coli CFT073
caggcuacgccagauccgcca

SEQ ID NO: 2598932 - RNA, 13 nt, Escherichia coli CFT073
caggcuacuccca

SEQ ID NO: 2598933 - RNA, 16 nt, Escherichia coli CFT073
caggcuacucccagua

SEQ ID NO: 2598934 - RNA, 17 nt, Escherichia coli CFT073
caggcuacucccaguag

SEQ ID NO: 2598935 - RNA, 17 nt, Escherichia coli CFT073
caggcuagaugugccaa

SEQ ID NO: 2598936 - RNA, 14 nt, Escherichia coli CFT073
caggcuaucggcca

SEQ ID NO: 2598937 - RNA, 15 nt, Escherichia coli CFT073
caggcucauaccuuc

SEQ ID NO: 2598938 - RNA, 14 nt, Escherichia coli CFT073
caggcucauuaauu

SEQ ID NO: 2598939 - RNA, 22 nt, Escherichia coli CFT073
caggcugaggcguuucaacucc

SEQ ID NO: 2598940 - RNA, 12 nt, Escherichia coli CFT073
caggcugcguag

SEQ ID NO: 2598941 - RNA, 23 nt, Escherichia coli CFT073
caggcugcguaguuuguccugca

SEQ ID NO: 2598942 - RNA, 20 nt, Escherichia coli CFT073
caggcuggagcguugcgcca

SEQ ID NO: 2598943 - RNA, 22 nt, Escherichia coli CFT073
caggcuggcgucacgccgacca

SEQ ID NO: 2598944 - RNA, 14 nt, Escherichia coli CFT073
caggcuggcugacc

SEQ ID NO: 2598945 - RNA, 20 nt, Escherichia coli CFT073
caggcugggcacucuuggca

SEQ ID NO: 2598946 - RNA, 20 nt, Escherichia coli CFT073
caggcuguuguucagugcau

SEQ ID NO: 2598947 - RNA, 19 nt, Escherichia coli CFT073
caggcuuacacuuccuuua

SEQ ID NO: 2598948 - RNA, 20 nt, Escherichia coli CFT073
caggcuuacguuacccagca

SEQ ID NO: 2598949 - RNA, 13 nt, Escherichia coli CFT073
caggcuucaacac

SEQ ID NO: 2598950 - RNA, 13 nt, Escherichia coli CFT073
caggcuuccuggc

SEQ ID NO: 2598951 - RNA, 20 nt, Escherichia coli CFT073
caggcuuuauucugacgcca

SEQ ID NO: 2598952 - RNA, 21 nt, Escherichia coli CFT073
caggcuuuauucugacgccac

SEQ ID NO: 2598953 - RNA, 23 nt, Escherichia coli CFT073
caggcuuuauucugacgccacca

SEQ ID NO: 2598954 - RNA, 23 nt, Escherichia coli CFT073
caggcuuuccgucagcggcagcu

SEQ ID NO: 2598955 - RNA, 18 nt, Escherichia coli CFT073
cagggaaaaaagccccgc

SEQ ID NO: 2598956 - RNA, 23 nt, Escherichia coli CFT073
cagggaaaaaagccccgcagcca

SEQ ID NO: 2598957 - RNA, 19 nt, Escherichia coli CFT073
cagggaaacagccacccau

SEQ ID NO: 2598958 - RNA, 18 nt, Escherichia coli CFT073
cagggaaagaaacgccau

SEQ ID NO: 2598959 - RNA, 21 nt, Escherichia coli CFT073
cagggaaaggauggcgaugcu

SEQ ID NO: 2598960 - RNA, 20 nt, Escherichia coli CFT073
cagggacgcgcaaaauggcc

SEQ ID NO: 2598961 - RNA, 19 nt, Escherichia coli CFT073
cagggacguaccaaugacc

SEQ ID NO: 2598962 - RNA, 16 nt, Escherichia coli CFT073
cagggauaaagcuuuu

SEQ ID NO: 2598963 - RNA, 18 nt, Escherichia coli CFT073
cagggaucaacauucaga

SEQ ID NO: 2598964 - RNA, 15 nt, Escherichia coli CFT073
caguaaagcagcgaa

SEQ ID NO: 2598965 - RNA, 17 nt, Escherichia coli CFT073
caguaaagcgcaaaaua

SEQ ID NO: 2598966 - RNA, 22 nt, Escherichia coli CFT073
caguaaaguaucaaacagaaaa

SEQ ID NO: 2598967 - RNA, 15 nt, Escherichia coli CFT073
caguaaauaaaaaau

SEQ ID NO: 2598968 - RNA, 17 nt, Escherichia coli CFT073
caguaaauccgccacuu

SEQ ID NO: 2598969 - RNA, 19 nt, Escherichia coli CFT073
caguaaauggugauaucac

SEQ ID NO: 2598970 - RNA, 18 nt, Escherichia coli CFT073
caguaaccagaaaccgug

SEQ ID NO: 2598971 - RNA, 12 nt, Escherichia coli CFT073
caguaacccagc

SEQ ID NO: 2598972 - RNA, 15 nt, Escherichia coli CFT073
caguaacgcucccug

SEQ ID NO: 2598973 - RNA, 14 nt, Escherichia coli CFT073
caguaacucauugc

SEQ ID NO: 2598974 - RNA, 17 nt, Escherichia coli CFT073
caguaacugcuguaguc

SEQ ID NO: 2598975 - RNA, 18 nt, Escherichia coli CFT073
caguaacuuacuuagugc

SEQ ID NO: 2598976 - RNA, 18 nt, Escherichia coli CFT073
caguaagcaguccagcgc

SEQ ID NO: 2598977 - RNA, 19 nt, Escherichia coli CFT073
caguaagcaguccagcgcc

SEQ ID NO: 2598978 - RNA, 18 nt, Escherichia coli CFT073
caguaaggccugguucau

SEQ ID NO: 2598979 - RNA, 20 nt, Escherichia coli CFT073
caguaaggccugguucaucg

SEQ ID NO: 2598980 - RNA, 13 nt, Escherichia coli CFT073
caguaagguuugu

SEQ ID NO: 2598981 - RNA, 13 nt, Escherichia coli CFT073
caguaauaaagac

SEQ ID NO: 2598982 - RNA, 18 nt, Escherichia coli CFT073
caguaauaccgaacgcag

SEQ ID NO: 2598983 - RNA, 10 nt, Escherichia coli CFT073
caguaaucag

SEQ ID NO: 2598984 - RNA, 15 nt, Escherichia coli CFT073
caguaauccaccguu

SEQ ID NO: 2598985 - RNA, 13 nt, Escherichia coli CFT073
caguaauccagca

SEQ ID NO: 2598986 - RNA, 16 nt, Escherichia coli CFT073
caguaaucgcgccagc

SEQ ID NO: 2598987 - RNA, 17 nt, Escherichia coli CFT073
caguaaucgcgccagcc

SEQ ID NO: 2598988 - RNA, 18 nt, Escherichia coli CFT073
caguaaucggcugaacgu

SEQ ID NO: 2598989 - RNA, 13 nt, Escherichia coli CFT073
caguaauuuccug

SEQ ID NO: 2598990 - RNA, 12 nt, Escherichia coli CFT073
caguacacgcug

SEQ ID NO: 2598991 - RNA, 15 nt, Escherichia coli CFT073
caguacagccgccag

SEQ ID NO: 2598992 - RNA, 17 nt, Escherichia coli CFT073
caguacagccgccagac

SEQ ID NO: 2598993 - RNA, 14 nt, Escherichia coli CFT073
caguaccagcaacg

SEQ ID NO: 2598994 - RNA, 16 nt, Escherichia coli CFT073
caguaccagcaacgcu

SEQ ID NO: 2598995 - RNA, 14 nt, Escherichia coli CFT073
caguaccagcaccu

SEQ ID NO: 2598996 - RNA, 16 nt, Escherichia coli CFT073
caguaccagcaccuga

SEQ ID NO: 2598997 - RNA, 13 nt, Escherichia coli CFT073
caguaccagcagc

SEQ ID NO: 2598998 - RNA, 14 nt, Escherichia coli CFT073
caguaccagcagcg

SEQ ID NO: 2598999 - RNA, 16 nt, Escherichia coli CFT073
caguaccagcccgccg

SEQ ID NO: 2599000 - RNA, 17 nt, Escherichia coli CFT073
caguaccaggcaauaaa

SEQ ID NO: 2599001 - RNA, 17 nt, Escherichia coli CFT073
caguacccaaucagcga

SEQ ID NO: 2599002 - RNA, 22 nt, Escherichia coli CFT073
caguaccgauugcccauacagg

SEQ ID NO: 2599003 - RNA, 19 nt, Escherichia coli CFT073
caguaccgccaccaccaga

SEQ ID NO: 2599004 - RNA, 20 nt, Escherichia coli CFT073
caguaccgccaccaccagac

SEQ ID NO: 2599005 - RNA, 12 nt, Escherichia coli CFT073
caguaccgccag

SEQ ID NO: 2599006 - RNA, 22 nt, Escherichia coli CFT073
caguaccgccgccauaaacagc

SEQ ID NO: 2599007 - RNA, 16 nt, Escherichia coli CFT073
caguaccgcgucgauc

SEQ ID NO: 2599008 - RNA, 18 nt, Escherichia coli CFT073
caguaccguagaggugau

SEQ ID NO: 2599009 - RNA, 20 nt, Escherichia coli CFT073
caguaccuucguccauccca

SEQ ID NO: 2599010 - RNA, 20 nt, Escherichia coli CFT073
caguacgaaauaacugaaua

SEQ ID NO: 2599011 - RNA, 17 nt, Escherichia coli CFT073
caguacgcgcccgccgc

SEQ ID NO: 2599012 - RNA, 21 nt, Escherichia coli CFT073
caguacgcggacacuuuccug

SEQ ID NO: 2599013 - RNA, 17 nt, Escherichia coli CFT073
caguacgcgggguuuua

SEQ ID NO: 2599014 - RNA, 15 nt, Escherichia coli CFT073
caguacggcaaagau

SEQ ID NO: 2599015 - RNA, 12 nt, Escherichia coli CFT073
caguacggcagc

SEQ ID NO: 2599016 - RNA, 23 nt, Escherichia coli CFT073
caguacggcagcaaucgaccagg

SEQ ID NO: 2599017 - RNA, 19 nt, Escherichia coli CFT073
caguacggcuauauacagc

SEQ ID NO: 2599018 - RNA, 21 nt, Escherichia coli CFT073
caguacggcuauauacagcgc

SEQ ID NO: 2599019 - RNA, 23 nt, Escherichia coli CFT073
caguacggcuucgaucaggaacu

SEQ ID NO: 2599020 - RNA, 17 nt, Escherichia coli CFT073
caguacgggcagcgcau

SEQ ID NO: 2599021 - RNA, 19 nt, Escherichia coli CFT073
caguacguguuguuccagu

SEQ ID NO: 2599022 - RNA, 18 nt, Escherichia coli CFT073
caguacguuaucaccgau

SEQ ID NO: 2599023 - RNA, 17 nt, Escherichia coli CFT073
caguacucgcacuuuuc

SEQ ID NO: 2599024 - RNA, 16 nt, Escherichia coli CFT073
caguacugacuaucca

SEQ ID NO: 2599025 - RNA, 18 nt, Escherichia coli CFT073
caguacuguacaacacag

SEQ ID NO: 2599026 - RNA, 15 nt, Escherichia coli CFT073
caguagaauaaugau

SEQ ID NO: 2599027 - RNA, 19 nt, Escherichia coli CFT073
caguagauccuugcggauc

SEQ ID NO: 2599028 - RNA, 12 nt, Escherichia coli CFT073
caguagcagcag

SEQ ID NO: 2599029 - RNA, 19 nt, Escherichia coli CFT073
caguagcagcaggaauaau

SEQ ID NO: 2599030 - RNA, 15 nt, Escherichia coli CFT073
caguaggggcaggga

SEQ ID NO: 2599031 - RNA, 14 nt, Escherichia coli CFT073
caguaguugcucaa

SEQ ID NO: 2599032 - RNA, 16 nt, Escherichia coli CFT073
caguaguugcucaagc

SEQ ID NO: 2599033 - RNA, 20 nt, Escherichia coli CFT073
caguaguuuuugcagaugga

SEQ ID NO: 2599034 - RNA, 16 nt, Escherichia coli CFT073
caguauauugcagaaa

SEQ ID NO: 2599035 - RNA, 15 nt, Escherichia coli CFT073
caguauguaauuaaa

SEQ ID NO: 2599036 - RNA, 14 nt, Escherichia coli CFT073
caguauuaccagac

SEQ ID NO: 2599037 - RNA, 19 nt, Escherichia coli CFT073
caguauucagaucagcggc

SEQ ID NO: 2599038 - RNA, 15 nt, Escherichia coli CFT073
caguauugccaugca

SEQ ID NO: 2599039 - RNA, 13 nt, Escherichia coli CFT073
caguauuucuuug

SEQ ID NO: 2599040 - RNA, 20 nt, Escherichia coli CFT073
caguauuucuuuguuucccc

SEQ ID NO: 2599041 - RNA, 21 nt, Escherichia coli CFT073
caguauuugucugccacaccu

SEQ ID NO: 2599042 - RNA, 20 nt, Escherichia coli CFT073
cagucaaaacuuuucaccag

SEQ ID NO: 2599043 - RNA, 13 nt, Escherichia coli CFT073
cagucacagggga

SEQ ID NO: 2599044 - RNA, 19 nt, Escherichia coli CFT073
cagucacaggggaggaaca

SEQ ID NO: 2599045 - RNA, 16 nt, Escherichia coli CFT073
cagucaccagcaucag

SEQ ID NO: 2599046 - RNA, 14 nt, Escherichia coli CFT073
cagucacccgcugc

SEQ ID NO: 2599047 - RNA, 14 nt, Escherichia coli CFT073
cagucacccugccc

SEQ ID NO: 2599048 - RNA, 15 nt, Escherichia coli CFT073
cagucaccugcccuc

SEQ ID NO: 2599049 - RNA, 16 nt, Escherichia coli CFT073
cagucacgacaaagac

SEQ ID NO: 2599050 - RNA, 15 nt, Escherichia coli CFT073
cagucacgguuaauc

SEQ ID NO: 2599051 - RNA, 13 nt, Escherichia coli CFT073
cagucacugccac

SEQ ID NO: 2599052 - RNA, 18 nt, Escherichia coli CFT073
cagucacugccaccaucc

SEQ ID NO: 2599053 - RNA, 14 nt, Escherichia coli CFT073
cagucacugugacg

SEQ ID NO: 2599054 - RNA, 17 nt, Escherichia coli CFT073
cagucacuuuuuuuccg

SEQ ID NO: 2599055 - RNA, 15 nt, Escherichia coli CFT073
cagucagcaccagac

SEQ ID NO: 2599056 - RNA, 17 nt, Escherichia coli CFT073
cagucagcgaacaccag

SEQ ID NO: 2599057 - RNA, 14 nt, Escherichia coli CFT073
cagucagcgguuuu

SEQ ID NO: 2599058 - RNA, 23 nt, Escherichia coli CFT073
cagucaggcgauuguuuagaucc

SEQ ID NO: 2599059 - RNA, 18 nt, Escherichia coli CFT073
cagucagggucuggugcu

SEQ ID NO: 2599060 - RNA, 21 nt, Escherichia coli CFT073
cagucagggucuggugcugau

SEQ ID NO: 2599061 - RNA, 18 nt, Escherichia coli CFT073
cagucauaacguucagca

SEQ ID NO: 2599062 - RNA, 19 nt, Escherichia coli CFT073
cagucauaacguucagcac

SEQ ID NO: 2599063 - RNA, 22 nt, Escherichia coli CFT073
cagucauacuuauugaaagcaa

SEQ ID NO: 2599064 - RNA, 22 nt, Escherichia coli CFT073
cagucaucacuuucagaccgcc

SEQ ID NO: 2599065 - RNA, 15 nt, Escherichia coli CFT073
cagucauuuucuuca

SEQ ID NO: 2599066 - RNA, 16 nt, Escherichia coli CFT073
caguccaccuggccug

SEQ ID NO: 2599067 - RNA, 12 nt, Escherichia coli CFT073
caguccacggcu

SEQ ID NO: 2599068 - RNA, 17 nt, Escherichia coli CFT073
caguccacggcugcggc

SEQ ID NO: 2599069 - RNA, 20 nt, Escherichia coli CFT073
caguccacggcugcggccaa

SEQ ID NO: 2599070 - RNA, 21 nt, Escherichia coli CFT073
caguccagcgccugacgcggg

SEQ ID NO: 2599071 - RNA, 21 nt, Escherichia coli CFT073
caguccaguauagaaggugac

SEQ ID NO: 2599072 - RNA, 12 nt, Escherichia coli CFT073
caguccaucggc

SEQ ID NO: 2599073 - RNA, 15 nt, Escherichia coli CFT073
caguguccagaugcu

SEQ ID NO: 2599074 - RNA, 22 nt, Escherichia coli CFT073
caguguccagaugcuguaccag

SEQ ID NO: 2599075 - RNA, 20 nt, Escherichia coli CFT073
caguguccaguaauggccaa

SEQ ID NO: 2599076 - RNA, 18 nt, Escherichia coli CFT073
cagugucgcaucaggcau

SEQ ID NO: 2599077 - RNA, 13 nt, Escherichia coli CFT073
cagugugccacuu

SEQ ID NO: 2599078 - RNA, 21 nt, Escherichia coli CFT073
cagugugccugaugcgacgcu

SEQ ID NO: 2599079 - RNA, 14 nt, Escherichia coli CFT073
cagugugcgaugcu

SEQ ID NO: 2599080 - RNA, 19 nt, Escherichia coli CFT073
caguguuggcggcagauga

SEQ ID NO: 2599081 - RNA, 15 nt, Escherichia coli CFT073
caguguuguauucag

SEQ ID NO: 2599082 - RNA, 10 nt, Escherichia coli CFT073
caguguuuag

SEQ ID NO: 2599083 - RNA, 16 nt, Escherichia coli CFT073
caguguuuaguggcuu

SEQ ID NO: 2599084 - RNA, 20 nt, Escherichia coli CFT073
caguguuuaguggcuuaacu

SEQ ID NO: 2599085 - RNA, 16 nt, Escherichia coli CFT073
caguuaaccaguuuua

SEQ ID NO: 2599086 - RNA, 17 nt, Escherichia coli CFT073
caguuaagcccuuagua

SEQ ID NO: 2599087 - RNA, 14 nt, Escherichia coli CFT073
caguuaccagccgg

SEQ ID NO: 2599088 - RNA, 19 nt, Escherichia coli CFT073
caguuaucaaauucauugc

SEQ ID NO: 2599089 - RNA, 17 nt, Escherichia coli CFT073
caguuaucaggcugcug

SEQ ID NO: 2599090 - RNA, 22 nt, Escherichia coli CFT073
caguuaucgcauuaucaaagau

SEQ ID NO: 2599091 - RNA, 15 nt, Escherichia coli CFT073
caguucaaugcgccg

SEQ ID NO: 2599092 - RNA, 19 nt, Escherichia coli CFT073
caguucacagcgcagauua

SEQ ID NO: 2599093 - RNA, 14 nt, Escherichia coli CFT073
caguucacccgguc

SEQ ID NO: 2599094 - RNA, 16 nt, Escherichia coli CFT073
caguucacgaauauuu

SEQ ID NO: 2599095 - RNA, 12 nt, Escherichia coli CFT073
caguucagcaac

SEQ ID NO: 2599096 - RNA, 13 nt, Escherichia coli CFT073
caguucagcugcc

SEQ ID NO: 2599097 - RNA, 20 nt, Escherichia coli CFT073
caguucaggcugaggcguuu

SEQ ID NO: 2599098 - RNA, 22 nt, Escherichia coli CFT073
caguucaggcugaggcguuuca

SEQ ID NO: 2599099 - RNA, 21 nt, Escherichia coli CFT073
caguucaucaacgcccauaaa

SEQ ID NO: 2599100 - RNA, 19 nt, Escherichia coli CFT073
caguucauccauuaacagc

SEQ ID NO: 2599101 - RNA, 19 nt, Escherichia coli CFT073
caguuccacuucugcacgg

SEQ ID NO: 2599102 - RNA, 18 nt, Escherichia coli CFT073
caguuccagcaaaucaau

SEQ ID NO: 2599103 - RNA, 15 nt, Escherichia coli CFT073
caguuccagcagcuc

SEQ ID NO: 2599104 - RNA, 19 nt, Escherichia coli CFT073
caguuccauccaccagccc

SEQ ID NO: 2599105 - RNA, 18 nt, Escherichia coli CFT073
caguucccagggcuuucg

SEQ ID NO: 2599106 - RNA, 14 nt, Escherichia coli CFT073
caguucccccugcc

SEQ ID NO: 2599107 - RNA, 15 nt, Escherichia coli CFT073
caguucccccugcca

SEQ ID NO: 2599108 - RNA, 17 nt, Escherichia coli CFT073
caguuccugcuuugaca

SEQ ID NO: 2599109 - RNA, 21 nt, Escherichia coli CFT073
caguuccuuaacuucaucggc

SEQ ID NO: 2599110 - RNA, 22 nt, Escherichia coli CFT073
caguucgcuuugaaugugcggc

SEQ ID NO: 2599111 - RNA, 18 nt, Escherichia coli CFT073
caguucggcguucaccag

SEQ ID NO: 2599112 - RNA, 16 nt, Escherichia coli CFT073
caguucgucacaguua

SEQ ID NO: 2599113 - RNA, 23 nt, Escherichia coli CFT073
caguucuagugcuacccacuucc

SEQ ID NO: 2599114 - RNA, 13 nt, Escherichia coli CFT073
caguucugcagcg

SEQ ID NO: 2599115 - RNA, 15 nt, Escherichia coli CFT073
caguucuucaaaaau

SEQ ID NO: 2599116 - RNA, 17 nt, Escherichia coli CFT073
caguucuucaaaaauaa

SEQ ID NO: 2599117 - RNA, 17 nt, Escherichia coli CFT073
caguucuuccgccagac

SEQ ID NO: 2599118 - RNA, 21 nt, Escherichia coli CFT073
caguugacuuugacaccgcug

SEQ ID NO: 2599119 - RNA, 19 nt, Escherichia coli CFT073
caguugaugauguucaacu

SEQ ID NO: 2599120 - RNA, 19 nt, Escherichia coli CFT073
caguugauggaaaauuguu

SEQ ID NO: 2599121 - RNA, 22 nt, Escherichia coli CFT073
caguugauuaugaucgccacgc

SEQ ID NO: 2599122 - RNA, 23 nt, Escherichia coli CFT073
caguugcauaauuucuucguucg

SEQ ID NO: 2599123 - RNA, 21 nt, Escherichia coli CFT073
caguugccauauccaccggaa

SEQ ID NO: 2599124 - RNA, 14 nt, Escherichia coli CFT073
caguugcucggcaa

SEQ ID NO: 2599125 - RNA, 15 nt, Escherichia coli CFT073
caguuggcagcaagc

SEQ ID NO: 2599126 - RNA, 15 nt, Escherichia coli CFT073
caguugguagagcac

SEQ ID NO: 2599127 - RNA, 16 nt, Escherichia coli CFT073
caguugguagagcacg

SEQ ID NO: 2599128 - RNA, 23 nt, Escherichia coli CFT073
caguugguuagagcacaucacuc

SEQ ID NO: 2599129 - RNA, 12 nt, Escherichia coli CFT073
caguugguucaa

SEQ ID NO: 2599130 - RNA, 22 nt, Escherichia coli CFT073
caguuguaugucauaaaaauga

SEQ ID NO: 2599131 - RNA, 20 nt, Escherichia coli CFT073
caguugugcacgcgauuuac

SEQ ID NO: 2599132 - RNA, 17 nt, Escherichia coli CFT073
caguuuaaccgggagau

SEQ ID NO: 2599133 - RNA, 13 nt, Escherichia coli CFT073
caguuuauacagc

SEQ ID NO: 2599134 - RNA, 15 nt, Escherichia coli CFT073
caguuuaugaaucaa

SEQ ID NO: 2599135 - RNA, 14 nt, Escherichia coli CFT073
caguuuauggaaca

SEQ ID NO: 2599136 - RNA, 16 nt, Escherichia coli CFT073
caguuucaccagcagu

SEQ ID NO: 2599137 - RNA, 14 nt, Escherichia coli CFT073
caguuucaccucuc

SEQ ID NO: 2599138 - RNA, 19 nt, Escherichia coli CFT073
caguuucagagcgaauuaa

SEQ ID NO: 2599139 - RNA, 21 nt, Escherichia coli CFT073
caguuucagagcgaauuaaga

SEQ ID NO: 2599140 - RNA, 22 nt, Escherichia coli CFT073
caguuucaugauauguuuuaaa

SEQ ID NO: 2599141 - RNA, 23 nt, Escherichia coli CFT073
caguuucccaagaugcggggauu

SEQ ID NO: 2599142 - RNA, 17 nt, Escherichia coli CFT073
caguuucgacaccuuca

SEQ ID NO: 2599143 - RNA, 18 nt, Escherichia coli CFT073
caguuucgaucagcaauu

SEQ ID NO: 2599144 - RNA, 21 nt, Escherichia coli CFT073
caguuucgaucagcaauuucu

SEQ ID NO: 2599145 - RNA, 17 nt, Escherichia coli CFT073
caguuucgcauccagag

SEQ ID NO: 2599146 - RNA, 20 nt, Escherichia coli CFT073
caguuucgccaguuuuucaa

SEQ ID NO: 2599147 - RNA, 17 nt, Escherichia coli CFT073
caguuucgucaacuucu

SEQ ID NO: 2599148 - RNA, 19 nt, Escherichia coli CFT073
caguuugagauugaagaua

SEQ ID NO: 2599149 - RNA, 20 nt, Escherichia coli CFT073
caguuugcgcgugcugggau

SEQ ID NO: 2599150 - RNA, 15 nt, Escherichia coli CFT073
caguuugcguucaau

SEQ ID NO: 2599151 - RNA, 16 nt, Escherichia coli CFT073
caguuugcugcuguua

SEQ ID NO: 2599152 - RNA, 20 nt, Escherichia coli CFT073
caguuuguaagucagaaagc

SEQ ID NO: 2599153 - RNA, 20 nt, Escherichia coli CFT073
caguuuuaguggauuaacug

SEQ ID NO: 2599154 - RNA, 21 nt, Escherichia coli CFT073
caguuuucauauaccgcauca

SEQ ID NO: 2599155 - RNA, 17 nt, Escherichia coli CFT073
caguuuuccgccauuca

SEQ ID NO: 2599156 - RNA, 13 nt, Escherichia coli CFT073
caguuuucgcccc

SEQ ID NO: 2599157 - RNA, 14 nt, Escherichia coli CFT073
caguuuugucuucg

SEQ ID NO: 2599158 - RNA, 22 nt, Escherichia coli CFT073
caguuuugucuucggccauuga

SEQ ID NO: 2599159 - RNA, 15 nt, Escherichia coli CFT073
caguuuuucacccgc

SEQ ID NO: 2599160 - RNA, 17 nt, Escherichia coli CFT073
caguuuuuccccugcca

SEQ ID NO: 2599161 - RNA, 16 nt, Escherichia coli CFT073
caguuuuucuuuuuca

SEQ ID NO: 2599162 - RNA, 22 nt, Escherichia coli CFT073
caguuuuucuuuuucaaacugg

SEQ ID NO: 2599163 - RNA, 23 nt, Escherichia coli CFT073
cauaaaaauauauuccuauauau

SEQ ID NO: 2599164 - RNA, 19 nt, Escherichia coli CFT073
cauaaaaauugcggccuau

SEQ ID NO: 2599165 - RNA, 16 nt, Escherichia coli CFT073
cauaaaagggcagcag

SEQ ID NO: 2599166 - RNA, 22 nt, Escherichia coli CFT073
cauaaaagggcagcaggaucag

SEQ ID NO: 2599167 - RNA, 12 nt, Escherichia coli CFT073
cauaaaaucaau

SEQ ID NO: 2599168 - RNA, 19 nt, Escherichia coli CFT073
cauaaacaauacagcgaau

SEQ ID NO: 2599169 - RNA, 15 nt, Escherichia coli CFT073
cauaaacaccagcaa

SEQ ID NO: 2599170 - RNA, 16 nt, Escherichia coli CFT073
cauaaacaccagcagc

SEQ ID NO: 2599171 - RNA, 14 nt, Escherichia coli CFT073
cauaaacacucaca

SEQ ID NO: 2599172 - RNA, 19 nt, Escherichia coli CFT073
cauaaacaucgucaggaag

SEQ ID NO: 2599173 - RNA, 12 nt, Escherichia coli CFT073
cauaaacaucuu

SEQ ID NO: 2599174 - RNA, 22 nt, Escherichia coli CFT073
cauaaacaucuuccacaugccc

SEQ ID NO: 2599175 - RNA, 17 nt, Escherichia coli CFT073
cauaaaccgagccaaac

SEQ ID NO: 2599176 - RNA, 16 nt, Escherichia coli CFT073
cauaaacuacgcucgc

SEQ ID NO: 2599177 - RNA, 13 nt, Escherichia coli CFT073
cauaaacuucauu

SEQ ID NO: 2599178 - RNA, 15 nt, Escherichia coli CFT073
cauaaagauguaauc

SEQ ID NO: 2599179 - RNA, 20 nt, Escherichia coli CFT073
cauaaagauguaaucgccuu

SEQ ID NO: 2599180 - RNA, 22 nt, Escherichia coli CFT073
cauaaagcccgcuucaaacgcu

SEQ ID NO: 2599181 - RNA, 17 nt, Escherichia coli CFT073
cauacuggacacugaau

SEQ ID NO: 2599182 - RNA, 17 nt, Escherichia coli CFT073
cauacuggcggaucccg

SEQ ID NO: 2599183 - RNA, 17 nt, Escherichia coli CFT073
cauacuggcucugaaua

SEQ ID NO: 2599184 - RNA, 22 nt, Escherichia coli CFT073
cauacuguccugcggcguacca

SEQ ID NO: 2599185 - RNA, 17 nt, Escherichia coli CFT073
cauacuuaaauaaugcu

SEQ ID NO: 2599186 - RNA, 15 nt, Escherichia coli CFT073
cauacuuaaugccag

SEQ ID NO: 2599187 - RNA, 22 nt, Escherichia coli CFT073
cauacuuauugaaagcaaaaaa

SEQ ID NO: 2599188 - RNA, 12 nt, Escherichia coli CFT073
cauacuuucuca

SEQ ID NO: 2599189 - RNA, 22 nt, Escherichia coli CFT073
cauagaaaaagaauugcagaua

SEQ ID NO: 2599190 - RNA, 21 nt, Escherichia coli CFT073
cauagaagcucauaugcagca

SEQ ID NO: 2599191 - RNA, 18 nt, Escherichia coli CFT073
cauagaauacgccacgac

SEQ ID NO: 2599192 - RNA, 18 nt, Escherichia coli CFT073
cauagacaauguaucuuu

SEQ ID NO: 2599193 - RNA, 19 nt, Escherichia coli CFT073
cauagacagccacaucccg

SEQ ID NO: 2599194 - RNA, 14 nt, Escherichia coli CFT073
cauagaccauugca

SEQ ID NO: 2599195 - RNA, 22 nt, Escherichia coli CFT073
cauagacuuuacuaauagcaaa

SEQ ID NO: 2599196 - RNA, 18 nt, Escherichia coli CFT073
cauagagagauguugcug

SEQ ID NO: 2599197 - RNA, 16 nt, Escherichia coli CFT073
cauagagauaacuggc

SEQ ID NO: 2599198 - RNA, 15 nt, Escherichia coli CFT073
cauagauaccuucuu

SEQ ID NO: 2599199 - RNA, 16 nt, Escherichia coli CFT073
cauagauuaaaaucgc

SEQ ID NO: 2599200 - RNA, 23 nt, Escherichia coli CFT073
cauagauuaauuucccaccacua

SEQ ID NO: 2599201 - RNA, 23 nt, Escherichia coli CFT073
cauagcaauaaaugccuggauga

SEQ ID NO: 2599202 - RNA, 15 nt, Escherichia coli CFT073
cauagcacauccuga

SEQ ID NO: 2599203 - RNA, 16 nt, Escherichia coli CFT073
cauagcagcacaccac

SEQ ID NO: 2599204 - RNA, 13 nt, Escherichia coli CFT073
cauagccaucccu

SEQ ID NO: 2599205 - RNA, 18 nt, Escherichia coli CFT073
cauagccccagcgcagac

SEQ ID NO: 2599206 - RNA, 13 nt, Escherichia coli CFT073
cauagccuccggc

SEQ ID NO: 2599207 - RNA, 21 nt, Escherichia coli CFT073
cauagccucugccccgccaac

SEQ ID NO: 2599208 - RNA, 21 nt, Escherichia coli CFT073
cauagcguaacuuaucaauug

SEQ ID NO: 2599209 - RNA, 18 nt, Escherichia coli CFT073
cauagcgugacaccagca

SEQ ID NO: 2599210 - RNA, 18 nt, Escherichia coli CFT073
cauagcguucgucgauau

SEQ ID NO: 2599211 - RNA, 14 nt, Escherichia coli CFT073
cauagcguucuucc

SEQ ID NO: 2599212 - RNA, 16 nt, Escherichia coli CFT073
cauagcuaaaaauaau

SEQ ID NO: 2599213 - RNA, 18 nt, Escherichia coli CFT073
cauagcuuuggcggcauc

SEQ ID NO: 2599214 - RNA, 14 nt, Escherichia coli CFT073
cauaggccugcuga

SEQ ID NO: 2599215 - RNA, 14 nt, Escherichia coli CFT073
cauaggcugccgac

SEQ ID NO: 2599216 - RNA, 22 nt, Escherichia coli CFT073
cauaggugcccgcauagcccag

SEQ ID NO: 2599217 - RNA, 13 nt, Escherichia coli CFT073
cauaguaagcaga

SEQ ID NO: 2599218 - RNA, 23 nt, Escherichia coli CFT073
cauaguaaguguuguauuauaua

SEQ ID NO: 2599219 - RNA, 17 nt, Escherichia coli CFT073
cauaguacuggaagaaa

SEQ ID NO: 2599220 - RNA, 18 nt, Escherichia coli CFT073
cauaguacuggaagaaaa

SEQ ID NO: 2599221 - RNA, 19 nt, Escherichia coli CFT073
cauaguaggucauaucgac

SEQ ID NO: 2599222 - RNA, 22 nt, Escherichia coli CFT073
cauaguauuuauccauaauuug

SEQ ID NO: 2599223 - RNA, 19 nt, Escherichia coli CFT073
cauaguccggcaccagcgc

SEQ ID NO: 2599224 - RNA, 16 nt, Escherichia coli CFT073
cauagugaaaacgaag

SEQ ID NO: 2599225 - RNA, 19 nt, Escherichia coli CFT073
cauaguguguuccucugcu

SEQ ID NO: 2599226 - RNA, 15 nt, Escherichia coli CFT073
cauauaaaccugaua

SEQ ID NO: 2599227 - RNA, 17 nt, Escherichia coli CFT073
cauauaaaugccgguua

SEQ ID NO: 2599228 - RNA, 19 nt, Escherichia coli CFT073
cauauaaccggcaacagaa

SEQ ID NO: 2599229 - RNA, 20 nt, Escherichia coli CFT073
cauauaaccggcaacagaac

SEQ ID NO: 2599230 - RNA, 18 nt, Escherichia coli CFT073
cauauaacguccaguuga

SEQ ID NO: 2599231 - RNA, 15 nt, Escherichia coli CFT073
cauauaagugcauua

SEQ ID NO: 2599232 - RNA, 20 nt, Escherichia coli CFT073
cauauaagugcauuaaauuc

SEQ ID NO: 2599233 - RNA, 21 nt, Escherichia coli CFT073
cauauaccacacccgcaagac

SEQ ID NO: 2599234 - RNA, 17 nt, Escherichia coli CFT073
cauauaccgcaucagca

SEQ ID NO: 2599235 - RNA, 22 nt, Escherichia coli CFT073
cauauaccgcgguucccagcgu

SEQ ID NO: 2599236 - RNA, 18 nt, Escherichia coli CFT073
cauauaccgucagcgucu

SEQ ID NO: 2599237 - RNA, 14 nt, Escherichia coli CFT073
cauauagccgccau

SEQ ID NO: 2599238 - RNA, 19 nt, Escherichia coli CFT073
cauauagccgcgcaguuuc

SEQ ID NO: 2599239 - RNA, 14 nt, Escherichia coli CFT073
cauauauaaaauca

SEQ ID NO: 2599240 - RNA, 20 nt, Escherichia coli CFT073
cauauauaaaaucauauucu

SEQ ID NO: 2599241 - RNA, 17 nt, Escherichia coli CFT073
cauaucaaaaagcugua

SEQ ID NO: 2599242 - RNA, 13 nt, Escherichia coli CFT073
cauaucaauuaga

SEQ ID NO: 2599243 - RNA, 16 nt, Escherichia coli CFT073
cauaucacuuuuauau

SEQ ID NO: 2599244 - RNA, 19 nt, Escherichia coli CFT073
cauaucacuuuuauauaau

SEQ ID NO: 2599245 - RNA, 11 nt, Escherichia coli CFT073
cauaucagcgc

SEQ ID NO: 2599246 - RNA, 12 nt, Escherichia coli CFT073
cauaucaucaag

SEQ ID NO: 2599247 - RNA, 18 nt, Escherichia coli CFT073
cauaucaucaucggucag

SEQ ID NO: 2599248 - RNA, 18 nt, Escherichia coli CFT073
cauaucauuuugcugcca

SEQ ID NO: 2599249 - RNA, 13 nt, Escherichia coli CFT073
cauauccagcgcc

SEQ ID NO: 2599250 - RNA, 21 nt, Escherichia coli CFT073
cauauccaucguugaauacau

SEQ ID NO: 2599251 - RNA, 15 nt, Escherichia coli CFT073
cauaucccaccagcg

SEQ ID NO: 2599252 - RNA, 17 nt, Escherichia coli CFT073
cauauccggugccaaag

SEQ ID NO: 2599253 - RNA, 14 nt, Escherichia coli CFT073
cauaucgaccagcg

SEQ ID NO: 2599254 - RNA, 18 nt, Escherichia coli CFT073
cauaucgccauugcuggu

SEQ ID NO: 2599255 - RNA, 19 nt, Escherichia coli CFT073
cauaucgcgugcacuacaa

SEQ ID NO: 2599256 - RNA, 14 nt, Escherichia coli CFT073
cauaucggauugcg

SEQ ID NO: 2599257 - RNA, 18 nt, Escherichia coli CFT073
cauaucguagccccaguc

SEQ ID NO: 2599258 - RNA, 15 nt, Escherichia coli CFT073
cauaucuauuacagc

SEQ ID NO: 2599259 - RNA, 17 nt, Escherichia coli CFT073
cauaucucccaguaagc

SEQ ID NO: 2599260 - RNA, 18 nt, Escherichia coli CFT073
cauaucuucuccugucau

SEQ ID NO: 2599261 - RNA, 13 nt, Escherichia coli CFT073
cauaucuucugaa

SEQ ID NO: 2599262 - RNA, 17 nt, Escherichia coli CFT073
cauaucuuuuucguaag

SEQ ID NO: 2599263 - RNA, 17 nt, Escherichia coli CFT073
cauaugauucauauugc

SEQ ID NO: 2599264 - RNA, 17 nt, Escherichia coli CFT073
cauaugcaaaucacgca

SEQ ID NO: 2599265 - RNA, 14 nt, Escherichia coli CFT073
cauaugcaaugcau

SEQ ID NO: 2599266 - RNA, 15 nt, Escherichia coli CFT073
cauaugcacacgcag

SEQ ID NO: 2599267 - RNA, 16 nt, Escherichia coli CFT073
cauaugcacaugauga

SEQ ID NO: 2599268 - RNA, 21 nt, Escherichia coli CFT073
cauaugcacaugaugauggcu

SEQ ID NO: 2599269 - RNA, 14 nt, Escherichia coli CFT073
cauaugcagcaucc

SEQ ID NO: 2599270 - RNA, 19 nt, Escherichia coli CFT073
cauaugcagcauccagcug

SEQ ID NO: 2599271 - RNA, 24 nt, Escherichia coli CFT073
cauaugcagccacugcugcgcgaa

SEQ ID NO: 2599272 - RNA, 16 nt, Escherichia coli CFT073
cauaugcgccagacga

SEQ ID NO: 2599273 - RNA, 17 nt, Escherichia coli CFT073
cauauggaagaaacgcu

SEQ ID NO: 2599274 - RNA, 21 nt, Escherichia coli CFT073
cauauggauaugaucugcaca

SEQ ID NO: 2599275 - RNA, 24 nt, Escherichia coli CFT073
cauauggauaugaucugcacagca

SEQ ID NO: 2599276 - RNA, 15 nt, Escherichia coli CFT073
cauauguugaaaagc

SEQ ID NO: 2599277 - RNA, 18 nt, Escherichia coli CFT073
cauauguuuaaccggcag

SEQ ID NO: 2599278 - RNA, 20 nt, Escherichia coli CFT073
cauauguuuacgcuggcgga

SEQ ID NO: 2599279 - RNA, 16 nt, Escherichia coli CFT073
cauauuaacgcagcaa

SEQ ID NO: 2599280 - RNA, 18 nt, Escherichia coli CFT073
cauauuauucauaaugcc

SEQ ID NO: 2599281 - RNA, 14 nt, Escherichia coli CFT073
cauauucagcagca

SEQ ID NO: 2599282 - RNA, 15 nt, Escherichia coli CFT073
cauauucauagcaca

SEQ ID NO: 2599283 - RNA, 20 nt, Escherichia coli CFT073
cauauucauagcacauccug

SEQ ID NO: 2599284 - RNA, 23 nt, Escherichia coli CFT073
cauauucauccccgcaggucgga

SEQ ID NO: 2599285 - RNA, 17 nt, Escherichia coli CFT073
cauauucccgcaacuua

SEQ ID NO: 2599286 - RNA, 18 nt, Escherichia coli CFT073
cauauuccgcaccugcca

SEQ ID NO: 2599287 - RNA, 20 nt, Escherichia coli CFT073
cauauuccgccaccugcgaa

SEQ ID NO: 2599288 - RNA, 14 nt, Escherichia coli CFT073
cauauucgccauca

SEQ ID NO: 2599289 - RNA, 18 nt, Escherichia coli CFT073
cauauucgccgcccugca

SEQ ID NO: 2599290 - RNA, 18 nt, Escherichia coli CFT073
cauauucugaucgugcuc

SEQ ID NO: 2599291 - RNA, 22 nt, Escherichia coli CFT073
cauauugaccguuucgccagac

SEQ ID NO: 2599292 - RNA, 17 nt, Escherichia coli CFT073
cauauugccaucacggc

SEQ ID NO: 2599293 - RNA, 18 nt, Escherichia coli CFT073
cauauuggggaugacgaa

SEQ ID NO: 2599294 - RNA, 15 nt, Escherichia coli CFT073
cauauuguccuguac

SEQ ID NO: 2599295 - RNA, 19 nt, Escherichia coli CFT073
cauauugucugcgccgauc

SEQ ID NO: 2599296 - RNA, 18 nt, Escherichia coli CFT073
cauauuguguaugcacac

SEQ ID NO: 2599297 - RNA, 18 nt, Escherichia coli CFT073
cauauuguucugaccaaa

SEQ ID NO: 2599298 - RNA, 14 nt, Escherichia coli CFT073
cauauuuaaaaacg

SEQ ID NO: 2599299 - RNA, 19 nt, Escherichia coli CFT073
cauauuuaagccugcauca

SEQ ID NO: 2599300 - RNA, 14 nt, Escherichia coli CFT073
cauauuugguauca

SEQ ID NO: 2599301 - RNA, 15 nt, Escherichia coli CFT073
cauauuugguaucaa

SEQ ID NO: 2599302 - RNA, 14 nt, Escherichia coli CFT073
cauauuuuuugaaa

SEQ ID NO: 2599303 - RNA, 17 nt, Escherichia coli CFT073
caucaaaauuaccuuua

SEQ ID NO: 2599304 - RNA, 14 nt, Escherichia coli CFT073
caucaaacaacggc

SEQ ID NO: 2599305 - RNA, 17 nt, Escherichia coli CFT073
caucaaacaacggcacu

SEQ ID NO: 2599306 - RNA, 22 nt, Escherichia coli CFT073
caucaaacaacggcacuucaau

SEQ ID NO: 2599307 - RNA, 15 nt, Escherichia coli CFT073
caucaaacaccgaac

SEQ ID NO: 2599308 - RNA, 16 nt, Escherichia coli CFT073
caucaaacagccccug

SEQ ID NO: 2599309 - RNA, 15 nt, Escherichia coli CFT073
caucaaacccauuuu

SEQ ID NO: 2599310 - RNA, 17 nt, Escherichia coli CFT073
caucaaagaaaagcagu

SEQ ID NO: 2599311 - RNA, 15 nt, Escherichia coli CFT073
caucaaaucacagca

SEQ ID NO: 2599312 - RNA, 18 nt, Escherichia coli CFT073
caucaaaucacagcaccu

SEQ ID NO: 2599313 - RNA, 14 nt, Escherichia coli CFT073
caucaaauccccac

SEQ ID NO: 2599314 - RNA, 21 nt, Escherichia coli CFT073
caucaaaucugccguaacugc

SEQ ID NO: 2599315 - RNA, 20 nt, Escherichia coli CFT073
caucaaauggcauccuugcu

SEQ ID NO: 2599316 - RNA, 17 nt, Escherichia coli CFT073
caucaaccagcacaaag

SEQ ID NO: 2599317 - RNA, 15 nt, Escherichia coli CFT073
caucaaccagcaccu

SEQ ID NO: 2599318 - RNA, 13 nt, Escherichia coli CFT073
caucaacccagaa

SEQ ID NO: 2599319 - RNA, 13 nt, Escherichia coli CFT073
caucaacccgccc

SEQ ID NO: 2599320 - RNA, 20 nt, Escherichia coli CFT073
caucaacccgcccagugcug

SEQ ID NO: 2599321 - RNA, 17 nt, Escherichia coli CFT073
caucaacgcagacgccg

SEQ ID NO: 2599322 - RNA, 20 nt, Escherichia coli CFT073
caucaacgccugaugcgacg

SEQ ID NO: 2599323 - RNA, 21 nt, Escherichia coli CFT073
caucaacgcggcaaaacccug

SEQ ID NO: 2599324 - RNA, 14 nt, Escherichia coli CFT073
caucaacugacuau

SEQ ID NO: 2599325 - RNA, 14 nt, Escherichia coli CFT073
caucaacugcgcua

SEQ ID NO: 2599326 - RNA, 14 nt, Escherichia coli CFT073
caucaagaaacucu

SEQ ID NO: 2599327 - RNA, 13 nt, Escherichia coli CFT073
caucaagcggcgc

SEQ ID NO: 2599328 - RNA, 21 nt, Escherichia coli CFT073
caucaagcuaacgaacgcagu

SEQ ID NO: 2599329 - RNA, 22 nt, Escherichia coli CFT073
caucaagcuaacgaacgcagug

SEQ ID NO: 2599330 - RNA, 18 nt, Escherichia coli CFT073
caucaagcugugccugaa

SEQ ID NO: 2599331 - RNA, 18 nt, Escherichia coli CFT073
caucaaggcugauaacgu

SEQ ID NO: 2599332 - RNA, 15 nt, Escherichia coli CFT073
caucaaguaaccuuu

SEQ ID NO: 2599333 - RNA, 22 nt, Escherichia coli CFT073
caucaaguagcagguaaucugc

SEQ ID NO: 2599334 - RNA, 22 nt, Escherichia coli CFT073
caucaaguugauuuuucguuuu

SEQ ID NO: 2599335 - RNA, 19 nt, Escherichia coli CFT073
caucaauaaagccgcccau

SEQ ID NO: 2599336 - RNA, 14 nt, Escherichia coli CFT073
caucaauaacaaag

SEQ ID NO: 2599337 - RNA, 18 nt, Escherichia coli CFT073
caucaauaaucaccgaac

SEQ ID NO: 2599338 - RNA, 23 nt, Escherichia coli CFT073
caucaauaccauuaucauugagc

SEQ ID NO: 2599339 - RNA, 13 nt, Escherichia coli CFT073
caucaauauucca

SEQ ID NO: 2599340 - RNA, 13 nt, Escherichia coli CFT073
caucaaucccuuc

SEQ ID NO: 2599341 - RNA, 21 nt, Escherichia coli CFT073
caucaaucccuucgacuuuca

SEQ ID NO: 2599342 - RNA, 17 nt, Escherichia coli CFT073
caucaaucgcucccagc

SEQ ID NO: 2599343 - RNA, 22 nt, Escherichia coli CFT073
caucaaugauauaccguagauu

SEQ ID NO: 2599344 - RNA, 16 nt, Escherichia coli CFT073
caucaaugccagcaua

SEQ ID NO: 2599345 - RNA, 17 nt, Escherichia coli CFT073
caucaauuaacugaacu

SEQ ID NO: 2599346 - RNA, 16 nt, Escherichia coli CFT073
caucaauuacaccauc

SEQ ID NO: 2599347 - RNA, 14 nt, Escherichia coli CFT073
caucaauugcaauc

SEQ ID NO: 2599348 - RNA, 17 nt, Escherichia coli CFT073
caucaauugcucacucc

SEQ ID NO: 2599349 - RNA, 20 nt, Escherichia coli CFT073
caucacaaaauagaaauuua

SEQ ID NO: 2599350 - RNA, 19 nt, Escherichia coli CFT073
caucacaaaauuuauccag

SEQ ID NO: 2599351 - RNA, 15 nt, Escherichia coli CFT073
caucacaacuucgca

SEQ ID NO: 2599352 - RNA, 22 nt, Escherichia coli CFT073
caucacaauuccgguacgccag

SEQ ID NO: 2599353 - RNA, 20 nt, Escherichia coli CFT073
caucacauaaucgaaaacau

SEQ ID NO: 2599354 - RNA, 14 nt, Escherichia coli CFT073
caucacauccagcg

SEQ ID NO: 2599355 - RNA, 14 nt, Escherichia coli CFT073
caucacaucccagc

SEQ ID NO: 2599356 - RNA, 22 nt, Escherichia coli CFT073
caucacaugcuggaaccacagc

SEQ ID NO: 2599357 - RNA, 19 nt, Escherichia coli CFT073
caucaccaaugacagcccc

SEQ ID NO: 2599358 - RNA, 13 nt, Escherichia coli CFT073
caucaccacgccg

SEQ ID NO: 2599359 - RNA, 20 nt, Escherichia coli CFT073
caucaccacgccgagagaag

SEQ ID NO: 2599360 - RNA, 23 nt, Escherichia coli CFT073
caucaccacgccgagagaagcgc

SEQ ID NO: 2599361 - RNA, 19 nt, Escherichia coli CFT073
caucaccacguuagcaaau

SEQ ID NO: 2599362 - RNA, 12 nt, Escherichia coli CFT073
caucaccaggcc

SEQ ID NO: 2599363 - RNA, 23 nt, Escherichia coli CFT073
caucaccgacggauuauucacua

SEQ ID NO: 2599364 - RNA, 20 nt, Escherichia coli CFT073
caucaccgaugcccucaaua

SEQ ID NO: 2599365 - RNA, 15 nt, Escherichia coli CFT073
caucaccgccaggcc

SEQ ID NO: 2599366 - RNA, 14 nt, Escherichia coli CFT073
caucaccucuucac

SEQ ID NO: 2599367 - RNA, 17 nt, Escherichia coli CFT073
caucaccugacagcaga

SEQ ID NO: 2599368 - RNA, 18 nt, Escherichia coli CFT073
caucaccugacagcagag

SEQ ID NO: 2599369 - RNA, 14 nt, Escherichia coli CFT073
caucacgaaaauca

SEQ ID NO: 2599370 - RNA, 20 nt, Escherichia coli CFT073
caucacgaccgcuucaggaa

SEQ ID NO: 2599371 - RNA, 18 nt, Escherichia coli CFT073
caucacgcaacauuccgg

SEQ ID NO: 2599372 - RNA, 20 nt, Escherichia coli CFT073
caucacgcagcgugaagcua

SEQ ID NO: 2599373 - RNA, 15 nt, Escherichia coli CFT073
caucacgcccgcuuu

SEQ ID NO: 2599374 - RNA, 17 nt, Escherichia coli CFT073
caucacgcgcaucugua

SEQ ID NO: 2599375 - RNA, 22 nt, Escherichia coli CFT073
caucacgguugagagcaaacac

SEQ ID NO: 2599376 - RNA, 21 nt, Escherichia coli CFT073
caucacuaaggguaaaacgac

SEQ ID NO: 2599377 - RNA, 20 nt, Escherichia coli CFT073
caucacuaccugauucgcac

SEQ ID NO: 2599378 - RNA, 22 nt, Escherichia coli CFT073
caucacuauucagaucuugcuc

SEQ ID NO: 2599379 - RNA, 20 nt, Escherichia coli CFT073
caucacucacgacacauaaa

SEQ ID NO: 2599380 - RNA, 15 nt, Escherichia coli CFT073
caucacuccccuccu

SEQ ID NO: 2599381 - RNA, 17 nt, Escherichia coli CFT073
caucacucccuuucugc

SEQ ID NO: 2599382 - RNA, 16 nt, Escherichia coli CFT073
caucacugacaucacg

SEQ ID NO: 2599383 - RNA, 21 nt, Escherichia coli CFT073
caucacugacaucacgccacu

SEQ ID NO: 2599384 - RNA, 23 nt, Escherichia coli CFT073
caucacugcaaauacccaaaaaa

SEQ ID NO: 2599385 - RNA, 13 nt, Escherichia coli CFT073
caucacugccgac

SEQ ID NO: 2599386 - RNA, 12 nt, Escherichia coli CFT073
caucacugcgcu

SEQ ID NO: 2599387 - RNA, 19 nt, Escherichia coli CFT073
caucacuugauccauaucg

SEQ ID NO: 2599388 - RNA, 20 nt, Escherichia coli CFT073
caucacuugcucccgggcau

SEQ ID NO: 2599389 - RNA, 20 nt, Escherichia coli CFT073
caucacuuuuuccggugcca

SEQ ID NO: 2599390 - RNA, 16 nt, Escherichia coli CFT073
caucagaacagcccca

SEQ ID NO: 2599391 - RNA, 17 nt, Escherichia coli CFT073
caucagaacagccccaa

SEQ ID NO: 2599392 - RNA, 22 nt, Escherichia coli CFT073
caucagacugcuuuucccuuuc

SEQ ID NO: 2599393 - RNA, 14 nt, Escherichia coli CFT073
caucagaucgcgac

SEQ ID NO: 2599394 - RNA, 14 nt, Escherichia coli CFT073
caucagaugaagau

SEQ ID NO: 2599395 - RNA, 14 nt, Escherichia coli CFT073
caucagcaacgcug

SEQ ID NO: 2599396 - RNA, 12 nt, Escherichia coli CFT073
caucagcagcaa

SEQ ID NO: 2599397 - RNA, 19 nt, Escherichia coli CFT073
caucccuuucgccugcaaa

SEQ ID NO: 2599398 - RNA, 16 nt, Escherichia coli CFT073
cauccgaacgcugaca

SEQ ID NO: 2599399 - RNA, 17 nt, Escherichia coli CFT073
cauccgacaucaacgcc

SEQ ID NO: 2599400 - RNA, 13 nt, Escherichia coli CFT073
cauccgacauuug

SEQ ID NO: 2599401 - RNA, 19 nt, Escherichia coli CFT073
cauccgacuuugaaggaua

SEQ ID NO: 2599402 - RNA, 20 nt, Escherichia coli CFT073
cauccgaugguuuagccugu

SEQ ID NO: 2599403 - RNA, 16 nt, Escherichia coli CFT073
cauccgauuguuccug

SEQ ID NO: 2599404 - RNA, 12 nt, Escherichia coli CFT073
cauccgcaauuu

SEQ ID NO: 2599405 - RNA, 21 nt, Escherichia coli CFT073
cauccgcaucacgaccgcuuc

SEQ ID NO: 2599406 - RNA, 14 nt, Escherichia coli CFT073
cauccgccagcagc

SEQ ID NO: 2599407 - RNA, 20 nt, Escherichia coli CFT073
cauccgccccggcuucaaaa

SEQ ID NO: 2599408 - RNA, 13 nt, Escherichia coli CFT073
cauccgcgcaaua

SEQ ID NO: 2599409 - RNA, 13 nt, Escherichia coli CFT073
cauccgcgcgcgu

SEQ ID NO: 2599410 - RNA, 18 nt, Escherichia coli CFT073
cauccgcgcuuucuggcg

SEQ ID NO: 2599411 - RNA, 16 nt, Escherichia coli CFT073
cauccgcgugacgcug

SEQ ID NO: 2599412 - RNA, 22 nt, Escherichia coli CFT073
cauccggaucgagaauauucac

SEQ ID NO: 2599413 - RNA, 12 nt, Escherichia coli CFT073
cauccggcaacc

SEQ ID NO: 2599414 - RNA, 17 nt, Escherichia coli CFT073
cauccggcaauauccau

SEQ ID NO: 2599415 - RNA, 17 nt, Escherichia coli CFT073
cauccggcaaugaaacu

SEQ ID NO: 2599416 - RNA, 19 nt, Escherichia coli CFT073
cauccggcaaugaaacuca

SEQ ID NO: 2599417 - RNA, 17 nt, Escherichia coli CFT073
cauccggcaauucucac

SEQ ID NO: 2599418 - RNA, 19 nt, Escherichia coli CFT073
cauccggcaauuuugcgcc

SEQ ID NO: 2599419 - RNA, 21 nt, Escherichia coli CFT073
cauccggcacgucuucgauau

SEQ ID NO: 2599420 - RNA, 15 nt, Escherichia coli CFT073
cauccggcagcaaau

SEQ ID NO: 2599421 - RNA, 15 nt, Escherichia coli CFT073
cauccggcauaaaca

SEQ ID NO: 2599422 - RNA, 15 nt, Escherichia coli CFT073
cauccggcauaaacu

SEQ ID NO: 2599423 - RNA, 15 nt, Escherichia coli CFT073
cauccggcaucaacc

SEQ ID NO: 2599424 - RNA, 18 nt, Escherichia coli CFT073
cauccggcauuugagcag

SEQ ID NO: 2599425 - RNA, 17 nt, Escherichia coli CFT073
cauccggcgacaggaac

SEQ ID NO: 2599426 - RNA, 18 nt, Escherichia coli CFT073
cauccggcgacaggaacc

SEQ ID NO: 2599427 - RNA, 17 nt, Escherichia coli CFT073
cauccggcucgcaucaa

SEQ ID NO: 2599428 - RNA, 18 nt, Escherichia coli CFT073
cauccggcucgcaucaau

SEQ ID NO: 2599429 - RNA, 19 nt, Escherichia coli CFT073
cauccggcuuaaauccaaa

SEQ ID NO: 2599430 - RNA, 16 nt, Escherichia coli CFT073
cauccgguacuuuccu

SEQ ID NO: 2599431 - RNA, 20 nt, Escherichia coli CFT073
cauccgguguggcauggcga

SEQ ID NO: 2599432 - RNA, 22 nt, Escherichia coli CFT073
cauccgguuaucgccugcgcca

SEQ ID NO: 2599433 - RNA, 18 nt, Escherichia coli CFT073
cauccgguuuucugccug

SEQ ID NO: 2599434 - RNA, 14 nt, Escherichia coli CFT073
cauccguccgcaaa

SEQ ID NO: 2599435 - RNA, 15 nt, Escherichia coli CFT073
cauccgucggcuuca

SEQ ID NO: 2599436 - RNA, 22 nt, Escherichia coli CFT073
cauccguuucagcuuauucauc

SEQ ID NO: 2599437 - RNA, 21 nt, Escherichia coli CFT073
cauccuaaaggcaaaaugcca

SEQ ID NO: 2599438 - RNA, 14 nt, Escherichia coli CFT073
cauccucauaacgu

SEQ ID NO: 2599439 - RNA, 22 nt, Escherichia coli CFT073
cauccucauaacguaaaccaau

SEQ ID NO: 2599440 - RNA, 17 nt, Escherichia coli CFT073
cauccugaauauccugu

SEQ ID NO: 2599441 - RNA, 15 nt, Escherichia coli CFT073
cauccugaaucgcuu

SEQ ID NO: 2599442 - RNA, 20 nt, Escherichia coli CFT073
cauccugaauuaacuuauca

SEQ ID NO: 2599443 - RNA, 15 nt, Escherichia coli CFT073
cauccugaucgccau

SEQ ID NO: 2599444 - RNA, 14 nt, Escherichia coli CFT073
cauccugcaccaca

SEQ ID NO: 2599445 - RNA, 18 nt, Escherichia coli CFT073
cauccugcggcagcucca

SEQ ID NO: 2599446 - RNA, 19 nt, Escherichia coli CFT073
cauccugcggcagcuccag

SEQ ID NO: 2599447 - RNA, 21 nt, Escherichia coli CFT073
cauccugcggcagcuccagca

SEQ ID NO: 2599448 - RNA, 12 nt, Escherichia coli CFT073
cauccugcugca

SEQ ID NO: 2599449 - RNA, 21 nt, Escherichia coli CFT073
cauccuggggauucaucacca

SEQ ID NO: 2599450 - RNA, 19 nt, Escherichia coli CFT073
cauccuguaugacaaaaga

SEQ ID NO: 2599451 - RNA, 14 nt, Escherichia coli CFT073
cauccuguggcuuu

SEQ ID NO: 2599452 - RNA, 21 nt, Escherichia coli CFT073
cauccuguggcuuuuuuguag

SEQ ID NO: 2599453 - RNA, 15 nt, Escherichia coli CFT073
cauccuguucauuuu

SEQ ID NO: 2599454 - RNA, 21 nt, Escherichia coli CFT073
cauccuguucauuuuuaggau

SEQ ID NO: 2599455 - RNA, 22 nt, Escherichia coli CFT073
cauccuuaugcagcggaauaau

SEQ ID NO: 2599456 - RNA, 15 nt, Escherichia coli CFT073
cauccuugcuaacca

SEQ ID NO: 2599457 - RNA, 16 nt, Escherichia coli CFT073
cauccuuugcuggcaa

SEQ ID NO: 2599458 - RNA, 14 nt, Escherichia coli CFT073
caucgaaaaugcca

SEQ ID NO: 2599459 - RNA, 21 nt, Escherichia coli CFT073
caucgaaaaugccacugcgcc

SEQ ID NO: 2599460 - RNA, 17 nt, Escherichia coli CFT073
caucgaaccaucggcuu

SEQ ID NO: 2599461 - RNA, 18 nt, Escherichia coli CFT073
caucgaaccaucggcuuu

SEQ ID NO: 2599462 - RNA, 21 nt, Escherichia coli CFT073
caucgaauaaauugagcugcg

SEQ ID NO: 2599463 - RNA, 14 nt, Escherichia coli CFT073
caucgacagcaaau

SEQ ID NO: 2599464 - RNA, 18 nt, Escherichia coli CFT073
caucgacagcaaauugcg

SEQ ID NO: 2599465 - RNA, 18 nt, Escherichia coli CFT073
caucgacaguaccagcag

SEQ ID NO: 2599466 - RNA, 12 nt, Escherichia coli CFT073
caucgacauaau

SEQ ID NO: 2599467 - RNA, 21 nt, Escherichia coli CFT073
caucgacauaauugaccagau

SEQ ID NO: 2599468 - RNA, 15 nt, Escherichia coli CFT073
caucgacaucaacga

SEQ ID NO: 2599469 - RNA, 16 nt, Escherichia coli CFT073
caucgacauugaccag

SEQ ID NO: 2599470 - RNA, 20 nt, Escherichia coli CFT073
caucgacauugaccagugca

SEQ ID NO: 2599471 - RNA, 21 nt, Escherichia coli CFT073
caucgacgaaauggugugcau

SEQ ID NO: 2599472 - RNA, 16 nt, Escherichia coli CFT073
caucgacgccaucauu

SEQ ID NO: 2599473 - RNA, 16 nt, Escherichia coli CFT073
caucgacgucagcaga

SEQ ID NO: 2599474 - RNA, 18 nt, Escherichia coli CFT073
caucgacguccaaucagc

SEQ ID NO: 2599475 - RNA, 15 nt, Escherichia coli CFT073
caucgacguggugaa

SEQ ID NO: 2599476 - RNA, 15 nt, Escherichia coli CFT073
caucgacucaagcgu

SEQ ID NO: 2599477 - RNA, 15 nt, Escherichia coli CFT073
caucgacuucucgca

SEQ ID NO: 2599478 - RNA, 15 nt, Escherichia coli CFT073
caucgagaucgacac

SEQ ID NO: 2599479 - RNA, 12 nt, Escherichia coli CFT073
caucgagcagca

SEQ ID NO: 2599480 - RNA, 17 nt, Escherichia coli CFT073
caucgagcgcagcaaca

SEQ ID NO: 2599481 - RNA, 18 nt, Escherichia coli CFT073
caucgagcgcagcaacau

SEQ ID NO: 2599482 - RNA, 14 nt, Escherichia coli CFT073
caucgauccccugc

SEQ ID NO: 2599483 - RNA, 16 nt, Escherichia coli CFT073
caucgauccccugccc

SEQ ID NO: 2599484 - RNA, 14 nt, Escherichia coli CFT073
caucgaugccgccu

SEQ ID NO: 2599485 - RNA, 12 nt, Escherichia coli CFT073
caucgaugcugc

SEQ ID NO: 2599486 - RNA, 13 nt, Escherichia coli CFT073
caucgauuuacug

SEQ ID NO: 2599487 - RNA, 15 nt, Escherichia coli CFT073
caucgauuuucugcu

SEQ ID NO: 2599488 - RNA, 16 nt, Escherichia coli CFT073
caucgauuuugcaaua

SEQ ID NO: 2599489 - RNA, 23 nt, Escherichia coli CFT073
caucgcaaaauacaccguuagag

SEQ ID NO: 2599490 - RNA, 15 nt, Escherichia coli CFT073
caucgcaaaauuucg

SEQ ID NO: 2599491 - RNA, 23 nt, Escherichia coli CFT073
caucgcaaacagcacaucuccca

SEQ ID NO: 2599492 - RNA, 14 nt, Escherichia coli CFT073
caucgcaaaccaga

SEQ ID NO: 2599493 - RNA, 19 nt, Escherichia coli CFT073
caucgcaaaccagacgcgc

SEQ ID NO: 2599494 - RNA, 17 nt, Escherichia coli CFT073
caucgcaacgcaucuuu

SEQ ID NO: 2599495 - RNA, 16 nt, Escherichia coli CFT073
caucgcagauuucuuc

SEQ ID NO: 2599496 - RNA, 17 nt, Escherichia coli CFT073
caucgcauacgguuucu

SEQ ID NO: 2599497 - RNA, 20 nt, Escherichia coli CFT073
caucgcauacgguuucucca

SEQ ID NO: 2599498 - RNA, 20 nt, Escherichia coli CFT073
caucgcauccggcaaugcgc

SEQ ID NO: 2599499 - RNA, 22 nt, Escherichia coli CFT073
caucgcaucgccuaaauggaaa

SEQ ID NO: 2599500 - RNA, 14 nt, Escherichia coli CFT073
caucgcaugccagc

SEQ ID NO: 2599501 - RNA, 22 nt, Escherichia coli CFT073
caucgcauguugauuaccuguc

SEQ ID NO: 2599502 - RNA, 17 nt, Escherichia coli CFT073
caucgccacggcaugaa

SEQ ID NO: 2599503 - RNA, 14 nt, Escherichia coli CFT073
caucgccacugcaa

SEQ ID NO: 2599504 - RNA, 16 nt, Escherichia coli CFT073
caucgccagcagccau

SEQ ID NO: 2599505 - RNA, 16 nt, Escherichia coli CFT073
caucgccagcucaagg

SEQ ID NO: 2599506 - RNA, 15 nt, Escherichia coli CFT073
caucuggcauucaga

SEQ ID NO: 2599507 - RNA, 16 nt, Escherichia coli CFT073
caucuggcauuuugcu

SEQ ID NO: 2599508 - RNA, 19 nt, Escherichia coli CFT073
caucuggcgauacggugca

SEQ ID NO: 2599509 - RNA, 20 nt, Escherichia coli CFT073
caucugggauuuuguuuaac

SEQ ID NO: 2599510 - RNA, 15 nt, Escherichia coli CFT073
caucugggcugauga

SEQ ID NO: 2599511 - RNA, 21 nt, Escherichia coli CFT073
caucugguaacccauccagca

SEQ ID NO: 2599512 - RNA, 17 nt, Escherichia coli CFT073
caucuggugccagcgcc

SEQ ID NO: 2599513 - RNA, 18 nt, Escherichia coli CFT073
caucugguuccuaaauaa

SEQ ID NO: 2599514 - RNA, 12 nt, Escherichia coli CFT073
caucuguuaucu

SEQ ID NO: 2599515 - RNA, 13 nt, Escherichia coli CFT073
caucuguuuucaa

SEQ ID NO: 2599516 - RNA, 23 nt, Escherichia coli CFT073
caucuuaauagcugccagccccu

SEQ ID NO: 2599517 - RNA, 18 nt, Escherichia coli CFT073
caucuucacuguccgcca

SEQ ID NO: 2599518 - RNA, 19 nt, Escherichia coli CFT073
caucuucacuguccgccag

SEQ ID NO: 2599519 - RNA, 20 nt, Escherichia coli CFT073
caucuucacuguccgccaga

SEQ ID NO: 2599520 - RNA, 12 nt, Escherichia coli CFT073
caucuuccagca

SEQ ID NO: 2599521 - RNA, 20 nt, Escherichia coli CFT073
caucuuccagcgucgggcca

SEQ ID NO: 2599522 - RNA, 13 nt, Escherichia coli CFT073
caucuuccagcug

SEQ ID NO: 2599523 - RNA, 20 nt, Escherichia coli CFT073
caucuuccagcugcacgcca

SEQ ID NO: 2599524 - RNA, 19 nt, Escherichia coli CFT073
caucuucccgcgccagcgc

SEQ ID NO: 2599525 - RNA, 14 nt, Escherichia coli CFT073
caucuuccggagcu

SEQ ID NO: 2599526 - RNA, 18 nt, Escherichia coli CFT073
caucuuccgggcaacaau

SEQ ID NO: 2599527 - RNA, 14 nt, Escherichia coli CFT073
caucuuccggguua

SEQ ID NO: 2599528 - RNA, 17 nt, Escherichia coli CFT073
caucuucggcaauacuu

SEQ ID NO: 2599529 - RNA, 12 nt, Escherichia coli CFT073
caucuucggcgu

SEQ ID NO: 2599530 - RNA, 15 nt, Escherichia coli CFT073
caucuucgucaaaga

SEQ ID NO: 2599531 - RNA, 16 nt, Escherichia coli CFT073
caucuucuccacgcca

SEQ ID NO: 2599532 - RNA, 14 nt, Escherichia coli CFT073
caucuucugaauca

SEQ ID NO: 2599533 - RNA, 13 nt, Escherichia coli CFT073
caucuucugccgg

SEQ ID NO: 2599534 - RNA, 18 nt, Escherichia coli CFT073
caucuucuucaauuuccg

SEQ ID NO: 2599535 - RNA, 17 nt, Escherichia coli CFT073
caucuucuucauucccg

SEQ ID NO: 2599536 - RNA, 16 nt, Escherichia coli CFT073
caucuucuuugcgcca

SEQ ID NO: 2599537 - RNA, 17 nt, Escherichia coli CFT073
caucuucuuugcgccag

SEQ ID NO: 2599538 - RNA, 15 nt, Escherichia coli CFT073
caucuuucagaauca

SEQ ID NO: 2599539 - RNA, 12 nt, Escherichia coli CFT073
caucuuuuucaa

SEQ ID NO: 2599540 - RNA, 15 nt, Escherichia coli CFT073
caucuuuuucaaucc

SEQ ID NO: 2599541 - RNA, 19 nt, Escherichia coli CFT073
caugaaaaauagacacaaa

SEQ ID NO: 2599542 - RNA, 19 nt, Escherichia coli CFT073
caugaaagcgaugcugaug

SEQ ID NO: 2599543 - RNA, 16 nt, Escherichia coli CFT073
caugaacaaaacauac

SEQ ID NO: 2599544 - RNA, 22 nt, Escherichia coli CFT073
caugaacaaaacauacuuucuc

SEQ ID NO: 2599545 - RNA, 15 nt, Escherichia coli CFT073
caugaacauugcugc

SEQ ID NO: 2599546 - RNA, 16 nt, Escherichia coli CFT073
caugaaccgugucgcc

SEQ ID NO: 2599547 - RNA, 15 nt, Escherichia coli CFT073
caugaacgccugauu

SEQ ID NO: 2599548 - RNA, 22 nt, Escherichia coli CFT073
caugaagcacggcaucaaugcc

SEQ ID NO: 2599549 - RNA, 19 nt, Escherichia coli CFT073
caugaagcugacaggcgcu

SEQ ID NO: 2599550 - RNA, 17 nt, Escherichia coli CFT073
caugaauaaaaaaacuu

SEQ ID NO: 2599551 - RNA, 13 nt, Escherichia coli CFT073
caugaaucacgau

SEQ ID NO: 2599552 - RNA, 18 nt, Escherichia coli CFT073
caugaauucgacuuucuc

SEQ ID NO: 2599553 - RNA, 19 nt, Escherichia coli CFT073
caugaauucgacuuucucu

SEQ ID NO: 2599554 - RNA, 19 nt, Escherichia coli CFT073
caugacacacucugaccug

SEQ ID NO: 2599555 - RNA, 15 nt, Escherichia coli CFT073
caugacauucauaaa

SEQ ID NO: 2599556 - RNA, 22 nt, Escherichia coli CFT073
caugaccgaggcgcggcgaucu

SEQ ID NO: 2599557 - RNA, 24 nt, Escherichia coli CFT073
caugaccgaucaaggcauauacca

SEQ ID NO: 2599558 - RNA, 16 nt, Escherichia coli CFT073
caugaccgcuccgcca

SEQ ID NO: 2599559 - RNA, 15 nt, Escherichia coli CFT073
caugaccgugaucgu

SEQ ID NO: 2599560 - RNA, 17 nt, Escherichia coli CFT073
caugaccgugaucgugg

SEQ ID NO: 2599561 - RNA, 18 nt, Escherichia coli CFT073
caugaccgugaucguggc

SEQ ID NO: 2599562 - RNA, 16 nt, Escherichia coli CFT073
caugaccuuccagcgc

SEQ ID NO: 2599563 - RNA, 18 nt, Escherichia coli CFT073
caugaccuuccagcgcug

SEQ ID NO: 2599564 - RNA, 11 nt, Escherichia coli CFT073
caugaccuuuc

SEQ ID NO: 2599565 - RNA, 18 nt, Escherichia coli CFT073
caugacgaugauuguccc

SEQ ID NO: 2599566 - RNA, 18 nt, Escherichia coli CFT073
caugacgaugcagaaaua

SEQ ID NO: 2599567 - RNA, 20 nt, Escherichia coli CFT073
caugacgcacuuucgcuuua

SEQ ID NO: 2599568 - RNA, 15 nt, Escherichia coli CFT073
caugacgcaggcgua

SEQ ID NO: 2599569 - RNA, 23 nt, Escherichia coli CFT073
caugagccgcuugugccaccagc

SEQ ID NO: 2599570 - RNA, 21 nt, Escherichia coli CFT073
caugaguaauuuuucuuucgu

SEQ ID NO: 2599571 - RNA, 16 nt, Escherichia coli CFT073
caugauacaaaacaga

SEQ ID NO: 2599572 - RNA, 18 nt, Escherichia coli CFT073
caugauaccgauuacuca

SEQ ID NO: 2599573 - RNA, 14 nt, Escherichia coli CFT073
caugauacucagca

SEQ ID NO: 2599574 - RNA, 20 nt, Escherichia coli CFT073
caugauacuccacaucauug

SEQ ID NO: 2599575 - RNA, 18 nt, Escherichia coli CFT073
caugaucauucaccagcc

SEQ ID NO: 2599576 - RNA, 21 nt, Escherichia coli CFT073
caugaucauucaccagcccac

SEQ ID NO: 2599577 - RNA, 11 nt, Escherichia coli CFT073
caugaucgaag

SEQ ID NO: 2599578 - RNA, 22 nt, Escherichia coli CFT073
caugaucugcaaauucaauaaa

SEQ ID NO: 2599579 - RNA, 14 nt, Escherichia coli CFT073
caugaugacaacau

SEQ ID NO: 2599580 - RNA, 22 nt, Escherichia coli CFT073
caugaugagcgccauaucggca

SEQ ID NO: 2599581 - RNA, 18 nt, Escherichia coli CFT073
caugaugauaucacuggu

SEQ ID NO: 2599582 - RNA, 23 nt, Escherichia coli CFT073
caugaugcgcggcuccagaauau

SEQ ID NO: 2599583 - RNA, 19 nt, Escherichia coli CFT073
caugaugcuccgccagcgc

SEQ ID NO: 2599584 - RNA, 14 nt, Escherichia coli CFT073
caugauuaccagca

SEQ ID NO: 2599585 - RNA, 15 nt, Escherichia coli CFT073
caugauuaucaugcc

SEQ ID NO: 2599586 - RNA, 13 nt, Escherichia coli CFT073
caugauuccccag

SEQ ID NO: 2599587 - RNA, 17 nt, Escherichia coli CFT073
caugauuccccagccac

SEQ ID NO: 2599588 - RNA, 20 nt, Escherichia coli CFT073
caugauuguauggaaugcgc

SEQ ID NO: 2599589 - RNA, 17 nt, Escherichia coli CFT073
caugauuucaguuggca

SEQ ID NO: 2599590 - RNA, 14 nt, Escherichia coli CFT073
caugauuuucaucu

SEQ ID NO: 2599591 - RNA, 16 nt, Escherichia coli CFT073
caugauuuucaucuuu

SEQ ID NO: 2599592 - RNA, 20 nt, Escherichia coli CFT073
caugauuuucaucuuuugcg

SEQ ID NO: 2599593 - RNA, 16 nt, Escherichia coli CFT073
caugcaaauucaauau

SEQ ID NO: 2599594 - RNA, 17 nt, Escherichia coli CFT073
caugcaaucacugccac

SEQ ID NO: 2599595 - RNA, 17 nt, Escherichia coli CFT073
caugcacauccacgccu

SEQ ID NO: 2599596 - RNA, 21 nt, Escherichia coli CFT073
caugcacgcccgcagcggaau

SEQ ID NO: 2599597 - RNA, 17 nt, Escherichia coli CFT073
caugcagcaacucugcu

SEQ ID NO: 2599598 - RNA, 16 nt, Escherichia coli CFT073
caugcagccccauaug

SEQ ID NO: 2599599 - RNA, 20 nt, Escherichia coli CFT073
caugcaggcaugcaauauuc

SEQ ID NO: 2599600 - RNA, 14 nt, Escherichia coli CFT073
caugcaggcuggcc

SEQ ID NO: 2599601 - RNA, 18 nt, Escherichia coli CFT073
caugcauuuuuguccuca

SEQ ID NO: 2599602 - RNA, 18 nt, Escherichia coli CFT073
caugccaaagaaggaagg

SEQ ID NO: 2599603 - RNA, 15 nt, Escherichia coli CFT073
caugccaaaucaaug

SEQ ID NO: 2599604 - RNA, 22 nt, Escherichia coli CFT073
caugccaacgcggaugaggcgu

SEQ ID NO: 2599605 - RNA, 18 nt, Escherichia coli CFT073
caugccacaguaaaaccg

SEQ ID NO: 2599606 - RNA, 16 nt, Escherichia coli CFT073
caugccaucacaccuc

SEQ ID NO: 2599607 - RNA, 13 nt, Escherichia coli CFT073
caugccaucugcc

SEQ ID NO: 2599608 - RNA, 18 nt, Escherichia coli CFT073
caugcccauuccccagcc

SEQ ID NO: 2599609 - RNA, 21 nt, Escherichia coli CFT073
caugcccggucgggugcucau

SEQ ID NO: 2599610 - RNA, 18 nt, Escherichia coli CFT073
caugcccugcccgcugcc

SEQ ID NO: 2599611 - RNA, 22 nt, Escherichia coli CFT073
caugcccugcgcauuucgcucu

SEQ ID NO: 2599612 - RNA, 14 nt, Escherichia coli CFT073
caugccgaacaggu

SEQ ID NO: 2599613 - RNA, 13 nt, Escherichia coli CFT073
caugccgaaugcc

SEQ ID NO: 2599614 - RNA, 16 nt, Escherichia coli CFT073
caugccgcccagcagc

SEQ ID NO: 2599615 - RNA, 21 nt, Escherichia coli CFT073
cauugcucauuccgccgccca

SEQ ID NO: 2599616 - RNA, 16 nt, Escherichia coli CFT073
cauugcucucuucucc

SEQ ID NO: 2599617 - RNA, 14 nt, Escherichia coli CFT073
cauugcucuuucac

SEQ ID NO: 2599618 - RNA, 17 nt, Escherichia coli CFT073
cauugcucuuucacuuu

SEQ ID NO: 2599619 - RNA, 19 nt, Escherichia coli CFT073
cauugcugaugcaccuuca

SEQ ID NO: 2599620 - RNA, 21 nt, Escherichia coli CFT073
cauugcugaugcaccuucaac

SEQ ID NO: 2599621 - RNA, 18 nt, Escherichia coli CFT073
cauugcugccagaaaucg

SEQ ID NO: 2599622 - RNA, 12 nt, Escherichia coli CFT073
cauugcugguga

SEQ ID NO: 2599623 - RNA, 13 nt, Escherichia coli CFT073
cauugcuuaaagu

SEQ ID NO: 2599624 - RNA, 22 nt, Escherichia coli CFT073
cauugcuuaaaguguuccggcu

SEQ ID NO: 2599625 - RNA, 15 nt, Escherichia coli CFT073
cauugcuuuaagaua

SEQ ID NO: 2599626 - RNA, 14 nt, Escherichia coli CFT073
cauugcuuugguaa

SEQ ID NO: 2599627 - RNA, 20 nt, Escherichia coli CFT073
cauugcuuuuuugauuacag

SEQ ID NO: 2599628 - RNA, 23 nt, Escherichia coli CFT073
cauuggcaggcucugacugauga

SEQ ID NO: 2599629 - RNA, 18 nt, Escherichia coli CFT073
cauuggccggaauaccac

SEQ ID NO: 2599630 - RNA, 22 nt, Escherichia coli CFT073
cauuggccggaauaccacuuuc

SEQ ID NO: 2599631 - RNA, 18 nt, Escherichia coli CFT073
cauuggcggcagaugacu

SEQ ID NO: 2599632 - RNA, 17 nt, Escherichia coli CFT073
cauuggcucaucaaaca

SEQ ID NO: 2599633 - RNA, 19 nt, Escherichia coli CFT073
cauugggccacucaacauc

SEQ ID NO: 2599634 - RNA, 20 nt, Escherichia coli CFT073
cauugguaacguuugccagc

SEQ ID NO: 2599635 - RNA, 20 nt, Escherichia coli CFT073
cauugguaaugggaucgaaa

SEQ ID NO: 2599636 - RNA, 18 nt, Escherichia coli CFT073
cauugguauuccaguuca

SEQ ID NO: 2599637 - RNA, 20 nt, Escherichia coli CFT073
cauugguauuccaguucaga

SEQ ID NO: 2599638 - RNA, 22 nt, Escherichia coli CFT073
cauugguccgauuguacuuuaa

SEQ ID NO: 2599639 - RNA, 21 nt, Escherichia coli CFT073
cauuggucuggauggcuugcu

SEQ ID NO: 2599640 - RNA, 19 nt, Escherichia coli CFT073
cauuguaggccagauaaaa

SEQ ID NO: 2599641 - RNA, 20 nt, Escherichia coli CFT073
cauuguauauugcagcaacg

SEQ ID NO: 2599642 - RNA, 18 nt, Escherichia coli CFT073
cauugucuccagggcgga

SEQ ID NO: 2599643 - RNA, 22 nt, Escherichia coli CFT073
cauugucugaacguucugcugu

SEQ ID NO: 2599644 - RNA, 22 nt, Escherichia coli CFT073
cauugugauguaagcgcauaau

SEQ ID NO: 2599645 - RNA, 15 nt, Escherichia coli CFT073
cauuguggaaaggcc

SEQ ID NO: 2599646 - RNA, 21 nt, Escherichia coli CFT073
cauugugucugauugccggau

SEQ ID NO: 2599647 - RNA, 18 nt, Escherichia coli CFT073
cauuguuccacucuuuca

SEQ ID NO: 2599648 - RNA, 15 nt, Escherichia coli CFT073
cauuguucugcaaau

SEQ ID NO: 2599649 - RNA, 17 nt, Escherichia coli CFT073
cauuuaaaaaucagucg

SEQ ID NO: 2599650 - RNA, 18 nt, Escherichia coli CFT073
cauuuaaacucaccgcuc

SEQ ID NO: 2599651 - RNA, 17 nt, Escherichia coli CFT073
cauuuaacccuucaaga

SEQ ID NO: 2599652 - RNA, 13 nt, Escherichia coli CFT073
cauuuaagccacu

SEQ ID NO: 2599653 - RNA, 20 nt, Escherichia coli CFT073
cauuuacccgauccacugaa

SEQ ID NO: 2599654 - RNA, 22 nt, Escherichia coli CFT073
cauuuagcggccccauuuauuu

SEQ ID NO: 2599655 - RNA, 18 nt, Escherichia coli CFT073
cauuuagcguuaaaauuu

SEQ ID NO: 2599656 - RNA, 17 nt, Escherichia coli CFT073
cauuuaugccauguuca

SEQ ID NO: 2599657 - RNA, 15 nt, Escherichia coli CFT073
cauuuauuucaacga

SEQ ID NO: 2599658 - RNA, 19 nt, Escherichia coli CFT073
cauuuauuugacauuuuuu

SEQ ID NO: 2599659 - RNA, 16 nt, Escherichia coli CFT073
cauuucacguucacgu

SEQ ID NO: 2599660 - RNA, 20 nt, Escherichia coli CFT073
cauuucauaaauuaccacca

SEQ ID NO: 2599661 - RNA, 23 nt, Escherichia coli CFT073
cauuucauaaauuaccaccagcg

SEQ ID NO: 2599662 - RNA, 19 nt, Escherichia coli CFT073
cauuucauauucaaaaucc

SEQ ID NO: 2599663 - RNA, 12 nt, Escherichia coli CFT073
cauuucaucccc

SEQ ID NO: 2599664 - RNA, 19 nt, Escherichia coli CFT073
cauuucaugccgaacaggu

SEQ ID NO: 2599665 - RNA, 12 nt, Escherichia coli CFT073
cauuuccagcgc

SEQ ID NO: 2599666 - RNA, 19 nt, Escherichia coli CFT073
cauuucccagcaagaacca

SEQ ID NO: 2599667 - RNA, 18 nt, Escherichia coli CFT073
cauuuccccaaucuucuc

SEQ ID NO: 2599668 - RNA, 19 nt, Escherichia coli CFT073
cauuuccucaacaucuuca

SEQ ID NO: 2599669 - RNA, 19 nt, Escherichia coli CFT073
cauuucggcccaugacaaa

SEQ ID NO: 2599670 - RNA, 21 nt, Escherichia coli CFT073
cauuucggguguacauaaccg

SEQ ID NO: 2599671 - RNA, 21 nt, Escherichia coli CFT073
cauuucugacgaugguguuua

SEQ ID NO: 2599672 - RNA, 19 nt, Escherichia coli CFT073
cauuucugcaaucgucugc

SEQ ID NO: 2599673 - RNA, 23 nt, Escherichia coli CFT073
cauuucuggcggcgugaugccga

SEQ ID NO: 2599674 - RNA, 14 nt, Escherichia coli CFT073
cauuugaucgcugg

SEQ ID NO: 2599675 - RNA, 17 nt, Escherichia coli CFT073
cauuugcggguucuggc

SEQ ID NO: 2599676 - RNA, 20 nt, Escherichia coli CFT073
cauuuggauugcuauuuaac

SEQ ID NO: 2599677 - RNA, 19 nt, Escherichia coli CFT073
cauuuggcggggauuuuuu

SEQ ID NO: 2599678 - RNA, 21 nt, Escherichia coli CFT073
cauuuggcguaguugcugcgu

SEQ ID NO: 2599679 - RNA, 22 nt, Escherichia coli CFT073
cauuuggucggagauuugaaug

SEQ ID NO: 2599680 - RNA, 14 nt, Escherichia coli CFT073
cauuugucggaugc

SEQ ID NO: 2599681 - RNA, 17 nt, Escherichia coli CFT073
cauuugucggaugcggc

SEQ ID NO: 2599682 - RNA, 15 nt, Escherichia coli CFT073
cauuugugacauuaa

SEQ ID NO: 2599683 - RNA, 17 nt, Escherichia coli CFT073
cauuuguugguacaccu

SEQ ID NO: 2599684 - RNA, 15 nt, Escherichia coli CFT073
cauuuuauccucuuc

SEQ ID NO: 2599685 - RNA, 22 nt, Escherichia coli CFT073
cauuuucagccagggauaagcc

SEQ ID NO: 2599686 - RNA, 13 nt, Escherichia coli CFT073
cauuuucauuuaa

SEQ ID NO: 2599687 - RNA, 13 nt, Escherichia coli CFT073
cauuuucgcuggc

SEQ ID NO: 2599688 - RNA, 11 nt, Escherichia coli CFT073
cauuuucucgc

SEQ ID NO: 2599689 - RNA, 18 nt, Escherichia coli CFT073
cauuuucugcccguuuaa

SEQ ID NO: 2599690 - RNA, 15 nt, Escherichia coli CFT073
cauuuucuucagcag

SEQ ID NO: 2599691 - RNA, 12 nt, Escherichia coli CFT073
cauuuucuuccg

SEQ ID NO: 2599692 - RNA, 16 nt, Escherichia coli CFT073
cauuuugcacauucca

SEQ ID NO: 2599693 - RNA, 20 nt, Escherichia coli CFT073
cauuuugcuguuuaguggua

SEQ ID NO: 2599694 - RNA, 22 nt, Escherichia coli CFT073
cauuuugggcgggaucuccaca

SEQ ID NO: 2599695 - RNA, 14 nt, Escherichia coli CFT073
cauuuuguaggccu

SEQ ID NO: 2599696 - RNA, 15 nt, Escherichia coli CFT073
cauuuuuaauaacuu

SEQ ID NO: 2599697 - RNA, 19 nt, Escherichia coli CFT073
cauuuuuaauaacuuuuag

SEQ ID NO: 2599698 - RNA, 16 nt, Escherichia coli CFT073
cauuuuuaguuuugug

SEQ ID NO: 2599699 - RNA, 15 nt, Escherichia coli CFT073
cauuuuucacugcgg

SEQ ID NO: 2599700 - RNA, 16 nt, Escherichia coli CFT073
cauuuuucagacguuc

SEQ ID NO: 2599701 - RNA, 19 nt, Escherichia coli CFT073
cauuuuucagcguucccca

SEQ ID NO: 2599702 - RNA, 20 nt, Escherichia coli CFT073
cauuuuucagcguuccccag

SEQ ID NO: 2599703 - RNA, 20 nt, Escherichia coli CFT073
cauuuuucggcgucagaacu

SEQ ID NO: 2599704 - RNA, 20 nt, Escherichia coli CFT073
cauuuuuuacucucguucca

SEQ ID NO: 2599705 - RNA, 22 nt, Escherichia coli CFT073
cauuuuuuaucacuucuucuug

SEQ ID NO: 2599706 - RNA, 14 nt, Escherichia coli CFT073
cauuuuuuccccuu

SEQ ID NO: 2599707 - RNA, 15 nt, Escherichia coli CFT073
cauuuuuuccccuua

SEQ ID NO: 2599708 - RNA, 21 nt, Escherichia coli CFT073
cauuuuuuuaaccuaaaugcu

SEQ ID NO: 2599709 - RNA, 18 nt, Escherichia coli CFT073
cauuuuuuugccugcuau

SEQ ID NO: 2599710 - RNA, 23 nt, Escherichia coli CFT073
ccaaaaagaauaaauauccuccg

SEQ ID NO: 2599711 - RNA, 12 nt, Escherichia coli CFT073
ccaaaaagcguc

SEQ ID NO: 2599712 - RNA, 11 nt, Escherichia coli CFT073
ccaaaaagggg

SEQ ID NO: 2599713 - RNA, 22 nt, Escherichia coli CFT073
ccaaaaaggggaaaaauucagg

SEQ ID NO: 2599714 - RNA, 23 nt, Escherichia coli CFT073
ccaaaaaggggaaaaauucaggg

SEQ ID NO: 2599715 - RNA, 13 nt, Escherichia coli CFT073
ccaaaaauaaggc

SEQ ID NO: 2599716 - RNA, 19 nt, Escherichia coli CFT073
ccaaaaaucgacuguggua

SEQ ID NO: 2599717 - RNA, 14 nt, Escherichia coli CFT073
ccaaaacagcgaca

SEQ ID NO: 2599718 - RNA, 16 nt, Escherichia coli CFT073
ccaaaacagcgacacc

SEQ ID NO: 2599719 - RNA, 20 nt, Escherichia coli CFT073
ccaaaacagcgacaccagcc

SEQ ID NO: 2599720 - RNA, 15 nt, Escherichia coli CFT073
ccaaaaccggcucua

SEQ ID NO: 2599721 - RNA, 19 nt, Escherichia coli CFT073
ccaaaacggacauguugcu

SEQ ID NO: 2599722 - RNA, 16 nt, Escherichia coli CFT073
ccaaaacucgcuggcg

SEQ ID NO: 2599723 - RNA, 19 nt, Escherichia coli CFT073
ccaauaaucugcccggcau

SEQ ID NO: 2599724 - RNA, 14 nt, Escherichia coli CFT073
ccaauaccaaaaau

SEQ ID NO: 2599725 - RNA, 14 nt, Escherichia coli CFT073
ccaauaccaaaauc

SEQ ID NO: 2599726 - RNA, 16 nt, Escherichia coli CFT073
ccaauacgauuaacgc

SEQ ID NO: 2599727 - RNA, 23 nt, Escherichia coli CFT073
ccaauagaaagugacagcccggc

SEQ ID NO: 2599728 - RNA, 18 nt, Escherichia coli CFT073
ccaauauugcgcuguuac

SEQ ID NO: 2599729 - RNA, 20 nt, Escherichia coli CFT073
ccaaucaauucucgccagug

SEQ ID NO: 2599730 - RNA, 14 nt, Escherichia coli CFT073
ccaaucagcacaca

SEQ ID NO: 2599731 - RNA, 18 nt, Escherichia coli CFT073
ccaaucagcccugcccag

SEQ ID NO: 2599732 - RNA, 22 nt, Escherichia coli CFT073
ccaaucagcgcagcacccagaa

SEQ ID NO: 2599733 - RNA, 14 nt, Escherichia coli CFT073
ccaaucauaaacgc

SEQ ID NO: 2599734 - RNA, 14 nt, Escherichia coli CFT073
ccaaucccgccaua

SEQ ID NO: 2599735 - RNA, 19 nt, Escherichia coli CFT073
ccaaucccggaagccacca

SEQ ID NO: 2599736 - RNA, 17 nt, Escherichia coli CFT073
ccaaucgagccacgguc

SEQ ID NO: 2599737 - RNA, 13 nt, Escherichia coli CFT073
ccaaucggcagaa

SEQ ID NO: 2599738 - RNA, 17 nt, Escherichia coli CFT073
ccaaucggccauugccc

SEQ ID NO: 2599739 - RNA, 17 nt, Escherichia coli CFT073
ccaaucggcccgcccag

SEQ ID NO: 2599740 - RNA, 23 nt, Escherichia coli CFT073
ccaaucgggaagauaucgugcgg

SEQ ID NO: 2599741 - RNA, 15 nt, Escherichia coli CFT073
ccaaucguucaacca

SEQ ID NO: 2599742 - RNA, 13 nt, Escherichia coli CFT073
ccaaucucccagc

SEQ ID NO: 2599743 - RNA, 15 nt, Escherichia coli CFT073
ccaaugaccacuccg

SEQ ID NO: 2599744 - RNA, 16 nt, Escherichia coli CFT073
ccaaugacuauuugcg

SEQ ID NO: 2599745 - RNA, 19 nt, Escherichia coli CFT073
ccaaugcaggcaucgguga

SEQ ID NO: 2599746 - RNA, 20 nt, Escherichia coli CFT073
ccaaugccaauguagccacg

SEQ ID NO: 2599747 - RNA, 16 nt, Escherichia coli CFT073
ccaaugcugcacccca

SEQ ID NO: 2599748 - RNA, 19 nt, Escherichia coli CFT073
ccaaugcugguaauggcuu

SEQ ID NO: 2599749 - RNA, 23 nt, Escherichia coli CFT073
ccaauggaauagcgaagaauacg

SEQ ID NO: 2599750 - RNA, 19 nt, Escherichia coli CFT073
ccaauggcaggaucuggug

SEQ ID NO: 2599751 - RNA, 22 nt, Escherichia coli CFT073
ccaauggcguauaccugauuac

SEQ ID NO: 2599752 - RNA, 18 nt, Escherichia coli CFT073
ccaauggcuuuugccgcc

SEQ ID NO: 2599753 - RNA, 20 nt, Escherichia coli CFT073
ccaauggucauugucgcggu

SEQ ID NO: 2599754 - RNA, 16 nt, Escherichia coli CFT073
ccaauguaaccacagg

SEQ ID NO: 2599755 - RNA, 17 nt, Escherichia coli CFT073
ccaauguacggaauaag

SEQ ID NO: 2599756 - RNA, 19 nt, Escherichia coli CFT073
ccaauguacggaauaagua

SEQ ID NO: 2599757 - RNA, 22 nt, Escherichia coli CFT073
ccaauguggaaagccccagccc

SEQ ID NO: 2599758 - RNA, 24 nt, Escherichia coli CFT073
ccaauguuacgaccuuccugacgg

SEQ ID NO: 2599759 - RNA, 19 nt, Escherichia coli CFT073
ccaauguucaguuugccca

SEQ ID NO: 2599760 - RNA, 13 nt, Escherichia coli CFT073
ccaauguuuuucu

SEQ ID NO: 2599761 - RNA, 18 nt, Escherichia coli CFT073
ccaauuuaagugguauug

SEQ ID NO: 2599762 - RNA, 18 nt, Escherichia coli CFT073
ccaauuucaucgcugaau

SEQ ID NO: 2599763 - RNA, 23 nt, Escherichia coli CFT073
ccaauuucugugcagccaaaaau

SEQ ID NO: 2599764 - RNA, 16 nt, Escherichia coli CFT073
ccaauuugcgccgccg

SEQ ID NO: 2599765 - RNA, 18 nt, Escherichia coli CFT073
ccacaaaaacaccgcugu

SEQ ID NO: 2599766 - RNA, 16 nt, Escherichia coli CFT073
ccacaaaauaaccgcc

SEQ ID NO: 2599767 - RNA, 12 nt, Escherichia coli CFT073
ccacaaaccacc

SEQ ID NO: 2599768 - RNA, 23 nt, Escherichia coli CFT073
ccacaaaccaugauuccccagcc

SEQ ID NO: 2599769 - RNA, 19 nt, Escherichia coli CFT073
ccacaaauaccccaccgcc

SEQ ID NO: 2599770 - RNA, 17 nt, Escherichia coli CFT073
ccacaacaccuuucacg

SEQ ID NO: 2599771 - RNA, 22 nt, Escherichia coli CFT073
ccacaacaccuuucacgccgaa

SEQ ID NO: 2599772 - RNA, 17 nt, Escherichia coli CFT073
ccacaacgugggccagg

SEQ ID NO: 2599773 - RNA, 13 nt, Escherichia coli CFT073
ccacaacuucaac

SEQ ID NO: 2599774 - RNA, 15 nt, Escherichia coli CFT073
ccacaagcccgccag

SEQ ID NO: 2599775 - RNA, 21 nt, Escherichia coli CFT073
ccacaagcccgccagaccagc

SEQ ID NO: 2599776 - RNA, 24 nt, Escherichia coli CFT073
ccacaagcccgccagaccagcuac

SEQ ID NO: 2599777 - RNA, 22 nt, Escherichia coli CFT073
ccacaauaaagcgauaaauggc

SEQ ID NO: 2599778 - RNA, 19 nt, Escherichia coli CFT073
ccacaauaccaaucgcagg

SEQ ID NO: 2599779 - RNA, 13 nt, Escherichia coli CFT073
ccacaaucaacgc

SEQ ID NO: 2599780 - RNA, 21 nt, Escherichia coli CFT073
ccacaaucaacgccaccauca

SEQ ID NO: 2599781 - RNA, 17 nt, Escherichia coli CFT073
ccacaaucgcagcgcaa

SEQ ID NO: 2599782 - RNA, 21 nt, Escherichia coli CFT073
ccacaaucuuaggggacauuu

SEQ ID NO: 2599783 - RNA, 18 nt, Escherichia coli CFT073
ccacaauggcauauuccg

SEQ ID NO: 2599784 - RNA, 21 nt, Escherichia coli CFT073
ccacaauggcauauuccgcca

SEQ ID NO: 2599785 - RNA, 21 nt, Escherichia coli CFT073
ccacacaaagugcgaggauca

SEQ ID NO: 2599786 - RNA, 23 nt, Escherichia coli CFT073
ccacacaaagugcgaggaucauc

SEQ ID NO: 2599787 - RNA, 23 nt, Escherichia coli CFT073
ccacaccaaucaacaauugcggg

SEQ ID NO: 2599788 - RNA, 16 nt, Escherichia coli CFT073
ccacaccaccaugcua

SEQ ID NO: 2599789 - RNA, 15 nt, Escherichia coli CFT073
ccacaccacgccacu

SEQ ID NO: 2599790 - RNA, 13 nt, Escherichia coli CFT073
ccacaccagacca

SEQ ID NO: 2599791 - RNA, 14 nt, Escherichia coli CFT073
ccacacccgcaaga

SEQ ID NO: 2599792 - RNA, 18 nt, Escherichia coli CFT073
ccacaccgccuaccgcca

SEQ ID NO: 2599793 - RNA, 18 nt, Escherichia coli CFT073
ccacaccuacgcccgcca

SEQ ID NO: 2599794 - RNA, 14 nt, Escherichia coli CFT073
ccacaccugccacc

SEQ ID NO: 2599795 - RNA, 19 nt, Escherichia coli CFT073
ccacaccugccaccagcac

SEQ ID NO: 2599796 - RNA, 14 nt, Escherichia coli CFT073
ccacacgacgccag

SEQ ID NO: 2599797 - RNA, 21 nt, Escherichia coli CFT073
ccacacgacgcgccagcagcg

SEQ ID NO: 2599798 - RNA, 13 nt, Escherichia coli CFT073
ccacacgcgccca

SEQ ID NO: 2599799 - RNA, 17 nt, Escherichia coli CFT073
ccacacgcgcccagccu

SEQ ID NO: 2599800 - RNA, 13 nt, Escherichia coli CFT073
ccacagcaagcag

SEQ ID NO: 2599801 - RNA, 15 nt, Escherichia coli CFT073
ccacagcaaugcauu

SEQ ID NO: 2599802 - RNA, 19 nt, Escherichia coli CFT073
ccacagcaccccauagcca

SEQ ID NO: 2599803 - RNA, 20 nt, Escherichia coli CFT073
ccacagcaccccauagccag

SEQ ID NO: 2599804 - RNA, 18 nt, Escherichia coli CFT073
ccacagcagccuucgcca

SEQ ID NO: 2599805 - RNA, 19 nt, Escherichia coli CFT073
ccacagcagccuucgccac

SEQ ID NO: 2599806 - RNA, 13 nt, Escherichia coli CFT073
ccacagcaguuag

SEQ ID NO: 2599807 - RNA, 23 nt, Escherichia coli CFT073
ccacagcaguuagcuuuucuccu

SEQ ID NO: 2599808 - RNA, 15 nt, Escherichia coli CFT073
ccacagccgagcgcu

SEQ ID NO: 2599809 - RNA, 19 nt, Escherichia coli CFT073
ccacagcgcgucuucaucg

SEQ ID NO: 2599810 - RNA, 15 nt, Escherichia coli CFT073
ccacagcucugcugu

SEQ ID NO: 2599811 - RNA, 14 nt, Escherichia coli CFT073
ccacaggcuggcgu

SEQ ID NO: 2599812 - RNA, 22 nt, Escherichia coli CFT073
ccacaggcuggcgucacgccga

SEQ ID NO: 2599813 - RNA, 22 nt, Escherichia coli CFT073
ccacaguaagccgguaaucacc

SEQ ID NO: 2599814 - RNA, 23 nt, Escherichia coli CFT073
ccacagugacccgcagccagcac

SEQ ID NO: 2599815 - RNA, 14 nt, Escherichia coli CFT073
ccacaguuucauau

SEQ ID NO: 2599816 - RNA, 19 nt, Escherichia coli CFT073
ccacaguuuuacugcagcc

SEQ ID NO: 2599817 - RNA, 16 nt, Escherichia coli CFT073
ccacaguuuuccgcca

SEQ ID NO: 2599818 - RNA, 19 nt, Escherichia coli CFT073
ccacauaaccaaucaucga

SEQ ID NO: 2599819 - RNA, 21 nt, Escherichia coli CFT073
ccacauauguuuaaccggcag

SEQ ID NO: 2599820 - RNA, 15 nt, Escherichia coli CFT073
ccacaucaaucccuu

SEQ ID NO: 2599821 - RNA, 14 nt, Escherichia coli CFT073
ccacaucagcauau

SEQ ID NO: 2599822 - RNA, 17 nt, Escherichia coli CFT073
ccacauccagcggcaga

SEQ ID NO: 2599823 - RNA, 19 nt, Escherichia coli CFT073
ccacaucggcaucaggcca

SEQ ID NO: 2599824 - RNA, 23 nt, Escherichia coli CFT073
ccacaucgguuugcgcagcuuug

SEQ ID NO: 2599825 - RNA, 21 nt, Escherichia coli CFT073
ccacaugaucauucaccagcc

SEQ ID NO: 2599826 - RNA, 23 nt, Escherichia coli CFT073
ccacaugaucauucaccagccca

SEQ ID NO: 2599827 - RNA, 17 nt, Escherichia coli CFT073
ccacaugccugcauaaa

SEQ ID NO: 2599828 - RNA, 20 nt, Escherichia coli CFT073
ccacaugccugcauaaagga

SEQ ID NO: 2599829 - RNA, 16 nt, Escherichia coli CFT073
ccacauggaaugguca

SEQ ID NO: 2599830 - RNA, 18 nt, Escherichia coli CFT073
ccacggaaaggcaguuca

SEQ ID NO: 2599831 - RNA, 21 nt, Escherichia coli CFT073
ccacggacuuaugaguucgcg

SEQ ID NO: 2599832 - RNA, 14 nt, Escherichia coli CFT073
ccacggcagcaacu

SEQ ID NO: 2599833 - RNA, 15 nt, Escherichia coli CFT073
ccacggcaugaaagc

SEQ ID NO: 2599834 - RNA, 14 nt, Escherichia coli CFT073
ccacggcauuuccg

SEQ ID NO: 2599835 - RNA, 21 nt, Escherichia coli CFT073
ccacggcuauaccccaccccg

SEQ ID NO: 2599836 - RNA, 13 nt, Escherichia coli CFT073
ccacggcuccagc

SEQ ID NO: 2599837 - RNA, 14 nt, Escherichia coli CFT073
ccacggcuccagca

SEQ ID NO: 2599838 - RNA, 16 nt, Escherichia coli CFT073
ccacggcucgugcggu

SEQ ID NO: 2599839 - RNA, 14 nt, Escherichia coli CFT073
ccacgggaaauagc

SEQ ID NO: 2599840 - RNA, 18 nt, Escherichia coli CFT073
ccacgguaugacccagcg

SEQ ID NO: 2599841 - RNA, 22 nt, Escherichia coli CFT073
ccacgguuuuuugcagcaacca

SEQ ID NO: 2599842 - RNA, 18 nt, Escherichia coli CFT073
ccacguacugaucuuuuu

SEQ ID NO: 2599843 - RNA, 14 nt, Escherichia coli CFT073
ccacgucacucuuu

SEQ ID NO: 2599844 - RNA, 13 nt, Escherichia coli CFT073
ccacgucaucagc

SEQ ID NO: 2599845 - RNA, 18 nt, Escherichia coli CFT073
ccacgucguuucgugcuc

SEQ ID NO: 2599846 - RNA, 13 nt, Escherichia coli CFT073
ccacgucugaagu

SEQ ID NO: 2599847 - RNA, 23 nt, Escherichia coli CFT073
ccacgugaguguggccaguucca

SEQ ID NO: 2599848 - RNA, 13 nt, Escherichia coli CFT073
ccacguucauuuc

SEQ ID NO: 2599849 - RNA, 22 nt, Escherichia coli CFT073
ccacguuccuggaaccagugaa

SEQ ID NO: 2599850 - RNA, 21 nt, Escherichia coli CFT073
ccacguucggugauauacgcc

SEQ ID NO: 2599851 - RNA, 14 nt, Escherichia coli CFT073
ccacguugcaucac

SEQ ID NO: 2599852 - RNA, 21 nt, Escherichia coli CFT073
ccacguugcaucacccgcugc

SEQ ID NO: 2599853 - RNA, 15 nt, Escherichia coli CFT073
ccacguuuaccgccc

SEQ ID NO: 2599854 - RNA, 14 nt, Escherichia coli CFT073
ccacguuucuucua

SEQ ID NO: 2599855 - RNA, 15 nt, Escherichia coli CFT073
ccacuacaccguacu

SEQ ID NO: 2599856 - RNA, 21 nt, Escherichia coli CFT073
ccacuacagcggaacuuuuuu

SEQ ID NO: 2599857 - RNA, 18 nt, Escherichia coli CFT073
ccacuaccguaguaaauc

SEQ ID NO: 2599858 - RNA, 20 nt, Escherichia coli CFT073
ccacuacgcccgcaaucaac

SEQ ID NO: 2599859 - RNA, 21 nt, Escherichia coli CFT073
ccacuacgcuguagccgccau

SEQ ID NO: 2599860 - RNA, 22 nt, Escherichia coli CFT073
ccacuacuuaauaagcaggcca

SEQ ID NO: 2599861 - RNA, 21 nt, Escherichia coli CFT073
ccacucagcccauaccguggu

SEQ ID NO: 2599862 - RNA, 13 nt, Escherichia coli CFT073
ccacucccgcgcu

SEQ ID NO: 2599863 - RNA, 16 nt, Escherichia coli CFT073
ccacucggacguuuuc

SEQ ID NO: 2599864 - RNA, 20 nt, Escherichia coli CFT073
ccacucgggagagccccagc

SEQ ID NO: 2599865 - RNA, 13 nt, Escherichia coli CFT073
ccacucuccuggu

SEQ ID NO: 2599866 - RNA, 15 nt, Escherichia coli CFT073
ccacucugccaggca

SEQ ID NO: 2599867 - RNA, 15 nt, Escherichia coli CFT073
ccacucuuucagcac

SEQ ID NO: 2599868 - RNA, 18 nt, Escherichia coli CFT073
ccacugacaaucgccagu

SEQ ID NO: 2599869 - RNA, 21 nt, Escherichia coli CFT073
ccacugacacaggcagcaauc

SEQ ID NO: 2599870 - RNA, 15 nt, Escherichia coli CFT073
ccacugaccgcccgg

SEQ ID NO: 2599871 - RNA, 17 nt, Escherichia coli CFT073
ccacugaccgcccggcc

SEQ ID NO: 2599872 - RNA, 22 nt, Escherichia coli CFT073
ccacugacgggaaacucugcug

SEQ ID NO: 2599873 - RNA, 15 nt, Escherichia coli CFT073
ccacugcaaaucacc

SEQ ID NO: 2599874 - RNA, 19 nt, Escherichia coli CFT073
ccacugcauggcggcgucu

SEQ ID NO: 2599875 - RNA, 17 nt, Escherichia coli CFT073
ccacugcgacaccagca

SEQ ID NO: 2599876 - RNA, 19 nt, Escherichia coli CFT073
ccacugcgccaacgucugc

SEQ ID NO: 2599877 - RNA, 16 nt, Escherichia coli CFT073
ccacuggauguugcau

SEQ ID NO: 2599878 - RNA, 19 nt, Escherichia coli CFT073
ccacuggcaacacuuuauc

SEQ ID NO: 2599879 - RNA, 21 nt, Escherichia coli CFT073
ccacuggcaauaauaucccaa

SEQ ID NO: 2599880 - RNA, 12 nt, Escherichia coli CFT073
ccacuggcuguu

SEQ ID NO: 2599881 - RNA, 19 nt, Escherichia coli CFT073
ccacuguuugaucugcugc

SEQ ID NO: 2599882 - RNA, 19 nt, Escherichia coli CFT073
ccacuuaacguuaccuuua

SEQ ID NO: 2599883 - RNA, 21 nt, Escherichia coli CFT073
ccacuucacgaugcagcgucu

SEQ ID NO: 2599884 - RNA, 15 nt, Escherichia coli CFT073
ccacuucaucaagca

SEQ ID NO: 2599885 - RNA, 16 nt, Escherichia coli CFT073
ccacuucaucgucaua

SEQ ID NO: 2599886 - RNA, 14 nt, Escherichia coli CFT073
ccacuuccaccacu

SEQ ID NO: 2599887 - RNA, 21 nt, Escherichia coli CFT073
ccacuuccaccacuuccugcu

SEQ ID NO: 2599888 - RNA, 12 nt, Escherichia coli CFT073
ccacuuccagca

SEQ ID NO: 2599889 - RNA, 17 nt, Escherichia coli CFT073
ccacuucccaacgcugc

SEQ ID NO: 2599890 - RNA, 19 nt, Escherichia coli CFT073
ccacuucccaacgcugcgu

SEQ ID NO: 2599891 - RNA, 14 nt, Escherichia coli CFT073
ccacuuccccucau

SEQ ID NO: 2599892 - RNA, 23 nt, Escherichia coli CFT073
ccacuuccgcgucaaucugcccg

SEQ ID NO: 2599893 - RNA, 14 nt, Escherichia coli CFT073
ccacuuccugcgcc

SEQ ID NO: 2599894 - RNA, 16 nt, Escherichia coli CFT073
ccacuuccugcgccag

SEQ ID NO: 2599895 - RNA, 14 nt, Escherichia coli CFT073
ccacuuccugcgga

SEQ ID NO: 2599896 - RNA, 14 nt, Escherichia coli CFT073
ccacuuccugcucg

SEQ ID NO: 2599897 - RNA, 16 nt, Escherichia coli CFT073
ccacuuccugcucggu

SEQ ID NO: 2599898 - RNA, 20 nt, Escherichia coli CFT073
ccacuucuuccagcggcagg

SEQ ID NO: 2599899 - RNA, 19 nt, Escherichia coli CFT073
ccacuucuuucacgcccgc

SEQ ID NO: 2599900 - RNA, 21 nt, Escherichia coli CFT073
ccacuugagccgccaccagaa

SEQ ID NO: 2599901 - RNA, 22 nt, Escherichia coli CFT073
ccacuuuaaugugucugaaagc

SEQ ID NO: 2599902 - RNA, 15 nt, Escherichia coli CFT073
ccacuuuacgggcaa

SEQ ID NO: 2599903 - RNA, 17 nt, Escherichia coli CFT073
ccacuuuauagcuuuuc

SEQ ID NO: 2599904 - RNA, 22 nt, Escherichia coli CFT073
ccacuuuaugauccagcuuguc

SEQ ID NO: 2599905 - RNA, 16 nt, Escherichia coli CFT073
ccacuuucacgccgcc

SEQ ID NO: 2599906 - RNA, 17 nt, Escherichia coli CFT073
ccacuuucacgccgcca

SEQ ID NO: 2599907 - RNA, 18 nt, Escherichia coli CFT073
ccacuuugcuuucagauu

SEQ ID NO: 2599908 - RNA, 13 nt, Escherichia coli CFT073
ccacuuuggugaa

SEQ ID NO: 2599909 - RNA, 20 nt, Escherichia coli CFT073
ccacuuuggugaaugccuga

SEQ ID NO: 2599910 - RNA, 14 nt, Escherichia coli CFT073
ccacuuuugccgca

SEQ ID NO: 2599911 - RNA, 22 nt, Escherichia coli CFT073
ccacuuuuuauuuacucuccug

SEQ ID NO: 2599912 - RNA, 18 nt, Escherichia coli CFT073
ccacuuuuuucacccaca

SEQ ID NO: 2599913 - RNA, 21 nt, Escherichia coli CFT073
ccacuuuuuucacccacacuu

SEQ ID NO: 2599914 - RNA, 13 nt, Escherichia coli CFT073
ccagaaaaccugg

SEQ ID NO: 2599915 - RNA, 19 nt, Escherichia coli CFT073
ccagaaaaccuggcgcagu

SEQ ID NO: 2599916 - RNA, 20 nt, Escherichia coli CFT073
ccagaaaaggaguuuuuccu

SEQ ID NO: 2599917 - RNA, 16 nt, Escherichia coli CFT073
ccagaaaauacucagc

SEQ ID NO: 2599918 - RNA, 18 nt, Escherichia coli CFT073
ccagaaaauacucagcac

SEQ ID NO: 2599919 - RNA, 22 nt, Escherichia coli CFT073
ccagaaaauacucagcaccccg

SEQ ID NO: 2599920 - RNA, 19 nt, Escherichia coli CFT073
ccagaaaaucacggcaaac

SEQ ID NO: 2599921 - RNA, 20 nt, Escherichia coli CFT073
ccagaaacagaguauaaaaa

SEQ ID NO: 2599922 - RNA, 21 nt, Escherichia coli CFT073
ccagaaacagaguauaaaaaa

SEQ ID NO: 2599923 - RNA, 17 nt, Escherichia coli CFT073
ccagaaaccagccacgg

SEQ ID NO: 2599924 - RNA, 23 nt, Escherichia coli CFT073
ccagaaaccaucuauaaaauccu

SEQ ID NO: 2599925 - RNA, 13 nt, Escherichia coli CFT073
ccagaaaccgugu

SEQ ID NO: 2599926 - RNA, 17 nt, Escherichia coli CFT073
ccagaaacgccaccauu

SEQ ID NO: 2599927 - RNA, 23 nt, Escherichia coli CFT073
ccagaaagacgguuaacgccagc

SEQ ID NO: 2599928 - RNA, 15 nt, Escherichia coli CFT073
ccagaaaguuuuuca

SEQ ID NO: 2599929 - RNA, 20 nt, Escherichia coli CFT073
ccagaaauagaccggagaaa

SEQ ID NO: 2599930 - RNA, 23 nt, Escherichia coli CFT073
ccagaaauagaccggagaaaaga

SEQ ID NO: 2599931 - RNA, 13 nt, Escherichia coli CFT073
ccagaaaucacca

SEQ ID NO: 2599932 - RNA, 20 nt, Escherichia coli CFT073
ccagaacacgcucccagcag

SEQ ID NO: 2599933 - RNA, 12 nt, Escherichia coli CFT073
ccagaacagaaa

SEQ ID NO: 2599934 - RNA, 19 nt, Escherichia coli CFT073
ccagaacagcggagcaaga

SEQ ID NO: 2599935 - RNA, 12 nt, Escherichia coli CFT073
ccagaaccagca

SEQ ID NO: 2599936 - RNA, 18 nt, Escherichia coli CFT073
ccagaaccagcaaccacu

SEQ ID NO: 2599937 - RNA, 21 nt, Escherichia coli CFT073
ccagaaccaguugagugaaua

SEQ ID NO: 2599938 - RNA, 19 nt, Escherichia coli CFT073
ccagaugcgcuuuuaccgu

SEQ ID NO: 2599939 - RNA, 21 nt, Escherichia coli CFT073
ccagaugcggcgugaacgccu

SEQ ID NO: 2599940 - RNA, 21 nt, Escherichia coli CFT073
ccagauggcuuuccaccauca

SEQ ID NO: 2599941 - RNA, 18 nt, Escherichia coli CFT073
ccagauggcuuugcccuu

SEQ ID NO: 2599942 - RNA, 18 nt, Escherichia coli CFT073
ccagauguggugccagug

SEQ ID NO: 2599943 - RNA, 19 nt, Escherichia coli CFT073
ccagauguucuucaauggu

SEQ ID NO: 2599944 - RNA, 16 nt, Escherichia coli CFT073
ccagauuaaucagcag

SEQ ID NO: 2599945 - RNA, 15 nt, Escherichia coli CFT073
ccagauuaauuauug

SEQ ID NO: 2599946 - RNA, 19 nt, Escherichia coli CFT073
ccagauuccugcgucccua

SEQ ID NO: 2599947 - RNA, 18 nt, Escherichia coli CFT073
ccagauucucauauaucc

SEQ ID NO: 2599948 - RNA, 15 nt, Escherichia coli CFT073
ccagauucuccaccu

SEQ ID NO: 2599949 - RNA, 20 nt, Escherichia coli CFT073
ccagauucuccaccugcggc

SEQ ID NO: 2599950 - RNA, 17 nt, Escherichia coli CFT073
ccagauucuccagcauc

SEQ ID NO: 2599951 - RNA, 22 nt, Escherichia coli CFT073
ccagauuguacuuuccagccac

SEQ ID NO: 2599952 - RNA, 21 nt, Escherichia coli CFT073
ccagauugugugacacuucuu

SEQ ID NO: 2599953 - RNA, 22 nt, Escherichia coli CFT073
ccagauugugugacacuucuuc

SEQ ID NO: 2599954 - RNA, 23 nt, Escherichia coli CFT073
ccagauugugugacacuucuucg

SEQ ID NO: 2599955 - RNA, 20 nt, Escherichia coli CFT073
ccagauuguuauccagcugu

SEQ ID NO: 2599956 - RNA, 17 nt, Escherichia coli CFT073
ccagauuuaacggcagc

SEQ ID NO: 2599957 - RNA, 12 nt, Escherichia coli CFT073
ccagauuuucuu

SEQ ID NO: 2599958 - RNA, 18 nt, Escherichia coli CFT073
ccagauuuuucaguauuu

SEQ ID NO: 2599959 - RNA, 14 nt, Escherichia coli CFT073
ccagcaaaaucacc

SEQ ID NO: 2599960 - RNA, 15 nt, Escherichia coli CFT073
ccagcaaaaucacca

SEQ ID NO: 2599961 - RNA, 19 nt, Escherichia coli CFT073
ccagcaaaaucaccaucac

SEQ ID NO: 2599962 - RNA, 23 nt, Escherichia coli CFT073
ccagcaaacgcacuuuuaacgcc

SEQ ID NO: 2599963 - RNA, 21 nt, Escherichia coli CFT073
ccagcaaagagagauccagcu

SEQ ID NO: 2599964 - RNA, 12 nt, Escherichia coli CFT073
ccagcaaagugc

SEQ ID NO: 2599965 - RNA, 14 nt, Escherichia coli CFT073
ccagcaaaucaauc

SEQ ID NO: 2599966 - RNA, 17 nt, Escherichia coli CFT073
ccagcaacaacaacacg

SEQ ID NO: 2599967 - RNA, 20 nt, Escherichia coli CFT073
ccagcaacauuggcucauca

SEQ ID NO: 2599968 - RNA, 23 nt, Escherichia coli CFT073
ccagcaaccaacgcuagcagcag

SEQ ID NO: 2599969 - RNA, 19 nt, Escherichia coli CFT073
ccagcaaccaaugccgcca

SEQ ID NO: 2599970 - RNA, 20 nt, Escherichia coli CFT073
ccagcaaccaaugccgccag

SEQ ID NO: 2599971 - RNA, 14 nt, Escherichia coli CFT073
ccagcaacgcuuca

SEQ ID NO: 2599972 - RNA, 18 nt, Escherichia coli CFT073
ccagcaacguuucgcugg

SEQ ID NO: 2599973 - RNA, 22 nt, Escherichia coli CFT073
ccagcaacguuucgcuggaugu

SEQ ID NO: 2599974 - RNA, 17 nt, Escherichia coli CFT073
ccagcaacugauacacc

SEQ ID NO: 2599975 - RNA, 18 nt, Escherichia coli CFT073
ccagcaacuguaacgcag

SEQ ID NO: 2599976 - RNA, 13 nt, Escherichia coli CFT073
ccagcaagaacca

SEQ ID NO: 2599977 - RNA, 20 nt, Escherichia coli CFT073
ccagcaagagcaaauaaaac

SEQ ID NO: 2599978 - RNA, 21 nt, Escherichia coli CFT073
ccagcaagagcaaauaaaaca

SEQ ID NO: 2599979 - RNA, 21 nt, Escherichia coli CFT073
ccagcaagcugugcgauagca

SEQ ID NO: 2599980 - RNA, 12 nt, Escherichia coli CFT073
ccagcaauacaa

SEQ ID NO: 2599981 - RNA, 14 nt, Escherichia coli CFT073
ccagcaauacaaau

SEQ ID NO: 2599982 - RNA, 16 nt, Escherichia coli CFT073
ccagcaauacaaauga

SEQ ID NO: 2599983 - RNA, 21 nt, Escherichia coli CFT073
ccagcaauacaaaugaguuau

SEQ ID NO: 2599984 - RNA, 14 nt, Escherichia coli CFT073
ccagcaauccccag

SEQ ID NO: 2599985 - RNA, 15 nt, Escherichia coli CFT073
ccagcaauccccaga

SEQ ID NO: 2599986 - RNA, 17 nt, Escherichia coli CFT073
ccagcaauccccagaca

SEQ ID NO: 2599987 - RNA, 20 nt, Escherichia coli CFT073
ccagcaauccccagacaaaa

SEQ ID NO: 2599988 - RNA, 21 nt, Escherichia coli CFT073
ccagcaauuugcgcucaauaa

SEQ ID NO: 2599989 - RNA, 16 nt, Escherichia coli CFT073
ccagcacagccagccu

SEQ ID NO: 2599990 - RNA, 20 nt, Escherichia coli CFT073
ccagcacauaacucauacug

SEQ ID NO: 2599991 - RNA, 22 nt, Escherichia coli CFT073
ccagcacauagccgaaaaugcu

SEQ ID NO: 2599992 - RNA, 16 nt, Escherichia coli CFT073
ccagcacauauucacg

SEQ ID NO: 2599993 - RNA, 23 nt, Escherichia coli CFT073
ccagcacauauucacgggcgcgg

SEQ ID NO: 2599994 - RNA, 20 nt, Escherichia coli CFT073
ccagcacaucaucaaagcca

SEQ ID NO: 2599995 - RNA, 12 nt, Escherichia coli CFT073
ccagcaccagca

SEQ ID NO: 2599996 - RNA, 16 nt, Escherichia coli CFT073
ccagcaccagcaacaa

SEQ ID NO: 2599997 - RNA, 16 nt, Escherichia coli CFT073
ccagcaccaggcuugc

SEQ ID NO: 2599998 - RNA, 11 nt, Escherichia coli CFT073
ccagcaccagu

SEQ ID NO: 2599999 - RNA, 18 nt, Escherichia coli CFT073
ccagcaccgccagcagca

SEQ ID NO: 2600000 - RNA, 15 nt, Escherichia coli CFT073
ccagcaccgcuggcu

SEQ ID NO: 2600001 - RNA, 18 nt, Escherichia coli CFT073
ccagcaccgcuggcucac

SEQ ID NO: 2600002 - RNA, 12 nt, Escherichia coli CFT073
ccagcaccugaa

SEQ ID NO: 2600003 - RNA, 13 nt, Escherichia coli CFT073
ccagcaccugaau

SEQ ID NO: 2600004 - RNA, 20 nt, Escherichia coli CFT073
ccagcacgcaggcaucuuuu

SEQ ID NO: 2600005 - RNA, 20 nt, Escherichia coli CFT073
ccagcacggauaccgcacgc

SEQ ID NO: 2600006 - RNA, 17 nt, Escherichia coli CFT073
ccagcacguugugcccu

SEQ ID NO: 2600007 - RNA, 20 nt, Escherichia coli CFT073
ccagcacguugugcccuucc

SEQ ID NO: 2600008 - RNA, 16 nt, Escherichia coli CFT073
ccagcacugccagcca

SEQ ID NO: 2600009 - RNA, 12 nt, Escherichia coli CFT073
ccagcacugccg

SEQ ID NO: 2600010 - RNA, 15 nt, Escherichia coli CFT073
ccagcacuucgcugg

SEQ ID NO: 2600011 - RNA, 18 nt, Escherichia coli CFT073
ccagcacuuuaaccugca

SEQ ID NO: 2600012 - RNA, 13 nt, Escherichia coli CFT073
ccagcagagauac

SEQ ID NO: 2600013 - RNA, 18 nt, Escherichia coli CFT073
ccagcagagaucuuucac

SEQ ID NO: 2600014 - RNA, 20 nt, Escherichia coli CFT073
ccagcagaugcugugccucc

SEQ ID NO: 2600015 - RNA, 12 nt, Escherichia coli CFT073
ccagcagauggc

SEQ ID NO: 2600016 - RNA, 13 nt, Escherichia coli CFT073
ccagcagcaacca

SEQ ID NO: 2600017 - RNA, 14 nt, Escherichia coli CFT073
ccagcagcaaccau

SEQ ID NO: 2600018 - RNA, 22 nt, Escherichia coli CFT073
ccagcagcgaaucagcccagcc

SEQ ID NO: 2600019 - RNA, 22 nt, Escherichia coli CFT073
ccagcagcgcaaagcccgccgc

SEQ ID NO: 2600020 - RNA, 14 nt, Escherichia coli CFT073
ccagcagcucccug

SEQ ID NO: 2600021 - RNA, 18 nt, Escherichia coli CFT073
ccagcagcugcucccagc

SEQ ID NO: 2600022 - RNA, 21 nt, Escherichia coli CFT073
ccagcagcugcucccagcgca

SEQ ID NO: 2600023 - RNA, 13 nt, Escherichia coli CFT073
ccagcagcuucac

SEQ ID NO: 2600024 - RNA, 17 nt, Escherichia coli CFT073
ccagcaggaacgagaac

SEQ ID NO: 2600025 - RNA, 21 nt, Escherichia coli CFT073
ccagcaggaagcggcucggcu

SEQ ID NO: 2600026 - RNA, 20 nt, Escherichia coli CFT073
ccagcaggaaucccaucaga

SEQ ID NO: 2600027 - RNA, 18 nt, Escherichia coli CFT073
ccagcagggcaaucgcgc

SEQ ID NO: 2600028 - RNA, 17 nt, Escherichia coli CFT073
ccagcaggugauacauc

SEQ ID NO: 2600029 - RNA, 17 nt, Escherichia coli CFT073
ccagcaguacaguaccg

SEQ ID NO: 2600030 - RNA, 15 nt, Escherichia coli CFT073
ccagcaguccccagg

SEQ ID NO: 2600031 - RNA, 17 nt, Escherichia coli CFT073
ccagcaguuccagcaua

SEQ ID NO: 2600032 - RNA, 22 nt, Escherichia coli CFT073
ccagcaguucgcccgcuucauc

SEQ ID NO: 2600033 - RNA, 12 nt, Escherichia coli CFT073
ccagcaguugcu

SEQ ID NO: 2600034 - RNA, 13 nt, Escherichia coli CFT073
ccagcaguuugau

SEQ ID NO: 2600035 - RNA, 20 nt, Escherichia coli CFT073
ccagcauaacuaauuccgcu

SEQ ID NO: 2600036 - RNA, 13 nt, Escherichia coli CFT073
ccagcauaaucac

SEQ ID NO: 2600037 - RNA, 15 nt, Escherichia coli CFT073
ccagcauaccuucca

SEQ ID NO: 2600038 - RNA, 15 nt, Escherichia coli CFT073
ccagcaucaacaaca

SEQ ID NO: 2600039 - RNA, 18 nt, Escherichia coli CFT073
ccagcaucacgcccgcuu

SEQ ID NO: 2600040 - RNA, 15 nt, Escherichia coli CFT073
ccagcaucagaccca

SEQ ID NO: 2600041 - RNA, 22 nt, Escherichia coli CFT073
ccagcaucagauggggauggcg

SEQ ID NO: 2600042 - RNA, 14 nt, Escherichia coli CFT073
ccagcaucauaaau

SEQ ID NO: 2600043 - RNA, 17 nt, Escherichia coli CFT073
ccagcaucgaccaggau

SEQ ID NO: 2600044 - RNA, 15 nt, Escherichia coli CFT073
ccagcaucggcaacg

SEQ ID NO: 2600045 - RNA, 17 nt, Escherichia coli CFT073
ccagcaucggcaacgcc

SEQ ID NO: 2600046 - RNA, 18 nt, Escherichia coli CFT073
ccagcguagugaaggcaa

SEQ ID NO: 2600047 - RNA, 18 nt, Escherichia coli CFT073
ccagcgucagcagcaaua

SEQ ID NO: 2600048 - RNA, 15 nt, Escherichia coli CFT073
ccagcgucagcagga

SEQ ID NO: 2600049 - RNA, 11 nt, Escherichia coli CFT073
ccagcgucagu

SEQ ID NO: 2600050 - RNA, 22 nt, Escherichia coli CFT073
ccagcgucaucaauccugcagc

SEQ ID NO: 2600051 - RNA, 17 nt, Escherichia coli CFT073
ccagcgucgccagcaga

SEQ ID NO: 2600052 - RNA, 18 nt, Escherichia coli CFT073
ccagcgucgggccacgcu

SEQ ID NO: 2600053 - RNA, 22 nt, Escherichia coli CFT073
ccagcgucguauccagcguuau

SEQ ID NO: 2600054 - RNA, 17 nt, Escherichia coli CFT073
ccagcguggucauggca

SEQ ID NO: 2600055 - RNA, 19 nt, Escherichia coli CFT073
ccagcguguugaggaagcg

SEQ ID NO: 2600056 - RNA, 14 nt, Escherichia coli CFT073
ccagcguguugccg

SEQ ID NO: 2600057 - RNA, 17 nt, Escherichia coli CFT073
ccagcguguugccgcuu

SEQ ID NO: 2600058 - RNA, 16 nt, Escherichia coli CFT073
ccagcguguuggcccc

SEQ ID NO: 2600059 - RNA, 23 nt, Escherichia coli CFT073
ccagcguuaauuuccucuucccg

SEQ ID NO: 2600060 - RNA, 17 nt, Escherichia coli CFT073
ccagcguuacccagaca

SEQ ID NO: 2600061 - RNA, 21 nt, Escherichia coli CFT073
ccagcguuacccagacaaaau

SEQ ID NO: 2600062 - RNA, 15 nt, Escherichia coli CFT073
ccagcguuaccggcu

SEQ ID NO: 2600063 - RNA, 20 nt, Escherichia coli CFT073
ccagcguuauaaaacacauu

SEQ ID NO: 2600064 - RNA, 21 nt, Escherichia coli CFT073
ccagcguuuaucaauauccag

SEQ ID NO: 2600065 - RNA, 18 nt, Escherichia coli CFT073
ccagcuaaucgagccgau

SEQ ID NO: 2600066 - RNA, 21 nt, Escherichia coli CFT073
ccagcucaagugccagaucag

SEQ ID NO: 2600067 - RNA, 21 nt, Escherichia coli CFT073
ccagcuccacacgcucuucca

SEQ ID NO: 2600068 - RNA, 12 nt, Escherichia coli CFT073
ccagcuccagcc

SEQ ID NO: 2600069 - RNA, 18 nt, Escherichia coli CFT073
ccagcuccggcacuuccc

SEQ ID NO: 2600070 - RNA, 18 nt, Escherichia coli CFT073
ccagcuccguccagccac

SEQ ID NO: 2600071 - RNA, 21 nt, Escherichia coli CFT073
ccagcucgcgauacgcuucaa

SEQ ID NO: 2600072 - RNA, 19 nt, Escherichia coli CFT073
ccagcucggggugguuguc

SEQ ID NO: 2600073 - RNA, 22 nt, Escherichia coli CFT073
ccagcucugcgcccugcaucac

SEQ ID NO: 2600074 - RNA, 18 nt, Escherichia coli CFT073
ccagcucuuccucgcucu

SEQ ID NO: 2600075 - RNA, 16 nt, Escherichia coli CFT073
ccagcucuucuggauc

SEQ ID NO: 2600076 - RNA, 21 nt, Escherichia coli CFT073
ccagcucuuuaccugacagac

SEQ ID NO: 2600077 - RNA, 22 nt, Escherichia coli CFT073
ccagcugaaaucaccgccacca

SEQ ID NO: 2600078 - RNA, 21 nt, Escherichia coli CFT073
ccagcugauguagucauacug

SEQ ID NO: 2600079 - RNA, 21 nt, Escherichia coli CFT073
ccagcugccgaaccacugaug

SEQ ID NO: 2600080 - RNA, 18 nt, Escherichia coli CFT073
ccagcugcucgcgagaac

SEQ ID NO: 2600081 - RNA, 19 nt, Escherichia coli CFT073
ccagcuggcgccaggcuuc

SEQ ID NO: 2600082 - RNA, 15 nt, Escherichia coli CFT073
ccagcuguccgauuu

SEQ ID NO: 2600083 - RNA, 16 nt, Escherichia coli CFT073
ccagcuguccgauuug

SEQ ID NO: 2600084 - RNA, 18 nt, Escherichia coli CFT073
ccagcuuaacauccccau

SEQ ID NO: 2600085 - RNA, 14 nt, Escherichia coli CFT073
ccagcuucagauuc

SEQ ID NO: 2600086 - RNA, 19 nt, Escherichia coli CFT073
ccagcuuccaggcaaucag

SEQ ID NO: 2600087 - RNA, 21 nt, Escherichia coli CFT073
ccagcuucgcuucccaacgca

SEQ ID NO: 2600088 - RNA, 11 nt, Escherichia coli CFT073
ccagcuugaag

SEQ ID NO: 2600089 - RNA, 15 nt, Escherichia coli CFT073
ccagcuugccuucac

SEQ ID NO: 2600090 - RNA, 21 nt, Escherichia coli CFT073
ccagcuugccuucacaggccg

SEQ ID NO: 2600091 - RNA, 17 nt, Escherichia coli CFT073
ccagcuugcgacaugcg

SEQ ID NO: 2600092 - RNA, 14 nt, Escherichia coli CFT073
ccagcuuuugacca

SEQ ID NO: 2600093 - RNA, 19 nt, Escherichia coli CFT073
ccagcuuuuuuggcagcgu

SEQ ID NO: 2600094 - RNA, 13 nt, Escherichia coli CFT073
ccaggaaacccaa

SEQ ID NO: 2600095 - RNA, 16 nt, Escherichia coli CFT073
ccaggaacaacgacag

SEQ ID NO: 2600096 - RNA, 18 nt, Escherichia coli CFT073
ccaggaacaacgacaggc

SEQ ID NO: 2600097 - RNA, 15 nt, Escherichia coli CFT073
ccaggaacagugaaa

SEQ ID NO: 2600098 - RNA, 21 nt, Escherichia coli CFT073
ccaggaaccugugacagcagc

SEQ ID NO: 2600099 - RNA, 23 nt, Escherichia coli CFT073
ccaggaaccugugacagcagcgg

SEQ ID NO: 2600100 - RNA, 13 nt, Escherichia coli CFT073
ccaggaacgccau

SEQ ID NO: 2600101 - RNA, 21 nt, Escherichia coli CFT073
ccaggaacgcgccaagauaga

SEQ ID NO: 2600102 - RNA, 13 nt, Escherichia coli CFT073
ccaggaacucagc

SEQ ID NO: 2600103 - RNA, 12 nt, Escherichia coli CFT073
ccaggaagccuu

SEQ ID NO: 2600104 - RNA, 13 nt, Escherichia coli CFT073
ccaggaagccuuc

SEQ ID NO: 2600105 - RNA, 17 nt, Escherichia coli CFT073
ccaggacaucagcgcac

SEQ ID NO: 2600106 - RNA, 23 nt, Escherichia coli CFT073
ccaggaccacuggcgacgccgga

SEQ ID NO: 2600107 - RNA, 15 nt, Escherichia coli CFT073
ccaggacgauaaacc

SEQ ID NO: 2600108 - RNA, 20 nt, Escherichia coli CFT073
ccaggacuggcgauaucaau

SEQ ID NO: 2600109 - RNA, 16 nt, Escherichia coli CFT073
ccaggagguauuauuc

SEQ ID NO: 2600110 - RNA, 19 nt, Escherichia coli CFT073
ccaggagucuuucagacug

SEQ ID NO: 2600111 - RNA, 21 nt, Escherichia coli CFT073
ccaggagucuuucagacugag

SEQ ID NO: 2600112 - RNA, 23 nt, Escherichia coli CFT073
ccaggagucuuucagacugagau

SEQ ID NO: 2600113 - RNA, 19 nt, Escherichia coli CFT073
ccaggaguuacugcaacga

SEQ ID NO: 2600114 - RNA, 14 nt, Escherichia coli CFT073
ccaggaucagcaaa

SEQ ID NO: 2600115 - RNA, 15 nt, Escherichia coli CFT073
ccaggaugcuucaac

SEQ ID NO: 2600116 - RNA, 20 nt, Escherichia coli CFT073
ccaggcaaaauccuuccagc

SEQ ID NO: 2600117 - RNA, 14 nt, Escherichia coli CFT073
ccaggcaaaccagu

SEQ ID NO: 2600118 - RNA, 15 nt, Escherichia coli CFT073
ccaggcaaaccagua

SEQ ID NO: 2600119 - RNA, 21 nt, Escherichia coli CFT073
ccaggcaagaauccgccccgc

SEQ ID NO: 2600120 - RNA, 20 nt, Escherichia coli CFT073
ccaggcaaguagcgccagac

SEQ ID NO: 2600121 - RNA, 22 nt, Escherichia coli CFT073
ccaggcaaguagcgccagacug

SEQ ID NO: 2600122 - RNA, 16 nt, Escherichia coli CFT073
ccaggcaauaaacauc

SEQ ID NO: 2600123 - RNA, 21 nt, Escherichia coli CFT073
ccaggcaaugacaucgcccuc

SEQ ID NO: 2600124 - RNA, 15 nt, Escherichia coli CFT073
ccaggcacaccagca

SEQ ID NO: 2600125 - RNA, 18 nt, Escherichia coli CFT073
ccaggcacaccagcaaua

SEQ ID NO: 2600126 - RNA, 13 nt, Escherichia coli CFT073
ccaggcaccaaaa

SEQ ID NO: 2600127 - RNA, 14 nt, Escherichia coli CFT073
ccaggcacuggccu

SEQ ID NO: 2600128 - RNA, 12 nt, Escherichia coli CFT073
ccaggcauagaa

SEQ ID NO: 2600129 - RNA, 13 nt, Escherichia coli CFT073
ccaggcauagaaa

SEQ ID NO: 2600130 - RNA, 14 nt, Escherichia coli CFT073
ccaggcauagaaaa

SEQ ID NO: 2600131 - RNA, 11 nt, Escherichia coli CFT073
ccaggcaucca

SEQ ID NO: 2600132 - RNA, 13 nt, Escherichia coli CFT073
ccaggcauccagu

SEQ ID NO: 2600133 - RNA, 18 nt, Escherichia coli CFT073
ccaggcauccaguugcau

SEQ ID NO: 2600134 - RNA, 13 nt, Escherichia coli CFT073
ccaggccaucagc

SEQ ID NO: 2600135 - RNA, 14 nt, Escherichia coli CFT073
ccaggccaucgcca

SEQ ID NO: 2600136 - RNA, 21 nt, Escherichia coli CFT073
ccaggccgauagacacugccg

SEQ ID NO: 2600137 - RNA, 22 nt, Escherichia coli CFT073
ccaggccgauagacacugccgc

SEQ ID NO: 2600138 - RNA, 18 nt, Escherichia coli CFT073
ccaggccgguaacgcuuu

SEQ ID NO: 2600139 - RNA, 22 nt, Escherichia coli CFT073
ccaggcgaagacaaaaccaacg

SEQ ID NO: 2600140 - RNA, 19 nt, Escherichia coli CFT073
ccaggcgcgagaagaucca

SEQ ID NO: 2600141 - RNA, 13 nt, Escherichia coli CFT073
ccaggcgcugaac

SEQ ID NO: 2600142 - RNA, 21 nt, Escherichia coli CFT073
ccaggcgcugaacuuccggga

SEQ ID NO: 2600143 - RNA, 22 nt, Escherichia coli CFT073
ccaggcggguacguuucgccug

SEQ ID NO: 2600144 - RNA, 23 nt, Escherichia coli CFT073
ccaggcgucuggcccaugccagu

SEQ ID NO: 2600145 - RNA, 14 nt, Escherichia coli CFT073
ccaggcguggauac

SEQ ID NO: 2600146 - RNA, 20 nt, Escherichia coli CFT073
ccaggcuggucgcgcggaag

SEQ ID NO: 2600147 - RNA, 20 nt, Escherichia coli CFT073
ccaggcuuaauugcgcagcg

SEQ ID NO: 2600148 - RNA, 20 nt, Escherichia coli CFT073
ccaggcuuacacuuccuuua

SEQ ID NO: 2600149 - RNA, 23 nt, Escherichia coli CFT073
ccaggcuuacacuuccuuuacuu

SEQ ID NO: 2600150 - RNA, 17 nt, Escherichia coli CFT073
ccagggaaacagccacc

SEQ ID NO: 2600151 - RNA, 15 nt, Escherichia coli CFT073
ccagggaaauaaucg

SEQ ID NO: 2600152 - RNA, 14 nt, Escherichia coli CFT073
ccagggaagauguu

SEQ ID NO: 2600153 - RNA, 15 nt, Escherichia coli CFT073
ccagggauaaagccc

SEQ ID NO: 2600154 - RNA, 20 nt, Escherichia coli CFT073
ccaguggcauuuucugcccg

SEQ ID NO: 2600155 - RNA, 17 nt, Escherichia coli CFT073
ccagugguacaaaagca

SEQ ID NO: 2600156 - RNA, 21 nt, Escherichia coli CFT073
ccagugguuaccgaauccagc

SEQ ID NO: 2600157 - RNA, 15 nt, Escherichia coli CFT073
ccaguguuuuaccgg

SEQ ID NO: 2600158 - RNA, 16 nt, Escherichia coli CFT073
ccaguuaacgccgcgc

SEQ ID NO: 2600159 - RNA, 19 nt, Escherichia coli CFT073
ccaguuaagcgaguuauug

SEQ ID NO: 2600160 - RNA, 19 nt, Escherichia coli CFT073
ccaguuaccaccgccagau

SEQ ID NO: 2600161 - RNA, 20 nt, Escherichia coli CFT073
ccaguuaccaccgccagauu

SEQ ID NO: 2600162 - RNA, 13 nt, Escherichia coli CFT073
ccaguuaucacga

SEQ ID NO: 2600163 - RNA, 18 nt, Escherichia coli CFT073
ccaguucaccaccuggcg

SEQ ID NO: 2600164 - RNA, 23 nt, Escherichia coli CFT073
ccaguucacgcgauuuuucaucg

SEQ ID NO: 2600165 - RNA, 19 nt, Escherichia coli CFT073
ccaguucaguaaaaccauu

SEQ ID NO: 2600166 - RNA, 21 nt, Escherichia coli CFT073
ccaguucauguucgacaugcu

SEQ ID NO: 2600167 - RNA, 17 nt, Escherichia coli CFT073
ccaguuccacuucugca

SEQ ID NO: 2600168 - RNA, 12 nt, Escherichia coli CFT073
ccaguucccccu

SEQ ID NO: 2600169 - RNA, 16 nt, Escherichia coli CFT073
ccaguucccccugcca

SEQ ID NO: 2600170 - RNA, 19 nt, Escherichia coli CFT073
ccaguuccccgcgauugau

SEQ ID NO: 2600171 - RNA, 23 nt, Escherichia coli CFT073
ccaguuccuuaacuucaucggca

SEQ ID NO: 2600172 - RNA, 20 nt, Escherichia coli CFT073
ccaguucgcuggcauugcca

SEQ ID NO: 2600173 - RNA, 20 nt, Escherichia coli CFT073
ccaguucgcuuugaaugugc

SEQ ID NO: 2600174 - RNA, 15 nt, Escherichia coli CFT073
ccaguucuagugcua

SEQ ID NO: 2600175 - RNA, 14 nt, Escherichia coli CFT073
ccaguugagugaau

SEQ ID NO: 2600176 - RNA, 22 nt, Escherichia coli CFT073
ccaguugaugaccagugcagau

SEQ ID NO: 2600177 - RNA, 18 nt, Escherichia coli CFT073
ccaguugcauacauaaau

SEQ ID NO: 2600178 - RNA, 16 nt, Escherichia coli CFT073
ccaguugccgacgcuc

SEQ ID NO: 2600179 - RNA, 22 nt, Escherichia coli CFT073
ccaguugcgcaacguaucaucg

SEQ ID NO: 2600180 - RNA, 14 nt, Escherichia coli CFT073
ccaguugcguaaua

SEQ ID NO: 2600181 - RNA, 23 nt, Escherichia coli CFT073
ccaguugugaugauuuugcgcca

SEQ ID NO: 2600182 - RNA, 20 nt, Escherichia coli CFT073
ccaguugugaugccacuuca

SEQ ID NO: 2600183 - RNA, 14 nt, Escherichia coli CFT073
ccaguugugcugcc

SEQ ID NO: 2600184 - RNA, 19 nt, Escherichia coli CFT073
ccaguugugcugccagcca

SEQ ID NO: 2600185 - RNA, 20 nt, Escherichia coli CFT073
ccaguugugucagugcgcga

SEQ ID NO: 2600186 - RNA, 15 nt, Escherichia coli CFT073
ccaguuuaugccugu

SEQ ID NO: 2600187 - RNA, 19 nt, Escherichia coli CFT073
ccaguuuauggaacaacac

SEQ ID NO: 2600188 - RNA, 13 nt, Escherichia coli CFT073
ccaguuucacagg

SEQ ID NO: 2600189 - RNA, 15 nt, Escherichia coli CFT073
ccaguuuccaccaga

SEQ ID NO: 2600190 - RNA, 13 nt, Escherichia coli CFT073
ccaguuucgccag

SEQ ID NO: 2600191 - RNA, 14 nt, Escherichia coli CFT073
ccaguuucuguacc

SEQ ID NO: 2600192 - RNA, 14 nt, Escherichia coli CFT073
ccaguuucuucagg

SEQ ID NO: 2600193 - RNA, 16 nt, Escherichia coli CFT073
ccaguuuggucuggca

SEQ ID NO: 2600194 - RNA, 20 nt, Escherichia coli CFT073
ccaguuuggugacgccacaa

SEQ ID NO: 2600195 - RNA, 19 nt, Escherichia coli CFT073
ccauaaaaaaacccgccga

SEQ ID NO: 2600196 - RNA, 24 nt, Escherichia coli CFT073
ccauaaaacucgauggcguuuucc

SEQ ID NO: 2600197 - RNA, 21 nt, Escherichia coli CFT073
ccauaaaaggcaccuggaaau

SEQ ID NO: 2600198 - RNA, 15 nt, Escherichia coli CFT073
ccauaaaaucacagg

SEQ ID NO: 2600199 - RNA, 18 nt, Escherichia coli CFT073
ccauaaaaucacaggucg

SEQ ID NO: 2600200 - RNA, 16 nt, Escherichia coli CFT073
ccauaaacaccagcag

SEQ ID NO: 2600201 - RNA, 22 nt, Escherichia coli CFT073
ccauaaaccgcaucauguaaau

SEQ ID NO: 2600202 - RNA, 14 nt, Escherichia coli CFT073
ccauaaacuucauu

SEQ ID NO: 2600203 - RNA, 16 nt, Escherichia coli CFT073
ccauaaagauguaauc

SEQ ID NO: 2600204 - RNA, 20 nt, Escherichia coli CFT073
ccauaaagauguaaucgccu

SEQ ID NO: 2600205 - RNA, 22 nt, Escherichia coli CFT073
ccauaaagguaccgacgaucaa

SEQ ID NO: 2600206 - RNA, 14 nt, Escherichia coli CFT073
ccauaacaaauauc

SEQ ID NO: 2600207 - RNA, 19 nt, Escherichia coli CFT073
ccauaacccacaccauaau

SEQ ID NO: 2600208 - RNA, 17 nt, Escherichia coli CFT073
ccauaaccgccagcaca

SEQ ID NO: 2600209 - RNA, 20 nt, Escherichia coli CFT073
ccauaaccgccagcacagcc

SEQ ID NO: 2600210 - RNA, 23 nt, Escherichia coli CFT073
ccauaaccggccuguaaggaaua

SEQ ID NO: 2600211 - RNA, 21 nt, Escherichia coli CFT073
ccauaacgacccaacuuuguu

SEQ ID NO: 2600212 - RNA, 16 nt, Escherichia coli CFT073
ccauaagugcgucauu

SEQ ID NO: 2600213 - RNA, 19 nt, Escherichia coli CFT073
ccauaauaaccucaugguu

SEQ ID NO: 2600214 - RNA, 11 nt, Escherichia coli CFT073
ccauaauauuu

SEQ ID NO: 2600215 - RNA, 16 nt, Escherichia coli CFT073
ccauaaucaaauaaau

SEQ ID NO: 2600216 - RNA, 15 nt, Escherichia coli CFT073
ccauaaucaaugcca

SEQ ID NO: 2600217 - RNA, 17 nt, Escherichia coli CFT073
ccauaaucaaugccagg

SEQ ID NO: 2600218 - RNA, 11 nt, Escherichia coli CFT073
ccauaaucugc

SEQ ID NO: 2600219 - RNA, 16 nt, Escherichia coli CFT073
ccauaaucugcgggua

SEQ ID NO: 2600220 - RNA, 21 nt, Escherichia coli CFT073
ccauacauugcggaccagcgg

SEQ ID NO: 2600221 - RNA, 20 nt, Escherichia coli CFT073
ccauaccacuuccagcagac

SEQ ID NO: 2600222 - RNA, 21 nt, Escherichia coli CFT073
ccauacccaccaauuaauccc

SEQ ID NO: 2600223 - RNA, 17 nt, Escherichia coli CFT073
ccauaccgucgccagac

SEQ ID NO: 2600224 - RNA, 16 nt, Escherichia coli CFT073
ccauaccuggugcagc

SEQ ID NO: 2600225 - RNA, 18 nt, Escherichia coli CFT073
ccauacggcucagcucug

SEQ ID NO: 2600226 - RNA, 19 nt, Escherichia coli CFT073
ccauacggucugccagucg

SEQ ID NO: 2600227 - RNA, 22 nt, Escherichia coli CFT073
ccauacgucggugcagcaugau

SEQ ID NO: 2600228 - RNA, 21 nt, Escherichia coli CFT073
ccauacucacaucaacaacga

SEQ ID NO: 2600229 - RNA, 23 nt, Escherichia coli CFT073
ccauacucguugacgaccagucc

SEQ ID NO: 2600230 - RNA, 19 nt, Escherichia coli CFT073
ccauacuguucggacggcg

SEQ ID NO: 2600231 - RNA, 21 nt, Escherichia coli CFT073
ccauagcccaugcaucggcca

SEQ ID NO: 2600232 - RNA, 15 nt, Escherichia coli CFT073
ccauagggcgugaag

SEQ ID NO: 2600233 - RNA, 12 nt, Escherichia coli CFT073
ccauauaaacau

SEQ ID NO: 2600234 - RNA, 19 nt, Escherichia coli CFT073
ccauauaaacauaucacuu

SEQ ID NO: 2600235 - RNA, 23 nt, Escherichia coli CFT073
ccauauaaacauaucacuuuuau

SEQ ID NO: 2600236 - RNA, 23 nt, Escherichia coli CFT073
ccauauaccgcgguucccagcgu

SEQ ID NO: 2600237 - RNA, 19 nt, Escherichia coli CFT073
ccauaucaucaauaugaau

SEQ ID NO: 2600238 - RNA, 23 nt, Escherichia coli CFT073
ccauauccaccggaauggucagu

SEQ ID NO: 2600239 - RNA, 22 nt, Escherichia coli CFT073
ccauauccagcgcaguuuuucc

SEQ ID NO: 2600240 - RNA, 18 nt, Escherichia coli CFT073
ccauaucgccauugcugg

SEQ ID NO: 2600241 - RNA, 18 nt, Escherichia coli CFT073
ccauaucgcuggcugcag

SEQ ID NO: 2600242 - RNA, 16 nt, Escherichia coli CFT073
ccauaucuauuacagc

SEQ ID NO: 2600243 - RNA, 20 nt, Escherichia coli CFT073
ccauaugcagcacuugcagc

SEQ ID NO: 2600244 - RNA, 21 nt, Escherichia coli CFT073
ccauaugcagccacugcugcg

SEQ ID NO: 2600245 - RNA, 16 nt, Escherichia coli CFT073
ccauauggcugcaucc

SEQ ID NO: 2600246 - RNA, 17 nt, Escherichia coli CFT073
ccauauggcugcaucca

SEQ ID NO: 2600247 - RNA, 18 nt, Escherichia coli CFT073
ccauauuaacgcagcaaa

SEQ ID NO: 2600248 - RNA, 14 nt, Escherichia coli CFT073
ccauauucgaaccc

SEQ ID NO: 2600249 - RNA, 20 nt, Escherichia coli CFT073
ccauauucguuaucguacca

SEQ ID NO: 2600250 - RNA, 15 nt, Escherichia coli CFT073
ccauauugaacggca

SEQ ID NO: 2600251 - RNA, 19 nt, Escherichia coli CFT073
ccauauuggcaacagccau

SEQ ID NO: 2600252 - RNA, 19 nt, Escherichia coli CFT073
ccauauuguuucaacacag

SEQ ID NO: 2600253 - RNA, 20 nt, Escherichia coli CFT073
ccauauuuaacuccuucuaa

SEQ ID NO: 2600254 - RNA, 17 nt, Escherichia coli CFT073
ccaucaaaggcuucaac

SEQ ID NO: 2600255 - RNA, 15 nt, Escherichia coli CFT073
ccaucaaaucacuaa

SEQ ID NO: 2600256 - RNA, 21 nt, Escherichia coli CFT073
ccaucaacaacuggcguuucu

SEQ ID NO: 2600257 - RNA, 15 nt, Escherichia coli CFT073
ccaucaaccuucaca

SEQ ID NO: 2600258 - RNA, 13 nt, Escherichia coli CFT073
ccaucaacgccag

SEQ ID NO: 2600259 - RNA, 13 nt, Escherichia coli CFT073
ccaucaagaacac

SEQ ID NO: 2600260 - RNA, 22 nt, Escherichia coli CFT073
ccaucaaguagcagguaaucug

SEQ ID NO: 2600261 - RNA, 13 nt, Escherichia coli CFT073
ccaugccaucugc

SEQ ID NO: 2600262 - RNA, 16 nt, Escherichia coli CFT073
ccaugccaucugccag

SEQ ID NO: 2600263 - RNA, 21 nt, Escherichia coli CFT073
ccaugccgccaccaccagcgc

SEQ ID NO: 2600264 - RNA, 15 nt, Escherichia coli CFT073
ccaugccgccacucu

SEQ ID NO: 2600265 - RNA, 15 nt, Escherichia coli CFT073
ccaugccgcccagca

SEQ ID NO: 2600266 - RNA, 20 nt, Escherichia coli CFT073
ccaugccuucauaaugaaug

SEQ ID NO: 2600267 - RNA, 15 nt, Escherichia coli CFT073
ccaugccuuguuuaa

SEQ ID NO: 2600268 - RNA, 21 nt, Escherichia coli CFT073
ccaugcgaagaccgcaucacg

SEQ ID NO: 2600269 - RNA, 20 nt, Escherichia coli CFT073
ccaugcgaaugccaauuucc

SEQ ID NO: 2600270 - RNA, 21 nt, Escherichia coli CFT073
ccaugcgcccaucggaccauu

SEQ ID NO: 2600271 - RNA, 22 nt, Escherichia coli CFT073
ccaugcgcgccggacgcaccuu

SEQ ID NO: 2600272 - RNA, 14 nt, Escherichia coli CFT073
ccaugcgcugggcg

SEQ ID NO: 2600273 - RNA, 13 nt, Escherichia coli CFT073
ccaugcggcaucu

SEQ ID NO: 2600274 - RNA, 16 nt, Escherichia coli CFT073
ccaugcggcgaggaau

SEQ ID NO: 2600275 - RNA, 17 nt, Escherichia coli CFT073
ccaugcggcgaggaauc

SEQ ID NO: 2600276 - RNA, 15 nt, Escherichia coli CFT073
ccaugcuaugcgcca

SEQ ID NO: 2600277 - RNA, 14 nt, Escherichia coli CFT073
ccaugcugagcuuc

SEQ ID NO: 2600278 - RNA, 19 nt, Escherichia coli CFT073
ccaugcuggcuguuuacau

SEQ ID NO: 2600279 - RNA, 16 nt, Escherichia coli CFT073
ccaugcuguucgcaac

SEQ ID NO: 2600280 - RNA, 18 nt, Escherichia coli CFT073
ccaugcuuguuuauuauc

SEQ ID NO: 2600281 - RNA, 18 nt, Escherichia coli CFT073
ccauggaacucuuucuga

SEQ ID NO: 2600282 - RNA, 19 nt, Escherichia coli CFT073
ccauggacaugcgcaccuu

SEQ ID NO: 2600283 - RNA, 20 nt, Escherichia coli CFT073
ccauggcauuaaauucagca

SEQ ID NO: 2600284 - RNA, 21 nt, Escherichia coli CFT073
ccauggcuggcaccuggcgca

SEQ ID NO: 2600285 - RNA, 12 nt, Escherichia coli CFT073
ccauguaauucg

SEQ ID NO: 2600286 - RNA, 15 nt, Escherichia coli CFT073
ccauguaccagacug

SEQ ID NO: 2600287 - RNA, 16 nt, Escherichia coli CFT073
ccaugucgccaccugu

SEQ ID NO: 2600288 - RNA, 15 nt, Escherichia coli CFT073
ccaugugcgacgggc

SEQ ID NO: 2600289 - RNA, 18 nt, Escherichia coli CFT073
ccauguugacuucaaucu

SEQ ID NO: 2600290 - RNA, 23 nt, Escherichia coli CFT073
ccauguugacuucaaucugagcg

SEQ ID NO: 2600291 - RNA, 12 nt, Escherichia coli CFT073
ccauguuuuccu

SEQ ID NO: 2600292 - RNA, 19 nt, Escherichia coli CFT073
ccauguuuuccuuuucgca

SEQ ID NO: 2600293 - RNA, 12 nt, Escherichia coli CFT073
ccauuaaacacc

SEQ ID NO: 2600294 - RNA, 16 nt, Escherichia coli CFT073
ccauuaaacaccagua

SEQ ID NO: 2600295 - RNA, 17 nt, Escherichia coli CFT073
ccauuaaacaccaguac

SEQ ID NO: 2600296 - RNA, 19 nt, Escherichia coli CFT073
ccauuaaaucagccuuaau

SEQ ID NO: 2600297 - RNA, 15 nt, Escherichia coli CFT073
ccauuaaccagccac

SEQ ID NO: 2600298 - RNA, 13 nt, Escherichia coli CFT073
ccauuaacccauu

SEQ ID NO: 2600299 - RNA, 16 nt, Escherichia coli CFT073
ccauuaauaccgccaa

SEQ ID NO: 2600300 - RNA, 14 nt, Escherichia coli CFT073
ccauuacacugaaa

SEQ ID NO: 2600301 - RNA, 16 nt, Escherichia coli CFT073
ccauuacacugaaaaa

SEQ ID NO: 2600302 - RNA, 20 nt, Escherichia coli CFT073
ccauuacacugaaaaaaagu

SEQ ID NO: 2600303 - RNA, 21 nt, Escherichia coli CFT073
ccauuacccggugccgccguc

SEQ ID NO: 2600304 - RNA, 13 nt, Escherichia coli CFT073
ccauuagucacau

SEQ ID NO: 2600305 - RNA, 22 nt, Escherichia coli CFT073
ccauuagucuggauugcagaga

SEQ ID NO: 2600306 - RNA, 16 nt, Escherichia coli CFT073
ccauuaucauugagca

SEQ ID NO: 2600307 - RNA, 20 nt, Escherichia coli CFT073
ccauuauuuucgucagcucc

SEQ ID NO: 2600308 - RNA, 21 nt, Escherichia coli CFT073
ccauucaaggacaaaccggcu

SEQ ID NO: 2600309 - RNA, 13 nt, Escherichia coli CFT073
ccauucaaucuuc

SEQ ID NO: 2600310 - RNA, 12 nt, Escherichia coli CFT073
ccauucacaauu

SEQ ID NO: 2600311 - RNA, 21 nt, Escherichia coli CFT073
ccauucacgagagcgggaaaa

SEQ ID NO: 2600312 - RNA, 21 nt, Escherichia coli CFT073
ccauucagauugauguuacca

SEQ ID NO: 2600313 - RNA, 14 nt, Escherichia coli CFT073
ccauuccccagccg

SEQ ID NO: 2600314 - RNA, 16 nt, Escherichia coli CFT073
ccauuccccagccgau

SEQ ID NO: 2600315 - RNA, 22 nt, Escherichia coli CFT073
ccauucgaugguuuuauagcgg

SEQ ID NO: 2600316 - RNA, 17 nt, Escherichia coli CFT073
ccauucgccguccagga

SEQ ID NO: 2600317 - RNA, 19 nt, Escherichia coli CFT073
ccauucuccgcucuucauc

SEQ ID NO: 2600318 - RNA, 16 nt, Escherichia coli CFT073
ccauucuugcgcggau

SEQ ID NO: 2600319 - RNA, 16 nt, Escherichia coli CFT073
ccauucuuucccagca

SEQ ID NO: 2600320 - RNA, 17 nt, Escherichia coli CFT073
ccauugaauuaaaaugu

SEQ ID NO: 2600321 - RNA, 21 nt, Escherichia coli CFT073
ccauugacguucccuucuugc

SEQ ID NO: 2600322 - RNA, 23 nt, Escherichia coli CFT073
ccauugagccggaaguauccacg

SEQ ID NO: 2600323 - RNA, 13 nt, Escherichia coli CFT073
ccauugagcuuuc

SEQ ID NO: 2600324 - RNA, 18 nt, Escherichia coli CFT073
ccauugaugagaacauca

SEQ ID NO: 2600325 - RNA, 23 nt, Escherichia coli CFT073
ccauugcacgcgaccgucuuuau

SEQ ID NO: 2600326 - RNA, 18 nt, Escherichia coli CFT073
ccauugcagccaaucugc

SEQ ID NO: 2600327 - RNA, 22 nt, Escherichia coli CFT073
ccauugcgcaaccgcccggccu

SEQ ID NO: 2600328 - RNA, 22 nt, Escherichia coli CFT073
ccauugcgggcuggaaacgcga

SEQ ID NO: 2600329 - RNA, 19 nt, Escherichia coli CFT073
ccauugcucuuucacuuua

SEQ ID NO: 2600330 - RNA, 21 nt, Escherichia coli CFT073
ccauugcugaugcaccuucaa

SEQ ID NO: 2600331 - RNA, 15 nt, Escherichia coli CFT073
ccauugggccacuca

SEQ ID NO: 2600332 - RNA, 21 nt, Escherichia coli CFT073
ccauuggugcuguucugccgg

SEQ ID NO: 2600333 - RNA, 13 nt, Escherichia coli CFT073
ccauuguuagcaa

SEQ ID NO: 2600334 - RNA, 23 nt, Escherichia coli CFT073
ccauuguugcuggauccccugcc

SEQ ID NO: 2600335 - RNA, 19 nt, Escherichia coli CFT073
ccauuguuggcgaugagau

SEQ ID NO: 2600336 - RNA, 19 nt, Escherichia coli CFT073
ccauuguuguagguacccg

SEQ ID NO: 2600337 - RNA, 13 nt, Escherichia coli CFT073
ccauuuaaacuca

SEQ ID NO: 2600338 - RNA, 20 nt, Escherichia coli CFT073
ccauuuaaacucaccgcucu

SEQ ID NO: 2600339 - RNA, 19 nt, Escherichia coli CFT073
ccauuuacccgauccacug

SEQ ID NO: 2600340 - RNA, 13 nt, Escherichia coli CFT073
ccauuucaaugcg

SEQ ID NO: 2600341 - RNA, 22 nt, Escherichia coli CFT073
ccauuucauaaauuaccaccag

SEQ ID NO: 2600342 - RNA, 20 nt, Escherichia coli CFT073
ccauuucgcugguaccuguc

SEQ ID NO: 2600343 - RNA, 11 nt, Escherichia coli CFT073
ccauuucgucg

SEQ ID NO: 2600344 - RNA, 18 nt, Escherichia coli CFT073
ccauuucguuagcaaacg

SEQ ID NO: 2600345 - RNA, 13 nt, Escherichia coli CFT073
ccauuucuucugc

SEQ ID NO: 2600346 - RNA, 20 nt, Escherichia coli CFT073
ccauuugccucaguggcugc

SEQ ID NO: 2600347 - RNA, 23 nt, Escherichia coli CFT073
ccauuuggcggggauuuuuuuau

SEQ ID NO: 2600348 - RNA, 19 nt, Escherichia coli CFT073
ccauuuugcaugagugcca

SEQ ID NO: 2600349 - RNA, 22 nt, Escherichia coli CFT073
ccauuuuucagacguucuuccu

SEQ ID NO: 2600350 - RNA, 17 nt, Escherichia coli CFT073
ccauuuuuuuacccagc

SEQ ID NO: 2600351 - RNA, 23 nt, Escherichia coli CFT073
cccaaaaaaucaacgacaaaaau

SEQ ID NO: 2600352 - RNA, 23 nt, Escherichia coli CFT073
cccaaaaccuggacaguuucagu

SEQ ID NO: 2600353 - RNA, 15 nt, Escherichia coli CFT073
cccaaaauaucacgc

SEQ ID NO: 2600354 - RNA, 18 nt, Escherichia coli CFT073
cccaaaaugucggaugcg

SEQ ID NO: 2600355 - RNA, 23 nt, Escherichia coli CFT073
cccaaaaugucggaugcgacgcu

SEQ ID NO: 2600356 - RNA, 12 nt, Escherichia coli CFT073
cccaaaccgccc

SEQ ID NO: 2600357 - RNA, 13 nt, Escherichia coli CFT073
cccaaagccaauc

SEQ ID NO: 2600358 - RNA, 17 nt, Escherichia coli CFT073
cccaaaugucggaugcg

SEQ ID NO: 2600359 - RNA, 22 nt, Escherichia coli CFT073
cccaaaugucggaugcggcgcu

SEQ ID NO: 2600360 - RNA, 15 nt, Escherichia coli CFT073
cccaacaacagcgcg

SEQ ID NO: 2600361 - RNA, 20 nt, Escherichia coli CFT073
cccaacacucgaacaaggca

SEQ ID NO: 2600362 - RNA, 12 nt, Escherichia coli CFT073
cccaaccagcag

SEQ ID NO: 2600363 - RNA, 16 nt, Escherichia coli CFT073
cccaaccgcuuucugc

SEQ ID NO: 2600364 - RNA, 17 nt, Escherichia coli CFT073
cccaacgcaaaaccaag

SEQ ID NO: 2600365 - RNA, 23 nt, Escherichia coli CFT073
cccaacgcaaagagagaagccag

SEQ ID NO: 2600366 - RNA, 15 nt, Escherichia coli CFT073
cccaacgcagcaaca

SEQ ID NO: 2600367 - RNA, 14 nt, Escherichia coli CFT073
cccaacgcgcaaug

SEQ ID NO: 2600368 - RNA, 21 nt, Escherichia coli CFT073
cccaacguauguacaagcuga

SEQ ID NO: 2600369 - RNA, 18 nt, Escherichia coli CFT073
cccaggccaucgccaccg

SEQ ID NO: 2600370 - RNA, 23 nt, Escherichia coli CFT073
cccaggucgacaauccagucagc

SEQ ID NO: 2600371 - RNA, 17 nt, Escherichia coli CFT073
cccaguaaacacaccac

SEQ ID NO: 2600372 - RNA, 19 nt, Escherichia coli CFT073
cccaguaaacacaccacag

SEQ ID NO: 2600373 - RNA, 15 nt, Escherichia coli CFT073
cccaguaccgccagu

SEQ ID NO: 2600374 - RNA, 19 nt, Escherichia coli CFT073
cccaguagugcgcagaaca

SEQ ID NO: 2600375 - RNA, 19 nt, Escherichia coli CFT073
cccagucccguacccagca

SEQ ID NO: 2600376 - RNA, 13 nt, Escherichia coli CFT073
cccagucguccag

SEQ ID NO: 2600377 - RNA, 19 nt, Escherichia coli CFT073
cccagugaauccagcaugc

SEQ ID NO: 2600378 - RNA, 16 nt, Escherichia coli CFT073
cccagugcagcaucgc

SEQ ID NO: 2600379 - RNA, 16 nt, Escherichia coli CFT073
cccagugcggugccgc

SEQ ID NO: 2600380 - RNA, 23 nt, Escherichia coli CFT073
cccaguugaugaccagugcagau

SEQ ID NO: 2600381 - RNA, 19 nt, Escherichia coli CFT073
cccaguugugcugccagcc

SEQ ID NO: 2600382 - RNA, 11 nt, Escherichia coli CFT073
cccaguuucau

SEQ ID NO: 2600383 - RNA, 21 nt, Escherichia coli CFT073
cccaguuucaugauauguuuu

SEQ ID NO: 2600384 - RNA, 15 nt, Escherichia coli CFT073
cccaguuucuucagg

SEQ ID NO: 2600385 - RNA, 18 nt, Escherichia coli CFT073
cccaguuucuucaggcca

SEQ ID NO: 2600386 - RNA, 22 nt, Escherichia coli CFT073
cccaguuuucguaguuaauaau

SEQ ID NO: 2600387 - RNA, 15 nt, Escherichia coli CFT073
cccaguuuuucagga

SEQ ID NO: 2600388 - RNA, 16 nt, Escherichia coli CFT073
cccauaaaaaaacccg

SEQ ID NO: 2600389 - RNA, 16 nt, Escherichia coli CFT073
cccauaaacccggaua

SEQ ID NO: 2600390 - RNA, 22 nt, Escherichia coli CFT073
cccauaacauauucacccgcgc

SEQ ID NO: 2600391 - RNA, 16 nt, Escherichia coli CFT073
cccauaacccacacca

SEQ ID NO: 2600392 - RNA, 19 nt, Escherichia coli CFT073
cccauaacccacaccauaa

SEQ ID NO: 2600393 - RNA, 14 nt, Escherichia coli CFT073
cccauaaucaaugc

SEQ ID NO: 2600394 - RNA, 17 nt, Escherichia coli CFT073
cccauaaugccccagcg

SEQ ID NO: 2600395 - RNA, 23 nt, Escherichia coli CFT073
cccauacagcgucgguuccugau

SEQ ID NO: 2600396 - RNA, 14 nt, Escherichia coli CFT073
cccauacauaccag

SEQ ID NO: 2600397 - RNA, 22 nt, Escherichia coli CFT073
cccauacuuaaugccaguucag

SEQ ID NO: 2600398 - RNA, 22 nt, Escherichia coli CFT073
cccauagagagauguugcugcu

SEQ ID NO: 2600399 - RNA, 23 nt, Escherichia coli CFT073
cccauagagagauguugcugcuc

SEQ ID NO: 2600400 - RNA, 22 nt, Escherichia coli CFT073
cccauagauaccuucuugacau

SEQ ID NO: 2600401 - RNA, 21 nt, Escherichia coli CFT073
cccauaugcagccacugcugc

SEQ ID NO: 2600402 - RNA, 20 nt, Escherichia coli CFT073
cccaucagacgggagaucgc

SEQ ID NO: 2600403 - RNA, 23 nt, Escherichia coli CFT073
cccaucaucuggcugugauccau

SEQ ID NO: 2600404 - RNA, 17 nt, Escherichia coli CFT073
cccaucgcgacggcaga

SEQ ID NO: 2600405 - RNA, 15 nt, Escherichia coli CFT073
cccaucggcgccauu

SEQ ID NO: 2600406 - RNA, 16 nt, Escherichia coli CFT073
cccaucguugaaaaaa

SEQ ID NO: 2600407 - RNA, 17 nt, Escherichia coli CFT073
cccaucguugaaaaaau

SEQ ID NO: 2600408 - RNA, 14 nt, Escherichia coli CFT073
cccaucucuucuuc

SEQ ID NO: 2600409 - RNA, 19 nt, Escherichia coli CFT073
cccaugaugcgcggcucca

SEQ ID NO: 2600410 - RNA, 16 nt, Escherichia coli CFT073
cccauggcacuucaag

SEQ ID NO: 2600411 - RNA, 22 nt, Escherichia coli CFT073
cccauuaauaccgccaacaugc

SEQ ID NO: 2600412 - RNA, 18 nt, Escherichia coli CFT073
cccauucaucgccaccgc

SEQ ID NO: 2600413 - RNA, 14 nt, Escherichia coli CFT073
cccauuccagccau

SEQ ID NO: 2600414 - RNA, 13 nt, Escherichia coli CFT073
cccauucgccgaa

SEQ ID NO: 2600415 - RNA, 14 nt, Escherichia coli CFT073
cccauucugcgcug

SEQ ID NO: 2600416 - RNA, 17 nt, Escherichia coli CFT073
cccauugccccauguug

SEQ ID NO: 2600417 - RNA, 20 nt, Escherichia coli CFT073
cccauugccuggcugcccau

SEQ ID NO: 2600418 - RNA, 12 nt, Escherichia coli CFT073
cccauugguugc

SEQ ID NO: 2600419 - RNA, 13 nt, Escherichia coli CFT073
cccauuuauuucu

SEQ ID NO: 2600420 - RNA, 14 nt, Escherichia coli CFT073
cccauuuucagccg

SEQ ID NO: 2600421 - RNA, 15 nt, Escherichia coli CFT073
cccauuuucagccgg

SEQ ID NO: 2600422 - RNA, 21 nt, Escherichia coli CFT073
cccauuuucagccggcaggau

SEQ ID NO: 2600423 - RNA, 22 nt, Escherichia coli CFT073
ccccaaccguucauaggcaaug

SEQ ID NO: 2600424 - RNA, 15 nt, Escherichia coli CFT073
ccccaaguuuaugca

SEQ ID NO: 2600425 - RNA, 20 nt, Escherichia coli CFT073
ccccaauguggagagcaaca

SEQ ID NO: 2600426 - RNA, 19 nt, Escherichia coli CFT073
ccccacaaaauaaccgcca

SEQ ID NO: 2600427 - RNA, 14 nt, Escherichia coli CFT073
ccccacaccaccau

SEQ ID NO: 2600428 - RNA, 19 nt, Escherichia coli CFT073
ccccacagacccagguaga

SEQ ID NO: 2600429 - RNA, 15 nt, Escherichia coli CFT073
ccccacauguugcag

SEQ ID NO: 2600430 - RNA, 19 nt, Escherichia coli CFT073
ccccacggcguguagccca

SEQ ID NO: 2600431 - RNA, 23 nt, Escherichia coli CFT073
ccccacggcguguagcccaucag

SEQ ID NO: 2600432 - RNA, 22 nt, Escherichia coli CFT073
ccccacggucauaugcaaacca

SEQ ID NO: 2600433 - RNA, 14 nt, Escherichia coli CFT073
ccccacugcauggc

SEQ ID NO: 2600434 - RNA, 20 nt, Escherichia coli CFT073
ccccacugcauggcggcguc

SEQ ID NO: 2600435 - RNA, 23 nt, Escherichia coli CFT073
ccccacuucauccgacaccagcc

SEQ ID NO: 2600436 - RNA, 22 nt, Escherichia coli CFT073
ccccagaccaauugccgcacca

SEQ ID NO: 2600437 - RNA, 18 nt, Escherichia coli CFT073
ccccagacguuucgccag

SEQ ID NO: 2600438 - RNA, 22 nt, Escherichia coli CFT073
ccccagauacccgacagauaaa

SEQ ID NO: 2600439 - RNA, 14 nt, Escherichia coli CFT073
ccccagccaggugg

SEQ ID NO: 2600440 - RNA, 13 nt, Escherichia coli CFT073
ccccagccgguca

SEQ ID NO: 2600441 - RNA, 12 nt, Escherichia coli CFT073
ccccagcgcaag

SEQ ID NO: 2600442 - RNA, 13 nt, Escherichia coli CFT073
ccccagcgcaaua

SEQ ID NO: 2600443 - RNA, 16 nt, Escherichia coli CFT073
ccccagcggaaaauau

SEQ ID NO: 2600444 - RNA, 17 nt, Escherichia coli CFT073
ccccagcgucagcagca

SEQ ID NO: 2600445 - RNA, 14 nt, Escherichia coli CFT073
ccccagcuggcgcc

SEQ ID NO: 2600446 - RNA, 20 nt, Escherichia coli CFT073
ccccaguaaacacaccacag

SEQ ID NO: 2600447 - RNA, 17 nt, Escherichia coli CFT073
ccccagucuuccugcgg

SEQ ID NO: 2600448 - RNA, 22 nt, Escherichia coli CFT073
ccccauauuggcaacagccauc

SEQ ID NO: 2600449 - RNA, 21 nt, Escherichia coli CFT073
ccccaucagcaucccaccuga

SEQ ID NO: 2600450 - RNA, 13 nt, Escherichia coli CFT073
ccccauccacgca

SEQ ID NO: 2600451 - RNA, 23 nt, Escherichia coli CFT073
ccccaucgcguuugcguuccggc

SEQ ID NO: 2600452 - RNA, 11 nt, Escherichia coli CFT073
ccccauugccc

SEQ ID NO: 2600453 - RNA, 15 nt, Escherichia coli CFT073
cccccaccgccgccg

SEQ ID NO: 2600454 - RNA, 20 nt, Escherichia coli CFT073
cccccagacgacggcugcca

SEQ ID NO: 2600455 - RNA, 20 nt, Escherichia coli CFT073
cccccagcacuacggagauu

SEQ ID NO: 2600456 - RNA, 19 nt, Escherichia coli CFT073
cccccauugaaacgagugg

SEQ ID NO: 2600457 - RNA, 18 nt, Escherichia coli CFT073
cccccauugggccacuca

SEQ ID NO: 2600458 - RNA, 13 nt, Escherichia coli CFT073
cccccgguaauaa

SEQ ID NO: 2600459 - RNA, 17 nt, Escherichia coli CFT073
cccccugcaauaaacaa

SEQ ID NO: 2600460 - RNA, 13 nt, Escherichia coli CFT073
cccccuuaccccg

SEQ ID NO: 2600461 - RNA, 13 nt, Escherichia coli CFT073
cccccuuccugcu

SEQ ID NO: 2600462 - RNA, 18 nt, Escherichia coli CFT073
ccccgagguguauuucac

SEQ ID NO: 2600463 - RNA, 18 nt, Escherichia coli CFT073
ccccgccagcgccaucgg

SEQ ID NO: 2600464 - RNA, 22 nt, Escherichia coli CFT073
ccccgcgaacggggcugccagc

SEQ ID NO: 2600465 - RNA, 22 nt, Escherichia coli CFT073
ccccgcgcucacaccacaacag

SEQ ID NO: 2600466 - RNA, 22 nt, Escherichia coli CFT073
ccccgcucacgcagcggcggca

SEQ ID NO: 2600467 - RNA, 17 nt, Escherichia coli CFT073
ccccgcuucgcccgcca

SEQ ID NO: 2600468 - RNA, 19 nt, Escherichia coli CFT073
ccccgcuuuuuucagcgcc

SEQ ID NO: 2600469 - RNA, 20 nt, Escherichia coli CFT073
ccccggcacugucaacagcg

SEQ ID NO: 2600470 - RNA, 12 nt, Escherichia coli CFT073
ccccggcaggaa

SEQ ID NO: 2600471 - RNA, 12 nt, Escherichia coli CFT073
ccccggccagua

SEQ ID NO: 2600472 - RNA, 21 nt, Escherichia coli CFT073
ccccggcgaucccagagcggg

SEQ ID NO: 2600473 - RNA, 21 nt, Escherichia coli CFT073
ccccggcggcuugcaccagca

SEQ ID NO: 2600474 - RNA, 15 nt, Escherichia coli CFT073
ccccggucagcagca

SEQ ID NO: 2600475 - RNA, 21 nt, Escherichia coli CFT073
ccccggucagcagcaccaccg

SEQ ID NO: 2600476 - RNA, 13 nt, Escherichia coli CFT073
ccccgguuucucu

SEQ ID NO: 2600477 - RNA, 23 nt, Escherichia coli CFT073
cccguauccaccgacacuacaaa

SEQ ID NO: 2600478 - RNA, 20 nt, Escherichia coli CFT073
cccgucaacggugcuuuaau

SEQ ID NO: 2600479 - RNA, 14 nt, Escherichia coli CFT073
cccgucagcaaaau

SEQ ID NO: 2600480 - RNA, 12 nt, Escherichia coli CFT073
cccguccccuga

SEQ ID NO: 2600481 - RNA, 13 nt, Escherichia coli CFT073
cccgucugcugcu

SEQ ID NO: 2600482 - RNA, 20 nt, Escherichia coli CFT073
cccgugaugcggucgcugcc

SEQ ID NO: 2600483 - RNA, 16 nt, Escherichia coli CFT073
cccguuaaccacuuca

SEQ ID NO: 2600484 - RNA, 19 nt, Escherichia coli CFT073
cccguucauccgcuucagg

SEQ ID NO: 2600485 - RNA, 20 nt, Escherichia coli CFT073
cccguugaucuucucuuaua

SEQ ID NO: 2600486 - RNA, 16 nt, Escherichia coli CFT073
cccguuguuugaaauu

SEQ ID NO: 2600487 - RNA, 15 nt, Escherichia coli CFT073
cccguuucaccguga

SEQ ID NO: 2600488 - RNA, 21 nt, Escherichia coli CFT073
cccguuuucuccagcgccgcc

SEQ ID NO: 2600489 - RNA, 22 nt, Escherichia coli CFT073
cccguuuuuagauuguuuucaa

SEQ ID NO: 2600490 - RNA, 17 nt, Escherichia coli CFT073
cccuaacagggcgcugu

SEQ ID NO: 2600491 - RNA, 22 nt, Escherichia coli CFT073
cccuaauaccguuccaacgcca

SEQ ID NO: 2600492 - RNA, 17 nt, Escherichia coli CFT073
cccuacgccuaccacca

SEQ ID NO: 2600493 - RNA, 20 nt, Escherichia coli CFT073
cccuacgcgauaaaaaaccc

SEQ ID NO: 2600494 - RNA, 17 nt, Escherichia coli CFT073
cccuacuccaccuuuga

SEQ ID NO: 2600495 - RNA, 17 nt, Escherichia coli CFT073
cccuacucucugugcug

SEQ ID NO: 2600496 - RNA, 20 nt, Escherichia coli CFT073
cccucaacuugcucaagcca

SEQ ID NO: 2600497 - RNA, 16 nt, Escherichia coli CFT073
cccucaagccacuucc

SEQ ID NO: 2600498 - RNA, 19 nt, Escherichia coli CFT073
cccucaauaaucauucgcc

SEQ ID NO: 2600499 - RNA, 16 nt, Escherichia coli CFT073
cccucgaccaucuccu

SEQ ID NO: 2600500 - RNA, 14 nt, Escherichia coli CFT073
cccucgccccuccg

SEQ ID NO: 2600501 - RNA, 15 nt, Escherichia coli CFT073
cccucgccccuccgg

SEQ ID NO: 2600502 - RNA, 23 nt, Escherichia coli CFT073
cccucguuuugccgccaucaucg

SEQ ID NO: 2600503 - RNA, 16 nt, Escherichia coli CFT073
cccucuaaaauaacga

SEQ ID NO: 2600504 - RNA, 21 nt, Escherichia coli CFT073
cccucuaaacgcucaaacagc

SEQ ID NO: 2600505 - RNA, 23 nt, Escherichia coli CFT073
cccucucggcauauaccgucagc

SEQ ID NO: 2600506 - RNA, 15 nt, Escherichia coli CFT073
cccucuguccgccag

SEQ ID NO: 2600507 - RNA, 14 nt, Escherichia coli CFT073
cccucuucagccgc

SEQ ID NO: 2600508 - RNA, 19 nt, Escherichia coli CFT073
cccugaaagcgacagcgca

SEQ ID NO: 2600509 - RNA, 15 nt, Escherichia coli CFT073
cccugaaauauugcu

SEQ ID NO: 2600510 - RNA, 19 nt, Escherichia coli CFT073
cccugaauaacgccgacag

SEQ ID NO: 2600511 - RNA, 19 nt, Escherichia coli CFT073
cccugaaucgccacgccaa

SEQ ID NO: 2600512 - RNA, 15 nt, Escherichia coli CFT073
cccugaauucucaaa

SEQ ID NO: 2600513 - RNA, 19 nt, Escherichia coli CFT073
cccugaccgucaaacaugc

SEQ ID NO: 2600514 - RNA, 22 nt, Escherichia coli CFT073
cccugaccgucuuuuuuuacgg

SEQ ID NO: 2600515 - RNA, 19 nt, Escherichia coli CFT073
cccugaccuuaauaaacuc

SEQ ID NO: 2600516 - RNA, 21 nt, Escherichia coli CFT073
cccugacugguuaguuucagc

SEQ ID NO: 2600517 - RNA, 18 nt, Escherichia coli CFT073
cccugacuugcgaacuca

SEQ ID NO: 2600518 - RNA, 23 nt, Escherichia coli CFT073
cccugagcaacaauuuucccuuc

SEQ ID NO: 2600519 - RNA, 15 nt, Escherichia coli CFT073
cccugagcaucaaua

SEQ ID NO: 2600520 - RNA, 16 nt, Escherichia coli CFT073
cccugagcaucaauac

SEQ ID NO: 2600521 - RNA, 17 nt, Escherichia coli CFT073
cccugaguuuucaguac

SEQ ID NO: 2600522 - RNA, 15 nt, Escherichia coli CFT073
cccugaucacccaca

SEQ ID NO: 2600523 - RNA, 23 nt, Escherichia coli CFT073
cccugaugcgugcgccagagccc

SEQ ID NO: 2600524 - RNA, 19 nt, Escherichia coli CFT073
cccugauggcugauuaccc

SEQ ID NO: 2600525 - RNA, 15 nt, Escherichia coli CFT073
cccugcaacacucgu

SEQ ID NO: 2600526 - RNA, 17 nt, Escherichia coli CFT073
cccugcaacaucaccgg

SEQ ID NO: 2600527 - RNA, 16 nt, Escherichia coli CFT073
cccugcaauaaacaaa

SEQ ID NO: 2600528 - RNA, 19 nt, Escherichia coli CFT073
cccugcaccggugcaucca

SEQ ID NO: 2600529 - RNA, 14 nt, Escherichia coli CFT073
cccugcagucaccu

SEQ ID NO: 2600530 - RNA, 18 nt, Escherichia coli CFT073
cccugcauaaucaggauc

SEQ ID NO: 2600531 - RNA, 23 nt, Escherichia coli CFT073
cccugcauauaaucgauccccaa

SEQ ID NO: 2600532 - RNA, 19 nt, Escherichia coli CFT073
cccugcaucacugacauca

SEQ ID NO: 2600533 - RNA, 16 nt, Escherichia coli CFT073
cccugccaaccaacgc

SEQ ID NO: 2600534 - RNA, 21 nt, Escherichia coli CFT073
cccugccagaaucgcaaccag

SEQ ID NO: 2600535 - RNA, 21 nt, Escherichia coli CFT073
cccugccagcgauacucucgc

SEQ ID NO: 2600536 - RNA, 22 nt, Escherichia coli CFT073
cccugccagcgauacucucgcg

SEQ ID NO: 2600537 - RNA, 15 nt, Escherichia coli CFT073
cccugccaucacuau

SEQ ID NO: 2600538 - RNA, 21 nt, Escherichia coli CFT073
cccugccccaucugccccauu

SEQ ID NO: 2600539 - RNA, 23 nt, Escherichia coli CFT073
cccugcccggagccaucccugca

SEQ ID NO: 2600540 - RNA, 12 nt, Escherichia coli CFT073
cccugccgccau

SEQ ID NO: 2600541 - RNA, 15 nt, Escherichia coli CFT073
cccugcgccagcgca

SEQ ID NO: 2600542 - RNA, 19 nt, Escherichia coli CFT073
cccugcggcgaugaccgcc

SEQ ID NO: 2600543 - RNA, 13 nt, Escherichia coli CFT073
cccugcggcggag

SEQ ID NO: 2600544 - RNA, 16 nt, Escherichia coli CFT073
cccugcguugagaaac

SEQ ID NO: 2600545 - RNA, 20 nt, Escherichia coli CFT073
cccuggaaaaaaugccccag

SEQ ID NO: 2600546 - RNA, 23 nt, Escherichia coli CFT073
cccuggacaacauuccuguugac

SEQ ID NO: 2600547 - RNA, 20 nt, Escherichia coli CFT073
cccuggcaauagcgcacgcc

SEQ ID NO: 2600548 - RNA, 18 nt, Escherichia coli CFT073
cccuggcgagcagcaaua

SEQ ID NO: 2600549 - RNA, 23 nt, Escherichia coli CFT073
cccuggcgcagcacgacucuccc

SEQ ID NO: 2600550 - RNA, 19 nt, Escherichia coli CFT073
cccuggcuaucggcaaaaa

SEQ ID NO: 2600551 - RNA, 22 nt, Escherichia coli CFT073
cccuggcuggucagcaauuuua

SEQ ID NO: 2600552 - RNA, 15 nt, Escherichia coli CFT073
cccugggcuucaucc

SEQ ID NO: 2600553 - RNA, 22 nt, Escherichia coli CFT073
cccugggcuucauccagcagcg

SEQ ID NO: 2600554 - RNA, 18 nt, Escherichia coli CFT073
cccuggucauaggcugcc

SEQ ID NO: 2600555 - RNA, 17 nt, Escherichia coli CFT073
cccuggucgguuucagc

SEQ ID NO: 2600556 - RNA, 19 nt, Escherichia coli CFT073
cccuggucgguuucagcca

SEQ ID NO: 2600557 - RNA, 22 nt, Escherichia coli CFT073
cccuggugggguucccgagcgg

SEQ ID NO: 2600558 - RNA, 18 nt, Escherichia coli CFT073
cccugugccagcggcagu

SEQ ID NO: 2600559 - RNA, 13 nt, Escherichia coli CFT073
cccugugucgccg

SEQ ID NO: 2600560 - RNA, 23 nt, Escherichia coli CFT073
cccuguuaccgggcuacaacgca

SEQ ID NO: 2600561 - RNA, 22 nt, Escherichia coli CFT073
cccuuaauuaucuggucaguua

SEQ ID NO: 2600562 - RNA, 14 nt, Escherichia coli CFT073
cccuuacccuuacu

SEQ ID NO: 2600563 - RNA, 16 nt, Escherichia coli CFT073
cccuuaguaacgccag

SEQ ID NO: 2600564 - RNA, 18 nt, Escherichia coli CFT073
cccuucacucugcugcca

SEQ ID NO: 2600565 - RNA, 14 nt, Escherichia coli CFT073
cccuucaucacgca

SEQ ID NO: 2600566 - RNA, 20 nt, Escherichia coli CFT073
cccuucaucacgcaguguca

SEQ ID NO: 2600567 - RNA, 23 nt, Escherichia coli CFT073
cccuucccgggucgcgacugcca

SEQ ID NO: 2600568 - RNA, 19 nt, Escherichia coli CFT073
cccuuccgcuuuuaacauc

SEQ ID NO: 2600569 - RNA, 11 nt, Escherichia coli CFT073
cccuuccugcc

SEQ ID NO: 2600570 - RNA, 12 nt, Escherichia coli CFT073
cccuuccugccc

SEQ ID NO: 2600571 - RNA, 16 nt, Escherichia coli CFT073
cccuucgauaaaggcc

SEQ ID NO: 2600572 - RNA, 16 nt, Escherichia coli CFT073
cccuucgcccugcguc

SEQ ID NO: 2600573 - RNA, 16 nt, Escherichia coli CFT073
cccuucgccgccgcug

SEQ ID NO: 2600574 - RNA, 16 nt, Escherichia coli CFT073
cccuucuuucacuuca

SEQ ID NO: 2600575 - RNA, 23 nt, Escherichia coli CFT073
cccuugauuaacgacacucucuu

SEQ ID NO: 2600576 - RNA, 13 nt, Escherichia coli CFT073
cccuugcgcaaug

SEQ ID NO: 2600577 - RNA, 16 nt, Escherichia coli CFT073
cccuuggcgucuaagg

SEQ ID NO: 2600578 - RNA, 13 nt, Escherichia coli CFT073
cccuuucugcauc

SEQ ID NO: 2600579 - RNA, 14 nt, Escherichia coli CFT073
cccuuucugcauga

SEQ ID NO: 2600580 - RNA, 12 nt, Escherichia coli CFT073
cccuuucugcug

SEQ ID NO: 2600581 - RNA, 14 nt, Escherichia coli CFT073
cccuuucugcugcu

SEQ ID NO: 2600582 - RNA, 17 nt, Escherichia coli CFT073
cccuuucuuauuuuucu

SEQ ID NO: 2600583 - RNA, 20 nt, Escherichia coli CFT073
cccuuugccugccgccuuuu

SEQ ID NO: 2600584 - RNA, 12 nt, Escherichia coli CFT073
cccuuuuagcac

SEQ ID NO: 2600585 - RNA, 15 nt, Escherichia coli CFT073
ccgaugccgcggcgc

SEQ ID NO: 2600586 - RNA, 18 nt, Escherichia coli CFT073
ccgaugccgcuacaaaau

SEQ ID NO: 2600587 - RNA, 18 nt, Escherichia coli CFT073
ccgaugccguuaaggcca

SEQ ID NO: 2600588 - RNA, 20 nt, Escherichia coli CFT073
ccgauggcaaaagugauauu

SEQ ID NO: 2600589 - RNA, 20 nt, Escherichia coli CFT073
ccgauggcagaaaucaacgg

SEQ ID NO: 2600590 - RNA, 18 nt, Escherichia coli CFT073
ccgauggcccgcguaagc

SEQ ID NO: 2600591 - RNA, 13 nt, Escherichia coli CFT073
ccgauggcgauuu

SEQ ID NO: 2600592 - RNA, 17 nt, Escherichia coli CFT073
ccgauggugcagcagac

SEQ ID NO: 2600593 - RNA, 21 nt, Escherichia coli CFT073
ccgauggugcagcagacgcug

SEQ ID NO: 2600594 - RNA, 16 nt, Escherichia coli CFT073
ccgaugucuuugcguu

SEQ ID NO: 2600595 - RNA, 21 nt, Escherichia coli CFT073
ccgauuaaucuuccagaucac

SEQ ID NO: 2600596 - RNA, 22 nt, Escherichia coli CFT073
ccgauuaauuccccugccagaa

SEQ ID NO: 2600597 - RNA, 18 nt, Escherichia coli CFT073
ccgauuaauugccgccag

SEQ ID NO: 2600598 - RNA, 19 nt, Escherichia coli CFT073
ccgauuguacuuuaaaaua

SEQ ID NO: 2600599 - RNA, 20 nt, Escherichia coli CFT073
ccgauuguacuuuaaaauaa

SEQ ID NO: 2600600 - RNA, 17 nt, Escherichia coli CFT073
ccgauuucgcugauuug

SEQ ID NO: 2600601 - RNA, 20 nt, Escherichia coli CFT073
ccgauuuugccgguuugcgc

SEQ ID NO: 2600602 - RNA, 15 nt, Escherichia coli CFT073
ccgcaaacaggcgca

SEQ ID NO: 2600603 - RNA, 12 nt, Escherichia coli CFT073
ccgcaaaccaga

SEQ ID NO: 2600604 - RNA, 15 nt, Escherichia coli CFT073
ccgcaaacucaucgc

SEQ ID NO: 2600605 - RNA, 20 nt, Escherichia coli CFT073
ccgcaaacucaucgccgcca

SEQ ID NO: 2600606 - RNA, 13 nt, Escherichia coli CFT073
ccgcaaacugcug

SEQ ID NO: 2600607 - RNA, 14 nt, Escherichia coli CFT073
ccgcaaagaaacgc

SEQ ID NO: 2600608 - RNA, 20 nt, Escherichia coli CFT073
ccgcaaagguugcagcuccc

SEQ ID NO: 2600609 - RNA, 14 nt, Escherichia coli CFT073
ccgcaaaucgccga

SEQ ID NO: 2600610 - RNA, 16 nt, Escherichia coli CFT073
ccgcaaaucgccgaga

SEQ ID NO: 2600611 - RNA, 22 nt, Escherichia coli CFT073
ccgcaacaauaacccccugccc

SEQ ID NO: 2600612 - RNA, 20 nt, Escherichia coli CFT073
ccgcaacagugaaauacagu

SEQ ID NO: 2600613 - RNA, 13 nt, Escherichia coli CFT073
ccgcaacauauaa

SEQ ID NO: 2600614 - RNA, 15 nt, Escherichia coli CFT073
ccgcaacauauaagu

SEQ ID NO: 2600615 - RNA, 17 nt, Escherichia coli CFT073
ccgcaacauaucuuuuu

SEQ ID NO: 2600616 - RNA, 20 nt, Escherichia coli CFT073
ccgcaaccgccguugccuuu

SEQ ID NO: 2600617 - RNA, 23 nt, Escherichia coli CFT073
ccgcaaccggccguaagaaaguc

SEQ ID NO: 2600618 - RNA, 14 nt, Escherichia coli CFT073
ccgcaacgacagaa

SEQ ID NO: 2600619 - RNA, 18 nt, Escherichia coli CFT073
ccgcaacgcccugcaacu

SEQ ID NO: 2600620 - RNA, 15 nt, Escherichia coli CFT073
ccgcaacgucaguga

SEQ ID NO: 2600621 - RNA, 14 nt, Escherichia coli CFT073
ccgcaacuaccagc

SEQ ID NO: 2600622 - RNA, 20 nt, Escherichia coli CFT073
ccgcaaucagcguuucgcca

SEQ ID NO: 2600623 - RNA, 23 nt, Escherichia coli CFT073
ccgcaaucagcguuucgccauaa

SEQ ID NO: 2600624 - RNA, 13 nt, Escherichia coli CFT073
ccgcaaucgcggc

SEQ ID NO: 2600625 - RNA, 13 nt, Escherichia coli CFT073
ccgcaaugugcuc

SEQ ID NO: 2600626 - RNA, 16 nt, Escherichia coli CFT073
ccgcaauuccgcccgu

SEQ ID NO: 2600627 - RNA, 14 nt, Escherichia coli CFT073
ccgcaauugcugua

SEQ ID NO: 2600628 - RNA, 24 nt, Escherichia coli CFT073
ccgcacaaagcacguugucuggcg

SEQ ID NO: 2600629 - RNA, 20 nt, Escherichia coli CFT073
ccgcacaaagcgguuuguga

SEQ ID NO: 2600630 - RNA, 18 nt, Escherichia coli CFT073
ccgcacaaauagccagca

SEQ ID NO: 2600631 - RNA, 21 nt, Escherichia coli CFT073
ccgcacauuucccggccacgc

SEQ ID NO: 2600632 - RNA, 13 nt, Escherichia coli CFT073
ccgcaccaaccau

SEQ ID NO: 2600633 - RNA, 14 nt, Escherichia coli CFT073
ccgcaccaccagca

SEQ ID NO: 2600634 - RNA, 16 nt, Escherichia coli CFT073
ccgcaccaccagcagc

SEQ ID NO: 2600635 - RNA, 15 nt, Escherichia coli CFT073
ccgcaccaccgagua

SEQ ID NO: 2600636 - RNA, 13 nt, Escherichia coli CFT073
ccgcaccaggcag

SEQ ID NO: 2600637 - RNA, 17 nt, Escherichia coli CFT073
ccgcaccgcgguacagc

SEQ ID NO: 2600638 - RNA, 15 nt, Escherichia coli CFT073
ccgcaccugccagcg

SEQ ID NO: 2600639 - RNA, 18 nt, Escherichia coli CFT073
ccgcaccugccagcgccg

SEQ ID NO: 2600640 - RNA, 18 nt, Escherichia coli CFT073
ccgcacgacgaaucugau

SEQ ID NO: 2600641 - RNA, 17 nt, Escherichia coli CFT073
ccgcacucuacuucuuc

SEQ ID NO: 2600642 - RNA, 21 nt, Escherichia coli CFT073
ccgcagagauagaacugcauu

SEQ ID NO: 2600643 - RNA, 19 nt, Escherichia coli CFT073
ccgcagcaacuacagcauu

SEQ ID NO: 2600644 - RNA, 13 nt, Escherichia coli CFT073
ccgcagccgccac

SEQ ID NO: 2600645 - RNA, 19 nt, Escherichia coli CFT073
ccgcagccggaaaaccauc

SEQ ID NO: 2600646 - RNA, 15 nt, Escherichia coli CFT073
ccgcagcguccagcg

SEQ ID NO: 2600647 - RNA, 16 nt, Escherichia coli CFT073
ccgcagcguccagcgc

SEQ ID NO: 2600648 - RNA, 13 nt, Escherichia coli CFT073
ccgcagcuccagc

SEQ ID NO: 2600649 - RNA, 17 nt, Escherichia coli CFT073
ccgcaggaugagcgcga

SEQ ID NO: 2600650 - RNA, 20 nt, Escherichia coli CFT073
ccgcagguagcagcagcgcc

SEQ ID NO: 2600651 - RNA, 21 nt, Escherichia coli CFT073
ccgcagguagcagcagcgcca

SEQ ID NO: 2600652 - RNA, 22 nt, Escherichia coli CFT073
ccgcaggucggauaagacgcgc

SEQ ID NO: 2600653 - RNA, 18 nt, Escherichia coli CFT073
ccgcauauuccaccacuu

SEQ ID NO: 2600654 - RNA, 19 nt, Escherichia coli CFT073
ccgcaucaggccgccagca

SEQ ID NO: 2600655 - RNA, 13 nt, Escherichia coli CFT073
ccgcaucauacug

SEQ ID NO: 2600656 - RNA, 15 nt, Escherichia coli CFT073
ccgcauccgacauca

SEQ ID NO: 2600657 - RNA, 14 nt, Escherichia coli CFT073
ccgcauccggcaag

SEQ ID NO: 2600658 - RNA, 19 nt, Escherichia coli CFT073
ccgcauccggcauaaacaa

SEQ ID NO: 2600659 - RNA, 20 nt, Escherichia coli CFT073
ccgcauccggcgacaggaac

SEQ ID NO: 2600660 - RNA, 21 nt, Escherichia coli CFT073
ccgcauccggcgauuuucauc

SEQ ID NO: 2600661 - RNA, 21 nt, Escherichia coli CFT073
ccgcauccggcguaaacaacg

SEQ ID NO: 2600662 - RNA, 20 nt, Escherichia coli CFT073
ccgcaucgccgguuuugcca

SEQ ID NO: 2600663 - RNA, 18 nt, Escherichia coli CFT073
ccgcaucgguuucgcuau

SEQ ID NO: 2600664 - RNA, 19 nt, Escherichia coli CFT073
ccgcaucguggccugcuca

SEQ ID NO: 2600665 - RNA, 16 nt, Escherichia coli CFT073
ccgcaugaguacgcgg

SEQ ID NO: 2600666 - RNA, 18 nt, Escherichia coli CFT073
ccgcauggaaccaguuca

SEQ ID NO: 2600667 - RNA, 18 nt, Escherichia coli CFT073
ccgcauucuucugaauau

SEQ ID NO: 2600668 - RNA, 19 nt, Escherichia coli CFT073
ccgcauugguaaaaccggu

SEQ ID NO: 2600669 - RNA, 20 nt, Escherichia coli CFT073
ccgcauuuuuucuucaguuc

SEQ ID NO: 2600670 - RNA, 14 nt, Escherichia coli CFT073
ccgccaaacgcggu

SEQ ID NO: 2600671 - RNA, 15 nt, Escherichia coli CFT073
ccgccaacagugccg

SEQ ID NO: 2600672 - RNA, 14 nt, Escherichia coli CFT073
ccgccaaucagcau

SEQ ID NO: 2600673 - RNA, 16 nt, Escherichia coli CFT073
ccgccaaucgccacgc

SEQ ID NO: 2600674 - RNA, 18 nt, Escherichia coli CFT073
ccgccaaucgccacgcca

SEQ ID NO: 2600675 - RNA, 15 nt, Escherichia coli CFT073
ccgccacagcagccu

SEQ ID NO: 2600676 - RNA, 12 nt, Escherichia coli CFT073
ccgccaccagaa

SEQ ID NO: 2600677 - RNA, 18 nt, Escherichia coli CFT073
ccgccaccagaaccgccg

SEQ ID NO: 2600678 - RNA, 19 nt, Escherichia coli CFT073
ccgccaccagaaccgccgc

SEQ ID NO: 2600679 - RNA, 20 nt, Escherichia coli CFT073
ccgccaccagaaccgccgcu

SEQ ID NO: 2600680 - RNA, 15 nt, Escherichia coli CFT073
ccgccaccagcguca

SEQ ID NO: 2600681 - RNA, 11 nt, Escherichia coli CFT073
ccgccaccagg

SEQ ID NO: 2600682 - RNA, 15 nt, Escherichia coli CFT073
ccgccaccgccagaa

SEQ ID NO: 2600683 - RNA, 20 nt, Escherichia coli CFT073
ccgccaccggcuuucgcuuc

SEQ ID NO: 2600684 - RNA, 18 nt, Escherichia coli CFT073
ccgccacuacggcgguga

SEQ ID NO: 2600685 - RNA, 23 nt, Escherichia coli CFT073
ccgccacuugagccgccaccaga

SEQ ID NO: 2600686 - RNA, 23 nt, Escherichia coli CFT073
ccgccagaaaggguguccacgcu

SEQ ID NO: 2600687 - RNA, 22 nt, Escherichia coli CFT073
ccgccagaaauuugcagugcug

SEQ ID NO: 2600688 - RNA, 14 nt, Escherichia coli CFT073
ccgccagaagggaa

SEQ ID NO: 2600689 - RNA, 23 nt, Escherichia coli CFT073
ccgccagaauacccgaagcgcca

SEQ ID NO: 2600690 - RNA, 22 nt, Escherichia coli CFT073
ccgccagaauccccggcaggaa

SEQ ID NO: 2600691 - RNA, 21 nt, Escherichia coli CFT073
ccgccagacaauccagcgaaa

SEQ ID NO: 2600692 - RNA, 17 nt, Escherichia coli CFT073
ccgccagauagccgcca

SEQ ID NO: 2600693 - RNA, 23 nt, Escherichia coli CFT073
ccgcguaaacgugcggcugugcg

SEQ ID NO: 2600694 - RNA, 16 nt, Escherichia coli CFT073
ccgcguaacgccagaa

SEQ ID NO: 2600695 - RNA, 15 nt, Escherichia coli CFT073
ccgcguacgccgcuc

SEQ ID NO: 2600696 - RNA, 15 nt, Escherichia coli CFT073
ccgcguaguugcgcu

SEQ ID NO: 2600697 - RNA, 14 nt, Escherichia coli CFT073
ccgcgucaaucugc

SEQ ID NO: 2600698 - RNA, 17 nt, Escherichia coli CFT073
ccgcguccgcucgguca

SEQ ID NO: 2600699 - RNA, 15 nt, Escherichia coli CFT073
ccgcgucgcccgugg

SEQ ID NO: 2600700 - RNA, 16 nt, Escherichia coli CFT073
ccgcgucuuauccggc

SEQ ID NO: 2600701 - RNA, 14 nt, Escherichia coli CFT073
ccgcgugacgcugg

SEQ ID NO: 2600702 - RNA, 17 nt, Escherichia coli CFT073
ccgcgugaugcggcauc

SEQ ID NO: 2600703 - RNA, 18 nt, Escherichia coli CFT073
ccgcgugcgcuggacgcc

SEQ ID NO: 2600704 - RNA, 13 nt, Escherichia coli CFT073
ccgcgugcugcga

SEQ ID NO: 2600705 - RNA, 18 nt, Escherichia coli CFT073
ccgcguucgccagcguca

SEQ ID NO: 2600706 - RNA, 22 nt, Escherichia coli CFT073
ccgcguuggcaaugucaaguga

SEQ ID NO: 2600707 - RNA, 15 nt, Escherichia coli CFT073
ccgcuaaauccgccg

SEQ ID NO: 2600708 - RNA, 22 nt, Escherichia coli CFT073
ccgcuaaauccgccgccacuug

SEQ ID NO: 2600709 - RNA, 23 nt, Escherichia coli CFT073
ccgcuaacaugguuaaaaucucc

SEQ ID NO: 2600710 - RNA, 15 nt, Escherichia coli CFT073
ccgcuaacugauacc

SEQ ID NO: 2600711 - RNA, 19 nt, Escherichia coli CFT073
ccgcuaaugcgacccacgc

SEQ ID NO: 2600712 - RNA, 22 nt, Escherichia coli CFT073
ccgcuaaugcgacccacgcccc

SEQ ID NO: 2600713 - RNA, 13 nt, Escherichia coli CFT073
ccgcuacaucacc

SEQ ID NO: 2600714 - RNA, 14 nt, Escherichia coli CFT073
ccgcuacaucaccg

SEQ ID NO: 2600715 - RNA, 12 nt, Escherichia coli CFT073
ccgcuaccgccc

SEQ ID NO: 2600716 - RNA, 15 nt, Escherichia coli CFT073
ccgcuaccugccgcc

SEQ ID NO: 2600717 - RNA, 19 nt, Escherichia coli CFT073
ccgcuacucugacccagaa

SEQ ID NO: 2600718 - RNA, 22 nt, Escherichia coli CFT073
ccgcuaguucucgggcggcagg

SEQ ID NO: 2600719 - RNA, 14 nt, Escherichia coli CFT073
ccgcuauguuuauu

SEQ ID NO: 2600720 - RNA, 15 nt, Escherichia coli CFT073
ccgcuauuauacugc

SEQ ID NO: 2600721 - RNA, 17 nt, Escherichia coli CFT073
ccgcuauugaccagcgc

SEQ ID NO: 2600722 - RNA, 19 nt, Escherichia coli CFT073
ccgcucacgcagcggcggc

SEQ ID NO: 2600723 - RNA, 19 nt, Escherichia coli CFT073
ccgcucaucaccgcaaagu

SEQ ID NO: 2600724 - RNA, 14 nt, Escherichia coli CFT073
ccgcuccgccaucu

SEQ ID NO: 2600725 - RNA, 13 nt, Escherichia coli CFT073
ccgcuccggcagc

SEQ ID NO: 2600726 - RNA, 18 nt, Escherichia coli CFT073
ccgcuccggcagcagcac

SEQ ID NO: 2600727 - RNA, 14 nt, Escherichia coli CFT073
ccgcucucuucgug

SEQ ID NO: 2600728 - RNA, 21 nt, Escherichia coli CFT073
ccgcucucuucguggcccgcc

SEQ ID NO: 2600729 - RNA, 18 nt, Escherichia coli CFT073
ccgcucugaaagcggccu

SEQ ID NO: 2600730 - RNA, 11 nt, Escherichia coli CFT073
ccgcucugccc

SEQ ID NO: 2600731 - RNA, 16 nt, Escherichia coli CFT073
ccgcucugcuucgccu

SEQ ID NO: 2600732 - RNA, 18 nt, Escherichia coli CFT073
ccgcucuucaucuuccag

SEQ ID NO: 2600733 - RNA, 15 nt, Escherichia coli CFT073
ccgcugaugcagcgu

SEQ ID NO: 2600734 - RNA, 11 nt, Escherichia coli CFT073
ccgcugauuca

SEQ ID NO: 2600735 - RNA, 19 nt, Escherichia coli CFT073
ccgcugauugcuggcgggc

SEQ ID NO: 2600736 - RNA, 19 nt, Escherichia coli CFT073
ccgcugcaacacuuccgcu

SEQ ID NO: 2600737 - RNA, 21 nt, Escherichia coli CFT073
ccgcugcgauuucagcgccgc

SEQ ID NO: 2600738 - RNA, 14 nt, Escherichia coli CFT073
ccgcugcgccauaa

SEQ ID NO: 2600739 - RNA, 21 nt, Escherichia coli CFT073
ccgcugcuggcguugucaucg

SEQ ID NO: 2600740 - RNA, 22 nt, Escherichia coli CFT073
ccgcugguggauguuugcagua

SEQ ID NO: 2600741 - RNA, 17 nt, Escherichia coli CFT073
ccgcuguaauugccgcu

SEQ ID NO: 2600742 - RNA, 17 nt, Escherichia coli CFT073
ccgcugucuaccagcac

SEQ ID NO: 2600743 - RNA, 17 nt, Escherichia coli CFT073
ccgcugucugaaugaua

SEQ ID NO: 2600744 - RNA, 21 nt, Escherichia coli CFT073
ccgcuguuauugucggcagau

SEQ ID NO: 2600745 - RNA, 17 nt, Escherichia coli CFT073
ccgcuguucugauuuug

SEQ ID NO: 2600746 - RNA, 18 nt, Escherichia coli CFT073
ccgcuguugccagcagca

SEQ ID NO: 2600747 - RNA, 14 nt, Escherichia coli CFT073
ccgcuguugcuucc

SEQ ID NO: 2600748 - RNA, 21 nt, Escherichia coli CFT073
ccgcuguuuguucaagcgcaa

SEQ ID NO: 2600749 - RNA, 22 nt, Escherichia coli CFT073
ccgcuuaagcugccugcuaaca

SEQ ID NO: 2600750 - RNA, 21 nt, Escherichia coli CFT073
ccgcuucaaaguucugcgucu

SEQ ID NO: 2600751 - RNA, 14 nt, Escherichia coli CFT073
ccgcuucacucccu

SEQ ID NO: 2600752 - RNA, 14 nt, Escherichia coli CFT073
ccgcuucauagccg

SEQ ID NO: 2600753 - RNA, 15 nt, Escherichia coli CFT073
ccgcuucgcccgcca

SEQ ID NO: 2600754 - RNA, 14 nt, Escherichia coli CFT073
ccgcuucugcagcu

SEQ ID NO: 2600755 - RNA, 19 nt, Escherichia coli CFT073
ccgcuuuccucaucagaaa

SEQ ID NO: 2600756 - RNA, 15 nt, Escherichia coli CFT073
ccgcuuuuccggcau

SEQ ID NO: 2600757 - RNA, 21 nt, Escherichia coli CFT073
ccgcuuuugguuuuucaacca

SEQ ID NO: 2600758 - RNA, 17 nt, Escherichia coli CFT073
ccgcuuuuuucaucucu

SEQ ID NO: 2600759 - RNA, 18 nt, Escherichia coli CFT073
ccggaaaaaucaaaaacu

SEQ ID NO: 2600760 - RNA, 12 nt, Escherichia coli CFT073
ccggaaagcgua

SEQ ID NO: 2600761 - RNA, 19 nt, Escherichia coli CFT073
ccggaacaaaugaaagcag

SEQ ID NO: 2600762 - RNA, 14 nt, Escherichia coli CFT073
ccggaaccaccaga

SEQ ID NO: 2600763 - RNA, 16 nt, Escherichia coli CFT073
ccggaaccagcgccug

SEQ ID NO: 2600764 - RNA, 22 nt, Escherichia coli CFT073
ccggaaccggcaacggcgugag

SEQ ID NO: 2600765 - RNA, 17 nt, Escherichia coli CFT073
ccggaaccugacggcgc

SEQ ID NO: 2600766 - RNA, 11 nt, Escherichia coli CFT073
ccggaacgugc

SEQ ID NO: 2600767 - RNA, 14 nt, Escherichia coli CFT073
ccggaacgugcaua

SEQ ID NO: 2600768 - RNA, 17 nt, Escherichia coli CFT073
ccggaagcgccaccagc

SEQ ID NO: 2600769 - RNA, 18 nt, Escherichia coli CFT073
ccggaagcgugcaucggc

SEQ ID NO: 2600770 - RNA, 20 nt, Escherichia coli CFT073
ccggaagcuacgguugucuu

SEQ ID NO: 2600771 - RNA, 23 nt, Escherichia coli CFT073
ccggaaggaagacguagcaagca

SEQ ID NO: 2600772 - RNA, 15 nt, Escherichia coli CFT073
ccggaaguccgagga

SEQ ID NO: 2600773 - RNA, 12 nt, Escherichia coli CFT073
ccggaauaccac

SEQ ID NO: 2600774 - RNA, 15 nt, Escherichia coli CFT073
ccggaauagcuuuac

SEQ ID NO: 2600775 - RNA, 19 nt, Escherichia coli CFT073
ccggaaucagaauccggug

SEQ ID NO: 2600776 - RNA, 21 nt, Escherichia coli CFT073
ccggaauuucuuucagcaguu

SEQ ID NO: 2600777 - RNA, 19 nt, Escherichia coli CFT073
ccggacacucggcgcggau

SEQ ID NO: 2600778 - RNA, 19 nt, Escherichia coli CFT073
ccggaccggucggggccag

SEQ ID NO: 2600779 - RNA, 17 nt, Escherichia coli CFT073
ccggacgacggcaucgc

SEQ ID NO: 2600780 - RNA, 15 nt, Escherichia coli CFT073
ccggacggcaauucc

SEQ ID NO: 2600781 - RNA, 12 nt, Escherichia coli CFT073
ccggacgucagg

SEQ ID NO: 2600782 - RNA, 19 nt, Escherichia coli CFT073
ccggacguuugauuuuuaa

SEQ ID NO: 2600783 - RNA, 20 nt, Escherichia coli CFT073
ccggacguuugauuuuuaac

SEQ ID NO: 2600784 - RNA, 18 nt, Escherichia coli CFT073
ccggacuccagacaccgc

SEQ ID NO: 2600785 - RNA, 16 nt, Escherichia coli CFT073
ccggagaaauccgggg

SEQ ID NO: 2600786 - RNA, 17 nt, Escherichia coli CFT073
ccggagacaaacagggu

SEQ ID NO: 2600787 - RNA, 22 nt, Escherichia coli CFT073
ccggagacauuacguccaucac

SEQ ID NO: 2600788 - RNA, 12 nt, Escherichia coli CFT073
ccggagcuggcg

SEQ ID NO: 2600789 - RNA, 18 nt, Escherichia coli CFT073
ccggaggagugcgccagu

SEQ ID NO: 2600790 - RNA, 17 nt, Escherichia coli CFT073
ccggagguuuuucaaau

SEQ ID NO: 2600791 - RNA, 22 nt, Escherichia coli CFT073
ccggauaaggcauuuacgccgc

SEQ ID NO: 2600792 - RNA, 18 nt, Escherichia coli CFT073
ccggauaaggcgcgucaa

SEQ ID NO: 2600793 - RNA, 19 nt, Escherichia coli CFT073
ccggauaaucggcaauacu

SEQ ID NO: 2600794 - RNA, 17 nt, Escherichia coli CFT073
ccggauacagccccagc

SEQ ID NO: 2600795 - RNA, 20 nt, Escherichia coli CFT073
ccggauaccccagcuggcgc

SEQ ID NO: 2600796 - RNA, 13 nt, Escherichia coli CFT073
ccggaucgccaaa

SEQ ID NO: 2600797 - RNA, 16 nt, Escherichia coli CFT073
ccggaucugccauauc

SEQ ID NO: 2600798 - RNA, 17 nt, Escherichia coli CFT073
ccggaucugccauaucc

SEQ ID NO: 2600799 - RNA, 23 nt, Escherichia coli CFT073
ccggaugaguaaacuucaacgcu

SEQ ID NO: 2600800 - RNA, 19 nt, Escherichia coli CFT073
ccggaugcaacgcuggcgc

SEQ ID NO: 2600801 - RNA, 16 nt, Escherichia coli CFT073
ccggaugcaccaucuc

SEQ ID NO: 2600802 - RNA, 18 nt, Escherichia coli CFT073
ccggcuucgucgccagcu

SEQ ID NO: 2600803 - RNA, 16 nt, Escherichia coli CFT073
ccggcuucuucugccg

SEQ ID NO: 2600804 - RNA, 20 nt, Escherichia coli CFT073
ccggcuucuucugccgcuuc

SEQ ID NO: 2600805 - RNA, 16 nt, Escherichia coli CFT073
ccggcuucuuuugcug

SEQ ID NO: 2600806 - RNA, 23 nt, Escherichia coli CFT073
ccggcuucuuuugcugccuucac

SEQ ID NO: 2600807 - RNA, 22 nt, Escherichia coli CFT073
ccggcuuucaccugaucaauuu

SEQ ID NO: 2600808 - RNA, 13 nt, Escherichia coli CFT073
ccgggaaaacauc

SEQ ID NO: 2600809 - RNA, 19 nt, Escherichia coli CFT073
ccgggaaauccucaaccgg

SEQ ID NO: 2600810 - RNA, 20 nt, Escherichia coli CFT073
ccgggaacaccgguauucuc

SEQ ID NO: 2600811 - RNA, 14 nt, Escherichia coli CFT073
ccgggaaggaaccu

SEQ ID NO: 2600812 - RNA, 18 nt, Escherichia coli CFT073
ccgggaaucgaaaugcca

SEQ ID NO: 2600813 - RNA, 12 nt, Escherichia coli CFT073
ccgggagcggcg

SEQ ID NO: 2600814 - RNA, 22 nt, Escherichia coli CFT073
ccgggauauaugucaccagcau

SEQ ID NO: 2600815 - RNA, 18 nt, Escherichia coli CFT073
ccgggaucagacgaccca

SEQ ID NO: 2600816 - RNA, 22 nt, Escherichia coli CFT073
ccgggaucauaaccaacaaaac

SEQ ID NO: 2600817 - RNA, 14 nt, Escherichia coli CFT073
ccgggcaaaaguca

SEQ ID NO: 2600818 - RNA, 12 nt, Escherichia coli CFT073
ccgggcaaaugc

SEQ ID NO: 2600819 - RNA, 17 nt, Escherichia coli CFT073
ccgggcaaaugcucccc

SEQ ID NO: 2600820 - RNA, 19 nt, Escherichia coli CFT073
ccgggcaaaugcuccccug

SEQ ID NO: 2600821 - RNA, 14 nt, Escherichia coli CFT073
ccgggcaugaacaa

SEQ ID NO: 2600822 - RNA, 20 nt, Escherichia coli CFT073
ccgggccucgcagcggcagc

SEQ ID NO: 2600823 - RNA, 17 nt, Escherichia coli CFT073
ccgggcgaugcagcgca

SEQ ID NO: 2600824 - RNA, 19 nt, Escherichia coli CFT073
ccgggcuccauagggcagg

SEQ ID NO: 2600825 - RNA, 17 nt, Escherichia coli CFT073
ccgggcugguuuucagc

SEQ ID NO: 2600826 - RNA, 22 nt, Escherichia coli CFT073
ccgggcuguuuuccagcaccac

SEQ ID NO: 2600827 - RNA, 21 nt, Escherichia coli CFT073
ccggggagauauuccccagac

SEQ ID NO: 2600828 - RNA, 13 nt, Escherichia coli CFT073
ccgggguaauucc

SEQ ID NO: 2600829 - RNA, 16 nt, Escherichia coli CFT073
ccggggucaaaccugg

SEQ ID NO: 2600830 - RNA, 16 nt, Escherichia coli CFT073
ccgggguuucacccac

SEQ ID NO: 2600831 - RNA, 19 nt, Escherichia coli CFT073
ccgggguuuugcugauuaa

SEQ ID NO: 2600832 - RNA, 15 nt, Escherichia coli CFT073
ccggguaaacaccac

SEQ ID NO: 2600833 - RNA, 15 nt, Escherichia coli CFT073
ccggguagcgcggca

SEQ ID NO: 2600834 - RNA, 15 nt, Escherichia coli CFT073
ccgggucagcgggau

SEQ ID NO: 2600835 - RNA, 14 nt, Escherichia coli CFT073
ccgggugaacugcc

SEQ ID NO: 2600836 - RNA, 16 nt, Escherichia coli CFT073
ccgggugaacugccac

SEQ ID NO: 2600837 - RNA, 19 nt, Escherichia coli CFT073
ccggguggaucauuuucau

SEQ ID NO: 2600838 - RNA, 15 nt, Escherichia coli CFT073
ccgggugugacaaca

SEQ ID NO: 2600839 - RNA, 19 nt, Escherichia coli CFT073
ccggguguucuuucucgcc

SEQ ID NO: 2600840 - RNA, 16 nt, Escherichia coli CFT073
ccggguuacggaaacu

SEQ ID NO: 2600841 - RNA, 13 nt, Escherichia coli CFT073
ccggguucucgca

SEQ ID NO: 2600842 - RNA, 21 nt, Escherichia coli CFT073
ccggguuuccuggagaguguu

SEQ ID NO: 2600843 - RNA, 19 nt, Escherichia coli CFT073
ccggguuuucaaugauaaa

SEQ ID NO: 2600844 - RNA, 14 nt, Escherichia coli CFT073
ccgguaaacaaaaa

SEQ ID NO: 2600845 - RNA, 15 nt, Escherichia coli CFT073
ccgguaaagcgcaug

SEQ ID NO: 2600846 - RNA, 21 nt, Escherichia coli CFT073
ccgguaacccuucauauuccu

SEQ ID NO: 2600847 - RNA, 15 nt, Escherichia coli CFT073
ccgguaacggaccgc

SEQ ID NO: 2600848 - RNA, 19 nt, Escherichia coli CFT073
ccgguaaucaccagcaaca

SEQ ID NO: 2600849 - RNA, 14 nt, Escherichia coli CFT073
ccgguaaucaggca

SEQ ID NO: 2600850 - RNA, 17 nt, Escherichia coli CFT073
ccgguaauuccagcggu

SEQ ID NO: 2600851 - RNA, 21 nt, Escherichia coli CFT073
ccgguacaaacaucauccagu

SEQ ID NO: 2600852 - RNA, 17 nt, Escherichia coli CFT073
ccgguacacaaccgccg

SEQ ID NO: 2600853 - RNA, 16 nt, Escherichia coli CFT073
ccgguacgccagaccu

SEQ ID NO: 2600854 - RNA, 13 nt, Escherichia coli CFT073
ccgguacgccgcg

SEQ ID NO: 2600855 - RNA, 13 nt, Escherichia coli CFT073
ccgguagaugcca

SEQ ID NO: 2600856 - RNA, 14 nt, Escherichia coli CFT073
ccgguagccauuuu

SEQ ID NO: 2600857 - RNA, 19 nt, Escherichia coli CFT073
ccgguagcuggugaacauu

SEQ ID NO: 2600858 - RNA, 23 nt, Escherichia coli CFT073
ccgguagucaggaagccccagcu

SEQ ID NO: 2600859 - RNA, 21 nt, Escherichia coli CFT073
ccgguauaacuugccaggccg

SEQ ID NO: 2600860 - RNA, 15 nt, Escherichia coli CFT073
ccgguauccaucaga

SEQ ID NO: 2600861 - RNA, 23 nt, Escherichia coli CFT073
ccgguauguucagaaagcgccag

SEQ ID NO: 2600862 - RNA, 21 nt, Escherichia coli CFT073
ccggucaacccaaccugccag

SEQ ID NO: 2600863 - RNA, 17 nt, Escherichia coli CFT073
ccggucacgccggggau

SEQ ID NO: 2600864 - RNA, 13 nt, Escherichia coli CFT073
ccggucagcagca

SEQ ID NO: 2600865 - RNA, 18 nt, Escherichia coli CFT073
ccggucagcagcaccacc

SEQ ID NO: 2600866 - RNA, 23 nt, Escherichia coli CFT073
ccggucgugacugccgccagcau

SEQ ID NO: 2600867 - RNA, 20 nt, Escherichia coli CFT073
ccggucuaccgauccggcac

SEQ ID NO: 2600868 - RNA, 17 nt, Escherichia coli CFT073
ccggucucagcccagau

SEQ ID NO: 2600869 - RNA, 12 nt, Escherichia coli CFT073
ccggucuuucuu

SEQ ID NO: 2600870 - RNA, 22 nt, Escherichia coli CFT073
ccggucuuucuuuuuuucacuu

SEQ ID NO: 2600871 - RNA, 16 nt, Escherichia coli CFT073
ccggugaccaucagca

SEQ ID NO: 2600872 - RNA, 14 nt, Escherichia coli CFT073
ccggugauugcugc

SEQ ID NO: 2600873 - RNA, 11 nt, Escherichia coli CFT073
ccggugcauuc

SEQ ID NO: 2600874 - RNA, 13 nt, Escherichia coli CFT073
ccggugccaucuc

SEQ ID NO: 2600875 - RNA, 20 nt, Escherichia coli CFT073
ccggugcccgccagugcauc

SEQ ID NO: 2600876 - RNA, 16 nt, Escherichia coli CFT073
ccggugccgccgucag

SEQ ID NO: 2600877 - RNA, 17 nt, Escherichia coli CFT073
ccggugcgggaguugau

SEQ ID NO: 2600878 - RNA, 17 nt, Escherichia coli CFT073
ccggugcguauucggca

SEQ ID NO: 2600879 - RNA, 21 nt, Escherichia coli CFT073
ccgguggcgugaaugcgccaa

SEQ ID NO: 2600880 - RNA, 19 nt, Escherichia coli CFT073
ccggugucaugcgggcgag

SEQ ID NO: 2600881 - RNA, 22 nt, Escherichia coli CFT073
ccgguguucccguccgcacgcu

SEQ ID NO: 2600882 - RNA, 22 nt, Escherichia coli CFT073
ccgguuaaaucgacguucugcc

SEQ ID NO: 2600883 - RNA, 19 nt, Escherichia coli CFT073
ccgguuaaucuaaucugua

SEQ ID NO: 2600884 - RNA, 17 nt, Escherichia coli CFT073
ccgguuacggauuuccc

SEQ ID NO: 2600885 - RNA, 23 nt, Escherichia coli CFT073
ccgguuauuuuuauauagccagc

SEQ ID NO: 2600886 - RNA, 13 nt, Escherichia coli CFT073
ccgguucgcuuuu

SEQ ID NO: 2600887 - RNA, 18 nt, Escherichia coli CFT073
ccgguucgucauacucca

SEQ ID NO: 2600888 - RNA, 19 nt, Escherichia coli CFT073
ccgguugcagcucugccau

SEQ ID NO: 2600889 - RNA, 18 nt, Escherichia coli CFT073
ccgguugucgugguuggu

SEQ ID NO: 2600890 - RNA, 22 nt, Escherichia coli CFT073
ccgguuuaaucgauuuagaacu

SEQ ID NO: 2600891 - RNA, 20 nt, Escherichia coli CFT073
ccgguuuacucaacaaccag

SEQ ID NO: 2600892 - RNA, 15 nt, Escherichia coli CFT073
ccgguuucaaaacug

SEQ ID NO: 2600893 - RNA, 16 nt, Escherichia coli CFT073
ccgguuucccggcaau

SEQ ID NO: 2600894 - RNA, 15 nt, Escherichia coli CFT073
ccgguuucgccgcgg

SEQ ID NO: 2600895 - RNA, 15 nt, Escherichia coli CFT073
ccgguuuggcauaac

SEQ ID NO: 2600896 - RNA, 18 nt, Escherichia coli CFT073
ccgguuuuacuuugccuu

SEQ ID NO: 2600897 - RNA, 13 nt, Escherichia coli CFT073
ccgguuuucugcc

SEQ ID NO: 2600898 - RNA, 16 nt, Escherichia coli CFT073
ccgguuuugcaggaaa

SEQ ID NO: 2600899 - RNA, 16 nt, Escherichia coli CFT073
ccgguuuugguuuucu

SEQ ID NO: 2600900 - RNA, 12 nt, Escherichia coli CFT073
ccgguuuuucaa

SEQ ID NO: 2600901 - RNA, 13 nt, Escherichia coli CFT073
ccgguuuuucugg

SEQ ID NO: 2600902 - RNA, 18 nt, Escherichia coli CFT073
ccguaaaaaucggcaaca

SEQ ID NO: 2600903 - RNA, 20 nt, Escherichia coli CFT073
ccguaaaacucacaaccagg

SEQ ID NO: 2600904 - RNA, 20 nt, Escherichia coli CFT073
ccguaaagcccauaccacag

SEQ ID NO: 2600905 - RNA, 22 nt, Escherichia coli CFT073
ccguaaaucgucaguagcgcaa

SEQ ID NO: 2600906 - RNA, 18 nt, Escherichia coli CFT073
ccguaacauaacagccau

SEQ ID NO: 2600907 - RNA, 16 nt, Escherichia coli CFT073
ccguaaccaccagcac

SEQ ID NO: 2600908 - RNA, 13 nt, Escherichia coli CFT073
ccguaaccagcgc

SEQ ID NO: 2600909 - RNA, 19 nt, Escherichia coli CFT073
ccguaacgccuuucaggug

SEQ ID NO: 2600910 - RNA, 15 nt, Escherichia coli CFT073
ccguuccaacgccac

SEQ ID NO: 2600911 - RNA, 17 nt, Escherichia coli CFT073
ccguuccacccagcuca

SEQ ID NO: 2600912 - RNA, 14 nt, Escherichia coli CFT073
ccguuccagcguuc

SEQ ID NO: 2600913 - RNA, 13 nt, Escherichia coli CFT073
ccguuccggcaac

SEQ ID NO: 2600914 - RNA, 17 nt, Escherichia coli CFT073
ccguucucaccaacugg

SEQ ID NO: 2600915 - RNA, 22 nt, Escherichia coli CFT073
ccguucuggacuuccccugcca

SEQ ID NO: 2600916 - RNA, 18 nt, Escherichia coli CFT073
ccguucuucccgccuguc

SEQ ID NO: 2600917 - RNA, 18 nt, Escherichia coli CFT073
ccguugaggcgaucgucg

SEQ ID NO: 2600918 - RNA, 18 nt, Escherichia coli CFT073
ccguugccgcauugcgca

SEQ ID NO: 2600919 - RNA, 20 nt, Escherichia coli CFT073
ccguugccgguuaucccgcu

SEQ ID NO: 2600920 - RNA, 16 nt, Escherichia coli CFT073
ccguugcgcgucaacu

SEQ ID NO: 2600921 - RNA, 20 nt, Escherichia coli CFT073
ccguugcuucgccgcaucgu

SEQ ID NO: 2600922 - RNA, 16 nt, Escherichia coli CFT073
ccguugcuucuagugc

SEQ ID NO: 2600923 - RNA, 22 nt, Escherichia coli CFT073
ccguuggcauuucgaccauggu

SEQ ID NO: 2600924 - RNA, 22 nt, Escherichia coli CFT073
ccguuggcggcgugacgccaga

SEQ ID NO: 2600925 - RNA, 17 nt, Escherichia coli CFT073
ccguugguuauccuggu

SEQ ID NO: 2600926 - RNA, 20 nt, Escherichia coli CFT073
ccguuguaaaugcugcucca

SEQ ID NO: 2600927 - RNA, 19 nt, Escherichia coli CFT073
ccguugugcgauccacgcc

SEQ ID NO: 2600928 - RNA, 20 nt, Escherichia coli CFT073
ccguugugcgauccacgcca

SEQ ID NO: 2600929 - RNA, 17 nt, Escherichia coli CFT073
ccguuuaauugccucuu

SEQ ID NO: 2600930 - RNA, 15 nt, Escherichia coli CFT073
ccguuugccagaacu

SEQ ID NO: 2600931 - RNA, 19 nt, Escherichia coli CFT073
ccguuuguaggccugauaa

SEQ ID NO: 2600932 - RNA, 16 nt, Escherichia coli CFT073
ccguuuuaaaucgccg

SEQ ID NO: 2600933 - RNA, 14 nt, Escherichia coli CFT073
ccguuuucacccuc

SEQ ID NO: 2600934 - RNA, 14 nt, Escherichia coli CFT073
ccguuuucaccuua

SEQ ID NO: 2600935 - RNA, 18 nt, Escherichia coli CFT073
ccguuuuuacccagcagc

SEQ ID NO: 2600936 - RNA, 19 nt, Escherichia coli CFT073
ccguuuuuuuaucccuucu

SEQ ID NO: 2600937 - RNA, 14 nt, Escherichia coli CFT073
ccuaaaccaucagc

SEQ ID NO: 2600938 - RNA, 14 nt, Escherichia coli CFT073
ccuaaacccugagu

SEQ ID NO: 2600939 - RNA, 20 nt, Escherichia coli CFT073
ccuaaacgcgccgcuuuuuc

SEQ ID NO: 2600940 - RNA, 20 nt, Escherichia coli CFT073
ccuaaagagaaaccccggca

SEQ ID NO: 2600941 - RNA, 13 nt, Escherichia coli CFT073
ccuaaaggcaaaa

SEQ ID NO: 2600942 - RNA, 19 nt, Escherichia coli CFT073
ccuaaauaaacaccagcag

SEQ ID NO: 2600943 - RNA, 20 nt, Escherichia coli CFT073
ccuaaauaaacaccagcagu

SEQ ID NO: 2600944 - RNA, 17 nt, Escherichia coli CFT073
ccuaaauggaaaauugg

SEQ ID NO: 2600945 - RNA, 14 nt, Escherichia coli CFT073
ccuaaauuuuucca

SEQ ID NO: 2600946 - RNA, 15 nt, Escherichia coli CFT073
ccuaaauuuuuccac

SEQ ID NO: 2600947 - RNA, 17 nt, Escherichia coli CFT073
ccuaacaaccaucccca

SEQ ID NO: 2600948 - RNA, 12 nt, Escherichia coli CFT073
ccuaacacagca

SEQ ID NO: 2600949 - RNA, 15 nt, Escherichia coli CFT073
ccuaacacaugcaag

SEQ ID NO: 2600950 - RNA, 21 nt, Escherichia coli CFT073
ccuaacacaugcaagucgaac

SEQ ID NO: 2600951 - RNA, 23 nt, Escherichia coli CFT073
ccuaacagggcgcuguugcuauc

SEQ ID NO: 2600952 - RNA, 13 nt, Escherichia coli CFT073
ccuaacaucaucc

SEQ ID NO: 2600953 - RNA, 18 nt, Escherichia coli CFT073
ccuaacccucuccccgga

SEQ ID NO: 2600954 - RNA, 15 nt, Escherichia coli CFT073
ccuaagaaccagaau

SEQ ID NO: 2600955 - RNA, 21 nt, Escherichia coli CFT073
ccuaagaaccagaauuuccag

SEQ ID NO: 2600956 - RNA, 19 nt, Escherichia coli CFT073
ccuaauaccguuccaacgc

SEQ ID NO: 2600957 - RNA, 13 nt, Escherichia coli CFT073
ccuaauacucugg

SEQ ID NO: 2600958 - RNA, 16 nt, Escherichia coli CFT073
ccuaauggagaaacga

SEQ ID NO: 2600959 - RNA, 20 nt, Escherichia coli CFT073
ccuaaugucgacauaaucaa

SEQ ID NO: 2600960 - RNA, 13 nt, Escherichia coli CFT073
ccuacaaaccauc

SEQ ID NO: 2600961 - RNA, 16 nt, Escherichia coli CFT073
ccuacaaaccaucuga

SEQ ID NO: 2600962 - RNA, 20 nt, Escherichia coli CFT073
ccuacaaaggcacgccaauu

SEQ ID NO: 2600963 - RNA, 17 nt, Escherichia coli CFT073
ccuacaauuucagugau

SEQ ID NO: 2600964 - RNA, 13 nt, Escherichia coli CFT073
ccuacacaccuuc

SEQ ID NO: 2600965 - RNA, 13 nt, Escherichia coli CFT073
ccuacacacgcca

SEQ ID NO: 2600966 - RNA, 18 nt, Escherichia coli CFT073
ccuacacauuaucucaac

SEQ ID NO: 2600967 - RNA, 23 nt, Escherichia coli CFT073
ccuacaccccagccggucagcag

SEQ ID NO: 2600968 - RNA, 19 nt, Escherichia coli CFT073
ccuacacguugaaacuuau

SEQ ID NO: 2600969 - RNA, 13 nt, Escherichia coli CFT073
ccuacagccacac

SEQ ID NO: 2600970 - RNA, 20 nt, Escherichia coli CFT073
ccuacauagccccugcaaua

SEQ ID NO: 2600971 - RNA, 17 nt, Escherichia coli CFT073
ccuacauauccgcgccu

SEQ ID NO: 2600972 - RNA, 20 nt, Escherichia coli CFT073
ccuacaugauuucugcaaua

SEQ ID NO: 2600973 - RNA, 13 nt, Escherichia coli CFT073
ccuaccaacgcac

SEQ ID NO: 2600974 - RNA, 18 nt, Escherichia coli CFT073
ccuaccagagauagcgaa

SEQ ID NO: 2600975 - RNA, 15 nt, Escherichia coli CFT073
ccuacgcuugcugcg

SEQ ID NO: 2600976 - RNA, 18 nt, Escherichia coli CFT073
ccuacgggaacagugcuu

SEQ ID NO: 2600977 - RNA, 20 nt, Escherichia coli CFT073
ccuacguuaaaacacacuac

SEQ ID NO: 2600978 - RNA, 21 nt, Escherichia coli CFT073
ccuacuaccaguagugaaaaa

SEQ ID NO: 2600979 - RNA, 13 nt, Escherichia coli CFT073
ccuacucucgcau

SEQ ID NO: 2600980 - RNA, 12 nt, Escherichia coli CFT073
ccuauauauuua

SEQ ID NO: 2600981 - RNA, 22 nt, Escherichia coli CFT073
ccuaucaucgcggcacacagca

SEQ ID NO: 2600982 - RNA, 17 nt, Escherichia coli CFT073
ccuauuucauucaggcc

SEQ ID NO: 2600983 - RNA, 13 nt, Escherichia coli CFT073
ccucaaaaagaaa

SEQ ID NO: 2600984 - RNA, 16 nt, Escherichia coli CFT073
ccucaaaagguucagc

SEQ ID NO: 2600985 - RNA, 16 nt, Escherichia coli CFT073
ccucaacaaucgucag

SEQ ID NO: 2600986 - RNA, 17 nt, Escherichia coli CFT073
ccucaacaaucgucagc

SEQ ID NO: 2600987 - RNA, 15 nt, Escherichia coli CFT073
ccucaacaucuucac

SEQ ID NO: 2600988 - RNA, 16 nt, Escherichia coli CFT073
ccucaacaucuucacc

SEQ ID NO: 2600989 - RNA, 15 nt, Escherichia coli CFT073
ccucaacggaauaaa

SEQ ID NO: 2600990 - RNA, 13 nt, Escherichia coli CFT073
ccucaagaaucac

SEQ ID NO: 2600991 - RNA, 14 nt, Escherichia coli CFT073
ccucaagcguugcu

SEQ ID NO: 2600992 - RNA, 12 nt, Escherichia coli CFT073
ccucaauaauca

SEQ ID NO: 2600993 - RNA, 15 nt, Escherichia coli CFT073
ccucaauaaucauuc

SEQ ID NO: 2600994 - RNA, 13 nt, Escherichia coli CFT073
ccucaaucagcgg

SEQ ID NO: 2600995 - RNA, 18 nt, Escherichia coli CFT073
ccucaaucagcggcucau

SEQ ID NO: 2600996 - RNA, 20 nt, Escherichia coli CFT073
ccucaaucagcggcucaugu

SEQ ID NO: 2600997 - RNA, 22 nt, Escherichia coli CFT073
ccucaaugaaucgcagucucuu

SEQ ID NO: 2600998 - RNA, 17 nt, Escherichia coli CFT073
ccucacagcuaaucauc

SEQ ID NO: 2600999 - RNA, 16 nt, Escherichia coli CFT073
ccucaccucaauggca

SEQ ID NO: 2601000 - RNA, 21 nt, Escherichia coli CFT073
ccucacgguuuugcucggcaa

SEQ ID NO: 2601001 - RNA, 23 nt, Escherichia coli CFT073
ccucacgguuuugcucggcaauc

SEQ ID NO: 2601002 - RNA, 18 nt, Escherichia coli CFT073
ccucacuuaaagcaacac

SEQ ID NO: 2601003 - RNA, 21 nt, Escherichia coli CFT073
ccucacuuaaagcaacaccau

SEQ ID NO: 2601004 - RNA, 15 nt, Escherichia coli CFT073
ccucacuuugauuua

SEQ ID NO: 2601005 - RNA, 20 nt, Escherichia coli CFT073
ccucagcauaugcuucuucc

SEQ ID NO: 2601006 - RNA, 14 nt, Escherichia coli CFT073
ccucagccacacuu

SEQ ID NO: 2601007 - RNA, 21 nt, Escherichia coli CFT073
ccucagccgaaacacacaaag

SEQ ID NO: 2601008 - RNA, 14 nt, Escherichia coli CFT073
ccucagccuucugu

SEQ ID NO: 2601009 - RNA, 16 nt, Escherichia coli CFT073
ccucagcggucaccgg

SEQ ID NO: 2601010 - RNA, 20 nt, Escherichia coli CFT073
ccucagguucaaccgcagcu

SEQ ID NO: 2601011 - RNA, 23 nt, Escherichia coli CFT073
ccucagguugauagaaauaucgc

SEQ ID NO: 2601012 - RNA, 20 nt, Escherichia coli CFT073
ccucaguacccgcguucugg

SEQ ID NO: 2601013 - RNA, 19 nt, Escherichia coli CFT073
ccucauaacguaaaccaau

SEQ ID NO: 2601014 - RNA, 22 nt, Escherichia coli CFT073
ccucaucaauauugucuucauc

SEQ ID NO: 2601015 - RNA, 14 nt, Escherichia coli CFT073
ccucaucauccucu

SEQ ID NO: 2601016 - RNA, 12 nt, Escherichia coli CFT073
ccucaucuccag

SEQ ID NO: 2601017 - RNA, 16 nt, Escherichia coli CFT073
ccucaugcggcgcgcc

SEQ ID NO: 2601018 - RNA, 13 nt, Escherichia coli CFT073
ccucauuuaaaau

SEQ ID NO: 2601019 - RNA, 19 nt, Escherichia coli CFT073
ccugacugucgcuauucaa

SEQ ID NO: 2601020 - RNA, 23 nt, Escherichia coli CFT073
ccugacuguuuuuccagcuuagc

SEQ ID NO: 2601021 - RNA, 21 nt, Escherichia coli CFT073
ccugacuuaccuccugucuaa

SEQ ID NO: 2601022 - RNA, 19 nt, Escherichia coli CFT073
ccugacuuuguaccagcgg

SEQ ID NO: 2601023 - RNA, 18 nt, Escherichia coli CFT073
ccugagaagcgcagcgca

SEQ ID NO: 2601024 - RNA, 20 nt, Escherichia coli CFT073
ccugagaagcgcagcgcauc

SEQ ID NO: 2601025 - RNA, 22 nt, Escherichia coli CFT073
ccugagaauuccggcagagaaa

SEQ ID NO: 2601026 - RNA, 14 nt, Escherichia coli CFT073
ccugagacaaacag

SEQ ID NO: 2601027 - RNA, 23 nt, Escherichia coli CFT073
ccugagcagcaaccacuugcagc

SEQ ID NO: 2601028 - RNA, 22 nt, Escherichia coli CFT073
ccugagcagcgauaucugccga

SEQ ID NO: 2601029 - RNA, 15 nt, Escherichia coli CFT073
ccugagccggaguug

SEQ ID NO: 2601030 - RNA, 15 nt, Escherichia coli CFT073
ccugaguaucgaaaa

SEQ ID NO: 2601031 - RNA, 15 nt, Escherichia coli CFT073
ccugaguuaauuaaa

SEQ ID NO: 2601032 - RNA, 20 nt, Escherichia coli CFT073
ccugauaacacagcggcagc

SEQ ID NO: 2601033 - RNA, 15 nt, Escherichia coli CFT073
ccugauaaccuucca

SEQ ID NO: 2601034 - RNA, 19 nt, Escherichia coli CFT073
ccugauaagacagcgucac

SEQ ID NO: 2601035 - RNA, 21 nt, Escherichia coli CFT073
ccugauaagacgcgccagcgu

SEQ ID NO: 2601036 - RNA, 23 nt, Escherichia coli CFT073
ccugauaagcguagcgcaucagg

SEQ ID NO: 2601037 - RNA, 23 nt, Escherichia coli CFT073
ccugauaagugaagaccgugauu

SEQ ID NO: 2601038 - RNA, 15 nt, Escherichia coli CFT073
ccugauacagccaaa

SEQ ID NO: 2601039 - RNA, 19 nt, Escherichia coli CFT073
ccugauacgagcaaaagcc

SEQ ID NO: 2601040 - RNA, 22 nt, Escherichia coli CFT073
ccugauagcccgcacaaagcac

SEQ ID NO: 2601041 - RNA, 17 nt, Escherichia coli CFT073
ccugauauucucgcucc

SEQ ID NO: 2601042 - RNA, 23 nt, Escherichia coli CFT073
ccugaucaagcuggcgcuggcga

SEQ ID NO: 2601043 - RNA, 18 nt, Escherichia coli CFT073
ccugaucaauaaucucuu

SEQ ID NO: 2601044 - RNA, 12 nt, Escherichia coli CFT073
ccugaucaauca

SEQ ID NO: 2601045 - RNA, 13 nt, Escherichia coli CFT073
ccugaucacccac

SEQ ID NO: 2601046 - RNA, 19 nt, Escherichia coli CFT073
ccugauccagcucuuccuc

SEQ ID NO: 2601047 - RNA, 15 nt, Escherichia coli CFT073
ccugauccugcaaca

SEQ ID NO: 2601048 - RNA, 20 nt, Escherichia coli CFT073
ccugaucgagcaguaaucca

SEQ ID NO: 2601049 - RNA, 23 nt, Escherichia coli CFT073
ccugaugaauauucucggcugcc

SEQ ID NO: 2601050 - RNA, 15 nt, Escherichia coli CFT073
ccugaugacgcagau

SEQ ID NO: 2601051 - RNA, 20 nt, Escherichia coli CFT073
ccugaugacgcagaucccac

SEQ ID NO: 2601052 - RNA, 18 nt, Escherichia coli CFT073
ccugaugaucuaaaagca

SEQ ID NO: 2601053 - RNA, 22 nt, Escherichia coli CFT073
ccugaugcgacgcgggccgcgu

SEQ ID NO: 2601054 - RNA, 19 nt, Escherichia coli CFT073
ccugaugcgacgcuugacg

SEQ ID NO: 2601055 - RNA, 22 nt, Escherichia coli CFT073
ccugaugcgacgcuugccgcgu

SEQ ID NO: 2601056 - RNA, 16 nt, Escherichia coli CFT073
ccugaugcgaugcugg

SEQ ID NO: 2601057 - RNA, 19 nt, Escherichia coli CFT073
ccugaugcgaugcuggcgc

SEQ ID NO: 2601058 - RNA, 16 nt, Escherichia coli CFT073
ccugaugcgcuucgcu

SEQ ID NO: 2601059 - RNA, 19 nt, Escherichia coli CFT073
ccugaugcgguuucaacau

SEQ ID NO: 2601060 - RNA, 14 nt, Escherichia coli CFT073
ccugaugcuucaga

SEQ ID NO: 2601061 - RNA, 12 nt, Escherichia coli CFT073
ccugauguagcg

SEQ ID NO: 2601062 - RNA, 20 nt, Escherichia coli CFT073
ccugaugugaaagauaaaac

SEQ ID NO: 2601063 - RNA, 16 nt, Escherichia coli CFT073
ccugaugugaugcccg

SEQ ID NO: 2601064 - RNA, 14 nt, Escherichia coli CFT073
ccugaugugcagau

SEQ ID NO: 2601065 - RNA, 18 nt, Escherichia coli CFT073
ccugauuaagaucgugca

SEQ ID NO: 2601066 - RNA, 19 nt, Escherichia coli CFT073
ccugauuaccuaccaacgc

SEQ ID NO: 2601067 - RNA, 20 nt, Escherichia coli CFT073
ccugauuaccuaccaacgca

SEQ ID NO: 2601068 - RNA, 21 nt, Escherichia coli CFT073
ccugauuaguggcacacugau

SEQ ID NO: 2601069 - RNA, 18 nt, Escherichia coli CFT073
ccugauucgcaccacguu

SEQ ID NO: 2601070 - RNA, 14 nt, Escherichia coli CFT073
ccugauugaccgcc

SEQ ID NO: 2601071 - RNA, 22 nt, Escherichia coli CFT073
ccugauuguuuguagccgccaa

SEQ ID NO: 2601072 - RNA, 15 nt, Escherichia coli CFT073
ccugauuuacguaaa

SEQ ID NO: 2601073 - RNA, 11 nt, Escherichia coli CFT073
ccugcaaaaua

SEQ ID NO: 2601074 - RNA, 20 nt, Escherichia coli CFT073
ccugcaaaaucuguugaaau

SEQ ID NO: 2601075 - RNA, 15 nt, Escherichia coli CFT073
ccugcaaauaaauac

SEQ ID NO: 2601076 - RNA, 23 nt, Escherichia coli CFT073
ccugcaaauucaacguccuggcg

SEQ ID NO: 2601077 - RNA, 13 nt, Escherichia coli CFT073
ccugcaacaacac

SEQ ID NO: 2601078 - RNA, 21 nt, Escherichia coli CFT073
ccugcaacgaaccaaucaccc

SEQ ID NO: 2601079 - RNA, 22 nt, Escherichia coli CFT073
ccugcaacgaaccaaucacccc

SEQ ID NO: 2601080 - RNA, 19 nt, Escherichia coli CFT073
ccugcaacggcaucgccaa

SEQ ID NO: 2601081 - RNA, 24 nt, Escherichia coli CFT073
ccugcaacguuuuaagcaaauaau

SEQ ID NO: 2601082 - RNA, 15 nt, Escherichia coli CFT073
ccugcaagcgucgcg

SEQ ID NO: 2601083 - RNA, 16 nt, Escherichia coli CFT073
ccugcaauaaacaaac

SEQ ID NO: 2601084 - RNA, 23 nt, Escherichia coli CFT073
ccugcaaucuuuccugcacaaug

SEQ ID NO: 2601085 - RNA, 17 nt, Escherichia coli CFT073
ccugcaauuuaccuuuc

SEQ ID NO: 2601086 - RNA, 19 nt, Escherichia coli CFT073
ccugcacaaagcgccagaa

SEQ ID NO: 2601087 - RNA, 20 nt, Escherichia coli CFT073
ccugcacaaauuugccgucg

SEQ ID NO: 2601088 - RNA, 14 nt, Escherichia coli CFT073
ccugcacaaugccu

SEQ ID NO: 2601089 - RNA, 17 nt, Escherichia coli CFT073
ccugcacaaugccuuuu

SEQ ID NO: 2601090 - RNA, 19 nt, Escherichia coli CFT073
ccugcacaggcauucagau

SEQ ID NO: 2601091 - RNA, 16 nt, Escherichia coli CFT073
ccugcacgaccggguu

SEQ ID NO: 2601092 - RNA, 16 nt, Escherichia coli CFT073
ccugcacugcaggccg

SEQ ID NO: 2601093 - RNA, 18 nt, Escherichia coli CFT073
ccugcacugucccaaaau

SEQ ID NO: 2601094 - RNA, 19 nt, Escherichia coli CFT073
ccugcagaaaauccagcgu

SEQ ID NO: 2601095 - RNA, 23 nt, Escherichia coli CFT073
ccugcagcugcagauaacuggcc

SEQ ID NO: 2601096 - RNA, 17 nt, Escherichia coli CFT073
ccugcaggaaagcaaga

SEQ ID NO: 2601097 - RNA, 15 nt, Escherichia coli CFT073
ccugcaggaaaucaa

SEQ ID NO: 2601098 - RNA, 15 nt, Escherichia coli CFT073
ccugcagggauggcu

SEQ ID NO: 2601099 - RNA, 17 nt, Escherichia coli CFT073
ccugcagucaccugccc

SEQ ID NO: 2601100 - RNA, 21 nt, Escherichia coli CFT073
ccugcagugcaggccggaguu

SEQ ID NO: 2601101 - RNA, 18 nt, Escherichia coli CFT073
ccugcagugcgcgaacca

SEQ ID NO: 2601102 - RNA, 20 nt, Escherichia coli CFT073
ccugcauaaaggcaaaacag

SEQ ID NO: 2601103 - RNA, 18 nt, Escherichia coli CFT073
ccugcauaccaagcccga

SEQ ID NO: 2601104 - RNA, 14 nt, Escherichia coli CFT073
ccugcauaucggca

SEQ ID NO: 2601105 - RNA, 11 nt, Escherichia coli CFT073
ccugcaucaca

SEQ ID NO: 2601106 - RNA, 19 nt, Escherichia coli CFT073
ccugcauuagcaaugcccu

SEQ ID NO: 2601107 - RNA, 19 nt, Escherichia coli CFT073
ccugcauuugcgcagcguu

SEQ ID NO: 2601108 - RNA, 14 nt, Escherichia coli CFT073
ccugccagaagcag

SEQ ID NO: 2601109 - RNA, 20 nt, Escherichia coli CFT073
ccugccagagcugaauauca

SEQ ID NO: 2601110 - RNA, 18 nt, Escherichia coli CFT073
ccugccagauccagugcg

SEQ ID NO: 2601111 - RNA, 17 nt, Escherichia coli CFT073
ccugccagaugcagcgg

SEQ ID NO: 2601112 - RNA, 15 nt, Escherichia coli CFT073
ccugccagcaguuug

SEQ ID NO: 2601113 - RNA, 19 nt, Escherichia coli CFT073
ccugccagcgucagcagga

SEQ ID NO: 2601114 - RNA, 12 nt, Escherichia coli CFT073
ccugccagcguu

SEQ ID NO: 2601115 - RNA, 22 nt, Escherichia coli CFT073
ccugccagcuugcgauccugca

SEQ ID NO: 2601116 - RNA, 19 nt, Escherichia coli CFT073
ccugccagggucaguuuca

SEQ ID NO: 2601117 - RNA, 20 nt, Escherichia coli CFT073
ccugccaguaagcaguccag

SEQ ID NO: 2601118 - RNA, 21 nt, Escherichia coli CFT073
ccugccaguaagcaguccagc

SEQ ID NO: 2601119 - RNA, 19 nt, Escherichia coli CFT073
ccugccaguggagccauca

SEQ ID NO: 2601120 - RNA, 16 nt, Escherichia coli CFT073
ccugccaugcgcaauc

SEQ ID NO: 2601121 - RNA, 13 nt, Escherichia coli CFT073
ccugccauuguuc

SEQ ID NO: 2601122 - RNA, 12 nt, Escherichia coli CFT073
ccugccccagag

SEQ ID NO: 2601123 - RNA, 15 nt, Escherichia coli CFT073
ccugccccaucugcc

SEQ ID NO: 2601124 - RNA, 16 nt, Escherichia coli CFT073
ccugccccgucuuccg

SEQ ID NO: 2601125 - RNA, 14 nt, Escherichia coli CFT073
ccugcccgcuccag

SEQ ID NO: 2601126 - RNA, 13 nt, Escherichia coli CFT073
ccugugguuuaua

SEQ ID NO: 2601127 - RNA, 22 nt, Escherichia coli CFT073
ccuguuaagaagggcuggccaa

SEQ ID NO: 2601128 - RNA, 23 nt, Escherichia coli CFT073
ccuguuaaucagcuaauggcugc

SEQ ID NO: 2601129 - RNA, 20 nt, Escherichia coli CFT073
ccuguucauaugcuuguuug

SEQ ID NO: 2601130 - RNA, 23 nt, Escherichia coli CFT073
ccuguucaucgauagaacggaua

SEQ ID NO: 2601131 - RNA, 16 nt, Escherichia coli CFT073
ccuguucauuuuuagg

SEQ ID NO: 2601132 - RNA, 14 nt, Escherichia coli CFT073
ccuguucgccgccg

SEQ ID NO: 2601133 - RNA, 13 nt, Escherichia coli CFT073
ccuguugacggga

SEQ ID NO: 2601134 - RNA, 15 nt, Escherichia coli CFT073
ccuguugaugccagu

SEQ ID NO: 2601135 - RNA, 18 nt, Escherichia coli CFT073
ccuguugcccaugcuucu

SEQ ID NO: 2601136 - RNA, 15 nt, Escherichia coli CFT073
ccuguugccugcacu

SEQ ID NO: 2601137 - RNA, 15 nt, Escherichia coli CFT073
ccuguugcgcuacgu

SEQ ID NO: 2601138 - RNA, 23 nt, Escherichia coli CFT073
ccuguuucacuucgucagaaaug

SEQ ID NO: 2601139 - RNA, 16 nt, Escherichia coli CFT073
ccuguuuuuuaauuca

SEQ ID NO: 2601140 - RNA, 19 nt, Escherichia coli CFT073
ccuguuuuuuaauucagga

SEQ ID NO: 2601141 - RNA, 18 nt, Escherichia coli CFT073
ccuguuuuuuuaaugcgc

SEQ ID NO: 2601142 - RNA, 14 nt, Escherichia coli CFT073
ccuuaacaaaaacu

SEQ ID NO: 2601143 - RNA, 16 nt, Escherichia coli CFT073
ccuuaacgcaaaaucu

SEQ ID NO: 2601144 - RNA, 19 nt, Escherichia coli CFT073
ccuuaauaccggcauccag

SEQ ID NO: 2601145 - RNA, 14 nt, Escherichia coli CFT073
ccuuaauuaucugg

SEQ ID NO: 2601146 - RNA, 13 nt, Escherichia coli CFT073
ccuuaccaaccgc

SEQ ID NO: 2601147 - RNA, 20 nt, Escherichia coli CFT073
ccuuaccaccuuacuuacac

SEQ ID NO: 2601148 - RNA, 12 nt, Escherichia coli CFT073
ccuuacugcccc

SEQ ID NO: 2601149 - RNA, 23 nt, Escherichia coli CFT073
ccuuaguaacgccagcggucaua

SEQ ID NO: 2601150 - RNA, 13 nt, Escherichia coli CFT073
ccuuauaaccaga

SEQ ID NO: 2601151 - RNA, 19 nt, Escherichia coli CFT073
ccuuauauaaaacacugag

SEQ ID NO: 2601152 - RNA, 16 nt, Escherichia coli CFT073
ccuuaucguuagcaug

SEQ ID NO: 2601153 - RNA, 18 nt, Escherichia coli CFT073
ccuuaugcagcggaauaa

SEQ ID NO: 2601154 - RNA, 19 nt, Escherichia coli CFT073
ccuuaugcagcggaauaau

SEQ ID NO: 2601155 - RNA, 21 nt, Escherichia coli CFT073
ccuuaugcagcggaauaaucu

SEQ ID NO: 2601156 - RNA, 14 nt, Escherichia coli CFT073
ccuuauucacgcca

SEQ ID NO: 2601157 - RNA, 17 nt, Escherichia coli CFT073
ccuuauugucuuuaaau

SEQ ID NO: 2601158 - RNA, 15 nt, Escherichia coli CFT073
ccuucaagaauuaaa

SEQ ID NO: 2601159 - RNA, 20 nt, Escherichia coli CFT073
ccuucaauacuggcaaaauc

SEQ ID NO: 2601160 - RNA, 13 nt, Escherichia coli CFT073
ccuucaauaucau

SEQ ID NO: 2601161 - RNA, 20 nt, Escherichia coli CFT073
ccuucaauaucauuacgcca

SEQ ID NO: 2601162 - RNA, 22 nt, Escherichia coli CFT073
ccuucaaugaucgucauaucau

SEQ ID NO: 2601163 - RNA, 13 nt, Escherichia coli CFT073
ccuucaauuaugc

SEQ ID NO: 2601164 - RNA, 17 nt, Escherichia coli CFT073
ccuucacaggccgccag

SEQ ID NO: 2601165 - RNA, 15 nt, Escherichia coli CFT073
ccuucacccucacgc

SEQ ID NO: 2601166 - RNA, 23 nt, Escherichia coli CFT073
ccuucacgggcaaccacagugag

SEQ ID NO: 2601167 - RNA, 22 nt, Escherichia coli CFT073
ccuucacggguugcgccugugu

SEQ ID NO: 2601168 - RNA, 23 nt, Escherichia coli CFT073
ccuucacgguuauuggagccugc

SEQ ID NO: 2601169 - RNA, 19 nt, Escherichia coli CFT073
ccuucagaagaucggaaga

SEQ ID NO: 2601170 - RNA, 21 nt, Escherichia coli CFT073
ccuucagcaagaguuuuaaaa

SEQ ID NO: 2601171 - RNA, 13 nt, Escherichia coli CFT073
ccuucagcaucga

SEQ ID NO: 2601172 - RNA, 20 nt, Escherichia coli CFT073
ccuucagccccagacguuuc

SEQ ID NO: 2601173 - RNA, 23 nt, Escherichia coli CFT073
ccuucagcgaagcccacaccgcc

SEQ ID NO: 2601174 - RNA, 15 nt, Escherichia coli CFT073
ccuucaggacccuca

SEQ ID NO: 2601175 - RNA, 16 nt, Escherichia coli CFT073
ccuucagguuuuucag

SEQ ID NO: 2601176 - RNA, 23 nt, Escherichia coli CFT073
ccuucagguuuuucagcugccca

SEQ ID NO: 2601177 - RNA, 19 nt, Escherichia coli CFT073
ccuucagucauauuucugu

SEQ ID NO: 2601178 - RNA, 17 nt, Escherichia coli CFT073
ccuucaguuuccagcaa

SEQ ID NO: 2601179 - RNA, 18 nt, Escherichia coli CFT073
ccuucaguuuccagcaaa

SEQ ID NO: 2601180 - RNA, 23 nt, Escherichia coli CFT073
ccuucauauuccugacccagcac

SEQ ID NO: 2601181 - RNA, 22 nt, Escherichia coli CFT073
ccuucaucacgcagugucagca

SEQ ID NO: 2601182 - RNA, 23 nt, Escherichia coli CFT073
ccuucaucacgcagugucagcac

SEQ ID NO: 2601183 - RNA, 13 nt, Escherichia coli CFT073
ccuucauccaggg

SEQ ID NO: 2601184 - RNA, 20 nt, Escherichia coli CFT073
ccuucauccaucggcgcuuc

SEQ ID NO: 2601185 - RNA, 12 nt, Escherichia coli CFT073
ccuucauucagg

SEQ ID NO: 2601186 - RNA, 21 nt, Escherichia coli CFT073
ccuuccagaaacauccccagc

SEQ ID NO: 2601187 - RNA, 12 nt, Escherichia coli CFT073
ccuuccagcagc

SEQ ID NO: 2601188 - RNA, 13 nt, Escherichia coli CFT073
ccuuccagcagcu

SEQ ID NO: 2601189 - RNA, 14 nt, Escherichia coli CFT073
ccuuccagcuccag

SEQ ID NO: 2601190 - RNA, 15 nt, Escherichia coli CFT073
ccuuccagcuccagc

SEQ ID NO: 2601191 - RNA, 16 nt, Escherichia coli CFT073
ccuuccagcuccagcc

SEQ ID NO: 2601192 - RNA, 16 nt, Escherichia coli CFT073
ccuuccagcucuuugg

SEQ ID NO: 2601193 - RNA, 15 nt, Escherichia coli CFT073
ccuuccagcuucgcu

SEQ ID NO: 2601194 - RNA, 20 nt, Escherichia coli CFT073
ccuuccauacgaauugccgc

SEQ ID NO: 2601195 - RNA, 22 nt, Escherichia coli CFT073
ccuuccauacgaauugccgcgc

SEQ ID NO: 2601196 - RNA, 18 nt, Escherichia coli CFT073
ccuuccauuaucgccagg

SEQ ID NO: 2601197 - RNA, 21 nt, Escherichia coli CFT073
ccuuccauuaucgccaggugu

SEQ ID NO: 2601198 - RNA, 12 nt, Escherichia coli CFT073
ccuucccagccg

SEQ ID NO: 2601199 - RNA, 15 nt, Escherichia coli CFT073
ccuucccccaccacc

SEQ ID NO: 2601200 - RNA, 18 nt, Escherichia coli CFT073
ccuucccgcaaugcaauc

SEQ ID NO: 2601201 - RNA, 14 nt, Escherichia coli CFT073
ccuucccugcagua

SEQ ID NO: 2601202 - RNA, 14 nt, Escherichia coli CFT073
ccuucccuucguug

SEQ ID NO: 2601203 - RNA, 12 nt, Escherichia coli CFT073
ccuucccuuuca

SEQ ID NO: 2601204 - RNA, 14 nt, Escherichia coli CFT073
ccuuccgccagucg

SEQ ID NO: 2601205 - RNA, 21 nt, Escherichia coli CFT073
ccuuccgccagucguuucgcc

SEQ ID NO: 2601206 - RNA, 16 nt, Escherichia coli CFT073
ccuuccugaacggucg

SEQ ID NO: 2601207 - RNA, 19 nt, Escherichia coli CFT073
ccuuccugaacggucgagg

SEQ ID NO: 2601208 - RNA, 19 nt, Escherichia coli CFT073
ccuuccugacucacacgca

SEQ ID NO: 2601209 - RNA, 16 nt, Escherichia coli CFT073
ccuucgauauauuuuu

SEQ ID NO: 2601210 - RNA, 16 nt, Escherichia coli CFT073
ccuucgauauccagau

SEQ ID NO: 2601211 - RNA, 20 nt, Escherichia coli CFT073
ccuucgcaaaaaaccauccc

SEQ ID NO: 2601212 - RNA, 13 nt, Escherichia coli CFT073
ccuucgccaccgu

SEQ ID NO: 2601213 - RNA, 13 nt, Escherichia coli CFT073
ccuucgccagugg

SEQ ID NO: 2601214 - RNA, 18 nt, Escherichia coli CFT073
ccuucgcccugcgucgca

SEQ ID NO: 2601215 - RNA, 14 nt, Escherichia coli CFT073
ccuucggccccauc

SEQ ID NO: 2601216 - RNA, 16 nt, Escherichia coli CFT073
ccuucguacugugcgc

SEQ ID NO: 2601217 - RNA, 19 nt, Escherichia coli CFT073
ccuucguccaucccacacu

SEQ ID NO: 2601218 - RNA, 12 nt, Escherichia coli CFT073
ccuucuccacac

SEQ ID NO: 2601219 - RNA, 15 nt, Escherichia coli CFT073
ccuucuccacaccgu

SEQ ID NO: 2601220 - RNA, 13 nt, Escherichia coli CFT073
ccuucucggcagu

SEQ ID NO: 2601221 - RNA, 20 nt, Escherichia coli CFT073
ccuucucuucaaaccacugc

SEQ ID NO: 2601222 - RNA, 14 nt, Escherichia coli CFT073
ccuucugagaucaa

SEQ ID NO: 2601223 - RNA, 20 nt, Escherichia coli CFT073
ccuucugagcccacuguuug

SEQ ID NO: 2601224 - RNA, 14 nt, Escherichia coli CFT073
ccuucugcacgcga

SEQ ID NO: 2601225 - RNA, 23 nt, Escherichia coli CFT073
ccuucugccaccagguucaacag

SEQ ID NO: 2601226 - RNA, 13 nt, Escherichia coli CFT073
ccuucuggcgacc

SEQ ID NO: 2601227 - RNA, 21 nt, Escherichia coli CFT073
ccuucuguuauauauuacccu

SEQ ID NO: 2601228 - RNA, 11 nt, Escherichia coli CFT073
ccuucuucauc

SEQ ID NO: 2601229 - RNA, 14 nt, Escherichia coli CFT073
ccuucuucuuucag

SEQ ID NO: 2601230 - RNA, 16 nt, Escherichia coli CFT073
ccuucuugaacccuuu

SEQ ID NO: 2601231 - RNA, 23 nt, Escherichia coli CFT073
ccuucuugcucgaagaguuccag

SEQ ID NO: 2601232 - RNA, 14 nt, Escherichia coli CFT073
ccuucuugucggua

SEQ ID NO: 2601233 - RNA, 23 nt, Escherichia coli CFT073
ccuugaaaucguuugcauccagu

SEQ ID NO: 2601234 - RNA, 20 nt, Escherichia coli CFT073
ccuugaacucugaaucgcua

SEQ ID NO: 2601235 - RNA, 16 nt, Escherichia coli CFT073
ccuugagugacauggc

SEQ ID NO: 2601236 - RNA, 21 nt, Escherichia coli CFT073
ccuugaugaaaaaaccagaaa

SEQ ID NO: 2601237 - RNA, 13 nt, Escherichia coli CFT073
ccuugcaacuccg

SEQ ID NO: 2601238 - RNA, 22 nt, Escherichia coli CFT073
ccuugcagauauugcaccccaa

SEQ ID NO: 2601239 - RNA, 16 nt, Escherichia coli CFT073
ccuugcaguugaucca

SEQ ID NO: 2601240 - RNA, 21 nt, Escherichia coli CFT073
ccuugcaguuguaaucacgcu

SEQ ID NO: 2601241 - RNA, 22 nt, Escherichia coli CFT073
ccuugcgauuacguucggcaaa

SEQ ID NO: 2601242 - RNA, 12 nt, Escherichia coli CFT073
ccuugcgcaaug

SEQ ID NO: 2601243 - RNA, 15 nt, Escherichia coli CFT073
ccuugcgcaaugagu

SEQ ID NO: 2601244 - RNA, 19 nt, Escherichia coli CFT073
ccuugcggaucggcuggcg

SEQ ID NO: 2601245 - RNA, 21 nt, Escherichia coli CFT073
ccuugcggaucggcuggcggc

SEQ ID NO: 2601246 - RNA, 18 nt, Escherichia coli CFT073
ccuugcucuucgcguaau

SEQ ID NO: 2601247 - RNA, 14 nt, Escherichia coli CFT073
ccuugcugauuuua

SEQ ID NO: 2601248 - RNA, 13 nt, Escherichia coli CFT073
ccuugcuggcgau

SEQ ID NO: 2601249 - RNA, 13 nt, Escherichia coli CFT073
ccuugcuucgcca

SEQ ID NO: 2601250 - RNA, 17 nt, Escherichia coli CFT073
ccuuguauuaauaccag

SEQ ID NO: 2601251 - RNA, 14 nt, Escherichia coli CFT073
ccuuguucaagagc

SEQ ID NO: 2601252 - RNA, 20 nt, Escherichia coli CFT073
ccuuguuuaaggaaaaacga

SEQ ID NO: 2601253 - RNA, 15 nt, Escherichia coli CFT073
ccuuuaacacgcaac

SEQ ID NO: 2601254 - RNA, 22 nt, Escherichia coli CFT073
ccuuuaaucuuagacaucaaaa

SEQ ID NO: 2601255 - RNA, 15 nt, Escherichia coli CFT073
ccuuuacaugaaaaa

SEQ ID NO: 2601256 - RNA, 15 nt, Escherichia coli CFT073
ccuuuacuucaccau

SEQ ID NO: 2601257 - RNA, 14 nt, Escherichia coli CFT073
ccuuuagcgagcga

SEQ ID NO: 2601258 - RNA, 18 nt, Escherichia coli CFT073
ccuuuaguaugcugauau

SEQ ID NO: 2601259 - RNA, 18 nt, Escherichia coli CFT073
ccuuuaucacgcagcaga

SEQ ID NO: 2601260 - RNA, 13 nt, Escherichia coli CFT073
ccuuuaucugccc

SEQ ID NO: 2601261 - RNA, 13 nt, Escherichia coli CFT073
ccuuuaugacuau

SEQ ID NO: 2601262 - RNA, 13 nt, Escherichia coli CFT073
ccuuuauugcgaa

SEQ ID NO: 2601263 - RNA, 22 nt, Escherichia coli CFT073
ccuuuauuuugggggcguuucc

SEQ ID NO: 2601264 - RNA, 21 nt, Escherichia coli CFT073
ccuuucaauaccgccugcaaa

SEQ ID NO: 2601265 - RNA, 23 nt, Escherichia coli CFT073
ccuuucacaucagaacagcccca

SEQ ID NO: 2601266 - RNA, 16 nt, Escherichia coli CFT073
ccuuucaccucaguga

SEQ ID NO: 2601267 - RNA, 16 nt, Escherichia coli CFT073
ccuuucagauauccca

SEQ ID NO: 2601268 - RNA, 13 nt, Escherichia coli CFT073
ccuuucagcguua

SEQ ID NO: 2601269 - RNA, 23 nt, Escherichia coli CFT073
ccuuucauggucgucaccgccag

SEQ ID NO: 2601270 - RNA, 14 nt, Escherichia coli CFT073
ccuuuccagcaauc

SEQ ID NO: 2601271 - RNA, 20 nt, Escherichia coli CFT073
ccuuuccagcaaucgucgau

SEQ ID NO: 2601272 - RNA, 17 nt, Escherichia coli CFT073
ccuuuccccggcagcau

SEQ ID NO: 2601273 - RNA, 13 nt, Escherichia coli CFT073
ccuuucggccaug

SEQ ID NO: 2601274 - RNA, 16 nt, Escherichia coli CFT073
ccuuugaacugcugau

SEQ ID NO: 2601275 - RNA, 14 nt, Escherichia coli CFT073
ccuuugguguggau

SEQ ID NO: 2601276 - RNA, 19 nt, Escherichia coli CFT073
ccuuuguaaccugcuggcg

SEQ ID NO: 2601277 - RNA, 13 nt, Escherichia coli CFT073
ccuuuugacuccu

SEQ ID NO: 2601278 - RNA, 17 nt, Escherichia coli CFT073
ccuuuugccuucugagc

SEQ ID NO: 2601279 - RNA, 15 nt, Escherichia coli CFT073
ccuuuuggcacacuu

SEQ ID NO: 2601280 - RNA, 10 nt, Escherichia coli CFT073
ccuuuuuaau

SEQ ID NO: 2601281 - RNA, 12 nt, Escherichia coli CFT073
ccuuuuucacau

SEQ ID NO: 2601282 - RNA, 20 nt, Escherichia coli CFT073
ccuuuuucacaucauugaca

SEQ ID NO: 2601283 - RNA, 19 nt, Escherichia coli CFT073
ccuuuuucaguuugcugac

SEQ ID NO: 2601284 - RNA, 21 nt, Escherichia coli CFT073
ccuuuuuguuguaaugacaac

SEQ ID NO: 2601285 - RNA, 16 nt, Escherichia coli CFT073
ccuuuuuucgccgcag

SEQ ID NO: 2601286 - RNA, 21 nt, Escherichia coli CFT073
ccuuuuuuugucuguuugcuc

SEQ ID NO: 2601287 - RNA, 20 nt, Escherichia coli CFT073
cgaaaaagaaucgauuaucu

SEQ ID NO: 2601288 - RNA, 20 nt, Escherichia coli CFT073
cgaaaaagucccuucccagc

SEQ ID NO: 2601289 - RNA, 19 nt, Escherichia coli CFT073
cgaaaaaucgacaaaauca

SEQ ID NO: 2601290 - RNA, 13 nt, Escherichia coli CFT073
cgaaaaaugaaua

SEQ ID NO: 2601291 - RNA, 12 nt, Escherichia coli CFT073
cgaaaaaugaug

SEQ ID NO: 2601292 - RNA, 12 nt, Escherichia coli CFT073
cgaaaacccuca

SEQ ID NO: 2601293 - RNA, 17 nt, Escherichia coli CFT073
cgaaaacccucaauaau

SEQ ID NO: 2601294 - RNA, 18 nt, Escherichia coli CFT073
cgaaaacgcauaucuucu

SEQ ID NO: 2601295 - RNA, 15 nt, Escherichia coli CFT073
cgaaaagaaacugug

SEQ ID NO: 2601296 - RNA, 16 nt, Escherichia coli CFT073
cgaaaagcuucuuccu

SEQ ID NO: 2601297 - RNA, 16 nt, Escherichia coli CFT073
cgaaaaggauaaauaa

SEQ ID NO: 2601298 - RNA, 21 nt, Escherichia coli CFT073
cgaaaauaauccuggcagcau

SEQ ID NO: 2601299 - RNA, 17 nt, Escherichia coli CFT073
cgaaaaucccggcaaca

SEQ ID NO: 2601300 - RNA, 16 nt, Escherichia coli CFT073
cgaaaaucgccugaac

SEQ ID NO: 2601301 - RNA, 21 nt, Escherichia coli CFT073
cgaaaaugccacugcgccggg

SEQ ID NO: 2601302 - RNA, 20 nt, Escherichia coli CFT073
cgaaaaugccccagcguucg

SEQ ID NO: 2601303 - RNA, 19 nt, Escherichia coli CFT073
cgaaaaugcucgccuugcu

SEQ ID NO: 2601304 - RNA, 22 nt, Escherichia coli CFT073
cgaaaauuacgccggaaaguua

SEQ ID NO: 2601305 - RNA, 14 nt, Escherichia coli CFT073
cgaaaauuggcaga

SEQ ID NO: 2601306 - RNA, 20 nt, Escherichia coli CFT073
cgaaacagcgccccaugaua

SEQ ID NO: 2601307 - RNA, 17 nt, Escherichia coli CFT073
cgaaaccuucagcaucg

SEQ ID NO: 2601308 - RNA, 20 nt, Escherichia coli CFT073
cgaaacgaaagucccgauaa

SEQ ID NO: 2601309 - RNA, 15 nt, Escherichia coli CFT073
cgaaacgcaguuuaa

SEQ ID NO: 2601310 - RNA, 15 nt, Escherichia coli CFT073
cgaaacuugcgugau

SEQ ID NO: 2601311 - RNA, 16 nt, Escherichia coli CFT073
cgaaagcacuguucgc

SEQ ID NO: 2601312 - RNA, 22 nt, Escherichia coli CFT073
cgaaagcacuguucgccgcagc

SEQ ID NO: 2601313 - RNA, 16 nt, Escherichia coli CFT073
cgaaagcgggcuugau

SEQ ID NO: 2601314 - RNA, 14 nt, Escherichia coli CFT073
cgaaagcgugagug

SEQ ID NO: 2601315 - RNA, 15 nt, Escherichia coli CFT073
cgaaaguuauuggca

SEQ ID NO: 2601316 - RNA, 21 nt, Escherichia coli CFT073
cgaaaguuugaaagaugcugg

SEQ ID NO: 2601317 - RNA, 14 nt, Escherichia coli CFT073
cgaaauaaacaagc

SEQ ID NO: 2601318 - RNA, 12 nt, Escherichia coli CFT073
cgaaauaacuga

SEQ ID NO: 2601319 - RNA, 18 nt, Escherichia coli CFT073
cgaaauaacugaauaaua

SEQ ID NO: 2601320 - RNA, 22 nt, Escherichia coli CFT073
cgaaauacaaguccccgcuucg

SEQ ID NO: 2601321 - RNA, 21 nt, Escherichia coli CFT073
cgaaauagccaggcagauaau

SEQ ID NO: 2601322 - RNA, 20 nt, Escherichia coli CFT073
cgaaauagcgccauaaaacu

SEQ ID NO: 2601323 - RNA, 23 nt, Escherichia coli CFT073
cgaaaucacgcacucgacgcagc

SEQ ID NO: 2601324 - RNA, 15 nt, Escherichia coli CFT073
cgaaaucacuggcgu

SEQ ID NO: 2601325 - RNA, 18 nt, Escherichia coli CFT073
cgaaaucauucgcagcug

SEQ ID NO: 2601326 - RNA, 21 nt, Escherichia coli CFT073
cgaaaucauucgcagcugcag

SEQ ID NO: 2601327 - RNA, 15 nt, Escherichia coli CFT073
cgaaauccccccggu

SEQ ID NO: 2601328 - RNA, 21 nt, Escherichia coli CFT073
cgaaauccuggugaaaguugg

SEQ ID NO: 2601329 - RNA, 12 nt, Escherichia coli CFT073
cgaaaucgccau

SEQ ID NO: 2601330 - RNA, 14 nt, Escherichia coli CFT073
cgaaaugaauaauc

SEQ ID NO: 2601331 - RNA, 17 nt, Escherichia coli CFT073
cgaaauggccauccauu

SEQ ID NO: 2601332 - RNA, 23 nt, Escherichia coli CFT073
cgaaauggugugcaugguguuca

SEQ ID NO: 2601333 - RNA, 19 nt, Escherichia coli CFT073
cgaaaugucaaacaguuca

SEQ ID NO: 2601334 - RNA, 19 nt, Escherichia coli CFT073
cgaacaaggcaauuaaaaa

SEQ ID NO: 2601335 - RNA, 17 nt, Escherichia coli CFT073
cgaacaauaucgccagc

SEQ ID NO: 2601336 - RNA, 14 nt, Escherichia coli CFT073
cgaacaccagcagu

SEQ ID NO: 2601337 - RNA, 21 nt, Escherichia coli CFT073
cgaacaccagcaguaaaccac

SEQ ID NO: 2601338 - RNA, 16 nt, Escherichia coli CFT073
cgaacacgaaucaggc

SEQ ID NO: 2601339 - RNA, 14 nt, Escherichia coli CFT073
cgaacagccaggcu

SEQ ID NO: 2601340 - RNA, 22 nt, Escherichia coli CFT073
cgaacagcucaacgccgcuauc

SEQ ID NO: 2601341 - RNA, 18 nt, Escherichia coli CFT073
cgaacagucgcugaucac

SEQ ID NO: 2601342 - RNA, 23 nt, Escherichia coli CFT073
cgaacagucgcugaucaccguag

SEQ ID NO: 2601343 - RNA, 19 nt, Escherichia coli CFT073
cgacaaaugcgccgccaaa

SEQ ID NO: 2601344 - RNA, 14 nt, Escherichia coli CFT073
cgacaacaccgaua

SEQ ID NO: 2601345 - RNA, 21 nt, Escherichia coli CFT073
cgacaacgccuuguucgcccu

SEQ ID NO: 2601346 - RNA, 16 nt, Escherichia coli CFT073
cgacaagaauauugcu

SEQ ID NO: 2601347 - RNA, 16 nt, Escherichia coli CFT073
cgacaagauccugaua

SEQ ID NO: 2601348 - RNA, 21 nt, Escherichia coli CFT073
cgacaagcucauuucccaaca

SEQ ID NO: 2601349 - RNA, 16 nt, Escherichia coli CFT073
cgacaauaaucaacgc

SEQ ID NO: 2601350 - RNA, 20 nt, Escherichia coli CFT073
cgacaauaccgguuaugaca

SEQ ID NO: 2601351 - RNA, 15 nt, Escherichia coli CFT073
cgacaaucagguaag

SEQ ID NO: 2601352 - RNA, 21 nt, Escherichia coli CFT073
cgacaauccagucagcgguuu

SEQ ID NO: 2601353 - RNA, 20 nt, Escherichia coli CFT073
cgacaauccaguugguucaa

SEQ ID NO: 2601354 - RNA, 15 nt, Escherichia coli CFT073
cgacaaucccugcau

SEQ ID NO: 2601355 - RNA, 13 nt, Escherichia coli CFT073
cgacaaugguuaa

SEQ ID NO: 2601356 - RNA, 18 nt, Escherichia coli CFT073
cgacacacugcgccgcca

SEQ ID NO: 2601357 - RNA, 14 nt, Escherichia coli CFT073
cgacaccagccauc

SEQ ID NO: 2601358 - RNA, 15 nt, Escherichia coli CFT073
cgacaccagccaucu

SEQ ID NO: 2601359 - RNA, 13 nt, Escherichia coli CFT073
cgacaccggcaga

SEQ ID NO: 2601360 - RNA, 19 nt, Escherichia coli CFT073
cgacacgcaucacgcgcau

SEQ ID NO: 2601361 - RNA, 14 nt, Escherichia coli CFT073
cgacacugugccgg

SEQ ID NO: 2601362 - RNA, 18 nt, Escherichia coli CFT073
cgacagacggcgacgcgc

SEQ ID NO: 2601363 - RNA, 11 nt, Escherichia coli CFT073
cgacagccauc

SEQ ID NO: 2601364 - RNA, 12 nt, Escherichia coli CFT073
cgacagccaucc

SEQ ID NO: 2601365 - RNA, 14 nt, Escherichia coli CFT073
cgacagccucuucc

SEQ ID NO: 2601366 - RNA, 15 nt, Escherichia coli CFT073
cgacagcugcgacca

SEQ ID NO: 2601367 - RNA, 12 nt, Escherichia coli CFT073
cgacaggaacca

SEQ ID NO: 2601368 - RNA, 23 nt, Escherichia coli CFT073
cgacaggcuuacguuacccagca

SEQ ID NO: 2601369 - RNA, 14 nt, Escherichia coli CFT073
cgacaguagccccg

SEQ ID NO: 2601370 - RNA, 14 nt, Escherichia coli CFT073
cgacaguagcccuu

SEQ ID NO: 2601371 - RNA, 17 nt, Escherichia coli CFT073
cgacaguugccgcuuuu

SEQ ID NO: 2601372 - RNA, 14 nt, Escherichia coli CFT073
cgacaguugcugcg

SEQ ID NO: 2601373 - RNA, 23 nt, Escherichia coli CFT073
cgacaguugcugcgugaccgcca

SEQ ID NO: 2601374 - RNA, 15 nt, Escherichia coli CFT073
cgacauaauuuuucu

SEQ ID NO: 2601375 - RNA, 21 nt, Escherichia coli CFT073
cgacauacaggggaucgacgc

SEQ ID NO: 2601376 - RNA, 21 nt, Escherichia coli CFT073
cgacauacuugacuaagucuc

SEQ ID NO: 2601377 - RNA, 21 nt, Escherichia coli CFT073
cgacauaucauuuugcugcca

SEQ ID NO: 2601378 - RNA, 17 nt, Escherichia coli CFT073
cgacaucaagaaaugca

SEQ ID NO: 2601379 - RNA, 19 nt, Escherichia coli CFT073
cgacauccaugcacugcaa

SEQ ID NO: 2601380 - RNA, 12 nt, Escherichia coli CFT073
cgacauccgcca

SEQ ID NO: 2601381 - RNA, 20 nt, Escherichia coli CFT073
cgacaucgacguggugaaau

SEQ ID NO: 2601382 - RNA, 14 nt, Escherichia coli CFT073
cgacaugcuuacca

SEQ ID NO: 2601383 - RNA, 13 nt, Escherichia coli CFT073
cgacauugccagu

SEQ ID NO: 2601384 - RNA, 20 nt, Escherichia coli CFT073
cgacauuucccccuuccugc

SEQ ID NO: 2601385 - RNA, 16 nt, Escherichia coli CFT073
cgacauuucugcugcc

SEQ ID NO: 2601386 - RNA, 21 nt, Escherichia coli CFT073
cgacauuuugggacagugcag

SEQ ID NO: 2601387 - RNA, 20 nt, Escherichia coli CFT073
cgaccaaacuuauccgccag

SEQ ID NO: 2601388 - RNA, 12 nt, Escherichia coli CFT073
cgaccaaagaau

SEQ ID NO: 2601389 - RNA, 23 nt, Escherichia coli CFT073
cgaccaaagaauccgcccucuuc

SEQ ID NO: 2601390 - RNA, 20 nt, Escherichia coli CFT073
cgaccaaccaucaucccuaa

SEQ ID NO: 2601391 - RNA, 16 nt, Escherichia coli CFT073
cgaccaaucacacaac

SEQ ID NO: 2601392 - RNA, 20 nt, Escherichia coli CFT073
cgaccaaucacacaaccaug

SEQ ID NO: 2601393 - RNA, 17 nt, Escherichia coli CFT073
cgaccacccaccgcagc

SEQ ID NO: 2601394 - RNA, 15 nt, Escherichia coli CFT073
cgaccacucuuucga

SEQ ID NO: 2601395 - RNA, 12 nt, Escherichia coli CFT073
cgaccacuucau

SEQ ID NO: 2601396 - RNA, 13 nt, Escherichia coli CFT073
cgaccacuucaug

SEQ ID NO: 2601397 - RNA, 14 nt, Escherichia coli CFT073
cgaccacuucaugc

SEQ ID NO: 2601398 - RNA, 18 nt, Escherichia coli CFT073
cgaccacuucaugcccca

SEQ ID NO: 2601399 - RNA, 14 nt, Escherichia coli CFT073
cgaccagaaaugca

SEQ ID NO: 2601400 - RNA, 17 nt, Escherichia coli CFT073
cgaccagaaaugcagcu

SEQ ID NO: 2601401 - RNA, 17 nt, Escherichia coli CFT073
cgaccagaccggcaauc

SEQ ID NO: 2601402 - RNA, 21 nt, Escherichia coli CFT073
cgaccagauaagaacugacuu

SEQ ID NO: 2601403 - RNA, 15 nt, Escherichia coli CFT073
cgaccagcaccgcca

SEQ ID NO: 2601404 - RNA, 17 nt, Escherichia coli CFT073
cgaccagcaccgccagc

SEQ ID NO: 2601405 - RNA, 18 nt, Escherichia coli CFT073
cgaccagcaccgccagca

SEQ ID NO: 2601406 - RNA, 13 nt, Escherichia coli CFT073
cgaccagcgccgc

SEQ ID NO: 2601407 - RNA, 20 nt, Escherichia coli CFT073
cgaccagcggcaacaucauc

SEQ ID NO: 2601408 - RNA, 22 nt, Escherichia coli CFT073
cgaccagcgucguauccagcgu

SEQ ID NO: 2601409 - RNA, 14 nt, Escherichia coli CFT073
cgaccaggaacgcc

SEQ ID NO: 2601410 - RNA, 13 nt, Escherichia coli CFT073
cgaccaggcaaac

SEQ ID NO: 2601411 - RNA, 18 nt, Escherichia coli CFT073
cgaccaggccaucagcag

SEQ ID NO: 2601412 - RNA, 19 nt, Escherichia coli CFT073
cgaccaggccaucagcagc

SEQ ID NO: 2601413 - RNA, 17 nt, Escherichia coli CFT073
cgaccagugaaaauggc

SEQ ID NO: 2601414 - RNA, 22 nt, Escherichia coli CFT073
cgaccaguuguaaucugcacca

SEQ ID NO: 2601415 - RNA, 23 nt, Escherichia coli CFT073
cgaccaucaaccuucacaaucug

SEQ ID NO: 2601416 - RNA, 14 nt, Escherichia coli CFT073
cgaccaucgccagc

SEQ ID NO: 2601417 - RNA, 19 nt, Escherichia coli CFT073
cgaccaucggaucggccau

SEQ ID NO: 2601418 - RNA, 21 nt, Escherichia coli CFT073
cgaccaucuccuuacugcccc

SEQ ID NO: 2601419 - RNA, 14 nt, Escherichia coli CFT073
cgacccacgccccu

SEQ ID NO: 2601420 - RNA, 15 nt, Escherichia coli CFT073
cgacccacgccccug

SEQ ID NO: 2601421 - RNA, 14 nt, Escherichia coli CFT073
cgacccauuacgua

SEQ ID NO: 2601422 - RNA, 16 nt, Escherichia coli CFT073
cgacccuaaccggcgc

SEQ ID NO: 2601423 - RNA, 13 nt, Escherichia coli CFT073
cgacccugaugaa

SEQ ID NO: 2601424 - RNA, 19 nt, Escherichia coli CFT073
cgaccgaagccuuuaccgc

SEQ ID NO: 2601425 - RNA, 13 nt, Escherichia coli CFT073
cgaccgagcuggu

SEQ ID NO: 2601426 - RNA, 15 nt, Escherichia coli CFT073
cgaccgagcugguga

SEQ ID NO: 2601427 - RNA, 16 nt, Escherichia coli CFT073
cgaccgccauuaaacg

SEQ ID NO: 2601428 - RNA, 11 nt, Escherichia coli CFT073
cgaccgccgcu

SEQ ID NO: 2601429 - RNA, 15 nt, Escherichia coli CFT073
cgaccgccgcucacc

SEQ ID NO: 2601430 - RNA, 14 nt, Escherichia coli CFT073
cgaccgccuucagu

SEQ ID NO: 2601431 - RNA, 22 nt, Escherichia coli CFT073
cgaccgccuucguacugugcgc

SEQ ID NO: 2601432 - RNA, 19 nt, Escherichia coli CFT073
cgaccggcguaacggccac

SEQ ID NO: 2601433 - RNA, 17 nt, Escherichia coli CFT073
cgaccgggagauuugca

SEQ ID NO: 2601434 - RNA, 21 nt, Escherichia coli CFT073
cgaccgguccacuuccugcgc

SEQ ID NO: 2601435 - RNA, 22 nt, Escherichia coli CFT073
cgaccguaaauucucccgcccc

SEQ ID NO: 2601436 - RNA, 23 nt, Escherichia coli CFT073
cgaccgucuuuauccagcaccac

SEQ ID NO: 2601437 - RNA, 16 nt, Escherichia coli CFT073
cgaccgugcgccagca

SEQ ID NO: 2601438 - RNA, 23 nt, Escherichia coli CFT073
cgaccguuugccagaacugcugc

SEQ ID NO: 2601439 - RNA, 19 nt, Escherichia coli CFT073
cgaccuacaaaaucaugca

SEQ ID NO: 2601440 - RNA, 20 nt, Escherichia coli CFT073
cgaccuacaaaaucaugcaa

SEQ ID NO: 2601441 - RNA, 23 nt, Escherichia coli CFT073
cgaccuacaaaaucaugcaaauu

SEQ ID NO: 2601442 - RNA, 17 nt, Escherichia coli CFT073
cgaccuacaaucaacgg

SEQ ID NO: 2601443 - RNA, 14 nt, Escherichia coli CFT073
cgaccuacacaccu

SEQ ID NO: 2601444 - RNA, 14 nt, Escherichia coli CFT073
cgaccugauccauu

SEQ ID NO: 2601445 - RNA, 18 nt, Escherichia coli CFT073
cgaccuucugaauaauga

SEQ ID NO: 2601446 - RNA, 14 nt, Escherichia coli CFT073
cgaccuuuuuugca

SEQ ID NO: 2601447 - RNA, 12 nt, Escherichia coli CFT073
cgacgaaguuga

SEQ ID NO: 2601448 - RNA, 14 nt, Escherichia coli CFT073
cgacgacaggcaag

SEQ ID NO: 2601449 - RNA, 15 nt, Escherichia coli CFT073
cgacgaccaccgaau

SEQ ID NO: 2601450 - RNA, 20 nt, Escherichia coli CFT073
cgacgaccgccgcucaccug

SEQ ID NO: 2601451 - RNA, 12 nt, Escherichia coli CFT073
cgacgaggaaaa

SEQ ID NO: 2601452 - RNA, 18 nt, Escherichia coli CFT073
cgagcgaauaaaccacac

SEQ ID NO: 2601453 - RNA, 20 nt, Escherichia coli CFT073
cgagcgaccaauccgacuua

SEQ ID NO: 2601454 - RNA, 11 nt, Escherichia coli CFT073
cgagcgaucca

SEQ ID NO: 2601455 - RNA, 18 nt, Escherichia coli CFT073
cgagcgauccaacuaaau

SEQ ID NO: 2601456 - RNA, 15 nt, Escherichia coli CFT073
cgagcgccagcgaag

SEQ ID NO: 2601457 - RNA, 18 nt, Escherichia coli CFT073
cgagcggccaaagggagc

SEQ ID NO: 2601458 - RNA, 21 nt, Escherichia coli CFT073
cgagcgucauauagccgccuu

SEQ ID NO: 2601459 - RNA, 18 nt, Escherichia coli CFT073
cgagcugccaguugcgcu

SEQ ID NO: 2601460 - RNA, 13 nt, Escherichia coli CFT073
cgagcuggaagcc

SEQ ID NO: 2601461 - RNA, 20 nt, Escherichia coli CFT073
cgagcuggugauaaccgcgc

SEQ ID NO: 2601462 - RNA, 14 nt, Escherichia coli CFT073
cgagcuuaacugcc

SEQ ID NO: 2601463 - RNA, 22 nt, Escherichia coli CFT073
cgagcuuauuuguugagcugga

SEQ ID NO: 2601464 - RNA, 17 nt, Escherichia coli CFT073
cgagcuuucgaccagcc

SEQ ID NO: 2601465 - RNA, 19 nt, Escherichia coli CFT073
cgaggaacagcgcgcugac

SEQ ID NO: 2601466 - RNA, 20 nt, Escherichia coli CFT073
cgaggaagaccucacgguuu

SEQ ID NO: 2601467 - RNA, 22 nt, Escherichia coli CFT073
cgaggaaucguucauaccacgc

SEQ ID NO: 2601468 - RNA, 16 nt, Escherichia coli CFT073
cgaggaaugacggauc

SEQ ID NO: 2601469 - RNA, 12 nt, Escherichia coli CFT073
cgaggagaggcc

SEQ ID NO: 2601470 - RNA, 22 nt, Escherichia coli CFT073
cgaggaggacuauuuacagauu

SEQ ID NO: 2601471 - RNA, 20 nt, Escherichia coli CFT073
cgaggaucacaaugccgcca

SEQ ID NO: 2601472 - RNA, 17 nt, Escherichia coli CFT073
cgaggaucucugcaaga

SEQ ID NO: 2601473 - RNA, 20 nt, Escherichia coli CFT073
cgaggauucgaaccucggaa

SEQ ID NO: 2601474 - RNA, 16 nt, Escherichia coli CFT073
cgaggcaaccagcacg

SEQ ID NO: 2601475 - RNA, 14 nt, Escherichia coli CFT073
cgaggccaauuugg

SEQ ID NO: 2601476 - RNA, 14 nt, Escherichia coli CFT073
cgaggccagccaga

SEQ ID NO: 2601477 - RNA, 18 nt, Escherichia coli CFT073
cgaggcguuuuccagaua

SEQ ID NO: 2601478 - RNA, 18 nt, Escherichia coli CFT073
cgaggcucugauugccuu

SEQ ID NO: 2601479 - RNA, 16 nt, Escherichia coli CFT073
cgaggcuuauccggca

SEQ ID NO: 2601480 - RNA, 20 nt, Escherichia coli CFT073
cgagggaagcaauaagcacu

SEQ ID NO: 2601481 - RNA, 17 nt, Escherichia coli CFT073
cgagggcgauauccuga

SEQ ID NO: 2601482 - RNA, 18 nt, Escherichia coli CFT073
cgaggggaccgaucgcgc

SEQ ID NO: 2601483 - RNA, 20 nt, Escherichia coli CFT073
cgagguagcgauagaaauca

SEQ ID NO: 2601484 - RNA, 19 nt, Escherichia coli CFT073
cgaggugccaccagugcag

SEQ ID NO: 2601485 - RNA, 18 nt, Escherichia coli CFT073
cgaggugucuucgcgcac

SEQ ID NO: 2601486 - RNA, 12 nt, Escherichia coli CFT073
cgagguuaucgu

SEQ ID NO: 2601487 - RNA, 22 nt, Escherichia coli CFT073
cgagguugaugauugcgccgcc

SEQ ID NO: 2601488 - RNA, 16 nt, Escherichia coli CFT073
cgaguacaaaaauaag

SEQ ID NO: 2601489 - RNA, 16 nt, Escherichia coli CFT073
cgaguagcaaccggau

SEQ ID NO: 2601490 - RNA, 23 nt, Escherichia coli CFT073
cgaguagcguucuguuucuggca

SEQ ID NO: 2601491 - RNA, 23 nt, Escherichia coli CFT073
cgaguagcucaccagcaggcacu

SEQ ID NO: 2601492 - RNA, 22 nt, Escherichia coli CFT073
cgaguccuuccuggcuggcgcu

SEQ ID NO: 2601493 - RNA, 18 nt, Escherichia coli CFT073
cgagucgccuaccaucaa

SEQ ID NO: 2601494 - RNA, 18 nt, Escherichia coli CFT073
cgagugcauccagugccg

SEQ ID NO: 2601495 - RNA, 18 nt, Escherichia coli CFT073
cgagugcgggcgagagga

SEQ ID NO: 2601496 - RNA, 16 nt, Escherichia coli CFT073
cgaguggucuccugga

SEQ ID NO: 2601497 - RNA, 17 nt, Escherichia coli CFT073
cgaguguaauccugcca

SEQ ID NO: 2601498 - RNA, 23 nt, Escherichia coli CFT073
cgagugucacuggccagcggcga

SEQ ID NO: 2601499 - RNA, 18 nt, Escherichia coli CFT073
cgaguguguggaaaacag

SEQ ID NO: 2601500 - RNA, 24 nt, Escherichia coli CFT073
cgaguuaccgugugcggcgaugau

SEQ ID NO: 2601501 - RNA, 15 nt, Escherichia coli CFT073
cgaguuagcauggcu

SEQ ID NO: 2601502 - RNA, 16 nt, Escherichia coli CFT073
cgaguuuccaucagac

SEQ ID NO: 2601503 - RNA, 13 nt, Escherichia coli CFT073
cgauaaaacauua

SEQ ID NO: 2601504 - RNA, 16 nt, Escherichia coli CFT073
cgauaaaacgccgcug

SEQ ID NO: 2601505 - RNA, 22 nt, Escherichia coli CFT073
cgauaaaacuucugcaacguuu

SEQ ID NO: 2601506 - RNA, 14 nt, Escherichia coli CFT073
cgauaaaauaauca

SEQ ID NO: 2601507 - RNA, 15 nt, Escherichia coli CFT073
cgauaaaauaaucac

SEQ ID NO: 2601508 - RNA, 19 nt, Escherichia coli CFT073
cgauaaacgcgacgauuaa

SEQ ID NO: 2601509 - RNA, 13 nt, Escherichia coli CFT073
cgauaaagcuggg

SEQ ID NO: 2601510 - RNA, 14 nt, Escherichia coli CFT073
cgauaaagcugggu

SEQ ID NO: 2601511 - RNA, 19 nt, Escherichia coli CFT073
cgauaaccaucccuucacc

SEQ ID NO: 2601512 - RNA, 17 nt, Escherichia coli CFT073
cgauaacgccccaaucc

SEQ ID NO: 2601513 - RNA, 16 nt, Escherichia coli CFT073
cgauaagccagcaacc

SEQ ID NO: 2601514 - RNA, 12 nt, Escherichia coli CFT073
cgauaagggagc

SEQ ID NO: 2601515 - RNA, 18 nt, Escherichia coli CFT073
cgauaauacccagcaacg

SEQ ID NO: 2601516 - RNA, 19 nt, Escherichia coli CFT073
cgauaauauucggcguaau

SEQ ID NO: 2601517 - RNA, 16 nt, Escherichia coli CFT073
cgauaauauugaugca

SEQ ID NO: 2601518 - RNA, 19 nt, Escherichia coli CFT073
cgauaauauugaugcacac

SEQ ID NO: 2601519 - RNA, 18 nt, Escherichia coli CFT073
cgauaaucaucagacugg

SEQ ID NO: 2601520 - RNA, 17 nt, Escherichia coli CFT073
cgauaauguuaaccugc

SEQ ID NO: 2601521 - RNA, 18 nt, Escherichia coli CFT073
cgauaauguuaaccugca

SEQ ID NO: 2601522 - RNA, 21 nt, Escherichia coli CFT073
cgauaauuuacaaucacuuca

SEQ ID NO: 2601523 - RNA, 13 nt, Escherichia coli CFT073
cgauacaaaagca

SEQ ID NO: 2601524 - RNA, 14 nt, Escherichia coli CFT073
cgauacaacgcuuu

SEQ ID NO: 2601525 - RNA, 14 nt, Escherichia coli CFT073
cgauacaccagaug

SEQ ID NO: 2601526 - RNA, 14 nt, Escherichia coli CFT073
cgauaccaguaaaa

SEQ ID NO: 2601527 - RNA, 13 nt, Escherichia coli CFT073
cgauaccgccgca

SEQ ID NO: 2601528 - RNA, 17 nt, Escherichia coli CFT073
cgauaccuaacgccagc

SEQ ID NO: 2601529 - RNA, 22 nt, Escherichia coli CFT073
cgauacgccucgggaaggucag

SEQ ID NO: 2601530 - RNA, 14 nt, Escherichia coli CFT073
cgauacggugcaca

SEQ ID NO: 2601531 - RNA, 20 nt, Escherichia coli CFT073
cgauacuacgucucaauuua

SEQ ID NO: 2601532 - RNA, 23 nt, Escherichia coli CFT073
cgauacucuuuuggcguuguguc

SEQ ID NO: 2601533 - RNA, 14 nt, Escherichia coli CFT073
cgauacugccgccc

SEQ ID NO: 2601534 - RNA, 17 nt, Escherichia coli CFT073
cgauacugccgcccauc

SEQ ID NO: 2601535 - RNA, 21 nt, Escherichia coli CFT073
cgauacugccgcccaucgcga

SEQ ID NO: 2601536 - RNA, 13 nt, Escherichia coli CFT073
cgauagacacugc

SEQ ID NO: 2601537 - RNA, 15 nt, Escherichia coli CFT073
cgauagacacugccg

SEQ ID NO: 2601538 - RNA, 17 nt, Escherichia coli CFT073
cgauagagagcagucag

SEQ ID NO: 2601539 - RNA, 19 nt, Escherichia coli CFT073
cgauagcagcccagaucag

SEQ ID NO: 2601540 - RNA, 13 nt, Escherichia coli CFT073
cgauagcccagac

SEQ ID NO: 2601541 - RNA, 14 nt, Escherichia coli CFT073
cgauagcuaacugc

SEQ ID NO: 2601542 - RNA, 18 nt, Escherichia coli CFT073
cgauaggcuuccgccauc

SEQ ID NO: 2601543 - RNA, 23 nt, Escherichia coli CFT073
cgauaggggggauugccgcgaga

SEQ ID NO: 2601544 - RNA, 22 nt, Escherichia coli CFT073
cgauagucguugccacacgacg

SEQ ID NO: 2601545 - RNA, 15 nt, Escherichia coli CFT073
cgauauaaaaaauac

SEQ ID NO: 2601546 - RNA, 19 nt, Escherichia coli CFT073
cgauauaaggguugcugac

SEQ ID NO: 2601547 - RNA, 17 nt, Escherichia coli CFT073
cgauauacaaacauaaa

SEQ ID NO: 2601548 - RNA, 20 nt, Escherichia coli CFT073
cgauauauuuuguaccguac

SEQ ID NO: 2601549 - RNA, 14 nt, Escherichia coli CFT073
cgauaucaccaauu

SEQ ID NO: 2601550 - RNA, 18 nt, Escherichia coli CFT073
cgauaucaggcaaacaga

SEQ ID NO: 2601551 - RNA, 19 nt, Escherichia coli CFT073
cgauaucaggcaaacagaa

SEQ ID NO: 2601552 - RNA, 22 nt, Escherichia coli CFT073
cgauaucaggcaaacagaauua

SEQ ID NO: 2601553 - RNA, 16 nt, Escherichia coli CFT073
cgauauccagaccgcg

SEQ ID NO: 2601554 - RNA, 23 nt, Escherichia coli CFT073
cgauauccagcgcggcgaaggug

SEQ ID NO: 2601555 - RNA, 22 nt, Escherichia coli CFT073
cgauauccaguucaugacguga

SEQ ID NO: 2601556 - RNA, 17 nt, Escherichia coli CFT073
cgauaucccaggcaaaa

SEQ ID NO: 2601557 - RNA, 21 nt, Escherichia coli CFT073
cgauaucgcugucgccacccc

SEQ ID NO: 2601558 - RNA, 21 nt, Escherichia coli CFT073
cgauaucguacucgccuauac

SEQ ID NO: 2601559 - RNA, 15 nt, Escherichia coli CFT073
cgauaugccggcauc

SEQ ID NO: 2601560 - RNA, 16 nt, Escherichia coli CFT073
cgauuaaucagugcaa

SEQ ID NO: 2601561 - RNA, 13 nt, Escherichia coli CFT073
cgauuaauccagu

SEQ ID NO: 2601562 - RNA, 14 nt, Escherichia coli CFT073
cgauuaccacgaua

SEQ ID NO: 2601563 - RNA, 14 nt, Escherichia coli CFT073
cgauuaccgccagc

SEQ ID NO: 2601564 - RNA, 17 nt, Escherichia coli CFT073
cgauuacguuugcagca

SEQ ID NO: 2601565 - RNA, 13 nt, Escherichia coli CFT073
cgauuacucagca

SEQ ID NO: 2601566 - RNA, 23 nt, Escherichia coli CFT073
cgauuagcgauaaaacgccgcug

SEQ ID NO: 2601567 - RNA, 16 nt, Escherichia coli CFT073
cgauuaucccauauac

SEQ ID NO: 2601568 - RNA, 15 nt, Escherichia coli CFT073
cgauuauccgccagc

SEQ ID NO: 2601569 - RNA, 14 nt, Escherichia coli CFT073
cgauuauuuauucc

SEQ ID NO: 2601570 - RNA, 22 nt, Escherichia coli CFT073
cgauuauuuauucccgccagau

SEQ ID NO: 2601571 - RNA, 17 nt, Escherichia coli CFT073
cgauucacauaacggcc

SEQ ID NO: 2601572 - RNA, 21 nt, Escherichia coli CFT073
cgauucagaugccauuuugca

SEQ ID NO: 2601573 - RNA, 21 nt, Escherichia coli CFT073
cgauucaggguuuacaggcuc

SEQ ID NO: 2601574 - RNA, 18 nt, Escherichia coli CFT073
cgauuccguugccagaug

SEQ ID NO: 2601575 - RNA, 15 nt, Escherichia coli CFT073
cgauucggcaaucac

SEQ ID NO: 2601576 - RNA, 18 nt, Escherichia coli CFT073
cgauugaagcagcgcugg

SEQ ID NO: 2601577 - RNA, 13 nt, Escherichia coli CFT073
cgauugccggaug

SEQ ID NO: 2601578 - RNA, 15 nt, Escherichia coli CFT073
cgauuguuccugcuc

SEQ ID NO: 2601579 - RNA, 14 nt, Escherichia coli CFT073
cgauuuaucgauuu

SEQ ID NO: 2601580 - RNA, 23 nt, Escherichia coli CFT073
cgauuuauuuuucuggcgcggcg

SEQ ID NO: 2601581 - RNA, 21 nt, Escherichia coli CFT073
cgauuucaaccacucacgaua

SEQ ID NO: 2601582 - RNA, 17 nt, Escherichia coli CFT073
cgauuucacccagcguu

SEQ ID NO: 2601583 - RNA, 18 nt, Escherichia coli CFT073
cgauuucacgcucagcaa

SEQ ID NO: 2601584 - RNA, 15 nt, Escherichia coli CFT073
cgauuucaucgccca

SEQ ID NO: 2601585 - RNA, 21 nt, Escherichia coli CFT073
cgauuucuacuuauucaccac

SEQ ID NO: 2601586 - RNA, 12 nt, Escherichia coli CFT073
cgauuugccgga

SEQ ID NO: 2601587 - RNA, 20 nt, Escherichia coli CFT073
cgauuugcguaaaaccugcc

SEQ ID NO: 2601588 - RNA, 20 nt, Escherichia coli CFT073
cgauuuugccagccgcagcu

SEQ ID NO: 2601589 - RNA, 21 nt, Escherichia coli CFT073
cgauuuuguccucggcacgcg

SEQ ID NO: 2601590 - RNA, 14 nt, Escherichia coli CFT073
cgauuuuucaucac

SEQ ID NO: 2601591 - RNA, 15 nt, Escherichia coli CFT073
cgauuuuugacuucc

SEQ ID NO: 2601592 - RNA, 16 nt, Escherichia coli CFT073
cgauuuuuuccagcgc

SEQ ID NO: 2601593 - RNA, 16 nt, Escherichia coli CFT073
cgauuuuuuccgcaaa

SEQ ID NO: 2601594 - RNA, 16 nt, Escherichia coli CFT073
cgcaaaacccgcuucu

SEQ ID NO: 2601595 - RNA, 13 nt, Escherichia coli CFT073
cgcaaaauaaaaa

SEQ ID NO: 2601596 - RNA, 18 nt, Escherichia coli CFT073
cgcaaaauaccagcaauu

SEQ ID NO: 2601597 - RNA, 22 nt, Escherichia coli CFT073
cgcaaaaucucacacugaugau

SEQ ID NO: 2601598 - RNA, 16 nt, Escherichia coli CFT073
cgcaaaauugccugau

SEQ ID NO: 2601599 - RNA, 20 nt, Escherichia coli CFT073
cgcaaacaacgccacacgca

SEQ ID NO: 2601600 - RNA, 17 nt, Escherichia coli CFT073
cgcaaacaccagcugaa

SEQ ID NO: 2601601 - RNA, 20 nt, Escherichia coli CFT073
cgcaaacaggcgcagaacuu

SEQ ID NO: 2601602 - RNA, 20 nt, Escherichia coli CFT073
cgcaaacagugaccaucuuc

SEQ ID NO: 2601603 - RNA, 23 nt, Escherichia coli CFT073
cgcaaacaucggcuuauucauau

SEQ ID NO: 2601604 - RNA, 20 nt, Escherichia coli CFT073
cgcaaaccagacaacaguca

SEQ ID NO: 2601605 - RNA, 17 nt, Escherichia coli CFT073
cgcaaaccgacgcuguc

SEQ ID NO: 2601606 - RNA, 19 nt, Escherichia coli CFT073
cgcaaacucaucgccgcca

SEQ ID NO: 2601607 - RNA, 13 nt, Escherichia coli CFT073
cgcaaacugcugu

SEQ ID NO: 2601608 - RNA, 21 nt, Escherichia coli CFT073
cgcaaacuucgguuaccacac

SEQ ID NO: 2601609 - RNA, 19 nt, Escherichia coli CFT073
cgcaaacuuugccacaauc

SEQ ID NO: 2601610 - RNA, 23 nt, Escherichia coli CFT073
cgcaaagagagaagccagguaga

SEQ ID NO: 2601611 - RNA, 20 nt, Escherichia coli CFT073
cgcaaagauaaugacuuccg

SEQ ID NO: 2601612 - RNA, 17 nt, Escherichia coli CFT073
cgcaaagcacgccaggu

SEQ ID NO: 2601613 - RNA, 17 nt, Escherichia coli CFT073
cgcaaaggccagcaauc

SEQ ID NO: 2601614 - RNA, 17 nt, Escherichia coli CFT073
cgcaaagggacuuuuca

SEQ ID NO: 2601615 - RNA, 21 nt, Escherichia coli CFT073
cgcaaagggacuuuucaggcu

SEQ ID NO: 2601616 - RNA, 14 nt, Escherichia coli CFT073
cgcaaauccacguu

SEQ ID NO: 2601617 - RNA, 13 nt, Escherichia coli CFT073
cgcaacaacacac

SEQ ID NO: 2601618 - RNA, 21 nt, Escherichia coli CFT073
cgcaacagugaaauacaguua

SEQ ID NO: 2601619 - RNA, 13 nt, Escherichia coli CFT073
cgcaacauuccgg

SEQ ID NO: 2601620 - RNA, 21 nt, Escherichia coli CFT073
cgcaaccagcgucgcaucagg

SEQ ID NO: 2601621 - RNA, 20 nt, Escherichia coli CFT073
cgcaaccgccaacagcagcc

SEQ ID NO: 2601622 - RNA, 19 nt, Escherichia coli CFT073
cgcaaccuucgccagaaua

SEQ ID NO: 2601623 - RNA, 15 nt, Escherichia coli CFT073
cgcaaccuugcugcg

SEQ ID NO: 2601624 - RNA, 13 nt, Escherichia coli CFT073
cgcaacgccgcca

SEQ ID NO: 2601625 - RNA, 14 nt, Escherichia coli CFT073
cgcaacgccgccaa

SEQ ID NO: 2601626 - RNA, 19 nt, Escherichia coli CFT073
cgcaacgccgccaacguga

SEQ ID NO: 2601627 - RNA, 17 nt, Escherichia coli CFT073
cgcaacgguucugcugc

SEQ ID NO: 2601628 - RNA, 22 nt, Escherichia coli CFT073
cgcaacgguucugcugccgcua

SEQ ID NO: 2601629 - RNA, 16 nt, Escherichia coli CFT073
cgcaacguaucaucgc

SEQ ID NO: 2601630 - RNA, 15 nt, Escherichia coli CFT073
cgcaacuccaccagc

SEQ ID NO: 2601631 - RNA, 22 nt, Escherichia coli CFT073
cgcaacuuauuggcaaucgcgg

SEQ ID NO: 2601632 - RNA, 15 nt, Escherichia coli CFT073
cgcaacuuuuucuug

SEQ ID NO: 2601633 - RNA, 18 nt, Escherichia coli CFT073
cgcaagacgaaaaaugaa

SEQ ID NO: 2601634 - RNA, 23 nt, Escherichia coli CFT073
cgcaagccacgggccgaaugcga

SEQ ID NO: 2601635 - RNA, 12 nt, Escherichia coli CFT073
cgcaagccaggu

SEQ ID NO: 2601636 - RNA, 23 nt, Escherichia coli CFT073
cgcaagcccccaguaaucgggca

SEQ ID NO: 2601637 - RNA, 22 nt, Escherichia coli CFT073
cgcaagcugcugacauacggcg

SEQ ID NO: 2601638 - RNA, 21 nt, Escherichia coli CFT073
cgcaaggcacaaagucgcgcg

SEQ ID NO: 2601639 - RNA, 12 nt, Escherichia coli CFT073
cgcaaggcauug

SEQ ID NO: 2601640 - RNA, 16 nt, Escherichia coli CFT073
cgcaauaaccaucagc

SEQ ID NO: 2601641 - RNA, 14 nt, Escherichia coli CFT073
cgcaauagccugau

SEQ ID NO: 2601642 - RNA, 17 nt, Escherichia coli CFT073
cgcaauagugauguucu

SEQ ID NO: 2601643 - RNA, 21 nt, Escherichia coli CFT073
cgcaauagugauguucuggcg

SEQ ID NO: 2601644 - RNA, 22 nt, Escherichia coli CFT073
cgcaauagugauguucuggcga

SEQ ID NO: 2601645 - RNA, 19 nt, Escherichia coli CFT073
cgcaauauguuuccgcgaa

SEQ ID NO: 2601646 - RNA, 16 nt, Escherichia coli CFT073
cgcaaucaaauuugcc

SEQ ID NO: 2601647 - RNA, 14 nt, Escherichia coli CFT073
cgcaaucagcaccg

SEQ ID NO: 2601648 - RNA, 14 nt, Escherichia coli CFT073
cgcaaucagcguuu

SEQ ID NO: 2601649 - RNA, 17 nt, Escherichia coli CFT073
cgcaaucauuuuuuccc

SEQ ID NO: 2601650 - RNA, 15 nt, Escherichia coli CFT073
cgcaaucgacaaugu

SEQ ID NO: 2601651 - RNA, 21 nt, Escherichia coli CFT073
cgcaaucgccuccagcgcugg

SEQ ID NO: 2601652 - RNA, 15 nt, Escherichia coli CFT073
cgcaaucgcgccgga

SEQ ID NO: 2601653 - RNA, 16 nt, Escherichia coli CFT073
cgcaaucgcggcagcg

SEQ ID NO: 2601654 - RNA, 14 nt, Escherichia coli CFT073
cgcaaucugcuucu

SEQ ID NO: 2601655 - RNA, 16 nt, Escherichia coli CFT073
cgcaaucugcuucuua

SEQ ID NO: 2601656 - RNA, 23 nt, Escherichia coli CFT073
cgcaaucugcuucuuaccaccuu

SEQ ID NO: 2601657 - RNA, 12 nt, Escherichia coli CFT073
cgcaaucuggca

SEQ ID NO: 2601658 - RNA, 17 nt, Escherichia coli CFT073
cgcaaugacgucuucca

SEQ ID NO: 2601659 - RNA, 22 nt, Escherichia coli CFT073
cgcaaugcguuuggagccgcug

SEQ ID NO: 2601660 - RNA, 22 nt, Escherichia coli CFT073
cgcaaugucuuuuaugguagaa

SEQ ID NO: 2601661 - RNA, 18 nt, Escherichia coli CFT073
cgcaauucgcgucggcgu

SEQ ID NO: 2601662 - RNA, 13 nt, Escherichia coli CFT073
cgcaauugcugaa

SEQ ID NO: 2601663 - RNA, 21 nt, Escherichia coli CFT073
cgcaauuuauugaauuugcag

SEQ ID NO: 2601664 - RNA, 20 nt, Escherichia coli CFT073
cgcaauuucauuauucauug

SEQ ID NO: 2601665 - RNA, 18 nt, Escherichia coli CFT073
cgcaauuuugacaauaau

SEQ ID NO: 2601666 - RNA, 13 nt, Escherichia coli CFT073
cgcacaaccgccg

SEQ ID NO: 2601667 - RNA, 22 nt, Escherichia coli CFT073
cgcacaaccugaguaaaucacc

SEQ ID NO: 2601668 - RNA, 15 nt, Escherichia coli CFT073
cgcaggucgcgcauu

SEQ ID NO: 2601669 - RNA, 19 nt, Escherichia coli CFT073
cgcaggucgcgcauuaccu

SEQ ID NO: 2601670 - RNA, 20 nt, Escherichia coli CFT073
cgcaggugacgcuggcagca

SEQ ID NO: 2601671 - RNA, 13 nt, Escherichia coli CFT073
cgcaggugauccu

SEQ ID NO: 2601672 - RNA, 21 nt, Escherichia coli CFT073
cgcaggugcgugcgcccauca

SEQ ID NO: 2601673 - RNA, 14 nt, Escherichia coli CFT073
cgcaguaaacgcca

SEQ ID NO: 2601674 - RNA, 17 nt, Escherichia coli CFT073
cgcaguaaacgccaggg

SEQ ID NO: 2601675 - RNA, 16 nt, Escherichia coli CFT073
cgcaguaaauccgcca

SEQ ID NO: 2601676 - RNA, 19 nt, Escherichia coli CFT073
cgcaguaaauccgccacuu

SEQ ID NO: 2601677 - RNA, 13 nt, Escherichia coli CFT073
cgcagucaccagc

SEQ ID NO: 2601678 - RNA, 14 nt, Escherichia coli CFT073
cgcagucgcugacc

SEQ ID NO: 2601679 - RNA, 16 nt, Escherichia coli CFT073
cgcagucgggugcugc

SEQ ID NO: 2601680 - RNA, 20 nt, Escherichia coli CFT073
cgcagucuggugcugcgcuu

SEQ ID NO: 2601681 - RNA, 20 nt, Escherichia coli CFT073
cgcagugaaauuucugccuc

SEQ ID NO: 2601682 - RNA, 19 nt, Escherichia coli CFT073
cgcagugagaagccaccgc

SEQ ID NO: 2601683 - RNA, 21 nt, Escherichia coli CFT073
cgcagugcugcaccaacauca

SEQ ID NO: 2601684 - RNA, 20 nt, Escherichia coli CFT073
cgcagugucagcaccagaga

SEQ ID NO: 2601685 - RNA, 18 nt, Escherichia coli CFT073
cgcaguucaccugguuca

SEQ ID NO: 2601686 - RNA, 13 nt, Escherichia coli CFT073
cgcaguugccgga

SEQ ID NO: 2601687 - RNA, 20 nt, Escherichia coli CFT073
cgcaguuguucggcgcugaa

SEQ ID NO: 2601688 - RNA, 17 nt, Escherichia coli CFT073
cgcaguuuaaucguuga

SEQ ID NO: 2601689 - RNA, 16 nt, Escherichia coli CFT073
cgcaguuuaugcagua

SEQ ID NO: 2601690 - RNA, 16 nt, Escherichia coli CFT073
cgcaguuuuuccuuuu

SEQ ID NO: 2601691 - RNA, 19 nt, Escherichia coli CFT073
cgcauaaagaguuuucuua

SEQ ID NO: 2601692 - RNA, 18 nt, Escherichia coli CFT073
cgcauaacucaccaucaa

SEQ ID NO: 2601693 - RNA, 17 nt, Escherichia coli CFT073
cgcauaagccacaauau

SEQ ID NO: 2601694 - RNA, 18 nt, Escherichia coli CFT073
cgcauacauaacagaaua

SEQ ID NO: 2601695 - RNA, 13 nt, Escherichia coli CFT073
cgcauaccaaaau

SEQ ID NO: 2601696 - RNA, 20 nt, Escherichia coli CFT073
cgcauaccccaucagcguaa

SEQ ID NO: 2601697 - RNA, 15 nt, Escherichia coli CFT073
cgcauaccuaccugc

SEQ ID NO: 2601698 - RNA, 15 nt, Escherichia coli CFT073
cgcauagacagccac

SEQ ID NO: 2601699 - RNA, 19 nt, Escherichia coli CFT073
cgcauagacagccacaucc

SEQ ID NO: 2601700 - RNA, 23 nt, Escherichia coli CFT073
cgcauagaucucaagcgguaaac

SEQ ID NO: 2601701 - RNA, 15 nt, Escherichia coli CFT073
cgcauagcaccaccg

SEQ ID NO: 2601702 - RNA, 14 nt, Escherichia coli CFT073
cgcauagcccagcg

SEQ ID NO: 2601703 - RNA, 15 nt, Escherichia coli CFT073
cgcauagccuccggc

SEQ ID NO: 2601704 - RNA, 17 nt, Escherichia coli CFT073
cgcauagccuccggcca

SEQ ID NO: 2601705 - RNA, 13 nt, Escherichia coli CFT073
cgcauagcuggcg

SEQ ID NO: 2601706 - RNA, 22 nt, Escherichia coli CFT073
cgcauaguuuuuugggaugaua

SEQ ID NO: 2601707 - RNA, 19 nt, Escherichia coli CFT073
cgcauauugccaucacggc

SEQ ID NO: 2601708 - RNA, 23 nt, Escherichia coli CFT073
cgcauauuguucugaccaaacaa

SEQ ID NO: 2601709 - RNA, 22 nt, Escherichia coli CFT073
cgcaucaaucuuuuucaugcua

SEQ ID NO: 2601710 - RNA, 14 nt, Escherichia coli CFT073
cgcaucacagacca

SEQ ID NO: 2601711 - RNA, 16 nt, Escherichia coli CFT073
cgcaucaccccuuccu

SEQ ID NO: 2601712 - RNA, 15 nt, Escherichia coli CFT073
cgcaucacgacagca

SEQ ID NO: 2601713 - RNA, 18 nt, Escherichia coli CFT073
cgcaucacgacagcacca

SEQ ID NO: 2601714 - RNA, 18 nt, Escherichia coli CFT073
cgcaucacgaccgcuuca

SEQ ID NO: 2601715 - RNA, 13 nt, Escherichia coli CFT073
cgcaucagcagau

SEQ ID NO: 2601716 - RNA, 13 nt, Escherichia coli CFT073
cgcaucagcaucg

SEQ ID NO: 2601717 - RNA, 20 nt, Escherichia coli CFT073
cgcaucagcuuacgcaacuc

SEQ ID NO: 2601718 - RNA, 20 nt, Escherichia coli CFT073
cgcaucaggcaacaaacuca

SEQ ID NO: 2601719 - RNA, 16 nt, Escherichia coli CFT073
cgcaucagugaaccca

SEQ ID NO: 2601720 - RNA, 17 nt, Escherichia coli CFT073
cgcaucaguuucauuuc

SEQ ID NO: 2601721 - RNA, 23 nt, Escherichia coli CFT073
cgcaucaguuucgaucagcaauu

SEQ ID NO: 2601722 - RNA, 11 nt, Escherichia coli CFT073
cgcaucauccg

SEQ ID NO: 2601723 - RNA, 15 nt, Escherichia coli CFT073
cgcaucauccgucgg

SEQ ID NO: 2601724 - RNA, 20 nt, Escherichia coli CFT073
cgcaucaugaaacgcccacg

SEQ ID NO: 2601725 - RNA, 13 nt, Escherichia coli CFT073
cgcauccaccaga

SEQ ID NO: 2601726 - RNA, 21 nt, Escherichia coli CFT073
cgcauccgacaaaaugauguc

SEQ ID NO: 2601727 - RNA, 16 nt, Escherichia coli CFT073
cgcauccgacacuggc

SEQ ID NO: 2601728 - RNA, 16 nt, Escherichia coli CFT073
cgcauccgacaucaac

SEQ ID NO: 2601729 - RNA, 19 nt, Escherichia coli CFT073
cgcauccgacaucaacgcc

SEQ ID NO: 2601730 - RNA, 19 nt, Escherichia coli CFT073
cgcauccgacaucuaacgc

SEQ ID NO: 2601731 - RNA, 15 nt, Escherichia coli CFT073
cgcauccgacauuuu

SEQ ID NO: 2601732 - RNA, 16 nt, Escherichia coli CFT073
cgcauccgccagcagc

SEQ ID NO: 2601733 - RNA, 13 nt, Escherichia coli CFT073
cgcauccggcaac

SEQ ID NO: 2601734 - RNA, 16 nt, Escherichia coli CFT073
cgcauccggcaucagu

SEQ ID NO: 2601735 - RNA, 18 nt, Escherichia coli CFT073
cgcauccggcauuguuca

SEQ ID NO: 2601736 - RNA, 19 nt, Escherichia coli CFT073
cgcauccggcauuguucau

SEQ ID NO: 2601737 - RNA, 12 nt, Escherichia coli CFT073
cgcauccggcga

SEQ ID NO: 2601738 - RNA, 19 nt, Escherichia coli CFT073
cgcauccggcguaaacaac

SEQ ID NO: 2601739 - RNA, 18 nt, Escherichia coli CFT073
cgcauccgguauuaguua

SEQ ID NO: 2601740 - RNA, 14 nt, Escherichia coli CFT073
cgcauccucauaac

SEQ ID NO: 2601741 - RNA, 12 nt, Escherichia coli CFT073
cgcaucgaucuu

SEQ ID NO: 2601742 - RNA, 14 nt, Escherichia coli CFT073
cgcaucgcccagcc

SEQ ID NO: 2601743 - RNA, 17 nt, Escherichia coli CFT073
cgcaucgcgcaccagcg

SEQ ID NO: 2601744 - RNA, 21 nt, Escherichia coli CFT073
cgcaucgcgguuaugccgccg

SEQ ID NO: 2601745 - RNA, 16 nt, Escherichia coli CFT073
cgcaucgcuuuugcgg

SEQ ID NO: 2601746 - RNA, 15 nt, Escherichia coli CFT073
cgcaucggucgcguu

SEQ ID NO: 2601747 - RNA, 15 nt, Escherichia coli CFT073
cgcaucugaccagau

SEQ ID NO: 2601748 - RNA, 22 nt, Escherichia coli CFT073
cgcaucuggcaucggcgcacaa

SEQ ID NO: 2601749 - RNA, 24 nt, Escherichia coli CFT073
cgcaucuggcauuuugcuuucaau

SEQ ID NO: 2601750 - RNA, 15 nt, Escherichia coli CFT073
cgcaucuggucagau

SEQ ID NO: 2601751 - RNA, 17 nt, Escherichia coli CFT073
cgcaucuguaugucagu

SEQ ID NO: 2601752 - RNA, 22 nt, Escherichia coli CFT073
cgcaucuuaaucucucaacacc

SEQ ID NO: 2601753 - RNA, 15 nt, Escherichia coli CFT073
cgcaugacgcaacaa

SEQ ID NO: 2601754 - RNA, 21 nt, Escherichia coli CFT073
cgcaugcauuuucaauaacug

SEQ ID NO: 2601755 - RNA, 19 nt, Escherichia coli CFT073
cgcauggaaccaguucacu

SEQ ID NO: 2601756 - RNA, 17 nt, Escherichia coli CFT073
cgcauggaagcgcaggu

SEQ ID NO: 2601757 - RNA, 17 nt, Escherichia coli CFT073
cgcaugugcccccugca

SEQ ID NO: 2601758 - RNA, 24 nt, Escherichia coli CFT073
cgcaugugcccccugcaauaaaca

SEQ ID NO: 2601759 - RNA, 18 nt, Escherichia coli CFT073
cgcauguuccucaucguc

SEQ ID NO: 2601760 - RNA, 14 nt, Escherichia coli CFT073
cgcauguuguuuuc

SEQ ID NO: 2601761 - RNA, 16 nt, Escherichia coli CFT073
cgcauguuuagucgcc

SEQ ID NO: 2601762 - RNA, 19 nt, Escherichia coli CFT073
cgcauuaucaaggcaguug

SEQ ID NO: 2601763 - RNA, 18 nt, Escherichia coli CFT073
cgcauuauccuuuaucug

SEQ ID NO: 2601764 - RNA, 20 nt, Escherichia coli CFT073
cgcauuauggugaagaagcc

SEQ ID NO: 2601765 - RNA, 22 nt, Escherichia coli CFT073
cgcauuauggugaagaagccac

SEQ ID NO: 2601766 - RNA, 16 nt, Escherichia coli CFT073
cgcauucugugccgga

SEQ ID NO: 2601767 - RNA, 22 nt, Escherichia coli CFT073
cgcauugagaucuuucgcuuua

SEQ ID NO: 2601768 - RNA, 17 nt, Escherichia coli CFT073
cgcauuggacagguuca

SEQ ID NO: 2601769 - RNA, 15 nt, Escherichia coli CFT073
cgcauuuacucucau

SEQ ID NO: 2601770 - RNA, 14 nt, Escherichia coli CFT073
cgcauuucccagca

SEQ ID NO: 2601771 - RNA, 20 nt, Escherichia coli CFT073
cgcauuucucgguauuacaa

SEQ ID NO: 2601772 - RNA, 19 nt, Escherichia coli CFT073
cgcauuuguaggcaggaua

SEQ ID NO: 2601773 - RNA, 16 nt, Escherichia coli CFT073
cgcauuuucuucauuc

SEQ ID NO: 2601774 - RNA, 16 nt, Escherichia coli CFT073
cgccaaaagcgauuau

SEQ ID NO: 2601775 - RNA, 21 nt, Escherichia coli CFT073
cgccaaaaggcaauucaauua

SEQ ID NO: 2601776 - RNA, 14 nt, Escherichia coli CFT073
cgccagcaccagca

SEQ ID NO: 2601777 - RNA, 11 nt, Escherichia coli CFT073
cgccagcacua

SEQ ID NO: 2601778 - RNA, 14 nt, Escherichia coli CFT073
cgccagcacuuccu

SEQ ID NO: 2601779 - RNA, 20 nt, Escherichia coli CFT073
cgccagcagcagcgccaacg

SEQ ID NO: 2601780 - RNA, 17 nt, Escherichia coli CFT073
cgccagcagcucacgca

SEQ ID NO: 2601781 - RNA, 23 nt, Escherichia coli CFT073
cgccagcagcucacgcagcuucu

SEQ ID NO: 2601782 - RNA, 16 nt, Escherichia coli CFT073
cgccagcaucggcaac

SEQ ID NO: 2601783 - RNA, 14 nt, Escherichia coli CFT073
cgccagcaugccgc

SEQ ID NO: 2601784 - RNA, 16 nt, Escherichia coli CFT073
cgccagcaugccgcca

SEQ ID NO: 2601785 - RNA, 19 nt, Escherichia coli CFT073
cgccagcaugccgccaagc

SEQ ID NO: 2601786 - RNA, 14 nt, Escherichia coli CFT073
cgccagcauuguca

SEQ ID NO: 2601787 - RNA, 16 nt, Escherichia coli CFT073
cgccagccaguauugc

SEQ ID NO: 2601788 - RNA, 12 nt, Escherichia coli CFT073
cgccagccaugu

SEQ ID NO: 2601789 - RNA, 18 nt, Escherichia coli CFT073
cgccagccaugucgccac

SEQ ID NO: 2601790 - RNA, 16 nt, Escherichia coli CFT073
cgccagcccuuucagc

SEQ ID NO: 2601791 - RNA, 22 nt, Escherichia coli CFT073
cgccagccgauaucuuuccggc

SEQ ID NO: 2601792 - RNA, 14 nt, Escherichia coli CFT073
cgccagccgccagc

SEQ ID NO: 2601793 - RNA, 15 nt, Escherichia coli CFT073
cgccagccgccagca

SEQ ID NO: 2601794 - RNA, 22 nt, Escherichia coli CFT073
cgccagccugcgcuaccagaaa

SEQ ID NO: 2601795 - RNA, 20 nt, Escherichia coli CFT073
cgccagcgaagccagcuccc

SEQ ID NO: 2601796 - RNA, 22 nt, Escherichia coli CFT073
cgccagcgaauuccaguugauu

SEQ ID NO: 2601797 - RNA, 22 nt, Escherichia coli CFT073
cgccagcgagaaauacgcccug

SEQ ID NO: 2601798 - RNA, 15 nt, Escherichia coli CFT073
cgccagcgcaccuga

SEQ ID NO: 2601799 - RNA, 11 nt, Escherichia coli CFT073
cgccagcgcca

SEQ ID NO: 2601800 - RNA, 18 nt, Escherichia coli CFT073
cgccagcgccaaagccag

SEQ ID NO: 2601801 - RNA, 23 nt, Escherichia coli CFT073
cgccagcgccaguuuuugcuucu

SEQ ID NO: 2601802 - RNA, 12 nt, Escherichia coli CFT073
cgccagcgccau

SEQ ID NO: 2601803 - RNA, 22 nt, Escherichia coli CFT073
cgccagcgccaucgguagcacc

SEQ ID NO: 2601804 - RNA, 13 nt, Escherichia coli CFT073
cgccagcgcgaca

SEQ ID NO: 2601805 - RNA, 18 nt, Escherichia coli CFT073
cgccagcgcgaccgccau

SEQ ID NO: 2601806 - RNA, 20 nt, Escherichia coli CFT073
cgccagcgcgaccgccauga

SEQ ID NO: 2601807 - RNA, 23 nt, Escherichia coli CFT073
cgccagcgcgccugaaugccaca

SEQ ID NO: 2601808 - RNA, 14 nt, Escherichia coli CFT073
cgccagcgcgcggc

SEQ ID NO: 2601809 - RNA, 23 nt, Escherichia coli CFT073
cgccagcgcggcggcaaucauca

SEQ ID NO: 2601810 - RNA, 23 nt, Escherichia coli CFT073
cgccagcggcguuugcuccugcu

SEQ ID NO: 2601811 - RNA, 19 nt, Escherichia coli CFT073
cgccagcggggcgaaaucu

SEQ ID NO: 2601812 - RNA, 21 nt, Escherichia coli CFT073
cgccagcggggcgaaaucuuc

SEQ ID NO: 2601813 - RNA, 23 nt, Escherichia coli CFT073
cgccagcggucauaacgcugaua

SEQ ID NO: 2601814 - RNA, 19 nt, Escherichia coli CFT073
cgccagcgguuguucaccc

SEQ ID NO: 2601815 - RNA, 22 nt, Escherichia coli CFT073
cgccagcgguuguucacccaac

SEQ ID NO: 2601816 - RNA, 16 nt, Escherichia coli CFT073
cgccagcgucacuucc

SEQ ID NO: 2601817 - RNA, 22 nt, Escherichia coli CFT073
cgccagcgucgcaucaggcauc

SEQ ID NO: 2601818 - RNA, 17 nt, Escherichia coli CFT073
cgccagcgucucuucaa

SEQ ID NO: 2601819 - RNA, 14 nt, Escherichia coli CFT073
cgccagcgugguca

SEQ ID NO: 2601820 - RNA, 21 nt, Escherichia coli CFT073
cgccagcguuaucccauucca

SEQ ID NO: 2601821 - RNA, 19 nt, Escherichia coli CFT073
cgccagcguugaugcucag

SEQ ID NO: 2601822 - RNA, 19 nt, Escherichia coli CFT073
cgccagcguuugcggcgcu

SEQ ID NO: 2601823 - RNA, 11 nt, Escherichia coli CFT073
cgccagcucca

SEQ ID NO: 2601824 - RNA, 15 nt, Escherichia coli CFT073
cgccagcuccagcgc

SEQ ID NO: 2601825 - RNA, 24 nt, Escherichia coli CFT073
cgccagcucugcgcccugcaucac

SEQ ID NO: 2601826 - RNA, 20 nt, Escherichia coli CFT073
cgccagcuucacgcgcuggg

SEQ ID NO: 2601827 - RNA, 21 nt, Escherichia coli CFT073
cgccagcuucgcuucccaacg

SEQ ID NO: 2601828 - RNA, 17 nt, Escherichia coli CFT073
cgccaggcacaccagca

SEQ ID NO: 2601829 - RNA, 18 nt, Escherichia coli CFT073
cgccaggcacaccagcaa

SEQ ID NO: 2601830 - RNA, 22 nt, Escherichia coli CFT073
cgccaggcauggcuugcgccau

SEQ ID NO: 2601831 - RNA, 18 nt, Escherichia coli CFT073
cgccaggcuuuccgucag

SEQ ID NO: 2601832 - RNA, 19 nt, Escherichia coli CFT073
cgccagguaacgaagaugg

SEQ ID NO: 2601833 - RNA, 23 nt, Escherichia coli CFT073
cgccagguacucaugcccacgca

SEQ ID NO: 2601834 - RNA, 22 nt, Escherichia coli CFT073
cgccagguguuuaaccaacaca

SEQ ID NO: 2601835 - RNA, 15 nt, Escherichia coli CFT073
cgccagguucaucaa

SEQ ID NO: 2601836 - RNA, 23 nt, Escherichia coli CFT073
cgccagguuuuagaucccacggc

SEQ ID NO: 2601837 - RNA, 19 nt, Escherichia coli CFT073
cgccaguaaucagcgcgga

SEQ ID NO: 2601838 - RNA, 15 nt, Escherichia coli CFT073
cgccaguaauccacc

SEQ ID NO: 2601839 - RNA, 18 nt, Escherichia coli CFT073
cgccaguaaucggcugaa

SEQ ID NO: 2601840 - RNA, 16 nt, Escherichia coli CFT073
cgccaguaccagcagc

SEQ ID NO: 2601841 - RNA, 23 nt, Escherichia coli CFT073
cgccaguaccgucgucauguuua

SEQ ID NO: 2601842 - RNA, 15 nt, Escherichia coli CFT073
cgccaguacgcgccc

SEQ ID NO: 2601843 - RNA, 15 nt, Escherichia coli CFT073
cgccagucacugcca

SEQ ID NO: 2601844 - RNA, 17 nt, Escherichia coli CFT073
cgccaguccaaucaggc

SEQ ID NO: 2601845 - RNA, 15 nt, Escherichia coli CFT073
cgccagugacgaccu

SEQ ID NO: 2601846 - RNA, 16 nt, Escherichia coli CFT073
cgccagugacugcgcc

SEQ ID NO: 2601847 - RNA, 15 nt, Escherichia coli CFT073
cgccagugcgcaaua

SEQ ID NO: 2601848 - RNA, 19 nt, Escherichia coli CFT073
cgccagugcgccccaggua

SEQ ID NO: 2601849 - RNA, 13 nt, Escherichia coli CFT073
cgccagugucgca

SEQ ID NO: 2601850 - RNA, 16 nt, Escherichia coli CFT073
cgccaguguucuuccg

SEQ ID NO: 2601851 - RNA, 15 nt, Escherichia coli CFT073
cgccaguucccccug

SEQ ID NO: 2601852 - RNA, 17 nt, Escherichia coli CFT073
cgccaguucgauaucca

SEQ ID NO: 2601853 - RNA, 11 nt, Escherichia coli CFT073
cgccaguucuu

SEQ ID NO: 2601854 - RNA, 23 nt, Escherichia coli CFT073
cgccaguugacguaacagagcau

SEQ ID NO: 2601855 - RNA, 22 nt, Escherichia coli CFT073
cgccaguuugcaggccaaacag

SEQ ID NO: 2601856 - RNA, 19 nt, Escherichia coli CFT073
cgccauaaacaccagcagc

SEQ ID NO: 2601857 - RNA, 20 nt, Escherichia coli CFT073
cgccauaaacaccagcagca

SEQ ID NO: 2601858 - RNA, 19 nt, Escherichia coli CFT073
cgccauaaacagcaggcag

SEQ ID NO: 2601859 - RNA, 16 nt, Escherichia coli CFT073
cgccauaaacuucauu

SEQ ID NO: 2601860 - RNA, 20 nt, Escherichia coli CFT073
cgccauaaacuucauucagc

SEQ ID NO: 2601861 - RNA, 14 nt, Escherichia coli CFT073
cgccauaacaaaua

SEQ ID NO: 2601862 - RNA, 15 nt, Escherichia coli CFT073
cgccauaacaaauau

SEQ ID NO: 2601863 - RNA, 16 nt, Escherichia coli CFT073
cgccauaaccgccagc

SEQ ID NO: 2601864 - RNA, 17 nt, Escherichia coli CFT073
cgccauaaccgccagca

SEQ ID NO: 2601865 - RNA, 18 nt, Escherichia coli CFT073
cgccauaaccgccagcac

SEQ ID NO: 2601866 - RNA, 22 nt, Escherichia coli CFT073
cgccauaaccgccagcacagcc

SEQ ID NO: 2601867 - RNA, 16 nt, Escherichia coli CFT073
cgccauaaucccgaac

SEQ ID NO: 2601868 - RNA, 18 nt, Escherichia coli CFT073
cgccauaccaugcaccaa

SEQ ID NO: 2601869 - RNA, 20 nt, Escherichia coli CFT073
cgccauaccaugcaccaacc

SEQ ID NO: 2601870 - RNA, 16 nt, Escherichia coli CFT073
cgccauauaccgcggu

SEQ ID NO: 2601871 - RNA, 15 nt, Escherichia coli CFT073
cgccauaucaccacc

SEQ ID NO: 2601872 - RNA, 13 nt, Escherichia coli CFT073
cgccauaucggca

SEQ ID NO: 2601873 - RNA, 14 nt, Escherichia coli CFT073
cgccaucaagaaca

SEQ ID NO: 2601874 - RNA, 14 nt, Escherichia coli CFT073
cgccaucaaucgac

SEQ ID NO: 2601875 - RNA, 18 nt, Escherichia coli CFT073
cgccaucaauuuugauga

SEQ ID NO: 2601876 - RNA, 23 nt, Escherichia coli CFT073
cgccaucaccaguugugaugcca

SEQ ID NO: 2601877 - RNA, 17 nt, Escherichia coli CFT073
cgccaucagccacuuca

SEQ ID NO: 2601878 - RNA, 13 nt, Escherichia coli CFT073
cgccaucagcgcc

SEQ ID NO: 2601879 - RNA, 16 nt, Escherichia coli CFT073
cgccaucaggcagaua

SEQ ID NO: 2601880 - RNA, 16 nt, Escherichia coli CFT073
cgccaucaguuucaga

SEQ ID NO: 2601881 - RNA, 15 nt, Escherichia coli CFT073
cgccauccaccguaa

SEQ ID NO: 2601882 - RNA, 21 nt, Escherichia coli CFT073
cgccauccccgaagcuuguuc

SEQ ID NO: 2601883 - RNA, 13 nt, Escherichia coli CFT073
cgccauccguaac

SEQ ID NO: 2601884 - RNA, 19 nt, Escherichia coli CFT073
cgccgcauuauggugaaga

SEQ ID NO: 2601885 - RNA, 17 nt, Escherichia coli CFT073
cgccgcauugcccaaua

SEQ ID NO: 2601886 - RNA, 12 nt, Escherichia coli CFT073
cgccgccaaagg

SEQ ID NO: 2601887 - RNA, 13 nt, Escherichia coli CFT073
cgccgccaaucgc

SEQ ID NO: 2601888 - RNA, 16 nt, Escherichia coli CFT073
cgccgccaccgccaga

SEQ ID NO: 2601889 - RNA, 14 nt, Escherichia coli CFT073
cgccgccacugcaa

SEQ ID NO: 2601890 - RNA, 20 nt, Escherichia coli CFT073
cgccgccagaccacugcgcc

SEQ ID NO: 2601891 - RNA, 19 nt, Escherichia coli CFT073
cgccgccagauagccgcca

SEQ ID NO: 2601892 - RNA, 14 nt, Escherichia coli CFT073
cgccgccagauccu

SEQ ID NO: 2601893 - RNA, 20 nt, Escherichia coli CFT073
cgccgccagauguuccgcca

SEQ ID NO: 2601894 - RNA, 13 nt, Escherichia coli CFT073
cgccgccagcggg

SEQ ID NO: 2601895 - RNA, 14 nt, Escherichia coli CFT073
cgccgccagcgggg

SEQ ID NO: 2601896 - RNA, 11 nt, Escherichia coli CFT073
cgccgccaggg

SEQ ID NO: 2601897 - RNA, 14 nt, Escherichia coli CFT073
cgccgcccaguccc

SEQ ID NO: 2601898 - RNA, 21 nt, Escherichia coli CFT073
cgccgccgagauuugccagau

SEQ ID NO: 2601899 - RNA, 14 nt, Escherichia coli CFT073
cgccgccgccagcg

SEQ ID NO: 2601900 - RNA, 15 nt, Escherichia coli CFT073
cgccgcggacaauaa

SEQ ID NO: 2601901 - RNA, 22 nt, Escherichia coli CFT073
cgccgcggacaauaauaucuuu

SEQ ID NO: 2601902 - RNA, 14 nt, Escherichia coli CFT073
cgccgcggcgcagc

SEQ ID NO: 2601903 - RNA, 15 nt, Escherichia coli CFT073
cgccgcggcgcagcu

SEQ ID NO: 2601904 - RNA, 16 nt, Escherichia coli CFT073
cgccgcgugccaccau

SEQ ID NO: 2601905 - RNA, 19 nt, Escherichia coli CFT073
cgccgcguuugcgcagcca

SEQ ID NO: 2601906 - RNA, 20 nt, Escherichia coli CFT073
cgccgcguuugcgcagccag

SEQ ID NO: 2601907 - RNA, 20 nt, Escherichia coli CFT073
cgccgcuaaauaccagcgua

SEQ ID NO: 2601908 - RNA, 22 nt, Escherichia coli CFT073
cgccgcuaacaugguuaaaauc

SEQ ID NO: 2601909 - RNA, 20 nt, Escherichia coli CFT073
cgccgcucggugcgcguggc

SEQ ID NO: 2601910 - RNA, 14 nt, Escherichia coli CFT073
cgccgcugguggcg

SEQ ID NO: 2601911 - RNA, 15 nt, Escherichia coli CFT073
cgccgcugguggcga

SEQ ID NO: 2601912 - RNA, 16 nt, Escherichia coli CFT073
cgccgcuuuaaucacc

SEQ ID NO: 2601913 - RNA, 13 nt, Escherichia coli CFT073
cgccgcuuuuucg

SEQ ID NO: 2601914 - RNA, 20 nt, Escherichia coli CFT073
cgccggaauaucaccacuga

SEQ ID NO: 2601915 - RNA, 17 nt, Escherichia coli CFT073
cgccggaaucaacgguu

SEQ ID NO: 2601916 - RNA, 13 nt, Escherichia coli CFT073
cgccggagagaaa

SEQ ID NO: 2601917 - RNA, 21 nt, Escherichia coli CFT073
cgccggauagcuaaucaucug

SEQ ID NO: 2601918 - RNA, 22 nt, Escherichia coli CFT073
cgccggaucgaccgguucgccu

SEQ ID NO: 2601919 - RNA, 17 nt, Escherichia coli CFT073
cgccggaugaaaaguca

SEQ ID NO: 2601920 - RNA, 17 nt, Escherichia coli CFT073
cgccggaugcggcaggc

SEQ ID NO: 2601921 - RNA, 15 nt, Escherichia coli CFT073
cgccggcgcaccggu

SEQ ID NO: 2601922 - RNA, 18 nt, Escherichia coli CFT073
cgccggcuucaucuuuau

SEQ ID NO: 2601923 - RNA, 21 nt, Escherichia coli CFT073
cgccggcuucaucuuuauuca

SEQ ID NO: 2601924 - RNA, 19 nt, Escherichia coli CFT073
cgccgggauauaugucacc

SEQ ID NO: 2601925 - RNA, 16 nt, Escherichia coli CFT073
cgccgggcuaaccgcu

SEQ ID NO: 2601926 - RNA, 17 nt, Escherichia coli CFT073
cgccgguaauuccagcg

SEQ ID NO: 2601927 - RNA, 22 nt, Escherichia coli CFT073
cgccggugagcacaucagcgcc

SEQ ID NO: 2601928 - RNA, 20 nt, Escherichia coli CFT073
cgccgguuaaucuaaucugu

SEQ ID NO: 2601929 - RNA, 13 nt, Escherichia coli CFT073
cgccguaaacauc

SEQ ID NO: 2601930 - RNA, 19 nt, Escherichia coli CFT073
cgccguaacugacgggcuu

SEQ ID NO: 2601931 - RNA, 18 nt, Escherichia coli CFT073
cgccguaauguugcgcca

SEQ ID NO: 2601932 - RNA, 22 nt, Escherichia coli CFT073
cgccguagccauuaccaggucg

SEQ ID NO: 2601933 - RNA, 13 nt, Escherichia coli CFT073
cgccguaggccau

SEQ ID NO: 2601934 - RNA, 17 nt, Escherichia coli CFT073
cgccguauacgcuucgg

SEQ ID NO: 2601935 - RNA, 15 nt, Escherichia coli CFT073
cgccgucaucacgca

SEQ ID NO: 2601936 - RNA, 20 nt, Escherichia coli CFT073
cgccgucaucacgcaggcug

SEQ ID NO: 2601937 - RNA, 18 nt, Escherichia coli CFT073
cgccguccacaaaccguu

SEQ ID NO: 2601938 - RNA, 15 nt, Escherichia coli CFT073
cgccguggccgagau

SEQ ID NO: 2601939 - RNA, 22 nt, Escherichia coli CFT073
cgccguugcuggcaaucaccuc

SEQ ID NO: 2601940 - RNA, 17 nt, Escherichia coli CFT073
cgccguuucagccagag

SEQ ID NO: 2601941 - RNA, 20 nt, Escherichia coli CFT073
cgccguuuuuacccagcagc

SEQ ID NO: 2601942 - RNA, 23 nt, Escherichia coli CFT073
cgccguuuuuuuauagcuuauuc

SEQ ID NO: 2601943 - RNA, 13 nt, Escherichia coli CFT073
cgccuaccaccag

SEQ ID NO: 2601944 - RNA, 19 nt, Escherichia coli CFT073
cgccuaccggaaucgcgcg

SEQ ID NO: 2601945 - RNA, 17 nt, Escherichia coli CFT073
cgccuacggcauucugc

SEQ ID NO: 2601946 - RNA, 23 nt, Escherichia coli CFT073
cgccuauuauccggcaaccaccg

SEQ ID NO: 2601947 - RNA, 19 nt, Escherichia coli CFT073
cgccucaagaaucacuuca

SEQ ID NO: 2601948 - RNA, 20 nt, Escherichia coli CFT073
cgccucaagaaucacuucau

SEQ ID NO: 2601949 - RNA, 22 nt, Escherichia coli CFT073
cgccucaagcucgcagagauca

SEQ ID NO: 2601950 - RNA, 14 nt, Escherichia coli CFT073
cgccucacgccagc

SEQ ID NO: 2601951 - RNA, 14 nt, Escherichia coli CFT073
cgccucagccagaa

SEQ ID NO: 2601952 - RNA, 23 nt, Escherichia coli CFT073
cgccucaguuucgacaccuucag

SEQ ID NO: 2601953 - RNA, 14 nt, Escherichia coli CFT073
cgccucaucaucgc

SEQ ID NO: 2601954 - RNA, 22 nt, Escherichia coli CFT073
cgccucuaacagaucauccauc

SEQ ID NO: 2601955 - RNA, 17 nt, Escherichia coli CFT073
cgccucuucauacaucu

SEQ ID NO: 2601956 - RNA, 11 nt, Escherichia coli CFT073
cgccucuucca

SEQ ID NO: 2601957 - RNA, 16 nt, Escherichia coli CFT073
cgccugaacaccagaa

SEQ ID NO: 2601958 - RNA, 13 nt, Escherichia coli CFT073
cgccugacgcaau

SEQ ID NO: 2601959 - RNA, 17 nt, Escherichia coli CFT073
cgccugagcagcgauau

SEQ ID NO: 2601960 - RNA, 14 nt, Escherichia coli CFT073
cgccugaucgagca

SEQ ID NO: 2601961 - RNA, 13 nt, Escherichia coli CFT073
cgccugaucgcgc

SEQ ID NO: 2601962 - RNA, 14 nt, Escherichia coli CFT073
cgccugaucgcgca

SEQ ID NO: 2601963 - RNA, 16 nt, Escherichia coli CFT073
cgccugaucgcgcagu

SEQ ID NO: 2601964 - RNA, 13 nt, Escherichia coli CFT073
cgccugcaaauaa

SEQ ID NO: 2601965 - RNA, 20 nt, Escherichia coli CFT073
cgccugcaagcgucgcgcca

SEQ ID NO: 2601966 - RNA, 18 nt, Escherichia coli CFT073
cgccugcauaaaggcaaa

SEQ ID NO: 2601967 - RNA, 14 nt, Escherichia coli CFT073
cgccugcaucucuu

SEQ ID NO: 2601968 - RNA, 13 nt, Escherichia coli CFT073
cgccugcccaaua

SEQ ID NO: 2601969 - RNA, 18 nt, Escherichia coli CFT073
cgccugcgaguuuuaccu

SEQ ID NO: 2601970 - RNA, 16 nt, Escherichia coli CFT073
cgccugcgccaccaca

SEQ ID NO: 2601971 - RNA, 19 nt, Escherichia coli CFT073
cgccugcgccagugccgga

SEQ ID NO: 2601972 - RNA, 14 nt, Escherichia coli CFT073
cgccugcggccagc

SEQ ID NO: 2601973 - RNA, 21 nt, Escherichia coli CFT073
cgccugcggcugauaaucuuc

SEQ ID NO: 2601974 - RNA, 17 nt, Escherichia coli CFT073
cgccugcgugcaguucc

SEQ ID NO: 2601975 - RNA, 20 nt, Escherichia coli CFT073
cgccugcugauaagacgcau

SEQ ID NO: 2601976 - RNA, 15 nt, Escherichia coli CFT073
cgccugcugcacacc

SEQ ID NO: 2601977 - RNA, 20 nt, Escherichia coli CFT073
cgccugcugcgucgcggccu

SEQ ID NO: 2601978 - RNA, 14 nt, Escherichia coli CFT073
cgccugcuuaacau

SEQ ID NO: 2601979 - RNA, 22 nt, Escherichia coli CFT073
cgccugcuucuacgcagguuaa

SEQ ID NO: 2601980 - RNA, 15 nt, Escherichia coli CFT073
cgccuggcgcugcuc

SEQ ID NO: 2601981 - RNA, 18 nt, Escherichia coli CFT073
cgccuggcgugcccccgu

SEQ ID NO: 2601982 - RNA, 15 nt, Escherichia coli CFT073
cgccugggugcgauu

SEQ ID NO: 2601983 - RNA, 16 nt, Escherichia coli CFT073
cgccuggugcaggcgu

SEQ ID NO: 2601984 - RNA, 22 nt, Escherichia coli CFT073
cgccuggugcaggcguuaauau

SEQ ID NO: 2601985 - RNA, 20 nt, Escherichia coli CFT073
cgccugguugaguaaauaac

SEQ ID NO: 2601986 - RNA, 22 nt, Escherichia coli CFT073
cgccugguuuugccaugcaaua

SEQ ID NO: 2601987 - RNA, 19 nt, Escherichia coli CFT073
cgccuuauccgaccuacag

SEQ ID NO: 2601988 - RNA, 20 nt, Escherichia coli CFT073
cgccuuauccggccuacaua

SEQ ID NO: 2601989 - RNA, 20 nt, Escherichia coli CFT073
cgccuuauccggccuacgaa

SEQ ID NO: 2601990 - RNA, 22 nt, Escherichia coli CFT073
cgccuuauccggccuacgggaa

SEQ ID NO: 2601991 - RNA, 20 nt, Escherichia coli CFT073
cgccuuauccggccuacugg

SEQ ID NO: 2601992 - RNA, 18 nt, Escherichia coli CFT073
cgcgccccacggauugcc

SEQ ID NO: 2601993 - RNA, 13 nt, Escherichia coli CFT073
cgcgcccgccgcu

SEQ ID NO: 2601994 - RNA, 15 nt, Escherichia coli CFT073
cgcgcccgcguuccu

SEQ ID NO: 2601995 - RNA, 23 nt, Escherichia coli CFT073
cgcgccgaagcugaccagacagu

SEQ ID NO: 2601996 - RNA, 23 nt, Escherichia coli CFT073
cgcgccgcagccggaaaaccauc

SEQ ID NO: 2601997 - RNA, 15 nt, Escherichia coli CFT073
cgcgccgccaacccc

SEQ ID NO: 2601998 - RNA, 14 nt, Escherichia coli CFT073
cgcgccgccaccgc

SEQ ID NO: 2601999 - RNA, 12 nt, Escherichia coli CFT073
cgcgccgccagc

SEQ ID NO: 2602000 - RNA, 15 nt, Escherichia coli CFT073
cgcgccgccagccac

SEQ ID NO: 2602001 - RNA, 19 nt, Escherichia coli CFT073
cgcgccgccagccacaggc

SEQ ID NO: 2602002 - RNA, 14 nt, Escherichia coli CFT073
cgcgccgcugagaa

SEQ ID NO: 2602003 - RNA, 23 nt, Escherichia coli CFT073
cgcgccggacgauuuauuuuucu

SEQ ID NO: 2602004 - RNA, 23 nt, Escherichia coli CFT073
cgcgccuguugcgguuucucccg

SEQ ID NO: 2602005 - RNA, 17 nt, Escherichia coli CFT073
cgcgccuuacgggcgua

SEQ ID NO: 2602006 - RNA, 21 nt, Escherichia coli CFT073
cgcgccuucgugcggcugcau

SEQ ID NO: 2602007 - RNA, 18 nt, Escherichia coli CFT073
cgcgcgcaccguccagcg

SEQ ID NO: 2602008 - RNA, 14 nt, Escherichia coli CFT073
cgcgcgccaguuca

SEQ ID NO: 2602009 - RNA, 22 nt, Escherichia coli CFT073
cgcgcgcuaacggagaauccag

SEQ ID NO: 2602010 - RNA, 21 nt, Escherichia coli CFT073
cgcgcggagcgccugucugca

SEQ ID NO: 2602011 - RNA, 21 nt, Escherichia coli CFT073
cgcgcggguggugcgcaccag

SEQ ID NO: 2602012 - RNA, 13 nt, Escherichia coli CFT073
cgcgcgucacgau

SEQ ID NO: 2602013 - RNA, 13 nt, Escherichia coli CFT073
cgcgcgugccgga

SEQ ID NO: 2602014 - RNA, 14 nt, Escherichia coli CFT073
cgcgcgugccggaa

SEQ ID NO: 2602015 - RNA, 21 nt, Escherichia coli CFT073
cgcgcgugccggaacgccgcu

SEQ ID NO: 2602016 - RNA, 22 nt, Escherichia coli CFT073
cgcgcgugccggaacgccgcug

SEQ ID NO: 2602017 - RNA, 23 nt, Escherichia coli CFT073
cgcgcuaacggagaauccagccc

SEQ ID NO: 2602018 - RNA, 19 nt, Escherichia coli CFT073
cgcgcuaccaaccagauua

SEQ ID NO: 2602019 - RNA, 15 nt, Escherichia coli CFT073
cgcgcuaccacuucc

SEQ ID NO: 2602020 - RNA, 16 nt, Escherichia coli CFT073
cgcgcucaauguugcu

SEQ ID NO: 2602021 - RNA, 15 nt, Escherichia coli CFT073
cgcgcucaccgcucu

SEQ ID NO: 2602022 - RNA, 15 nt, Escherichia coli CFT073
cgcgcuccaucaugu

SEQ ID NO: 2602023 - RNA, 17 nt, Escherichia coli CFT073
cgcgcuccggcacuuaa

SEQ ID NO: 2602024 - RNA, 23 nt, Escherichia coli CFT073
cgcgcucuucuucacgauaaauc

SEQ ID NO: 2602025 - RNA, 16 nt, Escherichia coli CFT073
cgcgcucuuuaaaggc

SEQ ID NO: 2602026 - RNA, 14 nt, Escherichia coli CFT073
cgcgcuggcgcagc

SEQ ID NO: 2602027 - RNA, 22 nt, Escherichia coli CFT073
cgcgcuguaauuucacaccauc

SEQ ID NO: 2602028 - RNA, 21 nt, Escherichia coli CFT073
cgcgcugugguguccuucuca

SEQ ID NO: 2602029 - RNA, 15 nt, Escherichia coli CFT073
cgcgcuuaucgccag

SEQ ID NO: 2602030 - RNA, 18 nt, Escherichia coli CFT073
cgcgcuuaucgccagcgc

SEQ ID NO: 2602031 - RNA, 14 nt, Escherichia coli CFT073
cgcgcuugccgccg

SEQ ID NO: 2602032 - RNA, 20 nt, Escherichia coli CFT073
cgcgcuuuaccaucgcgcac

SEQ ID NO: 2602033 - RNA, 22 nt, Escherichia coli CFT073
cgcgcuuuuacugcgucaucgg

SEQ ID NO: 2602034 - RNA, 21 nt, Escherichia coli CFT073
cgcggaacaagucggcgugca

SEQ ID NO: 2602035 - RNA, 21 nt, Escherichia coli CFT073
cgcggacaauaauaucuuucu

SEQ ID NO: 2602036 - RNA, 15 nt, Escherichia coli CFT073
cgcggaccccgcgcu

SEQ ID NO: 2602037 - RNA, 17 nt, Escherichia coli CFT073
cgcggauagccagcauc

SEQ ID NO: 2602038 - RNA, 14 nt, Escherichia coli CFT073
cgcggauaucuuuc

SEQ ID NO: 2602039 - RNA, 16 nt, Escherichia coli CFT073
cgcggaucuccggcga

SEQ ID NO: 2602040 - RNA, 19 nt, Escherichia coli CFT073
cgcggaucuccggcgaccg

SEQ ID NO: 2602041 - RNA, 22 nt, Escherichia coli CFT073
cgcggaugcguuguaccagcuu

SEQ ID NO: 2602042 - RNA, 22 nt, Escherichia coli CFT073
cgcggauggccucugccagcug

SEQ ID NO: 2602043 - RNA, 23 nt, Escherichia coli CFT073
cgcggauggccucugccagcugc

SEQ ID NO: 2602044 - RNA, 19 nt, Escherichia coli CFT073
cgcggauuuuauucagcag

SEQ ID NO: 2602045 - RNA, 23 nt, Escherichia coli CFT073
cgcggcaaaacccugcgccagcg

SEQ ID NO: 2602046 - RNA, 17 nt, Escherichia coli CFT073
cgcggcaauccccgcca

SEQ ID NO: 2602047 - RNA, 22 nt, Escherichia coli CFT073
cgcggcaaucuuuaccggucag

SEQ ID NO: 2602048 - RNA, 15 nt, Escherichia coli CFT073
cgcggcacaccagcc

SEQ ID NO: 2602049 - RNA, 14 nt, Escherichia coli CFT073
cgcggcagugacag

SEQ ID NO: 2602050 - RNA, 20 nt, Escherichia coli CFT073
cgcggcgaaggugccugccc

SEQ ID NO: 2602051 - RNA, 23 nt, Escherichia coli CFT073
cgcggcgauaauacccagcaacg

SEQ ID NO: 2602052 - RNA, 14 nt, Escherichia coli CFT073
cgcggcgaucugca

SEQ ID NO: 2602053 - RNA, 16 nt, Escherichia coli CFT073
cgcggcgcagcuccag

SEQ ID NO: 2602054 - RNA, 13 nt, Escherichia coli CFT073
cgcggcuaacucc

SEQ ID NO: 2602055 - RNA, 23 nt, Escherichia coli CFT073
cgcggcugcguaauucgccaccg

SEQ ID NO: 2602056 - RNA, 18 nt, Escherichia coli CFT073
cgcggcuguugccaccau

SEQ ID NO: 2602057 - RNA, 22 nt, Escherichia coli CFT073
cgcgggauguacguucgcgggc

SEQ ID NO: 2602058 - RNA, 14 nt, Escherichia coli CFT073
cgcgggcagaugcc

SEQ ID NO: 2602059 - RNA, 18 nt, Escherichia coli CFT073
cgcgguaaaagccauucu

SEQ ID NO: 2602060 - RNA, 15 nt, Escherichia coli CFT073
cgcgguaaaagccca

SEQ ID NO: 2602061 - RNA, 14 nt, Escherichia coli CFT073
cgcgguauccggcu

SEQ ID NO: 2602062 - RNA, 18 nt, Escherichia coli CFT073
cgcgguaucucgcgccag

SEQ ID NO: 2602063 - RNA, 23 nt, Escherichia coli CFT073
cgcgguauuacccucaaacgcca

SEQ ID NO: 2602064 - RNA, 17 nt, Escherichia coli CFT073
cgcggucagcugcuguu

SEQ ID NO: 2602065 - RNA, 21 nt, Escherichia coli CFT073
cgcggucgccgucaggcaagc

SEQ ID NO: 2602066 - RNA, 20 nt, Escherichia coli CFT073
cgcgguguugauacaggcgc

SEQ ID NO: 2602067 - RNA, 17 nt, Escherichia coli CFT073
cgcgguuacgcaccggu

SEQ ID NO: 2602068 - RNA, 16 nt, Escherichia coli CFT073
cgcgguuaugccgccg

SEQ ID NO: 2602069 - RNA, 19 nt, Escherichia coli CFT073
cgcgguuaugccgccgaca

SEQ ID NO: 2602070 - RNA, 14 nt, Escherichia coli CFT073
cgcgguucccagcg

SEQ ID NO: 2602071 - RNA, 13 nt, Escherichia coli CFT073
cgcgguucgggaa

SEQ ID NO: 2602072 - RNA, 20 nt, Escherichia coli CFT073
cgcgguugcugucggcggcg

SEQ ID NO: 2602073 - RNA, 16 nt, Escherichia coli CFT073
cgcgguuucgccgcca

SEQ ID NO: 2602074 - RNA, 15 nt, Escherichia coli CFT073
cgcguaaauccagca

SEQ ID NO: 2602075 - RNA, 20 nt, Escherichia coli CFT073
cgcguaaauccagcaccgcu

SEQ ID NO: 2602076 - RNA, 22 nt, Escherichia coli CFT073
cgcguaaauccagcaccgcuuu

SEQ ID NO: 2602077 - RNA, 18 nt, Escherichia coli CFT073
cgcguaauucacguauca

SEQ ID NO: 2602078 - RNA, 13 nt, Escherichia coli CFT073
cgcguaccgccga

SEQ ID NO: 2602079 - RNA, 16 nt, Escherichia coli CFT073
cgcguaugcccagcgc

SEQ ID NO: 2602080 - RNA, 22 nt, Escherichia coli CFT073
cgcgucaaguuaagcauuggca

SEQ ID NO: 2602081 - RNA, 19 nt, Escherichia coli CFT073
cgcgucaaucacacugacu

SEQ ID NO: 2602082 - RNA, 21 nt, Escherichia coli CFT073
cgcgucaaucacuuucugcgc

SEQ ID NO: 2602083 - RNA, 22 nt, Escherichia coli CFT073
cgcguccuguaacgcaggaugu

SEQ ID NO: 2602084 - RNA, 22 nt, Escherichia coli CFT073
cgcgucuuaucaggccuacaua

SEQ ID NO: 2602085 - RNA, 22 nt, Escherichia coli CFT073
cgcgucuuaucaggccuacgcc

SEQ ID NO: 2602086 - RNA, 21 nt, Escherichia coli CFT073
cgcgucuucaucguccagcgu

SEQ ID NO: 2602087 - RNA, 15 nt, Escherichia coli CFT073
cgcgugcgccaccgc

SEQ ID NO: 2602088 - RNA, 22 nt, Escherichia coli CFT073
cgcgugcgccaccgcuuccggc

SEQ ID NO: 2602089 - RNA, 12 nt, Escherichia coli CFT073
cgcgugcuggga

SEQ ID NO: 2602090 - RNA, 16 nt, Escherichia coli CFT073
cgcguggucagcacaa

SEQ ID NO: 2602091 - RNA, 19 nt, Escherichia coli CFT073
cgcguuaaauccugccaac

SEQ ID NO: 2602092 - RNA, 20 nt, Escherichia coli CFT073
cgcguuaaauccugccaacg

SEQ ID NO: 2602093 - RNA, 13 nt, Escherichia coli CFT073
cgcguuacgccau

SEQ ID NO: 2602094 - RNA, 14 nt, Escherichia coli CFT073
cgcguuacgcccaa

SEQ ID NO: 2602095 - RNA, 19 nt, Escherichia coli CFT073
cgcguuagcuuaauaagaa

SEQ ID NO: 2602096 - RNA, 17 nt, Escherichia coli CFT073
cgcguucugucagcacg

SEQ ID NO: 2602097 - RNA, 15 nt, Escherichia coli CFT073
cgcguuggcaagaua

SEQ ID NO: 2602098 - RNA, 22 nt, Escherichia coli CFT073
cgcguuggcaagauacgcaucg

SEQ ID NO: 2602099 - RNA, 15 nt, Escherichia coli CFT073
cgcugacgugcugca

SEQ ID NO: 2602100 - RNA, 15 nt, Escherichia coli CFT073
cgcugacucuacuga

SEQ ID NO: 2602101 - RNA, 21 nt, Escherichia coli CFT073
cgcugagcacgcuuagcuuug

SEQ ID NO: 2602102 - RNA, 21 nt, Escherichia coli CFT073
cgcugagccgacgccagcguu

SEQ ID NO: 2602103 - RNA, 23 nt, Escherichia coli CFT073
cgcugagccgacgccagcguuca

SEQ ID NO: 2602104 - RNA, 18 nt, Escherichia coli CFT073
cgcugaggaucgggcagu

SEQ ID NO: 2602105 - RNA, 18 nt, Escherichia coli CFT073
cgcugagguuaugcaaac

SEQ ID NO: 2602106 - RNA, 22 nt, Escherichia coli CFT073
cgcugauacccggcacacaaau

SEQ ID NO: 2602107 - RNA, 17 nt, Escherichia coli CFT073
cgcugauauacccuuca

SEQ ID NO: 2602108 - RNA, 19 nt, Escherichia coli CFT073
cgcugauauugcuccagac

SEQ ID NO: 2602109 - RNA, 15 nt, Escherichia coli CFT073
cgcugaucaccguag

SEQ ID NO: 2602110 - RNA, 12 nt, Escherichia coli CFT073
cgcugauucaag

SEQ ID NO: 2602111 - RNA, 15 nt, Escherichia coli CFT073
cgcugauucuuccca

SEQ ID NO: 2602112 - RNA, 20 nt, Escherichia coli CFT073
cgcugauugccccuccgcac

SEQ ID NO: 2602113 - RNA, 13 nt, Escherichia coli CFT073
cgcugauugcugg

SEQ ID NO: 2602114 - RNA, 22 nt, Escherichia coli CFT073
cgcugcaacacuuccgcuucca

SEQ ID NO: 2602115 - RNA, 21 nt, Escherichia coli CFT073
cgcugcaccagguuuucgucg

SEQ ID NO: 2602116 - RNA, 14 nt, Escherichia coli CFT073
cgcugcaccaguaa

SEQ ID NO: 2602117 - RNA, 22 nt, Escherichia coli CFT073
cgcugcacuuucucgacaucca

SEQ ID NO: 2602118 - RNA, 18 nt, Escherichia coli CFT073
cgcugccagaucaaacaa

SEQ ID NO: 2602119 - RNA, 20 nt, Escherichia coli CFT073
cgcugccagucacugugacg

SEQ ID NO: 2602120 - RNA, 17 nt, Escherichia coli CFT073
cgcugccaugaucaaau

SEQ ID NO: 2602121 - RNA, 12 nt, Escherichia coli CFT073
cgcugccccugg

SEQ ID NO: 2602122 - RNA, 13 nt, Escherichia coli CFT073
cgcugcccgccgc

SEQ ID NO: 2602123 - RNA, 18 nt, Escherichia coli CFT073
cgcugcgaaguuuuuccg

SEQ ID NO: 2602124 - RNA, 22 nt, Escherichia coli CFT073
cgcugcgaaguuuuuccgccgc

SEQ ID NO: 2602125 - RNA, 16 nt, Escherichia coli CFT073
cgcugcgcaggcaaua

SEQ ID NO: 2602126 - RNA, 21 nt, Escherichia coli CFT073
cgcugcgccauaaccgccagc

SEQ ID NO: 2602127 - RNA, 14 nt, Escherichia coli CFT073
cgcugcgcuucuca

SEQ ID NO: 2602128 - RNA, 17 nt, Escherichia coli CFT073
cgcugcgcuugcugcca

SEQ ID NO: 2602129 - RNA, 18 nt, Escherichia coli CFT073
cgcugcgcuugcugccag

SEQ ID NO: 2602130 - RNA, 21 nt, Escherichia coli CFT073
cgcugcggguugcucucgcca

SEQ ID NO: 2602131 - RNA, 22 nt, Escherichia coli CFT073
cgcugcggguugcucucgccag

SEQ ID NO: 2602132 - RNA, 23 nt, Escherichia coli CFT073
cgcugcggguugcucucgccagc

SEQ ID NO: 2602133 - RNA, 20 nt, Escherichia coli CFT073
cgcugcguacagcgcgggcu

SEQ ID NO: 2602134 - RNA, 13 nt, Escherichia coli CFT073
cgcugcuaauuua

SEQ ID NO: 2602135 - RNA, 11 nt, Escherichia coli CFT073
cgcugcucagg

SEQ ID NO: 2602136 - RNA, 14 nt, Escherichia coli CFT073
cgcugcugcacaua

SEQ ID NO: 2602137 - RNA, 15 nt, Escherichia coli CFT073
cgcugcugcacauac

SEQ ID NO: 2602138 - RNA, 22 nt, Escherichia coli CFT073
cgcugcugccguugccgcucuu

SEQ ID NO: 2602139 - RNA, 13 nt, Escherichia coli CFT073
cgcugcugggcug

SEQ ID NO: 2602140 - RNA, 11 nt, Escherichia coli CFT073
cgcuggaucga

SEQ ID NO: 2602141 - RNA, 20 nt, Escherichia coli CFT073
cgcuggaugcgaccagcguc

SEQ ID NO: 2602142 - RNA, 22 nt, Escherichia coli CFT073
cgcuggcaaaaaaguagcgcag

SEQ ID NO: 2602143 - RNA, 22 nt, Escherichia coli CFT073
cgcuggcaagaagaucagcaaa

SEQ ID NO: 2602144 - RNA, 22 nt, Escherichia coli CFT073
cgcuggcagcaagugcggcgca

SEQ ID NO: 2602145 - RNA, 20 nt, Escherichia coli CFT073
cgcuggcauggcgaaaaucu

SEQ ID NO: 2602146 - RNA, 23 nt, Escherichia coli CFT073
cgcuggccaugauuaccagcauc

SEQ ID NO: 2602147 - RNA, 20 nt, Escherichia coli CFT073
cgcuggccuccagcacuucc

SEQ ID NO: 2602148 - RNA, 22 nt, Escherichia coli CFT073
cgcuggcgugcggcguaaugcc

SEQ ID NO: 2602149 - RNA, 15 nt, Escherichia coli CFT073
cgcugggccaucagg

SEQ ID NO: 2602150 - RNA, 20 nt, Escherichia coli CFT073
cgcugguaaacgacccugcc

SEQ ID NO: 2602151 - RNA, 15 nt, Escherichia coli CFT073
cgcugguaacaucaa

SEQ ID NO: 2602152 - RNA, 17 nt, Escherichia coli CFT073
cgcugguaacaucaaua

SEQ ID NO: 2602153 - RNA, 14 nt, Escherichia coli CFT073
cgcuggugaaauca

SEQ ID NO: 2602154 - RNA, 19 nt, Escherichia coli CFT073
cgcuggugauucagggcag

SEQ ID NO: 2602155 - RNA, 21 nt, Escherichia coli CFT073
cgcuggugauucagggcagca

SEQ ID NO: 2602156 - RNA, 14 nt, Escherichia coli CFT073
cgcugguggcaggc

SEQ ID NO: 2602157 - RNA, 14 nt, Escherichia coli CFT073
cgcugguguacugc

SEQ ID NO: 2602158 - RNA, 20 nt, Escherichia coli CFT073
cgcuguaagccaagcgccgc

SEQ ID NO: 2602159 - RNA, 22 nt, Escherichia coli CFT073
cgcuguaagccacgauucagcg

SEQ ID NO: 2602160 - RNA, 19 nt, Escherichia coli CFT073
cgcuguaagccgccgccau

SEQ ID NO: 2602161 - RNA, 22 nt, Escherichia coli CFT073
cgcuguaauccaccgugccgcu

SEQ ID NO: 2602162 - RNA, 18 nt, Escherichia coli CFT073
cgcuguaauuaccagcgc

SEQ ID NO: 2602163 - RNA, 21 nt, Escherichia coli CFT073
cgcuguaauucuucaagugug

SEQ ID NO: 2602164 - RNA, 15 nt, Escherichia coli CFT073
cgcuguacucaccaa

SEQ ID NO: 2602165 - RNA, 18 nt, Escherichia coli CFT073
cgcuguacucaccaacgc

SEQ ID NO: 2602166 - RNA, 19 nt, Escherichia coli CFT073
cgcuguagccgccaucguu

SEQ ID NO: 2602167 - RNA, 15 nt, Escherichia coli CFT073
cgcugucauucauuc

SEQ ID NO: 2602168 - RNA, 12 nt, Escherichia coli CFT073
cgcugucggcaa

SEQ ID NO: 2602169 - RNA, 17 nt, Escherichia coli CFT073
cgcugucggugccauca

SEQ ID NO: 2602170 - RNA, 22 nt, Escherichia coli CFT073
cgcugucuacaaccgggcgcag

SEQ ID NO: 2602171 - RNA, 13 nt, Escherichia coli CFT073
cgcugugaaacac

SEQ ID NO: 2602172 - RNA, 16 nt, Escherichia coli CFT073
cgcugugacauccaga

SEQ ID NO: 2602173 - RNA, 16 nt, Escherichia coli CFT073
cgcugugagcaggcgu

SEQ ID NO: 2602174 - RNA, 19 nt, Escherichia coli CFT073
cgcugugcguaaucgccga

SEQ ID NO: 2602175 - RNA, 22 nt, Escherichia coli CFT073
cgcuguguguaggccagcgaua

SEQ ID NO: 2602176 - RNA, 15 nt, Escherichia coli CFT073
cgcuguuaugcacac

SEQ ID NO: 2602177 - RNA, 17 nt, Escherichia coli CFT073
cgcuguugccagcagca

SEQ ID NO: 2602178 - RNA, 17 nt, Escherichia coli CFT073
cgcuguuuccggcggca

SEQ ID NO: 2602179 - RNA, 18 nt, Escherichia coli CFT073
cgcuuaaauuuccaccgc

SEQ ID NO: 2602180 - RNA, 16 nt, Escherichia coli CFT073
cgcuuaaccggcuucg

SEQ ID NO: 2602181 - RNA, 20 nt, Escherichia coli CFT073
cgcuuaaccggcuucguuuu

SEQ ID NO: 2602182 - RNA, 18 nt, Escherichia coli CFT073
cgcuuaaggucagaaugc

SEQ ID NO: 2602183 - RNA, 14 nt, Escherichia coli CFT073
cgcuuaauccgcgc

SEQ ID NO: 2602184 - RNA, 21 nt, Escherichia coli CFT073
cgcuuaccauccacaccaaaa

SEQ ID NO: 2602185 - RNA, 16 nt, Escherichia coli CFT073
cgcuuaucaggcauug

SEQ ID NO: 2602186 - RNA, 14 nt, Escherichia coli CFT073
cgcuuaucaggccu

SEQ ID NO: 2602187 - RNA, 18 nt, Escherichia coli CFT073
cgcuuaucaggccuacaa

SEQ ID NO: 2602188 - RNA, 22 nt, Escherichia coli CFT073
cgcuuaucaggccuacgaucuu

SEQ ID NO: 2602189 - RNA, 14 nt, Escherichia coli CFT073
cgcuuaucaggcuu

SEQ ID NO: 2602190 - RNA, 18 nt, Escherichia coli CFT073
cgcuuaucgccagcgcga

SEQ ID NO: 2602191 - RNA, 21 nt, Escherichia coli CFT073
cgcuucaaaccuucauccauc

SEQ ID NO: 2602192 - RNA, 14 nt, Escherichia coli CFT073
cgcuucaacagcgg

SEQ ID NO: 2602193 - RNA, 16 nt, Escherichia coli CFT073
cgcuucaagcauugau

SEQ ID NO: 2602194 - RNA, 14 nt, Escherichia coli CFT073
cgcuucaaucagcg

SEQ ID NO: 2602195 - RNA, 18 nt, Escherichia coli CFT073
cgcuucacgcaccauaau

SEQ ID NO: 2602196 - RNA, 14 nt, Escherichia coli CFT073
cgcuucaggaauaa

SEQ ID NO: 2602197 - RNA, 20 nt, Escherichia coli CFT073
cgcuucaucgguuaacccgu

SEQ ID NO: 2602198 - RNA, 14 nt, Escherichia coli CFT073
cgcuuccaguucca

SEQ ID NO: 2602199 - RNA, 23 nt, Escherichia coli CFT073
cgcuuccaguuccauccaccagc

SEQ ID NO: 2602200 - RNA, 16 nt, Escherichia coli CFT073
cgcuucccaaagacga

SEQ ID NO: 2602201 - RNA, 16 nt, Escherichia coli CFT073
cgcuucgauucccagc

SEQ ID NO: 2602202 - RNA, 14 nt, Escherichia coli CFT073
cgcuucgccaguga

SEQ ID NO: 2602203 - RNA, 16 nt, Escherichia coli CFT073
cgcuucgcccgccagc

SEQ ID NO: 2602204 - RNA, 20 nt, Escherichia coli CFT073
cgcuucgcuaacauuuuagu

SEQ ID NO: 2602205 - RNA, 18 nt, Escherichia coli CFT073
cgcuucggaauaguucug

SEQ ID NO: 2602206 - RNA, 16 nt, Escherichia coli CFT073
cgcuucggcgccuuuu

SEQ ID NO: 2602207 - RNA, 16 nt, Escherichia coli CFT073
cggauuacccggcauc

SEQ ID NO: 2602208 - RNA, 18 nt, Escherichia coli CFT073
cggauuacggcucaaccc

SEQ ID NO: 2602209 - RNA, 23 nt, Escherichia coli CFT073
cggauuagaacuaaaggcuguca

SEQ ID NO: 2602210 - RNA, 17 nt, Escherichia coli CFT073
cggauucaguaaaucca

SEQ ID NO: 2602211 - RNA, 20 nt, Escherichia coli CFT073
cggauugaccaacaguugcc

SEQ ID NO: 2602212 - RNA, 22 nt, Escherichia coli CFT073
cggauugaccaacaguugccca

SEQ ID NO: 2602213 - RNA, 21 nt, Escherichia coli CFT073
cggauuguauugagauccugc

SEQ ID NO: 2602214 - RNA, 21 nt, Escherichia coli CFT073
cggauuucaaacgcgcccaaa

SEQ ID NO: 2602215 - RNA, 14 nt, Escherichia coli CFT073
cggauuucccgaua

SEQ ID NO: 2602216 - RNA, 13 nt, Escherichia coli CFT073
cggauuucggcgg

SEQ ID NO: 2602217 - RNA, 17 nt, Escherichia coli CFT073
cggauuuuucagcgcca

SEQ ID NO: 2602218 - RNA, 21 nt, Escherichia coli CFT073
cggauuuuucgcgcgggcaga

SEQ ID NO: 2602219 - RNA, 15 nt, Escherichia coli CFT073
cggcaaaacccugcg

SEQ ID NO: 2602220 - RNA, 20 nt, Escherichia coli CFT073
cggcaaaacggugcaggcuc

SEQ ID NO: 2602221 - RNA, 23 nt, Escherichia coli CFT073
cggcaaaacguuauuuugcuaau

SEQ ID NO: 2602222 - RNA, 19 nt, Escherichia coli CFT073
cggcaaaaucuuccagaau

SEQ ID NO: 2602223 - RNA, 12 nt, Escherichia coli CFT073
cggcaaacacgc

SEQ ID NO: 2602224 - RNA, 18 nt, Escherichia coli CFT073
cggcaaacaguugcugau

SEQ ID NO: 2602225 - RNA, 11 nt, Escherichia coli CFT073
cggcaaacugc

SEQ ID NO: 2602226 - RNA, 18 nt, Escherichia coli CFT073
cggcaaagcgcugaauau

SEQ ID NO: 2602227 - RNA, 19 nt, Escherichia coli CFT073
cggcaaaggcuucguucau

SEQ ID NO: 2602228 - RNA, 14 nt, Escherichia coli CFT073
cggcaaauaacaga

SEQ ID NO: 2602229 - RNA, 14 nt, Escherichia coli CFT073
cggcaacaaauuca

SEQ ID NO: 2602230 - RNA, 19 nt, Escherichia coli CFT073
cggcaacaaauucacgccu

SEQ ID NO: 2602231 - RNA, 21 nt, Escherichia coli CFT073
cggcaacaagauuagccauca

SEQ ID NO: 2602232 - RNA, 16 nt, Escherichia coli CFT073
cggcaacaauuuccgc

SEQ ID NO: 2602233 - RNA, 16 nt, Escherichia coli CFT073
cggcaacaucaaauca

SEQ ID NO: 2602234 - RNA, 15 nt, Escherichia coli CFT073
cggcaaccagcaccg

SEQ ID NO: 2602235 - RNA, 14 nt, Escherichia coli CFT073
cggcaaccagcagc

SEQ ID NO: 2602236 - RNA, 17 nt, Escherichia coli CFT073
cggcaaccagcagcauc

SEQ ID NO: 2602237 - RNA, 15 nt, Escherichia coli CFT073
cggcaaccgcaacga

SEQ ID NO: 2602238 - RNA, 13 nt, Escherichia coli CFT073
cggcaaccgcauc

SEQ ID NO: 2602239 - RNA, 17 nt, Escherichia coli CFT073
cggcaaccgcauccaga

SEQ ID NO: 2602240 - RNA, 22 nt, Escherichia coli CFT073
cggcaaccgcgccaagccugau

SEQ ID NO: 2602241 - RNA, 18 nt, Escherichia coli CFT073
cggcaaccggaucgucaa

SEQ ID NO: 2602242 - RNA, 20 nt, Escherichia coli CFT073
cggcaacgaaucacuggugu

SEQ ID NO: 2602243 - RNA, 17 nt, Escherichia coli CFT073
cggcaacgaccgcgagc

SEQ ID NO: 2602244 - RNA, 19 nt, Escherichia coli CFT073
cggcaagaaauaccgaaga

SEQ ID NO: 2602245 - RNA, 14 nt, Escherichia coli CFT073
cggcaagagaauug

SEQ ID NO: 2602246 - RNA, 18 nt, Escherichia coli CFT073
cggcaagauacugcauaa

SEQ ID NO: 2602247 - RNA, 15 nt, Escherichia coli CFT073
cggcaagaucagcau

SEQ ID NO: 2602248 - RNA, 20 nt, Escherichia coli CFT073
cggcaagcgucgcaucaggc

SEQ ID NO: 2602249 - RNA, 16 nt, Escherichia coli CFT073
cggcaaggccaauacc

SEQ ID NO: 2602250 - RNA, 22 nt, Escherichia coli CFT073
cggcaaggguugggauuuauuu

SEQ ID NO: 2602251 - RNA, 17 nt, Escherichia coli CFT073
cggcaauaaacagcacu

SEQ ID NO: 2602252 - RNA, 20 nt, Escherichia coli CFT073
cggcaauaaacagcacugaa

SEQ ID NO: 2602253 - RNA, 15 nt, Escherichia coli CFT073
cggcaauaacuccca

SEQ ID NO: 2602254 - RNA, 16 nt, Escherichia coli CFT073
cggcaauaacucccag

SEQ ID NO: 2602255 - RNA, 18 nt, Escherichia coli CFT073
cggcaaucaacgccugau

SEQ ID NO: 2602256 - RNA, 12 nt, Escherichia coli CFT073
cggcaaucacaa

SEQ ID NO: 2602257 - RNA, 23 nt, Escherichia coli CFT073
cggcaaucaccgccagcggcguu

SEQ ID NO: 2602258 - RNA, 15 nt, Escherichia coli CFT073
cggcaaucacgcccg

SEQ ID NO: 2602259 - RNA, 17 nt, Escherichia coli CFT073
cggcaauccccgccagc

SEQ ID NO: 2602260 - RNA, 17 nt, Escherichia coli CFT073
cggcaaucgcgccagaa

SEQ ID NO: 2602261 - RNA, 18 nt, Escherichia coli CFT073
cggcaaugaaagcgagcg

SEQ ID NO: 2602262 - RNA, 13 nt, Escherichia coli CFT073
cggcaaugagcgc

SEQ ID NO: 2602263 - RNA, 20 nt, Escherichia coli CFT073
cggcaaugcguuccagcaga

SEQ ID NO: 2602264 - RNA, 14 nt, Escherichia coli CFT073
cggcaauggcugcg

SEQ ID NO: 2602265 - RNA, 21 nt, Escherichia coli CFT073
cggcaauggucccuugcuggu

SEQ ID NO: 2602266 - RNA, 12 nt, Escherichia coli CFT073
cggcaauggucg

SEQ ID NO: 2602267 - RNA, 20 nt, Escherichia coli CFT073
cggcaauucucacugauuac

SEQ ID NO: 2602268 - RNA, 16 nt, Escherichia coli CFT073
cggcaauuugcgucaa

SEQ ID NO: 2602269 - RNA, 23 nt, Escherichia coli CFT073
cggcacaaaacuguaucccagcc

SEQ ID NO: 2602270 - RNA, 16 nt, Escherichia coli CFT073
cggcacaggucgcccc

SEQ ID NO: 2602271 - RNA, 15 nt, Escherichia coli CFT073
cggcacagucgcgac

SEQ ID NO: 2602272 - RNA, 14 nt, Escherichia coli CFT073
cggcaccaaucacc

SEQ ID NO: 2602273 - RNA, 16 nt, Escherichia coli CFT073
cggcaccaaucaccgc

SEQ ID NO: 2602274 - RNA, 19 nt, Escherichia coli CFT073
cggcaccaaucaccgccaa

SEQ ID NO: 2602275 - RNA, 21 nt, Escherichia coli CFT073
cggcaccaauguaggccugau

SEQ ID NO: 2602276 - RNA, 13 nt, Escherichia coli CFT073
cggcaccacauuc

SEQ ID NO: 2602277 - RNA, 15 nt, Escherichia coli CFT073
cggcaccacauucug

SEQ ID NO: 2602278 - RNA, 18 nt, Escherichia coli CFT073
cggcaccacauucugcau

SEQ ID NO: 2602279 - RNA, 14 nt, Escherichia coli CFT073
cggcaccacggcua

SEQ ID NO: 2602280 - RNA, 16 nt, Escherichia coli CFT073
cggcaccagcaccgug

SEQ ID NO: 2602281 - RNA, 19 nt, Escherichia coli CFT073
cggcaccagcaccguguuu

SEQ ID NO: 2602282 - RNA, 15 nt, Escherichia coli CFT073
cggcaccauccgucg

SEQ ID NO: 2602283 - RNA, 21 nt, Escherichia coli CFT073
cggcaccccugaagcggcaga

SEQ ID NO: 2602284 - RNA, 13 nt, Escherichia coli CFT073
cggcaccgaggau

SEQ ID NO: 2602285 - RNA, 14 nt, Escherichia coli CFT073
cggcaccgccgcca

SEQ ID NO: 2602286 - RNA, 21 nt, Escherichia coli CFT073
cggcaccuaucgcgucgccgg

SEQ ID NO: 2602287 - RNA, 20 nt, Escherichia coli CFT073
cggcaccuucgcggcaaaac

SEQ ID NO: 2602288 - RNA, 18 nt, Escherichia coli CFT073
cggcacggaaagcagcau

SEQ ID NO: 2602289 - RNA, 23 nt, Escherichia coli CFT073
cggcacggcguuuaguggguccc

SEQ ID NO: 2602290 - RNA, 22 nt, Escherichia coli CFT073
cggcacguaggcgaucccagcg

SEQ ID NO: 2602291 - RNA, 12 nt, Escherichia coli CFT073
cggcacguuacu

SEQ ID NO: 2602292 - RNA, 15 nt, Escherichia coli CFT073
cggcacuagucccuc

SEQ ID NO: 2602293 - RNA, 17 nt, Escherichia coli CFT073
cggcacucaaucgccaa

SEQ ID NO: 2602294 - RNA, 18 nt, Escherichia coli CFT073
cggcacugaaaguggaaa

SEQ ID NO: 2602295 - RNA, 18 nt, Escherichia coli CFT073
cggcacugaccaccacca

SEQ ID NO: 2602296 - RNA, 21 nt, Escherichia coli CFT073
cggcacuguuucgccagguuu

SEQ ID NO: 2602297 - RNA, 13 nt, Escherichia coli CFT073
cggcacuucaacu

SEQ ID NO: 2602298 - RNA, 17 nt, Escherichia coli CFT073
cggcacuuuuucaucag

SEQ ID NO: 2602299 - RNA, 13 nt, Escherichia coli CFT073
cggcagaacggug

SEQ ID NO: 2602300 - RNA, 19 nt, Escherichia coli CFT073
cggcagaaugguuucgcuu

SEQ ID NO: 2602301 - RNA, 11 nt, Escherichia coli CFT073
cggcagaccau

SEQ ID NO: 2602302 - RNA, 17 nt, Escherichia coli CFT073
cggcagagaaaccacau

SEQ ID NO: 2602303 - RNA, 20 nt, Escherichia coli CFT073
cggcagagaaaccacaucaa

SEQ ID NO: 2602304 - RNA, 20 nt, Escherichia coli CFT073
cggcagagaggacucugccg

SEQ ID NO: 2602305 - RNA, 21 nt, Escherichia coli CFT073
cggcagagaggacucugccgg

SEQ ID NO: 2602306 - RNA, 15 nt, Escherichia coli CFT073
cggcagauccaccag

SEQ ID NO: 2602307 - RNA, 16 nt, Escherichia coli CFT073
cggcagauccaccaga

SEQ ID NO: 2602308 - RNA, 14 nt, Escherichia coli CFT073
cggcagcaacagca

SEQ ID NO: 2602309 - RNA, 15 nt, Escherichia coli CFT073
cggcagcaaccgcuu

SEQ ID NO: 2602310 - RNA, 19 nt, Escherichia coli CFT073
cggcagcaaucgaccaggc

SEQ ID NO: 2602311 - RNA, 20 nt, Escherichia coli CFT073
cggcagcaaucgaccaggcc

SEQ ID NO: 2602312 - RNA, 21 nt, Escherichia coli CFT073
cggcagcaaucgaccaggcca

SEQ ID NO: 2602313 - RNA, 22 nt, Escherichia coli CFT073
cggcagccaggauuguaaguga

SEQ ID NO: 2602314 - RNA, 19 nt, Escherichia coli CFT073
cggcagccugcgucgccau

SEQ ID NO: 2602315 - RNA, 17 nt, Escherichia coli CFT073
cggcgauaguacauuuc

SEQ ID NO: 2602316 - RNA, 17 nt, Escherichia coli CFT073
cggcgaucgccugcugg

SEQ ID NO: 2602317 - RNA, 21 nt, Escherichia coli CFT073
cggcgauuaaucucaccaaua

SEQ ID NO: 2602318 - RNA, 20 nt, Escherichia coli CFT073
cggcgcaaaauugccggaug

SEQ ID NO: 2602319 - RNA, 14 nt, Escherichia coli CFT073
cggcgcacaaccgc

SEQ ID NO: 2602320 - RNA, 19 nt, Escherichia coli CFT073
cggcgcauagccuccggcc

SEQ ID NO: 2602321 - RNA, 16 nt, Escherichia coli CFT073
cggcgcaugcaggcau

SEQ ID NO: 2602322 - RNA, 18 nt, Escherichia coli CFT073
cggcgcgaguuugccgcu

SEQ ID NO: 2602323 - RNA, 21 nt, Escherichia coli CFT073
cggcgcgauaguaaucaccgg

SEQ ID NO: 2602324 - RNA, 23 nt, Escherichia coli CFT073
cggcgcgauauccaguucaugac

SEQ ID NO: 2602325 - RNA, 17 nt, Escherichia coli CFT073
cggcgcuaauucaacgc

SEQ ID NO: 2602326 - RNA, 20 nt, Escherichia coli CFT073
cggcgcuacggcguuucacu

SEQ ID NO: 2602327 - RNA, 17 nt, Escherichia coli CFT073
cggcgcucuugcggcau

SEQ ID NO: 2602328 - RNA, 14 nt, Escherichia coli CFT073
cggcgcugaccacu

SEQ ID NO: 2602329 - RNA, 23 nt, Escherichia coli CFT073
cggcgcuuuugcaucguucgcgu

SEQ ID NO: 2602330 - RNA, 19 nt, Escherichia coli CFT073
cggcgcuuuuuagcgccgu

SEQ ID NO: 2602331 - RNA, 22 nt, Escherichia coli CFT073
cggcggaauuaaccgcccaccg

SEQ ID NO: 2602332 - RNA, 17 nt, Escherichia coli CFT073
cggcggcacagccagcg

SEQ ID NO: 2602333 - RNA, 18 nt, Escherichia coli CFT073
cggcggcacagccagcgc

SEQ ID NO: 2602334 - RNA, 16 nt, Escherichia coli CFT073
cggcggcacucgcuga

SEQ ID NO: 2602335 - RNA, 20 nt, Escherichia coli CFT073
cggcggcgaccuuccaucuu

SEQ ID NO: 2602336 - RNA, 20 nt, Escherichia coli CFT073
cggcggcgaucgccugcugg

SEQ ID NO: 2602337 - RNA, 10 nt, Escherichia coli CFT073
cggcggcgga

SEQ ID NO: 2602338 - RNA, 20 nt, Escherichia coli CFT073
cggcggcggugugacguuau

SEQ ID NO: 2602339 - RNA, 20 nt, Escherichia coli CFT073
cggcggcuuauucccuucuu

SEQ ID NO: 2602340 - RNA, 20 nt, Escherichia coli CFT073
cggcggguuaaccagcacca

SEQ ID NO: 2602341 - RNA, 23 nt, Escherichia coli CFT073
cggcggguuaaccagcaccagcu

SEQ ID NO: 2602342 - RNA, 14 nt, Escherichia coli CFT073
cggcgguaaaaggg

SEQ ID NO: 2602343 - RNA, 18 nt, Escherichia coli CFT073
cggcggugacuagcagca

SEQ ID NO: 2602344 - RNA, 23 nt, Escherichia coli CFT073
cggcggugacuagcagcauuuca

SEQ ID NO: 2602345 - RNA, 19 nt, Escherichia coli CFT073
cggcggugagaagaccgcc

SEQ ID NO: 2602346 - RNA, 21 nt, Escherichia coli CFT073
cggcggugagaagaccgccgc

SEQ ID NO: 2602347 - RNA, 14 nt, Escherichia coli CFT073
cggcggugucgcca

SEQ ID NO: 2602348 - RNA, 15 nt, Escherichia coli CFT073
cggcguaaacgccuu

SEQ ID NO: 2602349 - RNA, 23 nt, Escherichia coli CFT073
cggcguaccaauacguuucuucc

SEQ ID NO: 2602350 - RNA, 16 nt, Escherichia coli CFT073
cggcguacccagcgug

SEQ ID NO: 2602351 - RNA, 18 nt, Escherichia coli CFT073
cggcguacuaucuacugc

SEQ ID NO: 2602352 - RNA, 15 nt, Escherichia coli CFT073
cggcguacuggcaau

SEQ ID NO: 2602353 - RNA, 23 nt, Escherichia coli CFT073
cggcgucagauucggauccagca

SEQ ID NO: 2602354 - RNA, 14 nt, Escherichia coli CFT073
cggcgucagcgcca

SEQ ID NO: 2602355 - RNA, 17 nt, Escherichia coli CFT073
cggcgucagcggcuguu

SEQ ID NO: 2602356 - RNA, 21 nt, Escherichia coli CFT073
cggcgucauaauccggcaaca

SEQ ID NO: 2602357 - RNA, 15 nt, Escherichia coli CFT073
cggcguccccacagu

SEQ ID NO: 2602358 - RNA, 20 nt, Escherichia coli CFT073
cggcgucgguuucgcgcagg

SEQ ID NO: 2602359 - RNA, 20 nt, Escherichia coli CFT073
cggcgucuuguugaacagac

SEQ ID NO: 2602360 - RNA, 16 nt, Escherichia coli CFT073
cggcgugacgccagaa

SEQ ID NO: 2602361 - RNA, 17 nt, Escherichia coli CFT073
cggcgugcaucucuuca

SEQ ID NO: 2602362 - RNA, 21 nt, Escherichia coli CFT073
cggcgugccggaugcaaacga

SEQ ID NO: 2602363 - RNA, 13 nt, Escherichia coli CFT073
cggcgugccgucg

SEQ ID NO: 2602364 - RNA, 18 nt, Escherichia coli CFT073
cggcgugcgcgcccauac

SEQ ID NO: 2602365 - RNA, 16 nt, Escherichia coli CFT073
cggcgugguaagaaga

SEQ ID NO: 2602366 - RNA, 15 nt, Escherichia coli CFT073
cggcguggugcagcc

SEQ ID NO: 2602367 - RNA, 19 nt, Escherichia coli CFT073
cggcguggugcagccgcca

SEQ ID NO: 2602368 - RNA, 16 nt, Escherichia coli CFT073
cggcgugguuccggcu

SEQ ID NO: 2602369 - RNA, 15 nt, Escherichia coli CFT073
cggcguguagcccau

SEQ ID NO: 2602370 - RNA, 16 nt, Escherichia coli CFT073
cggcguuaccggcaau

SEQ ID NO: 2602371 - RNA, 17 nt, Escherichia coli CFT073
cggcguucuuuacacag

SEQ ID NO: 2602372 - RNA, 13 nt, Escherichia coli CFT073
cggcguugcugcc

SEQ ID NO: 2602373 - RNA, 21 nt, Escherichia coli CFT073
cggcguuuagugggucccaga

SEQ ID NO: 2602374 - RNA, 15 nt, Escherichia coli CFT073
cggcguuucacauuc

SEQ ID NO: 2602375 - RNA, 13 nt, Escherichia coli CFT073
cggcguuuugcuu

SEQ ID NO: 2602376 - RNA, 18 nt, Escherichia coli CFT073
cggcguuuugcuuuuuau

SEQ ID NO: 2602377 - RNA, 17 nt, Escherichia coli CFT073
cggcguuuuggcuguga

SEQ ID NO: 2602378 - RNA, 23 nt, Escherichia coli CFT073
cggcguuuuuauugccguuaacu

SEQ ID NO: 2602379 - RNA, 18 nt, Escherichia coli CFT073
cggcguuuuuucaucacu

SEQ ID NO: 2602380 - RNA, 20 nt, Escherichia coli CFT073
cggcguuuuuucaucacugc

SEQ ID NO: 2602381 - RNA, 17 nt, Escherichia coli CFT073
cggcuaaaucguucaau

SEQ ID NO: 2602382 - RNA, 15 nt, Escherichia coli CFT073
cggcuaagcaauuac

SEQ ID NO: 2602383 - RNA, 16 nt, Escherichia coli CFT073
cggcuaagcaauuaca

SEQ ID NO: 2602384 - RNA, 16 nt, Escherichia coli CFT073
cggcuacgccaccagc

SEQ ID NO: 2602385 - RNA, 15 nt, Escherichia coli CFT073
cggcuauaccgccga

SEQ ID NO: 2602386 - RNA, 19 nt, Escherichia coli CFT073
cggcuauauacagcgccuc

SEQ ID NO: 2602387 - RNA, 23 nt, Escherichia coli CFT073
cggcuauauugcaggagcgauua

SEQ ID NO: 2602388 - RNA, 20 nt, Escherichia coli CFT073
cggcuauucuggccgcuuca

SEQ ID NO: 2602389 - RNA, 21 nt, Escherichia coli CFT073
cggcucacccccaucagcauc

SEQ ID NO: 2602390 - RNA, 20 nt, Escherichia coli CFT073
cggcucacuuuguaggccug

SEQ ID NO: 2602391 - RNA, 13 nt, Escherichia coli CFT073
cggcucagcaaua

SEQ ID NO: 2602392 - RNA, 20 nt, Escherichia coli CFT073
cggcucauaaaaacuccagu

SEQ ID NO: 2602393 - RNA, 18 nt, Escherichia coli CFT073
cggcucauguagccgcuu

SEQ ID NO: 2602394 - RNA, 15 nt, Escherichia coli CFT073
cggcucauuuuccgg

SEQ ID NO: 2602395 - RNA, 17 nt, Escherichia coli CFT073
cggcuccagacgcccgc

SEQ ID NO: 2602396 - RNA, 20 nt, Escherichia coli CFT073
cggcuccagacgcccgcgcc

SEQ ID NO: 2602397 - RNA, 21 nt, Escherichia coli CFT073
cggcuccagacgcccgcgccc

SEQ ID NO: 2602398 - RNA, 11 nt, Escherichia coli CFT073
cggcuccagau

SEQ ID NO: 2602399 - RNA, 21 nt, Escherichia coli CFT073
cggcuccagauagagccgguu

SEQ ID NO: 2602400 - RNA, 22 nt, Escherichia coli CFT073
cggcuccagcaaugucauaaac

SEQ ID NO: 2602401 - RNA, 21 nt, Escherichia coli CFT073
cggcuccaguuaacgccgcgc

SEQ ID NO: 2602402 - RNA, 15 nt, Escherichia coli CFT073
cggcuccccgcccug

SEQ ID NO: 2602403 - RNA, 18 nt, Escherichia coli CFT073
cggcucccgcagccacuc

SEQ ID NO: 2602404 - RNA, 18 nt, Escherichia coli CFT073
cggcucguccgcgcgcac

SEQ ID NO: 2602405 - RNA, 16 nt, Escherichia coli CFT073
cggcucuggcggcgcu

SEQ ID NO: 2602406 - RNA, 15 nt, Escherichia coli CFT073
cggcugaauacgcag

SEQ ID NO: 2602407 - RNA, 18 nt, Escherichia coli CFT073
cggcugaauacgcagcgu

SEQ ID NO: 2602408 - RNA, 21 nt, Escherichia coli CFT073
cggcugaauacgcagcgucau

SEQ ID NO: 2602409 - RNA, 17 nt, Escherichia coli CFT073
cggcugaauauccugac

SEQ ID NO: 2602410 - RNA, 18 nt, Escherichia coli CFT073
cggcugacaugcaguuga

SEQ ID NO: 2602411 - RNA, 13 nt, Escherichia coli CFT073
cggcugacugcuu

SEQ ID NO: 2602412 - RNA, 18 nt, Escherichia coli CFT073
cggcugauaacaauauca

SEQ ID NO: 2602413 - RNA, 13 nt, Escherichia coli CFT073
cggcugcaaaccc

SEQ ID NO: 2602414 - RNA, 12 nt, Escherichia coli CFT073
cggcugccugga

SEQ ID NO: 2602415 - RNA, 20 nt, Escherichia coli CFT073
cggcugcgcuucuuccagca

SEQ ID NO: 2602416 - RNA, 22 nt, Escherichia coli CFT073
cggcugcgcuucuuccagcauc

SEQ ID NO: 2602417 - RNA, 22 nt, Escherichia coli CFT073
cggcugcguaauucgccaccgg

SEQ ID NO: 2602418 - RNA, 13 nt, Escherichia coli CFT073
cggcugcguaccu

SEQ ID NO: 2602419 - RNA, 16 nt, Escherichia coli CFT073
cggcugcuaauauuuu

SEQ ID NO: 2602420 - RNA, 14 nt, Escherichia coli CFT073
cggcugcugccagc

SEQ ID NO: 2602421 - RNA, 14 nt, Escherichia coli CFT073
cggcuggcgcaaua

SEQ ID NO: 2602422 - RNA, 14 nt, Escherichia coli CFT073
cggcuggcggcguu

SEQ ID NO: 2602423 - RNA, 19 nt, Escherichia coli CFT073
cggggccguugacgauguc

SEQ ID NO: 2602424 - RNA, 16 nt, Escherichia coli CFT073
cggggcgaucgcgcca

SEQ ID NO: 2602425 - RNA, 17 nt, Escherichia coli CFT073
cggggcuauaccagaua

SEQ ID NO: 2602426 - RNA, 14 nt, Escherichia coli CFT073
cggguaaaaccauu

SEQ ID NO: 2602427 - RNA, 14 nt, Escherichia coli CFT073
cggguaauaaacca

SEQ ID NO: 2602428 - RNA, 17 nt, Escherichia coli CFT073
cggguacgguaaaggac

SEQ ID NO: 2602429 - RNA, 22 nt, Escherichia coli CFT073
cggguaggcugcuugagccagu

SEQ ID NO: 2602430 - RNA, 16 nt, Escherichia coli CFT073
cggguauauaaagccc

SEQ ID NO: 2602431 - RNA, 15 nt, Escherichia coli CFT073
cgggucaaucggcgc

SEQ ID NO: 2602432 - RNA, 13 nt, Escherichia coli CFT073
cgggucacugcgg

SEQ ID NO: 2602433 - RNA, 23 nt, Escherichia coli CFT073
cgggucaucaaaaucaucauugc

SEQ ID NO: 2602434 - RNA, 13 nt, Escherichia coli CFT073
cgggucgcuucgu

SEQ ID NO: 2602435 - RNA, 13 nt, Escherichia coli CFT073
cgggucguaauaa

SEQ ID NO: 2602436 - RNA, 15 nt, Escherichia coli CFT073
cgggucguaauaauu

SEQ ID NO: 2602437 - RNA, 14 nt, Escherichia coli CFT073
cgggugccucccgg

SEQ ID NO: 2602438 - RNA, 19 nt, Escherichia coli CFT073
cgggugcgacaggagccgc

SEQ ID NO: 2602439 - RNA, 19 nt, Escherichia coli CFT073
cgggugcgaugcauccggc

SEQ ID NO: 2602440 - RNA, 22 nt, Escherichia coli CFT073
cgggugcggaucauaugcacaa

SEQ ID NO: 2602441 - RNA, 15 nt, Escherichia coli CFT073
cggguggccagcaac

SEQ ID NO: 2602442 - RNA, 15 nt, Escherichia coli CFT073
cggguggucuucaua

SEQ ID NO: 2602443 - RNA, 19 nt, Escherichia coli CFT073
cggguggugcgcaccaggc

SEQ ID NO: 2602444 - RNA, 19 nt, Escherichia coli CFT073
cgggugguggcuggcaaca

SEQ ID NO: 2602445 - RNA, 19 nt, Escherichia coli CFT073
cgggugucccguaacggaa

SEQ ID NO: 2602446 - RNA, 17 nt, Escherichia coli CFT073
cggguuaaccagcacca

SEQ ID NO: 2602447 - RNA, 17 nt, Escherichia coli CFT073
cggguuacggaaacucu

SEQ ID NO: 2602448 - RNA, 15 nt, Escherichia coli CFT073
cggguucagugaauc

SEQ ID NO: 2602449 - RNA, 18 nt, Escherichia coli CFT073
cggguucgccaucccugc

SEQ ID NO: 2602450 - RNA, 13 nt, Escherichia coli CFT073
cggguucggauaa

SEQ ID NO: 2602451 - RNA, 14 nt, Escherichia coli CFT073
cggguugcggauca

SEQ ID NO: 2602452 - RNA, 16 nt, Escherichia coli CFT073
cggguugcucucgcca

SEQ ID NO: 2602453 - RNA, 19 nt, Escherichia coli CFT073
cggguuuaagcccggcauu

SEQ ID NO: 2602454 - RNA, 22 nt, Escherichia coli CFT073
cggguuuucgcugccacaccau

SEQ ID NO: 2602455 - RNA, 19 nt, Escherichia coli CFT073
cggguuuucuccaaccagc

SEQ ID NO: 2602456 - RNA, 13 nt, Escherichia coli CFT073
cggguuuucucgc

SEQ ID NO: 2602457 - RNA, 23 nt, Escherichia coli CFT073
cgguaaaaccgugcuucagccaa

SEQ ID NO: 2602458 - RNA, 18 nt, Escherichia coli CFT073
cgguaaaagcccaucauu

SEQ ID NO: 2602459 - RNA, 19 nt, Escherichia coli CFT073
cgguaaaagcccaucauug

SEQ ID NO: 2602460 - RNA, 21 nt, Escherichia coli CFT073
cgguaaaagcccaucauugac

SEQ ID NO: 2602461 - RNA, 13 nt, Escherichia coli CFT073
cgguaaaaucauc

SEQ ID NO: 2602462 - RNA, 14 nt, Escherichia coli CFT073
cgguaaaaucaucc

SEQ ID NO: 2602463 - RNA, 15 nt, Escherichia coli CFT073
cgguaaaauggucag

SEQ ID NO: 2602464 - RNA, 22 nt, Escherichia coli CFT073
cgguaaacaaaaacagcgccga

SEQ ID NO: 2602465 - RNA, 13 nt, Escherichia coli CFT073
cgguaaacgucgc

SEQ ID NO: 2602466 - RNA, 14 nt, Escherichia coli CFT073
cgguaaaucaccau

SEQ ID NO: 2602467 - RNA, 14 nt, Escherichia coli CFT073
cgguaaaucggcga

SEQ ID NO: 2602468 - RNA, 13 nt, Escherichia coli CFT073
cgguaacccuuca

SEQ ID NO: 2602469 - RNA, 17 nt, Escherichia coli CFT073
cgguaacgccaucccug

SEQ ID NO: 2602470 - RNA, 15 nt, Escherichia coli CFT073
cgguaacggaccgca

SEQ ID NO: 2602471 - RNA, 15 nt, Escherichia coli CFT073
cgguaacugcuugaa

SEQ ID NO: 2602472 - RNA, 15 nt, Escherichia coli CFT073
cgguaacuuaucugu

SEQ ID NO: 2602473 - RNA, 17 nt, Escherichia coli CFT073
cgguaagccggagcugg

SEQ ID NO: 2602474 - RNA, 20 nt, Escherichia coli CFT073
cgguaaguuuucgccggauc

SEQ ID NO: 2602475 - RNA, 21 nt, Escherichia coli CFT073
cgguaaucuguugagcgccgu

SEQ ID NO: 2602476 - RNA, 13 nt, Escherichia coli CFT073
cgguaaugcgcgc

SEQ ID NO: 2602477 - RNA, 15 nt, Escherichia coli CFT073
cgguaauguuuugca

SEQ ID NO: 2602478 - RNA, 22 nt, Escherichia coli CFT073
cgguaauugcacguccaguggc

SEQ ID NO: 2602479 - RNA, 23 nt, Escherichia coli CFT073
cgguacaaacaucauccagugcc

SEQ ID NO: 2602480 - RNA, 21 nt, Escherichia coli CFT073
cgguacaaucagacgcaaugu

SEQ ID NO: 2602481 - RNA, 14 nt, Escherichia coli CFT073
cgguacacgcagac

SEQ ID NO: 2602482 - RNA, 16 nt, Escherichia coli CFT073
cgguaccaugacgcac

SEQ ID NO: 2602483 - RNA, 13 nt, Escherichia coli CFT073
cgguaccugccgg

SEQ ID NO: 2602484 - RNA, 20 nt, Escherichia coli CFT073
cgguaccuuugaacugcuga

SEQ ID NO: 2602485 - RNA, 18 nt, Escherichia coli CFT073
cgguacggaagguccagu

SEQ ID NO: 2602486 - RNA, 20 nt, Escherichia coli CFT073
cgguacggauagccgcccca

SEQ ID NO: 2602487 - RNA, 15 nt, Escherichia coli CFT073
cgguacucgcgcagu

SEQ ID NO: 2602488 - RNA, 22 nt, Escherichia coli CFT073
cgguagaaaaauucaaccucug

SEQ ID NO: 2602489 - RNA, 15 nt, Escherichia coli CFT073
cgguagagaaaacca

SEQ ID NO: 2602490 - RNA, 15 nt, Escherichia coli CFT073
cgguagcccagccga

SEQ ID NO: 2602491 - RNA, 20 nt, Escherichia coli CFT073
cgguagccccgcgaacgggg

SEQ ID NO: 2602492 - RNA, 13 nt, Escherichia coli CFT073
cgguagcugguga

SEQ ID NO: 2602493 - RNA, 13 nt, Escherichia coli CFT073
cgguagucggcgc

SEQ ID NO: 2602494 - RNA, 17 nt, Escherichia coli CFT073
cgguaguggcaaccagc

SEQ ID NO: 2602495 - RNA, 14 nt, Escherichia coli CFT073
cgguaguuccacca

SEQ ID NO: 2602496 - RNA, 14 nt, Escherichia coli CFT073
cgguauaacccagu

SEQ ID NO: 2602497 - RNA, 16 nt, Escherichia coli CFT073
cgguauaacccaguac

SEQ ID NO: 2602498 - RNA, 16 nt, Escherichia coli CFT073
cgguauaacuugccag

SEQ ID NO: 2602499 - RNA, 15 nt, Escherichia coli CFT073
cgguauaaggcauca

SEQ ID NO: 2602500 - RNA, 18 nt, Escherichia coli CFT073
cgguauaaggcaucagcc

SEQ ID NO: 2602501 - RNA, 21 nt, Escherichia coli CFT073
cgguauaguccgccagaauac

SEQ ID NO: 2602502 - RNA, 13 nt, Escherichia coli CFT073
cgguaucaaacac

SEQ ID NO: 2602503 - RNA, 16 nt, Escherichia coli CFT073
cgguaucaaagcgcca

SEQ ID NO: 2602504 - RNA, 16 nt, Escherichia coli CFT073
cgguaucaccacccag

SEQ ID NO: 2602505 - RNA, 17 nt, Escherichia coli CFT073
cgguaucaccacccagc

SEQ ID NO: 2602506 - RNA, 20 nt, Escherichia coli CFT073
cgguaucaccacccagcggu

SEQ ID NO: 2602507 - RNA, 14 nt, Escherichia coli CFT073
cgguaucuuuccag

SEQ ID NO: 2602508 - RNA, 16 nt, Escherichia coli CFT073
cgguaucuuuccagcc

SEQ ID NO: 2602509 - RNA, 19 nt, Escherichia coli CFT073
cgguaucuuuccagccugc

SEQ ID NO: 2602510 - RNA, 20 nt, Escherichia coli CFT073
cgguaugacgaggaacauuc

SEQ ID NO: 2602511 - RNA, 18 nt, Escherichia coli CFT073
cgguauuaauuugccagc

SEQ ID NO: 2602512 - RNA, 19 nt, Escherichia coli CFT073
cgguauuaguuaaaugauu

SEQ ID NO: 2602513 - RNA, 14 nt, Escherichia coli CFT073
cgguauucuccugc

SEQ ID NO: 2602514 - RNA, 16 nt, Escherichia coli CFT073
cgguauugagcuucuc

SEQ ID NO: 2602515 - RNA, 20 nt, Escherichia coli CFT073
cgguauugagcuucucuggc

SEQ ID NO: 2602516 - RNA, 15 nt, Escherichia coli CFT073
cggucaaaagcugca

SEQ ID NO: 2602517 - RNA, 17 nt, Escherichia coli CFT073
cggucaacccaaccugc

SEQ ID NO: 2602518 - RNA, 20 nt, Escherichia coli CFT073
cggucaacccaaccugccag

SEQ ID NO: 2602519 - RNA, 18 nt, Escherichia coli CFT073
cggucaaguaaucaauca

SEQ ID NO: 2602520 - RNA, 17 nt, Escherichia coli CFT073
cggucacaucgcugaca

SEQ ID NO: 2602521 - RNA, 14 nt, Escherichia coli CFT073
cggucacggcugua

SEQ ID NO: 2602522 - RNA, 20 nt, Escherichia coli CFT073
cggucacggcuguagccagc

SEQ ID NO: 2602523 - RNA, 17 nt, Escherichia coli CFT073
cggucacugacaccagc

SEQ ID NO: 2602524 - RNA, 12 nt, Escherichia coli CFT073
cggucagcagca

SEQ ID NO: 2602525 - RNA, 16 nt, Escherichia coli CFT073
cggucagcagcaccac

SEQ ID NO: 2602526 - RNA, 23 nt, Escherichia coli CFT073
cggucagcagcaccaccgcccgu

SEQ ID NO: 2602527 - RNA, 14 nt, Escherichia coli CFT073
cggucagcgcaaug

SEQ ID NO: 2602528 - RNA, 20 nt, Escherichia coli CFT073
cggucagcugcuguucgguu

SEQ ID NO: 2602529 - RNA, 21 nt, Escherichia coli CFT073
cggucaguuuucgcccccagc

SEQ ID NO: 2602530 - RNA, 23 nt, Escherichia coli CFT073
cggucauaaucauuaacggccac

SEQ ID NO: 2602531 - RNA, 18 nt, Escherichia coli CFT073
cggucauaugcaaaccau

SEQ ID NO: 2602532 - RNA, 20 nt, Escherichia coli CFT073
cgguugugauuuuagccaua

SEQ ID NO: 2602533 - RNA, 22 nt, Escherichia coli CFT073
cgguuguucaaccaccggcacc

SEQ ID NO: 2602534 - RNA, 23 nt, Escherichia coli CFT073
cgguuguucaaccaccggcacca

SEQ ID NO: 2602535 - RNA, 22 nt, Escherichia coli CFT073
cgguuguuuugguuauuaacug

SEQ ID NO: 2602536 - RNA, 17 nt, Escherichia coli CFT073
cgguuuaaucgauuuag

SEQ ID NO: 2602537 - RNA, 22 nt, Escherichia coli CFT073
cgguuuaccgaugccgcggcgc

SEQ ID NO: 2602538 - RNA, 14 nt, Escherichia coli CFT073
cgguuuagaaaaga

SEQ ID NO: 2602539 - RNA, 23 nt, Escherichia coli CFT073
cgguuuagaaaagaguauuacau

SEQ ID NO: 2602540 - RNA, 16 nt, Escherichia coli CFT073
cgguuucaaccagcag

SEQ ID NO: 2602541 - RNA, 18 nt, Escherichia coli CFT073
cgguuucaaccagcaggg

SEQ ID NO: 2602542 - RNA, 15 nt, Escherichia coli CFT073
cgguuucaauccagg

SEQ ID NO: 2602543 - RNA, 16 nt, Escherichia coli CFT073
cgguuucagcucacgg

SEQ ID NO: 2602544 - RNA, 15 nt, Escherichia coli CFT073
cgguuuccacuucca

SEQ ID NO: 2602545 - RNA, 19 nt, Escherichia coli CFT073
cgguuuccaggcagccaua

SEQ ID NO: 2602546 - RNA, 20 nt, Escherichia coli CFT073
cgguuuccaggcagccauaa

SEQ ID NO: 2602547 - RNA, 21 nt, Escherichia coli CFT073
cgguuuccaggcagccauaac

SEQ ID NO: 2602548 - RNA, 15 nt, Escherichia coli CFT073
cgguuucccggcaau

SEQ ID NO: 2602549 - RNA, 21 nt, Escherichia coli CFT073
cgguuucuacaagcagagaga

SEQ ID NO: 2602550 - RNA, 19 nt, Escherichia coli CFT073
cgguuucuccccuucagca

SEQ ID NO: 2602551 - RNA, 23 nt, Escherichia coli CFT073
cgguuucucccgccugcugcguc

SEQ ID NO: 2602552 - RNA, 14 nt, Escherichia coli CFT073
cgguuucucuucug

SEQ ID NO: 2602553 - RNA, 18 nt, Escherichia coli CFT073
cgguuucugauucccugc

SEQ ID NO: 2602554 - RNA, 19 nt, Escherichia coli CFT073
cgguuugccauaaccugcc

SEQ ID NO: 2602555 - RNA, 16 nt, Escherichia coli CFT073
cgguuugccauuuucu

SEQ ID NO: 2602556 - RNA, 14 nt, Escherichia coli CFT073
cgguuugucaucau

SEQ ID NO: 2602557 - RNA, 14 nt, Escherichia coli CFT073
cgguuuguuaucaa

SEQ ID NO: 2602558 - RNA, 17 nt, Escherichia coli CFT073
cgguuuuaacaccacuc

SEQ ID NO: 2602559 - RNA, 15 nt, Escherichia coli CFT073
cgguuuucugccugg

SEQ ID NO: 2602560 - RNA, 17 nt, Escherichia coli CFT073
cgguuuugcgccaucaa

SEQ ID NO: 2602561 - RNA, 14 nt, Escherichia coli CFT073
cgguuuuucagcuu

SEQ ID NO: 2602562 - RNA, 14 nt, Escherichia coli CFT073
cgguuuuuccagcu

SEQ ID NO: 2602563 - RNA, 17 nt, Escherichia coli CFT073
cgguuuuuugaacagac

SEQ ID NO: 2602564 - RNA, 19 nt, Escherichia coli CFT073
cgguuuuuuuaauuacugc

SEQ ID NO: 2602565 - RNA, 16 nt, Escherichia coli CFT073
cguaaaaacccgcuuc

SEQ ID NO: 2602566 - RNA, 17 nt, Escherichia coli CFT073
cguaaaaacccgcuucg

SEQ ID NO: 2602567 - RNA, 15 nt, Escherichia coli CFT073
cguaaaaaucggcaa

SEQ ID NO: 2602568 - RNA, 17 nt, Escherichia coli CFT073
cguaaaaaucggcaaca

SEQ ID NO: 2602569 - RNA, 19 nt, Escherichia coli CFT073
cguaaaaaucggcaacauc

SEQ ID NO: 2602570 - RNA, 18 nt, Escherichia coli CFT073
cguaaaauauugcugcua

SEQ ID NO: 2602571 - RNA, 15 nt, Escherichia coli CFT073
cguaaaaugcggaaa

SEQ ID NO: 2602572 - RNA, 23 nt, Escherichia coli CFT073
cguaaacagggggaggcaucuuc

SEQ ID NO: 2602573 - RNA, 18 nt, Escherichia coli CFT073
cguaaaccaauggucgug

SEQ ID NO: 2602574 - RNA, 17 nt, Escherichia coli CFT073
cguaaaccacugacaca

SEQ ID NO: 2602575 - RNA, 23 nt, Escherichia coli CFT073
cguaaaccacugacacaggcagc

SEQ ID NO: 2602576 - RNA, 16 nt, Escherichia coli CFT073
cguaaacgccuuaucc

SEQ ID NO: 2602577 - RNA, 19 nt, Escherichia coli CFT073
cguaaagccugcuggcagc

SEQ ID NO: 2602578 - RNA, 17 nt, Escherichia coli CFT073
cguaaagucaaaauuca

SEQ ID NO: 2602579 - RNA, 18 nt, Escherichia coli CFT073
cguaaaucgucaguagcg

SEQ ID NO: 2602580 - RNA, 15 nt, Escherichia coli CFT073
cguaaaucuucaagc

SEQ ID NO: 2602581 - RNA, 15 nt, Escherichia coli CFT073
cguaaaucuuuacca

SEQ ID NO: 2602582 - RNA, 12 nt, Escherichia coli CFT073
cguaaauucucc

SEQ ID NO: 2602583 - RNA, 22 nt, Escherichia coli CFT073
cguaaauuuauuccgagcagcu

SEQ ID NO: 2602584 - RNA, 16 nt, Escherichia coli CFT073
cguaacacucgugcgu

SEQ ID NO: 2602585 - RNA, 19 nt, Escherichia coli CFT073
cguaacaggugauaaucca

SEQ ID NO: 2602586 - RNA, 14 nt, Escherichia coli CFT073
cguaacauauuccc

SEQ ID NO: 2602587 - RNA, 20 nt, Escherichia coli CFT073
cguaaccaaugccacccagc

SEQ ID NO: 2602588 - RNA, 17 nt, Escherichia coli CFT073
cguaaccagcgcagaca

SEQ ID NO: 2602589 - RNA, 14 nt, Escherichia coli CFT073
cguaacgaacacga

SEQ ID NO: 2602590 - RNA, 17 nt, Escherichia coli CFT073
cguaacgacccacaaua

SEQ ID NO: 2602591 - RNA, 13 nt, Escherichia coli CFT073
cguaacgacugac

SEQ ID NO: 2602592 - RNA, 12 nt, Escherichia coli CFT073
cguaacgacugc

SEQ ID NO: 2602593 - RNA, 16 nt, Escherichia coli CFT073
cguaacgacugcggau

SEQ ID NO: 2602594 - RNA, 14 nt, Escherichia coli CFT073
cguaacgcccacgc

SEQ ID NO: 2602595 - RNA, 22 nt, Escherichia coli CFT073
cguaacgccgcgauagagagca

SEQ ID NO: 2602596 - RNA, 18 nt, Escherichia coli CFT073
cguaacgccuuucaggug

SEQ ID NO: 2602597 - RNA, 19 nt, Escherichia coli CFT073
cguaacguaauccugcggu

SEQ ID NO: 2602598 - RNA, 16 nt, Escherichia coli CFT073
cguaacucauccaacu

SEQ ID NO: 2602599 - RNA, 19 nt, Escherichia coli CFT073
cguaagccugauaagcguu

SEQ ID NO: 2602600 - RNA, 20 nt, Escherichia coli CFT073
cguaaggcaucgcuaaucug

SEQ ID NO: 2602601 - RNA, 13 nt, Escherichia coli CFT073
cguaaguaagaua

SEQ ID NO: 2602602 - RNA, 16 nt, Escherichia coli CFT073
cguaagucaccgcuuu

SEQ ID NO: 2602603 - RNA, 14 nt, Escherichia coli CFT073
cguaaguggaacua

SEQ ID NO: 2602604 - RNA, 14 nt, Escherichia coli CFT073
cguaauagccugau

SEQ ID NO: 2602605 - RNA, 15 nt, Escherichia coli CFT073
cguaauagcucugcu

SEQ ID NO: 2602606 - RNA, 15 nt, Escherichia coli CFT073
cguaaucauaaaaca

SEQ ID NO: 2602607 - RNA, 20 nt, Escherichia coli CFT073
cguaauccugcgguacgcga

SEQ ID NO: 2602608 - RNA, 15 nt, Escherichia coli CFT073
cguaaucuuuucaua

SEQ ID NO: 2602609 - RNA, 19 nt, Escherichia coli CFT073
cguaauucacguaucagca

SEQ ID NO: 2602610 - RNA, 16 nt, Escherichia coli CFT073
cguaauucgccaccgg

SEQ ID NO: 2602611 - RNA, 14 nt, Escherichia coli CFT073
cguaauugccagac

SEQ ID NO: 2602612 - RNA, 14 nt, Escherichia coli CFT073
cguaauuugccguu

SEQ ID NO: 2602613 - RNA, 13 nt, Escherichia coli CFT073
cguaauuuuucgg

SEQ ID NO: 2602614 - RNA, 16 nt, Escherichia coli CFT073
cguacaaccaaaucug

SEQ ID NO: 2602615 - RNA, 12 nt, Escherichia coli CFT073
cguacaccaaca

SEQ ID NO: 2602616 - RNA, 15 nt, Escherichia coli CFT073
cguacaccaacauca

SEQ ID NO: 2602617 - RNA, 15 nt, Escherichia coli CFT073
cguacacccgccaga

SEQ ID NO: 2602618 - RNA, 15 nt, Escherichia coli CFT073
cguacaugcagggca

SEQ ID NO: 2602619 - RNA, 18 nt, Escherichia coli CFT073
cguacauugcugacaugg

SEQ ID NO: 2602620 - RNA, 20 nt, Escherichia coli CFT073
cguacauugcugacauggca

SEQ ID NO: 2602621 - RNA, 13 nt, Escherichia coli CFT073
cguaccagugcag

SEQ ID NO: 2602622 - RNA, 13 nt, Escherichia coli CFT073
cguaccaucgcca

SEQ ID NO: 2602623 - RNA, 15 nt, Escherichia coli CFT073
cguaccaucgccagc

SEQ ID NO: 2602624 - RNA, 17 nt, Escherichia coli CFT073
cguaccaugauccugca

SEQ ID NO: 2602625 - RNA, 18 nt, Escherichia coli CFT073
cguaccaugauccugcaa

SEQ ID NO: 2602626 - RNA, 17 nt, Escherichia coli CFT073
cguaccauuaucaccaa

SEQ ID NO: 2602627 - RNA, 16 nt, Escherichia coli CFT073
cguacccaucaacaac

SEQ ID NO: 2602628 - RNA, 16 nt, Escherichia coli CFT073
cguacccgccugauag

SEQ ID NO: 2602629 - RNA, 13 nt, Escherichia coli CFT073
cguacccuccggg

SEQ ID NO: 2602630 - RNA, 17 nt, Escherichia coli CFT073
cguaccgggcuuccggc

SEQ ID NO: 2602631 - RNA, 15 nt, Escherichia coli CFT073
cguaccuucgaugaa

SEQ ID NO: 2602632 - RNA, 14 nt, Escherichia coli CFT073
cguacgccagcguc

SEQ ID NO: 2602633 - RNA, 15 nt, Escherichia coli CFT073
cguacgccagcguca

SEQ ID NO: 2602634 - RNA, 20 nt, Escherichia coli CFT073
cguacgcguuaaauccugcc

SEQ ID NO: 2602635 - RNA, 16 nt, Escherichia coli CFT073
cguacggcccauaacc

SEQ ID NO: 2602636 - RNA, 21 nt, Escherichia coli CFT073
cguacggcuucagacaccguu

SEQ ID NO: 2602637 - RNA, 23 nt, Escherichia coli CFT073
cguacuacgcgccgccagccaca

SEQ ID NO: 2602638 - RNA, 15 nt, Escherichia coli CFT073
cguacuaucuacugc

SEQ ID NO: 2602639 - RNA, 21 nt, Escherichia coli CFT073
cguacucggcaguaucggaga

SEQ ID NO: 2602640 - RNA, 21 nt, Escherichia coli CFT073
cguacucugccacuacccgca

SEQ ID NO: 2602641 - RNA, 21 nt, Escherichia coli CFT073
cgucagggccugcguguggcg

SEQ ID NO: 2602642 - RNA, 18 nt, Escherichia coli CFT073
cgucaggugagcgucauu

SEQ ID NO: 2602643 - RNA, 17 nt, Escherichia coli CFT073
cgucagugacugcuuuu

SEQ ID NO: 2602644 - RNA, 14 nt, Escherichia coli CFT073
cgucaguucucugg

SEQ ID NO: 2602645 - RNA, 22 nt, Escherichia coli CFT073
cgucaguuuuucacccgcaauc

SEQ ID NO: 2602646 - RNA, 17 nt, Escherichia coli CFT073
cgucaguuuuuccagau

SEQ ID NO: 2602647 - RNA, 18 nt, Escherichia coli CFT073
cgucaguuuuuccagauc

SEQ ID NO: 2602648 - RNA, 17 nt, Escherichia coli CFT073
cgucauaauccggcaac

SEQ ID NO: 2602649 - RNA, 22 nt, Escherichia coli CFT073
cgucauacgaucaguuacucug

SEQ ID NO: 2602650 - RNA, 19 nt, Escherichia coli CFT073
cgucauauagccgcgcagu

SEQ ID NO: 2602651 - RNA, 19 nt, Escherichia coli CFT073
cgucauauucgccaucagc

SEQ ID NO: 2602652 - RNA, 15 nt, Escherichia coli CFT073
cgucaucccaguccu

SEQ ID NO: 2602653 - RNA, 15 nt, Escherichia coli CFT073
cgucaucgacagcaa

SEQ ID NO: 2602654 - RNA, 19 nt, Escherichia coli CFT073
cgucaucggcguugcccau

SEQ ID NO: 2602655 - RNA, 15 nt, Escherichia coli CFT073
cgucaugcuccugau

SEQ ID NO: 2602656 - RNA, 22 nt, Escherichia coli CFT073
cgucaugcuccugauuggcagg

SEQ ID NO: 2602657 - RNA, 22 nt, Escherichia coli CFT073
cgucauuaauacaucaacuuaa

SEQ ID NO: 2602658 - RNA, 19 nt, Escherichia coli CFT073
cgucauucauuuaaucguu

SEQ ID NO: 2602659 - RNA, 24 nt, Escherichia coli CFT073
cgucauugaugcugccaucaucuu

SEQ ID NO: 2602660 - RNA, 21 nt, Escherichia coli CFT073
cgucauuuucauugcuuucuu

SEQ ID NO: 2602661 - RNA, 20 nt, Escherichia coli CFT073
cguccaccagaacgacgacc

SEQ ID NO: 2602662 - RNA, 22 nt, Escherichia coli CFT073
cguccacggugcgacacugcgu

SEQ ID NO: 2602663 - RNA, 11 nt, Escherichia coli CFT073
cguccagaacc

SEQ ID NO: 2602664 - RNA, 14 nt, Escherichia coli CFT073
cguccagcagcaau

SEQ ID NO: 2602665 - RNA, 15 nt, Escherichia coli CFT073
cguccagcagcaaug

SEQ ID NO: 2602666 - RNA, 16 nt, Escherichia coli CFT073
cguccagccaccgcgu

SEQ ID NO: 2602667 - RNA, 16 nt, Escherichia coli CFT073
cguccagcgaaccuuc

SEQ ID NO: 2602668 - RNA, 19 nt, Escherichia coli CFT073
cguccagcgccugaauaau

SEQ ID NO: 2602669 - RNA, 13 nt, Escherichia coli CFT073
cguccagcugccu

SEQ ID NO: 2602670 - RNA, 22 nt, Escherichia coli CFT073
cguccagcuugccuucacaggc

SEQ ID NO: 2602671 - RNA, 18 nt, Escherichia coli CFT073
cguccagucgccugcuuu

SEQ ID NO: 2602672 - RNA, 16 nt, Escherichia coli CFT073
cguccagugaccgcug

SEQ ID NO: 2602673 - RNA, 15 nt, Escherichia coli CFT073
cguccaguuguguca

SEQ ID NO: 2602674 - RNA, 16 nt, Escherichia coli CFT073
cguccaucccacacug

SEQ ID NO: 2602675 - RNA, 16 nt, Escherichia coli CFT073
cguccauguuggagau

SEQ ID NO: 2602676 - RNA, 21 nt, Escherichia coli CFT073
cguccauuacccgagaauuuu

SEQ ID NO: 2602677 - RNA, 20 nt, Escherichia coli CFT073
cguccauuuacccacagaca

SEQ ID NO: 2602678 - RNA, 15 nt, Escherichia coli CFT073
cgucccaggcaaauc

SEQ ID NO: 2602679 - RNA, 18 nt, Escherichia coli CFT073
cgucccagucgucauccc

SEQ ID NO: 2602680 - RNA, 15 nt, Escherichia coli CFT073
cguccccaaaaaagc

SEQ ID NO: 2602681 - RNA, 16 nt, Escherichia coli CFT073
cguccccugcaaacgg

SEQ ID NO: 2602682 - RNA, 17 nt, Escherichia coli CFT073
cgucccguccuucaucu

SEQ ID NO: 2602683 - RNA, 19 nt, Escherichia coli CFT073
cgucccugguacagcagac

SEQ ID NO: 2602684 - RNA, 18 nt, Escherichia coli CFT073
cguccgacggcauuaacg

SEQ ID NO: 2602685 - RNA, 23 nt, Escherichia coli CFT073
cguccgcaaacguaaaugccagc

SEQ ID NO: 2602686 - RNA, 13 nt, Escherichia coli CFT073
cguccgcacgcug

SEQ ID NO: 2602687 - RNA, 20 nt, Escherichia coli CFT073
cguccgcucggucacugaca

SEQ ID NO: 2602688 - RNA, 14 nt, Escherichia coli CFT073
cguccggcacucaa

SEQ ID NO: 2602689 - RNA, 16 nt, Escherichia coli CFT073
cguccgggaaauccuc

SEQ ID NO: 2602690 - RNA, 23 nt, Escherichia coli CFT073
cguccgggcuaauacccucaacg

SEQ ID NO: 2602691 - RNA, 12 nt, Escherichia coli CFT073
cguccgguuucc

SEQ ID NO: 2602692 - RNA, 14 nt, Escherichia coli CFT073
cguccgguuuccgu

SEQ ID NO: 2602693 - RNA, 22 nt, Escherichia coli CFT073
cguccucacuuaaagcaacacc

SEQ ID NO: 2602694 - RNA, 22 nt, Escherichia coli CFT073
cguccugcgguugaaacacagc

SEQ ID NO: 2602695 - RNA, 14 nt, Escherichia coli CFT073
cguccugcucgcca

SEQ ID NO: 2602696 - RNA, 16 nt, Escherichia coli CFT073
cgucgaaaauaucgag

SEQ ID NO: 2602697 - RNA, 22 nt, Escherichia coli CFT073
cgucgaaagcccaucauccgcg

SEQ ID NO: 2602698 - RNA, 12 nt, Escherichia coli CFT073
cgucgaccagca

SEQ ID NO: 2602699 - RNA, 13 nt, Escherichia coli CFT073
cgucgauaaacau

SEQ ID NO: 2602700 - RNA, 22 nt, Escherichia coli CFT073
cgucgauaaacaucgccauaaa

SEQ ID NO: 2602701 - RNA, 14 nt, Escherichia coli CFT073
cgucgauugcucaa

SEQ ID NO: 2602702 - RNA, 22 nt, Escherichia coli CFT073
cgucgauuguuauaccagucca

SEQ ID NO: 2602703 - RNA, 20 nt, Escherichia coli CFT073
cgucgcaacuccaccagcac

SEQ ID NO: 2602704 - RNA, 20 nt, Escherichia coli CFT073
cgucgcaauacccugaccca

SEQ ID NO: 2602705 - RNA, 12 nt, Escherichia coli CFT073
cgucgcaucagg

SEQ ID NO: 2602706 - RNA, 22 nt, Escherichia coli CFT073
cgucgcaucaggcaaugggcaa

SEQ ID NO: 2602707 - RNA, 16 nt, Escherichia coli CFT073
cgucgcaucaggcaug

SEQ ID NO: 2602708 - RNA, 16 nt, Escherichia coli CFT073
cgucgcaucaggcauu

SEQ ID NO: 2602709 - RNA, 15 nt, Escherichia coli CFT073
cgucgcauccggcau

SEQ ID NO: 2602710 - RNA, 15 nt, Escherichia coli CFT073
cgucgccaaugcgca

SEQ ID NO: 2602711 - RNA, 19 nt, Escherichia coli CFT073
cgucgccaauggaauagcg

SEQ ID NO: 2602712 - RNA, 15 nt, Escherichia coli CFT073
cgucgccagaaagua

SEQ ID NO: 2602713 - RNA, 16 nt, Escherichia coli CFT073
cgucgccagcagcuca

SEQ ID NO: 2602714 - RNA, 14 nt, Escherichia coli CFT073
cgucgccagcgccu

SEQ ID NO: 2602715 - RNA, 14 nt, Escherichia coli CFT073
cgucgcccgaugcc

SEQ ID NO: 2602716 - RNA, 18 nt, Escherichia coli CFT073
cgucgccucgccgagcag

SEQ ID NO: 2602717 - RNA, 19 nt, Escherichia coli CFT073
cgucgccucgccgagcagc

SEQ ID NO: 2602718 - RNA, 13 nt, Escherichia coli CFT073
cgucgccuucaac

SEQ ID NO: 2602719 - RNA, 15 nt, Escherichia coli CFT073
cgucgccuucaacgu

SEQ ID NO: 2602720 - RNA, 13 nt, Escherichia coli CFT073
cgucgccuuucac

SEQ ID NO: 2602721 - RNA, 18 nt, Escherichia coli CFT073
cgucgccuuucacuuccg

SEQ ID NO: 2602722 - RNA, 18 nt, Escherichia coli CFT073
cgucgcgcacgcccauca

SEQ ID NO: 2602723 - RNA, 14 nt, Escherichia coli CFT073
cgucgcgccaggcg

SEQ ID NO: 2602724 - RNA, 22 nt, Escherichia coli CFT073
cgucgcgccaggcgcgagaaga

SEQ ID NO: 2602725 - RNA, 17 nt, Escherichia coli CFT073
cgucgcgcguaacauau

SEQ ID NO: 2602726 - RNA, 22 nt, Escherichia coli CFT073
cgucgcguuucuccacuggcac

SEQ ID NO: 2602727 - RNA, 19 nt, Escherichia coli CFT073
cgucgcuaucgaugccgcu

SEQ ID NO: 2602728 - RNA, 20 nt, Escherichia coli CFT073
cgucggaacaucgaugccgc

SEQ ID NO: 2602729 - RNA, 20 nt, Escherichia coli CFT073
cgucggcuucacgcccagca

SEQ ID NO: 2602730 - RNA, 17 nt, Escherichia coli CFT073
cgucgggauugcauccu

SEQ ID NO: 2602731 - RNA, 19 nt, Escherichia coli CFT073
cgucgggccacgcugcgcu

SEQ ID NO: 2602732 - RNA, 17 nt, Escherichia coli CFT073
cgucgguguccacuucc

SEQ ID NO: 2602733 - RNA, 13 nt, Escherichia coli CFT073
cgucgucgccaau

SEQ ID NO: 2602734 - RNA, 22 nt, Escherichia coli CFT073
cgucgucgcgcgaaucuucaua

SEQ ID NO: 2602735 - RNA, 16 nt, Escherichia coli CFT073
cgucgucuuuauccug

SEQ ID NO: 2602736 - RNA, 21 nt, Escherichia coli CFT073
cgucguuaguuuucgacaucg

SEQ ID NO: 2602737 - RNA, 19 nt, Escherichia coli CFT073
cgucguucaacaagccacg

SEQ ID NO: 2602738 - RNA, 22 nt, Escherichia coli CFT073
cgucguucgccagucuccaggc

SEQ ID NO: 2602739 - RNA, 17 nt, Escherichia coli CFT073
cgucuaucagcuucugc

SEQ ID NO: 2602740 - RNA, 18 nt, Escherichia coli CFT073
cgucuaucagcuucugca

SEQ ID NO: 2602741 - RNA, 21 nt, Escherichia coli CFT073
cgucuaucagcuucugcacga

SEQ ID NO: 2602742 - RNA, 15 nt, Escherichia coli CFT073
cgucucaaucaccac

SEQ ID NO: 2602743 - RNA, 17 nt, Escherichia coli CFT073
cgucucacuaucgccga

SEQ ID NO: 2602744 - RNA, 23 nt, Escherichia coli CFT073
cgucuccagacaauccgcagcaa

SEQ ID NO: 2602745 - RNA, 13 nt, Escherichia coli CFT073
cgucucgccagag

SEQ ID NO: 2602746 - RNA, 23 nt, Escherichia coli CFT073
cgucugacgcguaccuaacaguu

SEQ ID NO: 2602747 - RNA, 15 nt, Escherichia coli CFT073
cgucugacggccuuc

SEQ ID NO: 2602748 - RNA, 15 nt, Escherichia coli CFT073
cgucugaugaaagca

SEQ ID NO: 2602749 - RNA, 16 nt, Escherichia coli CFT073
cgugguuuaccaccag

SEQ ID NO: 2602750 - RNA, 20 nt, Escherichia coli CFT073
cgugguuuaccaccagcgga

SEQ ID NO: 2602751 - RNA, 15 nt, Escherichia coli CFT073
cguguacccagcagc

SEQ ID NO: 2602752 - RNA, 14 nt, Escherichia coli CFT073
cguguauaucacca

SEQ ID NO: 2602753 - RNA, 21 nt, Escherichia coli CFT073
cgugucauaacuggucaucaa

SEQ ID NO: 2602754 - RNA, 16 nt, Escherichia coli CFT073
cgugugauucagguau

SEQ ID NO: 2602755 - RNA, 15 nt, Escherichia coli CFT073
cguguggcgguagcg

SEQ ID NO: 2602756 - RNA, 14 nt, Escherichia coli CFT073
cgugugugagauau

SEQ ID NO: 2602757 - RNA, 22 nt, Escherichia coli CFT073
cgugugugagauauaucgcgua

SEQ ID NO: 2602758 - RNA, 16 nt, Escherichia coli CFT073
cguguguugagauaau

SEQ ID NO: 2602759 - RNA, 20 nt, Escherichia coli CFT073
cguguuccagagaacgaccc

SEQ ID NO: 2602760 - RNA, 13 nt, Escherichia coli CFT073
cguguucugaaua

SEQ ID NO: 2602761 - RNA, 17 nt, Escherichia coli CFT073
cguguugcuccacgcca

SEQ ID NO: 2602762 - RNA, 22 nt, Escherichia coli CFT073
cguguuuaugaaaguuuaacua

SEQ ID NO: 2602763 - RNA, 16 nt, Escherichia coli CFT073
cguguuucaucucauc

SEQ ID NO: 2602764 - RNA, 17 nt, Escherichia coli CFT073
cguguuuccgggccgaa

SEQ ID NO: 2602765 - RNA, 14 nt, Escherichia coli CFT073
cguuaaaaaacagu

SEQ ID NO: 2602766 - RNA, 15 nt, Escherichia coli CFT073
cguuaaacgccaaac

SEQ ID NO: 2602767 - RNA, 20 nt, Escherichia coli CFT073
cguuaaccacgaucccuugc

SEQ ID NO: 2602768 - RNA, 21 nt, Escherichia coli CFT073
cguuaacggcauuuuccagcu

SEQ ID NO: 2602769 - RNA, 14 nt, Escherichia coli CFT073
cguuaagcgucgca

SEQ ID NO: 2602770 - RNA, 18 nt, Escherichia coli CFT073
cguuaagcgucgcaucag

SEQ ID NO: 2602771 - RNA, 18 nt, Escherichia coli CFT073
cguuaagcuggaaaucaa

SEQ ID NO: 2602772 - RNA, 23 nt, Escherichia coli CFT073
cguuaaggccaaacaccaggcua

SEQ ID NO: 2602773 - RNA, 17 nt, Escherichia coli CFT073
cguuaaugacuuuugga

SEQ ID NO: 2602774 - RNA, 14 nt, Escherichia coli CFT073
cguuacaaccacau

SEQ ID NO: 2602775 - RNA, 15 nt, Escherichia coli CFT073
cguuacaaccacaua

SEQ ID NO: 2602776 - RNA, 16 nt, Escherichia coli CFT073
cguuacaaccacauau

SEQ ID NO: 2602777 - RNA, 22 nt, Escherichia coli CFT073
cguuacaccuuuccccggcagc

SEQ ID NO: 2602778 - RNA, 13 nt, Escherichia coli CFT073
cguuacagcugga

SEQ ID NO: 2602779 - RNA, 15 nt, Escherichia coli CFT073
cguuacccagcgcca

SEQ ID NO: 2602780 - RNA, 18 nt, Escherichia coli CFT073
cguuacccgacgcgccag

SEQ ID NO: 2602781 - RNA, 13 nt, Escherichia coli CFT073
cguuaccggcaau

SEQ ID NO: 2602782 - RNA, 19 nt, Escherichia coli CFT073
cguuaccggcuucgacagg

SEQ ID NO: 2602783 - RNA, 18 nt, Escherichia coli CFT073
cguuagaaaacgccugcu

SEQ ID NO: 2602784 - RNA, 22 nt, Escherichia coli CFT073
cguuagaaaacgccugcuccuc

SEQ ID NO: 2602785 - RNA, 15 nt, Escherichia coli CFT073
cguuagaaagcugcu

SEQ ID NO: 2602786 - RNA, 19 nt, Escherichia coli CFT073
cguuagaaagcugcugcuu

SEQ ID NO: 2602787 - RNA, 17 nt, Escherichia coli CFT073
cguuagaacccaacaga

SEQ ID NO: 2602788 - RNA, 17 nt, Escherichia coli CFT073
cguuagcgaguugauca

SEQ ID NO: 2602789 - RNA, 22 nt, Escherichia coli CFT073
cguuaggcacaucaacaccgac

SEQ ID NO: 2602790 - RNA, 16 nt, Escherichia coli CFT073
cguuagguugugaaug

SEQ ID NO: 2602791 - RNA, 16 nt, Escherichia coli CFT073
cguuauacauugagca

SEQ ID NO: 2602792 - RNA, 19 nt, Escherichia coli CFT073
cguuauagcgauuuuucau

SEQ ID NO: 2602793 - RNA, 14 nt, Escherichia coli CFT073
cguuauagguauuc

SEQ ID NO: 2602794 - RNA, 22 nt, Escherichia coli CFT073
cguuaucagaacgcguaguuaa

SEQ ID NO: 2602795 - RNA, 15 nt, Escherichia coli CFT073
cguuaugaucagcaa

SEQ ID NO: 2602796 - RNA, 22 nt, Escherichia coli CFT073
cguuauuauuacguccaccaga

SEQ ID NO: 2602797 - RNA, 15 nt, Escherichia coli CFT073
cguuauucaauuacg

SEQ ID NO: 2602798 - RNA, 16 nt, Escherichia coli CFT073
cguuauuuguugccgg

SEQ ID NO: 2602799 - RNA, 19 nt, Escherichia coli CFT073
cguuauuuguugccggaug

SEQ ID NO: 2602800 - RNA, 12 nt, Escherichia coli CFT073
cguuauuuugcu

SEQ ID NO: 2602801 - RNA, 21 nt, Escherichia coli CFT073
cguucaaaacggcuggugauu

SEQ ID NO: 2602802 - RNA, 15 nt, Escherichia coli CFT073
cguucaaaccguaaa

SEQ ID NO: 2602803 - RNA, 20 nt, Escherichia coli CFT073
cguucaagcugcaucuggcg

SEQ ID NO: 2602804 - RNA, 19 nt, Escherichia coli CFT073
cguucaauaauauuaaucc

SEQ ID NO: 2602805 - RNA, 18 nt, Escherichia coli CFT073
cguucaauacgcaguuuu

SEQ ID NO: 2602806 - RNA, 19 nt, Escherichia coli CFT073
cguucaaucuguccuucca

SEQ ID NO: 2602807 - RNA, 21 nt, Escherichia coli CFT073
cguucaccuaacagcaucgca

SEQ ID NO: 2602808 - RNA, 10 nt, Escherichia coli CFT073
cguucacgca

SEQ ID NO: 2602809 - RNA, 11 nt, Escherichia coli CFT073
cguucacgccg

SEQ ID NO: 2602810 - RNA, 18 nt, Escherichia coli CFT073
cguucagcacuucaccca

SEQ ID NO: 2602811 - RNA, 17 nt, Escherichia coli CFT073
cguucaguucaaaguua

SEQ ID NO: 2602812 - RNA, 15 nt, Escherichia coli CFT073
cguucaguuuaccgu

SEQ ID NO: 2602813 - RNA, 17 nt, Escherichia coli CFT073
cguucaguuuauucugc

SEQ ID NO: 2602814 - RNA, 23 nt, Escherichia coli CFT073
cguucauacgcaaugugcagcag

SEQ ID NO: 2602815 - RNA, 21 nt, Escherichia coli CFT073
cguucaucucgaauacgccga

SEQ ID NO: 2602816 - RNA, 16 nt, Escherichia coli CFT073
cguucauggcgugaca

SEQ ID NO: 2602817 - RNA, 18 nt, Escherichia coli CFT073
cguucauggcgugacaug

SEQ ID NO: 2602818 - RNA, 19 nt, Escherichia coli CFT073
cguucauuucguacagacg

SEQ ID NO: 2602819 - RNA, 19 nt, Escherichia coli CFT073
cguuccacgucacaggcca

SEQ ID NO: 2602820 - RNA, 15 nt, Escherichia coli CFT073
cguuccacucuuccc

SEQ ID NO: 2602821 - RNA, 22 nt, Escherichia coli CFT073
cguucccuuguugugccagacc

SEQ ID NO: 2602822 - RNA, 19 nt, Escherichia coli CFT073
cguuccggcggcacagcca

SEQ ID NO: 2602823 - RNA, 21 nt, Escherichia coli CFT073
cguuccggcggcacagccagc

SEQ ID NO: 2602824 - RNA, 14 nt, Escherichia coli CFT073
cguuccggcgguga

SEQ ID NO: 2602825 - RNA, 14 nt, Escherichia coli CFT073
cguuccucaccuuc

SEQ ID NO: 2602826 - RNA, 19 nt, Escherichia coli CFT073
cguucgacugcgccuucca

SEQ ID NO: 2602827 - RNA, 22 nt, Escherichia coli CFT073
cguucgauagcgcgccagccga

SEQ ID NO: 2602828 - RNA, 20 nt, Escherichia coli CFT073
cguucgaugcgauaaccagg

SEQ ID NO: 2602829 - RNA, 19 nt, Escherichia coli CFT073
cguucgccagcuccagcgc

SEQ ID NO: 2602830 - RNA, 18 nt, Escherichia coli CFT073
cguucgccccauacagcg

SEQ ID NO: 2602831 - RNA, 21 nt, Escherichia coli CFT073
cguucggcaaagcgcugaaga

SEQ ID NO: 2602832 - RNA, 14 nt, Escherichia coli CFT073
cguucgggaaaaua

SEQ ID NO: 2602833 - RNA, 15 nt, Escherichia coli CFT073
cguucggugcgcgcu

SEQ ID NO: 2602834 - RNA, 22 nt, Escherichia coli CFT073
cguucggugcgcgcuggcaucg

SEQ ID NO: 2602835 - RNA, 20 nt, Escherichia coli CFT073
cguucgguggugccgacauu

SEQ ID NO: 2602836 - RNA, 14 nt, Escherichia coli CFT073
cguucgguuuugcg

SEQ ID NO: 2602837 - RNA, 20 nt, Escherichia coli CFT073
cguucguccgagcggcacca

SEQ ID NO: 2602838 - RNA, 20 nt, Escherichia coli CFT073
cguucuccucaacgaugcga

SEQ ID NO: 2602839 - RNA, 13 nt, Escherichia coli CFT073
cguucucgcgaua

SEQ ID NO: 2602840 - RNA, 22 nt, Escherichia coli CFT073
cguucugccaaacgcucccagc

SEQ ID NO: 2602841 - RNA, 13 nt, Escherichia coli CFT073
cguucuguuucug

SEQ ID NO: 2602842 - RNA, 11 nt, Escherichia coli CFT073
cguucuuccuc

SEQ ID NO: 2602843 - RNA, 12 nt, Escherichia coli CFT073
cguucuuccugu

SEQ ID NO: 2602844 - RNA, 22 nt, Escherichia coli CFT073
cguucuucugcuucauguugca

SEQ ID NO: 2602845 - RNA, 19 nt, Escherichia coli CFT073
cguugaaaaaauuuuaucc

SEQ ID NO: 2602846 - RNA, 15 nt, Escherichia coli CFT073
cguugaaauugcugg

SEQ ID NO: 2602847 - RNA, 23 nt, Escherichia coli CFT073
cguugaacccggcaucaaccagc

SEQ ID NO: 2602848 - RNA, 18 nt, Escherichia coli CFT073
cguugaaguacccgccgu

SEQ ID NO: 2602849 - RNA, 23 nt, Escherichia coli CFT073
cguugaagucaggggcuuccagc

SEQ ID NO: 2602850 - RNA, 21 nt, Escherichia coli CFT073
cguugaaucuuuagcggcgga

SEQ ID NO: 2602851 - RNA, 15 nt, Escherichia coli CFT073
cguugaauuucaggu

SEQ ID NO: 2602852 - RNA, 23 nt, Escherichia coli CFT073
cguugaauuucagguucugacca

SEQ ID NO: 2602853 - RNA, 15 nt, Escherichia coli CFT073
cguugacgaccaguc

SEQ ID NO: 2602854 - RNA, 20 nt, Escherichia coli CFT073
cguugacgcuuuacuuaaua

SEQ ID NO: 2602855 - RNA, 18 nt, Escherichia coli CFT073
cguugacguucaugccgg

SEQ ID NO: 2602856 - RNA, 19 nt, Escherichia coli CFT073
cguugacucgguaaaauca

SEQ ID NO: 2602857 - RNA, 20 nt, Escherichia coli CFT073
cuaaaauuucuuuuuuucau

SEQ ID NO: 2602858 - RNA, 15 nt, Escherichia coli CFT073
cuaaacagagcugca

SEQ ID NO: 2602859 - RNA, 16 nt, Escherichia coli CFT073
cuaaacagagcugcaa

SEQ ID NO: 2602860 - RNA, 19 nt, Escherichia coli CFT073
cuaaacccgaccacuucca

SEQ ID NO: 2602861 - RNA, 19 nt, Escherichia coli CFT073
cuaaagaaaacgaauugca

SEQ ID NO: 2602862 - RNA, 15 nt, Escherichia coli CFT073
cuaaagcaacuccau

SEQ ID NO: 2602863 - RNA, 18 nt, Escherichia coli CFT073
cuaaagcacccagcaauc

SEQ ID NO: 2602864 - RNA, 19 nt, Escherichia coli CFT073
cuaaagcauucucccgccu

SEQ ID NO: 2602865 - RNA, 16 nt, Escherichia coli CFT073
cuaaagcuaucccuug

SEQ ID NO: 2602866 - RNA, 14 nt, Escherichia coli CFT073
cuaaaucggggauc

SEQ ID NO: 2602867 - RNA, 21 nt, Escherichia coli CFT073
cuaaaugucaucccuuccugc

SEQ ID NO: 2602868 - RNA, 23 nt, Escherichia coli CFT073
cuaaauuaucaacguagaauaaa

SEQ ID NO: 2602869 - RNA, 23 nt, Escherichia coli CFT073
cuaaauuuuaagccauuaaauca

SEQ ID NO: 2602870 - RNA, 23 nt, Escherichia coli CFT073
cuaacaacugcuggacgauuuca

SEQ ID NO: 2602871 - RNA, 22 nt, Escherichia coli CFT073
cuaacaauggagcacauugccu

SEQ ID NO: 2602872 - RNA, 23 nt, Escherichia coli CFT073
cuaacaauucacacucugccagc

SEQ ID NO: 2602873 - RNA, 20 nt, Escherichia coli CFT073
cuaacacagcaauaauaaua

SEQ ID NO: 2602874 - RNA, 14 nt, Escherichia coli CFT073
cuaacacuuucgcc

SEQ ID NO: 2602875 - RNA, 15 nt, Escherichia coli CFT073
cuaacagaucaucca

SEQ ID NO: 2602876 - RNA, 12 nt, Escherichia coli CFT073
cuaacagcagca

SEQ ID NO: 2602877 - RNA, 16 nt, Escherichia coli CFT073
cuaacagcgccgcgau

SEQ ID NO: 2602878 - RNA, 13 nt, Escherichia coli CFT073
cuaacaguucacc

SEQ ID NO: 2602879 - RNA, 14 nt, Escherichia coli CFT073
cuaacaugacacca

SEQ ID NO: 2602880 - RNA, 17 nt, Escherichia coli CFT073
cuaacaugccacuggcu

SEQ ID NO: 2602881 - RNA, 19 nt, Escherichia coli CFT073
cuaacaugcccauucccca

SEQ ID NO: 2602882 - RNA, 21 nt, Escherichia coli CFT073
cuaacauuuuaguuuacauua

SEQ ID NO: 2602883 - RNA, 12 nt, Escherichia coli CFT073
cuaaccgcgcau

SEQ ID NO: 2602884 - RNA, 16 nt, Escherichia coli CFT073
cuaaccggauaucuaa

SEQ ID NO: 2602885 - RNA, 23 nt, Escherichia coli CFT073
cuaaccuguuuucgauuuuuucc

SEQ ID NO: 2602886 - RNA, 17 nt, Escherichia coli CFT073
cuaacgacaaaucauac

SEQ ID NO: 2602887 - RNA, 22 nt, Escherichia coli CFT073
cuaacgacaaaucauacaggcg

SEQ ID NO: 2602888 - RNA, 22 nt, Escherichia coli CFT073
cuaacggagaauccagccccac

SEQ ID NO: 2602889 - RNA, 17 nt, Escherichia coli CFT073
cuaacgguucggcaauc

SEQ ID NO: 2602890 - RNA, 18 nt, Escherichia coli CFT073
cuaacgucugguaaagca

SEQ ID NO: 2602891 - RNA, 14 nt, Escherichia coli CFT073
cuaacucacgcaga

SEQ ID NO: 2602892 - RNA, 17 nt, Escherichia coli CFT073
cuaacuccugauuccag

SEQ ID NO: 2602893 - RNA, 13 nt, Escherichia coli CFT073
cuaacucuuccug

SEQ ID NO: 2602894 - RNA, 14 nt, Escherichia coli CFT073
cuaacucuuccugc

SEQ ID NO: 2602895 - RNA, 15 nt, Escherichia coli CFT073
cuaacucuuccugcg

SEQ ID NO: 2602896 - RNA, 18 nt, Escherichia coli CFT073
cuaacucuuccugcgcac

SEQ ID NO: 2602897 - RNA, 14 nt, Escherichia coli CFT073
cuaacucuugccag

SEQ ID NO: 2602898 - RNA, 13 nt, Escherichia coli CFT073
cuaacugacuuuc

SEQ ID NO: 2602899 - RNA, 16 nt, Escherichia coli CFT073
cuaacugacuuucuuu

SEQ ID NO: 2602900 - RNA, 18 nt, Escherichia coli CFT073
cuaacugaucacguuuuc

SEQ ID NO: 2602901 - RNA, 20 nt, Escherichia coli CFT073
cuaacugaucacguuuuccu

SEQ ID NO: 2602902 - RNA, 12 nt, Escherichia coli CFT073
cuaacuuauugu

SEQ ID NO: 2602903 - RNA, 14 nt, Escherichia coli CFT073
cuaacuucuuuuuc

SEQ ID NO: 2602904 - RNA, 19 nt, Escherichia coli CFT073
cuaagauaauccaggacau

SEQ ID NO: 2602905 - RNA, 16 nt, Escherichia coli CFT073
cuaagauaccccagcg

SEQ ID NO: 2602906 - RNA, 15 nt, Escherichia coli CFT073
cuaagcaauuacagg

SEQ ID NO: 2602907 - RNA, 17 nt, Escherichia coli CFT073
cuaagcaggcuggcgac

SEQ ID NO: 2602908 - RNA, 18 nt, Escherichia coli CFT073
cuaagcaggcuggcgacg

SEQ ID NO: 2602909 - RNA, 17 nt, Escherichia coli CFT073
cuaagcguuuucugcca

SEQ ID NO: 2602910 - RNA, 19 nt, Escherichia coli CFT073
cuaagcguuuucugccaga

SEQ ID NO: 2602911 - RNA, 19 nt, Escherichia coli CFT073
cuaagcugcgggaaauaac

SEQ ID NO: 2602912 - RNA, 14 nt, Escherichia coli CFT073
cuaaggcagccaga

SEQ ID NO: 2602913 - RNA, 17 nt, Escherichia coli CFT073
cuaagguaaaacaagug

SEQ ID NO: 2602914 - RNA, 13 nt, Escherichia coli CFT073
cuaagucuuucug

SEQ ID NO: 2602915 - RNA, 15 nt, Escherichia coli CFT073
cuaauaaaaccggug

SEQ ID NO: 2602916 - RNA, 14 nt, Escherichia coli CFT073
cuaauaccagaacu

SEQ ID NO: 2602917 - RNA, 17 nt, Escherichia coli CFT073
cuaauacucuggcuggu

SEQ ID NO: 2602918 - RNA, 15 nt, Escherichia coli CFT073
cuaauagcaaaauau

SEQ ID NO: 2602919 - RNA, 15 nt, Escherichia coli CFT073
cuaauaucgcgacug

SEQ ID NO: 2602920 - RNA, 20 nt, Escherichia coli CFT073
cuaaucagcuuuuccauauc

SEQ ID NO: 2602921 - RNA, 23 nt, Escherichia coli CFT073
cuaaucaucuguugugccacauc

SEQ ID NO: 2602922 - RNA, 21 nt, Escherichia coli CFT073
cuaaucgcuuuauagcauagc

SEQ ID NO: 2602923 - RNA, 17 nt, Escherichia coli CFT073
cuaaucucuucaccaua

SEQ ID NO: 2602924 - RNA, 18 nt, Escherichia coli CFT073
cuaaugccggauaagccu

SEQ ID NO: 2602925 - RNA, 20 nt, Escherichia coli CFT073
cuaauguagcgaccauaaca

SEQ ID NO: 2602926 - RNA, 14 nt, Escherichia coli CFT073
cuaauuaagacuga

SEQ ID NO: 2602927 - RNA, 16 nt, Escherichia coli CFT073
cuaauuaauaauauaa

SEQ ID NO: 2602928 - RNA, 17 nt, Escherichia coli CFT073
cuaauuaauaauauaaa

SEQ ID NO: 2602929 - RNA, 11 nt, Escherichia coli CFT073
cuaauuucacg

SEQ ID NO: 2602930 - RNA, 20 nt, Escherichia coli CFT073
cuaauuuccuggacuucuuu

SEQ ID NO: 2602931 - RNA, 14 nt, Escherichia coli CFT073
cuaauuugaaauga

SEQ ID NO: 2602932 - RNA, 21 nt, Escherichia coli CFT073
cuaauuuuuccagcauuucuu

SEQ ID NO: 2602933 - RNA, 14 nt, Escherichia coli CFT073
cuacaaaacauuau

SEQ ID NO: 2602934 - RNA, 22 nt, Escherichia coli CFT073
cuacaaagguuuguaacucagg

SEQ ID NO: 2602935 - RNA, 17 nt, Escherichia coli CFT073
cuacaagcagagagacg

SEQ ID NO: 2602936 - RNA, 22 nt, Escherichia coli CFT073
cuacaaguccguugaaauugcu

SEQ ID NO: 2602937 - RNA, 20 nt, Escherichia coli CFT073
cuacaauugguaaauaagcg

SEQ ID NO: 2602938 - RNA, 21 nt, Escherichia coli CFT073
cuacacauuaucucaacacac

SEQ ID NO: 2602939 - RNA, 13 nt, Escherichia coli CFT073
cuacaccccagcg

SEQ ID NO: 2602940 - RNA, 13 nt, Escherichia coli CFT073
cuacagcaacagg

SEQ ID NO: 2602941 - RNA, 20 nt, Escherichia coli CFT073
cuacagccaugcgaaugcca

SEQ ID NO: 2602942 - RNA, 15 nt, Escherichia coli CFT073
cuacagcggaacuuu

SEQ ID NO: 2602943 - RNA, 18 nt, Escherichia coli CFT073
cuacagcggaacuuuuuu

SEQ ID NO: 2602944 - RNA, 21 nt, Escherichia coli CFT073
cuacagcggaacuuuuuucau

SEQ ID NO: 2602945 - RNA, 16 nt, Escherichia coli CFT073
cuacagguaagguaau

SEQ ID NO: 2602946 - RNA, 12 nt, Escherichia coli CFT073
cuacaucauuuu

SEQ ID NO: 2602947 - RNA, 12 nt, Escherichia coli CFT073
cuacaucgacaa

SEQ ID NO: 2602948 - RNA, 14 nt, Escherichia coli CFT073
cuacaugauuucug

SEQ ID NO: 2602949 - RNA, 15 nt, Escherichia coli CFT073
cuacaugccaucaca

SEQ ID NO: 2602950 - RNA, 17 nt, Escherichia coli CFT073
cuacaugccaucacacc

SEQ ID NO: 2602951 - RNA, 21 nt, Escherichia coli CFT073
cuaccaaaacggacauguugc

SEQ ID NO: 2602952 - RNA, 15 nt, Escherichia coli CFT073
cuaccacgccgauaa

SEQ ID NO: 2602953 - RNA, 17 nt, Escherichia coli CFT073
cuaccacgccgauaauc

SEQ ID NO: 2602954 - RNA, 17 nt, Escherichia coli CFT073
cuaccacugccugaguu

SEQ ID NO: 2602955 - RNA, 21 nt, Escherichia coli CFT073
cuaccagcaaagagagaucca

SEQ ID NO: 2602956 - RNA, 11 nt, Escherichia coli CFT073
cuaccagcacc

SEQ ID NO: 2602957 - RNA, 15 nt, Escherichia coli CFT073
cuaccagcaccugcu

SEQ ID NO: 2602958 - RNA, 16 nt, Escherichia coli CFT073
cuaccagcgccaccgg

SEQ ID NO: 2602959 - RNA, 17 nt, Escherichia coli CFT073
cuaccagcgccaccggu

SEQ ID NO: 2602960 - RNA, 18 nt, Escherichia coli CFT073
cuaccagcgccaccgguu

SEQ ID NO: 2602961 - RNA, 22 nt, Escherichia coli CFT073
cuaccagcugaaaucaccgcca

SEQ ID NO: 2602962 - RNA, 20 nt, Escherichia coli CFT073
cuaccagguuucgcaauaac

SEQ ID NO: 2602963 - RNA, 15 nt, Escherichia coli CFT073
cuaccaguuccagcg

SEQ ID NO: 2602964 - RNA, 22 nt, Escherichia coli CFT073
cuaccaguuuggugacgccaca

SEQ ID NO: 2602965 - RNA, 23 nt, Escherichia coli CFT073
cuaccaucagguaauaggcaggc

SEQ ID NO: 2602966 - RNA, 18 nt, Escherichia coli CFT073
cucaaauaucugccggaa

SEQ ID NO: 2602967 - RNA, 12 nt, Escherichia coli CFT073
cucaacaaacgc

SEQ ID NO: 2602968 - RNA, 20 nt, Escherichia coli CFT073
cucaacaaccaggccagcgc

SEQ ID NO: 2602969 - RNA, 13 nt, Escherichia coli CFT073
cucaacagccaga

SEQ ID NO: 2602970 - RNA, 16 nt, Escherichia coli CFT073
cucaacagguugcgga

SEQ ID NO: 2602971 - RNA, 12 nt, Escherichia coli CFT073
cucaacaguaag

SEQ ID NO: 2602972 - RNA, 22 nt, Escherichia coli CFT073
cucaacauacaaauagccaauu

SEQ ID NO: 2602973 - RNA, 12 nt, Escherichia coli CFT073
cucaacccauuu

SEQ ID NO: 2602974 - RNA, 23 nt, Escherichia coli CFT073
cucaaccgccaguucccccugcc

SEQ ID NO: 2602975 - RNA, 17 nt, Escherichia coli CFT073
cucaaccgcuucuuucu

SEQ ID NO: 2602976 - RNA, 18 nt, Escherichia coli CFT073
cucaaccgcuucuuucuc

SEQ ID NO: 2602977 - RNA, 22 nt, Escherichia coli CFT073
cucaacgcccuguaaaaaagaa

SEQ ID NO: 2602978 - RNA, 21 nt, Escherichia coli CFT073
cucaacgccgcuaucagauuc

SEQ ID NO: 2602979 - RNA, 21 nt, Escherichia coli CFT073
cucaacgccuaaugccagcga

SEQ ID NO: 2602980 - RNA, 17 nt, Escherichia coli CFT073
cucaacggaauaaacgc

SEQ ID NO: 2602981 - RNA, 20 nt, Escherichia coli CFT073
cucaacggugaccucagguu

SEQ ID NO: 2602982 - RNA, 14 nt, Escherichia coli CFT073
cucaacucacacaa

SEQ ID NO: 2602983 - RNA, 14 nt, Escherichia coli CFT073
cucaacuccccgca

SEQ ID NO: 2602984 - RNA, 21 nt, Escherichia coli CFT073
cucaacugacugacgugauga

SEQ ID NO: 2602985 - RNA, 19 nt, Escherichia coli CFT073
cucaacuuauugaucaucc

SEQ ID NO: 2602986 - RNA, 16 nt, Escherichia coli CFT073
cucaagaaucacuuca

SEQ ID NO: 2602987 - RNA, 17 nt, Escherichia coli CFT073
cucaagagugaacacgu

SEQ ID NO: 2602988 - RNA, 14 nt, Escherichia coli CFT073
cucaagcaaccagg

SEQ ID NO: 2602989 - RNA, 18 nt, Escherichia coli CFT073
cucaagcaaucaagcccu

SEQ ID NO: 2602990 - RNA, 16 nt, Escherichia coli CFT073
cucaagcacccgccgc

SEQ ID NO: 2602991 - RNA, 15 nt, Escherichia coli CFT073
cucaagccagauauu

SEQ ID NO: 2602992 - RNA, 20 nt, Escherichia coli CFT073
cucaagcuuacugagcagau

SEQ ID NO: 2602993 - RNA, 17 nt, Escherichia coli CFT073
cucaaggagucagggag

SEQ ID NO: 2602994 - RNA, 21 nt, Escherichia coli CFT073
cucaaguaauaaagcacccug

SEQ ID NO: 2602995 - RNA, 13 nt, Escherichia coli CFT073
cucaauacccagc

SEQ ID NO: 2602996 - RNA, 15 nt, Escherichia coli CFT073
cucaauacccagcgu

SEQ ID NO: 2602997 - RNA, 17 nt, Escherichia coli CFT073
cucaaucccuuucucca

SEQ ID NO: 2602998 - RNA, 17 nt, Escherichia coli CFT073
cucaauccuacauccag

SEQ ID NO: 2602999 - RNA, 18 nt, Escherichia coli CFT073
cucaaucgaaauacgacu

SEQ ID NO: 2603000 - RNA, 15 nt, Escherichia coli CFT073
cucaaucgcacccgc

SEQ ID NO: 2603001 - RNA, 22 nt, Escherichia coli CFT073
cucaaucgucaaacgcacgucu

SEQ ID NO: 2603002 - RNA, 16 nt, Escherichia coli CFT073
cucaaugaugccgcca

SEQ ID NO: 2603003 - RNA, 20 nt, Escherichia coli CFT073
cucaaugccagcgacuguga

SEQ ID NO: 2603004 - RNA, 14 nt, Escherichia coli CFT073
cucaauggcagcau

SEQ ID NO: 2603005 - RNA, 14 nt, Escherichia coli CFT073
cucaauggcauccg

SEQ ID NO: 2603006 - RNA, 19 nt, Escherichia coli CFT073
cucaaugguguuuuccacc

SEQ ID NO: 2603007 - RNA, 22 nt, Escherichia coli CFT073
cucaauuccuuugcugcucuau

SEQ ID NO: 2603008 - RNA, 14 nt, Escherichia coli CFT073
cucaauuuucacuu

SEQ ID NO: 2603009 - RNA, 21 nt, Escherichia coli CFT073
cucacaagcccaggccaucgc

SEQ ID NO: 2603010 - RNA, 19 nt, Escherichia coli CFT073
cucacaaucaucgcaucca

SEQ ID NO: 2603011 - RNA, 14 nt, Escherichia coli CFT073
cucacacaaacggc

SEQ ID NO: 2603012 - RNA, 15 nt, Escherichia coli CFT073
cucacagcuaaucau

SEQ ID NO: 2603013 - RNA, 19 nt, Escherichia coli CFT073
cucaccaacuggcgcagca

SEQ ID NO: 2603014 - RNA, 18 nt, Escherichia coli CFT073
cucaccaauaaugucgcu

SEQ ID NO: 2603015 - RNA, 16 nt, Escherichia coli CFT073
cucaccaauccaggca

SEQ ID NO: 2603016 - RNA, 21 nt, Escherichia coli CFT073
cucaccacggugauucagcgu

SEQ ID NO: 2603017 - RNA, 19 nt, Escherichia coli CFT073
cucaccagcaucgcuucca

SEQ ID NO: 2603018 - RNA, 13 nt, Escherichia coli CFT073
cucaccagccgcg

SEQ ID NO: 2603019 - RNA, 17 nt, Escherichia coli CFT073
cucaccaucaaacagcc

SEQ ID NO: 2603020 - RNA, 23 nt, Escherichia coli CFT073
cucaccaucaaacagccccugac

SEQ ID NO: 2603021 - RNA, 14 nt, Escherichia coli CFT073
cucaccauuuuuug

SEQ ID NO: 2603022 - RNA, 18 nt, Escherichia coli CFT073
cucacccccacucccgca

SEQ ID NO: 2603023 - RNA, 15 nt, Escherichia coli CFT073
cucacccccaucagc

SEQ ID NO: 2603024 - RNA, 15 nt, Escherichia coli CFT073
cucacccgccagcgc

SEQ ID NO: 2603025 - RNA, 16 nt, Escherichia coli CFT073
cucacccgccagcgcg

SEQ ID NO: 2603026 - RNA, 20 nt, Escherichia coli CFT073
cucaccgauagucguugcca

SEQ ID NO: 2603027 - RNA, 22 nt, Escherichia coli CFT073
cucaccgaugaucgccaucagc

SEQ ID NO: 2603028 - RNA, 22 nt, Escherichia coli CFT073
cucaccggcauuuuuuagcgcc

SEQ ID NO: 2603029 - RNA, 14 nt, Escherichia coli CFT073
cucaccgguaaagu

SEQ ID NO: 2603030 - RNA, 20 nt, Escherichia coli CFT073
cucaccgguaaagucagcgu

SEQ ID NO: 2603031 - RNA, 19 nt, Escherichia coli CFT073
cucaccuuucgguucauaa

SEQ ID NO: 2603032 - RNA, 17 nt, Escherichia coli CFT073
cucacgaagcguuguca

SEQ ID NO: 2603033 - RNA, 16 nt, Escherichia coli CFT073
cucacgaauagcuuua

SEQ ID NO: 2603034 - RNA, 13 nt, Escherichia coli CFT073
cucacgcagcuuc

SEQ ID NO: 2603035 - RNA, 21 nt, Escherichia coli CFT073
cucacgcauacaguaucgccu

SEQ ID NO: 2603036 - RNA, 12 nt, Escherichia coli CFT073
cucacgcaucaa

SEQ ID NO: 2603037 - RNA, 17 nt, Escherichia coli CFT073
cucacgcgccagcuuca

SEQ ID NO: 2603038 - RNA, 20 nt, Escherichia coli CFT073
cucacgcugcguacagcgcg

SEQ ID NO: 2603039 - RNA, 22 nt, Escherichia coli CFT073
cucacgggugagccacaaaccg

SEQ ID NO: 2603040 - RNA, 22 nt, Escherichia coli CFT073
cucacuaauugcaaacagagcg

SEQ ID NO: 2603041 - RNA, 21 nt, Escherichia coli CFT073
cucacuacguagucuuuaccg

SEQ ID NO: 2603042 - RNA, 17 nt, Escherichia coli CFT073
cucacuaucgccgagau

SEQ ID NO: 2603043 - RNA, 20 nt, Escherichia coli CFT073
cucacucaucacuccccgca

SEQ ID NO: 2603044 - RNA, 22 nt, Escherichia coli CFT073
cucacuucgcugacgccugcca

SEQ ID NO: 2603045 - RNA, 15 nt, Escherichia coli CFT073
cucagaaaucagaua

SEQ ID NO: 2603046 - RNA, 15 nt, Escherichia coli CFT073
cucagaaucacgcca

SEQ ID NO: 2603047 - RNA, 17 nt, Escherichia coli CFT073
cucagaaucacgccaac

SEQ ID NO: 2603048 - RNA, 15 nt, Escherichia coli CFT073
cucagaauucuggga

SEQ ID NO: 2603049 - RNA, 17 nt, Escherichia coli CFT073
cucagaauucugggaug

SEQ ID NO: 2603050 - RNA, 16 nt, Escherichia coli CFT073
cucagaccauauuccc

SEQ ID NO: 2603051 - RNA, 15 nt, Escherichia coli CFT073
cucagacucauuaaa

SEQ ID NO: 2603052 - RNA, 18 nt, Escherichia coli CFT073
cucagauaaaugcaaacg

SEQ ID NO: 2603053 - RNA, 15 nt, Escherichia coli CFT073
cucagcaacagguaa

SEQ ID NO: 2603054 - RNA, 15 nt, Escherichia coli CFT073
cucagcauauucuug

SEQ ID NO: 2603055 - RNA, 19 nt, Escherichia coli CFT073
cucagccaaauccagcgca

SEQ ID NO: 2603056 - RNA, 22 nt, Escherichia coli CFT073
cucagccaaauccagcgcaaag

SEQ ID NO: 2603057 - RNA, 19 nt, Escherichia coli CFT073
cucagccaaaucccgugau

SEQ ID NO: 2603058 - RNA, 22 nt, Escherichia coli CFT073
cucagcccagauuagccauucu

SEQ ID NO: 2603059 - RNA, 22 nt, Escherichia coli CFT073
cucagccugauagagugugugu

SEQ ID NO: 2603060 - RNA, 13 nt, Escherichia coli CFT073
cucagccuucugu

SEQ ID NO: 2603061 - RNA, 14 nt, Escherichia coli CFT073
cucagccuucugua

SEQ ID NO: 2603062 - RNA, 16 nt, Escherichia coli CFT073
cucagcgccugcugca

SEQ ID NO: 2603063 - RNA, 17 nt, Escherichia coli CFT073
cucagcggucaccggaa

SEQ ID NO: 2603064 - RNA, 11 nt, Escherichia coli CFT073
cucagcugcca

SEQ ID NO: 2603065 - RNA, 13 nt, Escherichia coli CFT073
cucaggaaaagca

SEQ ID NO: 2603066 - RNA, 17 nt, Escherichia coli CFT073
cucaggaaauugcacca

SEQ ID NO: 2603067 - RNA, 16 nt, Escherichia coli CFT073
cucaggaacuuaguag

SEQ ID NO: 2603068 - RNA, 23 nt, Escherichia coli CFT073
cucaggcaaagcuguuucagugu

SEQ ID NO: 2603069 - RNA, 19 nt, Escherichia coli CFT073
cucaggccgauuucaugaa

SEQ ID NO: 2603070 - RNA, 17 nt, Escherichia coli CFT073
cucaggcgaucagugau

SEQ ID NO: 2603071 - RNA, 17 nt, Escherichia coli CFT073
cucaggcgcacgccaac

SEQ ID NO: 2603072 - RNA, 22 nt, Escherichia coli CFT073
cucaggcgcacgccaacaaaaa

SEQ ID NO: 2603073 - RNA, 21 nt, Escherichia coli CFT073
cucaggcgguggaacaaguca

SEQ ID NO: 2603074 - RNA, 21 nt, Escherichia coli CFT073
cuccgagagauccugagaaau

SEQ ID NO: 2603075 - RNA, 19 nt, Escherichia coli CFT073
cuccgcacaaacgccaccu

SEQ ID NO: 2603076 - RNA, 19 nt, Escherichia coli CFT073
cuccgcaccgcgguacagc

SEQ ID NO: 2603077 - RNA, 15 nt, Escherichia coli CFT073
cuccgccacgucauc

SEQ ID NO: 2603078 - RNA, 13 nt, Escherichia coli CFT073
cuccgccagcaac

SEQ ID NO: 2603079 - RNA, 19 nt, Escherichia coli CFT073
cuccgccagugacugcgcc

SEQ ID NO: 2603080 - RNA, 20 nt, Escherichia coli CFT073
cuccgccagugacugcgccg

SEQ ID NO: 2603081 - RNA, 15 nt, Escherichia coli CFT073
cuccgccaucuucuu

SEQ ID NO: 2603082 - RNA, 20 nt, Escherichia coli CFT073
cuccgccggaaucaacggca

SEQ ID NO: 2603083 - RNA, 23 nt, Escherichia coli CFT073
cuccgcgaccuguuuugccaggc

SEQ ID NO: 2603084 - RNA, 21 nt, Escherichia coli CFT073
cuccgcguucaauacgcaguu

SEQ ID NO: 2603085 - RNA, 14 nt, Escherichia coli CFT073
cuccgcucuucauc

SEQ ID NO: 2603086 - RNA, 16 nt, Escherichia coli CFT073
cuccgcucuucaucuu

SEQ ID NO: 2603087 - RNA, 17 nt, Escherichia coli CFT073
cuccgcuuaucaggccu

SEQ ID NO: 2603088 - RNA, 17 nt, Escherichia coli CFT073
cuccggcacuucccccu

SEQ ID NO: 2603089 - RNA, 17 nt, Escherichia coli CFT073
cuccggcgcauccauga

SEQ ID NO: 2603090 - RNA, 17 nt, Escherichia coli CFT073
cuccggcuuuuugagau

SEQ ID NO: 2603091 - RNA, 13 nt, Escherichia coli CFT073
cuccgggcaugaa

SEQ ID NO: 2603092 - RNA, 18 nt, Escherichia coli CFT073
cuccgggcggcguauuua

SEQ ID NO: 2603093 - RNA, 20 nt, Escherichia coli CFT073
cuccgggugugacaacaaca

SEQ ID NO: 2603094 - RNA, 17 nt, Escherichia coli CFT073
cuccgguugguuaucuc

SEQ ID NO: 2603095 - RNA, 17 nt, Escherichia coli CFT073
cuccgguuucccggcaa

SEQ ID NO: 2603096 - RNA, 13 nt, Escherichia coli CFT073
cuccgucauccug

SEQ ID NO: 2603097 - RNA, 22 nt, Escherichia coli CFT073
cuccgucgggcuuaacguccgg

SEQ ID NO: 2603098 - RNA, 14 nt, Escherichia coli CFT073
cuccgucuggccag

SEQ ID NO: 2603099 - RNA, 21 nt, Escherichia coli CFT073
cuccgugggcuaacacugcca

SEQ ID NO: 2603100 - RNA, 17 nt, Escherichia coli CFT073
cuccucaacaaucguca

SEQ ID NO: 2603101 - RNA, 17 nt, Escherichia coli CFT073
cuccuccagcgcuucca

SEQ ID NO: 2603102 - RNA, 14 nt, Escherichia coli CFT073
cuccugaaacaauu

SEQ ID NO: 2603103 - RNA, 17 nt, Escherichia coli CFT073
cuccugaacuuucucuc

SEQ ID NO: 2603104 - RNA, 23 nt, Escherichia coli CFT073
cuccugagaauuccggcagagaa

SEQ ID NO: 2603105 - RNA, 15 nt, Escherichia coli CFT073
cuccugauuccaggu

SEQ ID NO: 2603106 - RNA, 19 nt, Escherichia coli CFT073
cuccugcaacagguuacgc

SEQ ID NO: 2603107 - RNA, 18 nt, Escherichia coli CFT073
cuccugcaagccaacgau

SEQ ID NO: 2603108 - RNA, 15 nt, Escherichia coli CFT073
cuccugccaguuaua

SEQ ID NO: 2603109 - RNA, 23 nt, Escherichia coli CFT073
cuccugcgggagcgcuuuuuccu

SEQ ID NO: 2603110 - RNA, 16 nt, Escherichia coli CFT073
cuccugcuacaccauu

SEQ ID NO: 2603111 - RNA, 23 nt, Escherichia coli CFT073
cuccuggcgaauuuguuccccau

SEQ ID NO: 2603112 - RNA, 20 nt, Escherichia coli CFT073
cuccugguucccgaugcugu

SEQ ID NO: 2603113 - RNA, 23 nt, Escherichia coli CFT073
cuccugguuguauggccugguga

SEQ ID NO: 2603114 - RNA, 11 nt, Escherichia coli CFT073
cuccuguucac

SEQ ID NO: 2603115 - RNA, 14 nt, Escherichia coli CFT073
cucgaaaucacugg

SEQ ID NO: 2603116 - RNA, 15 nt, Escherichia coli CFT073
cucgaacauccccac

SEQ ID NO: 2603117 - RNA, 23 nt, Escherichia coli CFT073
cucgaacauccccacagaaacaa

SEQ ID NO: 2603118 - RNA, 18 nt, Escherichia coli CFT073
cucgaaguuuuccucagu

SEQ ID NO: 2603119 - RNA, 22 nt, Escherichia coli CFT073
cucgaauacgccgauaucgcug

SEQ ID NO: 2603120 - RNA, 16 nt, Escherichia coli CFT073
cucgaauuauucagag

SEQ ID NO: 2603121 - RNA, 16 nt, Escherichia coli CFT073
cucgaauugucaccgu

SEQ ID NO: 2603122 - RNA, 20 nt, Escherichia coli CFT073
cucgacacccagcuucauca

SEQ ID NO: 2603123 - RNA, 21 nt, Escherichia coli CFT073
cucgacacccagcuucaucau

SEQ ID NO: 2603124 - RNA, 18 nt, Escherichia coli CFT073
cucgacagccucuuccag

SEQ ID NO: 2603125 - RNA, 16 nt, Escherichia coli CFT073
cucgacgcagcagacg

SEQ ID NO: 2603126 - RNA, 16 nt, Escherichia coli CFT073
cucgacgguugaauca

SEQ ID NO: 2603127 - RNA, 19 nt, Escherichia coli CFT073
cucgacuagauacugacga

SEQ ID NO: 2603128 - RNA, 13 nt, Escherichia coli CFT073
cucgacuuucgca

SEQ ID NO: 2603129 - RNA, 17 nt, Escherichia coli CFT073
cucgagagagaaaauaa

SEQ ID NO: 2603130 - RNA, 23 nt, Escherichia coli CFT073
cucgagccgcauccgacacuggc

SEQ ID NO: 2603131 - RNA, 13 nt, Escherichia coli CFT073
cucgaggaaaugc

SEQ ID NO: 2603132 - RNA, 22 nt, Escherichia coli CFT073
cucgauaccagauuaauuauug

SEQ ID NO: 2603133 - RNA, 13 nt, Escherichia coli CFT073
cucgaucaguuca

SEQ ID NO: 2603134 - RNA, 21 nt, Escherichia coli CFT073
cucgauguuguacaugcugcu

SEQ ID NO: 2603135 - RNA, 21 nt, Escherichia coli CFT073
cucgauuuuauaaagggaugc

SEQ ID NO: 2603136 - RNA, 15 nt, Escherichia coli CFT073
cucgcaaaauaaaaa

SEQ ID NO: 2603137 - RNA, 23 nt, Escherichia coli CFT073
cucgcaauuauaauacgcuugau

SEQ ID NO: 2603138 - RNA, 17 nt, Escherichia coli CFT073
cucgcagagaucauaca

SEQ ID NO: 2603139 - RNA, 19 nt, Escherichia coli CFT073
cucgcagcccguggcgcga

SEQ ID NO: 2603140 - RNA, 16 nt, Escherichia coli CFT073
cucgcaucccauugcg

SEQ ID NO: 2603141 - RNA, 17 nt, Escherichia coli CFT073
cucgccacgaucgguga

SEQ ID NO: 2603142 - RNA, 18 nt, Escherichia coli CFT073
cucgccacgucacucuuu

SEQ ID NO: 2603143 - RNA, 12 nt, Escherichia coli CFT073
cucgcccaugcg

SEQ ID NO: 2603144 - RNA, 16 nt, Escherichia coli CFT073
cucgccccgugaugaa

SEQ ID NO: 2603145 - RNA, 18 nt, Escherichia coli CFT073
cucgccccugcccuuuca

SEQ ID NO: 2603146 - RNA, 17 nt, Escherichia coli CFT073
cucgccgcaaaacccag

SEQ ID NO: 2603147 - RNA, 22 nt, Escherichia coli CFT073
cucgccgcaaaacccaggcuua

SEQ ID NO: 2603148 - RNA, 14 nt, Escherichia coli CFT073
cucgccgcagagau

SEQ ID NO: 2603149 - RNA, 15 nt, Escherichia coli CFT073
cucgccgcagagauc

SEQ ID NO: 2603150 - RNA, 13 nt, Escherichia coli CFT073
cucgccgccgcag

SEQ ID NO: 2603151 - RNA, 12 nt, Escherichia coli CFT073
cucgccuuauca

SEQ ID NO: 2603152 - RNA, 15 nt, Escherichia coli CFT073
cucgccuuucacacg

SEQ ID NO: 2603153 - RNA, 15 nt, Escherichia coli CFT073
cucgccuuuucgccc

SEQ ID NO: 2603154 - RNA, 17 nt, Escherichia coli CFT073
cucgcgaaccgccuggc

SEQ ID NO: 2603155 - RNA, 20 nt, Escherichia coli CFT073
cucgcgaaccgccuggcgcu

SEQ ID NO: 2603156 - RNA, 13 nt, Escherichia coli CFT073
cucgcgcaccuac

SEQ ID NO: 2603157 - RNA, 22 nt, Escherichia coli CFT073
cucgcgcagauagagcgccugc

SEQ ID NO: 2603158 - RNA, 16 nt, Escherichia coli CFT073
cucgcgcagcucauca

SEQ ID NO: 2603159 - RNA, 14 nt, Escherichia coli CFT073
cucgcgccgcaucc

SEQ ID NO: 2603160 - RNA, 18 nt, Escherichia coli CFT073
cucgcgcuugcggaagca

SEQ ID NO: 2603161 - RNA, 17 nt, Escherichia coli CFT073
cucgcgguagcccagcc

SEQ ID NO: 2603162 - RNA, 19 nt, Escherichia coli CFT073
cucgcgguuggcaaucagu

SEQ ID NO: 2603163 - RNA, 16 nt, Escherichia coli CFT073
cucgcgucuggcauuu

SEQ ID NO: 2603164 - RNA, 21 nt, Escherichia coli CFT073
cucgcguucgauagcgcgcca

SEQ ID NO: 2603165 - RNA, 18 nt, Escherichia coli CFT073
cucgcguucuguugccgc

SEQ ID NO: 2603166 - RNA, 20 nt, Escherichia coli CFT073
cucgcguucuguugccgcua

SEQ ID NO: 2603167 - RNA, 16 nt, Escherichia coli CFT073
cucgcucgagagagaa

SEQ ID NO: 2603168 - RNA, 16 nt, Escherichia coli CFT073
cucgcucucgccgcgc

SEQ ID NO: 2603169 - RNA, 22 nt, Escherichia coli CFT073
cucgcugacaucaacaauucgu

SEQ ID NO: 2603170 - RNA, 20 nt, Escherichia coli CFT073
cucgcugcgaaguuuuuccg

SEQ ID NO: 2603171 - RNA, 22 nt, Escherichia coli CFT073
cucgcugcucacaccaugccag

SEQ ID NO: 2603172 - RNA, 21 nt, Escherichia coli CFT073
cucgcuggcguuguccgccag

SEQ ID NO: 2603173 - RNA, 23 nt, Escherichia coli CFT073
cucgcuggcguuguccgccagaa

SEQ ID NO: 2603174 - RNA, 20 nt, Escherichia coli CFT073
cucggaaugccggaaucaga

SEQ ID NO: 2603175 - RNA, 17 nt, Escherichia coli CFT073
cucggacaauaguuuca

SEQ ID NO: 2603176 - RNA, 12 nt, Escherichia coli CFT073
cucggccaccgu

SEQ ID NO: 2603177 - RNA, 20 nt, Escherichia coli CFT073
cucggcgagcaacgcagcgg

SEQ ID NO: 2603178 - RNA, 14 nt, Escherichia coli CFT073
cucggcgcggaugc

SEQ ID NO: 2603179 - RNA, 21 nt, Escherichia coli CFT073
cucggcgcuaaucaugucugg

SEQ ID NO: 2603180 - RNA, 22 nt, Escherichia coli CFT073
cucggcgggcaacguuccagca

SEQ ID NO: 2603181 - RNA, 16 nt, Escherichia coli CFT073
cucggcugccuggaua

SEQ ID NO: 2603182 - RNA, 19 nt, Escherichia coli CFT073
cucuuccagcgucuccaga

SEQ ID NO: 2603183 - RNA, 17 nt, Escherichia coli CFT073
cucuuccagguaagcaa

SEQ ID NO: 2603184 - RNA, 12 nt, Escherichia coli CFT073
cucuuccggcgu

SEQ ID NO: 2603185 - RNA, 19 nt, Escherichia coli CFT073
cucuuccgguguaucaggg

SEQ ID NO: 2603186 - RNA, 23 nt, Escherichia coli CFT073
cucuucgacaaucgcaaauaugu

SEQ ID NO: 2603187 - RNA, 15 nt, Escherichia coli CFT073
cucuucggcaagugu

SEQ ID NO: 2603188 - RNA, 17 nt, Escherichia coli CFT073
cucuucggcuucuaccu

SEQ ID NO: 2603189 - RNA, 17 nt, Escherichia coli CFT073
cucuucgguaaugcacu

SEQ ID NO: 2603190 - RNA, 21 nt, Escherichia coli CFT073
cucuucgguaaugcacuccgc

SEQ ID NO: 2603191 - RNA, 20 nt, Escherichia coli CFT073
cucuucguggcccgccagca

SEQ ID NO: 2603192 - RNA, 17 nt, Escherichia coli CFT073
cucuucguuuucaacgu

SEQ ID NO: 2603193 - RNA, 14 nt, Escherichia coli CFT073
cucuucuacauuuc

SEQ ID NO: 2603194 - RNA, 15 nt, Escherichia coli CFT073
cucuucuaguucaug

SEQ ID NO: 2603195 - RNA, 20 nt, Escherichia coli CFT073
cucuucuaguucauguauuu

SEQ ID NO: 2603196 - RNA, 22 nt, Escherichia coli CFT073
cucuucugcuuuacccacgcuu

SEQ ID NO: 2603197 - RNA, 12 nt, Escherichia coli CFT073
cucuucuuuaau

SEQ ID NO: 2603198 - RNA, 19 nt, Escherichia coli CFT073
cucuugauacguuauaucu

SEQ ID NO: 2603199 - RNA, 21 nt, Escherichia coli CFT073
cucuugcauuguguaauuaau

SEQ ID NO: 2603200 - RNA, 13 nt, Escherichia coli CFT073
cucuuuaaacaga

SEQ ID NO: 2603201 - RNA, 18 nt, Escherichia coli CFT073
cucuuuaaacagauagcc

SEQ ID NO: 2603202 - RNA, 23 nt, Escherichia coli CFT073
cucuuuaccggucaugucggcau

SEQ ID NO: 2603203 - RNA, 18 nt, Escherichia coli CFT073
cucuuuagcauucagcgu

SEQ ID NO: 2603204 - RNA, 16 nt, Escherichia coli CFT073
cucuuuauuuccugcg

SEQ ID NO: 2603205 - RNA, 21 nt, Escherichia coli CFT073
cucuuuauuuccugcgcaaua

SEQ ID NO: 2603206 - RNA, 12 nt, Escherichia coli CFT073
cucuuucaccaa

SEQ ID NO: 2603207 - RNA, 19 nt, Escherichia coli CFT073
cucuuucaggccgcgcagu

SEQ ID NO: 2603208 - RNA, 15 nt, Escherichia coli CFT073
cucuuuccauccggu

SEQ ID NO: 2603209 - RNA, 13 nt, Escherichia coli CFT073
cucuuucuucagc

SEQ ID NO: 2603210 - RNA, 23 nt, Escherichia coli CFT073
cucuuugcgguuaaagcaguacg

SEQ ID NO: 2603211 - RNA, 20 nt, Escherichia coli CFT073
cucuuugggcagaaaaucca

SEQ ID NO: 2603212 - RNA, 18 nt, Escherichia coli CFT073
cucuuugugacaaacuaa

SEQ ID NO: 2603213 - RNA, 23 nt, Escherichia coli CFT073
cucuuugugacaaacuaaccaga

SEQ ID NO: 2603214 - RNA, 17 nt, Escherichia coli CFT073
cugaaaaggcuaaaauu

SEQ ID NO: 2603215 - RNA, 19 nt, Escherichia coli CFT073
cugaaaaggcuaaaauugu

SEQ ID NO: 2603216 - RNA, 21 nt, Escherichia coli CFT073
cugaaaagguuacucccggau

SEQ ID NO: 2603217 - RNA, 17 nt, Escherichia coli CFT073
cugaaaauauucccguc

SEQ ID NO: 2603218 - RNA, 20 nt, Escherichia coli CFT073
cugaaaaugaaauaaaacaa

SEQ ID NO: 2603219 - RNA, 16 nt, Escherichia coli CFT073
cugaaacaugaacauc

SEQ ID NO: 2603220 - RNA, 13 nt, Escherichia coli CFT073
cugaaaccaccau

SEQ ID NO: 2603221 - RNA, 22 nt, Escherichia coli CFT073
cugaaacgcggcguaaccaccc

SEQ ID NO: 2603222 - RNA, 20 nt, Escherichia coli CFT073
cugaaacucgaccaguagcu

SEQ ID NO: 2603223 - RNA, 15 nt, Escherichia coli CFT073
cugaaacucgaugac

SEQ ID NO: 2603224 - RNA, 17 nt, Escherichia coli CFT073
cugaaagcugagaaaau

SEQ ID NO: 2603225 - RNA, 19 nt, Escherichia coli CFT073
cugaaaggcacucauuuuc

SEQ ID NO: 2603226 - RNA, 12 nt, Escherichia coli CFT073
cugaaagggaag

SEQ ID NO: 2603227 - RNA, 21 nt, Escherichia coli CFT073
cugaaagugacacugucaccu

SEQ ID NO: 2603228 - RNA, 18 nt, Escherichia coli CFT073
cugaaaucaccgccacca

SEQ ID NO: 2603229 - RNA, 22 nt, Escherichia coli CFT073
cugaaaucaccgccaccagcgu

SEQ ID NO: 2603230 - RNA, 19 nt, Escherichia coli CFT073
cugaaaugugcgcaaugcu

SEQ ID NO: 2603231 - RNA, 22 nt, Escherichia coli CFT073
cugaacaacaguuuuaucucca

SEQ ID NO: 2603232 - RNA, 14 nt, Escherichia coli CFT073
cugaacaagcaaga

SEQ ID NO: 2603233 - RNA, 17 nt, Escherichia coli CFT073
cugaacaagcaagagug

SEQ ID NO: 2603234 - RNA, 15 nt, Escherichia coli CFT073
cugaacagucgcuga

SEQ ID NO: 2603235 - RNA, 17 nt, Escherichia coli CFT073
cugaacgagaaaagcca

SEQ ID NO: 2603236 - RNA, 15 nt, Escherichia coli CFT073
cugaacgcaccuucc

SEQ ID NO: 2603237 - RNA, 13 nt, Escherichia coli CFT073
cugaacgccugca

SEQ ID NO: 2603238 - RNA, 16 nt, Escherichia coli CFT073
cugaacgccugcacca

SEQ ID NO: 2603239 - RNA, 18 nt, Escherichia coli CFT073
cugaacgccugcaccagc

SEQ ID NO: 2603240 - RNA, 22 nt, Escherichia coli CFT073
cugaacgcuucaccacgcccca

SEQ ID NO: 2603241 - RNA, 15 nt, Escherichia coli CFT073
cugaacggucgaggc

SEQ ID NO: 2603242 - RNA, 15 nt, Escherichia coli CFT073
cugaacgugaaaugu

SEQ ID NO: 2603243 - RNA, 20 nt, Escherichia coli CFT073
cugaacuuguuuacaaauaa

SEQ ID NO: 2603244 - RNA, 21 nt, Escherichia coli CFT073
cugaagaaaauccucaacgcc

SEQ ID NO: 2603245 - RNA, 20 nt, Escherichia coli CFT073
cugaagaaguaaaacagucg

SEQ ID NO: 2603246 - RNA, 15 nt, Escherichia coli CFT073
cugaagaucaacguc

SEQ ID NO: 2603247 - RNA, 17 nt, Escherichia coli CFT073
cugaagauugaacagca

SEQ ID NO: 2603248 - RNA, 19 nt, Escherichia coli CFT073
cugaagauugaacagcaga

SEQ ID NO: 2603249 - RNA, 14 nt, Escherichia coli CFT073
cugaagcaguuuca

SEQ ID NO: 2603250 - RNA, 13 nt, Escherichia coli CFT073
cugaagcauauuc

SEQ ID NO: 2603251 - RNA, 18 nt, Escherichia coli CFT073
cugaagcgaccaccaccc

SEQ ID NO: 2603252 - RNA, 13 nt, Escherichia coli CFT073
cugaagcgcgccu

SEQ ID NO: 2603253 - RNA, 14 nt, Escherichia coli CFT073
cugaagcgcgccug

SEQ ID NO: 2603254 - RNA, 15 nt, Escherichia coli CFT073
cugaagcgucuuauc

SEQ ID NO: 2603255 - RNA, 19 nt, Escherichia coli CFT073
cugaagcuaaaaccugcac

SEQ ID NO: 2603256 - RNA, 19 nt, Escherichia coli CFT073
cugaaggauuagacgaaua

SEQ ID NO: 2603257 - RNA, 13 nt, Escherichia coli CFT073
cugaaggcaaacg

SEQ ID NO: 2603258 - RNA, 14 nt, Escherichia coli CFT073
cugaaggcgcauug

SEQ ID NO: 2603259 - RNA, 19 nt, Escherichia coli CFT073
cugaaggggucuucuuccg

SEQ ID NO: 2603260 - RNA, 23 nt, Escherichia coli CFT073
cugaaguaaagaaacugguugca

SEQ ID NO: 2603261 - RNA, 19 nt, Escherichia coli CFT073
cugaagucggcuucuggcc

SEQ ID NO: 2603262 - RNA, 15 nt, Escherichia coli CFT073
cugaauaaacgccau

SEQ ID NO: 2603263 - RNA, 11 nt, Escherichia coli CFT073
cugaauaauca

SEQ ID NO: 2603264 - RNA, 11 nt, Escherichia coli CFT073
cugaauaaucc

SEQ ID NO: 2603265 - RNA, 16 nt, Escherichia coli CFT073
cugaauacacugcuga

SEQ ID NO: 2603266 - RNA, 17 nt, Escherichia coli CFT073
cugaauacacugcugau

SEQ ID NO: 2603267 - RNA, 23 nt, Escherichia coli CFT073
cugaauacacugcugauaaucca

SEQ ID NO: 2603268 - RNA, 17 nt, Escherichia coli CFT073
cugaauacccgccagaa

SEQ ID NO: 2603269 - RNA, 14 nt, Escherichia coli CFT073
cugaauaccguaaa

SEQ ID NO: 2603270 - RNA, 19 nt, Escherichia coli CFT073
cugaauaccguaaaacuca

SEQ ID NO: 2603271 - RNA, 19 nt, Escherichia coli CFT073
cugaauacgauccgacauc

SEQ ID NO: 2603272 - RNA, 20 nt, Escherichia coli CFT073
cugaauagugccgcaccagc

SEQ ID NO: 2603273 - RNA, 16 nt, Escherichia coli CFT073
cugaauaucaucaccc

SEQ ID NO: 2603274 - RNA, 17 nt, Escherichia coli CFT073
cugaauauccugacuuu

SEQ ID NO: 2603275 - RNA, 21 nt, Escherichia coli CFT073
cugaauauucggcuccagauu

SEQ ID NO: 2603276 - RNA, 16 nt, Escherichia coli CFT073
cugaaucagccaguaa

SEQ ID NO: 2603277 - RNA, 14 nt, Escherichia coli CFT073
cugaaucaggaacc

SEQ ID NO: 2603278 - RNA, 17 nt, Escherichia coli CFT073
cugaauccacuggcugu

SEQ ID NO: 2603279 - RNA, 13 nt, Escherichia coli CFT073
cugaaucgccgaa

SEQ ID NO: 2603280 - RNA, 16 nt, Escherichia coli CFT073
cugaaucugagcauuu

SEQ ID NO: 2603281 - RNA, 16 nt, Escherichia coli CFT073
cugaaucuggcuucau

SEQ ID NO: 2603282 - RNA, 20 nt, Escherichia coli CFT073
cugaauggauucagucuuaa

SEQ ID NO: 2603283 - RNA, 23 nt, Escherichia coli CFT073
cugaauggcgauuucacaagacu

SEQ ID NO: 2603284 - RNA, 20 nt, Escherichia coli CFT073
cugaauuaucuauauuuauu

SEQ ID NO: 2603285 - RNA, 22 nt, Escherichia coli CFT073
cugaauucccccauugaaacga

SEQ ID NO: 2603286 - RNA, 13 nt, Escherichia coli CFT073
cugaauuccccuc

SEQ ID NO: 2603287 - RNA, 20 nt, Escherichia coli CFT073
cugaauugacuacaaaaaaa

SEQ ID NO: 2603288 - RNA, 15 nt, Escherichia coli CFT073
cugaauuggguucuu

SEQ ID NO: 2603289 - RNA, 22 nt, Escherichia coli CFT073
cugaauuggguucuuuccugcg

SEQ ID NO: 2603290 - RNA, 17 nt, Escherichia coli CFT073
cugagucagcagcgcca

SEQ ID NO: 2603291 - RNA, 20 nt, Escherichia coli CFT073
cugagucggaacuuugcugc

SEQ ID NO: 2603292 - RNA, 18 nt, Escherichia coli CFT073
cugagugcgaaaaucaau

SEQ ID NO: 2603293 - RNA, 19 nt, Escherichia coli CFT073
cugagugcgaaaaucaaua

SEQ ID NO: 2603294 - RNA, 20 nt, Escherichia coli CFT073
cugaguggugagauugcugc

SEQ ID NO: 2603295 - RNA, 14 nt, Escherichia coli CFT073
cugaguuaauuaaa

SEQ ID NO: 2603296 - RNA, 14 nt, Escherichia coli CFT073
cugaguuacgucca

SEQ ID NO: 2603297 - RNA, 16 nt, Escherichia coli CFT073
cugaguuuuauucuuu

SEQ ID NO: 2603298 - RNA, 12 nt, Escherichia coli CFT073
cugauaaaaaac

SEQ ID NO: 2603299 - RNA, 14 nt, Escherichia coli CFT073
cugauaaaaaaccc

SEQ ID NO: 2603300 - RNA, 18 nt, Escherichia coli CFT073
cugauaaaacgcgcagcg

SEQ ID NO: 2603301 - RNA, 13 nt, Escherichia coli CFT073
cugauaaaucccg

SEQ ID NO: 2603302 - RNA, 14 nt, Escherichia coli CFT073
cugauaaaucccgc

SEQ ID NO: 2603303 - RNA, 18 nt, Escherichia coli CFT073
cugauaaaugaagaaaaa

SEQ ID NO: 2603304 - RNA, 18 nt, Escherichia coli CFT073
cugauaaccgccgccaaa

SEQ ID NO: 2603305 - RNA, 19 nt, Escherichia coli CFT073
cugauaaccgccgccaaac

SEQ ID NO: 2603306 - RNA, 17 nt, Escherichia coli CFT073
cugauaaccuuccagcu

SEQ ID NO: 2603307 - RNA, 18 nt, Escherichia coli CFT073
cugauaaccuuccagcuu

SEQ ID NO: 2603308 - RNA, 20 nt, Escherichia coli CFT073
cugauaacgaaucgggcaaa

SEQ ID NO: 2603309 - RNA, 15 nt, Escherichia coli CFT073
cugauaacgccacgc

SEQ ID NO: 2603310 - RNA, 20 nt, Escherichia coli CFT073
cugauaagacgcgccagcgu

SEQ ID NO: 2603311 - RNA, 19 nt, Escherichia coli CFT073
cugauaagacgcggcccgc

SEQ ID NO: 2603312 - RNA, 20 nt, Escherichia coli CFT073
cugauaagcguagcgcagca

SEQ ID NO: 2603313 - RNA, 22 nt, Escherichia coli CFT073
cugauaaggaucuggauaaaua

SEQ ID NO: 2603314 - RNA, 18 nt, Escherichia coli CFT073
cugauaaggcauuuacgc

SEQ ID NO: 2603315 - RNA, 14 nt, Escherichia coli CFT073
cugauaauaaauaa

SEQ ID NO: 2603316 - RNA, 12 nt, Escherichia coli CFT073
cugauaauaaua

SEQ ID NO: 2603317 - RNA, 16 nt, Escherichia coli CFT073
cugauaaucggggauc

SEQ ID NO: 2603318 - RNA, 20 nt, Escherichia coli CFT073
cugauaauuucagcacuuga

SEQ ID NO: 2603319 - RNA, 15 nt, Escherichia coli CFT073
cugauacccggcaca

SEQ ID NO: 2603320 - RNA, 20 nt, Escherichia coli CFT073
cugauacccggcuaacaguc

SEQ ID NO: 2603321 - RNA, 19 nt, Escherichia coli CFT073
cugauaccgcguuggcgca

SEQ ID NO: 2603322 - RNA, 17 nt, Escherichia coli CFT073
cugauacuauucauugc

SEQ ID NO: 2603323 - RNA, 19 nt, Escherichia coli CFT073
cugauagcggcggauuuca

SEQ ID NO: 2603324 - RNA, 16 nt, Escherichia coli CFT073
cugauaguaguuugau

SEQ ID NO: 2603325 - RNA, 18 nt, Escherichia coli CFT073
cugauagugcccggcaau

SEQ ID NO: 2603326 - RNA, 16 nt, Escherichia coli CFT073
cugauagugcugccau

SEQ ID NO: 2603327 - RNA, 15 nt, Escherichia coli CFT073
cugauauacccuuca

SEQ ID NO: 2603328 - RNA, 17 nt, Escherichia coli CFT073
cugauauaucaccuucc

SEQ ID NO: 2603329 - RNA, 21 nt, Escherichia coli CFT073
cugauauaucaccuuccagaa

SEQ ID NO: 2603330 - RNA, 14 nt, Escherichia coli CFT073
cugauaucaccugc

SEQ ID NO: 2603331 - RNA, 12 nt, Escherichia coli CFT073
cugauauccagc

SEQ ID NO: 2603332 - RNA, 21 nt, Escherichia coli CFT073
cugauaucggcucauaaaaac

SEQ ID NO: 2603333 - RNA, 23 nt, Escherichia coli CFT073
cugauaucggcucauaaaaacuc

SEQ ID NO: 2603334 - RNA, 17 nt, Escherichia coli CFT073
cugauauggugguaacu

SEQ ID NO: 2603335 - RNA, 15 nt, Escherichia coli CFT073
cugauauucagcgcc

SEQ ID NO: 2603336 - RNA, 16 nt, Escherichia coli CFT073
cugauauucagcgccc

SEQ ID NO: 2603337 - RNA, 18 nt, Escherichia coli CFT073
cugauauugcuccagacg

SEQ ID NO: 2603338 - RNA, 22 nt, Escherichia coli CFT073
cugauauuuaaacgguguaaaa

SEQ ID NO: 2603339 - RNA, 15 nt, Escherichia coli CFT073
cugaucaaagaccgg

SEQ ID NO: 2603340 - RNA, 21 nt, Escherichia coli CFT073
cugaucaauaaauuuuuucug

SEQ ID NO: 2603341 - RNA, 15 nt, Escherichia coli CFT073
cugaucaauaaucuc

SEQ ID NO: 2603342 - RNA, 16 nt, Escherichia coli CFT073
cugaucaauaucagca

SEQ ID NO: 2603343 - RNA, 13 nt, Escherichia coli CFT073
cugaucagcacga

SEQ ID NO: 2603344 - RNA, 14 nt, Escherichia coli CFT073
cugauccgcuucgg

SEQ ID NO: 2603345 - RNA, 14 nt, Escherichia coli CFT073
cugauccugacaag

SEQ ID NO: 2603346 - RNA, 18 nt, Escherichia coli CFT073
cugaucgacaguugcugc

SEQ ID NO: 2603347 - RNA, 21 nt, Escherichia coli CFT073
cugaucgauaaauucguuuuc

SEQ ID NO: 2603348 - RNA, 22 nt, Escherichia coli CFT073
cugaucgucagcacucacgcca

SEQ ID NO: 2603349 - RNA, 16 nt, Escherichia coli CFT073
cugaucguccugcggu

SEQ ID NO: 2603350 - RNA, 16 nt, Escherichia coli CFT073
cugaucgugcucgaca

SEQ ID NO: 2603351 - RNA, 13 nt, Escherichia coli CFT073
cugaucuacagcc

SEQ ID NO: 2603352 - RNA, 15 nt, Escherichia coli CFT073
cugaucuuauugguu

SEQ ID NO: 2603353 - RNA, 21 nt, Escherichia coli CFT073
cugaucuuuaucaagcaccaa

SEQ ID NO: 2603354 - RNA, 15 nt, Escherichia coli CFT073
cugaugaaagcaugu

SEQ ID NO: 2603355 - RNA, 13 nt, Escherichia coli CFT073
cugaugaaguuga

SEQ ID NO: 2603356 - RNA, 23 nt, Escherichia coli CFT073
cugaugacaaacgcaaaacugcc

SEQ ID NO: 2603357 - RNA, 12 nt, Escherichia coli CFT073
cugaugagcaaa

SEQ ID NO: 2603358 - RNA, 15 nt, Escherichia coli CFT073
cugaugauauuuuuc

SEQ ID NO: 2603359 - RNA, 19 nt, Escherichia coli CFT073
cugaugauauuuuucccug

SEQ ID NO: 2603360 - RNA, 19 nt, Escherichia coli CFT073
cugaugauccuggauuucu

SEQ ID NO: 2603361 - RNA, 23 nt, Escherichia coli CFT073
cugaugcagguacucaccguuga

SEQ ID NO: 2603362 - RNA, 18 nt, Escherichia coli CFT073
cugaugcaucaacaucau

SEQ ID NO: 2603363 - RNA, 15 nt, Escherichia coli CFT073
cugaugcccaaaaaa

SEQ ID NO: 2603364 - RNA, 21 nt, Escherichia coli CFT073
cugaugcccaaaaaaacggca

SEQ ID NO: 2603365 - RNA, 16 nt, Escherichia coli CFT073
cugaugcgacgcaggu

SEQ ID NO: 2603366 - RNA, 15 nt, Escherichia coli CFT073
cugaugcgacgccga

SEQ ID NO: 2603367 - RNA, 16 nt, Escherichia coli CFT073
cugaugcgacgcggca

SEQ ID NO: 2603368 - RNA, 22 nt, Escherichia coli CFT073
cugaugcgacgcugauagcguc

SEQ ID NO: 2603369 - RNA, 17 nt, Escherichia coli CFT073
cugaugcgaugcuggcg

SEQ ID NO: 2603370 - RNA, 18 nt, Escherichia coli CFT073
cugaugcgaugcuggcgc

SEQ ID NO: 2603371 - RNA, 23 nt, Escherichia coli CFT073
cugaugcugugaauauucauuuc

SEQ ID NO: 2603372 - RNA, 12 nt, Escherichia coli CFT073
cugaugcuucag

SEQ ID NO: 2603373 - RNA, 21 nt, Escherichia coli CFT073
cugaugcuuuccgccgucauc

SEQ ID NO: 2603374 - RNA, 19 nt, Escherichia coli CFT073
cugauggaagacauagcac

SEQ ID NO: 2603375 - RNA, 20 nt, Escherichia coli CFT073
cugauggaagugacaccggu

SEQ ID NO: 2603376 - RNA, 14 nt, Escherichia coli CFT073
cugauggcgcgcca

SEQ ID NO: 2603377 - RNA, 23 nt, Escherichia coli CFT073
cugauggcuguuuucagcaccag

SEQ ID NO: 2603378 - RNA, 16 nt, Escherichia coli CFT073
cugauggucggcgggc

SEQ ID NO: 2603379 - RNA, 19 nt, Escherichia coli CFT073
cugaugguuuuaauacugc

SEQ ID NO: 2603380 - RNA, 21 nt, Escherichia coli CFT073
cugauguacccgcugcaacuc

SEQ ID NO: 2603381 - RNA, 19 nt, Escherichia coli CFT073
cugauguagcgugauuuuu

SEQ ID NO: 2603382 - RNA, 14 nt, Escherichia coli CFT073
cugaugugcuccau

SEQ ID NO: 2603383 - RNA, 20 nt, Escherichia coli CFT073
cugaugugcuccgcucauca

SEQ ID NO: 2603384 - RNA, 15 nt, Escherichia coli CFT073
cugauguucgccaga

SEQ ID NO: 2603385 - RNA, 22 nt, Escherichia coli CFT073
cugauguugaaugugaccgacc

SEQ ID NO: 2603386 - RNA, 15 nt, Escherichia coli CFT073
cugauguugauaaaa

SEQ ID NO: 2603387 - RNA, 17 nt, Escherichia coli CFT073
cugauguuguuucucuu

SEQ ID NO: 2603388 - RNA, 14 nt, Escherichia coli CFT073
cugauuaacgcuug

SEQ ID NO: 2603389 - RNA, 21 nt, Escherichia coli CFT073
cugauuaacgcuuguaaauga

SEQ ID NO: 2603390 - RNA, 22 nt, Escherichia coli CFT073
cugauuaacuugcgacagccau

SEQ ID NO: 2603391 - RNA, 21 nt, Escherichia coli CFT073
cugauuaagaucgugcagcac

SEQ ID NO: 2603392 - RNA, 18 nt, Escherichia coli CFT073
cugauuaauauugaggau

SEQ ID NO: 2603393 - RNA, 20 nt, Escherichia coli CFT073
cugauuaccuaccaacgcac

SEQ ID NO: 2603394 - RNA, 16 nt, Escherichia coli CFT073
cugauuacucauuaau

SEQ ID NO: 2603395 - RNA, 19 nt, Escherichia coli CFT073
cugauuacucauuaaucaa

SEQ ID NO: 2603396 - RNA, 13 nt, Escherichia coli CFT073
cugauucaagauu

SEQ ID NO: 2603397 - RNA, 17 nt, Escherichia coli CFT073
cugauuccgggccacca

SEQ ID NO: 2603398 - RNA, 12 nt, Escherichia coli CFT073
cugcauuugcgc

SEQ ID NO: 2603399 - RNA, 20 nt, Escherichia coli CFT073
cugccaaacgcucccagcca

SEQ ID NO: 2603400 - RNA, 22 nt, Escherichia coli CFT073
cugccaaacgcucccagccagu

SEQ ID NO: 2603401 - RNA, 23 nt, Escherichia coli CFT073
cugccaaccguaacgacggcuau

SEQ ID NO: 2603402 - RNA, 20 nt, Escherichia coli CFT073
cugccaauggcaggaucugg

SEQ ID NO: 2603403 - RNA, 15 nt, Escherichia coli CFT073
cugccacauccccuc

SEQ ID NO: 2603404 - RNA, 17 nt, Escherichia coli CFT073
cugccacauccccuccc

SEQ ID NO: 2603405 - RNA, 21 nt, Escherichia coli CFT073
cugccaccaggaacgcgccaa

SEQ ID NO: 2603406 - RNA, 14 nt, Escherichia coli CFT073
cugccacgccacgc

SEQ ID NO: 2603407 - RNA, 15 nt, Escherichia coli CFT073
cugccacuacccgca

SEQ ID NO: 2603408 - RNA, 19 nt, Escherichia coli CFT073
cugccacucuccugguugu

SEQ ID NO: 2603409 - RNA, 24 nt, Escherichia coli CFT073
cugccagaaacgccugaucgagca

SEQ ID NO: 2603410 - RNA, 21 nt, Escherichia coli CFT073
cugccagaaaucggccuucca

SEQ ID NO: 2603411 - RNA, 19 nt, Escherichia coli CFT073
cugccagaaccgcuucuuc

SEQ ID NO: 2603412 - RNA, 15 nt, Escherichia coli CFT073
cugccagaagcagaa

SEQ ID NO: 2603413 - RNA, 18 nt, Escherichia coli CFT073
cugccagacaaaacugac

SEQ ID NO: 2603414 - RNA, 22 nt, Escherichia coli CFT073
cugccagaccuuaucacaaucg

SEQ ID NO: 2603415 - RNA, 19 nt, Escherichia coli CFT073
cugccagagcugaauauca

SEQ ID NO: 2603416 - RNA, 20 nt, Escherichia coli CFT073
cugccagagucagcaaugcc

SEQ ID NO: 2603417 - RNA, 23 nt, Escherichia coli CFT073
cugccagagucagcaaugccaga

SEQ ID NO: 2603418 - RNA, 12 nt, Escherichia coli CFT073
cugccagaugca

SEQ ID NO: 2603419 - RNA, 17 nt, Escherichia coli CFT073
cugccagauucuccagc

SEQ ID NO: 2603420 - RNA, 17 nt, Escherichia coli CFT073
cugccagcaagcgcacc

SEQ ID NO: 2603421 - RNA, 15 nt, Escherichia coli CFT073
cugccagcacugcca

SEQ ID NO: 2603422 - RNA, 15 nt, Escherichia coli CFT073
cugccagcaucucca

SEQ ID NO: 2603423 - RNA, 13 nt, Escherichia coli CFT073
cugccagcccgcu

SEQ ID NO: 2603424 - RNA, 14 nt, Escherichia coli CFT073
cugccagcccggca

SEQ ID NO: 2603425 - RNA, 22 nt, Escherichia coli CFT073
cugccagcccggcagcuuuaau

SEQ ID NO: 2603426 - RNA, 13 nt, Escherichia coli CFT073
cugccagcgccga

SEQ ID NO: 2603427 - RNA, 18 nt, Escherichia coli CFT073
cugccagcguaccaugau

SEQ ID NO: 2603428 - RNA, 15 nt, Escherichia coli CFT073
cugccagcguggcga

SEQ ID NO: 2603429 - RNA, 12 nt, Escherichia coli CFT073
cugccagcucuc

SEQ ID NO: 2603430 - RNA, 17 nt, Escherichia coli CFT073
cugccagcuugcgaucc

SEQ ID NO: 2603431 - RNA, 12 nt, Escherichia coli CFT073
cugccaggcagc

SEQ ID NO: 2603432 - RNA, 12 nt, Escherichia coli CFT073
cugccaggcugc

SEQ ID NO: 2603433 - RNA, 16 nt, Escherichia coli CFT073
cugccagggcacugau

SEQ ID NO: 2603434 - RNA, 22 nt, Escherichia coli CFT073
cugccagggucaguuucaccuc

SEQ ID NO: 2603435 - RNA, 20 nt, Escherichia coli CFT073
cugccaggucgugccagaaa

SEQ ID NO: 2603436 - RNA, 17 nt, Escherichia coli CFT073
cugccaggugcagccca

SEQ ID NO: 2603437 - RNA, 20 nt, Escherichia coli CFT073
cugccaguaaagcagcgaag

SEQ ID NO: 2603438 - RNA, 15 nt, Escherichia coli CFT073
cugccaguaagcagu

SEQ ID NO: 2603439 - RNA, 14 nt, Escherichia coli CFT073
cugccaguaauucc

SEQ ID NO: 2603440 - RNA, 22 nt, Escherichia coli CFT073
cugccagucggggggaggcugc

SEQ ID NO: 2603441 - RNA, 19 nt, Escherichia coli CFT073
cugccaguuucgucaguuc

SEQ ID NO: 2603442 - RNA, 12 nt, Escherichia coli CFT073
cugccaucacua

SEQ ID NO: 2603443 - RNA, 12 nt, Escherichia coli CFT073
cugccaugcagu

SEQ ID NO: 2603444 - RNA, 14 nt, Escherichia coli CFT073
cugccaugccaaac

SEQ ID NO: 2603445 - RNA, 22 nt, Escherichia coli CFT073
cugccaugucagacaacaugcc

SEQ ID NO: 2603446 - RNA, 15 nt, Escherichia coli CFT073
cugccauuagcguau

SEQ ID NO: 2603447 - RNA, 22 nt, Escherichia coli CFT073
cugccauuggcaggcucugacu

SEQ ID NO: 2603448 - RNA, 16 nt, Escherichia coli CFT073
cugccauuguugcugg

SEQ ID NO: 2603449 - RNA, 18 nt, Escherichia coli CFT073
cugccauuguugcuggau

SEQ ID NO: 2603450 - RNA, 23 nt, Escherichia coli CFT073
cugcccacgcgguauggucacug

SEQ ID NO: 2603451 - RNA, 21 nt, Escherichia coli CFT073
cugcccagccgguaaggccaa

SEQ ID NO: 2603452 - RNA, 21 nt, Escherichia coli CFT073
cugcccaggcaaaaaggccua

SEQ ID NO: 2603453 - RNA, 13 nt, Escherichia coli CFT073
cugcccaucaucg

SEQ ID NO: 2603454 - RNA, 15 nt, Escherichia coli CFT073
cugccccagagacaa

SEQ ID NO: 2603455 - RNA, 15 nt, Escherichia coli CFT073
cugccccagugggcu

SEQ ID NO: 2603456 - RNA, 16 nt, Escherichia coli CFT073
cugccccaucugcccc

SEQ ID NO: 2603457 - RNA, 18 nt, Escherichia coli CFT073
cugccccgccaacagugc

SEQ ID NO: 2603458 - RNA, 20 nt, Escherichia coli CFT073
cugccccgccaacagugccg

SEQ ID NO: 2603459 - RNA, 16 nt, Escherichia coli CFT073
cugccccgccagugcu

SEQ ID NO: 2603460 - RNA, 16 nt, Escherichia coli CFT073
cugcccgaacagcaac

SEQ ID NO: 2603461 - RNA, 17 nt, Escherichia coli CFT073
cugcccgcgauccagcg

SEQ ID NO: 2603462 - RNA, 15 nt, Escherichia coli CFT073
cugcccgcuccagcu

SEQ ID NO: 2603463 - RNA, 11 nt, Escherichia coli CFT073
cugcccggcaa

SEQ ID NO: 2603464 - RNA, 24 nt, Escherichia coli CFT073
cugcccggcaaacgucgcgcaugc

SEQ ID NO: 2603465 - RNA, 18 nt, Escherichia coli CFT073
cugcccguuuaacguuau

SEQ ID NO: 2603466 - RNA, 21 nt, Escherichia coli CFT073
cugccgacaauaaaacguugc

SEQ ID NO: 2603467 - RNA, 15 nt, Escherichia coli CFT073
cugccgaccaucugu

SEQ ID NO: 2603468 - RNA, 24 nt, Escherichia coli CFT073
cugccgacgccaggcucggauaac

SEQ ID NO: 2603469 - RNA, 17 nt, Escherichia coli CFT073
cugccgagcgcaagcca

SEQ ID NO: 2603470 - RNA, 14 nt, Escherichia coli CFT073
cugccgccaccaug

SEQ ID NO: 2603471 - RNA, 20 nt, Escherichia coli CFT073
cugccgccaccauguugcgc

SEQ ID NO: 2603472 - RNA, 23 nt, Escherichia coli CFT073
cugccgccaccauguugcgcaga

SEQ ID NO: 2603473 - RNA, 18 nt, Escherichia coli CFT073
cugccgccagcauuguca

SEQ ID NO: 2603474 - RNA, 23 nt, Escherichia coli CFT073
cugccgccagcauugucaggauc

SEQ ID NO: 2603475 - RNA, 15 nt, Escherichia coli CFT073
cugccgccagguuau

SEQ ID NO: 2603476 - RNA, 21 nt, Escherichia coli CFT073
cugccgccgcaaucagcguuu

SEQ ID NO: 2603477 - RNA, 17 nt, Escherichia coli CFT073
cugccgcgccagaucag

SEQ ID NO: 2603478 - RNA, 17 nt, Escherichia coli CFT073
cugccgcuauguuuauu

SEQ ID NO: 2603479 - RNA, 16 nt, Escherichia coli CFT073
cugccgcugcgcguga

SEQ ID NO: 2603480 - RNA, 21 nt, Escherichia coli CFT073
cugccggaacaggcaucacuu

SEQ ID NO: 2603481 - RNA, 15 nt, Escherichia coli CFT073
cugccggaauaauca

SEQ ID NO: 2603482 - RNA, 17 nt, Escherichia coli CFT073
cugccggaccaucuucc

SEQ ID NO: 2603483 - RNA, 20 nt, Escherichia coli CFT073
cugccggacguucgcccacu

SEQ ID NO: 2603484 - RNA, 17 nt, Escherichia coli CFT073
cugccggaguauuucau

SEQ ID NO: 2603485 - RNA, 23 nt, Escherichia coli CFT073
cugccggaguauuucauggggaa

SEQ ID NO: 2603486 - RNA, 20 nt, Escherichia coli CFT073
cugccgggggcgaccugugc

SEQ ID NO: 2603487 - RNA, 11 nt, Escherichia coli CFT073
cugccgguucc

SEQ ID NO: 2603488 - RNA, 17 nt, Escherichia coli CFT073
cugccgguuccagcuuc

SEQ ID NO: 2603489 - RNA, 15 nt, Escherichia coli CFT073
cugccguaacugcgc

SEQ ID NO: 2603490 - RNA, 15 nt, Escherichia coli CFT073
cugccguacaggcag

SEQ ID NO: 2603491 - RNA, 16 nt, Escherichia coli CFT073
cugccguagugaugca

SEQ ID NO: 2603492 - RNA, 23 nt, Escherichia coli CFT073
cugccguuaaagauaaugccagc

SEQ ID NO: 2603493 - RNA, 14 nt, Escherichia coli CFT073
cugccguucucaaa

SEQ ID NO: 2603494 - RNA, 13 nt, Escherichia coli CFT073
cugccguugaucu

SEQ ID NO: 2603495 - RNA, 18 nt, Escherichia coli CFT073
cugccguugaucugcccc

SEQ ID NO: 2603496 - RNA, 19 nt, Escherichia coli CFT073
cugccucgggauccaugca

SEQ ID NO: 2603497 - RNA, 19 nt, Escherichia coli CFT073
cugccugauccugagcuaa

SEQ ID NO: 2603498 - RNA, 13 nt, Escherichia coli CFT073
cugccugaugcgc

SEQ ID NO: 2603499 - RNA, 20 nt, Escherichia coli CFT073
cugccugcggcgaucuucaa

SEQ ID NO: 2603500 - RNA, 13 nt, Escherichia coli CFT073
cugccuucccuuc

SEQ ID NO: 2603501 - RNA, 17 nt, Escherichia coli CFT073
cugccuucccuucucuu

SEQ ID NO: 2603502 - RNA, 13 nt, Escherichia coli CFT073
cugccuugccagg

SEQ ID NO: 2603503 - RNA, 14 nt, Escherichia coli CFT073
cugccuugcucuuc

SEQ ID NO: 2603504 - RNA, 13 nt, Escherichia coli CFT073
cugccuuucccuu

SEQ ID NO: 2603505 - RNA, 19 nt, Escherichia coli CFT073
cugcgaaucgcuucauuua

SEQ ID NO: 2603506 - RNA, 12 nt, Escherichia coli CFT073
cugcucuucggg

SEQ ID NO: 2603507 - RNA, 17 nt, Escherichia coli CFT073
cugcucuugauccauua

SEQ ID NO: 2603508 - RNA, 15 nt, Escherichia coli CFT073
cugcucuuucagcac

SEQ ID NO: 2603509 - RNA, 19 nt, Escherichia coli CFT073
cugcucuuuuugcauaauu

SEQ ID NO: 2603510 - RNA, 16 nt, Escherichia coli CFT073
cugcugaauauugcca

SEQ ID NO: 2603511 - RNA, 14 nt, Escherichia coli CFT073
cugcugaauuuccu

SEQ ID NO: 2603512 - RNA, 17 nt, Escherichia coli CFT073
cugcugaccaccagcac

SEQ ID NO: 2603513 - RNA, 19 nt, Escherichia coli CFT073
cugcugacggugauaauca

SEQ ID NO: 2603514 - RNA, 22 nt, Escherichia coli CFT073
cugcugagaacauaaacaccca

SEQ ID NO: 2603515 - RNA, 17 nt, Escherichia coli CFT073
cugcugcaaugccauuc

SEQ ID NO: 2603516 - RNA, 18 nt, Escherichia coli CFT073
cugcugcaaugccauuca

SEQ ID NO: 2603517 - RNA, 14 nt, Escherichia coli CFT073
cugcugcacaccau

SEQ ID NO: 2603518 - RNA, 12 nt, Escherichia coli CFT073
cugcugcacaua

SEQ ID NO: 2603519 - RNA, 16 nt, Escherichia coli CFT073
cugcugcacgcccuga

SEQ ID NO: 2603520 - RNA, 19 nt, Escherichia coli CFT073
cugcugccguagccgaugu

SEQ ID NO: 2603521 - RNA, 21 nt, Escherichia coli CFT073
cugcugccguagccgaugucg

SEQ ID NO: 2603522 - RNA, 18 nt, Escherichia coli CFT073
cugcugccguugccgcuc

SEQ ID NO: 2603523 - RNA, 23 nt, Escherichia coli CFT073
cugcugcgcacaaacaucccuga

SEQ ID NO: 2603524 - RNA, 18 nt, Escherichia coli CFT073
cugcugcggaauagcaau

SEQ ID NO: 2603525 - RNA, 19 nt, Escherichia coli CFT073
cugcuggaaaggccgcgaa

SEQ ID NO: 2603526 - RNA, 19 nt, Escherichia coli CFT073
cugcuguaaagucuggaag

SEQ ID NO: 2603527 - RNA, 19 nt, Escherichia coli CFT073
cugcuguaagccaaaccga

SEQ ID NO: 2603528 - RNA, 11 nt, Escherichia coli CFT073
cugcugugacu

SEQ ID NO: 2603529 - RNA, 16 nt, Escherichia coli CFT073
cugcugugccagcucc

SEQ ID NO: 2603530 - RNA, 18 nt, Escherichia coli CFT073
cugcugugucucuucuuu

SEQ ID NO: 2603531 - RNA, 19 nt, Escherichia coli CFT073
cugcugugugauccacugc

SEQ ID NO: 2603532 - RNA, 19 nt, Escherichia coli CFT073
cugcuguuaccagacagaa

SEQ ID NO: 2603533 - RNA, 15 nt, Escherichia coli CFT073
cugcuguucuucugc

SEQ ID NO: 2603534 - RNA, 12 nt, Escherichia coli CFT073
cugcuguuuagu

SEQ ID NO: 2603535 - RNA, 15 nt, Escherichia coli CFT073
cugcuuaaauuucuu

SEQ ID NO: 2603536 - RNA, 15 nt, Escherichia coli CFT073
cugcuuauagcgcau

SEQ ID NO: 2603537 - RNA, 16 nt, Escherichia coli CFT073
cugcuuaucgcccugc

SEQ ID NO: 2603538 - RNA, 20 nt, Escherichia coli CFT073
cugcuuauuaaugcuuucag

SEQ ID NO: 2603539 - RNA, 15 nt, Escherichia coli CFT073
cugcuucggucagca

SEQ ID NO: 2603540 - RNA, 22 nt, Escherichia coli CFT073
cugcuucuuaccaccuuccucu

SEQ ID NO: 2603541 - RNA, 15 nt, Escherichia coli CFT073
cugcuugaauuuauc

SEQ ID NO: 2603542 - RNA, 23 nt, Escherichia coli CFT073
cugcuugaauuuaucuucaccaa

SEQ ID NO: 2603543 - RNA, 13 nt, Escherichia coli CFT073
cugcuugccaccg

SEQ ID NO: 2603544 - RNA, 23 nt, Escherichia coli CFT073
cugcuuuacccacgcuuuucauc

SEQ ID NO: 2603545 - RNA, 16 nt, Escherichia coli CFT073
cugcuuuaucagauca

SEQ ID NO: 2603546 - RNA, 21 nt, Escherichia coli CFT073
cugcuuuaucagaucacgcau

SEQ ID NO: 2603547 - RNA, 16 nt, Escherichia coli CFT073
cugcuuugacacuuca

SEQ ID NO: 2603548 - RNA, 20 nt, Escherichia coli CFT073
cugcuuuguucagcccuucu

SEQ ID NO: 2603549 - RNA, 15 nt, Escherichia coli CFT073
cugcuuuuucaucau

SEQ ID NO: 2603550 - RNA, 16 nt, Escherichia coli CFT073
cuggaaaaucuggcgc

SEQ ID NO: 2603551 - RNA, 12 nt, Escherichia coli CFT073
cuggaaacgcga

SEQ ID NO: 2603552 - RNA, 16 nt, Escherichia coli CFT073
cuggaaaggccgcgaa

SEQ ID NO: 2603553 - RNA, 14 nt, Escherichia coli CFT073
cuggaaauagauuu

SEQ ID NO: 2603554 - RNA, 15 nt, Escherichia coli CFT073
cuggaaaucaauggu

SEQ ID NO: 2603555 - RNA, 21 nt, Escherichia coli CFT073
cuggaacacgcgcauauuguu

SEQ ID NO: 2603556 - RNA, 21 nt, Escherichia coli CFT073
cuggaacaguugcagucucau

SEQ ID NO: 2603557 - RNA, 18 nt, Escherichia coli CFT073
cuggaaccacagcgccgu

SEQ ID NO: 2603558 - RNA, 21 nt, Escherichia coli CFT073
cuggaacgggaagaaaccauu

SEQ ID NO: 2603559 - RNA, 19 nt, Escherichia coli CFT073
cuggaacugaaaggcacuc

SEQ ID NO: 2603560 - RNA, 15 nt, Escherichia coli CFT073
cuggaagaaaacauu

SEQ ID NO: 2603561 - RNA, 21 nt, Escherichia coli CFT073
cuggaagaaaacauuuuaaac

SEQ ID NO: 2603562 - RNA, 13 nt, Escherichia coli CFT073
cuggaagaccagc

SEQ ID NO: 2603563 - RNA, 18 nt, Escherichia coli CFT073
cuggaagugaucuuucag

SEQ ID NO: 2603564 - RNA, 16 nt, Escherichia coli CFT073
cuggaaucaucaagca

SEQ ID NO: 2603565 - RNA, 22 nt, Escherichia coli CFT073
cuggaaucaucaagcacuugca

SEQ ID NO: 2603566 - RNA, 16 nt, Escherichia coli CFT073
cuggaauggaaacagc

SEQ ID NO: 2603567 - RNA, 23 nt, Escherichia coli CFT073
cuggaauggaaacagcaccaucc

SEQ ID NO: 2603568 - RNA, 16 nt, Escherichia coli CFT073
cuggacacugaauaaa

SEQ ID NO: 2603569 - RNA, 22 nt, Escherichia coli CFT073
cuggacccgaugaucaaaaaaa

SEQ ID NO: 2603570 - RNA, 19 nt, Escherichia coli CFT073
cuggacgccaauaccgauc

SEQ ID NO: 2603571 - RNA, 17 nt, Escherichia coli CFT073
cuggagagcgccgggca

SEQ ID NO: 2603572 - RNA, 18 nt, Escherichia coli CFT073
cuggagcaguauugauag

SEQ ID NO: 2603573 - RNA, 22 nt, Escherichia coli CFT073
cuggagcaguauugauagauuu

SEQ ID NO: 2603574 - RNA, 13 nt, Escherichia coli CFT073
cuggagcuggcga

SEQ ID NO: 2603575 - RNA, 16 nt, Escherichia coli CFT073
cuggagguuuagccaa

SEQ ID NO: 2603576 - RNA, 14 nt, Escherichia coli CFT073
cuggauaaccuguu

SEQ ID NO: 2603577 - RNA, 18 nt, Escherichia coli CFT073
cuggauaaucacaauggu

SEQ ID NO: 2603578 - RNA, 20 nt, Escherichia coli CFT073
cuggauaaugaagucugccg

SEQ ID NO: 2603579 - RNA, 22 nt, Escherichia coli CFT073
cuggauauacgcuuucagcacu

SEQ ID NO: 2603580 - RNA, 15 nt, Escherichia coli CFT073
cuggauaucgagaua

SEQ ID NO: 2603581 - RNA, 18 nt, Escherichia coli CFT073
cuggaucaaagucaucaa

SEQ ID NO: 2603582 - RNA, 20 nt, Escherichia coli CFT073
cuggaugaucccuucgcugg

SEQ ID NO: 2603583 - RNA, 19 nt, Escherichia coli CFT073
cuggaugcgaugcuggcgc

SEQ ID NO: 2603584 - RNA, 18 nt, Escherichia coli CFT073
cuggauggcgcuccagca

SEQ ID NO: 2603585 - RNA, 16 nt, Escherichia coli CFT073
cuggauuucaauaucg

SEQ ID NO: 2603586 - RNA, 15 nt, Escherichia coli CFT073
cuggauuugugucag

SEQ ID NO: 2603587 - RNA, 16 nt, Escherichia coli CFT073
cuggauuugugucaga

SEQ ID NO: 2603588 - RNA, 13 nt, Escherichia coli CFT073
cuggcaaaaacaa

SEQ ID NO: 2603589 - RNA, 22 nt, Escherichia coli CFT073
cuggcaaaaacaaggaucgcga

SEQ ID NO: 2603590 - RNA, 13 nt, Escherichia coli CFT073
cuggcaaaaauaa

SEQ ID NO: 2603591 - RNA, 14 nt, Escherichia coli CFT073
cuggcaaaaauaag

SEQ ID NO: 2603592 - RNA, 19 nt, Escherichia coli CFT073
cuggcaaacgucaguacaa

SEQ ID NO: 2603593 - RNA, 23 nt, Escherichia coli CFT073
cuggcaaaucaaaucacgauggc

SEQ ID NO: 2603594 - RNA, 22 nt, Escherichia coli CFT073
cuggcaacaacgcaacuccagc

SEQ ID NO: 2603595 - RNA, 20 nt, Escherichia coli CFT073
cuggcaagaaacgcuccacc

SEQ ID NO: 2603596 - RNA, 21 nt, Escherichia coli CFT073
cuggcaagaaacgcuccacca

SEQ ID NO: 2603597 - RNA, 22 nt, Escherichia coli CFT073
cuggcaagaaacgcuccaccac

SEQ ID NO: 2603598 - RNA, 20 nt, Escherichia coli CFT073
cuggcaagaagaucagcaaa

SEQ ID NO: 2603599 - RNA, 19 nt, Escherichia coli CFT073
cuggcaauaauaucccaac

SEQ ID NO: 2603600 - RNA, 17 nt, Escherichia coli CFT073
cuggcaaucgccagcgg

SEQ ID NO: 2603601 - RNA, 18 nt, Escherichia coli CFT073
cuggcaaucgccagcggc

SEQ ID NO: 2603602 - RNA, 23 nt, Escherichia coli CFT073
cuggcaauuaacgcacaaccagc

SEQ ID NO: 2603603 - RNA, 16 nt, Escherichia coli CFT073
cuggcacaugcauaaa

SEQ ID NO: 2603604 - RNA, 18 nt, Escherichia coli CFT073
cuggcaccaucagcucug

SEQ ID NO: 2603605 - RNA, 19 nt, Escherichia coli CFT073
cuggcacgcccgcgccauu

SEQ ID NO: 2603606 - RNA, 18 nt, Escherichia coli CFT073
cuggcacucuccggcaga

SEQ ID NO: 2603607 - RNA, 16 nt, Escherichia coli CFT073
cuggcacucuuccaga

SEQ ID NO: 2603608 - RNA, 21 nt, Escherichia coli CFT073
cuggcacucuuccagaccaaa

SEQ ID NO: 2603609 - RNA, 13 nt, Escherichia coli CFT073
cuggcacuguuca

SEQ ID NO: 2603610 - RNA, 18 nt, Escherichia coli CFT073
cuggcagaaaacgccugg

SEQ ID NO: 2603611 - RNA, 15 nt, Escherichia coli CFT073
cuggcagaaugaagu

SEQ ID NO: 2603612 - RNA, 18 nt, Escherichia coli CFT073
cuggcagcaccacgcaga

SEQ ID NO: 2603613 - RNA, 16 nt, Escherichia coli CFT073
cuggcagccacgacgc

SEQ ID NO: 2603614 - RNA, 16 nt, Escherichia coli CFT073
cugguaauugacgcca

SEQ ID NO: 2603615 - RNA, 16 nt, Escherichia coli CFT073
cugguaccccauaacg

SEQ ID NO: 2603616 - RNA, 18 nt, Escherichia coli CFT073
cugguaccugucgcuuuu

SEQ ID NO: 2603617 - RNA, 21 nt, Escherichia coli CFT073
cugguaccugucgcuuuugca

SEQ ID NO: 2603618 - RNA, 15 nt, Escherichia coli CFT073
cugguacguuuauua

SEQ ID NO: 2603619 - RNA, 18 nt, Escherichia coli CFT073
cugguacucaaccgccac

SEQ ID NO: 2603620 - RNA, 15 nt, Escherichia coli CFT073
cugguaggccugaua

SEQ ID NO: 2603621 - RNA, 20 nt, Escherichia coli CFT073
cugguaguuguacaacugcu

SEQ ID NO: 2603622 - RNA, 22 nt, Escherichia coli CFT073
cugguaucaauaauucggcuua

SEQ ID NO: 2603623 - RNA, 21 nt, Escherichia coli CFT073
cugguauucgcuaaucgguac

SEQ ID NO: 2603624 - RNA, 12 nt, Escherichia coli CFT073
cuggucaaagac

SEQ ID NO: 2603625 - RNA, 15 nt, Escherichia coli CFT073
cuggucaauggcgac

SEQ ID NO: 2603626 - RNA, 22 nt, Escherichia coli CFT073
cuggucaauggcgaccacugac

SEQ ID NO: 2603627 - RNA, 14 nt, Escherichia coli CFT073
cuggucacuaccug

SEQ ID NO: 2603628 - RNA, 15 nt, Escherichia coli CFT073
cuggucacugacgac

SEQ ID NO: 2603629 - RNA, 18 nt, Escherichia coli CFT073
cuggucaggaauggaaau

SEQ ID NO: 2603630 - RNA, 15 nt, Escherichia coli CFT073
cuggucaggccaaac

SEQ ID NO: 2603631 - RNA, 16 nt, Escherichia coli CFT073
cuggucauaggcugcc

SEQ ID NO: 2603632 - RNA, 20 nt, Escherichia coli CFT073
cuggucgagcguugccgcuc

SEQ ID NO: 2603633 - RNA, 16 nt, Escherichia coli CFT073
cuggucgaggaucucu

SEQ ID NO: 2603634 - RNA, 20 nt, Escherichia coli CFT073
cuggucgguuucagccagga

SEQ ID NO: 2603635 - RNA, 16 nt, Escherichia coli CFT073
cuggucuggcccacga

SEQ ID NO: 2603636 - RNA, 14 nt, Escherichia coli CFT073
cuggucuggugaau

SEQ ID NO: 2603637 - RNA, 17 nt, Escherichia coli CFT073
cuggugaaaucagccgu

SEQ ID NO: 2603638 - RNA, 21 nt, Escherichia coli CFT073
cuggugaaaucagccguuuca

SEQ ID NO: 2603639 - RNA, 13 nt, Escherichia coli CFT073
cuggugccagcgc

SEQ ID NO: 2603640 - RNA, 16 nt, Escherichia coli CFT073
cuggugccagcgccag

SEQ ID NO: 2603641 - RNA, 13 nt, Escherichia coli CFT073
cuggugccugcac

SEQ ID NO: 2603642 - RNA, 17 nt, Escherichia coli CFT073
cuggugccugcacuggu

SEQ ID NO: 2603643 - RNA, 17 nt, Escherichia coli CFT073
cuggugcguuuaccugc

SEQ ID NO: 2603644 - RNA, 13 nt, Escherichia coli CFT073
cuggugcugcgcu

SEQ ID NO: 2603645 - RNA, 19 nt, Escherichia coli CFT073
cuggugcuugccagagcag

SEQ ID NO: 2603646 - RNA, 23 nt, Escherichia coli CFT073
cuggugcuuuaaaugucauacua

SEQ ID NO: 2603647 - RNA, 16 nt, Escherichia coli CFT073
cugguggcaagaccug

SEQ ID NO: 2603648 - RNA, 14 nt, Escherichia coli CFT073
cugguggcaccucg

SEQ ID NO: 2603649 - RNA, 19 nt, Escherichia coli CFT073
cugguggcgauugaagcag

SEQ ID NO: 2603650 - RNA, 19 nt, Escherichia coli CFT073
cuggugggaccaaaauccg

SEQ ID NO: 2603651 - RNA, 15 nt, Escherichia coli CFT073
cuggugugcguugca

SEQ ID NO: 2603652 - RNA, 20 nt, Escherichia coli CFT073
cuggugugucuuuucaggcc

SEQ ID NO: 2603653 - RNA, 22 nt, Escherichia coli CFT073
cugguguucgauaaccaucccu

SEQ ID NO: 2603654 - RNA, 22 nt, Escherichia coli CFT073
cugguuagcaaccgccgcugcu

SEQ ID NO: 2603655 - RNA, 23 nt, Escherichia coli CFT073
cugguucagucguauccucagaa

SEQ ID NO: 2603656 - RNA, 14 nt, Escherichia coli CFT073
cugguucccaacaa

SEQ ID NO: 2603657 - RNA, 17 nt, Escherichia coli CFT073
cugguucccaacaacag

SEQ ID NO: 2603658 - RNA, 15 nt, Escherichia coli CFT073
cugguucccagagcu

SEQ ID NO: 2603659 - RNA, 19 nt, Escherichia coli CFT073
cugguucccagagcuuuug

SEQ ID NO: 2603660 - RNA, 19 nt, Escherichia coli CFT073
cugguuccccauucugcgc

SEQ ID NO: 2603661 - RNA, 20 nt, Escherichia coli CFT073
cugguugauauuuuccugcg

SEQ ID NO: 2603662 - RNA, 18 nt, Escherichia coli CFT073
cugguugauucauggcau

SEQ ID NO: 2603663 - RNA, 16 nt, Escherichia coli CFT073
cugguugauuuuaaag

SEQ ID NO: 2603664 - RNA, 20 nt, Escherichia coli CFT073
cugguugauuuuaaaggauu

SEQ ID NO: 2603665 - RNA, 19 nt, Escherichia coli CFT073
cugguuguauggccuggug

SEQ ID NO: 2603666 - RNA, 23 nt, Escherichia coli CFT073
cugguuucagcaucccaggcauc

SEQ ID NO: 2603667 - RNA, 14 nt, Escherichia coli CFT073
cugguuugccacgu

SEQ ID NO: 2603668 - RNA, 18 nt, Escherichia coli CFT073
cugguuuguaggucaggu

SEQ ID NO: 2603669 - RNA, 15 nt, Escherichia coli CFT073
cugguuuugaacagc

SEQ ID NO: 2603670 - RNA, 16 nt, Escherichia coli CFT073
cugguuuugugcgcca

SEQ ID NO: 2603671 - RNA, 20 nt, Escherichia coli CFT073
cuguaaaaaaggcagccauc

SEQ ID NO: 2603672 - RNA, 19 nt, Escherichia coli CFT073
cuguaaaagccccuucgcg

SEQ ID NO: 2603673 - RNA, 23 nt, Escherichia coli CFT073
cuguaaaagcgcauuuaucuuca

SEQ ID NO: 2603674 - RNA, 15 nt, Escherichia coli CFT073
cuguaacgcaggaug

SEQ ID NO: 2603675 - RNA, 20 nt, Escherichia coli CFT073
cuguaacgcaggauguaauc

SEQ ID NO: 2603676 - RNA, 21 nt, Escherichia coli CFT073
cuguaagcaauuauucauauc

SEQ ID NO: 2603677 - RNA, 13 nt, Escherichia coli CFT073
cuguaagccaaac

SEQ ID NO: 2603678 - RNA, 18 nt, Escherichia coli CFT073
cuguaagccucuuucaga

SEQ ID NO: 2603679 - RNA, 18 nt, Escherichia coli CFT073
cuguaaggugaaagcaau

SEQ ID NO: 2603680 - RNA, 20 nt, Escherichia coli CFT073
cuguaaguuacuaaaaguaa

SEQ ID NO: 2603681 - RNA, 17 nt, Escherichia coli CFT073
cuguaauagacugcacu

SEQ ID NO: 2603682 - RNA, 21 nt, Escherichia coli CFT073
cuguaaugcuauaaaaauaaa

SEQ ID NO: 2603683 - RNA, 11 nt, Escherichia coli CFT073
cuguaauggcu

SEQ ID NO: 2603684 - RNA, 18 nt, Escherichia coli CFT073
cuguaauuaaauuaucaa

SEQ ID NO: 2603685 - RNA, 14 nt, Escherichia coli CFT073
cuguaauucguaac

SEQ ID NO: 2603686 - RNA, 22 nt, Escherichia coli CFT073
cuguaauuucacaccaucaaca

SEQ ID NO: 2603687 - RNA, 16 nt, Escherichia coli CFT073
cuguacaagcaacuug

SEQ ID NO: 2603688 - RNA, 17 nt, Escherichia coli CFT073
cuguacaauaucgauaa

SEQ ID NO: 2603689 - RNA, 15 nt, Escherichia coli CFT073
cuguacaguaaucgu

SEQ ID NO: 2603690 - RNA, 23 nt, Escherichia coli CFT073
cuguacaucgcgccaacaaaagc

SEQ ID NO: 2603691 - RNA, 14 nt, Escherichia coli CFT073
cuguaccaccagaa

SEQ ID NO: 2603692 - RNA, 21 nt, Escherichia coli CFT073
cuguaccagcggcuuccagca

SEQ ID NO: 2603693 - RNA, 20 nt, Escherichia coli CFT073
cuguaccuggucgauaauaa

SEQ ID NO: 2603694 - RNA, 11 nt, Escherichia coli CFT073
cuguaccuucu

SEQ ID NO: 2603695 - RNA, 23 nt, Escherichia coli CFT073
cuguacgcgccaguuaucaggcu

SEQ ID NO: 2603696 - RNA, 16 nt, Escherichia coli CFT073
cuguacuuaaaacuca

SEQ ID NO: 2603697 - RNA, 13 nt, Escherichia coli CFT073
cuguacuuccugu

SEQ ID NO: 2603698 - RNA, 19 nt, Escherichia coli CFT073
cuguagaacaccugucuuc

SEQ ID NO: 2603699 - RNA, 15 nt, Escherichia coli CFT073
cuguagauauauccu

SEQ ID NO: 2603700 - RNA, 16 nt, Escherichia coli CFT073
cuguagauauucuucc

SEQ ID NO: 2603701 - RNA, 23 nt, Escherichia coli CFT073
cuguagauauucuuccaguggcu

SEQ ID NO: 2603702 - RNA, 15 nt, Escherichia coli CFT073
cuguaggucggauaa

SEQ ID NO: 2603703 - RNA, 23 nt, Escherichia coli CFT073
cuguaggucggauaaggcguuca

SEQ ID NO: 2603704 - RNA, 17 nt, Escherichia coli CFT073
cuguaguccaggccuga

SEQ ID NO: 2603705 - RNA, 14 nt, Escherichia coli CFT073
cuguaucaggcuga

SEQ ID NO: 2603706 - RNA, 15 nt, Escherichia coli CFT073
cuguaucgaugcugu

SEQ ID NO: 2603707 - RNA, 17 nt, Escherichia coli CFT073
cuguaugacaaaagaau

SEQ ID NO: 2603708 - RNA, 15 nt, Escherichia coli CFT073
cuguauguuccccuc

SEQ ID NO: 2603709 - RNA, 17 nt, Escherichia coli CFT073
cuguauuuggcugccga

SEQ ID NO: 2603710 - RNA, 13 nt, Escherichia coli CFT073
cuguauuuuuuaa

SEQ ID NO: 2603711 - RNA, 11 nt, Escherichia coli CFT073
cugucaacugc

SEQ ID NO: 2603712 - RNA, 20 nt, Escherichia coli CFT073
cugucaauaaacgccugcuu

SEQ ID NO: 2603713 - RNA, 22 nt, Escherichia coli CFT073
cugucaauaaacgccugcuuau

SEQ ID NO: 2603714 - RNA, 13 nt, Escherichia coli CFT073
cugucaccaauca

SEQ ID NO: 2603715 - RNA, 24 nt, Escherichia coli CFT073
cugucaccgggcaaacgcuggaug

SEQ ID NO: 2603716 - RNA, 14 nt, Escherichia coli CFT073
cugucaccucugca

SEQ ID NO: 2603717 - RNA, 15 nt, Escherichia coli CFT073
cugucaccucugcaa

SEQ ID NO: 2603718 - RNA, 13 nt, Escherichia coli CFT073
cugucaccuuuua

SEQ ID NO: 2603719 - RNA, 22 nt, Escherichia coli CFT073
cugucagaccuccguuuuucug

SEQ ID NO: 2603720 - RNA, 22 nt, Escherichia coli CFT073
cugucaguagcaaacacugccu

SEQ ID NO: 2603721 - RNA, 14 nt, Escherichia coli CFT073
cugucagucugcuu

SEQ ID NO: 2603722 - RNA, 16 nt, Escherichia coli CFT073
cuguuuagccgcuucu

SEQ ID NO: 2603723 - RNA, 15 nt, Escherichia coli CFT073
cuguuuauugaggau

SEQ ID NO: 2603724 - RNA, 22 nt, Escherichia coli CFT073
cuguuuauugaggauauuacug

SEQ ID NO: 2603725 - RNA, 18 nt, Escherichia coli CFT073
cuguuucgcggcaaacug

SEQ ID NO: 2603726 - RNA, 15 nt, Escherichia coli CFT073
cuguuucgcuucuuc

SEQ ID NO: 2603727 - RNA, 18 nt, Escherichia coli CFT073
cuguuucgcuucuucagc

SEQ ID NO: 2603728 - RNA, 22 nt, Escherichia coli CFT073
cuguuucgcuucuucagccugc

SEQ ID NO: 2603729 - RNA, 18 nt, Escherichia coli CFT073
cuguuugcgucagcuuca

SEQ ID NO: 2603730 - RNA, 19 nt, Escherichia coli CFT073
cuguuuggugcauaggcca

SEQ ID NO: 2603731 - RNA, 16 nt, Escherichia coli CFT073
cuguuugguugccagc

SEQ ID NO: 2603732 - RNA, 14 nt, Escherichia coli CFT073
cuguuuuaucacau

SEQ ID NO: 2603733 - RNA, 16 nt, Escherichia coli CFT073
cuguuuucagcaccag

SEQ ID NO: 2603734 - RNA, 13 nt, Escherichia coli CFT073
cuguuuugccagg

SEQ ID NO: 2603735 - RNA, 14 nt, Escherichia coli CFT073
cuguuuuuccagcu

SEQ ID NO: 2603736 - RNA, 15 nt, Escherichia coli CFT073
cuguuuuugcgaugg

SEQ ID NO: 2603737 - RNA, 17 nt, Escherichia coli CFT073
cuguuuuuuaauucagg

SEQ ID NO: 2603738 - RNA, 22 nt, Escherichia coli CFT073
cuguuuuuuaccugucgcuuug

SEQ ID NO: 2603739 - RNA, 13 nt, Escherichia coli CFT073
cuguuuuuucauc

SEQ ID NO: 2603740 - RNA, 20 nt, Escherichia coli CFT073
cuuaaaacucacccugaugc

SEQ ID NO: 2603741 - RNA, 13 nt, Escherichia coli CFT073
cuuaaauccaaac

SEQ ID NO: 2603742 - RNA, 21 nt, Escherichia coli CFT073
cuuaaaugcacccgccagaga

SEQ ID NO: 2603743 - RNA, 13 nt, Escherichia coli CFT073
cuuaaauuucuua

SEQ ID NO: 2603744 - RNA, 20 nt, Escherichia coli CFT073
cuuaacaacgggcaccgccg

SEQ ID NO: 2603745 - RNA, 12 nt, Escherichia coli CFT073
cuuaacaccccc

SEQ ID NO: 2603746 - RNA, 20 nt, Escherichia coli CFT073
cuuaacaccggcgcacuggc

SEQ ID NO: 2603747 - RNA, 23 nt, Escherichia coli CFT073
cuuaacagauugagaauaaugcc

SEQ ID NO: 2603748 - RNA, 16 nt, Escherichia coli CFT073
cuuaacccaaauccgc

SEQ ID NO: 2603749 - RNA, 14 nt, Escherichia coli CFT073
cuuaaccgccgcca

SEQ ID NO: 2603750 - RNA, 19 nt, Escherichia coli CFT073
cuuaacgauuacagcaucg

SEQ ID NO: 2603751 - RNA, 21 nt, Escherichia coli CFT073
cuuaacgcaccaugcacggac

SEQ ID NO: 2603752 - RNA, 19 nt, Escherichia coli CFT073
cuuaacgcgggcuucuucu

SEQ ID NO: 2603753 - RNA, 20 nt, Escherichia coli CFT073
cuuaacgcgggcuucuucuu

SEQ ID NO: 2603754 - RNA, 16 nt, Escherichia coli CFT073
cuuaacggcagcgccu

SEQ ID NO: 2603755 - RNA, 14 nt, Escherichia coli CFT073
cuuaacgguuuuac

SEQ ID NO: 2603756 - RNA, 16 nt, Escherichia coli CFT073
cuuaacguuaccuuua

SEQ ID NO: 2603757 - RNA, 23 nt, Escherichia coli CFT073
cuuaacucaccguaggcaauaaa

SEQ ID NO: 2603758 - RNA, 22 nt, Escherichia coli CFT073
cuuaagauucggcuucuuccuc

SEQ ID NO: 2603759 - RNA, 15 nt, Escherichia coli CFT073
cuuaagccagcgccc

SEQ ID NO: 2603760 - RNA, 22 nt, Escherichia coli CFT073
cuuaagccgcuguguguaggcc

SEQ ID NO: 2603761 - RNA, 16 nt, Escherichia coli CFT073
cuuaaggcuguuccca

SEQ ID NO: 2603762 - RNA, 18 nt, Escherichia coli CFT073
cuuaagguuuuuuccuuc

SEQ ID NO: 2603763 - RNA, 18 nt, Escherichia coli CFT073
cuuaagucuccauuuuuu

SEQ ID NO: 2603764 - RNA, 22 nt, Escherichia coli CFT073
cuuaaguuagucgcuuucauuc

SEQ ID NO: 2603765 - RNA, 17 nt, Escherichia coli CFT073
cuuaauaagcaggccau

SEQ ID NO: 2603766 - RNA, 17 nt, Escherichia coli CFT073
cuuaauagcuucuucuu

SEQ ID NO: 2603767 - RNA, 14 nt, Escherichia coli CFT073
cuuaaucaacucac

SEQ ID NO: 2603768 - RNA, 18 nt, Escherichia coli CFT073
cuuaaucaauugcaggaa

SEQ ID NO: 2603769 - RNA, 22 nt, Escherichia coli CFT073
cuuaaucaucaaugccagcaua

SEQ ID NO: 2603770 - RNA, 16 nt, Escherichia coli CFT073
cuuaaugagauaauca

SEQ ID NO: 2603771 - RNA, 17 nt, Escherichia coli CFT073
cuuaaugagauaaucaa

SEQ ID NO: 2603772 - RNA, 22 nt, Escherichia coli CFT073
cuuaaugcacggcagauaaaca

SEQ ID NO: 2603773 - RNA, 19 nt, Escherichia coli CFT073
cuuaaugcccaucucuucu

SEQ ID NO: 2603774 - RNA, 21 nt, Escherichia coli CFT073
cuuaaugcccaucucuucuuc

SEQ ID NO: 2603775 - RNA, 18 nt, Escherichia coli CFT073
cuuaauggaaaacuguuu

SEQ ID NO: 2603776 - RNA, 19 nt, Escherichia coli CFT073
cuuaauugcaccucagcau

SEQ ID NO: 2603777 - RNA, 18 nt, Escherichia coli CFT073
cuuaauugcccaaagcca

SEQ ID NO: 2603778 - RNA, 15 nt, Escherichia coli CFT073
cuuacacuuccuuua

SEQ ID NO: 2603779 - RNA, 13 nt, Escherichia coli CFT073
cuuacauauauua

SEQ ID NO: 2603780 - RNA, 17 nt, Escherichia coli CFT073
cuuacauucugucucau

SEQ ID NO: 2603781 - RNA, 16 nt, Escherichia coli CFT073
cuuaccaaauaaacga

SEQ ID NO: 2603782 - RNA, 22 nt, Escherichia coli CFT073
cuuaccacuaccgcacggacaa

SEQ ID NO: 2603783 - RNA, 14 nt, Escherichia coli CFT073
cuuaccccgcccga

SEQ ID NO: 2603784 - RNA, 15 nt, Escherichia coli CFT073
cuuacccuuacucac

SEQ ID NO: 2603785 - RNA, 16 nt, Escherichia coli CFT073
cuuaccguaggccagc

SEQ ID NO: 2603786 - RNA, 14 nt, Escherichia coli CFT073
cuuaccuaccugcu

SEQ ID NO: 2603787 - RNA, 12 nt, Escherichia coli CFT073
cuuaccuccugu

SEQ ID NO: 2603788 - RNA, 16 nt, Escherichia coli CFT073
cuuaccuccugucuaa

SEQ ID NO: 2603789 - RNA, 17 nt, Escherichia coli CFT073
cuuacgaaguuccugca

SEQ ID NO: 2603790 - RNA, 15 nt, Escherichia coli CFT073
cuuacgcaacugcca

SEQ ID NO: 2603791 - RNA, 17 nt, Escherichia coli CFT073
cuuacgcaacugccagu

SEQ ID NO: 2603792 - RNA, 23 nt, Escherichia coli CFT073
cuuacguauuucgauuuguucug

SEQ ID NO: 2603793 - RNA, 15 nt, Escherichia coli CFT073
cuuacguccgccguu

SEQ ID NO: 2603794 - RNA, 16 nt, Escherichia coli CFT073
cuuacuauauaaaccu

SEQ ID NO: 2603795 - RNA, 16 nt, Escherichia coli CFT073
cuuacucaugauguca

SEQ ID NO: 2603796 - RNA, 14 nt, Escherichia coli CFT073
cuuacuucaacaca

SEQ ID NO: 2603797 - RNA, 18 nt, Escherichia coli CFT073
cuuacuugcugcucugaa

SEQ ID NO: 2603798 - RNA, 13 nt, Escherichia coli CFT073
cuuagcguucugc

SEQ ID NO: 2603799 - RNA, 15 nt, Escherichia coli CFT073
cuuagucuccccaac

SEQ ID NO: 2603800 - RNA, 22 nt, Escherichia coli CFT073
cuuauaaaggcgcuucggcgcc

SEQ ID NO: 2603801 - RNA, 22 nt, Escherichia coli CFT073
cuuauaaccagacgauuuuccc

SEQ ID NO: 2603802 - RNA, 13 nt, Escherichia coli CFT073
cuuauaagucuca

SEQ ID NO: 2603803 - RNA, 17 nt, Escherichia coli CFT073
cuuauauacucuaaaua

SEQ ID NO: 2603804 - RNA, 14 nt, Escherichia coli CFT073
cuuaucaagaaagc

SEQ ID NO: 2603805 - RNA, 15 nt, Escherichia coli CFT073
cuuaucaaucucugc

SEQ ID NO: 2603806 - RNA, 17 nt, Escherichia coli CFT073
cuuaucaaucucugcaa

SEQ ID NO: 2603807 - RNA, 19 nt, Escherichia coli CFT073
cuuaucaaucucugcaaga

SEQ ID NO: 2603808 - RNA, 14 nt, Escherichia coli CFT073
cuuaucacagagga

SEQ ID NO: 2603809 - RNA, 17 nt, Escherichia coli CFT073
cuuaucagcauacgcca

SEQ ID NO: 2603810 - RNA, 19 nt, Escherichia coli CFT073
cuuaucaggccuacaaguc

SEQ ID NO: 2603811 - RNA, 17 nt, Escherichia coli CFT073
cuuaucaggccugcaaa

SEQ ID NO: 2603812 - RNA, 14 nt, Escherichia coli CFT073
cuuauccagcaacg

SEQ ID NO: 2603813 - RNA, 18 nt, Escherichia coli CFT073
cuuauccagcagaucgau

SEQ ID NO: 2603814 - RNA, 22 nt, Escherichia coli CFT073
cuuauccgacauuucugcugcc

SEQ ID NO: 2603815 - RNA, 17 nt, Escherichia coli CFT073
cuuauccgaccuacguu

SEQ ID NO: 2603816 - RNA, 15 nt, Escherichia coli CFT073
cuuauccggccuaca

SEQ ID NO: 2603817 - RNA, 16 nt, Escherichia coli CFT073
cuuauccggccuacaa

SEQ ID NO: 2603818 - RNA, 22 nt, Escherichia coli CFT073
cuuauccggccuacgggaacag

SEQ ID NO: 2603819 - RNA, 13 nt, Escherichia coli CFT073
cuuauccugagua

SEQ ID NO: 2603820 - RNA, 21 nt, Escherichia coli CFT073
cuuaucgcaggcuuccuggcu

SEQ ID NO: 2603821 - RNA, 17 nt, Escherichia coli CFT073
cuuaucgcccugcucca

SEQ ID NO: 2603822 - RNA, 18 nt, Escherichia coli CFT073
cuuaucgcccugcuccag

SEQ ID NO: 2603823 - RNA, 20 nt, Escherichia coli CFT073
cuuaucgcccugcuccagca

SEQ ID NO: 2603824 - RNA, 17 nt, Escherichia coli CFT073
cuuaucuaauaaacauu

SEQ ID NO: 2603825 - RNA, 16 nt, Escherichia coli CFT073
cuuaucuggccuacaa

SEQ ID NO: 2603826 - RNA, 22 nt, Escherichia coli CFT073
cuuaucuuauucccacuuuuca

SEQ ID NO: 2603827 - RNA, 15 nt, Escherichia coli CFT073
cuuaugcagcugcuc

SEQ ID NO: 2603828 - RNA, 18 nt, Escherichia coli CFT073
cuuaugcccggcacguuu

SEQ ID NO: 2603829 - RNA, 20 nt, Escherichia coli CFT073
cuuaugcugcgccaguugcu

SEQ ID NO: 2603830 - RNA, 17 nt, Escherichia coli CFT073
cuucauccgacaccagc

SEQ ID NO: 2603831 - RNA, 14 nt, Escherichia coli CFT073
cuucauccgccccg

SEQ ID NO: 2603832 - RNA, 22 nt, Escherichia coli CFT073
cuucauccgccccggcuucaaa

SEQ ID NO: 2603833 - RNA, 18 nt, Escherichia coli CFT073
cuucaucgaacgggugau

SEQ ID NO: 2603834 - RNA, 20 nt, Escherichia coli CFT073
cuucaucgaacgggugauuu

SEQ ID NO: 2603835 - RNA, 18 nt, Escherichia coli CFT073
cuucaucgaugcugcucu

SEQ ID NO: 2603836 - RNA, 19 nt, Escherichia coli CFT073
cuucaucggaaugcacagc

SEQ ID NO: 2603837 - RNA, 18 nt, Escherichia coli CFT073
cuucaucguaguaguuca

SEQ ID NO: 2603838 - RNA, 19 nt, Escherichia coli CFT073
cuucaucguaguaguucau

SEQ ID NO: 2603839 - RNA, 17 nt, Escherichia coli CFT073
cuucaucgugcucgcuu

SEQ ID NO: 2603840 - RNA, 18 nt, Escherichia coli CFT073
cuucaucgugcucgcuuu

SEQ ID NO: 2603841 - RNA, 20 nt, Escherichia coli CFT073
cuucaucuauagcacccgcc

SEQ ID NO: 2603842 - RNA, 13 nt, Escherichia coli CFT073
cuucaucugcacg

SEQ ID NO: 2603843 - RNA, 21 nt, Escherichia coli CFT073
cuucaucuucuuugcgccagc

SEQ ID NO: 2603844 - RNA, 13 nt, Escherichia coli CFT073
cuucaugaccuuc

SEQ ID NO: 2603845 - RNA, 16 nt, Escherichia coli CFT073
cuucaugcacucguaa

SEQ ID NO: 2603846 - RNA, 13 nt, Escherichia coli CFT073
cuucauguugcag

SEQ ID NO: 2603847 - RNA, 17 nt, Escherichia coli CFT073
cuucauuaccuucaaua

SEQ ID NO: 2603848 - RNA, 22 nt, Escherichia coli CFT073
cuucauuaucgauccuuaccag

SEQ ID NO: 2603849 - RNA, 15 nt, Escherichia coli CFT073
cuucauucacgauuu

SEQ ID NO: 2603850 - RNA, 19 nt, Escherichia coli CFT073
cuucauucagacaggcgaa

SEQ ID NO: 2603851 - RNA, 15 nt, Escherichia coli CFT073
cuucauucagccuuc

SEQ ID NO: 2603852 - RNA, 15 nt, Escherichia coli CFT073
cuucauugacgccaa

SEQ ID NO: 2603853 - RNA, 17 nt, Escherichia coli CFT073
cuucauuggcuugcacc

SEQ ID NO: 2603854 - RNA, 21 nt, Escherichia coli CFT073
cuucauuuacaucacgcagcu

SEQ ID NO: 2603855 - RNA, 20 nt, Escherichia coli CFT073
cuuccacaauaccaaucgca

SEQ ID NO: 2603856 - RNA, 17 nt, Escherichia coli CFT073
cuuccacaccacuucau

SEQ ID NO: 2603857 - RNA, 18 nt, Escherichia coli CFT073
cuuccacaccacuucauu

SEQ ID NO: 2603858 - RNA, 16 nt, Escherichia coli CFT073
cuuccaccaccacuga

SEQ ID NO: 2603859 - RNA, 18 nt, Escherichia coli CFT073
cuuccaccacuuccugcu

SEQ ID NO: 2603860 - RNA, 14 nt, Escherichia coli CFT073
cuuccaccagcggc

SEQ ID NO: 2603861 - RNA, 20 nt, Escherichia coli CFT073
cuuccagaaaaagaaugcgc

SEQ ID NO: 2603862 - RNA, 20 nt, Escherichia coli CFT073
cuuccagaaacauccccagc

SEQ ID NO: 2603863 - RNA, 22 nt, Escherichia coli CFT073
cuuccagaauccguacgcuuuu

SEQ ID NO: 2603864 - RNA, 17 nt, Escherichia coli CFT073
cuuccagacucaucuuc

SEQ ID NO: 2603865 - RNA, 21 nt, Escherichia coli CFT073
cuuccagacucugaaacucga

SEQ ID NO: 2603866 - RNA, 23 nt, Escherichia coli CFT073
cuuccagaucaccgcagaagcga

SEQ ID NO: 2603867 - RNA, 15 nt, Escherichia coli CFT073
cuuccagauucaguu

SEQ ID NO: 2603868 - RNA, 15 nt, Escherichia coli CFT073
cuuccagcaaaucca

SEQ ID NO: 2603869 - RNA, 12 nt, Escherichia coli CFT073
cuuccagcagcu

SEQ ID NO: 2603870 - RNA, 18 nt, Escherichia coli CFT073
cuuccagcaguucgcccg

SEQ ID NO: 2603871 - RNA, 11 nt, Escherichia coli CFT073
cuuccagcauc

SEQ ID NO: 2603872 - RNA, 19 nt, Escherichia coli CFT073
cuuccagcaucgcccccau

SEQ ID NO: 2603873 - RNA, 15 nt, Escherichia coli CFT073
cuuccagcauuucca

SEQ ID NO: 2603874 - RNA, 17 nt, Escherichia coli CFT073
cuuccagccacugcgca

SEQ ID NO: 2603875 - RNA, 18 nt, Escherichia coli CFT073
cuuccagccaugccacgc

SEQ ID NO: 2603876 - RNA, 14 nt, Escherichia coli CFT073
cuuccagcgauaau

SEQ ID NO: 2603877 - RNA, 13 nt, Escherichia coli CFT073
cuuccagcgcauc

SEQ ID NO: 2603878 - RNA, 19 nt, Escherichia coli CFT073
cuuccagcgcaucgccaaa

SEQ ID NO: 2603879 - RNA, 13 nt, Escherichia coli CFT073
cuuccagcguuuc

SEQ ID NO: 2603880 - RNA, 14 nt, Escherichia coli CFT073
cuuccagcuccagc

SEQ ID NO: 2603881 - RNA, 18 nt, Escherichia coli CFT073
cuuccagcuucagacgga

SEQ ID NO: 2603882 - RNA, 17 nt, Escherichia coli CFT073
cuuccaggguaaacauc

SEQ ID NO: 2603883 - RNA, 22 nt, Escherichia coli CFT073
cuuccagguaagcaaucagguc

SEQ ID NO: 2603884 - RNA, 16 nt, Escherichia coli CFT073
cuuccaguaacacuuc

SEQ ID NO: 2603885 - RNA, 20 nt, Escherichia coli CFT073
cuuccaguacgcgcaacccc

SEQ ID NO: 2603886 - RNA, 23 nt, Escherichia coli CFT073
cuuccaguggcauuuucugcccg

SEQ ID NO: 2603887 - RNA, 15 nt, Escherichia coli CFT073
cuuccaguuucgcca

SEQ ID NO: 2603888 - RNA, 19 nt, Escherichia coli CFT073
cuuccaguuugcucaaauc

SEQ ID NO: 2603889 - RNA, 21 nt, Escherichia coli CFT073
cuuccauacgaauugccgcgc

SEQ ID NO: 2603890 - RNA, 13 nt, Escherichia coli CFT073
cuuccaucacaaa

SEQ ID NO: 2603891 - RNA, 23 nt, Escherichia coli CFT073
cuuccaucaccgccacuaucgcc

SEQ ID NO: 2603892 - RNA, 12 nt, Escherichia coli CFT073
cuuccaucccuu

SEQ ID NO: 2603893 - RNA, 20 nt, Escherichia coli CFT073
cuuccauuccaccauacaga

SEQ ID NO: 2603894 - RNA, 22 nt, Escherichia coli CFT073
cuuccauucuccgcucuucauc

SEQ ID NO: 2603895 - RNA, 19 nt, Escherichia coli CFT073
cuuccauuucaucgccagc

SEQ ID NO: 2603896 - RNA, 16 nt, Escherichia coli CFT073
cuucccauacccacca

SEQ ID NO: 2603897 - RNA, 23 nt, Escherichia coli CFT073
cuucccccauugccgccucugcc

SEQ ID NO: 2603898 - RNA, 16 nt, Escherichia coli CFT073
cuuccccgcuucagcc

SEQ ID NO: 2603899 - RNA, 17 nt, Escherichia coli CFT073
cuuccccgcuucagccc

SEQ ID NO: 2603900 - RNA, 18 nt, Escherichia coli CFT073
cuuccccguuuugccagu

SEQ ID NO: 2603901 - RNA, 23 nt, Escherichia coli CFT073
cuuccccugccaaccaacgcgcc

SEQ ID NO: 2603902 - RNA, 22 nt, Escherichia coli CFT073
cuuccccuuuugccuucugagc

SEQ ID NO: 2603903 - RNA, 18 nt, Escherichia coli CFT073
cuucccgagacaucccuu

SEQ ID NO: 2603904 - RNA, 19 nt, Escherichia coli CFT073
cuucccgcaaugcaaucaa

SEQ ID NO: 2603905 - RNA, 19 nt, Escherichia coli CFT073
cuucccgcagaccuucugc

SEQ ID NO: 2603906 - RNA, 20 nt, Escherichia coli CFT073
cuucccgcagaccuucugcc

SEQ ID NO: 2603907 - RNA, 23 nt, Escherichia coli CFT073
cuucccgcugugguucauaugau

SEQ ID NO: 2603908 - RNA, 20 nt, Escherichia coli CFT073
cuucccugcugaauccccuu

SEQ ID NO: 2603909 - RNA, 17 nt, Escherichia coli CFT073
cuucccuucucuucaaa

SEQ ID NO: 2603910 - RNA, 23 nt, Escherichia coli CFT073
cuuccgcaaacaggcgcagaacu

SEQ ID NO: 2603911 - RNA, 22 nt, Escherichia coli CFT073
cuuccgcaauacagccagccag

SEQ ID NO: 2603912 - RNA, 17 nt, Escherichia coli CFT073
cuuccgcaggggaugga

SEQ ID NO: 2603913 - RNA, 23 nt, Escherichia coli CFT073
cuuccgccaccacgcccagcgac

SEQ ID NO: 2603914 - RNA, 16 nt, Escherichia coli CFT073
cuuccgccaucaaucg

SEQ ID NO: 2603915 - RNA, 18 nt, Escherichia coli CFT073
cuuccgcgccaaacauuu

SEQ ID NO: 2603916 - RNA, 17 nt, Escherichia coli CFT073
cuuccgcugacagcgcg

SEQ ID NO: 2603917 - RNA, 19 nt, Escherichia coli CFT073
cuuccgcuuuuaacaucuu

SEQ ID NO: 2603918 - RNA, 15 nt, Escherichia coli CFT073
cuuccggaaccacca

SEQ ID NO: 2603919 - RNA, 16 nt, Escherichia coli CFT073
cuuccggaaccaccag

SEQ ID NO: 2603920 - RNA, 17 nt, Escherichia coli CFT073
cuuccggaaccaccaga

SEQ ID NO: 2603921 - RNA, 19 nt, Escherichia coli CFT073
cuuccggaaccaccagauc

SEQ ID NO: 2603922 - RNA, 20 nt, Escherichia coli CFT073
cuuccggaaccaccagaucc

SEQ ID NO: 2603923 - RNA, 19 nt, Escherichia coli CFT073
cuuccggacguucagccau

SEQ ID NO: 2603924 - RNA, 15 nt, Escherichia coli CFT073
cuuccggagcugcuc

SEQ ID NO: 2603925 - RNA, 22 nt, Escherichia coli CFT073
cuuccggaguaaugaaaccgaa

SEQ ID NO: 2603926 - RNA, 23 nt, Escherichia coli CFT073
cuuccggcaagcaaauuaauuac

SEQ ID NO: 2603927 - RNA, 17 nt, Escherichia coli CFT073
cuuccggcacaucgccg

SEQ ID NO: 2603928 - RNA, 18 nt, Escherichia coli CFT073
cuuccggccagcaugccu

SEQ ID NO: 2603929 - RNA, 13 nt, Escherichia coli CFT073
cuuccgggcaaca

SEQ ID NO: 2603930 - RNA, 16 nt, Escherichia coli CFT073
cuuccgggcuauacac

SEQ ID NO: 2603931 - RNA, 14 nt, Escherichia coli CFT073
cuuccggugcgauc

SEQ ID NO: 2603932 - RNA, 13 nt, Escherichia coli CFT073
cuuccgucagcaa

SEQ ID NO: 2603933 - RNA, 18 nt, Escherichia coli CFT073
cuuccuacaagaggucaa

SEQ ID NO: 2603934 - RNA, 15 nt, Escherichia coli CFT073
cuuccuacguuaaaa

SEQ ID NO: 2603935 - RNA, 21 nt, Escherichia coli CFT073
cuuccuauggcuucuauuuuu

SEQ ID NO: 2603936 - RNA, 16 nt, Escherichia coli CFT073
cuuccuccaccacuuu

SEQ ID NO: 2603937 - RNA, 20 nt, Escherichia coli CFT073
cuuccucgcucucgccgcgc

SEQ ID NO: 2603938 - RNA, 15 nt, Escherichia coli CFT073
cuucuggcggcggca

SEQ ID NO: 2603939 - RNA, 15 nt, Escherichia coli CFT073
cuucuguaacuggaa

SEQ ID NO: 2603940 - RNA, 18 nt, Escherichia coli CFT073
cuucugucacgcuggcau

SEQ ID NO: 2603941 - RNA, 16 nt, Escherichia coli CFT073
cuucuguuaaaucauc

SEQ ID NO: 2603942 - RNA, 15 nt, Escherichia coli CFT073
cuucuguuugcgcca

SEQ ID NO: 2603943 - RNA, 13 nt, Escherichia coli CFT073
cuucuguuuuauc

SEQ ID NO: 2603944 - RNA, 17 nt, Escherichia coli CFT073
cuucuguuuuaucaauu

SEQ ID NO: 2603945 - RNA, 23 nt, Escherichia coli CFT073
cuucuuaaugcccaucucuucuu

SEQ ID NO: 2603946 - RNA, 13 nt, Escherichia coli CFT073
cuucuucaaaaaa

SEQ ID NO: 2603947 - RNA, 17 nt, Escherichia coli CFT073
cuucuucacaaaucuua

SEQ ID NO: 2603948 - RNA, 23 nt, Escherichia coli CFT073
cuucuucagccaguuuuucagcg

SEQ ID NO: 2603949 - RNA, 17 nt, Escherichia coli CFT073
cuucuucauucauccgc

SEQ ID NO: 2603950 - RNA, 12 nt, Escherichia coli CFT073
cuucuuccagcu

SEQ ID NO: 2603951 - RNA, 20 nt, Escherichia coli CFT073
cuucuucccagacccaguuu

SEQ ID NO: 2603952 - RNA, 12 nt, Escherichia coli CFT073
cuucuuccgcgc

SEQ ID NO: 2603953 - RNA, 22 nt, Escherichia coli CFT073
cuucuuccgcgccaaacauuuc

SEQ ID NO: 2603954 - RNA, 18 nt, Escherichia coli CFT073
cuucuuccgggcuauaca

SEQ ID NO: 2603955 - RNA, 16 nt, Escherichia coli CFT073
cuucuucggucgcuuc

SEQ ID NO: 2603956 - RNA, 15 nt, Escherichia coli CFT073
cuucuucuaucguuu

SEQ ID NO: 2603957 - RNA, 14 nt, Escherichia coli CFT073
cuucuucucagcca

SEQ ID NO: 2603958 - RNA, 14 nt, Escherichia coli CFT073
cuucuucuuccagg

SEQ ID NO: 2603959 - RNA, 16 nt, Escherichia coli CFT073
cuucuucuuucgccag

SEQ ID NO: 2603960 - RNA, 16 nt, Escherichia coli CFT073
cuucuugcgcaaaccu

SEQ ID NO: 2603961 - RNA, 17 nt, Escherichia coli CFT073
cuucuugcgcaaaccug

SEQ ID NO: 2603962 - RNA, 12 nt, Escherichia coli CFT073
cuucuuuaauua

SEQ ID NO: 2603963 - RNA, 23 nt, Escherichia coli CFT073
cuucuuuaguugagcuuuuuccg

SEQ ID NO: 2603964 - RNA, 13 nt, Escherichia coli CFT073
cuucuuucagagu

SEQ ID NO: 2603965 - RNA, 13 nt, Escherichia coli CFT073
cuucuuucaucau

SEQ ID NO: 2603966 - RNA, 18 nt, Escherichia coli CFT073
cuucuuucucggccaccg

SEQ ID NO: 2603967 - RNA, 21 nt, Escherichia coli CFT073
cuucuuugcgccagcggguaa

SEQ ID NO: 2603968 - RNA, 17 nt, Escherichia coli CFT073
cuucuuuugucgcuuua

SEQ ID NO: 2603969 - RNA, 21 nt, Escherichia coli CFT073
cuugaaaccgguuuguaggcc

SEQ ID NO: 2603970 - RNA, 19 nt, Escherichia coli CFT073
cuugaaaucaccguagccc

SEQ ID NO: 2603971 - RNA, 20 nt, Escherichia coli CFT073
cuugaacuuaucaucagucg

SEQ ID NO: 2603972 - RNA, 20 nt, Escherichia coli CFT073
cuugaauaaauuggcugggg

SEQ ID NO: 2603973 - RNA, 21 nt, Escherichia coli CFT073
cuugaauaaauuggcuggggu

SEQ ID NO: 2603974 - RNA, 13 nt, Escherichia coli CFT073
cuugaaucggcgu

SEQ ID NO: 2603975 - RNA, 12 nt, Escherichia coli CFT073
cuugaauuuauc

SEQ ID NO: 2603976 - RNA, 22 nt, Escherichia coli CFT073
cuugaauuuaucuucaccaaau

SEQ ID NO: 2603977 - RNA, 14 nt, Escherichia coli CFT073
cuugacuaucacuc

SEQ ID NO: 2603978 - RNA, 20 nt, Escherichia coli CFT073
cuugacucuguggcgggaaa

SEQ ID NO: 2603979 - RNA, 20 nt, Escherichia coli CFT073
cuugagacagaaacaaauga

SEQ ID NO: 2603980 - RNA, 21 nt, Escherichia coli CFT073
cuugagacagaaacaaaugaa

SEQ ID NO: 2603981 - RNA, 13 nt, Escherichia coli CFT073
cuugaguaauuaa

SEQ ID NO: 2603982 - RNA, 17 nt, Escherichia coli CFT073
cuugaguaccgagaaaa

SEQ ID NO: 2603983 - RNA, 22 nt, Escherichia coli CFT073
cuugauccugcagugcguaagc

SEQ ID NO: 2603984 - RNA, 12 nt, Escherichia coli CFT073
cuugaucuuccu

SEQ ID NO: 2603985 - RNA, 15 nt, Escherichia coli CFT073
cuugaucuuccugau

SEQ ID NO: 2603986 - RNA, 17 nt, Escherichia coli CFT073
cuugauuauccucugua

SEQ ID NO: 2603987 - RNA, 21 nt, Escherichia coli CFT073
cuugauuauuucccucguuuu

SEQ ID NO: 2603988 - RNA, 16 nt, Escherichia coli CFT073
cuugcaagaucgcgca

SEQ ID NO: 2603989 - RNA, 16 nt, Escherichia coli CFT073
cuugcagauaauuuug

SEQ ID NO: 2603990 - RNA, 21 nt, Escherichia coli CFT073
cuugcagauaauuuugcaguc

SEQ ID NO: 2603991 - RNA, 22 nt, Escherichia coli CFT073
cuugcaggaucagcuccggcag

SEQ ID NO: 2603992 - RNA, 22 nt, Escherichia coli CFT073
cuugcagucggcuuucucauuu

SEQ ID NO: 2603993 - RNA, 13 nt, Escherichia coli CFT073
cuugccaaauuua

SEQ ID NO: 2603994 - RNA, 17 nt, Escherichia coli CFT073
cuugccaaauuuacugu

SEQ ID NO: 2603995 - RNA, 16 nt, Escherichia coli CFT073
cuugccaaggucgggg

SEQ ID NO: 2603996 - RNA, 20 nt, Escherichia coli CFT073
cuugccagauuuucuucagc

SEQ ID NO: 2603997 - RNA, 16 nt, Escherichia coli CFT073
cuugccagcaggguuu

SEQ ID NO: 2603998 - RNA, 13 nt, Escherichia coli CFT073
cuugccaggccga

SEQ ID NO: 2603999 - RNA, 19 nt, Escherichia coli CFT073
cuugccagguagcguuuca

SEQ ID NO: 2604000 - RNA, 18 nt, Escherichia coli CFT073
cuugccagugacaugaau

SEQ ID NO: 2604001 - RNA, 20 nt, Escherichia coli CFT073
cuugccauuccacaaaaacc

SEQ ID NO: 2604002 - RNA, 15 nt, Escherichia coli CFT073
cuugccgcgucuuau

SEQ ID NO: 2604003 - RNA, 23 nt, Escherichia coli CFT073
cuugccgucuucuucccagaccc

SEQ ID NO: 2604004 - RNA, 16 nt, Escherichia coli CFT073
cuugccuccagcgacg

SEQ ID NO: 2604005 - RNA, 13 nt, Escherichia coli CFT073
cuugccucccugc

SEQ ID NO: 2604006 - RNA, 19 nt, Escherichia coli CFT073
cuugccucccugcaaagaa

SEQ ID NO: 2604007 - RNA, 14 nt, Escherichia coli CFT073
cuugccugcaggaa

SEQ ID NO: 2604008 - RNA, 17 nt, Escherichia coli CFT073
cuugccuucacaggccg

SEQ ID NO: 2604009 - RNA, 14 nt, Escherichia coli CFT073
cuugcgacagccau

SEQ ID NO: 2604010 - RNA, 14 nt, Escherichia coli CFT073
cuugcgacucagcc

SEQ ID NO: 2604011 - RNA, 19 nt, Escherichia coli CFT073
cuugcgauauggcugcgcu

SEQ ID NO: 2604012 - RNA, 20 nt, Escherichia coli CFT073
cuugcgauauggcugcgcuu

SEQ ID NO: 2604013 - RNA, 16 nt, Escherichia coli CFT073
cuugcgauccugcaga

SEQ ID NO: 2604014 - RNA, 18 nt, Escherichia coli CFT073
cuugcgauuacguucggc

SEQ ID NO: 2604015 - RNA, 18 nt, Escherichia coli CFT073
cuugcgcauaauaagcgc

SEQ ID NO: 2604016 - RNA, 13 nt, Escherichia coli CFT073
cuugcgccgcccg

SEQ ID NO: 2604017 - RNA, 13 nt, Escherichia coli CFT073
cuugcggaucggc

SEQ ID NO: 2604018 - RNA, 13 nt, Escherichia coli CFT073
cuugcggccagca

SEQ ID NO: 2604019 - RNA, 14 nt, Escherichia coli CFT073
cuugcggcguauau

SEQ ID NO: 2604020 - RNA, 22 nt, Escherichia coli CFT073
cuugcggucaggugcccgcguu

SEQ ID NO: 2604021 - RNA, 21 nt, Escherichia coli CFT073
cuugcucagauugcugacaac

SEQ ID NO: 2604022 - RNA, 12 nt, Escherichia coli CFT073
cuugcucagugu

SEQ ID NO: 2604023 - RNA, 21 nt, Escherichia coli CFT073
cuugcucgaagaguuccagcg

SEQ ID NO: 2604024 - RNA, 22 nt, Escherichia coli CFT073
cuugcucgcgcaccuacagcca

SEQ ID NO: 2604025 - RNA, 16 nt, Escherichia coli CFT073
cuugcucguuuucaau

SEQ ID NO: 2604026 - RNA, 14 nt, Escherichia coli CFT073
cuugcugacguaaa

SEQ ID NO: 2604027 - RNA, 16 nt, Escherichia coli CFT073
cuugcugaugcacgca

SEQ ID NO: 2604028 - RNA, 19 nt, Escherichia coli CFT073
cuugcugauugcggucagc

SEQ ID NO: 2604029 - RNA, 16 nt, Escherichia coli CFT073
cuugcugcauuacugg

SEQ ID NO: 2604030 - RNA, 15 nt, Escherichia coli CFT073
cuugcugcgauccgc

SEQ ID NO: 2604031 - RNA, 19 nt, Escherichia coli CFT073
cuugcugguacguuuauua

SEQ ID NO: 2604032 - RNA, 15 nt, Escherichia coli CFT073
cuugcuggucacuga

SEQ ID NO: 2604033 - RNA, 15 nt, Escherichia coli CFT073
cuugcugugcagcaa

SEQ ID NO: 2604034 - RNA, 14 nt, Escherichia coli CFT073
cuugcuuuccagcu

SEQ ID NO: 2604035 - RNA, 22 nt, Escherichia coli CFT073
cuuggcaaagcugucaccaauc

SEQ ID NO: 2604036 - RNA, 18 nt, Escherichia coli CFT073
cuuggcagagcgacauac

SEQ ID NO: 2604037 - RNA, 15 nt, Escherichia coli CFT073
cuugguuacgcaccg

SEQ ID NO: 2604038 - RNA, 21 nt, Escherichia coli CFT073
cuugguuacgcaccgggcagg

SEQ ID NO: 2604039 - RNA, 17 nt, Escherichia coli CFT073
cuuguaaaacagccaau

SEQ ID NO: 2604040 - RNA, 19 nt, Escherichia coli CFT073
cuuguaacgaguacaaaaa

SEQ ID NO: 2604041 - RNA, 20 nt, Escherichia coli CFT073
cuugucaccguaaccaccag

SEQ ID NO: 2604042 - RNA, 13 nt, Escherichia coli CFT073
cuugucaggccug

SEQ ID NO: 2604043 - RNA, 15 nt, Escherichia coli CFT073
cuugucaggccugug

SEQ ID NO: 2604044 - RNA, 17 nt, Escherichia coli CFT073
cuugucauuaccacaac

SEQ ID NO: 2604045 - RNA, 16 nt, Escherichia coli CFT073
cuuguccugccauugu

SEQ ID NO: 2604046 - RNA, 15 nt, Escherichia coli CFT073
cuugucucuggucaa

SEQ ID NO: 2604047 - RNA, 16 nt, Escherichia coli CFT073
cuuuccaucuuuccuc

SEQ ID NO: 2604048 - RNA, 19 nt, Escherichia coli CFT073
cuuuccaugccaucugcca

SEQ ID NO: 2604049 - RNA, 17 nt, Escherichia coli CFT073
cuuuccauucuuuccca

SEQ ID NO: 2604050 - RNA, 19 nt, Escherichia coli CFT073
cuuuccauucuuucccagc

SEQ ID NO: 2604051 - RNA, 16 nt, Escherichia coli CFT073
cuuucccggcaaucac

SEQ ID NO: 2604052 - RNA, 18 nt, Escherichia coli CFT073
cuuucccuucacucugcu

SEQ ID NO: 2604053 - RNA, 22 nt, Escherichia coli CFT073
cuuucccuucacucugcugcca

SEQ ID NO: 2604054 - RNA, 21 nt, Escherichia coli CFT073
cuuuccggaaaaaucaaaaac

SEQ ID NO: 2604055 - RNA, 21 nt, Escherichia coli CFT073
cuuuccggcauuagcaucaag

SEQ ID NO: 2604056 - RNA, 17 nt, Escherichia coli CFT073
cuuuccguuuucacccu

SEQ ID NO: 2604057 - RNA, 15 nt, Escherichia coli CFT073
cuuuccucacuccuu

SEQ ID NO: 2604058 - RNA, 16 nt, Escherichia coli CFT073
cuuuccuuaacaaaaa

SEQ ID NO: 2604059 - RNA, 20 nt, Escherichia coli CFT073
cuuucgacagcgauuccagu

SEQ ID NO: 2604060 - RNA, 18 nt, Escherichia coli CFT073
cuuucgagcaauuuuccu

SEQ ID NO: 2604061 - RNA, 18 nt, Escherichia coli CFT073
cuuucgauaagacauaac

SEQ ID NO: 2604062 - RNA, 22 nt, Escherichia coli CFT073
cuuucgauuucggcgugcgcgc

SEQ ID NO: 2604063 - RNA, 16 nt, Escherichia coli CFT073
cuuucgccacaaagcu

SEQ ID NO: 2604064 - RNA, 18 nt, Escherichia coli CFT073
cuuucgcccagcguugca

SEQ ID NO: 2604065 - RNA, 18 nt, Escherichia coli CFT073
cuuucgccgguuuuucaa

SEQ ID NO: 2604066 - RNA, 15 nt, Escherichia coli CFT073
cuuucgccugcggcg

SEQ ID NO: 2604067 - RNA, 15 nt, Escherichia coli CFT073
cuuucgcuucaacca

SEQ ID NO: 2604068 - RNA, 14 nt, Escherichia coli CFT073
cuuucgcuucaagc

SEQ ID NO: 2604069 - RNA, 18 nt, Escherichia coli CFT073
cuuucgcuuuaucgccca

SEQ ID NO: 2604070 - RNA, 20 nt, Escherichia coli CFT073
cuuucggauuacugccagcu

SEQ ID NO: 2604071 - RNA, 17 nt, Escherichia coli CFT073
cuuucgggcgcaaaaac

SEQ ID NO: 2604072 - RNA, 20 nt, Escherichia coli CFT073
cuuucggguggccagcaaca

SEQ ID NO: 2604073 - RNA, 13 nt, Escherichia coli CFT073
cuuucgguagcag

SEQ ID NO: 2604074 - RNA, 18 nt, Escherichia coli CFT073
cuuucguacgagcucuuc

SEQ ID NO: 2604075 - RNA, 17 nt, Escherichia coli CFT073
cuuucguaggccugaua

SEQ ID NO: 2604076 - RNA, 21 nt, Escherichia coli CFT073
cuuucguggugagggcaaaca

SEQ ID NO: 2604077 - RNA, 19 nt, Escherichia coli CFT073
cuuucucaaaauacugccu

SEQ ID NO: 2604078 - RNA, 23 nt, Escherichia coli CFT073
cuuucucagucauaacguucagc

SEQ ID NO: 2604079 - RNA, 15 nt, Escherichia coli CFT073
cuuucuccggcagcu

SEQ ID NO: 2604080 - RNA, 19 nt, Escherichia coli CFT073
cuuucuccggcagcuuuac

SEQ ID NO: 2604081 - RNA, 15 nt, Escherichia coli CFT073
cuuucucgucaauac

SEQ ID NO: 2604082 - RNA, 16 nt, Escherichia coli CFT073
cuuucucuucaucuau

SEQ ID NO: 2604083 - RNA, 14 nt, Escherichia coli CFT073
cuuucucuuccagc

SEQ ID NO: 2604084 - RNA, 22 nt, Escherichia coli CFT073
cuuucugacgaauuaccaacac

SEQ ID NO: 2604085 - RNA, 16 nt, Escherichia coli CFT073
cuuucugagcaucaca

SEQ ID NO: 2604086 - RNA, 16 nt, Escherichia coli CFT073
cuuucugauaaccgua

SEQ ID NO: 2604087 - RNA, 16 nt, Escherichia coli CFT073
cuuucugcaaccagaa

SEQ ID NO: 2604088 - RNA, 23 nt, Escherichia coli CFT073
cuuucugcagggcaauagccagc

SEQ ID NO: 2604089 - RNA, 13 nt, Escherichia coli CFT073
cuuucuucagcgu

SEQ ID NO: 2604090 - RNA, 23 nt, Escherichia coli CFT073
cuuucuucccguuuucaguccuc

SEQ ID NO: 2604091 - RNA, 16 nt, Escherichia coli CFT073
cuuucuugccacuggc

SEQ ID NO: 2604092 - RNA, 14 nt, Escherichia coli CFT073
cuuucuugcgcccg

SEQ ID NO: 2604093 - RNA, 21 nt, Escherichia coli CFT073
cuuucuuuuauaguucggcug

SEQ ID NO: 2604094 - RNA, 23 nt, Escherichia coli CFT073
cuuucuuuuuguugcgcugaaac

SEQ ID NO: 2604095 - RNA, 18 nt, Escherichia coli CFT073
cuuugaaaauaacgucgc

SEQ ID NO: 2604096 - RNA, 15 nt, Escherichia coli CFT073
cuuugaaacgcacgc

SEQ ID NO: 2604097 - RNA, 21 nt, Escherichia coli CFT073
cuuugaaaucgaacagguugg

SEQ ID NO: 2604098 - RNA, 21 nt, Escherichia coli CFT073
cuuugacaccgcuguugcuuc

SEQ ID NO: 2604099 - RNA, 16 nt, Escherichia coli CFT073
cuuugacacuucauug

SEQ ID NO: 2604100 - RNA, 21 nt, Escherichia coli CFT073
cuuugacagcuuuuacaaaau

SEQ ID NO: 2604101 - RNA, 20 nt, Escherichia coli CFT073
cuuugacgucgaaacugaca

SEQ ID NO: 2604102 - RNA, 18 nt, Escherichia coli CFT073
cuuugacuguccgcaucc

SEQ ID NO: 2604103 - RNA, 12 nt, Escherichia coli CFT073
cuuugaucgcgu

SEQ ID NO: 2604104 - RNA, 18 nt, Escherichia coli CFT073
cuuugaucgcguuuuuug

SEQ ID NO: 2604105 - RNA, 22 nt, Escherichia coli CFT073
cuuugaucgguugcugaacagc

SEQ ID NO: 2604106 - RNA, 21 nt, Escherichia coli CFT073
cuuugaucucuaacgguucuu

SEQ ID NO: 2604107 - RNA, 16 nt, Escherichia coli CFT073
cuuugaugccaccagg

SEQ ID NO: 2604108 - RNA, 17 nt, Escherichia coli CFT073
cuuugaugccaccaggc

SEQ ID NO: 2604109 - RNA, 15 nt, Escherichia coli CFT073
cuuugauuaaccguu

SEQ ID NO: 2604110 - RNA, 17 nt, Escherichia coli CFT073
cuuugauuuccucccca

SEQ ID NO: 2604111 - RNA, 22 nt, Escherichia coli CFT073
cuuugcacucugcgacgguuuc

SEQ ID NO: 2604112 - RNA, 17 nt, Escherichia coli CFT073
cuuugcagguucugcuc

SEQ ID NO: 2604113 - RNA, 13 nt, Escherichia coli CFT073
cuuugcccuuucu

SEQ ID NO: 2604114 - RNA, 12 nt, Escherichia coli CFT073
cuuugccggaug

SEQ ID NO: 2604115 - RNA, 15 nt, Escherichia coli CFT073
cuuugccgucugcca

SEQ ID NO: 2604116 - RNA, 14 nt, Escherichia coli CFT073
cuuugccugccgcc

SEQ ID NO: 2604117 - RNA, 17 nt, Escherichia coli CFT073
cuuugcguuuggcauca

SEQ ID NO: 2604118 - RNA, 17 nt, Escherichia coli CFT073
cuuugcugcaaugaagg

SEQ ID NO: 2604119 - RNA, 14 nt, Escherichia coli CFT073
cuuugcugccuuuc

SEQ ID NO: 2604120 - RNA, 12 nt, Escherichia coli CFT073
cuuugcugugaa

SEQ ID NO: 2604121 - RNA, 17 nt, Escherichia coli CFT073
cuuugcugugaagcacc

SEQ ID NO: 2604122 - RNA, 20 nt, Escherichia coli CFT073
cuuugcuuuguaaagcgcca

SEQ ID NO: 2604123 - RNA, 19 nt, Escherichia coli CFT073
cuuuggacucauuaaacca

SEQ ID NO: 2604124 - RNA, 21 nt, Escherichia coli CFT073
cuuuggcggccuucuuccagu

SEQ ID NO: 2604125 - RNA, 13 nt, Escherichia coli CFT073
cuuuguaagcagg

SEQ ID NO: 2604126 - RNA, 16 nt, Escherichia coli CFT073
cuuuguaggccagaua

SEQ ID NO: 2604127 - RNA, 21 nt, Escherichia coli CFT073
cuuuguaggccugauaagacg

SEQ ID NO: 2604128 - RNA, 18 nt, Escherichia coli CFT073
cuuugucauuaaauccgc

SEQ ID NO: 2604129 - RNA, 18 nt, Escherichia coli CFT073
cuuugucgauuuccuuca

SEQ ID NO: 2604130 - RNA, 15 nt, Escherichia coli CFT073
cuuugucgggcaggc

SEQ ID NO: 2604131 - RNA, 21 nt, Escherichia coli CFT073
cuuugucuuucuggaaauaga

SEQ ID NO: 2604132 - RNA, 18 nt, Escherichia coli CFT073
cuuugugucagugucaga

SEQ ID NO: 2604133 - RNA, 17 nt, Escherichia coli CFT073
cuuuguguguuucggcu

SEQ ID NO: 2604134 - RNA, 18 nt, Escherichia coli CFT073
cuuuguuaaacagugccc

SEQ ID NO: 2604135 - RNA, 19 nt, Escherichia coli CFT073
cuuuguuaaacagugccca

SEQ ID NO: 2604136 - RNA, 21 nt, Escherichia coli CFT073
cuuuguuacccccauccacgc

SEQ ID NO: 2604137 - RNA, 15 nt, Escherichia coli CFT073
cuuuguuuccccugg

SEQ ID NO: 2604138 - RNA, 20 nt, Escherichia coli CFT073
cuuuguuuccccugguucaa

SEQ ID NO: 2604139 - RNA, 19 nt, Escherichia coli CFT073
cuuuuaaaccuuguuuaau

SEQ ID NO: 2604140 - RNA, 13 nt, Escherichia coli CFT073
cuuuuaaaucauc

SEQ ID NO: 2604141 - RNA, 13 nt, Escherichia coli CFT073
cuuuuaaaugcac

SEQ ID NO: 2604142 - RNA, 20 nt, Escherichia coli CFT073
cuuuuaacacguugcaacug

SEQ ID NO: 2604143 - RNA, 22 nt, Escherichia coli CFT073
cuuuuaauaauucaaaaaccug

SEQ ID NO: 2604144 - RNA, 20 nt, Escherichia coli CFT073
cuuuuacgcgggcagugcgc

SEQ ID NO: 2604145 - RNA, 16 nt, Escherichia coli CFT073
cuuuuacugcacucgc

SEQ ID NO: 2604146 - RNA, 13 nt, Escherichia coli CFT073
cuuuuagcgacaa

SEQ ID NO: 2604147 - RNA, 23 nt, Escherichia coli CFT073
cuuuuagcuguggugcaauccac

SEQ ID NO: 2604148 - RNA, 15 nt, Escherichia coli CFT073
cuuuuauauaaugaa

SEQ ID NO: 2604149 - RNA, 13 nt, Escherichia coli CFT073
cuuuuauuagccg

SEQ ID NO: 2604150 - RNA, 16 nt, Escherichia coli CFT073
cuuuuauucauguuga

SEQ ID NO: 2604151 - RNA, 17 nt, Escherichia coli CFT073
cuuuuauucauguugau

SEQ ID NO: 2604152 - RNA, 18 nt, Escherichia coli CFT073
cuuuuauucauguugauu

SEQ ID NO: 2604153 - RNA, 14 nt, Escherichia coli CFT073
cuuuucaaacacuu

SEQ ID NO: 2604154 - RNA, 16 nt, Escherichia coli CFT073
cuuuucaaacacuucu

SEQ ID NO: 2604155 - RNA, 20 nt, Escherichia coli CFT073
gaaaaugguuugccagcaga

SEQ ID NO: 2604156 - RNA, 18 nt, Escherichia coli CFT073
gaaaauuaacgggcaggu

SEQ ID NO: 2604157 - RNA, 20 nt, Escherichia coli CFT073
gaaaauuaacgggcagguca

SEQ ID NO: 2604158 - RNA, 16 nt, Escherichia coli CFT073
gaaaauuacgaauucc

SEQ ID NO: 2604159 - RNA, 18 nt, Escherichia coli CFT073
gaaaauuacgccggaaag

SEQ ID NO: 2604160 - RNA, 19 nt, Escherichia coli CFT073
gaaaauuauuuuaaauuuc

SEQ ID NO: 2604161 - RNA, 13 nt, Escherichia coli CFT073
gaaaauucaguuc

SEQ ID NO: 2604162 - RNA, 20 nt, Escherichia coli CFT073
gaaaauuguaguguugcagu

SEQ ID NO: 2604163 - RNA, 11 nt, Escherichia coli CFT073
gaaaauugucu

SEQ ID NO: 2604164 - RNA, 21 nt, Escherichia coli CFT073
gaaaauugucuuuuucaaagu

SEQ ID NO: 2604165 - RNA, 21 nt, Escherichia coli CFT073
gaaaauuuuuucagauaaaag

SEQ ID NO: 2604166 - RNA, 23 nt, Escherichia coli CFT073
gaaacaaaucacuauuaaagaaa

SEQ ID NO: 2604167 - RNA, 13 nt, Escherichia coli CFT073
gaaacaaaugaaa

SEQ ID NO: 2604168 - RNA, 15 nt, Escherichia coli CFT073
gaaacaagaaguuau

SEQ ID NO: 2604169 - RNA, 16 nt, Escherichia coli CFT073
gaaacacacuuuccag

SEQ ID NO: 2604170 - RNA, 22 nt, Escherichia coli CFT073
gaaacaccgucaacguuuuucg

SEQ ID NO: 2604171 - RNA, 21 nt, Escherichia coli CFT073
gaaacagauaaaaguuacauc

SEQ ID NO: 2604172 - RNA, 15 nt, Escherichia coli CFT073
gaaacagcaccaucc

SEQ ID NO: 2604173 - RNA, 21 nt, Escherichia coli CFT073
gaaacagccaaucauaaacgc

SEQ ID NO: 2604174 - RNA, 16 nt, Escherichia coli CFT073
gaaacaguaaguucac

SEQ ID NO: 2604175 - RNA, 16 nt, Escherichia coli CFT073
gaaacauccggcaacc

SEQ ID NO: 2604176 - RNA, 21 nt, Escherichia coli CFT073
gaaaccaaacuuaugcagcug

SEQ ID NO: 2604177 - RNA, 13 nt, Escherichia coli CFT073
gaaaccagcagcc

SEQ ID NO: 2604178 - RNA, 12 nt, Escherichia coli CFT073
gaaaccauauua

SEQ ID NO: 2604179 - RNA, 20 nt, Escherichia coli CFT073
gaaaccauccagcagacgcu

SEQ ID NO: 2604180 - RNA, 14 nt, Escherichia coli CFT073
gaaaccauugcagc

SEQ ID NO: 2604181 - RNA, 14 nt, Escherichia coli CFT073
gaaacccaacgcaa

SEQ ID NO: 2604182 - RNA, 19 nt, Escherichia coli CFT073
gaaacccggccacagcgcc

SEQ ID NO: 2604183 - RNA, 16 nt, Escherichia coli CFT073
gaaaccgaauccuuug

SEQ ID NO: 2604184 - RNA, 21 nt, Escherichia coli CFT073
gaaaccgagauaaaugccaaa

SEQ ID NO: 2604185 - RNA, 21 nt, Escherichia coli CFT073
gaaaccgguuuguaggccgga

SEQ ID NO: 2604186 - RNA, 19 nt, Escherichia coli CFT073
gaaaccgucuucccgcagc

SEQ ID NO: 2604187 - RNA, 20 nt, Escherichia coli CFT073
gaaaccgucuucccgcagcc

SEQ ID NO: 2604188 - RNA, 16 nt, Escherichia coli CFT073
gaaaccugaauccacu

SEQ ID NO: 2604189 - RNA, 21 nt, Escherichia coli CFT073
gaaaccuuacgccauccccga

SEQ ID NO: 2604190 - RNA, 16 nt, Escherichia coli CFT073
gaaaccuuuaugcagc

SEQ ID NO: 2604191 - RNA, 15 nt, Escherichia coli CFT073
gaaacgaaacccaaa

SEQ ID NO: 2604192 - RNA, 20 nt, Escherichia coli CFT073
gaaacgacaguaucgugaca

SEQ ID NO: 2604193 - RNA, 16 nt, Escherichia coli CFT073
gaaacgcaaauacuga

SEQ ID NO: 2604194 - RNA, 12 nt, Escherichia coli CFT073
gaaacgccaucu

SEQ ID NO: 2604195 - RNA, 19 nt, Escherichia coli CFT073
gaaacgccaucucuuuaug

SEQ ID NO: 2604196 - RNA, 15 nt, Escherichia coli CFT073
gaaacgccaucugaa

SEQ ID NO: 2604197 - RNA, 20 nt, Escherichia coli CFT073
gaaacgcgucugaccgucuu

SEQ ID NO: 2604198 - RNA, 23 nt, Escherichia coli CFT073
gaaacgcgucugaccgucuuuca

SEQ ID NO: 2604199 - RNA, 21 nt, Escherichia coli CFT073
gaaacgcucauaaauugcagc

SEQ ID NO: 2604200 - RNA, 22 nt, Escherichia coli CFT073
gaaacgguuaaucuguugaaaa

SEQ ID NO: 2604201 - RNA, 21 nt, Escherichia coli CFT073
gaaacguuaugcaccgacaau

SEQ ID NO: 2604202 - RNA, 18 nt, Escherichia coli CFT073
gaaacucgcugacugaua

SEQ ID NO: 2604203 - RNA, 14 nt, Escherichia coli CFT073
gaaacucugcggca

SEQ ID NO: 2604204 - RNA, 22 nt, Escherichia coli CFT073
gaaacugacaggucaucgcauc

SEQ ID NO: 2604205 - RNA, 19 nt, Escherichia coli CFT073
gaaacugaucauuaucacc

SEQ ID NO: 2604206 - RNA, 12 nt, Escherichia coli CFT073
gaaacuggaugg

SEQ ID NO: 2604207 - RNA, 19 nt, Escherichia coli CFT073
gaaacuggauggccugauu

SEQ ID NO: 2604208 - RNA, 15 nt, Escherichia coli CFT073
gaaacugugauugug

SEQ ID NO: 2604209 - RNA, 16 nt, Escherichia coli CFT073
gaaacuguucgcuggu

SEQ ID NO: 2604210 - RNA, 23 nt, Escherichia coli CFT073
gaaacuuauuuaaacccuuucug

SEQ ID NO: 2604211 - RNA, 21 nt, Escherichia coli CFT073
gaaacuucaccaacugugugc

SEQ ID NO: 2604212 - RNA, 24 nt, Escherichia coli CFT073
gaaacuuuccaugccaucugccag

SEQ ID NO: 2604213 - RNA, 16 nt, Escherichia coli CFT073
gaaagacugaauugcc

SEQ ID NO: 2604214 - RNA, 17 nt, Escherichia coli CFT073
gaaagacugaauugcca

SEQ ID NO: 2604215 - RNA, 12 nt, Escherichia coli CFT073
gaaagagcaaug

SEQ ID NO: 2604216 - RNA, 18 nt, Escherichia coli CFT073
gaaagagccgauaaacac

SEQ ID NO: 2604217 - RNA, 21 nt, Escherichia coli CFT073
gaaagaucacaauguaaauca

SEQ ID NO: 2604218 - RNA, 12 nt, Escherichia coli CFT073
gaaagauuuaau

SEQ ID NO: 2604219 - RNA, 20 nt, Escherichia coli CFT073
gaaagcaauuaacagugaca

SEQ ID NO: 2604220 - RNA, 16 nt, Escherichia coli CFT073
gaaagcaccugcacag

SEQ ID NO: 2604221 - RNA, 17 nt, Escherichia coli CFT073
gaaagcaccugcacagg

SEQ ID NO: 2604222 - RNA, 21 nt, Escherichia coli CFT073
gaaagcacuguucgccgcagc

SEQ ID NO: 2604223 - RNA, 21 nt, Escherichia coli CFT073
gaaagcagauaacccagcagc

SEQ ID NO: 2604224 - RNA, 18 nt, Escherichia coli CFT073
gaaagcaguaccgcagcc

SEQ ID NO: 2604225 - RNA, 14 nt, Escherichia coli CFT073
gaaagcaguuuaua

SEQ ID NO: 2604226 - RNA, 16 nt, Escherichia coli CFT073
gaaagcaguuuauaaa

SEQ ID NO: 2604227 - RNA, 13 nt, Escherichia coli CFT073
gaaagcccaucau

SEQ ID NO: 2604228 - RNA, 15 nt, Escherichia coli CFT073
gaaagcccaucaucc

SEQ ID NO: 2604229 - RNA, 13 nt, Escherichia coli CFT073
gaaagcccgcuuu

SEQ ID NO: 2604230 - RNA, 14 nt, Escherichia coli CFT073
gaaagccgacugca

SEQ ID NO: 2604231 - RNA, 18 nt, Escherichia coli CFT073
gaaagccgcuggcgcagc

SEQ ID NO: 2604232 - RNA, 20 nt, Escherichia coli CFT073
gaaagcgacuuugccuggcg

SEQ ID NO: 2604233 - RNA, 18 nt, Escherichia coli CFT073
gaaagcgagcaguacagc

SEQ ID NO: 2604234 - RNA, 19 nt, Escherichia coli CFT073
gaaagcgaggcuuauccgg

SEQ ID NO: 2604235 - RNA, 19 nt, Escherichia coli CFT073
gaaagcgccagcaagagca

SEQ ID NO: 2604236 - RNA, 21 nt, Escherichia coli CFT073
gaaagcgccaucaaugugcug

SEQ ID NO: 2604237 - RNA, 20 nt, Escherichia coli CFT073
gaaagcguauccaucacuaa

SEQ ID NO: 2604238 - RNA, 21 nt, Escherichia coli CFT073
gaaagcgucgccgccgccagc

SEQ ID NO: 2604239 - RNA, 20 nt, Escherichia coli CFT073
gaaagcugcugaccaccagc

SEQ ID NO: 2604240 - RNA, 21 nt, Escherichia coli CFT073
gaaagcugcugaccaccagca

SEQ ID NO: 2604241 - RNA, 22 nt, Escherichia coli CFT073
gaaagcugcugaccaccagcac

SEQ ID NO: 2604242 - RNA, 20 nt, Escherichia coli CFT073
gaaaggaacaaucuugcaaa

SEQ ID NO: 2604243 - RNA, 12 nt, Escherichia coli CFT073
gaaagggaagaa

SEQ ID NO: 2604244 - RNA, 20 nt, Escherichia coli CFT073
gaaagggcgucgauauccac

SEQ ID NO: 2604245 - RNA, 15 nt, Escherichia coli CFT073
gaaagguauuuagcg

SEQ ID NO: 2604246 - RNA, 15 nt, Escherichia coli CFT073
gaaaggucaucauca

SEQ ID NO: 2604247 - RNA, 12 nt, Escherichia coli CFT073
gaaaguaaauua

SEQ ID NO: 2604248 - RNA, 14 nt, Escherichia coli CFT073
gaaaguaaauuauu

SEQ ID NO: 2604249 - RNA, 20 nt, Escherichia coli CFT073
gaaaguaacaauagcgaaca

SEQ ID NO: 2604250 - RNA, 19 nt, Escherichia coli CFT073
gaaaguagcggaaccgcag

SEQ ID NO: 2604251 - RNA, 18 nt, Escherichia coli CFT073
gaaaguauaugagaagac

SEQ ID NO: 2604252 - RNA, 19 nt, Escherichia coli CFT073
gaaagucguaggccugaua

SEQ ID NO: 2604253 - RNA, 21 nt, Escherichia coli CFT073
gaaagugccacgccccgcaua

SEQ ID NO: 2604254 - RNA, 21 nt, Escherichia coli CFT073
gaaagugccggauguucgcau

SEQ ID NO: 2604255 - RNA, 17 nt, Escherichia coli CFT073
gaaagugcuguaaagca

SEQ ID NO: 2604256 - RNA, 19 nt, Escherichia coli CFT073
gaaaguuucaaaggugcca

SEQ ID NO: 2604257 - RNA, 15 nt, Escherichia coli CFT073
gaaauaaaacaaaua

SEQ ID NO: 2604258 - RNA, 12 nt, Escherichia coli CFT073
gaaauaacaaau

SEQ ID NO: 2604259 - RNA, 15 nt, Escherichia coli CFT073
gaaauaacgcugaua

SEQ ID NO: 2604260 - RNA, 22 nt, Escherichia coli CFT073
gaaauaacuucuauucaccagc

SEQ ID NO: 2604261 - RNA, 12 nt, Escherichia coli CFT073
gaaauaaucacc

SEQ ID NO: 2604262 - RNA, 21 nt, Escherichia coli CFT073
gaaauaaucgggaauacagaa

SEQ ID NO: 2604263 - RNA, 15 nt, Escherichia coli CFT073
gaacaucacugcaaa

SEQ ID NO: 2604264 - RNA, 23 nt, Escherichia coli CFT073
gaacauccuuuccuuaagccagc

SEQ ID NO: 2604265 - RNA, 19 nt, Escherichia coli CFT073
gaacaugcgggucuuacug

SEQ ID NO: 2604266 - RNA, 20 nt, Escherichia coli CFT073
gaacaugcgggucuuacugg

SEQ ID NO: 2604267 - RNA, 23 nt, Escherichia coli CFT073
gaacauucccgguuucaggauga

SEQ ID NO: 2604268 - RNA, 13 nt, Escherichia coli CFT073
gaaccaaccgcaa

SEQ ID NO: 2604269 - RNA, 17 nt, Escherichia coli CFT073
gaaccaccagauccaac

SEQ ID NO: 2604270 - RNA, 21 nt, Escherichia coli CFT073
gaaccacggaaaggcaguuca

SEQ ID NO: 2604271 - RNA, 21 nt, Escherichia coli CFT073
gaaccagaauuuccagaaagu

SEQ ID NO: 2604272 - RNA, 22 nt, Escherichia coli CFT073
gaaccagaauuuccagaaagug

SEQ ID NO: 2604273 - RNA, 18 nt, Escherichia coli CFT073
gaaccagcgcacagagca

SEQ ID NO: 2604274 - RNA, 21 nt, Escherichia coli CFT073
gaaccagggaaaaaagccccg

SEQ ID NO: 2604275 - RNA, 18 nt, Escherichia coli CFT073
gaaccagugcuccaccuu

SEQ ID NO: 2604276 - RNA, 13 nt, Escherichia coli CFT073
gaaccaucaccuc

SEQ ID NO: 2604277 - RNA, 12 nt, Escherichia coli CFT073
gaaccaucgacg

SEQ ID NO: 2604278 - RNA, 11 nt, Escherichia coli CFT073
gaaccaucggc

SEQ ID NO: 2604279 - RNA, 23 nt, Escherichia coli CFT073
gaaccaugcaaucacugccacca

SEQ ID NO: 2604280 - RNA, 22 nt, Escherichia coli CFT073
gaacccagcgcgauacgcagua

SEQ ID NO: 2604281 - RNA, 19 nt, Escherichia coli CFT073
gaacccgcaguccugcagg

SEQ ID NO: 2604282 - RNA, 18 nt, Escherichia coli CFT073
gaacccggguaggcugcu

SEQ ID NO: 2604283 - RNA, 17 nt, Escherichia coli CFT073
gaacccguuggcacagg

SEQ ID NO: 2604284 - RNA, 16 nt, Escherichia coli CFT073
gaaccgaaauggcugc

SEQ ID NO: 2604285 - RNA, 14 nt, Escherichia coli CFT073
gaaccgagcacacc

SEQ ID NO: 2604286 - RNA, 21 nt, Escherichia coli CFT073
gaaccgauaguauggagcagg

SEQ ID NO: 2604287 - RNA, 18 nt, Escherichia coli CFT073
gaaccgaucagauugaga

SEQ ID NO: 2604288 - RNA, 15 nt, Escherichia coli CFT073
gaaccgccccacccc

SEQ ID NO: 2604289 - RNA, 15 nt, Escherichia coli CFT073
gaaccgccuggcgcu

SEQ ID NO: 2604290 - RNA, 20 nt, Escherichia coli CFT073
gaaccgccuggcgcugcuca

SEQ ID NO: 2604291 - RNA, 12 nt, Escherichia coli CFT073
gaaccgugaccg

SEQ ID NO: 2604292 - RNA, 16 nt, Escherichia coli CFT073
gaaccgugucgccauc

SEQ ID NO: 2604293 - RNA, 21 nt, Escherichia coli CFT073
gaaccguucauuucacgcagc

SEQ ID NO: 2604294 - RNA, 20 nt, Escherichia coli CFT073
gaaccugacggcgcaacgca

SEQ ID NO: 2604295 - RNA, 17 nt, Escherichia coli CFT073
gaaccugugacagcagc

SEQ ID NO: 2604296 - RNA, 18 nt, Escherichia coli CFT073
gaaccugugacagcagcg

SEQ ID NO: 2604297 - RNA, 22 nt, Escherichia coli CFT073
gaaccuuccaucgcaucuucgc

SEQ ID NO: 2604298 - RNA, 13 nt, Escherichia coli CFT073
gaacgagaaaagc

SEQ ID NO: 2604299 - RNA, 18 nt, Escherichia coli CFT073
gaacgaucgcuuucaacg

SEQ ID NO: 2604300 - RNA, 14 nt, Escherichia coli CFT073
gaacgccaccaacg

SEQ ID NO: 2604301 - RNA, 21 nt, Escherichia coli CFT073
gaacgccgaauaacgcgcagc

SEQ ID NO: 2604302 - RNA, 13 nt, Escherichia coli CFT073
gaacgccgccagu

SEQ ID NO: 2604303 - RNA, 13 nt, Escherichia coli CFT073
gaacgccgcuggu

SEQ ID NO: 2604304 - RNA, 19 nt, Escherichia coli CFT073
gaacgccuaacucuugcca

SEQ ID NO: 2604305 - RNA, 12 nt, Escherichia coli CFT073
gaacgccugcac

SEQ ID NO: 2604306 - RNA, 16 nt, Escherichia coli CFT073
gaacgccuuauccggc

SEQ ID NO: 2604307 - RNA, 19 nt, Escherichia coli CFT073
gaacgccuuauccggccua

SEQ ID NO: 2604308 - RNA, 18 nt, Escherichia coli CFT073
gaacgcgaaggccagcac

SEQ ID NO: 2604309 - RNA, 17 nt, Escherichia coli CFT073
gaacgcgccaagauaga

SEQ ID NO: 2604310 - RNA, 15 nt, Escherichia coli CFT073
gaacgcgcugcacca

SEQ ID NO: 2604311 - RNA, 19 nt, Escherichia coli CFT073
gaacgcugacaaacugcgu

SEQ ID NO: 2604312 - RNA, 14 nt, Escherichia coli CFT073
gaacgcugcauacu

SEQ ID NO: 2604313 - RNA, 21 nt, Escherichia coli CFT073
gaacggagucgggucgccgua

SEQ ID NO: 2604314 - RNA, 22 nt, Escherichia coli CFT073
gaacggauagagcgcugcgcag

SEQ ID NO: 2604315 - RNA, 14 nt, Escherichia coli CFT073
gaacggauauuuug

SEQ ID NO: 2604316 - RNA, 23 nt, Escherichia coli CFT073
gaacggcgaugcuuugaccuccc

SEQ ID NO: 2604317 - RNA, 15 nt, Escherichia coli CFT073
gaacggcggucaggu

SEQ ID NO: 2604318 - RNA, 20 nt, Escherichia coli CFT073
gaacgguaggccggauaagg

SEQ ID NO: 2604319 - RNA, 20 nt, Escherichia coli CFT073
gaacggugcgaccaaacugc

SEQ ID NO: 2604320 - RNA, 16 nt, Escherichia coli CFT073
gaacgucgcagggaga

SEQ ID NO: 2604321 - RNA, 16 nt, Escherichia coli CFT073
gaacgucugccuccca

SEQ ID NO: 2604322 - RNA, 17 nt, Escherichia coli CFT073
gaacgugcaaaaucaaa

SEQ ID NO: 2604323 - RNA, 22 nt, Escherichia coli CFT073
gaacguuccccgcgauggcugg

SEQ ID NO: 2604324 - RNA, 15 nt, Escherichia coli CFT073
gaacguucugcuguu

SEQ ID NO: 2604325 - RNA, 15 nt, Escherichia coli CFT073
gaacguuuaaugccg

SEQ ID NO: 2604326 - RNA, 13 nt, Escherichia coli CFT073
gaacguuuucacc

SEQ ID NO: 2604327 - RNA, 19 nt, Escherichia coli CFT073
gaacuaccgugcuguacag

SEQ ID NO: 2604328 - RNA, 12 nt, Escherichia coli CFT073
gaacuaguagca

SEQ ID NO: 2604329 - RNA, 22 nt, Escherichia coli CFT073
gaacuaguagcaugaaguaaca

SEQ ID NO: 2604330 - RNA, 16 nt, Escherichia coli CFT073
gaacucacacaaauau

SEQ ID NO: 2604331 - RNA, 14 nt, Escherichia coli CFT073
gaacucacagggcu

SEQ ID NO: 2604332 - RNA, 15 nt, Escherichia coli CFT073
gaacucacagggcug

SEQ ID NO: 2604333 - RNA, 20 nt, Escherichia coli CFT073
gaacucaggcugccagauca

SEQ ID NO: 2604334 - RNA, 22 nt, Escherichia coli CFT073
gaacucaggcugccagaucauc

SEQ ID NO: 2604335 - RNA, 17 nt, Escherichia coli CFT073
gaacuccgaucccugcg

SEQ ID NO: 2604336 - RNA, 18 nt, Escherichia coli CFT073
gaacuccgccccggcaau

SEQ ID NO: 2604337 - RNA, 15 nt, Escherichia coli CFT073
gaacucgaccugcaa

SEQ ID NO: 2604338 - RNA, 19 nt, Escherichia coli CFT073
gaacucuuccggcagggug

SEQ ID NO: 2604339 - RNA, 14 nt, Escherichia coli CFT073
gaacucuuccggga

SEQ ID NO: 2604340 - RNA, 13 nt, Escherichia coli CFT073
gaacugaaaggca

SEQ ID NO: 2604341 - RNA, 21 nt, Escherichia coli CFT073
gaacugaaaggcacucauuuu

SEQ ID NO: 2604342 - RNA, 17 nt, Escherichia coli CFT073
gaacugaacaccgccuu

SEQ ID NO: 2604343 - RNA, 23 nt, Escherichia coli CFT073
gaacugaugaacggugcgcaggc

SEQ ID NO: 2604344 - RNA, 14 nt, Escherichia coli CFT073
gaacugcaacucac

SEQ ID NO: 2604345 - RNA, 18 nt, Escherichia coli CFT073
gaacugcaacucaccuuu

SEQ ID NO: 2604346 - RNA, 16 nt, Escherichia coli CFT073
gaacugcaaggagagc

SEQ ID NO: 2604347 - RNA, 16 nt, Escherichia coli CFT073
gaacugcauugucgga

SEQ ID NO: 2604348 - RNA, 19 nt, Escherichia coli CFT073
gaacugcgguaauccgggu

SEQ ID NO: 2604349 - RNA, 15 nt, Escherichia coli CFT073
gaacugcuccagggc

SEQ ID NO: 2604350 - RNA, 15 nt, Escherichia coli CFT073
gaacugcugcgccag

SEQ ID NO: 2604351 - RNA, 21 nt, Escherichia coli CFT073
gaacuggcguuacccuugugg

SEQ ID NO: 2604352 - RNA, 18 nt, Escherichia coli CFT073
gaacugggccugcauauc

SEQ ID NO: 2604353 - RNA, 19 nt, Escherichia coli CFT073
gaacuuaguaggccugaua

SEQ ID NO: 2604354 - RNA, 22 nt, Escherichia coli CFT073
gaacuuaucgauuaccgccagc

SEQ ID NO: 2604355 - RNA, 13 nt, Escherichia coli CFT073
gaacuucccgcug

SEQ ID NO: 2604356 - RNA, 13 nt, Escherichia coli CFT073
gaacuucgccagc

SEQ ID NO: 2604357 - RNA, 16 nt, Escherichia coli CFT073
gaacuucgccagcgug

SEQ ID NO: 2604358 - RNA, 13 nt, Escherichia coli CFT073
gaacuuuuuucau

SEQ ID NO: 2604359 - RNA, 18 nt, Escherichia coli CFT073
gaacuuuuuucauccagc

SEQ ID NO: 2604360 - RNA, 10 nt, Escherichia coli CFT073
gaagaaaaac

SEQ ID NO: 2604361 - RNA, 13 nt, Escherichia coli CFT073
gaagaaaaacugg

SEQ ID NO: 2604362 - RNA, 19 nt, Escherichia coli CFT073
gaagaaaaugguuugccag

SEQ ID NO: 2604363 - RNA, 19 nt, Escherichia coli CFT073
gaagaaacgagcguacuga

SEQ ID NO: 2604364 - RNA, 12 nt, Escherichia coli CFT073
gaagaaaucagu

SEQ ID NO: 2604365 - RNA, 19 nt, Escherichia coli CFT073
gaagaaccaagccugcugg

SEQ ID NO: 2604366 - RNA, 12 nt, Escherichia coli CFT073
gaagaaccgcac

SEQ ID NO: 2604367 - RNA, 12 nt, Escherichia coli CFT073
gaagaagcccau

SEQ ID NO: 2604368 - RNA, 20 nt, Escherichia coli CFT073
gaagaagcuugcuucuuugc

SEQ ID NO: 2604369 - RNA, 12 nt, Escherichia coli CFT073
gaagaauaaauu

SEQ ID NO: 2604370 - RNA, 17 nt, Escherichia coli CFT073
gaagaauacgccccaga

SEQ ID NO: 2604371 - RNA, 17 nt, Escherichia coli CFT073
gaagaauuuucgcugga

SEQ ID NO: 2604372 - RNA, 20 nt, Escherichia coli CFT073
gaaguggauauccuggucaa

SEQ ID NO: 2604373 - RNA, 14 nt, Escherichia coli CFT073
gaaguggugauuca

SEQ ID NO: 2604374 - RNA, 15 nt, Escherichia coli CFT073
gaaguggugauucag

SEQ ID NO: 2604375 - RNA, 22 nt, Escherichia coli CFT073
gaaguuagagccgauauccgga

SEQ ID NO: 2604376 - RNA, 17 nt, Escherichia coli CFT073
gaaguuauuaaugacaa

SEQ ID NO: 2604377 - RNA, 19 nt, Escherichia coli CFT073
gaaguucguccccaccagu

SEQ ID NO: 2604378 - RNA, 15 nt, Escherichia coli CFT073
gaaguuuuccucagu

SEQ ID NO: 2604379 - RNA, 20 nt, Escherichia coli CFT073
gaaguuuugucgcugauucg

SEQ ID NO: 2604380 - RNA, 13 nt, Escherichia coli CFT073
gaaguuuuuccag

SEQ ID NO: 2604381 - RNA, 13 nt, Escherichia coli CFT073
gaauaaaaagcga

SEQ ID NO: 2604382 - RNA, 15 nt, Escherichia coli CFT073
gaauaaaaagcgaua

SEQ ID NO: 2604383 - RNA, 19 nt, Escherichia coli CFT073
gaauaaaagaaauagcgga

SEQ ID NO: 2604384 - RNA, 12 nt, Escherichia coli CFT073
gaauaaaagcca

SEQ ID NO: 2604385 - RNA, 15 nt, Escherichia coli CFT073
gaauaaagacacugc

SEQ ID NO: 2604386 - RNA, 15 nt, Escherichia coli CFT073
gaauaaagcuuuaau

SEQ ID NO: 2604387 - RNA, 15 nt, Escherichia coli CFT073
gaauaaauuugggug

SEQ ID NO: 2604388 - RNA, 21 nt, Escherichia coli CFT073
gaauaacaaacggcgguaaaa

SEQ ID NO: 2604389 - RNA, 23 nt, Escherichia coli CFT073
gaauaacacccauaaaaaaaccc

SEQ ID NO: 2604390 - RNA, 15 nt, Escherichia coli CFT073
gaauaacgcgcagcg

SEQ ID NO: 2604391 - RNA, 17 nt, Escherichia coli CFT073
gaauaacgcggcaggag

SEQ ID NO: 2604392 - RNA, 13 nt, Escherichia coli CFT073
gaauaacgcuggg

SEQ ID NO: 2604393 - RNA, 19 nt, Escherichia coli CFT073
gaauaacggcugauaacaa

SEQ ID NO: 2604394 - RNA, 14 nt, Escherichia coli CFT073
gaauaacuuccugu

SEQ ID NO: 2604395 - RNA, 12 nt, Escherichia coli CFT073
gaauaagacagu

SEQ ID NO: 2604396 - RNA, 15 nt, Escherichia coli CFT073
gaauaagcgcccagc

SEQ ID NO: 2604397 - RNA, 15 nt, Escherichia coli CFT073
gaauaagcugccgcu

SEQ ID NO: 2604398 - RNA, 22 nt, Escherichia coli CFT073
gaauaagcuguacggagcggau

SEQ ID NO: 2604399 - RNA, 14 nt, Escherichia coli CFT073
gaauaauccccaca

SEQ ID NO: 2604400 - RNA, 17 nt, Escherichia coli CFT073
gaauaauccccacauca

SEQ ID NO: 2604401 - RNA, 23 nt, Escherichia coli CFT073
gaauaaucguaaucagcaucuca

SEQ ID NO: 2604402 - RNA, 19 nt, Escherichia coli CFT073
gaauaaucguucccgcggc

SEQ ID NO: 2604403 - RNA, 17 nt, Escherichia coli CFT073
gaauaaugcaaaaaggc

SEQ ID NO: 2604404 - RNA, 12 nt, Escherichia coli CFT073
gaauaaugccuu

SEQ ID NO: 2604405 - RNA, 21 nt, Escherichia coli CFT073
gaauaaugguauuaagccagu

SEQ ID NO: 2604406 - RNA, 13 nt, Escherichia coli CFT073
gaauacacaucag

SEQ ID NO: 2604407 - RNA, 16 nt, Escherichia coli CFT073
gaauacacugcugaua

SEQ ID NO: 2604408 - RNA, 22 nt, Escherichia coli CFT073
gaauaccacgcguugauaacgu

SEQ ID NO: 2604409 - RNA, 12 nt, Escherichia coli CFT073
gaauacccagca

SEQ ID NO: 2604410 - RNA, 13 nt, Escherichia coli CFT073
gaauacccagcaa

SEQ ID NO: 2604411 - RNA, 14 nt, Escherichia coli CFT073
gaauacccagcaau

SEQ ID NO: 2604412 - RNA, 20 nt, Escherichia coli CFT073
gaauacccagcaaugccagg

SEQ ID NO: 2604413 - RNA, 16 nt, Escherichia coli CFT073
gaauaccguaaaacuc

SEQ ID NO: 2604414 - RNA, 18 nt, Escherichia coli CFT073
gaauaccguauucaacga

SEQ ID NO: 2604415 - RNA, 14 nt, Escherichia coli CFT073
gaauaccugaaacu

SEQ ID NO: 2604416 - RNA, 15 nt, Escherichia coli CFT073
gaauaccuucuuccu

SEQ ID NO: 2604417 - RNA, 17 nt, Escherichia coli CFT073
gaauaccuugcugcucc

SEQ ID NO: 2604418 - RNA, 12 nt, Escherichia coli CFT073
gaauacugccgu

SEQ ID NO: 2604419 - RNA, 15 nt, Escherichia coli CFT073
gaauagagccuggcu

SEQ ID NO: 2604420 - RNA, 20 nt, Escherichia coli CFT073
gaauagccuuuagcgagcga

SEQ ID NO: 2604421 - RNA, 20 nt, Escherichia coli CFT073
gaauagcgaaccgguaugac

SEQ ID NO: 2604422 - RNA, 23 nt, Escherichia coli CFT073
gaauagcgccacgccaaccaccg

SEQ ID NO: 2604423 - RNA, 16 nt, Escherichia coli CFT073
gaauagcucaguuggu

SEQ ID NO: 2604424 - RNA, 23 nt, Escherichia coli CFT073
gaauagcucaguugguagagcac

SEQ ID NO: 2604425 - RNA, 14 nt, Escherichia coli CFT073
gaauaguacauugu

SEQ ID NO: 2604426 - RNA, 14 nt, Escherichia coli CFT073
gaauauacgccaga

SEQ ID NO: 2604427 - RNA, 15 nt, Escherichia coli CFT073
gaauaucaccacuga

SEQ ID NO: 2604428 - RNA, 21 nt, Escherichia coli CFT073
gaauaucauugccgguuggcg

SEQ ID NO: 2604429 - RNA, 19 nt, Escherichia coli CFT073
gaauaucccauuucuccac

SEQ ID NO: 2604430 - RNA, 15 nt, Escherichia coli CFT073
gaauauccugacuuu

SEQ ID NO: 2604431 - RNA, 19 nt, Escherichia coli CFT073
gaauaucgaucgccgcacc

SEQ ID NO: 2604432 - RNA, 15 nt, Escherichia coli CFT073
gaauaucguauccgg

SEQ ID NO: 2604433 - RNA, 19 nt, Escherichia coli CFT073
gaauaugcugaauuagcca

SEQ ID NO: 2604434 - RNA, 22 nt, Escherichia coli CFT073
gaauaugggaggaaaaguaauc

SEQ ID NO: 2604435 - RNA, 13 nt, Escherichia coli CFT073
gaauauuccaguu

SEQ ID NO: 2604436 - RNA, 18 nt, Escherichia coli CFT073
gaauauucuguucaugca

SEQ ID NO: 2604437 - RNA, 18 nt, Escherichia coli CFT073
gaaucaaacauggagagu

SEQ ID NO: 2604438 - RNA, 11 nt, Escherichia coli CFT073
gaaucaacaca

SEQ ID NO: 2604439 - RNA, 16 nt, Escherichia coli CFT073
gaaucaaccaugguuu

SEQ ID NO: 2604440 - RNA, 23 nt, Escherichia coli CFT073
gaaucaacggcaacaauuuccgc

SEQ ID NO: 2604441 - RNA, 13 nt, Escherichia coli CFT073
gaaucaaucucag

SEQ ID NO: 2604442 - RNA, 22 nt, Escherichia coli CFT073
gaaucaccucuuuuucgacuuc

SEQ ID NO: 2604443 - RNA, 18 nt, Escherichia coli CFT073
gaaucacgaauuccgccu

SEQ ID NO: 2604444 - RNA, 22 nt, Escherichia coli CFT073
gaaucacgauacuggcgucuuu

SEQ ID NO: 2604445 - RNA, 17 nt, Escherichia coli CFT073
gaaucagaauccggugc

SEQ ID NO: 2604446 - RNA, 19 nt, Escherichia coli CFT073
gaaucagcaaacugguuga

SEQ ID NO: 2604447 - RNA, 20 nt, Escherichia coli CFT073
gaaucagcagauccaucgcc

SEQ ID NO: 2604448 - RNA, 20 nt, Escherichia coli CFT073
gaaucaggcgauuagcgaua

SEQ ID NO: 2604449 - RNA, 13 nt, Escherichia coli CFT073
gaaucauaggcuu

SEQ ID NO: 2604450 - RNA, 20 nt, Escherichia coli CFT073
gaaucaucauaucgucauua

SEQ ID NO: 2604451 - RNA, 22 nt, Escherichia coli CFT073
gaaucaucauaucgucauuauc

SEQ ID NO: 2604452 - RNA, 19 nt, Escherichia coli CFT073
gaaucaucgcuguggcagu

SEQ ID NO: 2604453 - RNA, 13 nt, Escherichia coli CFT073
gaauccagcaagc

SEQ ID NO: 2604454 - RNA, 19 nt, Escherichia coli CFT073
gaauccagcacgaagaggc

SEQ ID NO: 2604455 - RNA, 19 nt, Escherichia coli CFT073
gaauccccacaaaccaccg

SEQ ID NO: 2604456 - RNA, 14 nt, Escherichia coli CFT073
gaauccccacugca

SEQ ID NO: 2604457 - RNA, 24 nt, Escherichia coli CFT073
gaauccccacugcauggcggcguc

SEQ ID NO: 2604458 - RNA, 21 nt, Escherichia coli CFT073
gaauccccaggagcuuacaua

SEQ ID NO: 2604459 - RNA, 23 nt, Escherichia coli CFT073
gaaucccuuccgcuuuuaacauc

SEQ ID NO: 2604460 - RNA, 14 nt, Escherichia coli CFT073
gaauccgcaccaac

SEQ ID NO: 2604461 - RNA, 18 nt, Escherichia coli CFT073
gaauccgcaccaacucca

SEQ ID NO: 2604462 - RNA, 21 nt, Escherichia coli CFT073
gaauccgcaccaacuccacuu

SEQ ID NO: 2604463 - RNA, 18 nt, Escherichia coli CFT073
gaauccggugauugcugc

SEQ ID NO: 2604464 - RNA, 21 nt, Escherichia coli CFT073
gaauccguuaacguaccggcg

SEQ ID NO: 2604465 - RNA, 17 nt, Escherichia coli CFT073
gaauccuucccccacca

SEQ ID NO: 2604466 - RNA, 18 nt, Escherichia coli CFT073
gaauccuucccccaccac

SEQ ID NO: 2604467 - RNA, 19 nt, Escherichia coli CFT073
gaauccuucccccaccacc

SEQ ID NO: 2604468 - RNA, 18 nt, Escherichia coli CFT073
gaauccuuuggacucauu

SEQ ID NO: 2604469 - RNA, 13 nt, Escherichia coli CFT073
gaaucgcaaccag

SEQ ID NO: 2604470 - RNA, 15 nt, Escherichia coli CFT073
gaaucgccccagcac

SEQ ID NO: 2604471 - RNA, 12 nt, Escherichia coli CFT073
gaaucgccugua

SEQ ID NO: 2604472 - RNA, 21 nt, Escherichia coli CFT073
gaaucgcgcguguugcgccaa

SEQ ID NO: 2604473 - RNA, 17 nt, Escherichia coli CFT073
gaaucgcguugccaguu

SEQ ID NO: 2604474 - RNA, 16 nt, Escherichia coli CFT073
gaaucggaucaauccc

SEQ ID NO: 2604475 - RNA, 18 nt, Escherichia coli CFT073
gaaucggaucaaucccca

SEQ ID NO: 2604476 - RNA, 20 nt, Escherichia coli CFT073
gaaucggugcgcgaugguca

SEQ ID NO: 2604477 - RNA, 19 nt, Escherichia coli CFT073
gaaucgucggaauggcauc

SEQ ID NO: 2604478 - RNA, 14 nt, Escherichia coli CFT073
gaaucuaagauccc

SEQ ID NO: 2604479 - RNA, 13 nt, Escherichia coli CFT073
gaaucucaauucc

SEQ ID NO: 2604480 - RNA, 15 nt, Escherichia coli CFT073
gaaucucaggcaaau

SEQ ID NO: 2604481 - RNA, 14 nt, Escherichia coli CFT073
gacaacgccgcuuu

SEQ ID NO: 2604482 - RNA, 17 nt, Escherichia coli CFT073
gacaacgccuuguucgc

SEQ ID NO: 2604483 - RNA, 14 nt, Escherichia coli CFT073
gacaacguuuucaa

SEQ ID NO: 2604484 - RNA, 18 nt, Escherichia coli CFT073
gacaacucauuccccgga

SEQ ID NO: 2604485 - RNA, 20 nt, Escherichia coli CFT073
gacaacuuuugcaggaagcu

SEQ ID NO: 2604486 - RNA, 13 nt, Escherichia coli CFT073
gacaagaauauug

SEQ ID NO: 2604487 - RNA, 21 nt, Escherichia coli CFT073
gacaagcguuagcgugaucuc

SEQ ID NO: 2604488 - RNA, 15 nt, Escherichia coli CFT073
gacaagguaguagaa

SEQ ID NO: 2604489 - RNA, 16 nt, Escherichia coli CFT073
gacaagguaguagaaa

SEQ ID NO: 2604490 - RNA, 19 nt, Escherichia coli CFT073
gacaaguuguugcucacac

SEQ ID NO: 2604491 - RNA, 13 nt, Escherichia coli CFT073
gacaauaaacggu

SEQ ID NO: 2604492 - RNA, 13 nt, Escherichia coli CFT073
gacaauaaucaac

SEQ ID NO: 2604493 - RNA, 14 nt, Escherichia coli CFT073
gacaauaaucguuc

SEQ ID NO: 2604494 - RNA, 13 nt, Escherichia coli CFT073
gacaaucaauccg

SEQ ID NO: 2604495 - RNA, 17 nt, Escherichia coli CFT073
gacaaucaucgccguca

SEQ ID NO: 2604496 - RNA, 14 nt, Escherichia coli CFT073
gacaauccagcgaa

SEQ ID NO: 2604497 - RNA, 16 nt, Escherichia coli CFT073
gacaauccagcgaaau

SEQ ID NO: 2604498 - RNA, 19 nt, Escherichia coli CFT073
gacaauccagcgaaauaaa

SEQ ID NO: 2604499 - RNA, 22 nt, Escherichia coli CFT073
gacaauccaguugguucaacaa

SEQ ID NO: 2604500 - RNA, 16 nt, Escherichia coli CFT073
gacaauccccgccagc

SEQ ID NO: 2604501 - RNA, 13 nt, Escherichia coli CFT073
gacaauccgcgag

SEQ ID NO: 2604502 - RNA, 19 nt, Escherichia coli CFT073
gacaauccuucccugcagu

SEQ ID NO: 2604503 - RNA, 13 nt, Escherichia coli CFT073
gacaaucgccagu

SEQ ID NO: 2604504 - RNA, 21 nt, Escherichia coli CFT073
gacaaugccgaauagaacaua

SEQ ID NO: 2604505 - RNA, 17 nt, Escherichia coli CFT073
gacaauuacaaaaugac

SEQ ID NO: 2604506 - RNA, 16 nt, Escherichia coli CFT073
gacaauuacucgccuu

SEQ ID NO: 2604507 - RNA, 17 nt, Escherichia coli CFT073
gacaauuccgccugcag

SEQ ID NO: 2604508 - RNA, 12 nt, Escherichia coli CFT073
gacacaacgcuu

SEQ ID NO: 2604509 - RNA, 19 nt, Escherichia coli CFT073
gacacaaucaaauccugca

SEQ ID NO: 2604510 - RNA, 14 nt, Escherichia coli CFT073
gacacaaugccaua

SEQ ID NO: 2604511 - RNA, 19 nt, Escherichia coli CFT073
gacacaguucuucaaaaau

SEQ ID NO: 2604512 - RNA, 15 nt, Escherichia coli CFT073
gacacauaaauaaca

SEQ ID NO: 2604513 - RNA, 14 nt, Escherichia coli CFT073
gacacauaaccagg

SEQ ID NO: 2604514 - RNA, 13 nt, Escherichia coli CFT073
gacacaucagcaa

SEQ ID NO: 2604515 - RNA, 14 nt, Escherichia coli CFT073
gacacaucagcaac

SEQ ID NO: 2604516 - RNA, 17 nt, Escherichia coli CFT073
gacacaucagcaacgcu

SEQ ID NO: 2604517 - RNA, 20 nt, Escherichia coli CFT073
gacacaucagcaacgcugac

SEQ ID NO: 2604518 - RNA, 12 nt, Escherichia coli CFT073
gacaccaaacag

SEQ ID NO: 2604519 - RNA, 17 nt, Escherichia coli CFT073
gacaccaaggaacugug

SEQ ID NO: 2604520 - RNA, 14 nt, Escherichia coli CFT073
gacaccaaucagcc

SEQ ID NO: 2604521 - RNA, 18 nt, Escherichia coli CFT073
gacaccagccaucuguuc

SEQ ID NO: 2604522 - RNA, 13 nt, Escherichia coli CFT073
gacaccagcgucg

SEQ ID NO: 2604523 - RNA, 16 nt, Escherichia coli CFT073
gacaccagcgucgcgu

SEQ ID NO: 2604524 - RNA, 21 nt, Escherichia coli CFT073
gacaccccgguaaagcgcaug

SEQ ID NO: 2604525 - RNA, 18 nt, Escherichia coli CFT073
gacaccgcugcuucucuu

SEQ ID NO: 2604526 - RNA, 15 nt, Escherichia coli CFT073
gacaccggcagagau

SEQ ID NO: 2604527 - RNA, 18 nt, Escherichia coli CFT073
gacaccggcgcacaaccg

SEQ ID NO: 2604528 - RNA, 18 nt, Escherichia coli CFT073
gacaccggcuuucaccug

SEQ ID NO: 2604529 - RNA, 23 nt, Escherichia coli CFT073
gacaccuguaaguuacuaaaagu

SEQ ID NO: 2604530 - RNA, 14 nt, Escherichia coli CFT073
gacacgccgccaga

SEQ ID NO: 2604531 - RNA, 16 nt, Escherichia coli CFT073
gacacgcgcgcauggu

SEQ ID NO: 2604532 - RNA, 20 nt, Escherichia coli CFT073
gacacgcugccccugguuau

SEQ ID NO: 2604533 - RNA, 18 nt, Escherichia coli CFT073
gacacuauucgccagcac

SEQ ID NO: 2604534 - RNA, 15 nt, Escherichia coli CFT073
gacacugccacuuuu

SEQ ID NO: 2604535 - RNA, 13 nt, Escherichia coli CFT073
gacacugccgccg

SEQ ID NO: 2604536 - RNA, 23 nt, Escherichia coli CFT073
gacacugccgccgucaucugggc

SEQ ID NO: 2604537 - RNA, 21 nt, Escherichia coli CFT073
gacacugcgaucgcccgcaau

SEQ ID NO: 2604538 - RNA, 23 nt, Escherichia coli CFT073
gacacuggaaacagccaaucaua

SEQ ID NO: 2604539 - RNA, 15 nt, Escherichia coli CFT073
gacacuggcagugug

SEQ ID NO: 2604540 - RNA, 18 nt, Escherichia coli CFT073
gacacuggcagugugccu

SEQ ID NO: 2604541 - RNA, 22 nt, Escherichia coli CFT073
gacacugugccgguaacugcuu

SEQ ID NO: 2604542 - RNA, 13 nt, Escherichia coli CFT073
gacacuuuccugc

SEQ ID NO: 2604543 - RNA, 17 nt, Escherichia coli CFT073
gacagaaacaaaugaaa

SEQ ID NO: 2604544 - RNA, 22 nt, Escherichia coli CFT073
gacagaaagugaucccacauca

SEQ ID NO: 2604545 - RNA, 21 nt, Escherichia coli CFT073
gacagaaaucagaguuugcca

SEQ ID NO: 2604546 - RNA, 13 nt, Escherichia coli CFT073
gacagaacccggc

SEQ ID NO: 2604547 - RNA, 13 nt, Escherichia coli CFT073
gacagaaucagca

SEQ ID NO: 2604548 - RNA, 15 nt, Escherichia coli CFT073
gacagaaucagcagc

SEQ ID NO: 2604549 - RNA, 23 nt, Escherichia coli CFT073
gacagacagccucaagcacccgc

SEQ ID NO: 2604550 - RNA, 16 nt, Escherichia coli CFT073
gacagaccacucucug

SEQ ID NO: 2604551 - RNA, 17 nt, Escherichia coli CFT073
gacagacgccagcgcuu

SEQ ID NO: 2604552 - RNA, 15 nt, Escherichia coli CFT073
gacagagauauucag

SEQ ID NO: 2604553 - RNA, 15 nt, Escherichia coli CFT073
gacagauuuauaaaa

SEQ ID NO: 2604554 - RNA, 17 nt, Escherichia coli CFT073
gacagauuuauaaaauc

SEQ ID NO: 2604555 - RNA, 23 nt, Escherichia coli CFT073
gacagcaccacuggcgauauugc

SEQ ID NO: 2604556 - RNA, 21 nt, Escherichia coli CFT073
gacagcaccccgacagcaugc

SEQ ID NO: 2604557 - RNA, 14 nt, Escherichia coli CFT073
gacagcaggaaaau

SEQ ID NO: 2604558 - RNA, 19 nt, Escherichia coli CFT073
gacagccaggaauccagca

SEQ ID NO: 2604559 - RNA, 14 nt, Escherichia coli CFT073
gacagccaucccca

SEQ ID NO: 2604560 - RNA, 16 nt, Escherichia coli CFT073
gacagccccaccagca

SEQ ID NO: 2604561 - RNA, 17 nt, Escherichia coli CFT073
gacagccccaccagcaa

SEQ ID NO: 2604562 - RNA, 18 nt, Escherichia coli CFT073
gacagccccaccagcaaa

SEQ ID NO: 2604563 - RNA, 15 nt, Escherichia coli CFT073
gacagccucaagcac

SEQ ID NO: 2604564 - RNA, 18 nt, Escherichia coli CFT073
gacagcgcaauagccuga

SEQ ID NO: 2604565 - RNA, 16 nt, Escherichia coli CFT073
gacagcgcccgacaag

SEQ ID NO: 2604566 - RNA, 17 nt, Escherichia coli CFT073
gacagcggugauuuccg

SEQ ID NO: 2604567 - RNA, 18 nt, Escherichia coli CFT073
gacagcguaauagccuga

SEQ ID NO: 2604568 - RNA, 15 nt, Escherichia coli CFT073
gacagcucacgcgcc

SEQ ID NO: 2604569 - RNA, 16 nt, Escherichia coli CFT073
gacaggcagacgauga

SEQ ID NO: 2604570 - RNA, 16 nt, Escherichia coli CFT073
gacaggccgugcaguu

SEQ ID NO: 2604571 - RNA, 21 nt, Escherichia coli CFT073
gacaggcgaaaccagcagcca

SEQ ID NO: 2604572 - RNA, 20 nt, Escherichia coli CFT073
gacagggugagcagggcgcu

SEQ ID NO: 2604573 - RNA, 18 nt, Escherichia coli CFT073
gacaggucaucgcaucgu

SEQ ID NO: 2604574 - RNA, 15 nt, Escherichia coli CFT073
gacagguucaugcug

SEQ ID NO: 2604575 - RNA, 19 nt, Escherichia coli CFT073
gacagguucaugcugcggc

SEQ ID NO: 2604576 - RNA, 20 nt, Escherichia coli CFT073
gacagguucaugcugcggcu

SEQ ID NO: 2604577 - RNA, 23 nt, Escherichia coli CFT073
gacaguaagcccaccacaaacca

SEQ ID NO: 2604578 - RNA, 19 nt, Escherichia coli CFT073
gacaguagccuuuaucugu

SEQ ID NO: 2604579 - RNA, 14 nt, Escherichia coli CFT073
gacaguaucaccaa

SEQ ID NO: 2604580 - RNA, 17 nt, Escherichia coli CFT073
gacagucacguagcggc

SEQ ID NO: 2604581 - RNA, 20 nt, Escherichia coli CFT073
gacagugcauaaauaccggc

SEQ ID NO: 2604582 - RNA, 16 nt, Escherichia coli CFT073
gacaguucaaucuccg

SEQ ID NO: 2604583 - RNA, 22 nt, Escherichia coli CFT073
gacaguuucaguuaaccggcuu

SEQ ID NO: 2604584 - RNA, 16 nt, Escherichia coli CFT073
gacauaaacaccagca

SEQ ID NO: 2604585 - RNA, 19 nt, Escherichia coli CFT073
gacauaaacaccagcaaua

SEQ ID NO: 2604586 - RNA, 19 nt, Escherichia coli CFT073
gacauaaaucauuccguag

SEQ ID NO: 2604587 - RNA, 16 nt, Escherichia coli CFT073
gacauacagcaccgcc

SEQ ID NO: 2604588 - RNA, 12 nt, Escherichia coli CFT073
gacauacagcgu

SEQ ID NO: 2604589 - RNA, 15 nt, Escherichia coli CFT073
gacauacagcguuuu

SEQ ID NO: 2604590 - RNA, 12 nt, Escherichia coli CFT073
gaccauauuccc

SEQ ID NO: 2604591 - RNA, 17 nt, Escherichia coli CFT073
gaccaucagcagcggca

SEQ ID NO: 2604592 - RNA, 17 nt, Escherichia coli CFT073
gaccaucagcaugacaa

SEQ ID NO: 2604593 - RNA, 20 nt, Escherichia coli CFT073
gaccaucggcacgaccagga

SEQ ID NO: 2604594 - RNA, 18 nt, Escherichia coli CFT073
gaccaucggcgcuggcgu

SEQ ID NO: 2604595 - RNA, 13 nt, Escherichia coli CFT073
gaccauuacugua

SEQ ID NO: 2604596 - RNA, 19 nt, Escherichia coli CFT073
gaccauucgccguccagga

SEQ ID NO: 2604597 - RNA, 14 nt, Escherichia coli CFT073
gaccauugaugcuc

SEQ ID NO: 2604598 - RNA, 18 nt, Escherichia coli CFT073
gacccacgccuuuuucuc

SEQ ID NO: 2604599 - RNA, 20 nt, Escherichia coli CFT073
gacccagcaccaguaccauu

SEQ ID NO: 2604600 - RNA, 17 nt, Escherichia coli CFT073
gacccagcgccagcaua

SEQ ID NO: 2604601 - RNA, 14 nt, Escherichia coli CFT073
gacccaucuuguca

SEQ ID NO: 2604602 - RNA, 14 nt, Escherichia coli CFT073
gacccgcacacuca

SEQ ID NO: 2604603 - RNA, 15 nt, Escherichia coli CFT073
gacccgcagccagca

SEQ ID NO: 2604604 - RNA, 19 nt, Escherichia coli CFT073
gacccggcaucuaucgaau

SEQ ID NO: 2604605 - RNA, 20 nt, Escherichia coli CFT073
gacccguuuuucuuugcgua

SEQ ID NO: 2604606 - RNA, 12 nt, Escherichia coli CFT073
gaccgaacaggu

SEQ ID NO: 2604607 - RNA, 15 nt, Escherichia coli CFT073
gaccgaacaggucac

SEQ ID NO: 2604608 - RNA, 23 nt, Escherichia coli CFT073
gaccgaauccuuauauaaaacac

SEQ ID NO: 2604609 - RNA, 14 nt, Escherichia coli CFT073
gaccgacaccggca

SEQ ID NO: 2604610 - RNA, 17 nt, Escherichia coli CFT073
gaccgagcgcccgccaa

SEQ ID NO: 2604611 - RNA, 15 nt, Escherichia coli CFT073
gaccgauaaccugcc

SEQ ID NO: 2604612 - RNA, 12 nt, Escherichia coli CFT073
gaccgcaugcag

SEQ ID NO: 2604613 - RNA, 13 nt, Escherichia coli CFT073
gaccgccagcgcc

SEQ ID NO: 2604614 - RNA, 14 nt, Escherichia coli CFT073
gaccgccagcgcca

SEQ ID NO: 2604615 - RNA, 19 nt, Escherichia coli CFT073
gaccgccaguaucuucacu

SEQ ID NO: 2604616 - RNA, 21 nt, Escherichia coli CFT073
gaccgccgucguaacaggaaa

SEQ ID NO: 2604617 - RNA, 23 nt, Escherichia coli CFT073
gaccgccuucguacugugcgccc

SEQ ID NO: 2604618 - RNA, 18 nt, Escherichia coli CFT073
gaccgcgggacaaauaau

SEQ ID NO: 2604619 - RNA, 15 nt, Escherichia coli CFT073
gaccgcuccgccauc

SEQ ID NO: 2604620 - RNA, 18 nt, Escherichia coli CFT073
gaccgcuguuaugcacac

SEQ ID NO: 2604621 - RNA, 17 nt, Escherichia coli CFT073
gaccgcuucaggaacug

SEQ ID NO: 2604622 - RNA, 14 nt, Escherichia coli CFT073
gaccgcuuuccuca

SEQ ID NO: 2604623 - RNA, 18 nt, Escherichia coli CFT073
gaccgcuuuccucaucag

SEQ ID NO: 2604624 - RNA, 23 nt, Escherichia coli CFT073
gaccgcuuuccucaucagaaaga

SEQ ID NO: 2604625 - RNA, 17 nt, Escherichia coli CFT073
gaccgcuuuuugauaag

SEQ ID NO: 2604626 - RNA, 16 nt, Escherichia coli CFT073
gaccggaauuuacccg

SEQ ID NO: 2604627 - RNA, 22 nt, Escherichia coli CFT073
gaccggaauuuacccgccaggu

SEQ ID NO: 2604628 - RNA, 18 nt, Escherichia coli CFT073
gaccggcgguacuuggca

SEQ ID NO: 2604629 - RNA, 23 nt, Escherichia coli CFT073
gaccgggagauuugcaucaucaa

SEQ ID NO: 2604630 - RNA, 15 nt, Escherichia coli CFT073
gaccgggauuuucaa

SEQ ID NO: 2604631 - RNA, 15 nt, Escherichia coli CFT073
gaccgguccacuucc

SEQ ID NO: 2604632 - RNA, 18 nt, Escherichia coli CFT073
gaccgguccacuuccugc

SEQ ID NO: 2604633 - RNA, 19 nt, Escherichia coli CFT073
gaccguacaaccaaaucug

SEQ ID NO: 2604634 - RNA, 22 nt, Escherichia coli CFT073
gaccgucgagcagagaaacgcc

SEQ ID NO: 2604635 - RNA, 17 nt, Escherichia coli CFT073
gaccgucuuuauccagc

SEQ ID NO: 2604636 - RNA, 24 nt, Escherichia coli CFT073
gaccguugauuuuguuggcauggu

SEQ ID NO: 2604637 - RNA, 18 nt, Escherichia coli CFT073
gaccuaaaaauucccacu

SEQ ID NO: 2604638 - RNA, 14 nt, Escherichia coli CFT073
gaccuagcaaacua

SEQ ID NO: 2604639 - RNA, 16 nt, Escherichia coli CFT073
gaccuccaucgcacca

SEQ ID NO: 2604640 - RNA, 22 nt, Escherichia coli CFT073
gaccucgcuauuuacaucgcga

SEQ ID NO: 2604641 - RNA, 20 nt, Escherichia coli CFT073
gaccucuucggcaaguguug

SEQ ID NO: 2604642 - RNA, 18 nt, Escherichia coli CFT073
gaccugaauuugcuccag

SEQ ID NO: 2604643 - RNA, 19 nt, Escherichia coli CFT073
gaccugaauuugcuccaga

SEQ ID NO: 2604644 - RNA, 16 nt, Escherichia coli CFT073
gaccugacuguuccag

SEQ ID NO: 2604645 - RNA, 16 nt, Escherichia coli CFT073
gaccuggcgcuucacu

SEQ ID NO: 2604646 - RNA, 18 nt, Escherichia coli CFT073
gaccugucgcagauauug

SEQ ID NO: 2604647 - RNA, 13 nt, Escherichia coli CFT073
gaccugucucuua

SEQ ID NO: 2604648 - RNA, 21 nt, Escherichia coli CFT073
gaccugugccgccgcccggca

SEQ ID NO: 2604649 - RNA, 17 nt, Escherichia coli CFT073
gaccuucuucagcaaua

SEQ ID NO: 2604650 - RNA, 12 nt, Escherichia coli CFT073
gaccuugccaag

SEQ ID NO: 2604651 - RNA, 19 nt, Escherichia coli CFT073
gaccuuucaguuugccgcu

SEQ ID NO: 2604652 - RNA, 13 nt, Escherichia coli CFT073
gaccuuuuuucag

SEQ ID NO: 2604653 - RNA, 18 nt, Escherichia coli CFT073
gacgaauaccuucuuccu

SEQ ID NO: 2604654 - RNA, 15 nt, Escherichia coli CFT073
gacgaaucagcaaac

SEQ ID NO: 2604655 - RNA, 14 nt, Escherichia coli CFT073
gacgaccagcggca

SEQ ID NO: 2604656 - RNA, 19 nt, Escherichia coli CFT073
gacgaccagcggcaacauc

SEQ ID NO: 2604657 - RNA, 18 nt, Escherichia coli CFT073
gacgaccuuuuccaucgc

SEQ ID NO: 2604658 - RNA, 17 nt, Escherichia coli CFT073
gacgacgacaggcaagc

SEQ ID NO: 2604659 - RNA, 16 nt, Escherichia coli CFT073
gacgacgaccagcggc

SEQ ID NO: 2604660 - RNA, 21 nt, Escherichia coli CFT073
gacgacgcgcuuguccugcca

SEQ ID NO: 2604661 - RNA, 23 nt, Escherichia coli CFT073
gacgagaaaugucggcccgcauu

SEQ ID NO: 2604662 - RNA, 19 nt, Escherichia coli CFT073
gacgaggauuucgccgccc

SEQ ID NO: 2604663 - RNA, 13 nt, Escherichia coli CFT073
gacgaggcgcugg

SEQ ID NO: 2604664 - RNA, 15 nt, Escherichia coli CFT073
gacgagggauaaaga

SEQ ID NO: 2604665 - RNA, 18 nt, Escherichia coli CFT073
gacgaguccuuccuggcu

SEQ ID NO: 2604666 - RNA, 15 nt, Escherichia coli CFT073
gacgauaggucauau

SEQ ID NO: 2604667 - RNA, 17 nt, Escherichia coli CFT073
gacgauaggucauauca

SEQ ID NO: 2604668 - RNA, 22 nt, Escherichia coli CFT073
gacgauaucgauaaagaacgca

SEQ ID NO: 2604669 - RNA, 19 nt, Escherichia coli CFT073
gacgaucauuccgcccaga

SEQ ID NO: 2604670 - RNA, 14 nt, Escherichia coli CFT073
gacgaucgcgcagg

SEQ ID NO: 2604671 - RNA, 15 nt, Escherichia coli CFT073
gacgauuauuuuccg

SEQ ID NO: 2604672 - RNA, 22 nt, Escherichia coli CFT073
gacgauuccggcaaauaacaga

SEQ ID NO: 2604673 - RNA, 22 nt, Escherichia coli CFT073
gacgcaaaacgcgcucacugca

SEQ ID NO: 2604674 - RNA, 22 nt, Escherichia coli CFT073
gacgcaaccagcgucgcaucag

SEQ ID NO: 2604675 - RNA, 19 nt, Escherichia coli CFT073
gacgcaccuuguucaucgg

SEQ ID NO: 2604676 - RNA, 23 nt, Escherichia coli CFT073
gacgcagaccaaagucaaacugg

SEQ ID NO: 2604677 - RNA, 18 nt, Escherichia coli CFT073
gacgcagguugugcuggg

SEQ ID NO: 2604678 - RNA, 20 nt, Escherichia coli CFT073
gacgcauaaaaaaagcgggc

SEQ ID NO: 2604679 - RNA, 18 nt, Escherichia coli CFT073
gacgcauaauccaggcau

SEQ ID NO: 2604680 - RNA, 18 nt, Escherichia coli CFT073
gacgcaucuuauccagcc

SEQ ID NO: 2604681 - RNA, 18 nt, Escherichia coli CFT073
gacgccacaacgauaauc

SEQ ID NO: 2604682 - RNA, 19 nt, Escherichia coli CFT073
gacgccacuaucugauaau

SEQ ID NO: 2604683 - RNA, 20 nt, Escherichia coli CFT073
gacgccacuaucugauaauc

SEQ ID NO: 2604684 - RNA, 23 nt, Escherichia coli CFT073
gacgccagaaaaccuggcgcagu

SEQ ID NO: 2604685 - RNA, 18 nt, Escherichia coli CFT073
gacgccagccgauccgga

SEQ ID NO: 2604686 - RNA, 21 nt, Escherichia coli CFT073
gacgccccugcgcucguucuu

SEQ ID NO: 2604687 - RNA, 19 nt, Escherichia coli CFT073
gacgccgcuggugucgcac

SEQ ID NO: 2604688 - RNA, 17 nt, Escherichia coli CFT073
gacgccugccagcucuu

SEQ ID NO: 2604689 - RNA, 19 nt, Escherichia coli CFT073
gacgcgaacagcgucgcau

SEQ ID NO: 2604690 - RNA, 13 nt, Escherichia coli CFT073
gacgcgaagcaca

SEQ ID NO: 2604691 - RNA, 16 nt, Escherichia coli CFT073
gacgcgcaaaauggcc

SEQ ID NO: 2604692 - RNA, 22 nt, Escherichia coli CFT073
gacgcgcaggagcggcggaggc

SEQ ID NO: 2604693 - RNA, 13 nt, Escherichia coli CFT073
gacgcgcaucacg

SEQ ID NO: 2604694 - RNA, 14 nt, Escherichia coli CFT073
gacgcgccagcagc

SEQ ID NO: 2604695 - RNA, 15 nt, Escherichia coli CFT073
gacgcgccagcagcg

SEQ ID NO: 2604696 - RNA, 17 nt, Escherichia coli CFT073
gacgcgccagcagcgca

SEQ ID NO: 2604697 - RNA, 17 nt, Escherichia coli CFT073
gacgcgccagcaucgca

SEQ ID NO: 2604698 - RNA, 16 nt, Escherichia coli CFT073
gacugacgcucugcuu

SEQ ID NO: 2604699 - RNA, 17 nt, Escherichia coli CFT073
gacugaucaauaucagc

SEQ ID NO: 2604700 - RNA, 17 nt, Escherichia coli CFT073
gacugaugacaaacgca

SEQ ID NO: 2604701 - RNA, 18 nt, Escherichia coli CFT073
gacugaugacaaacgcaa

SEQ ID NO: 2604702 - RNA, 20 nt, Escherichia coli CFT073
gacugaugugcuccaucagg

SEQ ID NO: 2604703 - RNA, 19 nt, Escherichia coli CFT073
gacugccagcaucuccugu

SEQ ID NO: 2604704 - RNA, 20 nt, Escherichia coli CFT073
gacugccgcacuuacagcaa

SEQ ID NO: 2604705 - RNA, 14 nt, Escherichia coli CFT073
gacugcuuuuucaa

SEQ ID NO: 2604706 - RNA, 17 nt, Escherichia coli CFT073
gacugcuuuuucaauuu

SEQ ID NO: 2604707 - RNA, 15 nt, Escherichia coli CFT073
gacuggaaaucaaau

SEQ ID NO: 2604708 - RNA, 18 nt, Escherichia coli CFT073
gacuggaaaucaaauaca

SEQ ID NO: 2604709 - RNA, 17 nt, Escherichia coli CFT073
gacuggaacaagccaaa

SEQ ID NO: 2604710 - RNA, 18 nt, Escherichia coli CFT073
gacuggaacaagccaaau

SEQ ID NO: 2604711 - RNA, 22 nt, Escherichia coli CFT073
gacuggaacaagccaaauccag

SEQ ID NO: 2604712 - RNA, 17 nt, Escherichia coli CFT073
gacuggccauggauuca

SEQ ID NO: 2604713 - RNA, 18 nt, Escherichia coli CFT073
gacuggccauggauucaa

SEQ ID NO: 2604714 - RNA, 20 nt, Escherichia coli CFT073
gacuggccauggauucaagc

SEQ ID NO: 2604715 - RNA, 13 nt, Escherichia coli CFT073
gacuguaaaucug

SEQ ID NO: 2604716 - RNA, 19 nt, Escherichia coli CFT073
gacugucgcuauucaacgu

SEQ ID NO: 2604717 - RNA, 15 nt, Escherichia coli CFT073
gacugucuuccugcg

SEQ ID NO: 2604718 - RNA, 14 nt, Escherichia coli CFT073
gacuguucaccacu

SEQ ID NO: 2604719 - RNA, 23 nt, Escherichia coli CFT073
gacuguucauuuuguaggccuga

SEQ ID NO: 2604720 - RNA, 23 nt, Escherichia coli CFT073
gacuguuggaaucacucaucaug

SEQ ID NO: 2604721 - RNA, 15 nt, Escherichia coli CFT073
gacuuauaagucuca

SEQ ID NO: 2604722 - RNA, 14 nt, Escherichia coli CFT073
gacuuauucuucaa

SEQ ID NO: 2604723 - RNA, 22 nt, Escherichia coli CFT073
gacuucaaaaauaaguugccac

SEQ ID NO: 2604724 - RNA, 16 nt, Escherichia coli CFT073
gacuucagccagugcu

SEQ ID NO: 2604725 - RNA, 17 nt, Escherichia coli CFT073
gacuucaucacgaugca

SEQ ID NO: 2604726 - RNA, 20 nt, Escherichia coli CFT073
gacuucaucggaaugcacag

SEQ ID NO: 2604727 - RNA, 17 nt, Escherichia coli CFT073
gacuucaugcgcagcau

SEQ ID NO: 2604728 - RNA, 22 nt, Escherichia coli CFT073
gacuucauucagaaaaacuaca

SEQ ID NO: 2604729 - RNA, 16 nt, Escherichia coli CFT073
gacuuccaccagcggc

SEQ ID NO: 2604730 - RNA, 16 nt, Escherichia coli CFT073
gacuuccacuuccugc

SEQ ID NO: 2604731 - RNA, 22 nt, Escherichia coli CFT073
gacuuccccugccaaccaacgc

SEQ ID NO: 2604732 - RNA, 21 nt, Escherichia coli CFT073
gacuucccucccguuucggua

SEQ ID NO: 2604733 - RNA, 18 nt, Escherichia coli CFT073
gacuuccugccucuuugc

SEQ ID NO: 2604734 - RNA, 22 nt, Escherichia coli CFT073
gacuugcgaacucaccaugacc

SEQ ID NO: 2604735 - RNA, 21 nt, Escherichia coli CFT073
gacuuguggcgcaggggcaga

SEQ ID NO: 2604736 - RNA, 16 nt, Escherichia coli CFT073
gacuuuaccugccuga

SEQ ID NO: 2604737 - RNA, 20 nt, Escherichia coli CFT073
gacuuuagcgaaaucuuccg

SEQ ID NO: 2604738 - RNA, 23 nt, Escherichia coli CFT073
gacuuuaucugauuuaaaaaugc

SEQ ID NO: 2604739 - RNA, 17 nt, Escherichia coli CFT073
gacuuucaaagagagca

SEQ ID NO: 2604740 - RNA, 16 nt, Escherichia coli CFT073
gacuuucucuggcugu

SEQ ID NO: 2604741 - RNA, 17 nt, Escherichia coli CFT073
gacuuucucuggcuguu

SEQ ID NO: 2604742 - RNA, 15 nt, Escherichia coli CFT073
gacuuucuuuucccu

SEQ ID NO: 2604743 - RNA, 13 nt, Escherichia coli CFT073
gacuuugcgccau

SEQ ID NO: 2604744 - RNA, 15 nt, Escherichia coli CFT073
gacuuuuacugucug

SEQ ID NO: 2604745 - RNA, 17 nt, Escherichia coli CFT073
gacuuuugcccggcaug

SEQ ID NO: 2604746 - RNA, 21 nt, Escherichia coli CFT073
gacuuuuuauuuauggggugg

SEQ ID NO: 2604747 - RNA, 23 nt, Escherichia coli CFT073
gacuuuuuccaguccacguucaa

SEQ ID NO: 2604748 - RNA, 16 nt, Escherichia coli CFT073
gacuuuuugcggcagc

SEQ ID NO: 2604749 - RNA, 15 nt, Escherichia coli CFT073
gagaaaaaucuccgg

SEQ ID NO: 2604750 - RNA, 13 nt, Escherichia coli CFT073
gagaaaaucacac

SEQ ID NO: 2604751 - RNA, 19 nt, Escherichia coli CFT073
gagaaacauccgguuucau

SEQ ID NO: 2604752 - RNA, 18 nt, Escherichia coli CFT073
gagaaaccacaucaaucc

SEQ ID NO: 2604753 - RNA, 15 nt, Escherichia coli CFT073
gagaaagagugcgcc

SEQ ID NO: 2604754 - RNA, 21 nt, Escherichia coli CFT073
gagaaagagugcgccagucac

SEQ ID NO: 2604755 - RNA, 16 nt, Escherichia coli CFT073
gagaaagcaaaaauaa

SEQ ID NO: 2604756 - RNA, 17 nt, Escherichia coli CFT073
gagaaagcaaaaauaaa

SEQ ID NO: 2604757 - RNA, 23 nt, Escherichia coli CFT073
gagaaauauaaagaaugaaauuc

SEQ ID NO: 2604758 - RNA, 23 nt, Escherichia coli CFT073
gagaaauccggggcaauuucagu

SEQ ID NO: 2604759 - RNA, 17 nt, Escherichia coli CFT073
gagaaaucggggucauc

SEQ ID NO: 2604760 - RNA, 20 nt, Escherichia coli CFT073
gagaaauucugcauuagcau

SEQ ID NO: 2604761 - RNA, 17 nt, Escherichia coli CFT073
gagaacaccgaaccaaa

SEQ ID NO: 2604762 - RNA, 22 nt, Escherichia coli CFT073
gagaacacgaccugccagagcu

SEQ ID NO: 2604763 - RNA, 18 nt, Escherichia coli CFT073
gagaacaucaauccaaac

SEQ ID NO: 2604764 - RNA, 13 nt, Escherichia coli CFT073
gagaacaucaucc

SEQ ID NO: 2604765 - RNA, 16 nt, Escherichia coli CFT073
gagaacauucaucauu

SEQ ID NO: 2604766 - RNA, 14 nt, Escherichia coli CFT073
gagaaccagcgcac

SEQ ID NO: 2604767 - RNA, 14 nt, Escherichia coli CFT073
gagaaccagcugcc

SEQ ID NO: 2604768 - RNA, 20 nt, Escherichia coli CFT073
gagaacgccuuauccggccu

SEQ ID NO: 2604769 - RNA, 17 nt, Escherichia coli CFT073
gagaacggcgcaccaga

SEQ ID NO: 2604770 - RNA, 14 nt, Escherichia coli CFT073
gagaacugaaccaa

SEQ ID NO: 2604771 - RNA, 17 nt, Escherichia coli CFT073
gagaacuuaaucaucgc

SEQ ID NO: 2604772 - RNA, 16 nt, Escherichia coli CFT073
gagaacuucggcagag

SEQ ID NO: 2604773 - RNA, 15 nt, Escherichia coli CFT073
gagaagaccgccgcu

SEQ ID NO: 2604774 - RNA, 19 nt, Escherichia coli CFT073
gagaagcauccugcacuuc

SEQ ID NO: 2604775 - RNA, 23 nt, Escherichia coli CFT073
gagaagcauccugcacuucaaau

SEQ ID NO: 2604776 - RNA, 17 nt, Escherichia coli CFT073
gagaagccgaccagcac

SEQ ID NO: 2604777 - RNA, 22 nt, Escherichia coli CFT073
gagaagccgaccagcaccgcca

SEQ ID NO: 2604778 - RNA, 18 nt, Escherichia coli CFT073
gagaagguugccauaucu

SEQ ID NO: 2604779 - RNA, 19 nt, Escherichia coli CFT073
gagaagucggcuuuuagcg

SEQ ID NO: 2604780 - RNA, 21 nt, Escherichia coli CFT073
gagaauaaaacaagcagcugc

SEQ ID NO: 2604781 - RNA, 24 nt, Escherichia coli CFT073
gagaauaaaacaagcagcugccag

SEQ ID NO: 2604782 - RNA, 22 nt, Escherichia coli CFT073
gagaauaccguugaccauauca

SEQ ID NO: 2604783 - RNA, 17 nt, Escherichia coli CFT073
gagaauauguuuuuaaa

SEQ ID NO: 2604784 - RNA, 17 nt, Escherichia coli CFT073
gagaauauugccgggaa

SEQ ID NO: 2604785 - RNA, 16 nt, Escherichia coli CFT073
gagaaucaguuuuuuc

SEQ ID NO: 2604786 - RNA, 13 nt, Escherichia coli CFT073
gagaauccagccc

SEQ ID NO: 2604787 - RNA, 21 nt, Escherichia coli CFT073
gagaauccagccccaccagca

SEQ ID NO: 2604788 - RNA, 18 nt, Escherichia coli CFT073
gagaaucgacaccaguuc

SEQ ID NO: 2604789 - RNA, 14 nt, Escherichia coli CFT073
gagaaugaauuuca

SEQ ID NO: 2604790 - RNA, 20 nt, Escherichia coli CFT073
gagaaugacgacaaagaccu

SEQ ID NO: 2604791 - RNA, 16 nt, Escherichia coli CFT073
gagaauuccggcagag

SEQ ID NO: 2604792 - RNA, 20 nt, Escherichia coli CFT073
gagacaaaguaauucccagu

SEQ ID NO: 2604793 - RNA, 13 nt, Escherichia coli CFT073
gagacaacucauu

SEQ ID NO: 2604794 - RNA, 17 nt, Escherichia coli CFT073
gagacaaugcaaacggc

SEQ ID NO: 2604795 - RNA, 20 nt, Escherichia coli CFT073
gagacacugcgaucgcccgc

SEQ ID NO: 2604796 - RNA, 20 nt, Escherichia coli CFT073
gagacauuggcaaaaccaaa

SEQ ID NO: 2604797 - RNA, 15 nt, Escherichia coli CFT073
gagaccaaaccauca

SEQ ID NO: 2604798 - RNA, 14 nt, Escherichia coli CFT073
gagacgaucgccac

SEQ ID NO: 2604799 - RNA, 15 nt, Escherichia coli CFT073
gagacgaucgccacu

SEQ ID NO: 2604800 - RNA, 12 nt, Escherichia coli CFT073
gagacgccagaa

SEQ ID NO: 2604801 - RNA, 20 nt, Escherichia coli CFT073
gagacgccagaaccgagcac

SEQ ID NO: 2604802 - RNA, 21 nt, Escherichia coli CFT073
gagacgguuaaaaacagccag

SEQ ID NO: 2604803 - RNA, 17 nt, Escherichia coli CFT073
gagacuuauucuggcaa

SEQ ID NO: 2604804 - RNA, 18 nt, Escherichia coli CFT073
gagagaauuaaccagaaa

SEQ ID NO: 2604805 - RNA, 17 nt, Escherichia coli CFT073
gagagacauuggcaaaa

SEQ ID NO: 2604806 - RNA, 20 nt, Escherichia coli CFT073
gagcggaaacagcggcugcu

SEQ ID NO: 2604807 - RNA, 23 nt, Escherichia coli CFT073
gagcggcguuuuguagagcagca

SEQ ID NO: 2604808 - RNA, 19 nt, Escherichia coli CFT073
gagcgggggcucccaccgc

SEQ ID NO: 2604809 - RNA, 23 nt, Escherichia coli CFT073
gagcgguaaagaacugagcgccg

SEQ ID NO: 2604810 - RNA, 21 nt, Escherichia coli CFT073
gagcguacugaccgucgccuu

SEQ ID NO: 2604811 - RNA, 20 nt, Escherichia coli CFT073
gagcguauagagcagcggcg

SEQ ID NO: 2604812 - RNA, 15 nt, Escherichia coli CFT073
gagcgugagugcgaa

SEQ ID NO: 2604813 - RNA, 19 nt, Escherichia coli CFT073
gagcguggcuggcugaccu

SEQ ID NO: 2604814 - RNA, 22 nt, Escherichia coli CFT073
gagcguuucaaaaacaaagaau

SEQ ID NO: 2604815 - RNA, 23 nt, Escherichia coli CFT073
gagcuaaaaucgccaaacuuaag

SEQ ID NO: 2604816 - RNA, 13 nt, Escherichia coli CFT073
gagcuaaacagag

SEQ ID NO: 2604817 - RNA, 15 nt, Escherichia coli CFT073
gagcuaccggcagga

SEQ ID NO: 2604818 - RNA, 21 nt, Escherichia coli CFT073
gagcuaugaauagucgccagc

SEQ ID NO: 2604819 - RNA, 15 nt, Escherichia coli CFT073
gagcugaagcauggu

SEQ ID NO: 2604820 - RNA, 12 nt, Escherichia coli CFT073
gagcugagugcg

SEQ ID NO: 2604821 - RNA, 15 nt, Escherichia coli CFT073
gagcugagugcgaaa

SEQ ID NO: 2604822 - RNA, 14 nt, Escherichia coli CFT073
gagcugauuuccgg

SEQ ID NO: 2604823 - RNA, 18 nt, Escherichia coli CFT073
gagcugccaguugcgcuu

SEQ ID NO: 2604824 - RNA, 19 nt, Escherichia coli CFT073
gagcugcccggcucauuuu

SEQ ID NO: 2604825 - RNA, 18 nt, Escherichia coli CFT073
gagcugcucggaauaaau

SEQ ID NO: 2604826 - RNA, 12 nt, Escherichia coli CFT073
gagcuggcggac

SEQ ID NO: 2604827 - RNA, 20 nt, Escherichia coli CFT073
gagcugggaauuucugacga

SEQ ID NO: 2604828 - RNA, 13 nt, Escherichia coli CFT073
gagcuuauauacu

SEQ ID NO: 2604829 - RNA, 21 nt, Escherichia coli CFT073
gagcuuauuuguugagcugga

SEQ ID NO: 2604830 - RNA, 18 nt, Escherichia coli CFT073
gagcuucacccgcagcac

SEQ ID NO: 2604831 - RNA, 19 nt, Escherichia coli CFT073
gagcuucacccgcagcacg

SEQ ID NO: 2604832 - RNA, 14 nt, Escherichia coli CFT073
gagcuucagcuaaa

SEQ ID NO: 2604833 - RNA, 18 nt, Escherichia coli CFT073
gagcuuuauccugcccgc

SEQ ID NO: 2604834 - RNA, 14 nt, Escherichia coli CFT073
gagcuuucuuauuc

SEQ ID NO: 2604835 - RNA, 13 nt, Escherichia coli CFT073
gagcuuucuucca

SEQ ID NO: 2604836 - RNA, 15 nt, Escherichia coli CFT073
gagcuuucuuccagg

SEQ ID NO: 2604837 - RNA, 19 nt, Escherichia coli CFT073
gagcuuucuuccagguuaa

SEQ ID NO: 2604838 - RNA, 22 nt, Escherichia coli CFT073
gagcuuuuuuaauguggcuggg

SEQ ID NO: 2604839 - RNA, 13 nt, Escherichia coli CFT073
gaggaaaaguaau

SEQ ID NO: 2604840 - RNA, 21 nt, Escherichia coli CFT073
gaggaacaauccucccuuacc

SEQ ID NO: 2604841 - RNA, 15 nt, Escherichia coli CFT073
gaggaacgcccccaa

SEQ ID NO: 2604842 - RNA, 15 nt, Escherichia coli CFT073
gaggaagcugcccuu

SEQ ID NO: 2604843 - RNA, 20 nt, Escherichia coli CFT073
gaggaccugcgucugaugaa

SEQ ID NO: 2604844 - RNA, 21 nt, Escherichia coli CFT073
gaggacgguaaauacugguca

SEQ ID NO: 2604845 - RNA, 12 nt, Escherichia coli CFT073
gaggagagcagg

SEQ ID NO: 2604846 - RNA, 14 nt, Escherichia coli CFT073
gaggagaguaugcg

SEQ ID NO: 2604847 - RNA, 21 nt, Escherichia coli CFT073
gaggagagugcaaugaaaaac

SEQ ID NO: 2604848 - RNA, 16 nt, Escherichia coli CFT073
gaggaggcuauagcag

SEQ ID NO: 2604849 - RNA, 19 nt, Escherichia coli CFT073
gaggaucacaaugccgcca

SEQ ID NO: 2604850 - RNA, 22 nt, Escherichia coli CFT073
gaggaucaccaguccaucggca

SEQ ID NO: 2604851 - RNA, 10 nt, Escherichia coli CFT073
gaggaucaug

SEQ ID NO: 2604852 - RNA, 19 nt, Escherichia coli CFT073
gaggaucgauaucaccaau

SEQ ID NO: 2604853 - RNA, 18 nt, Escherichia coli CFT073
gaggaucuccacccgcaa

SEQ ID NO: 2604854 - RNA, 15 nt, Escherichia coli CFT073
gaggcaaaaucauca

SEQ ID NO: 2604855 - RNA, 17 nt, Escherichia coli CFT073
gaggcacaauggccagc

SEQ ID NO: 2604856 - RNA, 17 nt, Escherichia coli CFT073
gaggcauuggcaaauuu

SEQ ID NO: 2604857 - RNA, 13 nt, Escherichia coli CFT073
gaggccaaaacca

SEQ ID NO: 2604858 - RNA, 18 nt, Escherichia coli CFT073
gaggccagcggcuuuuua

SEQ ID NO: 2604859 - RNA, 21 nt, Escherichia coli CFT073
gaggccgagcuaauaaucauc

SEQ ID NO: 2604860 - RNA, 21 nt, Escherichia coli CFT073
gaggccgaguagccagcugcc

SEQ ID NO: 2604861 - RNA, 20 nt, Escherichia coli CFT073
gaggccgcggcucaggcgca

SEQ ID NO: 2604862 - RNA, 20 nt, Escherichia coli CFT073
gaggcgaaaaagucagcgua

SEQ ID NO: 2604863 - RNA, 21 nt, Escherichia coli CFT073
gaggcgacgguuuccaggcag

SEQ ID NO: 2604864 - RNA, 17 nt, Escherichia coli CFT073
gaggcgaucgucgccgu

SEQ ID NO: 2604865 - RNA, 16 nt, Escherichia coli CFT073
gaggcuaauaaacagg

SEQ ID NO: 2604866 - RNA, 14 nt, Escherichia coli CFT073
gaggcucaaccgcc

SEQ ID NO: 2604867 - RNA, 20 nt, Escherichia coli CFT073
gaggcuccgccugauuuacu

SEQ ID NO: 2604868 - RNA, 20 nt, Escherichia coli CFT073
gaggcugcauuauccacgcc

SEQ ID NO: 2604869 - RNA, 15 nt, Escherichia coli CFT073
gaggcuuauccggca

SEQ ID NO: 2604870 - RNA, 23 nt, Escherichia coli CFT073
gaggcuuuaauaccugccuggua

SEQ ID NO: 2604871 - RNA, 21 nt, Escherichia coli CFT073
gagguaacaauaaauucgcca

SEQ ID NO: 2604872 - RNA, 22 nt, Escherichia coli CFT073
gagguaagcuucagaauggaaa

SEQ ID NO: 2604873 - RNA, 17 nt, Escherichia coli CFT073
gagguaauccagcgucg

SEQ ID NO: 2604874 - RNA, 13 nt, Escherichia coli CFT073
gagguccagcucc

SEQ ID NO: 2604875 - RNA, 14 nt, Escherichia coli CFT073
gaggucgcacugcu

SEQ ID NO: 2604876 - RNA, 16 nt, Escherichia coli CFT073
gaggucugaccguucg

SEQ ID NO: 2604877 - RNA, 20 nt, Escherichia coli CFT073
gaggugccaccagugcaggc

SEQ ID NO: 2604878 - RNA, 16 nt, Escherichia coli CFT073
gagguggagucagggg

SEQ ID NO: 2604879 - RNA, 17 nt, Escherichia coli CFT073
gagguggagucagggga

SEQ ID NO: 2604880 - RNA, 19 nt, Escherichia coli CFT073
gagguuaauauuuucgcca

SEQ ID NO: 2604881 - RNA, 20 nt, Escherichia coli CFT073
gagguuaucgcccugccagc

SEQ ID NO: 2604882 - RNA, 22 nt, Escherichia coli CFT073
gagguuuccgggucggcagauu

SEQ ID NO: 2604883 - RNA, 17 nt, Escherichia coli CFT073
gaguaaaaaaacaucau

SEQ ID NO: 2604884 - RNA, 15 nt, Escherichia coli CFT073
gaguaaaccgccugu

SEQ ID NO: 2604885 - RNA, 13 nt, Escherichia coli CFT073
gaguaaagcccgc

SEQ ID NO: 2604886 - RNA, 20 nt, Escherichia coli CFT073
gaguaaauaaccuuaucguu

SEQ ID NO: 2604887 - RNA, 15 nt, Escherichia coli CFT073
gaguaauagccugau

SEQ ID NO: 2604888 - RNA, 16 nt, Escherichia coli CFT073
gaguaaugaaaccgaa

SEQ ID NO: 2604889 - RNA, 13 nt, Escherichia coli CFT073
gaguaauuaaacu

SEQ ID NO: 2604890 - RNA, 19 nt, Escherichia coli CFT073
gaguaauuaauacgccagc

SEQ ID NO: 2604891 - RNA, 17 nt, Escherichia coli CFT073
gaguaauuuuucuuucg

SEQ ID NO: 2604892 - RNA, 14 nt, Escherichia coli CFT073
gaguacaaaaauaa

SEQ ID NO: 2604893 - RNA, 19 nt, Escherichia coli CFT073
gaguacacuguaccugguc

SEQ ID NO: 2604894 - RNA, 12 nt, Escherichia coli CFT073
gaguacauccac

SEQ ID NO: 2604895 - RNA, 16 nt, Escherichia coli CFT073
gaguaccgagaaaauc

SEQ ID NO: 2604896 - RNA, 17 nt, Escherichia coli CFT073
gaguaccgagaaaauca

SEQ ID NO: 2604897 - RNA, 17 nt, Escherichia coli CFT073
gaguacgcgguuuuugu

SEQ ID NO: 2604898 - RNA, 16 nt, Escherichia coli CFT073
gaguacguucacuuuu

SEQ ID NO: 2604899 - RNA, 12 nt, Escherichia coli CFT073
gaguagccagcu

SEQ ID NO: 2604900 - RNA, 15 nt, Escherichia coli CFT073
gaguagccagcugcc

SEQ ID NO: 2604901 - RNA, 17 nt, Escherichia coli CFT073
gaguagccagcugccug

SEQ ID NO: 2604902 - RNA, 16 nt, Escherichia coli CFT073
gaguagcucaccagca

SEQ ID NO: 2604903 - RNA, 17 nt, Escherichia coli CFT073
gaguagcucaccagcag

SEQ ID NO: 2604904 - RNA, 15 nt, Escherichia coli CFT073
gaguaguggaaaccg

SEQ ID NO: 2604905 - RNA, 22 nt, Escherichia coli CFT073
gaguauaaaaaagggugcagga

SEQ ID NO: 2604906 - RNA, 13 nt, Escherichia coli CFT073
gaguauauauucg

SEQ ID NO: 2604907 - RNA, 15 nt, Escherichia coli CFT073
gaguauauucuguaa

SEQ ID NO: 2604908 - RNA, 18 nt, Escherichia coli CFT073
gaguauuacccggcacag

SEQ ID NO: 2604909 - RNA, 17 nt, Escherichia coli CFT073
gaguauucuugcugaua

SEQ ID NO: 2604910 - RNA, 23 nt, Escherichia coli CFT073
gaguauuucauggggaauuugcg

SEQ ID NO: 2604911 - RNA, 16 nt, Escherichia coli CFT073
gaguauuuccagcuca

SEQ ID NO: 2604912 - RNA, 20 nt, Escherichia coli CFT073
gagucacgcgguuaucccaa

SEQ ID NO: 2604913 - RNA, 20 nt, Escherichia coli CFT073
gagucgcaaaacucaccuuu

SEQ ID NO: 2604914 - RNA, 17 nt, Escherichia coli CFT073
gagucgccuuuuuccau

SEQ ID NO: 2604915 - RNA, 14 nt, Escherichia coli CFT073
gagucggaagauua

SEQ ID NO: 2604916 - RNA, 16 nt, Escherichia coli CFT073
gagucuuucagacuga

SEQ ID NO: 2604917 - RNA, 18 nt, Escherichia coli CFT073
gagucuuugcuugcgaaa

SEQ ID NO: 2604918 - RNA, 19 nt, Escherichia coli CFT073
gagugaccaccaauaaccg

SEQ ID NO: 2604919 - RNA, 14 nt, Escherichia coli CFT073
gagugaggcguggc

SEQ ID NO: 2604920 - RNA, 18 nt, Escherichia coli CFT073
gagugauacguaaaccac

SEQ ID NO: 2604921 - RNA, 23 nt, Escherichia coli CFT073
gagugauacguaaaccacugaca

SEQ ID NO: 2604922 - RNA, 15 nt, Escherichia coli CFT073
gagugauuccguuca

SEQ ID NO: 2604923 - RNA, 12 nt, Escherichia coli CFT073
gagugcagcacu

SEQ ID NO: 2604924 - RNA, 16 nt, Escherichia coli CFT073
gagugcauccaguugc

SEQ ID NO: 2604925 - RNA, 22 nt, Escherichia coli CFT073
gagugcgaaacuucuuaaaaug

SEQ ID NO: 2604926 - RNA, 17 nt, Escherichia coli CFT073
gaguggcgaaauuggua

SEQ ID NO: 2604927 - RNA, 15 nt, Escherichia coli CFT073
gaguggcuccaugug

SEQ ID NO: 2604928 - RNA, 21 nt, Escherichia coli CFT073
gagugguggggcauugaaaau

SEQ ID NO: 2604929 - RNA, 13 nt, Escherichia coli CFT073
gaguguaauccug

SEQ ID NO: 2604930 - RNA, 17 nt, Escherichia coli CFT073
gagugugcacagcaucc

SEQ ID NO: 2604931 - RNA, 16 nt, Escherichia coli CFT073
gaguguggaccgguga

SEQ ID NO: 2604932 - RNA, 16 nt, Escherichia coli CFT073
gaguguggccaguucc

SEQ ID NO: 2604933 - RNA, 21 nt, Escherichia coli CFT073
gaguuaauuagcuuaucaauc

SEQ ID NO: 2604934 - RNA, 14 nt, Escherichia coli CFT073
gaguuacuggcgag

SEQ ID NO: 2604935 - RNA, 17 nt, Escherichia coli CFT073
gaguuagaagccaguac

SEQ ID NO: 2604936 - RNA, 16 nt, Escherichia coli CFT073
gaguucacugccguac

SEQ ID NO: 2604937 - RNA, 21 nt, Escherichia coli CFT073
gaguucacugccguacaggca

SEQ ID NO: 2604938 - RNA, 16 nt, Escherichia coli CFT073
gaguucgagucucguu

SEQ ID NO: 2604939 - RNA, 19 nt, Escherichia coli CFT073
gaguucgugacgucucaau

SEQ ID NO: 2604940 - RNA, 16 nt, Escherichia coli CFT073
gaguugaaaaucucac

SEQ ID NO: 2604941 - RNA, 17 nt, Escherichia coli CFT073
gaguugauuuuguucaa

SEQ ID NO: 2604942 - RNA, 15 nt, Escherichia coli CFT073
gaguugcaccagcaa

SEQ ID NO: 2604943 - RNA, 22 nt, Escherichia coli CFT073
gaguugcaccagcaauaagcca

SEQ ID NO: 2604944 - RNA, 15 nt, Escherichia coli CFT073
gaguugccauccggc

SEQ ID NO: 2604945 - RNA, 15 nt, Escherichia coli CFT073
gaguuuauagccugu

SEQ ID NO: 2604946 - RNA, 12 nt, Escherichia coli CFT073
gaguuucaacau

SEQ ID NO: 2604947 - RNA, 20 nt, Escherichia coli CFT073
gaguuugccaccaacaguaa

SEQ ID NO: 2604948 - RNA, 16 nt, Escherichia coli CFT073
gaguuugccgcugucc

SEQ ID NO: 2604949 - RNA, 15 nt, Escherichia coli CFT073
gaguuuuaaaaccau

SEQ ID NO: 2604950 - RNA, 12 nt, Escherichia coli CFT073
gauaaaaaaccc

SEQ ID NO: 2604951 - RNA, 13 nt, Escherichia coli CFT073
gauaaaaacucaa

SEQ ID NO: 2604952 - RNA, 21 nt, Escherichia coli CFT073
gauaaaaauaccgagcagcca

SEQ ID NO: 2604953 - RNA, 14 nt, Escherichia coli CFT073
gauaaaacacauca

SEQ ID NO: 2604954 - RNA, 20 nt, Escherichia coli CFT073
gauaaaacauuacuaauuaa

SEQ ID NO: 2604955 - RNA, 13 nt, Escherichia coli CFT073
gauaaaacccaga

SEQ ID NO: 2604956 - RNA, 14 nt, Escherichia coli CFT073
gauaaaacgacacc

SEQ ID NO: 2604957 - RNA, 14 nt, Escherichia coli CFT073
gauaaaagugcaga

SEQ ID NO: 2604958 - RNA, 22 nt, Escherichia coli CFT073
gauaaaagugcagaucgccaga

SEQ ID NO: 2604959 - RNA, 17 nt, Escherichia coli CFT073
gauaaaaguuacaucag

SEQ ID NO: 2604960 - RNA, 17 nt, Escherichia coli CFT073
gauaaaauaaccgucuu

SEQ ID NO: 2604961 - RNA, 14 nt, Escherichia coli CFT073
gauaaaaucagaaa

SEQ ID NO: 2604962 - RNA, 21 nt, Escherichia coli CFT073
gauaaaaucccauaagugcgu

SEQ ID NO: 2604963 - RNA, 12 nt, Escherichia coli CFT073
gauaaaauuuug

SEQ ID NO: 2604964 - RNA, 15 nt, Escherichia coli CFT073
gauaaacagcgucga

SEQ ID NO: 2604965 - RNA, 16 nt, Escherichia coli CFT073
gauaaacaucgccaua

SEQ ID NO: 2604966 - RNA, 18 nt, Escherichia coli CFT073
gauaaacaucgccauaaa

SEQ ID NO: 2604967 - RNA, 17 nt, Escherichia coli CFT073
gauaaaccuccagcauc

SEQ ID NO: 2604968 - RNA, 15 nt, Escherichia coli CFT073
gauaaacgaccacuc

SEQ ID NO: 2604969 - RNA, 13 nt, Escherichia coli CFT073
gauaaacggaaca

SEQ ID NO: 2604970 - RNA, 21 nt, Escherichia coli CFT073
gauaaacguauaguggaauug

SEQ ID NO: 2604971 - RNA, 17 nt, Escherichia coli CFT073
gauaaacucacucugca

SEQ ID NO: 2604972 - RNA, 18 nt, Escherichia coli CFT073
gauaaagcgaccaaccau

SEQ ID NO: 2604973 - RNA, 12 nt, Escherichia coli CFT073
gauaaaggucga

SEQ ID NO: 2604974 - RNA, 12 nt, Escherichia coli CFT073
gauaaagugcuc

SEQ ID NO: 2604975 - RNA, 21 nt, Escherichia coli CFT073
gauaaauacgaucaaccaccg

SEQ ID NO: 2604976 - RNA, 21 nt, Escherichia coli CFT073
gauaaaucaacgccagauaaa

SEQ ID NO: 2604977 - RNA, 23 nt, Escherichia coli CFT073
gauaaaucgcacguugccagcaa

SEQ ID NO: 2604978 - RNA, 13 nt, Escherichia coli CFT073
gauaaaugccaaa

SEQ ID NO: 2604979 - RNA, 17 nt, Escherichia coli CFT073
gauaaaugccaccacac

SEQ ID NO: 2604980 - RNA, 17 nt, Escherichia coli CFT073
gauaacaaucaucaacc

SEQ ID NO: 2604981 - RNA, 15 nt, Escherichia coli CFT073
gauaacccagcagcc

SEQ ID NO: 2604982 - RNA, 16 nt, Escherichia coli CFT073
gauaaccccagaugga

SEQ ID NO: 2604983 - RNA, 17 nt, Escherichia coli CFT073
gauaaccccagauggau

SEQ ID NO: 2604984 - RNA, 11 nt, Escherichia coli CFT073
gauaacccugc

SEQ ID NO: 2604985 - RNA, 20 nt, Escherichia coli CFT073
gauaaccuaacucuuccugc

SEQ ID NO: 2604986 - RNA, 14 nt, Escherichia coli CFT073
gauaaccucauuaa

SEQ ID NO: 2604987 - RNA, 18 nt, Escherichia coli CFT073
gauaaccucauuaaucac

SEQ ID NO: 2604988 - RNA, 13 nt, Escherichia coli CFT073
gauaaccuucuuc

SEQ ID NO: 2604989 - RNA, 16 nt, Escherichia coli CFT073
gauaacgaaucgggca

SEQ ID NO: 2604990 - RNA, 20 nt, Escherichia coli CFT073
gauaacgagcaugauacuca

SEQ ID NO: 2604991 - RNA, 13 nt, Escherichia coli CFT073
gauaacgcgcugc

SEQ ID NO: 2604992 - RNA, 19 nt, Escherichia coli CFT073
gauaacggcagaagcagca

SEQ ID NO: 2604993 - RNA, 19 nt, Escherichia coli CFT073
gauaacguuuagcgguggc

SEQ ID NO: 2604994 - RNA, 16 nt, Escherichia coli CFT073
gauaacucaaaaauaa

SEQ ID NO: 2604995 - RNA, 17 nt, Escherichia coli CFT073
gauaacuggcaaaaaca

SEQ ID NO: 2604996 - RNA, 17 nt, Escherichia coli CFT073
gauaacuguuaaauaac

SEQ ID NO: 2604997 - RNA, 14 nt, Escherichia coli CFT073
gauaagacacgcca

SEQ ID NO: 2604998 - RNA, 20 nt, Escherichia coli CFT073
gauaagacgcgccagcaucg

SEQ ID NO: 2604999 - RNA, 14 nt, Escherichia coli CFT073
gauaagacgcggca

SEQ ID NO: 2605000 - RNA, 14 nt, Escherichia coli CFT073
gauaagacgcguca

SEQ ID NO: 2605001 - RNA, 22 nt, Escherichia coli CFT073
gauaagacgcgucagcgccgca

SEQ ID NO: 2605002 - RNA, 20 nt, Escherichia coli CFT073
gauaagacgcgucagugucu

SEQ ID NO: 2605003 - RNA, 20 nt, Escherichia coli CFT073
gauaagaggcgcgcggguga

SEQ ID NO: 2605004 - RNA, 17 nt, Escherichia coli CFT073
gauaagaugcgccagca

SEQ ID NO: 2605005 - RNA, 14 nt, Escherichia coli CFT073
gauaagaugcguua

SEQ ID NO: 2605006 - RNA, 22 nt, Escherichia coli CFT073
gauaagccagaccacagguaau

SEQ ID NO: 2605007 - RNA, 20 nt, Escherichia coli CFT073
gauaagcguagcgcaucagg

SEQ ID NO: 2605008 - RNA, 22 nt, Escherichia coli CFT073
gauaagcugauaacgccacgcc

SEQ ID NO: 2605009 - RNA, 11 nt, Escherichia coli CFT073
gauaaguaauc

SEQ ID NO: 2605010 - RNA, 19 nt, Escherichia coli CFT073
gauaagucacuaauugcag

SEQ ID NO: 2605011 - RNA, 16 nt, Escherichia coli CFT073
gauaagucgcccaaac

SEQ ID NO: 2605012 - RNA, 22 nt, Escherichia coli CFT073
gauaagugagcgauucaaauuc

SEQ ID NO: 2605013 - RNA, 15 nt, Escherichia coli CFT073
gauaaguucaaguuu

SEQ ID NO: 2605014 - RNA, 17 nt, Escherichia coli CFT073
gauaauaaaaaaccgga

SEQ ID NO: 2605015 - RNA, 14 nt, Escherichia coli CFT073
gauaauaaaaaccu

SEQ ID NO: 2605016 - RNA, 15 nt, Escherichia coli CFT073
gauaauaaaaagaau

SEQ ID NO: 2605017 - RNA, 14 nt, Escherichia coli CFT073
gauaauacccagca

SEQ ID NO: 2605018 - RNA, 21 nt, Escherichia coli CFT073
gauaauauugaugcacaccau

SEQ ID NO: 2605019 - RNA, 12 nt, Escherichia coli CFT073
gauaaucaaaug

SEQ ID NO: 2605020 - RNA, 12 nt, Escherichia coli CFT073
gauaaucaacaa

SEQ ID NO: 2605021 - RNA, 16 nt, Escherichia coli CFT073
gauaaucaacaaacca

SEQ ID NO: 2605022 - RNA, 19 nt, Escherichia coli CFT073
gauaaucacaauggucaac

SEQ ID NO: 2605023 - RNA, 13 nt, Escherichia coli CFT073
gauaucgcuggca

SEQ ID NO: 2605024 - RNA, 19 nt, Escherichia coli CFT073
gauaucgcuggcagaaagc

SEQ ID NO: 2605025 - RNA, 13 nt, Escherichia coli CFT073
gauaucggcagcg

SEQ ID NO: 2605026 - RNA, 16 nt, Escherichia coli CFT073
gauaucgucgagagau

SEQ ID NO: 2605027 - RNA, 21 nt, Escherichia coli CFT073
gauaucgugcgggaccagcac

SEQ ID NO: 2605028 - RNA, 11 nt, Escherichia coli CFT073
gauaugaccgu

SEQ ID NO: 2605029 - RNA, 13 nt, Escherichia coli CFT073
gauaugaccguuu

SEQ ID NO: 2605030 - RNA, 21 nt, Escherichia coli CFT073
gauaugaucaucaccuuacug

SEQ ID NO: 2605031 - RNA, 22 nt, Escherichia coli CFT073
gauaugauguaacaguugcagu

SEQ ID NO: 2605032 - RNA, 18 nt, Escherichia coli CFT073
gauaugcaguaaggaaau

SEQ ID NO: 2605033 - RNA, 13 nt, Escherichia coli CFT073
gauaugccagacu

SEQ ID NO: 2605034 - RNA, 16 nt, Escherichia coli CFT073
gauaugcgagcaccug

SEQ ID NO: 2605035 - RNA, 21 nt, Escherichia coli CFT073
gauaugcgcugucauucauuc

SEQ ID NO: 2605036 - RNA, 17 nt, Escherichia coli CFT073
gauauggccuucuucau

SEQ ID NO: 2605037 - RNA, 23 nt, Escherichia coli CFT073
gauaugggcaaacaaaaaaccua

SEQ ID NO: 2605038 - RNA, 20 nt, Escherichia coli CFT073
gauauuacauaccagcagca

SEQ ID NO: 2605039 - RNA, 20 nt, Escherichia coli CFT073
gauauuaguggcaaccgcaa

SEQ ID NO: 2605040 - RNA, 22 nt, Escherichia coli CFT073
gauauucauagagaagaauauc

SEQ ID NO: 2605041 - RNA, 18 nt, Escherichia coli CFT073
gauauucaucagcaucac

SEQ ID NO: 2605042 - RNA, 10 nt, Escherichia coli CFT073
gauauucauu

SEQ ID NO: 2605043 - RNA, 13 nt, Escherichia coli CFT073
gauauuccccaga

SEQ ID NO: 2605044 - RNA, 16 nt, Escherichia coli CFT073
gauauuccccagacga

SEQ ID NO: 2605045 - RNA, 13 nt, Escherichia coli CFT073
gauauucccccac

SEQ ID NO: 2605046 - RNA, 17 nt, Escherichia coli CFT073
gauauucccccaccgcc

SEQ ID NO: 2605047 - RNA, 20 nt, Escherichia coli CFT073
gauauucucgcuccaguuuu

SEQ ID NO: 2605048 - RNA, 20 nt, Escherichia coli CFT073
gauauucugguaaucgcaaa

SEQ ID NO: 2605049 - RNA, 20 nt, Escherichia coli CFT073
gauauugauaauaaaaagaa

SEQ ID NO: 2605050 - RNA, 21 nt, Escherichia coli CFT073
gauauugauucaucucuucuu

SEQ ID NO: 2605051 - RNA, 19 nt, Escherichia coli CFT073
gauauugcugcaguuuacg

SEQ ID NO: 2605052 - RNA, 13 nt, Escherichia coli CFT073
gauauuggucacc

SEQ ID NO: 2605053 - RNA, 23 nt, Escherichia coli CFT073
gauauuuaacaucauugccgccu

SEQ ID NO: 2605054 - RNA, 13 nt, Escherichia coli CFT073
gauauuuacaucc

SEQ ID NO: 2605055 - RNA, 15 nt, Escherichia coli CFT073
gauauuuagccagca

SEQ ID NO: 2605056 - RNA, 18 nt, Escherichia coli CFT073
gauauuuagccagcagcu

SEQ ID NO: 2605057 - RNA, 22 nt, Escherichia coli CFT073
gauauuucaccagcgcacguaa

SEQ ID NO: 2605058 - RNA, 21 nt, Escherichia coli CFT073
gauauuuucccaacgugacca

SEQ ID NO: 2605059 - RNA, 21 nt, Escherichia coli CFT073
gauauuuuguucaaaggcaga

SEQ ID NO: 2605060 - RNA, 20 nt, Escherichia coli CFT073
gaucaaaaaaaucuucacug

SEQ ID NO: 2605061 - RNA, 12 nt, Escherichia coli CFT073
gaucaaaccuca

SEQ ID NO: 2605062 - RNA, 16 nt, Escherichia coli CFT073
gaucaaagaccgguuu

SEQ ID NO: 2605063 - RNA, 20 nt, Escherichia coli CFT073
gaucaaauaaccgguauugc

SEQ ID NO: 2605064 - RNA, 14 nt, Escherichia coli CFT073
gaucaaauuauuac

SEQ ID NO: 2605065 - RNA, 17 nt, Escherichia coli CFT073
gaucaaauucaaugaca

SEQ ID NO: 2605066 - RNA, 12 nt, Escherichia coli CFT073
gaucaacacaug

SEQ ID NO: 2605067 - RNA, 12 nt, Escherichia coli CFT073
gaucaacagaau

SEQ ID NO: 2605068 - RNA, 16 nt, Escherichia coli CFT073
gaucaacagaaugaua

SEQ ID NO: 2605069 - RNA, 14 nt, Escherichia coli CFT073
gaucaacaggcacu

SEQ ID NO: 2605070 - RNA, 22 nt, Escherichia coli CFT073
gaucaaccgcgacauacuuaaa

SEQ ID NO: 2605071 - RNA, 15 nt, Escherichia coli CFT073
gaucaacgaccagaa

SEQ ID NO: 2605072 - RNA, 15 nt, Escherichia coli CFT073
gaucaacggugccau

SEQ ID NO: 2605073 - RNA, 21 nt, Escherichia coli CFT073
gaucaacggugccaucacgcc

SEQ ID NO: 2605074 - RNA, 13 nt, Escherichia coli CFT073
gaucaacugccgc

SEQ ID NO: 2605075 - RNA, 16 nt, Escherichia coli CFT073
gaucaacuucgcugcg

SEQ ID NO: 2605076 - RNA, 13 nt, Escherichia coli CFT073
gaucaagcaccgc

SEQ ID NO: 2605077 - RNA, 19 nt, Escherichia coli CFT073
gaucaagcuggcgcuggcg

SEQ ID NO: 2605078 - RNA, 12 nt, Escherichia coli CFT073
gaucaauaccau

SEQ ID NO: 2605079 - RNA, 17 nt, Escherichia coli CFT073
gaucacaucauaaauaa

SEQ ID NO: 2605080 - RNA, 14 nt, Escherichia coli CFT073
gaucacauccagua

SEQ ID NO: 2605081 - RNA, 20 nt, Escherichia coli CFT073
gaucaccaauaccagcauca

SEQ ID NO: 2605082 - RNA, 21 nt, Escherichia coli CFT073
gaucaccaauaccagcaucag

SEQ ID NO: 2605083 - RNA, 15 nt, Escherichia coli CFT073
gaucaccaauaucaa

SEQ ID NO: 2605084 - RNA, 21 nt, Escherichia coli CFT073
gaucaccacauucagcagccc

SEQ ID NO: 2605085 - RNA, 12 nt, Escherichia coli CFT073
gaucaccaccga

SEQ ID NO: 2605086 - RNA, 18 nt, Escherichia coli CFT073
gaucaccguagaaggcga

SEQ ID NO: 2605087 - RNA, 20 nt, Escherichia coli CFT073
gaucaccguagaaggcgaca

SEQ ID NO: 2605088 - RNA, 21 nt, Escherichia coli CFT073
gaucacgacuuguaccuucag

SEQ ID NO: 2605089 - RNA, 14 nt, Escherichia coli CFT073
gaucacgcagcaag

SEQ ID NO: 2605090 - RNA, 13 nt, Escherichia coli CFT073
gaucacgccccuc

SEQ ID NO: 2605091 - RNA, 15 nt, Escherichia coli CFT073
gaucacguaauaaaa

SEQ ID NO: 2605092 - RNA, 17 nt, Escherichia coli CFT073
gaucacguuuuccuuca

SEQ ID NO: 2605093 - RNA, 16 nt, Escherichia coli CFT073
gaucacuuccagcagu

SEQ ID NO: 2605094 - RNA, 23 nt, Escherichia coli CFT073
gaucacuucuguuugcgccacgc

SEQ ID NO: 2605095 - RNA, 13 nt, Escherichia coli CFT073
gaucagaagaggu

SEQ ID NO: 2605096 - RNA, 13 nt, Escherichia coli CFT073
gaucagaccgcca

SEQ ID NO: 2605097 - RNA, 20 nt, Escherichia coli CFT073
gaucagaccgccaaucagca

SEQ ID NO: 2605098 - RNA, 21 nt, Escherichia coli CFT073
gaucagaccgccaaucagcau

SEQ ID NO: 2605099 - RNA, 22 nt, Escherichia coli CFT073
gaucagagaacggaucaggcag

SEQ ID NO: 2605100 - RNA, 19 nt, Escherichia coli CFT073
gaucagcauccauaucgcc

SEQ ID NO: 2605101 - RNA, 20 nt, Escherichia coli CFT073
gaucagcauccauaucgcca

SEQ ID NO: 2605102 - RNA, 13 nt, Escherichia coli CFT073
gaucagcauuucg

SEQ ID NO: 2605103 - RNA, 15 nt, Escherichia coli CFT073
gaucagccaggcgau

SEQ ID NO: 2605104 - RNA, 17 nt, Escherichia coli CFT073
gaucagccauuuugcac

SEQ ID NO: 2605105 - RNA, 19 nt, Escherichia coli CFT073
gaucagccauuuugcacau

SEQ ID NO: 2605106 - RNA, 23 nt, Escherichia coli CFT073
gaucagccucucucugaggguga

SEQ ID NO: 2605107 - RNA, 18 nt, Escherichia coli CFT073
gaucagcgguuuugccag

SEQ ID NO: 2605108 - RNA, 15 nt, Escherichia coli CFT073
gaucagcgucaguug

SEQ ID NO: 2605109 - RNA, 18 nt, Escherichia coli CFT073
gaucagcgucaguugggc

SEQ ID NO: 2605110 - RNA, 18 nt, Escherichia coli CFT073
gaucagcuccggcagcug

SEQ ID NO: 2605111 - RNA, 16 nt, Escherichia coli CFT073
gaucagguauaccgaa

SEQ ID NO: 2605112 - RNA, 15 nt, Escherichia coli CFT073
gaucagguguuacgc

SEQ ID NO: 2605113 - RNA, 16 nt, Escherichia coli CFT073
gaucaguaauucgcau

SEQ ID NO: 2605114 - RNA, 18 nt, Escherichia coli CFT073
gaucaguuacucugcaag

SEQ ID NO: 2605115 - RNA, 23 nt, Escherichia coli CFT073
gaucaguugcucggcaaggccaa

SEQ ID NO: 2605116 - RNA, 18 nt, Escherichia coli CFT073
gaucauaaccaacaaaac

SEQ ID NO: 2605117 - RNA, 17 nt, Escherichia coli CFT073
gaucauacugaacuuau

SEQ ID NO: 2605118 - RNA, 22 nt, Escherichia coli CFT073
gaucauaucguccggcaccaga

SEQ ID NO: 2605119 - RNA, 17 nt, Escherichia coli CFT073
gaucauaugcacaauca

SEQ ID NO: 2605120 - RNA, 15 nt, Escherichia coli CFT073
gaucaucaaaaaaca

SEQ ID NO: 2605121 - RNA, 21 nt, Escherichia coli CFT073
gaucaucaccugcgcuggcag

SEQ ID NO: 2605122 - RNA, 15 nt, Escherichia coli CFT073
gaucaucauccagca

SEQ ID NO: 2605123 - RNA, 19 nt, Escherichia coli CFT073
gaucaucauuacguucuua

SEQ ID NO: 2605124 - RNA, 18 nt, Escherichia coli CFT073
gaucauccacccgcagca

SEQ ID NO: 2605125 - RNA, 22 nt, Escherichia coli CFT073
gaucauccauguggcauuggua

SEQ ID NO: 2605126 - RNA, 12 nt, Escherichia coli CFT073
gaucauccgcac

SEQ ID NO: 2605127 - RNA, 12 nt, Escherichia coli CFT073
gaucauccgccu

SEQ ID NO: 2605128 - RNA, 14 nt, Escherichia coli CFT073
gaucaucgacagua

SEQ ID NO: 2605129 - RNA, 15 nt, Escherichia coli CFT073
gaucaucucaacaaa

SEQ ID NO: 2605130 - RNA, 12 nt, Escherichia coli CFT073
gaucaucuggcg

SEQ ID NO: 2605131 - RNA, 19 nt, Escherichia coli CFT073
gaucaugauaaauaauaaa

SEQ ID NO: 2605132 - RNA, 16 nt, Escherichia coli CFT073
gaugaucgccgccagu

SEQ ID NO: 2605133 - RNA, 16 nt, Escherichia coli CFT073
gaugaucuccauugcc

SEQ ID NO: 2605134 - RNA, 16 nt, Escherichia coli CFT073
gaugaugacgcgcuca

SEQ ID NO: 2605135 - RNA, 19 nt, Escherichia coli CFT073
gaugaugcagauaaccaga

SEQ ID NO: 2605136 - RNA, 13 nt, Escherichia coli CFT073
gaugauugccaca

SEQ ID NO: 2605137 - RNA, 15 nt, Escherichia coli CFT073
gaugauuuccgccag

SEQ ID NO: 2605138 - RNA, 15 nt, Escherichia coli CFT073
gaugauuucgauccg

SEQ ID NO: 2605139 - RNA, 21 nt, Escherichia coli CFT073
gaugcaaacgauuaucaacac

SEQ ID NO: 2605140 - RNA, 14 nt, Escherichia coli CFT073
gaugcaacacauua

SEQ ID NO: 2605141 - RNA, 22 nt, Escherichia coli CFT073
gaugcacaacgcuuaucaggcu

SEQ ID NO: 2605142 - RNA, 14 nt, Escherichia coli CFT073
gaugcacaccaucg

SEQ ID NO: 2605143 - RNA, 19 nt, Escherichia coli CFT073
gaugcaccuucaacuugcu

SEQ ID NO: 2605144 - RNA, 15 nt, Escherichia coli CFT073
gaugcacuucagggc

SEQ ID NO: 2605145 - RNA, 14 nt, Escherichia coli CFT073
gaugcagcaucaug

SEQ ID NO: 2605146 - RNA, 15 nt, Escherichia coli CFT073
gaugcagcaucaugu

SEQ ID NO: 2605147 - RNA, 12 nt, Escherichia coli CFT073
gaugcagcgucu

SEQ ID NO: 2605148 - RNA, 17 nt, Escherichia coli CFT073
gaugcagguuaaccgcu

SEQ ID NO: 2605149 - RNA, 13 nt, Escherichia coli CFT073
gaugcauccggca

SEQ ID NO: 2605150 - RNA, 12 nt, Escherichia coli CFT073
gaugccaaaaau

SEQ ID NO: 2605151 - RNA, 20 nt, Escherichia coli CFT073
gaugccaaaaugcaccggau

SEQ ID NO: 2605152 - RNA, 17 nt, Escherichia coli CFT073
gaugccacaaucucgcc

SEQ ID NO: 2605153 - RNA, 15 nt, Escherichia coli CFT073
gaugccaccaggcag

SEQ ID NO: 2605154 - RNA, 15 nt, Escherichia coli CFT073
gaugccacuggaugu

SEQ ID NO: 2605155 - RNA, 19 nt, Escherichia coli CFT073
gaugccacuggauguugca

SEQ ID NO: 2605156 - RNA, 11 nt, Escherichia coli CFT073
gaugccagcac

SEQ ID NO: 2605157 - RNA, 23 nt, Escherichia coli CFT073
gaugccagcacagaucgcacuua

SEQ ID NO: 2605158 - RNA, 19 nt, Escherichia coli CFT073
gaugccagucaaugaaauu

SEQ ID NO: 2605159 - RNA, 13 nt, Escherichia coli CFT073
gaugccauucagu

SEQ ID NO: 2605160 - RNA, 13 nt, Escherichia coli CFT073
gaugcccagcuca

SEQ ID NO: 2605161 - RNA, 22 nt, Escherichia coli CFT073
gaugcccccaggagcgcggcaa

SEQ ID NO: 2605162 - RNA, 23 nt, Escherichia coli CFT073
gaugcccgaaagcguauccauca

SEQ ID NO: 2605163 - RNA, 20 nt, Escherichia coli CFT073
gaugcccggcgaaccgggcg

SEQ ID NO: 2605164 - RNA, 23 nt, Escherichia coli CFT073
gaugcccgguugcuuuucacaac

SEQ ID NO: 2605165 - RNA, 16 nt, Escherichia coli CFT073
gaugccgcauccggcu

SEQ ID NO: 2605166 - RNA, 21 nt, Escherichia coli CFT073
gaugccgccuggugcaggcgu

SEQ ID NO: 2605167 - RNA, 18 nt, Escherichia coli CFT073
gaugccgcuuauccccag

SEQ ID NO: 2605168 - RNA, 21 nt, Escherichia coli CFT073
gaugccgcuuauccccagaau

SEQ ID NO: 2605169 - RNA, 21 nt, Escherichia coli CFT073
gaugccggaaucaaccauggu

SEQ ID NO: 2605170 - RNA, 17 nt, Escherichia coli CFT073
gaugccggaugaguauu

SEQ ID NO: 2605171 - RNA, 18 nt, Escherichia coli CFT073
gaugccggguuugccaug

SEQ ID NO: 2605172 - RNA, 20 nt, Escherichia coli CFT073
gaugcgaacauccggcacuu

SEQ ID NO: 2605173 - RNA, 13 nt, Escherichia coli CFT073
gaugcgaccgccg

SEQ ID NO: 2605174 - RNA, 19 nt, Escherichia coli CFT073
gaugcgacgcgauccgccg

SEQ ID NO: 2605175 - RNA, 19 nt, Escherichia coli CFT073
gaugcgaugcugacgcauc

SEQ ID NO: 2605176 - RNA, 19 nt, Escherichia coli CFT073
gaugcgaugcuggcgcauc

SEQ ID NO: 2605177 - RNA, 22 nt, Escherichia coli CFT073
gaugcgccauaccaugcaccaa

SEQ ID NO: 2605178 - RNA, 21 nt, Escherichia coli CFT073
gaugcgcgagguaacaauaaa

SEQ ID NO: 2605179 - RNA, 17 nt, Escherichia coli CFT073
gaugcgcguaguacuuu

SEQ ID NO: 2605180 - RNA, 15 nt, Escherichia coli CFT073
gaugcgcuacgcuua

SEQ ID NO: 2605181 - RNA, 21 nt, Escherichia coli CFT073
gaugcgcuacgcuuaucaggc

SEQ ID NO: 2605182 - RNA, 17 nt, Escherichia coli CFT073
gaugcgcuggcgcaacu

SEQ ID NO: 2605183 - RNA, 11 nt, Escherichia coli CFT073
gaugcggcagu

SEQ ID NO: 2605184 - RNA, 19 nt, Escherichia coli CFT073
gaugcggcauaaacgccuu

SEQ ID NO: 2605185 - RNA, 20 nt, Escherichia coli CFT073
gaugcggcaugaacgccuga

SEQ ID NO: 2605186 - RNA, 19 nt, Escherichia coli CFT073
gaugcggcgagaacgccuu

SEQ ID NO: 2605187 - RNA, 20 nt, Escherichia coli CFT073
gaugcggcgagaacgccuua

SEQ ID NO: 2605188 - RNA, 13 nt, Escherichia coli CFT073
gaugcggcgugaa

SEQ ID NO: 2605189 - RNA, 16 nt, Escherichia coli CFT073
gaugcggcgugaacgc

SEQ ID NO: 2605190 - RNA, 19 nt, Escherichia coli CFT073
gaugcggcgugaacgccuu

SEQ ID NO: 2605191 - RNA, 20 nt, Escherichia coli CFT073
gaugcggcgugaacgccuua

SEQ ID NO: 2605192 - RNA, 21 nt, Escherichia coli CFT073
gaugcggcgugaacgccuuau

SEQ ID NO: 2605193 - RNA, 20 nt, Escherichia coli CFT073
gaugcggcgugaccgccuua

SEQ ID NO: 2605194 - RNA, 20 nt, Escherichia coli CFT073
gaugcggcguuaacgccuua

SEQ ID NO: 2605195 - RNA, 12 nt, Escherichia coli CFT073
gaugcggcugaa

SEQ ID NO: 2605196 - RNA, 23 nt, Escherichia coli CFT073
gaugcggugacagaggauauucu

SEQ ID NO: 2605197 - RNA, 17 nt, Escherichia coli CFT073
gaugcguggucaguugu

SEQ ID NO: 2605198 - RNA, 14 nt, Escherichia coli CFT073
gaugcguuuuucgg

SEQ ID NO: 2605199 - RNA, 21 nt, Escherichia coli CFT073
gaugcucacagaguauuucca

SEQ ID NO: 2605200 - RNA, 13 nt, Escherichia coli CFT073
gaugcuccgccag

SEQ ID NO: 2605201 - RNA, 12 nt, Escherichia coli CFT073
gaugcucuccgc

SEQ ID NO: 2605202 - RNA, 15 nt, Escherichia coli CFT073
gaugcugacacaucu

SEQ ID NO: 2605203 - RNA, 22 nt, Escherichia coli CFT073
gaugcugauguacccgcugcaa

SEQ ID NO: 2605204 - RNA, 19 nt, Escherichia coli CFT073
gaugcugcaauaaaauauc

SEQ ID NO: 2605205 - RNA, 16 nt, Escherichia coli CFT073
gaugcugccaucaucu

SEQ ID NO: 2605206 - RNA, 16 nt, Escherichia coli CFT073
gaugcugcuguuuuug

SEQ ID NO: 2605207 - RNA, 15 nt, Escherichia coli CFT073
gaugcugugcuccuu

SEQ ID NO: 2605208 - RNA, 15 nt, Escherichia coli CFT073
gaugcuuuccagcug

SEQ ID NO: 2605209 - RNA, 17 nt, Escherichia coli CFT073
gaugcuuugaccucccg

SEQ ID NO: 2605210 - RNA, 16 nt, Escherichia coli CFT073
gaugcuuuuuucugug

SEQ ID NO: 2605211 - RNA, 18 nt, Escherichia coli CFT073
gauggaguaguugaucgc

SEQ ID NO: 2605212 - RNA, 22 nt, Escherichia coli CFT073
gauggaucagcguuucuuccag

SEQ ID NO: 2605213 - RNA, 18 nt, Escherichia coli CFT073
gauggcaaaagugauauu

SEQ ID NO: 2605214 - RNA, 16 nt, Escherichia coli CFT073
gauggcaauuuucacu

SEQ ID NO: 2605215 - RNA, 17 nt, Escherichia coli CFT073
gauggcacgcauccggc

SEQ ID NO: 2605216 - RNA, 21 nt, Escherichia coli CFT073
gauggcagacuuuuccuuugc

SEQ ID NO: 2605217 - RNA, 13 nt, Escherichia coli CFT073
gauggcagggcag

SEQ ID NO: 2605218 - RNA, 15 nt, Escherichia coli CFT073
gauggcagggcagca

SEQ ID NO: 2605219 - RNA, 19 nt, Escherichia coli CFT073
gauggcauaccauccggca

SEQ ID NO: 2605220 - RNA, 23 nt, Escherichia coli CFT073
gauggcauaccauccggcauaaa

SEQ ID NO: 2605221 - RNA, 18 nt, Escherichia coli CFT073
gauggcgauacugccgcc

SEQ ID NO: 2605222 - RNA, 16 nt, Escherichia coli CFT073
gauggcgauucagcaa

SEQ ID NO: 2605223 - RNA, 23 nt, Escherichia coli CFT073
gauggcggcuuaguugaucgaca

SEQ ID NO: 2605224 - RNA, 20 nt, Escherichia coli CFT073
gauggcuauuacuuuaagcc

SEQ ID NO: 2605225 - RNA, 21 nt, Escherichia coli CFT073
gauggcuauuacuuuaagccu

SEQ ID NO: 2605226 - RNA, 19 nt, Escherichia coli CFT073
gauggcuccgggcagggcg

SEQ ID NO: 2605227 - RNA, 11 nt, Escherichia coli CFT073
gauggcugggg

SEQ ID NO: 2605228 - RNA, 14 nt, Escherichia coli CFT073
gauggcuuuccacc

SEQ ID NO: 2605229 - RNA, 12 nt, Escherichia coli CFT073
gaugggccagca

SEQ ID NO: 2605230 - RNA, 23 nt, Escherichia coli CFT073
gaugggcguuuucuaccagguuu

SEQ ID NO: 2605231 - RNA, 17 nt, Escherichia coli CFT073
gauggguaauaccaucc

SEQ ID NO: 2605232 - RNA, 23 nt, Escherichia coli CFT073
gaugguacuucaaucgccaccac

SEQ ID NO: 2605233 - RNA, 17 nt, Escherichia coli CFT073
gaugguaucuaucacua

SEQ ID NO: 2605234 - RNA, 17 nt, Escherichia coli CFT073
gauggucauauccagca

SEQ ID NO: 2605235 - RNA, 14 nt, Escherichia coli CFT073
gauggucgucaaac

SEQ ID NO: 2605236 - RNA, 22 nt, Escherichia coli CFT073
gauggugaaaaauaaugccacc

SEQ ID NO: 2605237 - RNA, 16 nt, Escherichia coli CFT073
gauggugacgccugga

SEQ ID NO: 2605238 - RNA, 22 nt, Escherichia coli CFT073
gauggugcuaauugcaccaucc

SEQ ID NO: 2605239 - RNA, 21 nt, Escherichia coli CFT073
gaugguugcugucaacugacu

SEQ ID NO: 2605240 - RNA, 14 nt, Escherichia coli CFT073
gauuuacuuucuug

SEQ ID NO: 2605241 - RNA, 22 nt, Escherichia coli CFT073
gauuucacagucgauaucgcug

SEQ ID NO: 2605242 - RNA, 13 nt, Escherichia coli CFT073
gauuucaggcuuu

SEQ ID NO: 2605243 - RNA, 17 nt, Escherichia coli CFT073
gauuucauauccggcac

SEQ ID NO: 2605244 - RNA, 12 nt, Escherichia coli CFT073
gauuucaucgcc

SEQ ID NO: 2605245 - RNA, 14 nt, Escherichia coli CFT073
gauuucaugaagcu

SEQ ID NO: 2605246 - RNA, 11 nt, Escherichia coli CFT073
gauuucauuca

SEQ ID NO: 2605247 - RNA, 14 nt, Escherichia coli CFT073
gauuuccaacgaau

SEQ ID NO: 2605248 - RNA, 12 nt, Escherichia coli CFT073
gauuuccagcuc

SEQ ID NO: 2605249 - RNA, 17 nt, Escherichia coli CFT073
gauuuccaucuccagcu

SEQ ID NO: 2605250 - RNA, 18 nt, Escherichia coli CFT073
gauuuccaucuccagcug

SEQ ID NO: 2605251 - RNA, 21 nt, Escherichia coli CFT073
gauuuccaucuccagcugcuc

SEQ ID NO: 2605252 - RNA, 19 nt, Escherichia coli CFT073
gauuuccggcaucgccagc

SEQ ID NO: 2605253 - RNA, 17 nt, Escherichia coli CFT073
gauuuccuucagcagca

SEQ ID NO: 2605254 - RNA, 23 nt, Escherichia coli CFT073
gauuucgccaucaagaacacaua

SEQ ID NO: 2605255 - RNA, 17 nt, Escherichia coli CFT073
gauuucucuggagaaau

SEQ ID NO: 2605256 - RNA, 22 nt, Escherichia coli CFT073
gauuucuuugucgaucauguag

SEQ ID NO: 2605257 - RNA, 22 nt, Escherichia coli CFT073
gauuugcaucaucaagguaauu

SEQ ID NO: 2605258 - RNA, 17 nt, Escherichia coli CFT073
gauuugcccuuccauac

SEQ ID NO: 2605259 - RNA, 20 nt, Escherichia coli CFT073
gauuugcgaauccggcagcg

SEQ ID NO: 2605260 - RNA, 13 nt, Escherichia coli CFT073
gauuuggcagcac

SEQ ID NO: 2605261 - RNA, 16 nt, Escherichia coli CFT073
gauuugguucuauugc

SEQ ID NO: 2605262 - RNA, 22 nt, Escherichia coli CFT073
gauuugucauaugcaaugcauc

SEQ ID NO: 2605263 - RNA, 20 nt, Escherichia coli CFT073
gauuugugcacgugccagau

SEQ ID NO: 2605264 - RNA, 14 nt, Escherichia coli CFT073
gauuuguucuggug

SEQ ID NO: 2605265 - RNA, 14 nt, Escherichia coli CFT073
gauuuuacuuccca

SEQ ID NO: 2605266 - RNA, 15 nt, Escherichia coli CFT073
gauuuuacuucccag

SEQ ID NO: 2605267 - RNA, 22 nt, Escherichia coli CFT073
gauuuuacuucccagucaagaa

SEQ ID NO: 2605268 - RNA, 21 nt, Escherichia coli CFT073
gauuuucauaaggcggauagc

SEQ ID NO: 2605269 - RNA, 15 nt, Escherichia coli CFT073
gauuuucaucuuuug

SEQ ID NO: 2605270 - RNA, 19 nt, Escherichia coli CFT073
gauuuucuacuucuuucac

SEQ ID NO: 2605271 - RNA, 12 nt, Escherichia coli CFT073
gauuuucugcuc

SEQ ID NO: 2605272 - RNA, 14 nt, Escherichia coli CFT073
gauuuucuucagcu

SEQ ID NO: 2605273 - RNA, 13 nt, Escherichia coli CFT073
gauuuugcaauaa

SEQ ID NO: 2605274 - RNA, 16 nt, Escherichia coli CFT073
gauuuugcaauaaugg

SEQ ID NO: 2605275 - RNA, 23 nt, Escherichia coli CFT073
gauuuuguaaucaacaaaagugg

SEQ ID NO: 2605276 - RNA, 15 nt, Escherichia coli CFT073
gauuuugugcaaaaa

SEQ ID NO: 2605277 - RNA, 19 nt, Escherichia coli CFT073
gauuuuuagcaugugcaau

SEQ ID NO: 2605278 - RNA, 18 nt, Escherichia coli CFT073
gauuuuucgcgcgggcag

SEQ ID NO: 2605279 - RNA, 23 nt, Escherichia coli CFT073
gauuuuucgcgcgggcagaugcc

SEQ ID NO: 2605280 - RNA, 13 nt, Escherichia coli CFT073
gauuuuuuugcag

SEQ ID NO: 2605281 - RNA, 11 nt, Escherichia coli CFT073
gcaaaaaaaga

SEQ ID NO: 2605282 - RNA, 13 nt, Escherichia coli CFT073
gcaaaaaaagcua

SEQ ID NO: 2605283 - RNA, 20 nt, Escherichia coli CFT073
gcaaaaaacacucuucaaca

SEQ ID NO: 2605284 - RNA, 19 nt, Escherichia coli CFT073
gcaaaaaagaaggaaaaua

SEQ ID NO: 2605285 - RNA, 24 nt, Escherichia coli CFT073
gcaaaaaagaaggaaaauacagca

SEQ ID NO: 2605286 - RNA, 19 nt, Escherichia coli CFT073
gcaaaaaaguagcgcagca

SEQ ID NO: 2605287 - RNA, 15 nt, Escherichia coli CFT073
gcaaaaaauagaacu

SEQ ID NO: 2605288 - RNA, 12 nt, Escherichia coli CFT073
gcaaaaacgcau

SEQ ID NO: 2605289 - RNA, 22 nt, Escherichia coli CFT073
gcaaaaaugauagccaggcgga

SEQ ID NO: 2605290 - RNA, 14 nt, Escherichia coli CFT073
gcaaaacccaggcu

SEQ ID NO: 2605291 - RNA, 17 nt, Escherichia coli CFT073
gcaaaacccugcgccag

SEQ ID NO: 2605292 - RNA, 18 nt, Escherichia coli CFT073
gcaaaacccugcgccagc

SEQ ID NO: 2605293 - RNA, 20 nt, Escherichia coli CFT073
gcaaaacgcaggauccacgc

SEQ ID NO: 2605294 - RNA, 16 nt, Escherichia coli CFT073
gcaaaacugccugaug

SEQ ID NO: 2605295 - RNA, 13 nt, Escherichia coli CFT073
gcaaaagcaggca

SEQ ID NO: 2605296 - RNA, 19 nt, Escherichia coli CFT073
gcaaaauaaccggcaagca

SEQ ID NO: 2605297 - RNA, 15 nt, Escherichia coli CFT073
gcaaaauacaugacc

SEQ ID NO: 2605298 - RNA, 22 nt, Escherichia coli CFT073
gcaaaauacguuuucaccucug

SEQ ID NO: 2605299 - RNA, 11 nt, Escherichia coli CFT073
gcaaaauaggu

SEQ ID NO: 2605300 - RNA, 12 nt, Escherichia coli CFT073
gcaaaauaggua

SEQ ID NO: 2605301 - RNA, 15 nt, Escherichia coli CFT073
gcaaaauauaaaccg

SEQ ID NO: 2605302 - RNA, 13 nt, Escherichia coli CFT073
gcaaaaucaaaca

SEQ ID NO: 2605303 - RNA, 14 nt, Escherichia coli CFT073
gcaaaaucaaacag

SEQ ID NO: 2605304 - RNA, 15 nt, Escherichia coli CFT073
gcaaaaucaccauca

SEQ ID NO: 2605305 - RNA, 15 nt, Escherichia coli CFT073
gcaaaauccuuccag

SEQ ID NO: 2605306 - RNA, 23 nt, Escherichia coli CFT073
gcaaaauccuuccagcuccagcc

SEQ ID NO: 2605307 - RNA, 19 nt, Escherichia coli CFT073
gcaaaaucguaagcaggag

SEQ ID NO: 2605308 - RNA, 13 nt, Escherichia coli CFT073
gcaaaaugccagc

SEQ ID NO: 2605309 - RNA, 18 nt, Escherichia coli CFT073
gcaaaauugccggaugcg

SEQ ID NO: 2605310 - RNA, 15 nt, Escherichia coli CFT073
gcaaaauuucuauca

SEQ ID NO: 2605311 - RNA, 16 nt, Escherichia coli CFT073
gcaaacaaaaaaccua

SEQ ID NO: 2605312 - RNA, 19 nt, Escherichia coli CFT073
gcaaacaacgccacacgca

SEQ ID NO: 2605313 - RNA, 13 nt, Escherichia coli CFT073
gcaaacaacgcuu

SEQ ID NO: 2605314 - RNA, 15 nt, Escherichia coli CFT073
gcaaacaccagcuga

SEQ ID NO: 2605315 - RNA, 14 nt, Escherichia coli CFT073
gcaaacacgccgcc

SEQ ID NO: 2605316 - RNA, 15 nt, Escherichia coli CFT073
gcaaacacgccgccg

SEQ ID NO: 2605317 - RNA, 18 nt, Escherichia coli CFT073
gcaaacagaauuaucauu

SEQ ID NO: 2605318 - RNA, 11 nt, Escherichia coli CFT073
gcaaacagcac

SEQ ID NO: 2605319 - RNA, 18 nt, Escherichia coli CFT073
gcaaacagucgcccgacc

SEQ ID NO: 2605320 - RNA, 23 nt, Escherichia coli CFT073
gcaaacagucgcccgaccaucgc

SEQ ID NO: 2605321 - RNA, 21 nt, Escherichia coli CFT073
gcaaacauacccacgaaaucu

SEQ ID NO: 2605322 - RNA, 17 nt, Escherichia coli CFT073
gcaaaccacaggccgga

SEQ ID NO: 2605323 - RNA, 21 nt, Escherichia coli CFT073
gcaaaccauagaauacgccac

SEQ ID NO: 2605324 - RNA, 15 nt, Escherichia coli CFT073
gcaaaccggacgauc

SEQ ID NO: 2605325 - RNA, 16 nt, Escherichia coli CFT073
gcaaaccugcaaugau

SEQ ID NO: 2605326 - RNA, 14 nt, Escherichia coli CFT073
gcaaaccuuucgcc

SEQ ID NO: 2605327 - RNA, 18 nt, Escherichia coli CFT073
gcaaacgauuaucaacac

SEQ ID NO: 2605328 - RNA, 15 nt, Escherichia coli CFT073
gcaaacgccaccugu

SEQ ID NO: 2605329 - RNA, 22 nt, Escherichia coli CFT073
gcaaacgcguuaagcccaguuc

SEQ ID NO: 2605330 - RNA, 12 nt, Escherichia coli CFT073
gcaaacgcugga

SEQ ID NO: 2605331 - RNA, 22 nt, Escherichia coli CFT073
gcaaacggcagcaugauacaaa

SEQ ID NO: 2605332 - RNA, 16 nt, Escherichia coli CFT073
gcaaacggcggaugag

SEQ ID NO: 2605333 - RNA, 18 nt, Escherichia coli CFT073
gcaaacggucaaucgcac

SEQ ID NO: 2605334 - RNA, 15 nt, Escherichia coli CFT073
gcaaacguaaaugcc

SEQ ID NO: 2605335 - RNA, 18 nt, Escherichia coli CFT073
gcaaacguaaaugccagc

SEQ ID NO: 2605336 - RNA, 19 nt, Escherichia coli CFT073
gcaaacguaaaugccagcc

SEQ ID NO: 2605337 - RNA, 17 nt, Escherichia coli CFT073
gcaaacgucgcgcaugc

SEQ ID NO: 2605338 - RNA, 22 nt, Escherichia coli CFT073
gcaaacugugcaaugaaaaaca

SEQ ID NO: 2605339 - RNA, 23 nt, Escherichia coli CFT073
gcaaacuucucaccaucaaacag

SEQ ID NO: 2605340 - RNA, 17 nt, Escherichia coli CFT073
gcaaagacgcguucauc

SEQ ID NO: 2605341 - RNA, 14 nt, Escherichia coli CFT073
gcaaagagagaagc

SEQ ID NO: 2605342 - RNA, 15 nt, Escherichia coli CFT073
gcaaagagagaagcc

SEQ ID NO: 2605343 - RNA, 19 nt, Escherichia coli CFT073
gcaaagagagaagccaggu

SEQ ID NO: 2605344 - RNA, 15 nt, Escherichia coli CFT073
gcaaagagagcagcg

SEQ ID NO: 2605345 - RNA, 13 nt, Escherichia coli CFT073
gcaaagagcagca

SEQ ID NO: 2605346 - RNA, 12 nt, Escherichia coli CFT073
gcaaagauauuc

SEQ ID NO: 2605347 - RNA, 17 nt, Escherichia coli CFT073
gcaaagauauucaguac

SEQ ID NO: 2605348 - RNA, 20 nt, Escherichia coli CFT073
gcaaagcaucauaaccucug

SEQ ID NO: 2605349 - RNA, 16 nt, Escherichia coli CFT073
gcaaucggcugcaccu

SEQ ID NO: 2605350 - RNA, 21 nt, Escherichia coli CFT073
gcaaucucguggucaauauca

SEQ ID NO: 2605351 - RNA, 18 nt, Escherichia coli CFT073
gcaaucugauuccgggcc

SEQ ID NO: 2605352 - RNA, 17 nt, Escherichia coli CFT073
gcaaucuguaacaaggu

SEQ ID NO: 2605353 - RNA, 22 nt, Escherichia coli CFT073
gcaaucuguuuauuugacagcc

SEQ ID NO: 2605354 - RNA, 18 nt, Escherichia coli CFT073
gcaaucuuuccugcacaa

SEQ ID NO: 2605355 - RNA, 14 nt, Escherichia coli CFT073
gcaaucuuucgagu

SEQ ID NO: 2605356 - RNA, 15 nt, Escherichia coli CFT073
gcaaugaaagcgagc

SEQ ID NO: 2605357 - RNA, 21 nt, Escherichia coli CFT073
gcaaugaagaaccgcaccagg

SEQ ID NO: 2605358 - RNA, 23 nt, Escherichia coli CFT073
gcaaugaagaaccgcaccaggca

SEQ ID NO: 2605359 - RNA, 20 nt, Escherichia coli CFT073
gcaaugauaaguccgaugcc

SEQ ID NO: 2605360 - RNA, 17 nt, Escherichia coli CFT073
gcaaugauuguaggccg

SEQ ID NO: 2605361 - RNA, 21 nt, Escherichia coli CFT073
gcaaugauuguaggccggaua

SEQ ID NO: 2605362 - RNA, 20 nt, Escherichia coli CFT073
gcaaugcaaucaaauggcug

SEQ ID NO: 2605363 - RNA, 21 nt, Escherichia coli CFT073
gcaaugcaaucaaauggcugg

SEQ ID NO: 2605364 - RNA, 22 nt, Escherichia coli CFT073
gcaaugcacacaaaauugccgc

SEQ ID NO: 2605365 - RNA, 19 nt, Escherichia coli CFT073
gcaaugcagaauuugcacc

SEQ ID NO: 2605366 - RNA, 14 nt, Escherichia coli CFT073
gcaaugccagcgua

SEQ ID NO: 2605367 - RNA, 17 nt, Escherichia coli CFT073
gcaaugccauucacaaa

SEQ ID NO: 2605368 - RNA, 21 nt, Escherichia coli CFT073
gcaaugccauucacaaaaaca

SEQ ID NO: 2605369 - RNA, 21 nt, Escherichia coli CFT073
gcaaugcgaucccgacaauca

SEQ ID NO: 2605370 - RNA, 19 nt, Escherichia coli CFT073
gcaaugcgcucgcauccug

SEQ ID NO: 2605371 - RNA, 23 nt, Escherichia coli CFT073
gcaaugcgcucgcauccugccag

SEQ ID NO: 2605372 - RNA, 15 nt, Escherichia coli CFT073
gcaauggaaaaaguu

SEQ ID NO: 2605373 - RNA, 17 nt, Escherichia coli CFT073
gcaauggaauucgcagc

SEQ ID NO: 2605374 - RNA, 17 nt, Escherichia coli CFT073
gcaauggacaccaggca

SEQ ID NO: 2605375 - RNA, 17 nt, Escherichia coli CFT073
gcaauggaccagaacgc

SEQ ID NO: 2605376 - RNA, 22 nt, Escherichia coli CFT073
gcaaugguguccaaaugcagca

SEQ ID NO: 2605377 - RNA, 18 nt, Escherichia coli CFT073
gcaauggugugauauuca

SEQ ID NO: 2605378 - RNA, 21 nt, Escherichia coli CFT073
gcaaugguucccggaccggcg

SEQ ID NO: 2605379 - RNA, 17 nt, Escherichia coli CFT073
gcaaugugaaaucagcg

SEQ ID NO: 2605380 - RNA, 15 nt, Escherichia coli CFT073
gcaaugugcagcagu

SEQ ID NO: 2605381 - RNA, 21 nt, Escherichia coli CFT073
gcaauguuaccgaucgccagc

SEQ ID NO: 2605382 - RNA, 14 nt, Escherichia coli CFT073
gcaauguuauccgg

SEQ ID NO: 2605383 - RNA, 15 nt, Escherichia coli CFT073
gcaauguuauccggc

SEQ ID NO: 2605384 - RNA, 20 nt, Escherichia coli CFT073
gcaauguuauccggcuauau

SEQ ID NO: 2605385 - RNA, 21 nt, Escherichia coli CFT073
gcaauguugcuggcgagugca

SEQ ID NO: 2605386 - RNA, 14 nt, Escherichia coli CFT073
gcaauuaaaaauuu

SEQ ID NO: 2605387 - RNA, 16 nt, Escherichia coli CFT073
gcaauuaacagugaca

SEQ ID NO: 2605388 - RNA, 19 nt, Escherichia coli CFT073
gcaauuacaggugaaucuu

SEQ ID NO: 2605389 - RNA, 14 nt, Escherichia coli CFT073
gcaauuauaauacg

SEQ ID NO: 2605390 - RNA, 17 nt, Escherichia coli CFT073
gcaauucggauguuagu

SEQ ID NO: 2605391 - RNA, 17 nt, Escherichia coli CFT073
gcaauugcauuugaacu

SEQ ID NO: 2605392 - RNA, 12 nt, Escherichia coli CFT073
gcaauugccgca

SEQ ID NO: 2605393 - RNA, 23 nt, Escherichia coli CFT073
gcaauugcugccccucaacuugc

SEQ ID NO: 2605394 - RNA, 18 nt, Escherichia coli CFT073
gcaauuggugcacgaugc

SEQ ID NO: 2605395 - RNA, 23 nt, Escherichia coli CFT073
gcaauuggugcacgaugccugau

SEQ ID NO: 2605396 - RNA, 19 nt, Escherichia coli CFT073
gcaauuguauccaugcgca

SEQ ID NO: 2605397 - RNA, 13 nt, Escherichia coli CFT073
gcaauuucacucc

SEQ ID NO: 2605398 - RNA, 18 nt, Escherichia coli CFT073
gcaauuucagugcugacu

SEQ ID NO: 2605399 - RNA, 12 nt, Escherichia coli CFT073
gcaauuucauua

SEQ ID NO: 2605400 - RNA, 20 nt, Escherichia coli CFT073
gcaauuuccgcuuucaacgc

SEQ ID NO: 2605401 - RNA, 17 nt, Escherichia coli CFT073
gcaauuucuccgccgga

SEQ ID NO: 2605402 - RNA, 22 nt, Escherichia coli CFT073
gcaauuugugcgucauuuucau

SEQ ID NO: 2605403 - RNA, 22 nt, Escherichia coli CFT073
gcaauuuugcguuuggcaucag

SEQ ID NO: 2605404 - RNA, 14 nt, Escherichia coli CFT073
gcacaaaacagguc

SEQ ID NO: 2605405 - RNA, 15 nt, Escherichia coli CFT073
gcacaaaaccugccg

SEQ ID NO: 2605406 - RNA, 17 nt, Escherichia coli CFT073
gcacaaacaucccugaa

SEQ ID NO: 2605407 - RNA, 18 nt, Escherichia coli CFT073
gcacaaagccgcgugcgc

SEQ ID NO: 2605408 - RNA, 18 nt, Escherichia coli CFT073
gcacaaagccgugccaga

SEQ ID NO: 2605409 - RNA, 16 nt, Escherichia coli CFT073
gcacaaaguggcggcu

SEQ ID NO: 2605410 - RNA, 15 nt, Escherichia coli CFT073
gcacaaauagccagc

SEQ ID NO: 2605411 - RNA, 22 nt, Escherichia coli CFT073
gcacaaauagccagcagagcaa

SEQ ID NO: 2605412 - RNA, 18 nt, Escherichia coli CFT073
gcacaaauccccaguugu

SEQ ID NO: 2605413 - RNA, 18 nt, Escherichia coli CFT073
gcacaaccgccagaugcg

SEQ ID NO: 2605414 - RNA, 14 nt, Escherichia coli CFT073
gcacaaccgccgga

SEQ ID NO: 2605415 - RNA, 18 nt, Escherichia coli CFT073
gcacaaccgccggaugcg

SEQ ID NO: 2605416 - RNA, 21 nt, Escherichia coli CFT073
gcacaaccgccggaugcggcg

SEQ ID NO: 2605417 - RNA, 17 nt, Escherichia coli CFT073
gcacaaccggaaccagc

SEQ ID NO: 2605418 - RNA, 19 nt, Escherichia coli CFT073
gcacaaccggaaccagcgc

SEQ ID NO: 2605419 - RNA, 14 nt, Escherichia coli CFT073
gcacaagcggcagu

SEQ ID NO: 2605420 - RNA, 16 nt, Escherichia coli CFT073
gcacaagcuaccagcc

SEQ ID NO: 2605421 - RNA, 16 nt, Escherichia coli CFT073
gcacaagucagcaacg

SEQ ID NO: 2605422 - RNA, 17 nt, Escherichia coli CFT073
gcacaauacauagaagc

SEQ ID NO: 2605423 - RNA, 16 nt, Escherichia coli CFT073
gcacaauccgccagga

SEQ ID NO: 2605424 - RNA, 22 nt, Escherichia coli CFT073
gcacaauccgccaggacaucag

SEQ ID NO: 2605425 - RNA, 19 nt, Escherichia coli CFT073
gcacaaucgcauagccaga

SEQ ID NO: 2605426 - RNA, 14 nt, Escherichia coli CFT073
gcacaaugccugau

SEQ ID NO: 2605427 - RNA, 17 nt, Escherichia coli CFT073
gcacaaugccugaugcg

SEQ ID NO: 2605428 - RNA, 17 nt, Escherichia coli CFT073
gcacaauggccagcaca

SEQ ID NO: 2605429 - RNA, 18 nt, Escherichia coli CFT073
gcacacaaaauugccgcu

SEQ ID NO: 2605430 - RNA, 20 nt, Escherichia coli CFT073
gcacacaaaauugccgcuau

SEQ ID NO: 2605431 - RNA, 17 nt, Escherichia coli CFT073
gcacacacacgcccagu

SEQ ID NO: 2605432 - RNA, 19 nt, Escherichia coli CFT073
gcacacaccagauccagca

SEQ ID NO: 2605433 - RNA, 17 nt, Escherichia coli CFT073
gcacacacuaccgccga

SEQ ID NO: 2605434 - RNA, 13 nt, Escherichia coli CFT073
gcacacauaacag

SEQ ID NO: 2605435 - RNA, 22 nt, Escherichia coli CFT073
gcacacauacauguauaaaaag

SEQ ID NO: 2605436 - RNA, 14 nt, Escherichia coli CFT073
gcacaccagcaaua

SEQ ID NO: 2605437 - RNA, 17 nt, Escherichia coli CFT073
gcacaccauagaccaug

SEQ ID NO: 2605438 - RNA, 20 nt, Escherichia coli CFT073
gcacaccauagaccaugagu

SEQ ID NO: 2605439 - RNA, 19 nt, Escherichia coli CFT073
gcacaccaucgcauacggu

SEQ ID NO: 2605440 - RNA, 17 nt, Escherichia coli CFT073
gcacaccccgcgccgcu

SEQ ID NO: 2605441 - RNA, 18 nt, Escherichia coli CFT073
gcacaccgaagacaucgc

SEQ ID NO: 2605442 - RNA, 16 nt, Escherichia coli CFT073
gcacaccgucagccag

SEQ ID NO: 2605443 - RNA, 14 nt, Escherichia coli CFT073
gcacacgauuccaa

SEQ ID NO: 2605444 - RNA, 17 nt, Escherichia coli CFT073
gcacacgcggagccagu

SEQ ID NO: 2605445 - RNA, 17 nt, Escherichia coli CFT073
gcacacuaccaaaacgg

SEQ ID NO: 2605446 - RNA, 13 nt, Escherichia coli CFT073
gcacacugccagu

SEQ ID NO: 2605447 - RNA, 16 nt, Escherichia coli CFT073
gcacacuguaagccac

SEQ ID NO: 2605448 - RNA, 21 nt, Escherichia coli CFT073
gcacacuguucauuaaagccg

SEQ ID NO: 2605449 - RNA, 14 nt, Escherichia coli CFT073
gcacagaaccggag

SEQ ID NO: 2605450 - RNA, 18 nt, Escherichia coli CFT073
gcacagaaugugaugcca

SEQ ID NO: 2605451 - RNA, 16 nt, Escherichia coli CFT073
gcacagagauaaaagg

SEQ ID NO: 2605452 - RNA, 23 nt, Escherichia coli CFT073
gcacagagauaaaaggcgucaug

SEQ ID NO: 2605453 - RNA, 17 nt, Escherichia coli CFT073
gcacagagcuaugaaua

SEQ ID NO: 2605454 - RNA, 15 nt, Escherichia coli CFT073
gcacagcauccgaac

SEQ ID NO: 2605455 - RNA, 16 nt, Escherichia coli CFT073
gcacagccagccucca

SEQ ID NO: 2605456 - RNA, 14 nt, Escherichia coli CFT073
gcacagccagcgca

SEQ ID NO: 2605457 - RNA, 17 nt, Escherichia coli CFT073
gcaccgugaccacccau

SEQ ID NO: 2605458 - RNA, 14 nt, Escherichia coli CFT073
gcaccuaaagcgcg

SEQ ID NO: 2605459 - RNA, 18 nt, Escherichia coli CFT073
gcaccuaucgcgucgccg

SEQ ID NO: 2605460 - RNA, 20 nt, Escherichia coli CFT073
gcaccuaucgcgucgccggu

SEQ ID NO: 2605461 - RNA, 22 nt, Escherichia coli CFT073
gcaccucauccugacaggcccc

SEQ ID NO: 2605462 - RNA, 16 nt, Escherichia coli CFT073
gcaccugaaccagacc

SEQ ID NO: 2605463 - RNA, 12 nt, Escherichia coli CFT073
gcaccugaaucg

SEQ ID NO: 2605464 - RNA, 16 nt, Escherichia coli CFT073
gcaccugauccagcuc

SEQ ID NO: 2605465 - RNA, 13 nt, Escherichia coli CFT073
gcaccugcacagg

SEQ ID NO: 2605466 - RNA, 14 nt, Escherichia coli CFT073
gcaccugccagcau

SEQ ID NO: 2605467 - RNA, 15 nt, Escherichia coli CFT073
gcaccugccagcgcc

SEQ ID NO: 2605468 - RNA, 17 nt, Escherichia coli CFT073
gcaccuguguuguucug

SEQ ID NO: 2605469 - RNA, 17 nt, Escherichia coli CFT073
gcaccuucaacuugcug

SEQ ID NO: 2605470 - RNA, 19 nt, Escherichia coli CFT073
gcaccuucauucaggccaa

SEQ ID NO: 2605471 - RNA, 23 nt, Escherichia coli CFT073
gcaccuucauucaggccaaagcc

SEQ ID NO: 2605472 - RNA, 20 nt, Escherichia coli CFT073
gcaccuuuaaccccagaggc

SEQ ID NO: 2605473 - RNA, 15 nt, Escherichia coli CFT073
gcaccuuuaccgauu

SEQ ID NO: 2605474 - RNA, 14 nt, Escherichia coli CFT073
gcacgaaagguucc

SEQ ID NO: 2605475 - RNA, 18 nt, Escherichia coli CFT073
gcacgaagaggccgccgu

SEQ ID NO: 2605476 - RNA, 18 nt, Escherichia coli CFT073
gcacgaauagucaguuca

SEQ ID NO: 2605477 - RNA, 18 nt, Escherichia coli CFT073
gcacgaauugcuuccagu

SEQ ID NO: 2605478 - RNA, 13 nt, Escherichia coli CFT073
gcacgacacagcu

SEQ ID NO: 2605479 - RNA, 20 nt, Escherichia coli CFT073
gcacgacauaagcgcaugaa

SEQ ID NO: 2605480 - RNA, 13 nt, Escherichia coli CFT073
gcacgaccgccuu

SEQ ID NO: 2605481 - RNA, 14 nt, Escherichia coli CFT073
gcacgaccuugcca

SEQ ID NO: 2605482 - RNA, 20 nt, Escherichia coli CFT073
gcacgaccuugccaaggucg

SEQ ID NO: 2605483 - RNA, 23 nt, Escherichia coli CFT073
gcacgacggaauuucauaugcgc

SEQ ID NO: 2605484 - RNA, 21 nt, Escherichia coli CFT073
gcacgacuuucucuucaucua

SEQ ID NO: 2605485 - RNA, 14 nt, Escherichia coli CFT073
gcacgaggugccac

SEQ ID NO: 2605486 - RNA, 16 nt, Escherichia coli CFT073
gcacgaggugccacca

SEQ ID NO: 2605487 - RNA, 21 nt, Escherichia coli CFT073
gcacgaggugccaccagugca

SEQ ID NO: 2605488 - RNA, 23 nt, Escherichia coli CFT073
gcacgagugaguuaauuuuccug

SEQ ID NO: 2605489 - RNA, 16 nt, Escherichia coli CFT073
gcacgaugcugcgcag

SEQ ID NO: 2605490 - RNA, 19 nt, Escherichia coli CFT073
gcacgauuuuguaggccgg

SEQ ID NO: 2605491 - RNA, 17 nt, Escherichia coli CFT073
gcacgcaggccacgaau

SEQ ID NO: 2605492 - RNA, 15 nt, Escherichia coli CFT073
gcacgcccugauaaa

SEQ ID NO: 2605493 - RNA, 12 nt, Escherichia coli CFT073
gcacgcggaggg

SEQ ID NO: 2605494 - RNA, 20 nt, Escherichia coli CFT073
gcacgcguaauauccagcgu

SEQ ID NO: 2605495 - RNA, 20 nt, Escherichia coli CFT073
gcacgcucuguucugcgccu

SEQ ID NO: 2605496 - RNA, 16 nt, Escherichia coli CFT073
gcacgcuggagaauaa

SEQ ID NO: 2605497 - RNA, 14 nt, Escherichia coli CFT073
gcacgcugucgcca

SEQ ID NO: 2605498 - RNA, 15 nt, Escherichia coli CFT073
gcacggaaagcagca

SEQ ID NO: 2605499 - RNA, 17 nt, Escherichia coli CFT073
gcacggaggcuccgccu

SEQ ID NO: 2605500 - RNA, 16 nt, Escherichia coli CFT073
gcacggcacacuuuca

SEQ ID NO: 2605501 - RNA, 19 nt, Escherichia coli CFT073
gcacggcacacuuucauca

SEQ ID NO: 2605502 - RNA, 13 nt, Escherichia coli CFT073
gcacggcagauaa

SEQ ID NO: 2605503 - RNA, 12 nt, Escherichia coli CFT073
gcacggcagcaa

SEQ ID NO: 2605504 - RNA, 19 nt, Escherichia coli CFT073
gcacggcaucaaugccgga

SEQ ID NO: 2605505 - RNA, 14 nt, Escherichia coli CFT073
gcacggcgcaccgc

SEQ ID NO: 2605506 - RNA, 19 nt, Escherichia coli CFT073
gcacggcgcaccgcacugg

SEQ ID NO: 2605507 - RNA, 17 nt, Escherichia coli CFT073
gcacgguggcuggcgcg

SEQ ID NO: 2605508 - RNA, 16 nt, Escherichia coli CFT073
gcacgguucagcguca

SEQ ID NO: 2605509 - RNA, 17 nt, Escherichia coli CFT073
gcacgguuuugucggca

SEQ ID NO: 2605510 - RNA, 15 nt, Escherichia coli CFT073
gcacguaagcuggaa

SEQ ID NO: 2605511 - RNA, 20 nt, Escherichia coli CFT073
gcacguacaugcagggcaaa

SEQ ID NO: 2605512 - RNA, 22 nt, Escherichia coli CFT073
gcacguaggcgaucccagcgcc

SEQ ID NO: 2605513 - RNA, 15 nt, Escherichia coli CFT073
gcacguccaguggca

SEQ ID NO: 2605514 - RNA, 16 nt, Escherichia coli CFT073
gcacguuacccgccgu

SEQ ID NO: 2605515 - RNA, 21 nt, Escherichia coli CFT073
gcacguuccguauaccgucag

SEQ ID NO: 2605516 - RNA, 14 nt, Escherichia coli CFT073
gcacguugccagca

SEQ ID NO: 2605517 - RNA, 17 nt, Escherichia coli CFT073
gcacguuuugcggaugu

SEQ ID NO: 2605518 - RNA, 14 nt, Escherichia coli CFT073
gcacguuuugcugg

SEQ ID NO: 2605519 - RNA, 16 nt, Escherichia coli CFT073
gcacuaagaaucgccg

SEQ ID NO: 2605520 - RNA, 21 nt, Escherichia coli CFT073
gcacuaaucgggccgacaaaa

SEQ ID NO: 2605521 - RNA, 16 nt, Escherichia coli CFT073
gcacuaccuugcuucu

SEQ ID NO: 2605522 - RNA, 19 nt, Escherichia coli CFT073
gcacuaccuugcuucuuac

SEQ ID NO: 2605523 - RNA, 17 nt, Escherichia coli CFT073
gcacuacgcagggauau

SEQ ID NO: 2605524 - RNA, 21 nt, Escherichia coli CFT073
gcacuauuuaccgccaacgca

SEQ ID NO: 2605525 - RNA, 15 nt, Escherichia coli CFT073
gcacucacgccaggc

SEQ ID NO: 2605526 - RNA, 18 nt, Escherichia coli CFT073
gcacucagguaacaggga

SEQ ID NO: 2605527 - RNA, 14 nt, Escherichia coli CFT073
gcacuccgccgcac

SEQ ID NO: 2605528 - RNA, 15 nt, Escherichia coli CFT073
gcacuccgccgcaca

SEQ ID NO: 2605529 - RNA, 22 nt, Escherichia coli CFT073
gcacucuacauguguucugcau

SEQ ID NO: 2605530 - RNA, 23 nt, Escherichia coli CFT073
gcacucuccuccguuaaccugga

SEQ ID NO: 2605531 - RNA, 21 nt, Escherichia coli CFT073
gcacucugaccgggaauauaa

SEQ ID NO: 2605532 - RNA, 20 nt, Escherichia coli CFT073
gcacugaaagagucgccagc

SEQ ID NO: 2605533 - RNA, 16 nt, Escherichia coli CFT073
gcacugaccaccacca

SEQ ID NO: 2605534 - RNA, 21 nt, Escherichia coli CFT073
gcacugacugacagacugcuu

SEQ ID NO: 2605535 - RNA, 22 nt, Escherichia coli CFT073
gcacugaguuacguccauguag

SEQ ID NO: 2605536 - RNA, 22 nt, Escherichia coli CFT073
gcacugauauugugagcaugug

SEQ ID NO: 2605537 - RNA, 21 nt, Escherichia coli CFT073
gcacugcaaaaaacagccgga

SEQ ID NO: 2605538 - RNA, 17 nt, Escherichia coli CFT073
gcacugcaggcugaugg

SEQ ID NO: 2605539 - RNA, 17 nt, Escherichia coli CFT073
gcacugccagccacagg

SEQ ID NO: 2605540 - RNA, 18 nt, Escherichia coli CFT073
gcacugccgccaugcggu

SEQ ID NO: 2605541 - RNA, 17 nt, Escherichia coli CFT073
gcacuggcaaucgcccg

SEQ ID NO: 2605542 - RNA, 22 nt, Escherichia coli CFT073
gcacuggccuuuucacaacgaa

SEQ ID NO: 2605543 - RNA, 14 nt, Escherichia coli CFT073
gcacuggcgagcgc

SEQ ID NO: 2605544 - RNA, 22 nt, Escherichia coli CFT073
gcacuggcgagcgccagcaugg

SEQ ID NO: 2605545 - RNA, 19 nt, Escherichia coli CFT073
gcacuggcgcgccuguugc

SEQ ID NO: 2605546 - RNA, 21 nt, Escherichia coli CFT073
gcacuggguucaucuuccagc

SEQ ID NO: 2605547 - RNA, 16 nt, Escherichia coli CFT073
gcacuggugccaugaa

SEQ ID NO: 2605548 - RNA, 20 nt, Escherichia coli CFT073
gcacugguggcagugcgcga

SEQ ID NO: 2605549 - RNA, 17 nt, Escherichia coli CFT073
gcacuguaaguguaugu

SEQ ID NO: 2605550 - RNA, 15 nt, Escherichia coli CFT073
gcacuguagaccagu

SEQ ID NO: 2605551 - RNA, 21 nt, Escherichia coli CFT073
gcacugucgagaucgcggcaa

SEQ ID NO: 2605552 - RNA, 22 nt, Escherichia coli CFT073
gcacuguguuggguucacuuuc

SEQ ID NO: 2605553 - RNA, 16 nt, Escherichia coli CFT073
gcacuguuucgccagg

SEQ ID NO: 2605554 - RNA, 19 nt, Escherichia coli CFT073
gcacuguuucgccagguuu

SEQ ID NO: 2605555 - RNA, 14 nt, Escherichia coli CFT073
gcacuuaauaccac

SEQ ID NO: 2605556 - RNA, 13 nt, Escherichia coli CFT073
gcacuuacagcaa

SEQ ID NO: 2605557 - RNA, 23 nt, Escherichia coli CFT073
gcacuuacagcaacgccuaaacu

SEQ ID NO: 2605558 - RNA, 17 nt, Escherichia coli CFT073
gcacuuacuuuccuaaa

SEQ ID NO: 2605559 - RNA, 22 nt, Escherichia coli CFT073
gcacuucaaauuucauaaucug

SEQ ID NO: 2605560 - RNA, 21 nt, Escherichia coli CFT073
gcacuucacgcggaucgccaa

SEQ ID NO: 2605561 - RNA, 12 nt, Escherichia coli CFT073
gcacuucgcuga

SEQ ID NO: 2605562 - RNA, 16 nt, Escherichia coli CFT073
gcacuucuuccgccag

SEQ ID NO: 2605563 - RNA, 17 nt, Escherichia coli CFT073
gcacuucuuccgccagc

SEQ ID NO: 2605564 - RNA, 21 nt, Escherichia coli CFT073
gcacuucuuccgccagcauca

SEQ ID NO: 2605565 - RNA, 15 nt, Escherichia coli CFT073
gcacuucuuccgggc

SEQ ID NO: 2605566 - RNA, 24 nt, Escherichia coli CFT073
gcacuugaguaauuaauacgccag

SEQ ID NO: 2605567 - RNA, 12 nt, Escherichia coli CFT073
gcacuugcagga

SEQ ID NO: 2605568 - RNA, 18 nt, Escherichia coli CFT073
gcacuuucggauuacugc

SEQ ID NO: 2605569 - RNA, 21 nt, Escherichia coli CFT073
gcacuuucuccggcagcuuua

SEQ ID NO: 2605570 - RNA, 16 nt, Escherichia coli CFT073
gcacuuuuaacgccuc

SEQ ID NO: 2605571 - RNA, 13 nt, Escherichia coli CFT073
gcacuuuuucauc

SEQ ID NO: 2605572 - RNA, 17 nt, Escherichia coli CFT073
gcacuuuuucaucaggu

SEQ ID NO: 2605573 - RNA, 11 nt, Escherichia coli CFT073
gcagaaaaucc

SEQ ID NO: 2605574 - RNA, 17 nt, Escherichia coli CFT073
gcagaaaauccagcaga

SEQ ID NO: 2605575 - RNA, 15 nt, Escherichia coli CFT073
gcagaaaauccagcg

SEQ ID NO: 2605576 - RNA, 17 nt, Escherichia coli CFT073
gcagaaaauccagcguc

SEQ ID NO: 2605577 - RNA, 11 nt, Escherichia coli CFT073
gcagaaacaac

SEQ ID NO: 2605578 - RNA, 13 nt, Escherichia coli CFT073
gcagaaacaucau

SEQ ID NO: 2605579 - RNA, 19 nt, Escherichia coli CFT073
gcagaaacaucauccccau

SEQ ID NO: 2605580 - RNA, 14 nt, Escherichia coli CFT073
gcagaaacgacacc

SEQ ID NO: 2605581 - RNA, 22 nt, Escherichia coli CFT073
gcagaaauaaaagccugaucaa

SEQ ID NO: 2605582 - RNA, 17 nt, Escherichia coli CFT073
gcagaaauaccccgcca

SEQ ID NO: 2605583 - RNA, 19 nt, Escherichia coli CFT073
gcagaaauaccccgccagc

SEQ ID NO: 2605584 - RNA, 15 nt, Escherichia coli CFT073
gcagaaaucaacggc

SEQ ID NO: 2605585 - RNA, 21 nt, Escherichia coli CFT073
gcagaaaucaacggcgucagc

SEQ ID NO: 2605586 - RNA, 16 nt, Escherichia coli CFT073
gcagaacagaucccac

SEQ ID NO: 2605587 - RNA, 13 nt, Escherichia coli CFT073
gcagaacaucagc

SEQ ID NO: 2605588 - RNA, 15 nt, Escherichia coli CFT073
gcagaacauccagcu

SEQ ID NO: 2605589 - RNA, 15 nt, Escherichia coli CFT073
gcagaacgaccagcg

SEQ ID NO: 2605590 - RNA, 23 nt, Escherichia coli CFT073
gcagaacgccaugccaaagaagg

SEQ ID NO: 2605591 - RNA, 16 nt, Escherichia coli CFT073
gcagaacgcuuucgca

SEQ ID NO: 2605592 - RNA, 20 nt, Escherichia coli CFT073
gcagaacggugcgaccaaac

SEQ ID NO: 2605593 - RNA, 17 nt, Escherichia coli CFT073
gcagaacguccgcagga

SEQ ID NO: 2605594 - RNA, 15 nt, Escherichia coli CFT073
gcagaagcagcagga

SEQ ID NO: 2605595 - RNA, 16 nt, Escherichia coli CFT073
gcagaagcagcaggac

SEQ ID NO: 2605596 - RNA, 23 nt, Escherichia coli CFT073
gcagaagcgauaaccuucaccgu

SEQ ID NO: 2605597 - RNA, 20 nt, Escherichia coli CFT073
gcagaaucaaucucagcgau

SEQ ID NO: 2605598 - RNA, 16 nt, Escherichia coli CFT073
gcagaauccggcgcuc

SEQ ID NO: 2605599 - RNA, 19 nt, Escherichia coli CFT073
gcagaaugaaugauacaga

SEQ ID NO: 2605600 - RNA, 20 nt, Escherichia coli CFT073
gcagaaugguaacaccagag

SEQ ID NO: 2605601 - RNA, 15 nt, Escherichia coli CFT073
gcagaauuggcauca

SEQ ID NO: 2605602 - RNA, 17 nt, Escherichia coli CFT073
gcagacaugaccacaaa

SEQ ID NO: 2605603 - RNA, 20 nt, Escherichia coli CFT073
gcagacauuccccgccagga

SEQ ID NO: 2605604 - RNA, 16 nt, Escherichia coli CFT073
gcagaccaaccgucag

SEQ ID NO: 2605605 - RNA, 16 nt, Escherichia coli CFT073
gcagaccagagcugau

SEQ ID NO: 2605606 - RNA, 21 nt, Escherichia coli CFT073
gcagaccagagcugauacggg

SEQ ID NO: 2605607 - RNA, 23 nt, Escherichia coli CFT073
gcagacgcaucgcccagccaucg

SEQ ID NO: 2605608 - RNA, 18 nt, Escherichia coli CFT073
gcagacgccguuccagau

SEQ ID NO: 2605609 - RNA, 13 nt, Escherichia coli CFT073
gcagacggcuguc

SEQ ID NO: 2605610 - RNA, 14 nt, Escherichia coli CFT073
gcagacggcuuucu

SEQ ID NO: 2605611 - RNA, 18 nt, Escherichia coli CFT073
gcagacguaauguauuua

SEQ ID NO: 2605612 - RNA, 16 nt, Escherichia coli CFT073
gcagacguagaaaauc

SEQ ID NO: 2605613 - RNA, 20 nt, Escherichia coli CFT073
gcagacguucuucugcuuca

SEQ ID NO: 2605614 - RNA, 21 nt, Escherichia coli CFT073
gcagacguuuuuucugcccca

SEQ ID NO: 2605615 - RNA, 18 nt, Escherichia coli CFT073
gcagacucaccugauuac

SEQ ID NO: 2605616 - RNA, 22 nt, Escherichia coli CFT073
gcagacuguaaaucugccguca

SEQ ID NO: 2605617 - RNA, 17 nt, Escherichia coli CFT073
gcagacuuuuugcggca

SEQ ID NO: 2605618 - RNA, 20 nt, Escherichia coli CFT073
gcagacuuuuugcggcagca

SEQ ID NO: 2605619 - RNA, 23 nt, Escherichia coli CFT073
gcagacuuuuugcggcagcaaug

SEQ ID NO: 2605620 - RNA, 15 nt, Escherichia coli CFT073
gcagagaaaccacau

SEQ ID NO: 2605621 - RNA, 18 nt, Escherichia coli CFT073
gcagagaaaccacaucaa

SEQ ID NO: 2605622 - RNA, 13 nt, Escherichia coli CFT073
gcagagagucacg

SEQ ID NO: 2605623 - RNA, 20 nt, Escherichia coli CFT073
gcagagauacaggccaccgc

SEQ ID NO: 2605624 - RNA, 23 nt, Escherichia coli CFT073
gcagagaucauacagaugcugcu

SEQ ID NO: 2605625 - RNA, 20 nt, Escherichia coli CFT073
gcagagaucgccccggcaag

SEQ ID NO: 2605626 - RNA, 22 nt, Escherichia coli CFT073
gcagagaucgccccggcaagaa

SEQ ID NO: 2605627 - RNA, 14 nt, Escherichia coli CFT073
gcagagcaaacagg

SEQ ID NO: 2605628 - RNA, 22 nt, Escherichia coli CFT073
gcagagccugaauaaacgccau

SEQ ID NO: 2605629 - RNA, 19 nt, Escherichia coli CFT073
gcagagcgauauccagcgc

SEQ ID NO: 2605630 - RNA, 23 nt, Escherichia coli CFT073
gcagaggugccugucagcccaaa

SEQ ID NO: 2605631 - RNA, 15 nt, Escherichia coli CFT073
gcagaguaucgccau

SEQ ID NO: 2605632 - RNA, 23 nt, Escherichia coli CFT073
gcagagugcgcagcaucggccug

SEQ ID NO: 2605633 - RNA, 13 nt, Escherichia coli CFT073
gcagaguuuccag

SEQ ID NO: 2605634 - RNA, 18 nt, Escherichia coli CFT073
gcagaguuuccaggcugg

SEQ ID NO: 2605635 - RNA, 13 nt, Escherichia coli CFT073
gcagauaaccacu

SEQ ID NO: 2605636 - RNA, 13 nt, Escherichia coli CFT073
gcagauaacccag

SEQ ID NO: 2605637 - RNA, 16 nt, Escherichia coli CFT073
gcagauaacccagcag

SEQ ID NO: 2605638 - RNA, 17 nt, Escherichia coli CFT073
gcagauaacccagcagc

SEQ ID NO: 2605639 - RNA, 22 nt, Escherichia coli CFT073
gcagauaacccagcagcccgag

SEQ ID NO: 2605640 - RNA, 13 nt, Escherichia coli CFT073
gcagauaauaguc

SEQ ID NO: 2605641 - RNA, 14 nt, Escherichia coli CFT073
gcagauacaaccaa

SEQ ID NO: 2605642 - RNA, 21 nt, Escherichia coli CFT073
gcagauacaaccaaucgcggc

SEQ ID NO: 2605643 - RNA, 14 nt, Escherichia coli CFT073
gcagauaccacauc

SEQ ID NO: 2605644 - RNA, 21 nt, Escherichia coli CFT073
gcagauaccaccagcgccauu

SEQ ID NO: 2605645 - RNA, 18 nt, Escherichia coli CFT073
gcagauacggcgcaucag

SEQ ID NO: 2605646 - RNA, 20 nt, Escherichia coli CFT073
gcagauagggcgagaaauug

SEQ ID NO: 2605647 - RNA, 20 nt, Escherichia coli CFT073
gcagauccaguuacccagcg

SEQ ID NO: 2605648 - RNA, 13 nt, Escherichia coli CFT073
gcagaucgaucuu

SEQ ID NO: 2605649 - RNA, 12 nt, Escherichia coli CFT073
gcagaucgccag

SEQ ID NO: 2605650 - RNA, 24 nt, Escherichia coli CFT073
gcagaucgccagagucagcacgag

SEQ ID NO: 2605651 - RNA, 15 nt, Escherichia coli CFT073
gcagaucgcggccua

SEQ ID NO: 2605652 - RNA, 19 nt, Escherichia coli CFT073
gcagaucgcggccuaccug

SEQ ID NO: 2605653 - RNA, 14 nt, Escherichia coli CFT073
gcagaucugcgcca

SEQ ID NO: 2605654 - RNA, 18 nt, Escherichia coli CFT073
gcagaucuuucugcaggg

SEQ ID NO: 2605655 - RNA, 22 nt, Escherichia coli CFT073
gcagaugacucgccgcaaaacc

SEQ ID NO: 2605656 - RNA, 18 nt, Escherichia coli CFT073
gcagaugcacaagcggca

SEQ ID NO: 2605657 - RNA, 23 nt, Escherichia coli CFT073
gcagaugcgucuucugcagucac

SEQ ID NO: 2605658 - RNA, 15 nt, Escherichia coli CFT073
gcagaugcugugccu

SEQ ID NO: 2605659 - RNA, 21 nt, Escherichia coli CFT073
gcagaugcugugccuccugcg

SEQ ID NO: 2605660 - RNA, 23 nt, Escherichia coli CFT073
gcagaugcugugccuccugcggc

SEQ ID NO: 2605661 - RNA, 17 nt, Escherichia coli CFT073
gcagauggaugagcaaa

SEQ ID NO: 2605662 - RNA, 16 nt, Escherichia coli CFT073
gcagauggcagccauc

SEQ ID NO: 2605663 - RNA, 16 nt, Escherichia coli CFT073
gcagauggcauccagc

SEQ ID NO: 2605664 - RNA, 19 nt, Escherichia coli CFT073
gcagauuucuucuggcuac

SEQ ID NO: 2605665 - RNA, 21 nt, Escherichia coli CFT073
gcagauuugccaguaccgauu

SEQ ID NO: 2605666 - RNA, 19 nt, Escherichia coli CFT073
gcagcaaaagcaggcaccg

SEQ ID NO: 2605667 - RNA, 20 nt, Escherichia coli CFT073
gcagcaaaagcaggcaccgc

SEQ ID NO: 2605668 - RNA, 22 nt, Escherichia coli CFT073
gcagcaaagacgaugaaugcaa

SEQ ID NO: 2605669 - RNA, 23 nt, Escherichia coli CFT073
gcagcaaagcccgggcacaucac

SEQ ID NO: 2605670 - RNA, 15 nt, Escherichia coli CFT073
gcagcaacaucacgc

SEQ ID NO: 2605671 - RNA, 18 nt, Escherichia coli CFT073
gcagcaacaucacgcuga

SEQ ID NO: 2605672 - RNA, 23 nt, Escherichia coli CFT073
gcagcaacaucacgcugacgcau

SEQ ID NO: 2605673 - RNA, 13 nt, Escherichia coli CFT073
gcaggaaauauaa

SEQ ID NO: 2605674 - RNA, 16 nt, Escherichia coli CFT073
gcaggaaaucaaugcc

SEQ ID NO: 2605675 - RNA, 20 nt, Escherichia coli CFT073
gcaggaacuucguaagccug

SEQ ID NO: 2605676 - RNA, 17 nt, Escherichia coli CFT073
gcaggaauaaucagcag

SEQ ID NO: 2605677 - RNA, 17 nt, Escherichia coli CFT073
gcaggaaucccaucaga

SEQ ID NO: 2605678 - RNA, 14 nt, Escherichia coli CFT073
gcaggaauggcugg

SEQ ID NO: 2605679 - RNA, 13 nt, Escherichia coli CFT073
gcaggagaccaaa

SEQ ID NO: 2605680 - RNA, 14 nt, Escherichia coli CFT073
gcaggagcggcgga

SEQ ID NO: 2605681 - RNA, 17 nt, Escherichia coli CFT073
gcaggagcugagugcga

SEQ ID NO: 2605682 - RNA, 16 nt, Escherichia coli CFT073
gcaggauaacggcaga

SEQ ID NO: 2605683 - RNA, 18 nt, Escherichia coli CFT073
gcaggaucuccaguuccc

SEQ ID NO: 2605684 - RNA, 14 nt, Escherichia coli CFT073
gcaggaucugcgcg

SEQ ID NO: 2605685 - RNA, 13 nt, Escherichia coli CFT073
gcaggaugcgaca

SEQ ID NO: 2605686 - RNA, 16 nt, Escherichia coli CFT073
gcaggcaaauuauuaa

SEQ ID NO: 2605687 - RNA, 13 nt, Escherichia coli CFT073
gcaggcaacuuca

SEQ ID NO: 2605688 - RNA, 16 nt, Escherichia coli CFT073
gcaggcaauuucgccu

SEQ ID NO: 2605689 - RNA, 18 nt, Escherichia coli CFT073
gcaggcacaaaaccugcc

SEQ ID NO: 2605690 - RNA, 18 nt, Escherichia coli CFT073
gcaggcaccagccccugg

SEQ ID NO: 2605691 - RNA, 18 nt, Escherichia coli CFT073
gcaggcaccgcgcccaca

SEQ ID NO: 2605692 - RNA, 15 nt, Escherichia coli CFT073
gcaggcacuugguuu

SEQ ID NO: 2605693 - RNA, 14 nt, Escherichia coli CFT073
gcaggcaucgguga

SEQ ID NO: 2605694 - RNA, 19 nt, Escherichia coli CFT073
gcaggcaucggugaugcuc

SEQ ID NO: 2605695 - RNA, 16 nt, Escherichia coli CFT073
gcaggccaaacagcgu

SEQ ID NO: 2605696 - RNA, 20 nt, Escherichia coli CFT073
gcaggccacgaaucagcacc

SEQ ID NO: 2605697 - RNA, 10 nt, Escherichia coli CFT073
gcaggccgga

SEQ ID NO: 2605698 - RNA, 13 nt, Escherichia coli CFT073
gcaggccggagac

SEQ ID NO: 2605699 - RNA, 17 nt, Escherichia coli CFT073
gcaggccgucgcguagc

SEQ ID NO: 2605700 - RNA, 18 nt, Escherichia coli CFT073
gcaggccgucgcguagca

SEQ ID NO: 2605701 - RNA, 14 nt, Escherichia coli CFT073
gcaggccugauaag

SEQ ID NO: 2605702 - RNA, 17 nt, Escherichia coli CFT073
gcaggcgacucgguugc

SEQ ID NO: 2605703 - RNA, 14 nt, Escherichia coli CFT073
gcaggcgcugaaaa

SEQ ID NO: 2605704 - RNA, 19 nt, Escherichia coli CFT073
gcaggcguaacacucgugc

SEQ ID NO: 2605705 - RNA, 18 nt, Escherichia coli CFT073
gcaggcgucgcaucaggc

SEQ ID NO: 2605706 - RNA, 12 nt, Escherichia coli CFT073
gcaggcgugcgc

SEQ ID NO: 2605707 - RNA, 23 nt, Escherichia coli CFT073
gcaggcguuaauauaaacgacag

SEQ ID NO: 2605708 - RNA, 13 nt, Escherichia coli CFT073
gcaggcuaaaaac

SEQ ID NO: 2605709 - RNA, 14 nt, Escherichia coli CFT073
gcaggcugcgcgcu

SEQ ID NO: 2605710 - RNA, 15 nt, Escherichia coli CFT073
gcaggcuggcgacga

SEQ ID NO: 2605711 - RNA, 12 nt, Escherichia coli CFT073
gcaggcuggugg

SEQ ID NO: 2605712 - RNA, 21 nt, Escherichia coli CFT073
gcaggcuguuaccccugcggc

SEQ ID NO: 2605713 - RNA, 23 nt, Escherichia coli CFT073
gcaggcuguuaccccugcggccg

SEQ ID NO: 2605714 - RNA, 14 nt, Escherichia coli CFT073
gcaggcuucaacac

SEQ ID NO: 2605715 - RNA, 21 nt, Escherichia coli CFT073
gcaggcuucaacacaggccgg

SEQ ID NO: 2605716 - RNA, 14 nt, Escherichia coli CFT073
gcaggcuucaauuu

SEQ ID NO: 2605717 - RNA, 13 nt, Escherichia coli CFT073
gcagggaagcgag

SEQ ID NO: 2605718 - RNA, 20 nt, Escherichia coli CFT073
gcagggcaauacgcuccgcc

SEQ ID NO: 2605719 - RNA, 21 nt, Escherichia coli CFT073
gcagggcaauacgcuccgccc

SEQ ID NO: 2605720 - RNA, 23 nt, Escherichia coli CFT073
gcagggcgaauuccugacuuacu

SEQ ID NO: 2605721 - RNA, 13 nt, Escherichia coli CFT073
gcagggcgggaga

SEQ ID NO: 2605722 - RNA, 15 nt, Escherichia coli CFT073
gcaggggaauuucaa

SEQ ID NO: 2605723 - RNA, 16 nt, Escherichia coli CFT073
gcaggggcaaucagca

SEQ ID NO: 2605724 - RNA, 21 nt, Escherichia coli CFT073
gcaggguacgacuuccuggcu

SEQ ID NO: 2605725 - RNA, 17 nt, Escherichia coli CFT073
gcagggugcuaucgcga

SEQ ID NO: 2605726 - RNA, 17 nt, Escherichia coli CFT073
gcaggguuugcgcccag

SEQ ID NO: 2605727 - RNA, 14 nt, Escherichia coli CFT073
gcagguaagaguuu

SEQ ID NO: 2605728 - RNA, 14 nt, Escherichia coli CFT073
gcagguaaucugcc

SEQ ID NO: 2605729 - RNA, 17 nt, Escherichia coli CFT073
gcagguacugguaagca

SEQ ID NO: 2605730 - RNA, 15 nt, Escherichia coli CFT073
gcagguagcagcagc

SEQ ID NO: 2605731 - RNA, 13 nt, Escherichia coli CFT073
gcaggucaagguc

SEQ ID NO: 2605732 - RNA, 15 nt, Escherichia coli CFT073
gcaggucgccagaaa

SEQ ID NO: 2605733 - RNA, 16 nt, Escherichia coli CFT073
gcaggugggauaaggc

SEQ ID NO: 2605734 - RNA, 19 nt, Escherichia coli CFT073
gcagguuaugaauauucug

SEQ ID NO: 2605735 - RNA, 16 nt, Escherichia coli CFT073
gcagguugagcaacaa

SEQ ID NO: 2605736 - RNA, 20 nt, Escherichia coli CFT073
gcagguugcagagcauccuu

SEQ ID NO: 2605737 - RNA, 18 nt, Escherichia coli CFT073
gcagguuggaauaaacaa

SEQ ID NO: 2605738 - RNA, 16 nt, Escherichia coli CFT073
gcagguuuuuacccaa

SEQ ID NO: 2605739 - RNA, 12 nt, Escherichia coli CFT073
gcaguaaaccac

SEQ ID NO: 2605740 - RNA, 16 nt, Escherichia coli CFT073
gcaguaaaccacauca

SEQ ID NO: 2605741 - RNA, 18 nt, Escherichia coli CFT073
gcaguaaaccacaucagc

SEQ ID NO: 2605742 - RNA, 13 nt, Escherichia coli CFT073
gcaguaaaccacc

SEQ ID NO: 2605743 - RNA, 15 nt, Escherichia coli CFT073
gcaguaaaccaccca

SEQ ID NO: 2605744 - RNA, 13 nt, Escherichia coli CFT073
gcaguaaaccgcu

SEQ ID NO: 2605745 - RNA, 15 nt, Escherichia coli CFT073
gcaguaaaccgcucg

SEQ ID NO: 2605746 - RNA, 21 nt, Escherichia coli CFT073
gcaguaaaccgcucgucacau

SEQ ID NO: 2605747 - RNA, 15 nt, Escherichia coli CFT073
gcaguaaacgccagg

SEQ ID NO: 2605748 - RNA, 16 nt, Escherichia coli CFT073
gcaguaaacgccaggg

SEQ ID NO: 2605749 - RNA, 20 nt, Escherichia coli CFT073
gcaguaaauaaaaaauccac

SEQ ID NO: 2605750 - RNA, 17 nt, Escherichia coli CFT073
gcaguaacugcuguagu

SEQ ID NO: 2605751 - RNA, 20 nt, Escherichia coli CFT073
gcaguaccagauaaucaccc

SEQ ID NO: 2605752 - RNA, 21 nt, Escherichia coli CFT073
gcaguaccagauaaucacccg

SEQ ID NO: 2605753 - RNA, 22 nt, Escherichia coli CFT073
gcaguaccagauaaucacccgc

SEQ ID NO: 2605754 - RNA, 20 nt, Escherichia coli CFT073
gcaguaccagcaacgcuuca

SEQ ID NO: 2605755 - RNA, 18 nt, Escherichia coli CFT073
gcaguaccgcagccggaa

SEQ ID NO: 2605756 - RNA, 17 nt, Escherichia coli CFT073
gcaguacgauaauggcu

SEQ ID NO: 2605757 - RNA, 16 nt, Escherichia coli CFT073
gcaguacggcagguca

SEQ ID NO: 2605758 - RNA, 18 nt, Escherichia coli CFT073
gcaguacguuuugagccu

SEQ ID NO: 2605759 - RNA, 22 nt, Escherichia coli CFT073
gcaguagaucuuauaugcgucu

SEQ ID NO: 2605760 - RNA, 23 nt, Escherichia coli CFT073
gcaguagcagcaggaauaaucag

SEQ ID NO: 2605761 - RNA, 18 nt, Escherichia coli CFT073
gcaguauuaccagaccuu

SEQ ID NO: 2605762 - RNA, 17 nt, Escherichia coli CFT073
gcagucaccugcccucc

SEQ ID NO: 2605763 - RNA, 19 nt, Escherichia coli CFT073
gcagucaccugcccuccgg

SEQ ID NO: 2605764 - RNA, 13 nt, Escherichia coli CFT073
gcagucaccugcg

SEQ ID NO: 2605765 - RNA, 19 nt, Escherichia coli CFT073
gcagucaccugcggugcag

SEQ ID NO: 2605766 - RNA, 22 nt, Escherichia coli CFT073
gcagucaccugcggugcagccg

SEQ ID NO: 2605767 - RNA, 14 nt, Escherichia coli CFT073
gcagucacgccagu

SEQ ID NO: 2605768 - RNA, 19 nt, Escherichia coli CFT073
gcagucccaucuucugaau

SEQ ID NO: 2605769 - RNA, 23 nt, Escherichia coli CFT073
gcaguccccacaucacaccaucc

SEQ ID NO: 2605770 - RNA, 21 nt, Escherichia coli CFT073
gcaguccgcuaaaaauaguuc

SEQ ID NO: 2605771 - RNA, 22 nt, Escherichia coli CFT073
gcagucggaaccgguuuagaaa

SEQ ID NO: 2605772 - RNA, 14 nt, Escherichia coli CFT073
gcagucgugcccaa

SEQ ID NO: 2605773 - RNA, 19 nt, Escherichia coli CFT073
gcagucuuaauagcuucuu

SEQ ID NO: 2605774 - RNA, 18 nt, Escherichia coli CFT073
gcagugacauucaccuca

SEQ ID NO: 2605775 - RNA, 19 nt, Escherichia coli CFT073
gcagugauagcacgguucg

SEQ ID NO: 2605776 - RNA, 13 nt, Escherichia coli CFT073
gcagugaucacuu

SEQ ID NO: 2605777 - RNA, 16 nt, Escherichia coli CFT073
gcagugauugccgcga

SEQ ID NO: 2605778 - RNA, 18 nt, Escherichia coli CFT073
gcagugcgcgaaccagag

SEQ ID NO: 2605779 - RNA, 23 nt, Escherichia coli CFT073
gcagugcgcgaaccagagacaga

SEQ ID NO: 2605780 - RNA, 23 nt, Escherichia coli CFT073
gcagugcucguagaagccagaga

SEQ ID NO: 2605781 - RNA, 15 nt, Escherichia coli CFT073
gcagugcugcaccaa

SEQ ID NO: 2605782 - RNA, 16 nt, Escherichia coli CFT073
gcaucugaagccugcu

SEQ ID NO: 2605783 - RNA, 14 nt, Escherichia coli CFT073
gcaucugauaagcc

SEQ ID NO: 2605784 - RNA, 23 nt, Escherichia coli CFT073
gcaucugccaccguguauuucug

SEQ ID NO: 2605785 - RNA, 19 nt, Escherichia coli CFT073
gcaucugcuguaaagucug

SEQ ID NO: 2605786 - RNA, 11 nt, Escherichia coli CFT073
gcaucugcuug

SEQ ID NO: 2605787 - RNA, 17 nt, Escherichia coli CFT073
gcaucuggcauaaacaa

SEQ ID NO: 2605788 - RNA, 20 nt, Escherichia coli CFT073
gcaucuggcauaaacaaagc

SEQ ID NO: 2605789 - RNA, 22 nt, Escherichia coli CFT073
gcaucuggcgauacggugcaca

SEQ ID NO: 2605790 - RNA, 18 nt, Escherichia coli CFT073
gcaucuggugccagcgcc

SEQ ID NO: 2605791 - RNA, 19 nt, Escherichia coli CFT073
gcaucuggugccagcgcca

SEQ ID NO: 2605792 - RNA, 22 nt, Escherichia coli CFT073
gcaucuggugccagcgccagca

SEQ ID NO: 2605793 - RNA, 23 nt, Escherichia coli CFT073
gcaucugguuuuuuauauucaug

SEQ ID NO: 2605794 - RNA, 15 nt, Escherichia coli CFT073
gcaucuguucuuuca

SEQ ID NO: 2605795 - RNA, 21 nt, Escherichia coli CFT073
gcaucuguugguaacuuacug

SEQ ID NO: 2605796 - RNA, 20 nt, Escherichia coli CFT073
gcaucuuaaucucucaacac

SEQ ID NO: 2605797 - RNA, 14 nt, Escherichia coli CFT073
gcaucuuaccgaug

SEQ ID NO: 2605798 - RNA, 13 nt, Escherichia coli CFT073
gcaucuucuucau

SEQ ID NO: 2605799 - RNA, 16 nt, Escherichia coli CFT073
gcaucuucuucauucc

SEQ ID NO: 2605800 - RNA, 18 nt, Escherichia coli CFT073
gcaucuucuucauucccg

SEQ ID NO: 2605801 - RNA, 16 nt, Escherichia coli CFT073
gcaucuucuucuaugc

SEQ ID NO: 2605802 - RNA, 19 nt, Escherichia coli CFT073
gcaucuucuucuaugccag

SEQ ID NO: 2605803 - RNA, 13 nt, Escherichia coli CFT073
gcaucuucuucug

SEQ ID NO: 2605804 - RNA, 16 nt, Escherichia coli CFT073
gcaucuucuucuggcu

SEQ ID NO: 2605805 - RNA, 13 nt, Escherichia coli CFT073
gcaucuuuuucaa

SEQ ID NO: 2605806 - RNA, 17 nt, Escherichia coli CFT073
gcaucuuuuucaaugca

SEQ ID NO: 2605807 - RNA, 19 nt, Escherichia coli CFT073
gcaucuuuuucaaugcaua

SEQ ID NO: 2605808 - RNA, 16 nt, Escherichia coli CFT073
gcaugaacaaaacaua

SEQ ID NO: 2605809 - RNA, 23 nt, Escherichia coli CFT073
gcaugaacaaaacauacuuucuc

SEQ ID NO: 2605810 - RNA, 15 nt, Escherichia coli CFT073
gcaugaacaaagcuc

SEQ ID NO: 2605811 - RNA, 16 nt, Escherichia coli CFT073
gcaugaacaaaucgca

SEQ ID NO: 2605812 - RNA, 17 nt, Escherichia coli CFT073
gcaugaacaaaucgcac

SEQ ID NO: 2605813 - RNA, 22 nt, Escherichia coli CFT073
gcaugaacgccugauucggccu

SEQ ID NO: 2605814 - RNA, 17 nt, Escherichia coli CFT073
gcaugaaguaacagaag

SEQ ID NO: 2605815 - RNA, 22 nt, Escherichia coli CFT073
gcaugaaguaacagaagaucau

SEQ ID NO: 2605816 - RNA, 22 nt, Escherichia coli CFT073
gcaugacacacucugaccuguc

SEQ ID NO: 2605817 - RNA, 13 nt, Escherichia coli CFT073
gcaugacagcgcc

SEQ ID NO: 2605818 - RNA, 15 nt, Escherichia coli CFT073
gcaugacccagugca

SEQ ID NO: 2605819 - RNA, 17 nt, Escherichia coli CFT073
gcaugagugccagauug

SEQ ID NO: 2605820 - RNA, 20 nt, Escherichia coli CFT073
gcaugauuucaucaucaggc

SEQ ID NO: 2605821 - RNA, 14 nt, Escherichia coli CFT073
gcaugcauuuucaa

SEQ ID NO: 2605822 - RNA, 13 nt, Escherichia coli CFT073
gcaugccagcgcc

SEQ ID NO: 2605823 - RNA, 14 nt, Escherichia coli CFT073
gcauggaucgccgc

SEQ ID NO: 2605824 - RNA, 15 nt, Escherichia coli CFT073
gcauggcagccaggu

SEQ ID NO: 2605825 - RNA, 17 nt, Escherichia coli CFT073
gcauggccugaauaacg

SEQ ID NO: 2605826 - RNA, 16 nt, Escherichia coli CFT073
gcauggcgaauggcac

SEQ ID NO: 2605827 - RNA, 21 nt, Escherichia coli CFT073
gcauggcuaaaguacguaaaa

SEQ ID NO: 2605828 - RNA, 12 nt, Escherichia coli CFT073
gcauggggagac

SEQ ID NO: 2605829 - RNA, 13 nt, Escherichia coli CFT073
gcauggggagacc

SEQ ID NO: 2605830 - RNA, 22 nt, Escherichia coli CFT073
gcaugguaacgccccacaagcc

SEQ ID NO: 2605831 - RNA, 14 nt, Escherichia coli CFT073
gcaugguacccaau

SEQ ID NO: 2605832 - RNA, 15 nt, Escherichia coli CFT073
gcaugguauaaggag

SEQ ID NO: 2605833 - RNA, 16 nt, Escherichia coli CFT073
gcauggugagcgcaca

SEQ ID NO: 2605834 - RNA, 14 nt, Escherichia coli CFT073
gcauguaacccuuu

SEQ ID NO: 2605835 - RNA, 20 nt, Escherichia coli CFT073
gcauguaacugccuuucccu

SEQ ID NO: 2605836 - RNA, 23 nt, Escherichia coli CFT073
gcaugucaggcaguguucuggcu

SEQ ID NO: 2605837 - RNA, 16 nt, Escherichia coli CFT073
gcaugucaggcgucgc

SEQ ID NO: 2605838 - RNA, 23 nt, Escherichia coli CFT073
gcaugucguagacgggcgucagc

SEQ ID NO: 2605839 - RNA, 20 nt, Escherichia coli CFT073
gcaugucuugccucccugca

SEQ ID NO: 2605840 - RNA, 19 nt, Escherichia coli CFT073
gcauguuaccgauagauuu

SEQ ID NO: 2605841 - RNA, 18 nt, Escherichia coli CFT073
gcauguucagucacuuca

SEQ ID NO: 2605842 - RNA, 17 nt, Escherichia coli CFT073
gcauguugauuaccugu

SEQ ID NO: 2605843 - RNA, 18 nt, Escherichia coli CFT073
gcauguuuuuuaaguuca

SEQ ID NO: 2605844 - RNA, 19 nt, Escherichia coli CFT073
gcauuaaauaccaagccaa

SEQ ID NO: 2605845 - RNA, 23 nt, Escherichia coli CFT073
gcauuaacaguagagccgccagu

SEQ ID NO: 2605846 - RNA, 22 nt, Escherichia coli CFT073
gcauuaacgcgaaauaaucaaa

SEQ ID NO: 2605847 - RNA, 16 nt, Escherichia coli CFT073
gcauuaacucacuggc

SEQ ID NO: 2605848 - RNA, 20 nt, Escherichia coli CFT073
gcauuaaguguaaucagccc

SEQ ID NO: 2605849 - RNA, 20 nt, Escherichia coli CFT073
gcauuaauaagguaauuauu

SEQ ID NO: 2605850 - RNA, 13 nt, Escherichia coli CFT073
gcauuacaagaau

SEQ ID NO: 2605851 - RNA, 18 nt, Escherichia coli CFT073
gcauuacgaaaucggcac

SEQ ID NO: 2605852 - RNA, 16 nt, Escherichia coli CFT073
gcauuacgcucgcugc

SEQ ID NO: 2605853 - RNA, 18 nt, Escherichia coli CFT073
gcauuacgcucgcugcaa

SEQ ID NO: 2605854 - RNA, 14 nt, Escherichia coli CFT073
gcauuacuuucggu

SEQ ID NO: 2605855 - RNA, 22 nt, Escherichia coli CFT073
gcauuacuuucggugacuucaa

SEQ ID NO: 2605856 - RNA, 17 nt, Escherichia coli CFT073
gcauuagcaaugcccug

SEQ ID NO: 2605857 - RNA, 19 nt, Escherichia coli CFT073
gcauuagcaucaagaaaaa

SEQ ID NO: 2605858 - RNA, 16 nt, Escherichia coli CFT073
gcauuagcauuaacag

SEQ ID NO: 2605859 - RNA, 18 nt, Escherichia coli CFT073
gcauuaucacaucagcgc

SEQ ID NO: 2605860 - RNA, 14 nt, Escherichia coli CFT073
gcauuauccucaau

SEQ ID NO: 2605861 - RNA, 19 nt, Escherichia coli CFT073
gcauucacauuuuuaagcc

SEQ ID NO: 2605862 - RNA, 19 nt, Escherichia coli CFT073
gcauucaccucugcggcaa

SEQ ID NO: 2605863 - RNA, 21 nt, Escherichia coli CFT073
gcauucagacacgccgccaga

SEQ ID NO: 2605864 - RNA, 13 nt, Escherichia coli CFT073
gcauucagcuucc

SEQ ID NO: 2605865 - RNA, 18 nt, Escherichia coli CFT073
gcauucagggcagugcca

SEQ ID NO: 2605866 - RNA, 22 nt, Escherichia coli CFT073
gcauucaugaacacacccggag

SEQ ID NO: 2605867 - RNA, 20 nt, Escherichia coli CFT073
gcauuccuuguuuaaggaaa

SEQ ID NO: 2605868 - RNA, 16 nt, Escherichia coli CFT073
gcauuccuuuacuuag

SEQ ID NO: 2605869 - RNA, 16 nt, Escherichia coli CFT073
gcauucgccacugcca

SEQ ID NO: 2605870 - RNA, 21 nt, Escherichia coli CFT073
gcauucgccacugccagcaaa

SEQ ID NO: 2605871 - RNA, 18 nt, Escherichia coli CFT073
gcauucggcgaccagcgc

SEQ ID NO: 2605872 - RNA, 21 nt, Escherichia coli CFT073
gcauucggcgaccagcgcagc

SEQ ID NO: 2605873 - RNA, 22 nt, Escherichia coli CFT073
gcauucggcgaccagcgcagcu

SEQ ID NO: 2605874 - RNA, 15 nt, Escherichia coli CFT073
gcauucguucucaau

SEQ ID NO: 2605875 - RNA, 12 nt, Escherichia coli CFT073
gcauucuucuga

SEQ ID NO: 2605876 - RNA, 14 nt, Escherichia coli CFT073
gcauugaaaauuac

SEQ ID NO: 2605877 - RNA, 14 nt, Escherichia coli CFT073
gcauugaaguuuaa

SEQ ID NO: 2605878 - RNA, 17 nt, Escherichia coli CFT073
gcauugaggguauccag

SEQ ID NO: 2605879 - RNA, 22 nt, Escherichia coli CFT073
gcauugauucgccgccgcauau

SEQ ID NO: 2605880 - RNA, 11 nt, Escherichia coli CFT073
gcauugccgga

SEQ ID NO: 2605881 - RNA, 14 nt, Escherichia coli CFT073
gcauugcggcauca

SEQ ID NO: 2605882 - RNA, 17 nt, Escherichia coli CFT073
gcauugcuucccauguc

SEQ ID NO: 2605883 - RNA, 13 nt, Escherichia coli CFT073
gcauuggcaaauu

SEQ ID NO: 2605884 - RNA, 22 nt, Escherichia coli CFT073
gcauuggcaaucacaucaccau

SEQ ID NO: 2605885 - RNA, 17 nt, Escherichia coli CFT073
gcauugguacaacgucc

SEQ ID NO: 2605886 - RNA, 22 nt, Escherichia coli CFT073
gcauuguauauugcagcaacga

SEQ ID NO: 2605887 - RNA, 19 nt, Escherichia coli CFT073
gcauuguguagggcagcgu

SEQ ID NO: 2605888 - RNA, 20 nt, Escherichia coli CFT073
gcauuguuuuuaucccggca

SEQ ID NO: 2605889 - RNA, 17 nt, Escherichia coli CFT073
gcauuuacucucaucaa

SEQ ID NO: 2605890 - RNA, 21 nt, Escherichia coli CFT073
gccacacgagucauuccugcc

SEQ ID NO: 2605891 - RNA, 21 nt, Escherichia coli CFT073
gccacagauaauaauguguuc

SEQ ID NO: 2605892 - RNA, 15 nt, Escherichia coli CFT073
gccacagcaagcagc

SEQ ID NO: 2605893 - RNA, 20 nt, Escherichia coli CFT073
gccacagcaagcagccgaua

SEQ ID NO: 2605894 - RNA, 18 nt, Escherichia coli CFT073
gccacagccgagcgcuac

SEQ ID NO: 2605895 - RNA, 15 nt, Escherichia coli CFT073
gccacaggccgcugu

SEQ ID NO: 2605896 - RNA, 15 nt, Escherichia coli CFT073
gccacaguaaaaccg

SEQ ID NO: 2605897 - RNA, 18 nt, Escherichia coli CFT073
gccacaguaaaaccggua

SEQ ID NO: 2605898 - RNA, 20 nt, Escherichia coli CFT073
gccacaguuuuacugcagcc

SEQ ID NO: 2605899 - RNA, 21 nt, Escherichia coli CFT073
gccacaguuuuacugcagcca

SEQ ID NO: 2605900 - RNA, 13 nt, Escherichia coli CFT073
gccacauacuguu

SEQ ID NO: 2605901 - RNA, 21 nt, Escherichia coli CFT073
gccacauccgcgguaucgccg

SEQ ID NO: 2605902 - RNA, 23 nt, Escherichia coli CFT073
gccacauccggcauauuaaccau

SEQ ID NO: 2605903 - RNA, 13 nt, Escherichia coli CFT073
gccacaucgccau

SEQ ID NO: 2605904 - RNA, 16 nt, Escherichia coli CFT073
gccacauugcugcaca

SEQ ID NO: 2605905 - RNA, 23 nt, Escherichia coli CFT073
gccacauugcugcacauccggua

SEQ ID NO: 2605906 - RNA, 10 nt, Escherichia coli CFT073
gccaccaacg

SEQ ID NO: 2605907 - RNA, 15 nt, Escherichia coli CFT073
gccaccaacgcacca

SEQ ID NO: 2605908 - RNA, 15 nt, Escherichia coli CFT073
gccaccaauacuugc

SEQ ID NO: 2605909 - RNA, 17 nt, Escherichia coli CFT073
gccaccacaccagacca

SEQ ID NO: 2605910 - RNA, 20 nt, Escherichia coli CFT073
gccaccacaccagaccagac

SEQ ID NO: 2605911 - RNA, 14 nt, Escherichia coli CFT073
gccaccaccagcgu

SEQ ID NO: 2605912 - RNA, 15 nt, Escherichia coli CFT073
gccaccaccaguaca

SEQ ID NO: 2605913 - RNA, 17 nt, Escherichia coli CFT073
gccaccaccucuuccag

SEQ ID NO: 2605914 - RNA, 17 nt, Escherichia coli CFT073
gccaccacgccaagaaa

SEQ ID NO: 2605915 - RNA, 15 nt, Escherichia coli CFT073
gccaccacgcccagc

SEQ ID NO: 2605916 - RNA, 19 nt, Escherichia coli CFT073
gccaccacgcccagcgacc

SEQ ID NO: 2605917 - RNA, 16 nt, Escherichia coli CFT073
gccaccacucaaaagc

SEQ ID NO: 2605918 - RNA, 14 nt, Escherichia coli CFT073
gccaccagaaccgc

SEQ ID NO: 2605919 - RNA, 17 nt, Escherichia coli CFT073
gccaccagaaccgccgc

SEQ ID NO: 2605920 - RNA, 15 nt, Escherichia coli CFT073
gccaccagcacaccg

SEQ ID NO: 2605921 - RNA, 20 nt, Escherichia coli CFT073
gccaccagcacaccgucagc

SEQ ID NO: 2605922 - RNA, 15 nt, Escherichia coli CFT073
gccaccagcgucaga

SEQ ID NO: 2605923 - RNA, 18 nt, Escherichia coli CFT073
gccaccagcgucagaaac

SEQ ID NO: 2605924 - RNA, 20 nt, Escherichia coli CFT073
gccaccagcgucagaaacag

SEQ ID NO: 2605925 - RNA, 21 nt, Escherichia coli CFT073
gccaccaggaaaaagaucagc

SEQ ID NO: 2605926 - RNA, 19 nt, Escherichia coli CFT073
gccaccaggaacgcgccaa

SEQ ID NO: 2605927 - RNA, 16 nt, Escherichia coli CFT073
gccaccaggcagcaca

SEQ ID NO: 2605928 - RNA, 13 nt, Escherichia coli CFT073
gccaccaggccac

SEQ ID NO: 2605929 - RNA, 10 nt, Escherichia coli CFT073
gccaccaggu

SEQ ID NO: 2605930 - RNA, 19 nt, Escherichia coli CFT073
gccaccagguucaacagcg

SEQ ID NO: 2605931 - RNA, 12 nt, Escherichia coli CFT073
gccaccaguaac

SEQ ID NO: 2605932 - RNA, 22 nt, Escherichia coli CFT073
gccaccauccccaccaaaacag

SEQ ID NO: 2605933 - RNA, 15 nt, Escherichia coli CFT073
gccaccaugcccagu

SEQ ID NO: 2605934 - RNA, 21 nt, Escherichia coli CFT073
gccaccauuuuacgcccgcga

SEQ ID NO: 2605935 - RNA, 16 nt, Escherichia coli CFT073
gccacccacaccgcag

SEQ ID NO: 2605936 - RNA, 12 nt, Escherichia coli CFT073
gccacccagcga

SEQ ID NO: 2605937 - RNA, 15 nt, Escherichia coli CFT073
gccaccccacaccag

SEQ ID NO: 2605938 - RNA, 18 nt, Escherichia coli CFT073
gccaccccagucguccag

SEQ ID NO: 2605939 - RNA, 18 nt, Escherichia coli CFT073
gccaccgaccaggcaaac

SEQ ID NO: 2605940 - RNA, 15 nt, Escherichia coli CFT073
gccaccgcccagaga

SEQ ID NO: 2605941 - RNA, 15 nt, Escherichia coli CFT073
gccaccgcuuccggc

SEQ ID NO: 2605942 - RNA, 22 nt, Escherichia coli CFT073
gccaccggcaaucugcuggcaa

SEQ ID NO: 2605943 - RNA, 17 nt, Escherichia coli CFT073
gccaccggcacauccag

SEQ ID NO: 2605944 - RNA, 23 nt, Escherichia coli CFT073
gccaccggcuuucgcuucaacca

SEQ ID NO: 2605945 - RNA, 13 nt, Escherichia coli CFT073
gccaccgggaacg

SEQ ID NO: 2605946 - RNA, 22 nt, Escherichia coli CFT073
gccaccgguacaaacaucaucc

SEQ ID NO: 2605947 - RNA, 21 nt, Escherichia coli CFT073
gccaccguccagaucaucccg

SEQ ID NO: 2605948 - RNA, 22 nt, Escherichia coli CFT073
gccaccuccgcuaaauccgccg

SEQ ID NO: 2605949 - RNA, 14 nt, Escherichia coli CFT073
gccaccucuuucac

SEQ ID NO: 2605950 - RNA, 20 nt, Escherichia coli CFT073
gccaccugcgaacuguaaug

SEQ ID NO: 2605951 - RNA, 12 nt, Escherichia coli CFT073
gccaccugugca

SEQ ID NO: 2605952 - RNA, 14 nt, Escherichia coli CFT073
gccaccuuucuguu

SEQ ID NO: 2605953 - RNA, 21 nt, Escherichia coli CFT073
gccacgaaaacccucaauaau

SEQ ID NO: 2605954 - RNA, 20 nt, Escherichia coli CFT073
gccacgacgucgggcggaaa

SEQ ID NO: 2605955 - RNA, 17 nt, Escherichia coli CFT073
gccacgaucggugaugc

SEQ ID NO: 2605956 - RNA, 15 nt, Escherichia coli CFT073
gccacgaugcacagc

SEQ ID NO: 2605957 - RNA, 17 nt, Escherichia coli CFT073
gccacgaugcacagcuc

SEQ ID NO: 2605958 - RNA, 14 nt, Escherichia coli CFT073
gccacgcauaacgc

SEQ ID NO: 2605959 - RNA, 21 nt, Escherichia coli CFT073
gccacgcauaacgcguaagua

SEQ ID NO: 2605960 - RNA, 18 nt, Escherichia coli CFT073
gccacgccaccagcguca

SEQ ID NO: 2605961 - RNA, 19 nt, Escherichia coli CFT073
gccacgccaccagcgucau

SEQ ID NO: 2605962 - RNA, 22 nt, Escherichia coli CFT073
gccacgccgaggcauucagcca

SEQ ID NO: 2605963 - RNA, 20 nt, Escherichia coli CFT073
gccacgccuguaccagcggc

SEQ ID NO: 2605964 - RNA, 15 nt, Escherichia coli CFT073
gccacgccuuccuga

SEQ ID NO: 2605965 - RNA, 19 nt, Escherichia coli CFT073
gccacgccuuccugauaac

SEQ ID NO: 2605966 - RNA, 13 nt, Escherichia coli CFT073
gccacgcggcggc

SEQ ID NO: 2605967 - RNA, 20 nt, Escherichia coli CFT073
gccacgcguucggaccaaug

SEQ ID NO: 2605968 - RNA, 20 nt, Escherichia coli CFT073
gccacgcugccgcgcagcga

SEQ ID NO: 2605969 - RNA, 20 nt, Escherichia coli CFT073
gccacgcuucaaucugauau

SEQ ID NO: 2605970 - RNA, 14 nt, Escherichia coli CFT073
gccacgcuuucugg

SEQ ID NO: 2605971 - RNA, 18 nt, Escherichia coli CFT073
gccacgcuuucuggcgcg

SEQ ID NO: 2605972 - RNA, 22 nt, Escherichia coli CFT073
gccacggcagaaugguuucgcu

SEQ ID NO: 2605973 - RNA, 14 nt, Escherichia coli CFT073
gccacggcuccagc

SEQ ID NO: 2605974 - RNA, 15 nt, Escherichia coli CFT073
gccacgggccgaaug

SEQ ID NO: 2605975 - RNA, 21 nt, Escherichia coli CFT073
gccacgguaugacccagcgcg

SEQ ID NO: 2605976 - RNA, 23 nt, Escherichia coli CFT073
gccacggugguuccacucugccc

SEQ ID NO: 2605977 - RNA, 18 nt, Escherichia coli CFT073
gccacgucguuccccauc

SEQ ID NO: 2605978 - RNA, 20 nt, Escherichia coli CFT073
gccacgucguuccccaucac

SEQ ID NO: 2605979 - RNA, 19 nt, Escherichia coli CFT073
gccacguucaaucugguga

SEQ ID NO: 2605980 - RNA, 14 nt, Escherichia coli CFT073
gccacuaagcaggg

SEQ ID NO: 2605981 - RNA, 16 nt, Escherichia coli CFT073
gccacucacugaugcc

SEQ ID NO: 2605982 - RNA, 19 nt, Escherichia coli CFT073
gccacucagcccauaccgu

SEQ ID NO: 2605983 - RNA, 21 nt, Escherichia coli CFT073
gccacucaggcaaagcuguuu

SEQ ID NO: 2605984 - RNA, 20 nt, Escherichia coli CFT073
gccacucugcgcauguaaug

SEQ ID NO: 2605985 - RNA, 23 nt, Escherichia coli CFT073
gccacugccagcaaaaaauagaa

SEQ ID NO: 2605986 - RNA, 20 nt, Escherichia coli CFT073
gccacugcgacaccagcaug

SEQ ID NO: 2605987 - RNA, 22 nt, Escherichia coli CFT073
gccacugcgccacgggcuaaac

SEQ ID NO: 2605988 - RNA, 13 nt, Escherichia coli CFT073
gccacugcgccau

SEQ ID NO: 2605989 - RNA, 16 nt, Escherichia coli CFT073
gccacugcgccgggca

SEQ ID NO: 2605990 - RNA, 18 nt, Escherichia coli CFT073
gccacuggcuuuccugau

SEQ ID NO: 2605991 - RNA, 15 nt, Escherichia coli CFT073
gccacuucaaccagc

SEQ ID NO: 2605992 - RNA, 18 nt, Escherichia coli CFT073
gccacuucuuccagcggc

SEQ ID NO: 2605993 - RNA, 19 nt, Escherichia coli CFT073
gccacuucuuccagcggca

SEQ ID NO: 2605994 - RNA, 20 nt, Escherichia coli CFT073
gccacuucuuccagcggcag

SEQ ID NO: 2605995 - RNA, 23 nt, Escherichia coli CFT073
gccacuucuuccagcggcaggcc

SEQ ID NO: 2605996 - RNA, 19 nt, Escherichia coli CFT073
gccacuugagccgccacca

SEQ ID NO: 2605997 - RNA, 18 nt, Escherichia coli CFT073
gccacuuucacgccgcca

SEQ ID NO: 2605998 - RNA, 15 nt, Escherichia coli CFT073
gccagcaguucaauc

SEQ ID NO: 2605999 - RNA, 16 nt, Escherichia coli CFT073
gccagcaguugcugac

SEQ ID NO: 2606000 - RNA, 15 nt, Escherichia coli CFT073
gccagcauaaucacc

SEQ ID NO: 2606001 - RNA, 21 nt, Escherichia coli CFT073
gccagcauaaucaccaucagc

SEQ ID NO: 2606002 - RNA, 15 nt, Escherichia coli CFT073
gccagcauacagcuu

SEQ ID NO: 2606003 - RNA, 17 nt, Escherichia coli CFT073
gccagcaucagacccac

SEQ ID NO: 2606004 - RNA, 13 nt, Escherichia coli CFT073
gccagcaucgcau

SEQ ID NO: 2606005 - RNA, 24 nt, Escherichia coli CFT073
gccagcaucggcaacgccagcgaa

SEQ ID NO: 2606006 - RNA, 23 nt, Escherichia coli CFT073
gccagcaucucaaucgcacccgc

SEQ ID NO: 2606007 - RNA, 19 nt, Escherichia coli CFT073
gccagcaucuccauacaga

SEQ ID NO: 2606008 - RNA, 14 nt, Escherichia coli CFT073
gccagcauggcacc

SEQ ID NO: 2606009 - RNA, 23 nt, Escherichia coli CFT073
gccagcauuggcguuugaccgac

SEQ ID NO: 2606010 - RNA, 19 nt, Escherichia coli CFT073
gccagcauugucaggauca

SEQ ID NO: 2606011 - RNA, 22 nt, Escherichia coli CFT073
gccagcauugucaggaucacca

SEQ ID NO: 2606012 - RNA, 14 nt, Escherichia coli CFT073
gccagccaauugcc

SEQ ID NO: 2606013 - RNA, 17 nt, Escherichia coli CFT073
gccagccacaggccgcu

SEQ ID NO: 2606014 - RNA, 16 nt, Escherichia coli CFT073
gccagccacaggccgg

SEQ ID NO: 2606015 - RNA, 12 nt, Escherichia coli CFT073
gccagccagcca

SEQ ID NO: 2606016 - RNA, 14 nt, Escherichia coli CFT073
gccagccaucgccu

SEQ ID NO: 2606017 - RNA, 14 nt, Escherichia coli CFT073
gccagccaugagac

SEQ ID NO: 2606018 - RNA, 14 nt, Escherichia coli CFT073
gccagccaugcggc

SEQ ID NO: 2606019 - RNA, 16 nt, Escherichia coli CFT073
gccagccauucaaucu

SEQ ID NO: 2606020 - RNA, 14 nt, Escherichia coli CFT073
gccagccccacagc

SEQ ID NO: 2606021 - RNA, 18 nt, Escherichia coli CFT073
gccagccccauaauauaa

SEQ ID NO: 2606022 - RNA, 14 nt, Escherichia coli CFT073
gccagccccucagc

SEQ ID NO: 2606023 - RNA, 21 nt, Escherichia coli CFT073
gccagccgauccggauggauc

SEQ ID NO: 2606024 - RNA, 14 nt, Escherichia coli CFT073
gccagccgccgcuc

SEQ ID NO: 2606025 - RNA, 15 nt, Escherichia coli CFT073
gccagccggguaauc

SEQ ID NO: 2606026 - RNA, 15 nt, Escherichia coli CFT073
gccagccucauccau

SEQ ID NO: 2606027 - RNA, 17 nt, Escherichia coli CFT073
gccagccucauccaugc

SEQ ID NO: 2606028 - RNA, 17 nt, Escherichia coli CFT073
gccagcgauaucgcgau

SEQ ID NO: 2606029 - RNA, 20 nt, Escherichia coli CFT073
gccagcgauccggguaauaa

SEQ ID NO: 2606030 - RNA, 14 nt, Escherichia coli CFT073
gccagcgauuuguc

SEQ ID NO: 2606031 - RNA, 18 nt, Escherichia coli CFT073
gccagcgcaccagcguca

SEQ ID NO: 2606032 - RNA, 23 nt, Escherichia coli CFT073
gccagcgcaccuucauucaggcc

SEQ ID NO: 2606033 - RNA, 14 nt, Escherichia coli CFT073
gccagcgcaucaug

SEQ ID NO: 2606034 - RNA, 16 nt, Escherichia coli CFT073
gccagcgccaaagcca

SEQ ID NO: 2606035 - RNA, 16 nt, Escherichia coli CFT073
gccagcgccaccacca

SEQ ID NO: 2606036 - RNA, 14 nt, Escherichia coli CFT073
gccagcgccagcac

SEQ ID NO: 2606037 - RNA, 15 nt, Escherichia coli CFT073
gccagcgccagcacu

SEQ ID NO: 2606038 - RNA, 21 nt, Escherichia coli CFT073
gccagcgccaucgguagcacc

SEQ ID NO: 2606039 - RNA, 19 nt, Escherichia coli CFT073
gccagcgcccguaaaccaa

SEQ ID NO: 2606040 - RNA, 20 nt, Escherichia coli CFT073
gccagcgcccguaaaccaag

SEQ ID NO: 2606041 - RNA, 22 nt, Escherichia coli CFT073
gccagcgcccguaaaccaagcu

SEQ ID NO: 2606042 - RNA, 15 nt, Escherichia coli CFT073
gccagcgccgacagu

SEQ ID NO: 2606043 - RNA, 14 nt, Escherichia coli CFT073
gccagcgccgcgcg

SEQ ID NO: 2606044 - RNA, 16 nt, Escherichia coli CFT073
gccagcgcgauacagg

SEQ ID NO: 2606045 - RNA, 18 nt, Escherichia coli CFT073
gccagcgcgauacaggcc

SEQ ID NO: 2606046 - RNA, 21 nt, Escherichia coli CFT073
gccagcgcgccugaaugccac

SEQ ID NO: 2606047 - RNA, 18 nt, Escherichia coli CFT073
gccagcgcgcggcuggca

SEQ ID NO: 2606048 - RNA, 22 nt, Escherichia coli CFT073
gccagcgcggcggcaaucauca

SEQ ID NO: 2606049 - RNA, 17 nt, Escherichia coli CFT073
gccagcgcugcccacca

SEQ ID NO: 2606050 - RNA, 20 nt, Escherichia coli CFT073
gccagcgcuguuagcgugca

SEQ ID NO: 2606051 - RNA, 21 nt, Escherichia coli CFT073
gccagcgcuguuagcgugcag

SEQ ID NO: 2606052 - RNA, 20 nt, Escherichia coli CFT073
gccagcgcuuugauggcacu

SEQ ID NO: 2606053 - RNA, 18 nt, Escherichia coli CFT073
gccagcggcaccgaggau

SEQ ID NO: 2606054 - RNA, 21 nt, Escherichia coli CFT073
gccagcggcaccgaggaugaa

SEQ ID NO: 2606055 - RNA, 17 nt, Escherichia coli CFT073
gccagcggcagcucgcg

SEQ ID NO: 2606056 - RNA, 19 nt, Escherichia coli CFT073
gccagcggcguucgaguaa

SEQ ID NO: 2606057 - RNA, 21 nt, Escherichia coli CFT073
gccagcggcguucgaguaaug

SEQ ID NO: 2606058 - RNA, 22 nt, Escherichia coli CFT073
gccagcggcuuuuuacgcgaca

SEQ ID NO: 2606059 - RNA, 19 nt, Escherichia coli CFT073
gccagcgguagcucgaccu

SEQ ID NO: 2606060 - RNA, 14 nt, Escherichia coli CFT073
gccagcggucauaa

SEQ ID NO: 2606061 - RNA, 19 nt, Escherichia coli CFT073
gccagcggugaaaacggca

SEQ ID NO: 2606062 - RNA, 21 nt, Escherichia coli CFT073
gccagcguaccuugcggcggu

SEQ ID NO: 2606063 - RNA, 17 nt, Escherichia coli CFT073
gccagcgucgcauccga

SEQ ID NO: 2606064 - RNA, 20 nt, Escherichia coli CFT073
gccagcgucgcauccgacau

SEQ ID NO: 2606065 - RNA, 19 nt, Escherichia coli CFT073
gccagcgucugagcaggcg

SEQ ID NO: 2606066 - RNA, 20 nt, Escherichia coli CFT073
gccagcgucugagcaggcgg

SEQ ID NO: 2606067 - RNA, 13 nt, Escherichia coli CFT073
gccagcguggcga

SEQ ID NO: 2606068 - RNA, 14 nt, Escherichia coli CFT073
gccagcuccagcgc

SEQ ID NO: 2606069 - RNA, 17 nt, Escherichia coli CFT073
gccagcuucgaggccgg

SEQ ID NO: 2606070 - RNA, 22 nt, Escherichia coli CFT073
gccagcuucgcuucccaacgca

SEQ ID NO: 2606071 - RNA, 23 nt, Escherichia coli CFT073
gccagcuucgcuucccaacgcag

SEQ ID NO: 2606072 - RNA, 14 nt, Escherichia coli CFT073
gccagcuugcagcc

SEQ ID NO: 2606073 - RNA, 15 nt, Escherichia coli CFT073
gccagcuugcagccg

SEQ ID NO: 2606074 - RNA, 19 nt, Escherichia coli CFT073
gccagcuugcagccgucgc

SEQ ID NO: 2606075 - RNA, 19 nt, Escherichia coli CFT073
gccagcuugcgauccugca

SEQ ID NO: 2606076 - RNA, 21 nt, Escherichia coli CFT073
gccagcuugcgauccugcaga

SEQ ID NO: 2606077 - RNA, 15 nt, Escherichia coli CFT073
gccagcuugcuuucc

SEQ ID NO: 2606078 - RNA, 17 nt, Escherichia coli CFT073
gccagcuuucaccugcg

SEQ ID NO: 2606079 - RNA, 18 nt, Escherichia coli CFT073
gccaggaacaacgacagg

SEQ ID NO: 2606080 - RNA, 18 nt, Escherichia coli CFT073
gccaggaaccugugacag

SEQ ID NO: 2606081 - RNA, 21 nt, Escherichia coli CFT073
gccaggaacgggauugccagc

SEQ ID NO: 2606082 - RNA, 14 nt, Escherichia coli CFT073
gccaggacaucagc

SEQ ID NO: 2606083 - RNA, 16 nt, Escherichia coli CFT073
gccaggacaucagcgc

SEQ ID NO: 2606084 - RNA, 17 nt, Escherichia coli CFT073
gccaggacaucagcgca

SEQ ID NO: 2606085 - RNA, 22 nt, Escherichia coli CFT073
gccaggagccaacacuuucacu

SEQ ID NO: 2606086 - RNA, 20 nt, Escherichia coli CFT073
gccaggcaaauucuguuuca

SEQ ID NO: 2606087 - RNA, 16 nt, Escherichia coli CFT073
gccaggcaccaaaaau

SEQ ID NO: 2606088 - RNA, 19 nt, Escherichia coli CFT073
gccaggcaccgcgugcgac

SEQ ID NO: 2606089 - RNA, 19 nt, Escherichia coli CFT073
gccaggcagagcucaacca

SEQ ID NO: 2606090 - RNA, 11 nt, Escherichia coli CFT073
gccaggcagcg

SEQ ID NO: 2606091 - RNA, 22 nt, Escherichia coli CFT073
gccaggccuaacaccaucagug

SEQ ID NO: 2606092 - RNA, 18 nt, Escherichia coli CFT073
gccaggcgcugcuggagc

SEQ ID NO: 2606093 - RNA, 13 nt, Escherichia coli CFT073
gccaggcuggcag

SEQ ID NO: 2606094 - RNA, 21 nt, Escherichia coli CFT073
gccaggcuguucggaugaguc

SEQ ID NO: 2606095 - RNA, 21 nt, Escherichia coli CFT073
gccaggcuuuccgucagcggc

SEQ ID NO: 2606096 - RNA, 17 nt, Escherichia coli CFT073
gccagggugcaggcgcu

SEQ ID NO: 2606097 - RNA, 22 nt, Escherichia coli CFT073
gccagguaaaucagaccgauag

SEQ ID NO: 2606098 - RNA, 16 nt, Escherichia coli CFT073
gccagguacucaugcc

SEQ ID NO: 2606099 - RNA, 14 nt, Escherichia coli CFT073
gccagguagcguuu

SEQ ID NO: 2606100 - RNA, 15 nt, Escherichia coli CFT073
gccagguagcguuuc

SEQ ID NO: 2606101 - RNA, 16 nt, Escherichia coli CFT073
gccaggucagagagcc

SEQ ID NO: 2606102 - RNA, 21 nt, Escherichia coli CFT073
gccaggucgcuugccgccagu

SEQ ID NO: 2606103 - RNA, 14 nt, Escherichia coli CFT073
gccaggugcagccc

SEQ ID NO: 2606104 - RNA, 16 nt, Escherichia coli CFT073
gccagguuaaccagca

SEQ ID NO: 2606105 - RNA, 17 nt, Escherichia coli CFT073
gccagguuuaccagcag

SEQ ID NO: 2606106 - RNA, 16 nt, Escherichia coli CFT073
gccaucgccacaccag

SEQ ID NO: 2606107 - RNA, 12 nt, Escherichia coli CFT073
gccaucgccagc

SEQ ID NO: 2606108 - RNA, 15 nt, Escherichia coli CFT073
gccaucgccaggaac

SEQ ID NO: 2606109 - RNA, 22 nt, Escherichia coli CFT073
gccaucgcugacgaucauuccg

SEQ ID NO: 2606110 - RNA, 16 nt, Escherichia coli CFT073
gccaucgguagcacca

SEQ ID NO: 2606111 - RNA, 19 nt, Escherichia coli CFT073
gccaucgugcuucacuuca

SEQ ID NO: 2606112 - RNA, 22 nt, Escherichia coli CFT073
gccaucguugagcaucugcaaa

SEQ ID NO: 2606113 - RNA, 16 nt, Escherichia coli CFT073
gccaucuccaucaucu

SEQ ID NO: 2606114 - RNA, 23 nt, Escherichia coli CFT073
gccaucucugcaacgucuucccg

SEQ ID NO: 2606115 - RNA, 18 nt, Escherichia coli CFT073
gccaucugaacucacaca

SEQ ID NO: 2606116 - RNA, 22 nt, Escherichia coli CFT073
gccaucugaugauauuuuuccc

SEQ ID NO: 2606117 - RNA, 16 nt, Escherichia coli CFT073
gccaucugccagcaag

SEQ ID NO: 2606118 - RNA, 21 nt, Escherichia coli CFT073
gccaucugccagcaagcgcac

SEQ ID NO: 2606119 - RNA, 13 nt, Escherichia coli CFT073
gccaucuggcugc

SEQ ID NO: 2606120 - RNA, 17 nt, Escherichia coli CFT073
gccaucuguuccggcgu

SEQ ID NO: 2606121 - RNA, 16 nt, Escherichia coli CFT073
gccaugaaaaaguuac

SEQ ID NO: 2606122 - RNA, 14 nt, Escherichia coli CFT073
gccaugaacgcgaa

SEQ ID NO: 2606123 - RNA, 15 nt, Escherichia coli CFT073
gccaugaccaccgca

SEQ ID NO: 2606124 - RNA, 18 nt, Escherichia coli CFT073
gccaugaccgcuccgcca

SEQ ID NO: 2606125 - RNA, 15 nt, Escherichia coli CFT073
gccaugaccuaaggu

SEQ ID NO: 2606126 - RNA, 14 nt, Escherichia coli CFT073
gccaugacgcacuu

SEQ ID NO: 2606127 - RNA, 22 nt, Escherichia coli CFT073
gccaugaguaauuuuucuuucg

SEQ ID NO: 2606128 - RNA, 23 nt, Escherichia coli CFT073
gccaugauuaccagcaucaccga

SEQ ID NO: 2606129 - RNA, 20 nt, Escherichia coli CFT073
gccaugcacccgcaaaugau

SEQ ID NO: 2606130 - RNA, 21 nt, Escherichia coli CFT073
gccaugcacgcaaaaacgcau

SEQ ID NO: 2606131 - RNA, 12 nt, Escherichia coli CFT073
gccaugcauauc

SEQ ID NO: 2606132 - RNA, 23 nt, Escherichia coli CFT073
gccaugccgccaccaccagcgca

SEQ ID NO: 2606133 - RNA, 15 nt, Escherichia coli CFT073
gccaugcgaaugcca

SEQ ID NO: 2606134 - RNA, 22 nt, Escherichia coli CFT073
gccaugcgcuccgguuuacuca

SEQ ID NO: 2606135 - RNA, 22 nt, Escherichia coli CFT073
gccaugcgguaaguuuucgccg

SEQ ID NO: 2606136 - RNA, 20 nt, Escherichia coli CFT073
gccaugcugagcuucuucaa

SEQ ID NO: 2606137 - RNA, 16 nt, Escherichia coli CFT073
gccaugcuguagugaa

SEQ ID NO: 2606138 - RNA, 16 nt, Escherichia coli CFT073
gccauggcauccaagc

SEQ ID NO: 2606139 - RNA, 21 nt, Escherichia coli CFT073
gccauggcauccaagcuggug

SEQ ID NO: 2606140 - RNA, 22 nt, Escherichia coli CFT073
gccauggcauuaaauucagcaa

SEQ ID NO: 2606141 - RNA, 17 nt, Escherichia coli CFT073
gccauguuuggcaaaag

SEQ ID NO: 2606142 - RNA, 16 nt, Escherichia coli CFT073
gccauguuuuccuuuu

SEQ ID NO: 2606143 - RNA, 19 nt, Escherichia coli CFT073
gccauuaaacgcaguaaac

SEQ ID NO: 2606144 - RNA, 17 nt, Escherichia coli CFT073
gccauuaaaucagccuu

SEQ ID NO: 2606145 - RNA, 20 nt, Escherichia coli CFT073
gccauuaaaucagccuuaau

SEQ ID NO: 2606146 - RNA, 16 nt, Escherichia coli CFT073
gccauuaacaguccga

SEQ ID NO: 2606147 - RNA, 15 nt, Escherichia coli CFT073
gccauuaacaucccu

SEQ ID NO: 2606148 - RNA, 17 nt, Escherichia coli CFT073
gccauuaacaucccuuc

SEQ ID NO: 2606149 - RNA, 15 nt, Escherichia coli CFT073
gccauuaaccagcca

SEQ ID NO: 2606150 - RNA, 18 nt, Escherichia coli CFT073
gccauuaaugccgcaacu

SEQ ID NO: 2606151 - RNA, 19 nt, Escherichia coli CFT073
gccauuaaugucggaugcg

SEQ ID NO: 2606152 - RNA, 12 nt, Escherichia coli CFT073
gccauuaccacc

SEQ ID NO: 2606153 - RNA, 14 nt, Escherichia coli CFT073
gccauuaccagguc

SEQ ID NO: 2606154 - RNA, 20 nt, Escherichia coli CFT073
gccauuacccggugccgccg

SEQ ID NO: 2606155 - RNA, 14 nt, Escherichia coli CFT073
gccauuacggguau

SEQ ID NO: 2606156 - RNA, 22 nt, Escherichia coli CFT073
gccauuagcaaauuauccccca

SEQ ID NO: 2606157 - RNA, 14 nt, Escherichia coli CFT073
gccauucacuucau

SEQ ID NO: 2606158 - RNA, 20 nt, Escherichia coli CFT073
gccauucauucaaauuaaac

SEQ ID NO: 2606159 - RNA, 22 nt, Escherichia coli CFT073
gccauuccuggggucaucagca

SEQ ID NO: 2606160 - RNA, 18 nt, Escherichia coli CFT073
gccauucuggcgcaacac

SEQ ID NO: 2606161 - RNA, 16 nt, Escherichia coli CFT073
gccauugaaaccgcug

SEQ ID NO: 2606162 - RNA, 16 nt, Escherichia coli CFT073
gccauugacgguuucc

SEQ ID NO: 2606163 - RNA, 18 nt, Escherichia coli CFT073
gccauugaguagccucug

SEQ ID NO: 2606164 - RNA, 19 nt, Escherichia coli CFT073
gccauugcccgaugcgcaa

SEQ ID NO: 2606165 - RNA, 20 nt, Escherichia coli CFT073
gccauugcuggugauugcaa

SEQ ID NO: 2606166 - RNA, 22 nt, Escherichia coli CFT073
gccauuuaacgcaucacgaaua

SEQ ID NO: 2606167 - RNA, 16 nt, Escherichia coli CFT073
gccauuucgcugguac

SEQ ID NO: 2606168 - RNA, 19 nt, Escherichia coli CFT073
gccauuucuggcuucucuu

SEQ ID NO: 2606169 - RNA, 20 nt, Escherichia coli CFT073
gccauuugcgacaaagcuca

SEQ ID NO: 2606170 - RNA, 12 nt, Escherichia coli CFT073
gccauuugcucu

SEQ ID NO: 2606171 - RNA, 16 nt, Escherichia coli CFT073
gccauuugggcggcuu

SEQ ID NO: 2606172 - RNA, 19 nt, Escherichia coli CFT073
gccauuuuacucauggaau

SEQ ID NO: 2606173 - RNA, 11 nt, Escherichia coli CFT073
gccauuuucac

SEQ ID NO: 2606174 - RNA, 13 nt, Escherichia coli CFT073
gccauuuucauuu

SEQ ID NO: 2606175 - RNA, 18 nt, Escherichia coli CFT073
gccauuuugcacauucca

SEQ ID NO: 2606176 - RNA, 21 nt, Escherichia coli CFT073
gccauuuugcaccuucagaau

SEQ ID NO: 2606177 - RNA, 16 nt, Escherichia coli CFT073
gccauuuugcgcggca

SEQ ID NO: 2606178 - RNA, 18 nt, Escherichia coli CFT073
gccauuuuuuuacccagc

SEQ ID NO: 2606179 - RNA, 19 nt, Escherichia coli CFT073
gccauuuuuuuacccagcg

SEQ ID NO: 2606180 - RNA, 18 nt, Escherichia coli CFT073
gcccaaaaauugccccca

SEQ ID NO: 2606181 - RNA, 16 nt, Escherichia coli CFT073
gcccaaaauaucacgc

SEQ ID NO: 2606182 - RNA, 15 nt, Escherichia coli CFT073
gcccaaacgcccaga

SEQ ID NO: 2606183 - RNA, 18 nt, Escherichia coli CFT073
gcccaacaguagacaauu

SEQ ID NO: 2606184 - RNA, 12 nt, Escherichia coli CFT073
gcccaaccagca

SEQ ID NO: 2606185 - RNA, 14 nt, Escherichia coli CFT073
gcccaaccagcagg

SEQ ID NO: 2606186 - RNA, 23 nt, Escherichia coli CFT073
gcccaaggcuaguacaggcggca

SEQ ID NO: 2606187 - RNA, 16 nt, Escherichia coli CFT073
gcccacaccagucagc

SEQ ID NO: 2606188 - RNA, 20 nt, Escherichia coli CFT073
gcccacaccagucagcgaac

SEQ ID NO: 2606189 - RNA, 16 nt, Escherichia coli CFT073
gcccaccaaagaacuu

SEQ ID NO: 2606190 - RNA, 18 nt, Escherichia coli CFT073
gcccaccacaaaccagcc

SEQ ID NO: 2606191 - RNA, 13 nt, Escherichia coli CFT073
gcccaccagccgc

SEQ ID NO: 2606192 - RNA, 16 nt, Escherichia coli CFT073
gcccaccgcauccagu

SEQ ID NO: 2606193 - RNA, 17 nt, Escherichia coli CFT073
gcccacgcaccaccagc

SEQ ID NO: 2606194 - RNA, 23 nt, Escherichia coli CFT073
gcccacgcaccaccagcgccugg

SEQ ID NO: 2606195 - RNA, 15 nt, Escherichia coli CFT073
gcccacgcuacucgc

SEQ ID NO: 2606196 - RNA, 16 nt, Escherichia coli CFT073
gcccacgguaaaauac

SEQ ID NO: 2606197 - RNA, 15 nt, Escherichia coli CFT073
gcccacuacgcccgc

SEQ ID NO: 2606198 - RNA, 22 nt, Escherichia coli CFT073
gcccacuacgcccgcaaucaac

SEQ ID NO: 2606199 - RNA, 20 nt, Escherichia coli CFT073
gcccacuguuugaucugcug

SEQ ID NO: 2606200 - RNA, 14 nt, Escherichia coli CFT073
gcccacuuucugcg

SEQ ID NO: 2606201 - RNA, 17 nt, Escherichia coli CFT073
gcccacuuucugcgcaa

SEQ ID NO: 2606202 - RNA, 18 nt, Escherichia coli CFT073
gcccagaccgugcgcagc

SEQ ID NO: 2606203 - RNA, 19 nt, Escherichia coli CFT073
gcccagauacggcggacgu

SEQ ID NO: 2606204 - RNA, 14 nt, Escherichia coli CFT073
gcccagaucagacc

SEQ ID NO: 2606205 - RNA, 12 nt, Escherichia coli CFT073
gcccagccugaa

SEQ ID NO: 2606206 - RNA, 20 nt, Escherichia coli CFT073
gcccagccugaaugccgcgc

SEQ ID NO: 2606207 - RNA, 22 nt, Escherichia coli CFT073
gcccagccugaaugccgcgccc

SEQ ID NO: 2606208 - RNA, 13 nt, Escherichia coli CFT073
gcccagcgcagga

SEQ ID NO: 2606209 - RNA, 17 nt, Escherichia coli CFT073
gcccagcgcaggaaaga

SEQ ID NO: 2606210 - RNA, 18 nt, Escherichia coli CFT073
gcccagcgccuggcagca

SEQ ID NO: 2606211 - RNA, 18 nt, Escherichia coli CFT073
gcccagcgcggcagcggc

SEQ ID NO: 2606212 - RNA, 22 nt, Escherichia coli CFT073
gcccagcguuccggcguccacc

SEQ ID NO: 2606213 - RNA, 17 nt, Escherichia coli CFT073
gcccaggaagcccgccc

SEQ ID NO: 2606214 - RNA, 13 nt, Escherichia coli CFT073
gcccgcagcgucc

SEQ ID NO: 2606215 - RNA, 16 nt, Escherichia coli CFT073
gcccgcagcguccagc

SEQ ID NO: 2606216 - RNA, 16 nt, Escherichia coli CFT073
gcccgcauagcccagc

SEQ ID NO: 2606217 - RNA, 19 nt, Escherichia coli CFT073
gcccgccagcaugccgcca

SEQ ID NO: 2606218 - RNA, 13 nt, Escherichia coli CFT073
gcccgccagugca

SEQ ID NO: 2606219 - RNA, 11 nt, Escherichia coli CFT073
gcccgccgcca

SEQ ID NO: 2606220 - RNA, 14 nt, Escherichia coli CFT073
gcccgccgcugguc

SEQ ID NO: 2606221 - RNA, 16 nt, Escherichia coli CFT073
gcccgcgaagcuggug

SEQ ID NO: 2606222 - RNA, 23 nt, Escherichia coli CFT073
gcccgcgauaaaaauccuguucc

SEQ ID NO: 2606223 - RNA, 16 nt, Escherichia coli CFT073
gcccgcgucgcaucag

SEQ ID NO: 2606224 - RNA, 14 nt, Escherichia coli CFT073
gcccgcuccagcua

SEQ ID NO: 2606225 - RNA, 14 nt, Escherichia coli CFT073
gcccggaacggugg

SEQ ID NO: 2606226 - RNA, 19 nt, Escherichia coli CFT073
gcccggagccaucccugca

SEQ ID NO: 2606227 - RNA, 24 nt, Escherichia coli CFT073
gcccggaucucuccgggcaugaac

SEQ ID NO: 2606228 - RNA, 15 nt, Escherichia coli CFT073
gcccggcaacaacag

SEQ ID NO: 2606229 - RNA, 19 nt, Escherichia coli CFT073
gcccggcaagugucgccug

SEQ ID NO: 2606230 - RNA, 20 nt, Escherichia coli CFT073
gcccggcaagugucgccugc

SEQ ID NO: 2606231 - RNA, 16 nt, Escherichia coli CFT073
gcccggcaccagcacc

SEQ ID NO: 2606232 - RNA, 18 nt, Escherichia coli CFT073
gcccggcaccagcaccgu

SEQ ID NO: 2606233 - RNA, 14 nt, Escherichia coli CFT073
gcccggcagcuuua

SEQ ID NO: 2606234 - RNA, 17 nt, Escherichia coli CFT073
gcccggcauucaccucu

SEQ ID NO: 2606235 - RNA, 22 nt, Escherichia coli CFT073
gcccggcauucaccucugcggc

SEQ ID NO: 2606236 - RNA, 15 nt, Escherichia coli CFT073
gcccggcguggugca

SEQ ID NO: 2606237 - RNA, 22 nt, Escherichia coli CFT073
gcccggcguggugcagccgcca

SEQ ID NO: 2606238 - RNA, 15 nt, Escherichia coli CFT073
gcccgggucagcgcc

SEQ ID NO: 2606239 - RNA, 20 nt, Escherichia coli CFT073
gcccggguuugccgcuggca

SEQ ID NO: 2606240 - RNA, 18 nt, Escherichia coli CFT073
gcccgguaaucgguuuua

SEQ ID NO: 2606241 - RNA, 18 nt, Escherichia coli CFT073
gcccggucgggugcucau

SEQ ID NO: 2606242 - RNA, 15 nt, Escherichia coli CFT073
gcccgguuauuuuua

SEQ ID NO: 2606243 - RNA, 14 nt, Escherichia coli CFT073
gcccgguuucgccg

SEQ ID NO: 2606244 - RNA, 23 nt, Escherichia coli CFT073
gcccgguuucgccgcggcgcagc

SEQ ID NO: 2606245 - RNA, 11 nt, Escherichia coli CFT073
gcccgguuuuu

SEQ ID NO: 2606246 - RNA, 18 nt, Escherichia coli CFT073
gcccguaaaccugcaauu

SEQ ID NO: 2606247 - RNA, 14 nt, Escherichia coli CFT073
gcccguaaacgggc

SEQ ID NO: 2606248 - RNA, 13 nt, Escherichia coli CFT073
gcccgucaguuca

SEQ ID NO: 2606249 - RNA, 22 nt, Escherichia coli CFT073
gcccguccccugagcauacauu

SEQ ID NO: 2606250 - RNA, 14 nt, Escherichia coli CFT073
gcccgugaugcaac

SEQ ID NO: 2606251 - RNA, 19 nt, Escherichia coli CFT073
gcccguuaagcguucugca

SEQ ID NO: 2606252 - RNA, 13 nt, Escherichia coli CFT073
gcccguucuuccu

SEQ ID NO: 2606253 - RNA, 15 nt, Escherichia coli CFT073
gcccguucuuccuca

SEQ ID NO: 2606254 - RNA, 22 nt, Escherichia coli CFT073
gcccguucuucgccauaacaaa

SEQ ID NO: 2606255 - RNA, 19 nt, Escherichia coli CFT073
gcccguuuucuccagcgcc

SEQ ID NO: 2606256 - RNA, 23 nt, Escherichia coli CFT073
gcccguuuuuuuaucccuucucc

SEQ ID NO: 2606257 - RNA, 21 nt, Escherichia coli CFT073
gcccuaaaaacaguaccagac

SEQ ID NO: 2606258 - RNA, 21 nt, Escherichia coli CFT073
gcccuaacaggcgcacacgau

SEQ ID NO: 2606259 - RNA, 17 nt, Escherichia coli CFT073
gcccucgccuuuuugcg

SEQ ID NO: 2606260 - RNA, 17 nt, Escherichia coli CFT073
gcccucuaaaauaacga

SEQ ID NO: 2606261 - RNA, 14 nt, Escherichia coli CFT073
gcccucugaauaac

SEQ ID NO: 2606262 - RNA, 14 nt, Escherichia coli CFT073
gcccucuuucacca

SEQ ID NO: 2606263 - RNA, 15 nt, Escherichia coli CFT073
gcccucuuucaccag

SEQ ID NO: 2606264 - RNA, 19 nt, Escherichia coli CFT073
gcccucuuuuuuaccgaua

SEQ ID NO: 2606265 - RNA, 15 nt, Escherichia coli CFT073
gcccugaaccaucga

SEQ ID NO: 2606266 - RNA, 19 nt, Escherichia coli CFT073
gcccugaauuucaauaauu

SEQ ID NO: 2606267 - RNA, 22 nt, Escherichia coli CFT073
gcccugaucacccacaccaccg

SEQ ID NO: 2606268 - RNA, 20 nt, Escherichia coli CFT073
gcccugaugcgugcgccaga

SEQ ID NO: 2606269 - RNA, 15 nt, Escherichia coli CFT073
gcccugcaacaucac

SEQ ID NO: 2606270 - RNA, 16 nt, Escherichia coli CFT073
gcccugcaacugcugc

SEQ ID NO: 2606271 - RNA, 16 nt, Escherichia coli CFT073
gcccugcaucaugcgc

SEQ ID NO: 2606272 - RNA, 13 nt, Escherichia coli CFT073
gcccugccagcga

SEQ ID NO: 2606273 - RNA, 10 nt, Escherichia coli CFT073
gcccugccuu

SEQ ID NO: 2606274 - RNA, 14 nt, Escherichia coli CFT073
gcccugcgucgcac

SEQ ID NO: 2606275 - RNA, 22 nt, Escherichia coli CFT073
gcccugggcuucauccagcagc

SEQ ID NO: 2606276 - RNA, 19 nt, Escherichia coli CFT073
gcccugucaccgggcaaac

SEQ ID NO: 2606277 - RNA, 17 nt, Escherichia coli CFT073
gcccugucgaggccaau

SEQ ID NO: 2606278 - RNA, 19 nt, Escherichia coli CFT073
gcccuguuaccgggcuaca

SEQ ID NO: 2606279 - RNA, 13 nt, Escherichia coli CFT073
gcccuguucugca

SEQ ID NO: 2606280 - RNA, 18 nt, Escherichia coli CFT073
gcccuuaccauucccaga

SEQ ID NO: 2606281 - RNA, 14 nt, Escherichia coli CFT073
gcccuucacuucac

SEQ ID NO: 2606282 - RNA, 13 nt, Escherichia coli CFT073
gcccuucaugcac

SEQ ID NO: 2606283 - RNA, 19 nt, Escherichia coli CFT073
gcccuucccggugcgcaga

SEQ ID NO: 2606284 - RNA, 15 nt, Escherichia coli CFT073
gcccuugugcugcgc

SEQ ID NO: 2606285 - RNA, 17 nt, Escherichia coli CFT073
gcccuuucgacgcgugc

SEQ ID NO: 2606286 - RNA, 22 nt, Escherichia coli CFT073
gcccuuucugcauccguucuuc

SEQ ID NO: 2606287 - RNA, 17 nt, Escherichia coli CFT073
gcccuuugcuggcauga

SEQ ID NO: 2606288 - RNA, 22 nt, Escherichia coli CFT073
gcccuuuguaggccagauaaga

SEQ ID NO: 2606289 - RNA, 18 nt, Escherichia coli CFT073
gcccuuuuuucuuacggu

SEQ ID NO: 2606290 - RNA, 13 nt, Escherichia coli CFT073
gccgaacagucgc

SEQ ID NO: 2606291 - RNA, 17 nt, Escherichia coli CFT073
gccgaacagucgcugau

SEQ ID NO: 2606292 - RNA, 21 nt, Escherichia coli CFT073
gccgaacagugccagacaaac

SEQ ID NO: 2606293 - RNA, 18 nt, Escherichia coli CFT073
gccgaaccagugcuccac

SEQ ID NO: 2606294 - RNA, 14 nt, Escherichia coli CFT073
gccgaaccauguca

SEQ ID NO: 2606295 - RNA, 13 nt, Escherichia coli CFT073
gccgaagaguuuu

SEQ ID NO: 2606296 - RNA, 21 nt, Escherichia coli CFT073
gccgaagaguuuuaaacgcag

SEQ ID NO: 2606297 - RNA, 23 nt, Escherichia coli CFT073
gccgaagccguuggucaucauca

SEQ ID NO: 2606298 - RNA, 16 nt, Escherichia coli CFT073
gccgaagcgagcuuuu

SEQ ID NO: 2606299 - RNA, 16 nt, Escherichia coli CFT073
gccgaagugguuccac

SEQ ID NO: 2606300 - RNA, 13 nt, Escherichia coli CFT073
gccgaauaacgcg

SEQ ID NO: 2606301 - RNA, 17 nt, Escherichia coli CFT073
gccgaauaacgcgcagc

SEQ ID NO: 2606302 - RNA, 19 nt, Escherichia coli CFT073
gccgaauaacgcgcagcgu

SEQ ID NO: 2606303 - RNA, 23 nt, Escherichia coli CFT073
gccgacaaaaucaguccacggcu

SEQ ID NO: 2606304 - RNA, 15 nt, Escherichia coli CFT073
gccgacaaacagcgu

SEQ ID NO: 2606305 - RNA, 16 nt, Escherichia coli CFT073
gccgacaaauaccacc

SEQ ID NO: 2606306 - RNA, 23 nt, Escherichia coli CFT073
gccgacaaauaccaccgugccgc

SEQ ID NO: 2606307 - RNA, 14 nt, Escherichia coli CFT073
gccgacaauaaacg

SEQ ID NO: 2606308 - RNA, 16 nt, Escherichia coli CFT073
gccgacaauaaacgcg

SEQ ID NO: 2606309 - RNA, 15 nt, Escherichia coli CFT073
gccgacagguggugu

SEQ ID NO: 2606310 - RNA, 12 nt, Escherichia coli CFT073
gccgacaguagc

SEQ ID NO: 2606311 - RNA, 11 nt, Escherichia coli CFT073
gccgacauagg

SEQ ID NO: 2606312 - RNA, 18 nt, Escherichia coli CFT073
gccgacaucaaacaggcu

SEQ ID NO: 2606313 - RNA, 20 nt, Escherichia coli CFT073
gccgacauuaucaccgacaa

SEQ ID NO: 2606314 - RNA, 17 nt, Escherichia coli CFT073
gccgaccaacgcagaaa

SEQ ID NO: 2606315 - RNA, 21 nt, Escherichia coli CFT073
gccgaccgcaaggaagccuga

SEQ ID NO: 2606316 - RNA, 24 nt, Escherichia coli CFT073
gccgacgauauuccgacggcgagc

SEQ ID NO: 2606317 - RNA, 17 nt, Escherichia coli CFT073
gccgacgccagcguuca

SEQ ID NO: 2606318 - RNA, 21 nt, Escherichia coli CFT073
gccgacgcgaagcacacauac

SEQ ID NO: 2606319 - RNA, 23 nt, Escherichia coli CFT073
gccgacgcuccugaucaagcugg

SEQ ID NO: 2606320 - RNA, 21 nt, Escherichia coli CFT073
gccgacguugcguugccgcca

SEQ ID NO: 2606321 - RNA, 19 nt, Escherichia coli CFT073
gccgagaaauaucagcagc

SEQ ID NO: 2606322 - RNA, 19 nt, Escherichia coli CFT073
gccgcuaaauaccagcgua

SEQ ID NO: 2606323 - RNA, 21 nt, Escherichia coli CFT073
gccgcuaacagcagcagcgca

SEQ ID NO: 2606324 - RNA, 22 nt, Escherichia coli CFT073
gccgcuaacgucugguaaagca

SEQ ID NO: 2606325 - RNA, 23 nt, Escherichia coli CFT073
gccgcuacucugacccagaagac

SEQ ID NO: 2606326 - RNA, 20 nt, Escherichia coli CFT073
gccgcuaguucucgggcggc

SEQ ID NO: 2606327 - RNA, 16 nt, Escherichia coli CFT073
gccgcuaucaggccac

SEQ ID NO: 2606328 - RNA, 18 nt, Escherichia coli CFT073
gccgcuaucaggccaccu

SEQ ID NO: 2606329 - RNA, 16 nt, Escherichia coli CFT073
gccgcuaucgcugaua

SEQ ID NO: 2606330 - RNA, 19 nt, Escherichia coli CFT073
gccgcuaucgcugauauac

SEQ ID NO: 2606331 - RNA, 17 nt, Escherichia coli CFT073
gccgcucagucggcgcu

SEQ ID NO: 2606332 - RNA, 13 nt, Escherichia coli CFT073
gccgcuccaaggu

SEQ ID NO: 2606333 - RNA, 21 nt, Escherichia coli CFT073
gccgcuccaaggucuccgccc

SEQ ID NO: 2606334 - RNA, 15 nt, Escherichia coli CFT073
gccgcuccuucaccu

SEQ ID NO: 2606335 - RNA, 23 nt, Escherichia coli CFT073
gccgcucucuucguggcccgcca

SEQ ID NO: 2606336 - RNA, 16 nt, Escherichia coli CFT073
gccgcugcuauggcgc

SEQ ID NO: 2606337 - RNA, 19 nt, Escherichia coli CFT073
gccgcuggucacuaccugc

SEQ ID NO: 2606338 - RNA, 11 nt, Escherichia coli CFT073
gccgcugguga

SEQ ID NO: 2606339 - RNA, 15 nt, Escherichia coli CFT073
gccgcuguaauacca

SEQ ID NO: 2606340 - RNA, 21 nt, Escherichia coli CFT073
gccgcuuaaauuggcgcucuc

SEQ ID NO: 2606341 - RNA, 19 nt, Escherichia coli CFT073
gccgcuuaauaagaagaaa

SEQ ID NO: 2606342 - RNA, 13 nt, Escherichia coli CFT073
gccgcuugcgaua

SEQ ID NO: 2606343 - RNA, 17 nt, Escherichia coli CFT073
gccgcuuuaaucaccau

SEQ ID NO: 2606344 - RNA, 14 nt, Escherichia coli CFT073
gccgcuuuaucuga

SEQ ID NO: 2606345 - RNA, 16 nt, Escherichia coli CFT073
gccgcuuuuucugcac

SEQ ID NO: 2606346 - RNA, 15 nt, Escherichia coli CFT073
gccggaacauccacu

SEQ ID NO: 2606347 - RNA, 17 nt, Escherichia coli CFT073
gccggaacauccacuaa

SEQ ID NO: 2606348 - RNA, 19 nt, Escherichia coli CFT073
gccggaacgccgcuggugg

SEQ ID NO: 2606349 - RNA, 19 nt, Escherichia coli CFT073
gccggaagcgccaccagcg

SEQ ID NO: 2606350 - RNA, 15 nt, Escherichia coli CFT073
gccggaagcuacggu

SEQ ID NO: 2606351 - RNA, 12 nt, Escherichia coli CFT073
gccggaauaauc

SEQ ID NO: 2606352 - RNA, 19 nt, Escherichia coli CFT073
gccggaauaccacuuucag

SEQ ID NO: 2606353 - RNA, 22 nt, Escherichia coli CFT073
gccggaauaccacuuucagcaa

SEQ ID NO: 2606354 - RNA, 16 nt, Escherichia coli CFT073
gccggaauauucuucc

SEQ ID NO: 2606355 - RNA, 17 nt, Escherichia coli CFT073
gccggaaucaacggcaa

SEQ ID NO: 2606356 - RNA, 18 nt, Escherichia coli CFT073
gccggaauuucuuucagc

SEQ ID NO: 2606357 - RNA, 18 nt, Escherichia coli CFT073
gccggacaaggcgcucgc

SEQ ID NO: 2606358 - RNA, 19 nt, Escherichia coli CFT073
gccggacgucaggccgcca

SEQ ID NO: 2606359 - RNA, 13 nt, Escherichia coli CFT073
gccggacuccagc

SEQ ID NO: 2606360 - RNA, 14 nt, Escherichia coli CFT073
gccggacuccagca

SEQ ID NO: 2606361 - RNA, 16 nt, Escherichia coli CFT073
gccggagacgacgccc

SEQ ID NO: 2606362 - RNA, 18 nt, Escherichia coli CFT073
gccggagagcaauuuccg

SEQ ID NO: 2606363 - RNA, 21 nt, Escherichia coli CFT073
gccggagagcaauuuccggca

SEQ ID NO: 2606364 - RNA, 12 nt, Escherichia coli CFT073
gccggagcgcgc

SEQ ID NO: 2606365 - RNA, 23 nt, Escherichia coli CFT073
gccggagcgcgcgucaucggcgc

SEQ ID NO: 2606366 - RNA, 18 nt, Escherichia coli CFT073
gccggaguacgccauuuc

SEQ ID NO: 2606367 - RNA, 18 nt, Escherichia coli CFT073
gccggauaagacgcguca

SEQ ID NO: 2606368 - RNA, 19 nt, Escherichia coli CFT073
gccggauaagaugcgccag

SEQ ID NO: 2606369 - RNA, 13 nt, Escherichia coli CFT073
gccggauaagcaa

SEQ ID NO: 2606370 - RNA, 21 nt, Escherichia coli CFT073
gccggauaagccucgcuuucc

SEQ ID NO: 2606371 - RNA, 14 nt, Escherichia coli CFT073
gccggauaaggcau

SEQ ID NO: 2606372 - RNA, 13 nt, Escherichia coli CFT073
gccggauauuccu

SEQ ID NO: 2606373 - RNA, 23 nt, Escherichia coli CFT073
gccggaucagguguuacgccgca

SEQ ID NO: 2606374 - RNA, 18 nt, Escherichia coli CFT073
gccggaucgguagaccgg

SEQ ID NO: 2606375 - RNA, 23 nt, Escherichia coli CFT073
gccggaugaggcguuuucgccgc

SEQ ID NO: 2606376 - RNA, 15 nt, Escherichia coli CFT073
gccggaugaucaucc

SEQ ID NO: 2606377 - RNA, 21 nt, Escherichia coli CFT073
gccggaugaugugaaucaucc

SEQ ID NO: 2606378 - RNA, 15 nt, Escherichia coli CFT073
gccggaugcaucaca

SEQ ID NO: 2606379 - RNA, 16 nt, Escherichia coli CFT073
gccggaugccgcugcu

SEQ ID NO: 2606380 - RNA, 23 nt, Escherichia coli CFT073
gccggaugccucuccuguucuca

SEQ ID NO: 2606381 - RNA, 22 nt, Escherichia coli CFT073
gccggaugcgaaguaaccgcau

SEQ ID NO: 2606382 - RNA, 13 nt, Escherichia coli CFT073
gccggaugcgacg

SEQ ID NO: 2606383 - RNA, 18 nt, Escherichia coli CFT073
gccggaugcgaugcugac

SEQ ID NO: 2606384 - RNA, 21 nt, Escherichia coli CFT073
gccggaugcgaugcuggcgca

SEQ ID NO: 2606385 - RNA, 22 nt, Escherichia coli CFT073
gccggaugcggcguaaacgccu

SEQ ID NO: 2606386 - RNA, 18 nt, Escherichia coli CFT073
gccggaugcggcgugaua

SEQ ID NO: 2606387 - RNA, 22 nt, Escherichia coli CFT073
gccggaugcuguauguuccccu

SEQ ID NO: 2606388 - RNA, 17 nt, Escherichia coli CFT073
gccggauggcacaugac

SEQ ID NO: 2606389 - RNA, 15 nt, Escherichia coli CFT073
gccggauggcugaua

SEQ ID NO: 2606390 - RNA, 16 nt, Escherichia coli CFT073
gccggaugguaugcca

SEQ ID NO: 2606391 - RNA, 18 nt, Escherichia coli CFT073
gccggaugguaugccauc

SEQ ID NO: 2606392 - RNA, 22 nt, Escherichia coli CFT073
gccggaugguaugccauccggc

SEQ ID NO: 2606393 - RNA, 21 nt, Escherichia coli CFT073
gccggauguguugcauccggc

SEQ ID NO: 2606394 - RNA, 22 nt, Escherichia coli CFT073
gccggauucacgccaaccagcu

SEQ ID NO: 2606395 - RNA, 23 nt, Escherichia coli CFT073
gccggauucacgccaaccagcug

SEQ ID NO: 2606396 - RNA, 15 nt, Escherichia coli CFT073
gccggcgcgcaggug

SEQ ID NO: 2606397 - RNA, 21 nt, Escherichia coli CFT073
gccgggaagcucucuuccagu

SEQ ID NO: 2606398 - RNA, 14 nt, Escherichia coli CFT073
gccgggaaugccac

SEQ ID NO: 2606399 - RNA, 13 nt, Escherichia coli CFT073
gccgggagcggcg

SEQ ID NO: 2606400 - RNA, 17 nt, Escherichia coli CFT073
gccgggaguuucagcgg

SEQ ID NO: 2606401 - RNA, 21 nt, Escherichia coli CFT073
gccgggauauaugucaccagc

SEQ ID NO: 2606402 - RNA, 23 nt, Escherichia coli CFT073
gccgggauauaugucaccagcau

SEQ ID NO: 2606403 - RNA, 14 nt, Escherichia coli CFT073
gccgggaucauaac

SEQ ID NO: 2606404 - RNA, 22 nt, Escherichia coli CFT073
gccgggauguugcugcgagcug

SEQ ID NO: 2606405 - RNA, 14 nt, Escherichia coli CFT073
gccgggcugauacc

SEQ ID NO: 2606406 - RNA, 20 nt, Escherichia coli CFT073
gccggggagauauuccccag

SEQ ID NO: 2606407 - RNA, 18 nt, Escherichia coli CFT073
gccggggucaaaccuggc

SEQ ID NO: 2606408 - RNA, 15 nt, Escherichia coli CFT073
gccgggguguucccg

SEQ ID NO: 2606409 - RNA, 23 nt, Escherichia coli CFT073
gccgggugauuucaaaauuaaag

SEQ ID NO: 2606410 - RNA, 21 nt, Escherichia coli CFT073
gccgggugcgaugcauccggc

SEQ ID NO: 2606411 - RNA, 21 nt, Escherichia coli CFT073
gccgguaaucaccagcaacac

SEQ ID NO: 2606412 - RNA, 18 nt, Escherichia coli CFT073
gccggucagcaggaccuu

SEQ ID NO: 2606413 - RNA, 17 nt, Escherichia coli CFT073
gccggucaucccuaaca

SEQ ID NO: 2606414 - RNA, 20 nt, Escherichia coli CFT073
gccggucuuguuaccggcau

SEQ ID NO: 2606415 - RNA, 15 nt, Escherichia coli CFT073
gccggugauggccgc

SEQ ID NO: 2606416 - RNA, 20 nt, Escherichia coli CFT073
gccggugauggccgcgccga

SEQ ID NO: 2606417 - RNA, 19 nt, Escherichia coli CFT073
gccggugcccgccagugca

SEQ ID NO: 2606418 - RNA, 16 nt, Escherichia coli CFT073
gccgguuccagcuuca

SEQ ID NO: 2606419 - RNA, 20 nt, Escherichia coli CFT073
gccgguucccagaccuucau

SEQ ID NO: 2606420 - RNA, 19 nt, Escherichia coli CFT073
gccgguugugugcuggcca

SEQ ID NO: 2606421 - RNA, 20 nt, Escherichia coli CFT073
gccgguugugugcuggccau

SEQ ID NO: 2606422 - RNA, 16 nt, Escherichia coli CFT073
gccguaaacagguuga

SEQ ID NO: 2606423 - RNA, 12 nt, Escherichia coli CFT073
gccguaaacgug

SEQ ID NO: 2606424 - RNA, 19 nt, Escherichia coli CFT073
gccguaagcaacgccaaau

SEQ ID NO: 2606425 - RNA, 16 nt, Escherichia coli CFT073
gccguaauccugcaaa

SEQ ID NO: 2606426 - RNA, 16 nt, Escherichia coli CFT073
gccguaaucgccucca

SEQ ID NO: 2606427 - RNA, 14 nt, Escherichia coli CFT073
gccguaauuaacac

SEQ ID NO: 2606428 - RNA, 15 nt, Escherichia coli CFT073
gccguacagcccagg

SEQ ID NO: 2606429 - RNA, 14 nt, Escherichia coli CFT073
gccguacaggcaga

SEQ ID NO: 2606430 - RNA, 20 nt, Escherichia coli CFT073
gccugauaagacgcguuagc

SEQ ID NO: 2606431 - RNA, 16 nt, Escherichia coli CFT073
gccugauaagcguagc

SEQ ID NO: 2606432 - RNA, 16 nt, Escherichia coli CFT073
gccugaucaaucauca

SEQ ID NO: 2606433 - RNA, 20 nt, Escherichia coli CFT073
gccugaucagcgaagcgcau

SEQ ID NO: 2606434 - RNA, 15 nt, Escherichia coli CFT073
gccugaucauuuccg

SEQ ID NO: 2606435 - RNA, 23 nt, Escherichia coli CFT073
gccugaucgagcaguaauccagc

SEQ ID NO: 2606436 - RNA, 14 nt, Escherichia coli CFT073
gccugaucgcgcaa

SEQ ID NO: 2606437 - RNA, 22 nt, Escherichia coli CFT073
gccugaugagcggagcacauca

SEQ ID NO: 2606438 - RNA, 13 nt, Escherichia coli CFT073
gccugaugcgacg

SEQ ID NO: 2606439 - RNA, 19 nt, Escherichia coli CFT073
gccugaugcgcuaugcuua

SEQ ID NO: 2606440 - RNA, 18 nt, Escherichia coli CFT073
gccugaugcgcugcgcuu

SEQ ID NO: 2606441 - RNA, 22 nt, Escherichia coli CFT073
gccugauucaaugaguuauaca

SEQ ID NO: 2606442 - RNA, 19 nt, Escherichia coli CFT073
gccugauuguuuguagccg

SEQ ID NO: 2606443 - RNA, 13 nt, Escherichia coli CFT073
gccugcaaaaucu

SEQ ID NO: 2606444 - RNA, 18 nt, Escherichia coli CFT073
gccugcaaaaucuguuga

SEQ ID NO: 2606445 - RNA, 13 nt, Escherichia coli CFT073
gccugcaaauaaa

SEQ ID NO: 2606446 - RNA, 15 nt, Escherichia coli CFT073
gccugcaacaggagc

SEQ ID NO: 2606447 - RNA, 16 nt, Escherichia coli CFT073
gccugcacaaagcgcc

SEQ ID NO: 2606448 - RNA, 17 nt, Escherichia coli CFT073
gccugcacaaagcgcca

SEQ ID NO: 2606449 - RNA, 15 nt, Escherichia coli CFT073
gccugcacaaccgga

SEQ ID NO: 2606450 - RNA, 23 nt, Escherichia coli CFT073
gccugcacaaccggaaccagcgc

SEQ ID NO: 2606451 - RNA, 14 nt, Escherichia coli CFT073
gccugcaccagccu

SEQ ID NO: 2606452 - RNA, 15 nt, Escherichia coli CFT073
gccugcacgaccggg

SEQ ID NO: 2606453 - RNA, 17 nt, Escherichia coli CFT073
gccugcacugcaggccg

SEQ ID NO: 2606454 - RNA, 12 nt, Escherichia coli CFT073
gccugcagcggc

SEQ ID NO: 2606455 - RNA, 21 nt, Escherichia coli CFT073
gccugcauaaaggcaaaacag

SEQ ID NO: 2606456 - RNA, 13 nt, Escherichia coli CFT073
gccugcaucacga

SEQ ID NO: 2606457 - RNA, 15 nt, Escherichia coli CFT073
gccugcaucacgagc

SEQ ID NO: 2606458 - RNA, 14 nt, Escherichia coli CFT073
gccugccagcucuu

SEQ ID NO: 2606459 - RNA, 16 nt, Escherichia coli CFT073
gccugccuucccuucu

SEQ ID NO: 2606460 - RNA, 14 nt, Escherichia coli CFT073
gccugcgaaucuaa

SEQ ID NO: 2606461 - RNA, 18 nt, Escherichia coli CFT073
gccugcggcgaucuucaa

SEQ ID NO: 2606462 - RNA, 18 nt, Escherichia coli CFT073
gccugcguucaguugauu

SEQ ID NO: 2606463 - RNA, 16 nt, Escherichia coli CFT073
gccugcuccucgguga

SEQ ID NO: 2606464 - RNA, 22 nt, Escherichia coli CFT073
gccugcugauaagacgcaucca

SEQ ID NO: 2606465 - RNA, 17 nt, Escherichia coli CFT073
gccugcugcacaccaua

SEQ ID NO: 2606466 - RNA, 19 nt, Escherichia coli CFT073
gccugcugcacaccauacu

SEQ ID NO: 2606467 - RNA, 16 nt, Escherichia coli CFT073
gccugcugcacagagc

SEQ ID NO: 2606468 - RNA, 16 nt, Escherichia coli CFT073
gccugcuuaucgcccu

SEQ ID NO: 2606469 - RNA, 21 nt, Escherichia coli CFT073
gccugcuucuacgcagguuaa

SEQ ID NO: 2606470 - RNA, 17 nt, Escherichia coli CFT073
gccugcuuuaucgaaca

SEQ ID NO: 2606471 - RNA, 19 nt, Escherichia coli CFT073
gccuggagguggcaguuac

SEQ ID NO: 2606472 - RNA, 21 nt, Escherichia coli CFT073
gccuggagguuuagccaaaaa

SEQ ID NO: 2606473 - RNA, 19 nt, Escherichia coli CFT073
gccuggcagcaugcugcca

SEQ ID NO: 2606474 - RNA, 16 nt, Escherichia coli CFT073
gccuggcgaaaggagg

SEQ ID NO: 2606475 - RNA, 14 nt, Escherichia coli CFT073
gccuggcgcugcuc

SEQ ID NO: 2606476 - RNA, 19 nt, Escherichia coli CFT073
gccuggcgcugcucaggcg

SEQ ID NO: 2606477 - RNA, 19 nt, Escherichia coli CFT073
gccuggcuaagcaucgcaa

SEQ ID NO: 2606478 - RNA, 17 nt, Escherichia coli CFT073
gccuggcugcgugaggc

SEQ ID NO: 2606479 - RNA, 13 nt, Escherichia coli CFT073
gccugggcgaggu

SEQ ID NO: 2606480 - RNA, 19 nt, Escherichia coli CFT073
gccugggggggaaacccac

SEQ ID NO: 2606481 - RNA, 23 nt, Escherichia coli CFT073
gccugggugaugguccaguuaag

SEQ ID NO: 2606482 - RNA, 17 nt, Escherichia coli CFT073
gccuggguuuucacaga

SEQ ID NO: 2606483 - RNA, 20 nt, Escherichia coli CFT073
gccugguaaucgcggguugc

SEQ ID NO: 2606484 - RNA, 14 nt, Escherichia coli CFT073
gccuggucaaagac

SEQ ID NO: 2606485 - RNA, 14 nt, Escherichia coli CFT073
gccuggugaccgcc

SEQ ID NO: 2606486 - RNA, 15 nt, Escherichia coli CFT073
gccugguuucucucc

SEQ ID NO: 2606487 - RNA, 17 nt, Escherichia coli CFT073
gccuguaaugccuuuuc

SEQ ID NO: 2606488 - RNA, 15 nt, Escherichia coli CFT073
gccuguacuuccugu

SEQ ID NO: 2606489 - RNA, 20 nt, Escherichia coli CFT073
gccuguccucuucagcauca

SEQ ID NO: 2606490 - RNA, 19 nt, Escherichia coli CFT073
gccugucggagcucccccu

SEQ ID NO: 2606491 - RNA, 17 nt, Escherichia coli CFT073
gccugucugcaaaaaua

SEQ ID NO: 2606492 - RNA, 13 nt, Escherichia coli CFT073
gccugugcaaccu

SEQ ID NO: 2606493 - RNA, 14 nt, Escherichia coli CFT073
gccugugcgauuuc

SEQ ID NO: 2606494 - RNA, 22 nt, Escherichia coli CFT073
gccuguggcgcgaccagacgca

SEQ ID NO: 2606495 - RNA, 16 nt, Escherichia coli CFT073
gccuguugcacaauac

SEQ ID NO: 2606496 - RNA, 11 nt, Escherichia coli CFT073
gccuguugccc

SEQ ID NO: 2606497 - RNA, 19 nt, Escherichia coli CFT073
gccuguugugucggcugcg

SEQ ID NO: 2606498 - RNA, 21 nt, Escherichia coli CFT073
gccuguuuaccggucaccgga

SEQ ID NO: 2606499 - RNA, 16 nt, Escherichia coli CFT073
gccuuaaaaaccagag

SEQ ID NO: 2606500 - RNA, 13 nt, Escherichia coli CFT073
gccuuaaacucca

SEQ ID NO: 2606501 - RNA, 16 nt, Escherichia coli CFT073
gccuuaaccgccgcca

SEQ ID NO: 2606502 - RNA, 18 nt, Escherichia coli CFT073
gccuuaaccgccgccaga

SEQ ID NO: 2606503 - RNA, 14 nt, Escherichia coli CFT073
gccuuaacgcaaaa

SEQ ID NO: 2606504 - RNA, 15 nt, Escherichia coli CFT073
gccuuaaucuucacu

SEQ ID NO: 2606505 - RNA, 22 nt, Escherichia coli CFT073
gccuuacccugaccgucuuuuu

SEQ ID NO: 2606506 - RNA, 14 nt, Escherichia coli CFT073
gccuuaccuguuau

SEQ ID NO: 2606507 - RNA, 19 nt, Escherichia coli CFT073
gccuuacgggcguauucaa

SEQ ID NO: 2606508 - RNA, 17 nt, Escherichia coli CFT073
gccuuauccggccuaca

SEQ ID NO: 2606509 - RNA, 18 nt, Escherichia coli CFT073
gccuuauccggccuacgg

SEQ ID NO: 2606510 - RNA, 22 nt, Escherichia coli CFT073
gccuuauccggccuacggguga

SEQ ID NO: 2606511 - RNA, 18 nt, Escherichia coli CFT073
gccuucaauauggaacgc

SEQ ID NO: 2606512 - RNA, 18 nt, Escherichia coli CFT073
gccuucacggcuuuguca

SEQ ID NO: 2606513 - RNA, 15 nt, Escherichia coli CFT073
gccuucacuuccggc

SEQ ID NO: 2606514 - RNA, 21 nt, Escherichia coli CFT073
gccuucagguuuuucagcugc

SEQ ID NO: 2606515 - RNA, 14 nt, Escherichia coli CFT073
gccuuccagcagcu

SEQ ID NO: 2606516 - RNA, 17 nt, Escherichia coli CFT073
gccuucccuucucuuca

SEQ ID NO: 2606517 - RNA, 18 nt, Escherichia coli CFT073
gccuucccuuucagcaaa

SEQ ID NO: 2606518 - RNA, 18 nt, Escherichia coli CFT073
gccuuccgcaaacaggcg

SEQ ID NO: 2606519 - RNA, 22 nt, Escherichia coli CFT073
gccuuccgcaaacaggcgcaga

SEQ ID NO: 2606520 - RNA, 16 nt, Escherichia coli CFT073
gccuuccgcugacagc

SEQ ID NO: 2606521 - RNA, 17 nt, Escherichia coli CFT073
gccuuccggcaguuuca

SEQ ID NO: 2606522 - RNA, 22 nt, Escherichia coli CFT073
gccuuccugauaacacagcggc

SEQ ID NO: 2606523 - RNA, 15 nt, Escherichia coli CFT073
gccuucgccuuucag

SEQ ID NO: 2606524 - RNA, 19 nt, Escherichia coli CFT073
gccuucgugcggcugcauc

SEQ ID NO: 2606525 - RNA, 22 nt, Escherichia coli CFT073
gccuucuccgggagaaggccuu

SEQ ID NO: 2606526 - RNA, 11 nt, Escherichia coli CFT073
gccuucugagc

SEQ ID NO: 2606527 - RNA, 19 nt, Escherichia coli CFT073
gccuucugagcccacuguu

SEQ ID NO: 2606528 - RNA, 15 nt, Escherichia coli CFT073
gccuucuucauccag

SEQ ID NO: 2606529 - RNA, 16 nt, Escherichia coli CFT073
gccuucuucauccagc

SEQ ID NO: 2606530 - RNA, 19 nt, Escherichia coli CFT073
gccuucuucauccagcgca

SEQ ID NO: 2606531 - RNA, 16 nt, Escherichia coli CFT073
gccuucuuccagcgca

SEQ ID NO: 2606532 - RNA, 22 nt, Escherichia coli CFT073
gccuucuucgcccacuuucugc

SEQ ID NO: 2606533 - RNA, 14 nt, Escherichia coli CFT073
gccuucuucuuuca

SEQ ID NO: 2606534 - RNA, 22 nt, Escherichia coli CFT073
gccuugaugaaaaaaccagaaa

SEQ ID NO: 2606535 - RNA, 19 nt, Escherichia coli CFT073
gccuugcgauuacguucgg

SEQ ID NO: 2606536 - RNA, 15 nt, Escherichia coli CFT073
gccuuguauuaauac

SEQ ID NO: 2606537 - RNA, 19 nt, Escherichia coli CFT073
gccuuguucggucagcgca

SEQ ID NO: 2606538 - RNA, 18 nt, Escherichia coli CFT073
gcgaccgucuuuauccag

SEQ ID NO: 2606539 - RNA, 22 nt, Escherichia coli CFT073
gcgaccgucuuuauccagcacc

SEQ ID NO: 2606540 - RNA, 15 nt, Escherichia coli CFT073
gcgaccguucgccag

SEQ ID NO: 2606541 - RNA, 22 nt, Escherichia coli CFT073
gcgacgaccacccaccgcagcc

SEQ ID NO: 2606542 - RNA, 21 nt, Escherichia coli CFT073
gcgacgaugagcgauaaacaa

SEQ ID NO: 2606543 - RNA, 12 nt, Escherichia coli CFT073
gcgacgcugaag

SEQ ID NO: 2606544 - RNA, 21 nt, Escherichia coli CFT073
gcgacgcugauagcgucuuau

SEQ ID NO: 2606545 - RNA, 19 nt, Escherichia coli CFT073
gcgacgcugcgcguuuuau

SEQ ID NO: 2606546 - RNA, 12 nt, Escherichia coli CFT073
gcgacgcuggcg

SEQ ID NO: 2606547 - RNA, 20 nt, Escherichia coli CFT073
gcgacgcugucgcgucuuau

SEQ ID NO: 2606548 - RNA, 21 nt, Escherichia coli CFT073
gcgacgcuugaugcgucuuau

SEQ ID NO: 2606549 - RNA, 21 nt, Escherichia coli CFT073
gcgacgcuugccgcgucuuau

SEQ ID NO: 2606550 - RNA, 21 nt, Escherichia coli CFT073
gcgacgcuuuacgcgucuuau

SEQ ID NO: 2606551 - RNA, 16 nt, Escherichia coli CFT073
gcgacggcaccacauu

SEQ ID NO: 2606552 - RNA, 18 nt, Escherichia coli CFT073
gcgacggcuugccaugcc

SEQ ID NO: 2606553 - RNA, 20 nt, Escherichia coli CFT073
gcgacgguugcggaacccag

SEQ ID NO: 2606554 - RNA, 17 nt, Escherichia coli CFT073
gcgacgguuuccaggca

SEQ ID NO: 2606555 - RNA, 20 nt, Escherichia coli CFT073
gcgacgguuuccaggcagcc

SEQ ID NO: 2606556 - RNA, 21 nt, Escherichia coli CFT073
gcgacgucgguuuccagcauc

SEQ ID NO: 2606557 - RNA, 21 nt, Escherichia coli CFT073
gcgacguucguuaacaacaac

SEQ ID NO: 2606558 - RNA, 12 nt, Escherichia coli CFT073
gcgacguucucg

SEQ ID NO: 2606559 - RNA, 22 nt, Escherichia coli CFT073
gcgacguugcuucucuugcugg

SEQ ID NO: 2606560 - RNA, 19 nt, Escherichia coli CFT073
gcgacucacgaaucgccuc

SEQ ID NO: 2606561 - RNA, 20 nt, Escherichia coli CFT073
gcgacucacgaaucgccuca

SEQ ID NO: 2606562 - RNA, 14 nt, Escherichia coli CFT073
gcgacucgguugca

SEQ ID NO: 2606563 - RNA, 12 nt, Escherichia coli CFT073
gcgacucuccug

SEQ ID NO: 2606564 - RNA, 22 nt, Escherichia coli CFT073
gcgacugaaaggucaucaucac

SEQ ID NO: 2606565 - RNA, 16 nt, Escherichia coli CFT073
gcgacugaaccagcgc

SEQ ID NO: 2606566 - RNA, 19 nt, Escherichia coli CFT073
gcgacugacgucacgcacc

SEQ ID NO: 2606567 - RNA, 15 nt, Escherichia coli CFT073
gcgacugccagcauc

SEQ ID NO: 2606568 - RNA, 16 nt, Escherichia coli CFT073
gcgacuugcucaggag

SEQ ID NO: 2606569 - RNA, 13 nt, Escherichia coli CFT073
gcgagaacgacgu

SEQ ID NO: 2606570 - RNA, 13 nt, Escherichia coli CFT073
gcgagaacgccuu

SEQ ID NO: 2606571 - RNA, 15 nt, Escherichia coli CFT073
gcgagaacgccuuau

SEQ ID NO: 2606572 - RNA, 15 nt, Escherichia coli CFT073
gcgagaauacauaua

SEQ ID NO: 2606573 - RNA, 19 nt, Escherichia coli CFT073
gcgagacuccgccgccauu

SEQ ID NO: 2606574 - RNA, 18 nt, Escherichia coli CFT073
gcgagauauccacauuaa

SEQ ID NO: 2606575 - RNA, 23 nt, Escherichia coli CFT073
gcgagaucuuuaucaaucaccgc

SEQ ID NO: 2606576 - RNA, 20 nt, Escherichia coli CFT073
gcgagcaaaaucguaagcag

SEQ ID NO: 2606577 - RNA, 14 nt, Escherichia coli CFT073
gcgagcagcauucc

SEQ ID NO: 2606578 - RNA, 16 nt, Escherichia coli CFT073
gcgagcaucgcgagga

SEQ ID NO: 2606579 - RNA, 12 nt, Escherichia coli CFT073
gcgagccgucgc

SEQ ID NO: 2606580 - RNA, 12 nt, Escherichia coli CFT073
gcgagcgccuua

SEQ ID NO: 2606581 - RNA, 18 nt, Escherichia coli CFT073
gcgagcgccuuauccggc

SEQ ID NO: 2606582 - RNA, 20 nt, Escherichia coli CFT073
gcgagcgccuuauccggccu

SEQ ID NO: 2606583 - RNA, 21 nt, Escherichia coli CFT073
gcgagcgccuuauccggccug

SEQ ID NO: 2606584 - RNA, 13 nt, Escherichia coli CFT073
gcgagcguuuuau

SEQ ID NO: 2606585 - RNA, 13 nt, Escherichia coli CFT073
gcgagcuggcgcu

SEQ ID NO: 2606586 - RNA, 17 nt, Escherichia coli CFT073
gcgagcuuucgaccagc

SEQ ID NO: 2606587 - RNA, 23 nt, Escherichia coli CFT073
gcgagcuuucgaccagccaggcc

SEQ ID NO: 2606588 - RNA, 13 nt, Escherichia coli CFT073
gcgaggaucacgc

SEQ ID NO: 2606589 - RNA, 21 nt, Escherichia coli CFT073
gcgaggaucaucggugugaga

SEQ ID NO: 2606590 - RNA, 16 nt, Escherichia coli CFT073
gcgagguaacaauaaa

SEQ ID NO: 2606591 - RNA, 12 nt, Escherichia coli CFT073
gcgaguaucguu

SEQ ID NO: 2606592 - RNA, 15 nt, Escherichia coli CFT073
gcgaguaucguuggc

SEQ ID NO: 2606593 - RNA, 19 nt, Escherichia coli CFT073
gcgagucgagaucccuucc

SEQ ID NO: 2606594 - RNA, 15 nt, Escherichia coli CFT073
gcgaguggucuccug

SEQ ID NO: 2606595 - RNA, 18 nt, Escherichia coli CFT073
gcgaguucgagucucguu

SEQ ID NO: 2606596 - RNA, 14 nt, Escherichia coli CFT073
gcgauaaaacgccg

SEQ ID NO: 2606597 - RNA, 20 nt, Escherichia coli CFT073
gcgauaaaacgccgcuggug

SEQ ID NO: 2606598 - RNA, 12 nt, Escherichia coli CFT073
gcgauaaaacuu

SEQ ID NO: 2606599 - RNA, 15 nt, Escherichia coli CFT073
gcgauaaaacuucug

SEQ ID NO: 2606600 - RNA, 18 nt, Escherichia coli CFT073
gcgauaaaccgaucgccg

SEQ ID NO: 2606601 - RNA, 17 nt, Escherichia coli CFT073
gcgauaaccgcaccuuc

SEQ ID NO: 2606602 - RNA, 16 nt, Escherichia coli CFT073
gcgauaacgccccaau

SEQ ID NO: 2606603 - RNA, 22 nt, Escherichia coli CFT073
gcgauaacggaucggaacgcga

SEQ ID NO: 2606604 - RNA, 18 nt, Escherichia coli CFT073
gcgauaacguguuccagu

SEQ ID NO: 2606605 - RNA, 17 nt, Escherichia coli CFT073
gcgauaaucagcgccag

SEQ ID NO: 2606606 - RNA, 21 nt, Escherichia coli CFT073
gcgauaaucagcgccagcgcg

SEQ ID NO: 2606607 - RNA, 19 nt, Escherichia coli CFT073
gcgauaauuuuucgauaac

SEQ ID NO: 2606608 - RNA, 21 nt, Escherichia coli CFT073
gcgauaauuuuucgauaacug

SEQ ID NO: 2606609 - RNA, 16 nt, Escherichia coli CFT073
gcgauaccacccgcag

SEQ ID NO: 2606610 - RNA, 20 nt, Escherichia coli CFT073
gcgauaccaguaauaagccc

SEQ ID NO: 2606611 - RNA, 23 nt, Escherichia coli CFT073
gcgauacggugcacaaugccuga

SEQ ID NO: 2606612 - RNA, 17 nt, Escherichia coli CFT073
gcgauacugccgcccau

SEQ ID NO: 2606613 - RNA, 22 nt, Escherichia coli CFT073
gcgauacuuuguaggccggaua

SEQ ID NO: 2606614 - RNA, 18 nt, Escherichia coli CFT073
gcgauagcauccaguucc

SEQ ID NO: 2606615 - RNA, 12 nt, Escherichia coli CFT073
gcgauaggccuu

SEQ ID NO: 2606616 - RNA, 22 nt, Escherichia coli CFT073
gcgauaggggggauugccgcga

SEQ ID NO: 2606617 - RNA, 15 nt, Escherichia coli CFT073
gcgauauccagcgcg

SEQ ID NO: 2606618 - RNA, 17 nt, Escherichia coli CFT073
gcgauauccgggcaaaa

SEQ ID NO: 2606619 - RNA, 22 nt, Escherichia coli CFT073
gcgauauccgugcauuccagca

SEQ ID NO: 2606620 - RNA, 22 nt, Escherichia coli CFT073
gcgauaugccggcaucaaacgg

SEQ ID NO: 2606621 - RNA, 21 nt, Escherichia coli CFT073
gcgauauuccgcaacgccgcc

SEQ ID NO: 2606622 - RNA, 15 nt, Escherichia coli CFT073
gcgauauugccgcga

SEQ ID NO: 2606623 - RNA, 20 nt, Escherichia coli CFT073
gcgauauugccgcgauagca

SEQ ID NO: 2606624 - RNA, 18 nt, Escherichia coli CFT073
gcgaucaucaguacgccu

SEQ ID NO: 2606625 - RNA, 19 nt, Escherichia coli CFT073
gcgaucgcccgcaaucagc

SEQ ID NO: 2606626 - RNA, 18 nt, Escherichia coli CFT073
gcgaucgccugcuggaca

SEQ ID NO: 2606627 - RNA, 19 nt, Escherichia coli CFT073
gcgaucgcgccaaucagcg

SEQ ID NO: 2606628 - RNA, 16 nt, Escherichia coli CFT073
gcgaucgcuaaagcau

SEQ ID NO: 2606629 - RNA, 18 nt, Escherichia coli CFT073
gcgaucgggcauuuccau

SEQ ID NO: 2606630 - RNA, 14 nt, Escherichia coli CFT073
gcgaucguccagcu

SEQ ID NO: 2606631 - RNA, 22 nt, Escherichia coli CFT073
gcgaucucggucaccaggaagc

SEQ ID NO: 2606632 - RNA, 14 nt, Escherichia coli CFT073
gcgaucucgucagc

SEQ ID NO: 2606633 - RNA, 19 nt, Escherichia coli CFT073
gcgaucugcaccuggcgca

SEQ ID NO: 2606634 - RNA, 15 nt, Escherichia coli CFT073
gcgaugaaauucacu

SEQ ID NO: 2606635 - RNA, 17 nt, Escherichia coli CFT073
gcgaugaaauucacugu

SEQ ID NO: 2606636 - RNA, 15 nt, Escherichia coli CFT073
gcgaugaucgccgcc

SEQ ID NO: 2606637 - RNA, 15 nt, Escherichia coli CFT073
gcgaugaugcgacgc

SEQ ID NO: 2606638 - RNA, 14 nt, Escherichia coli CFT073
gcgaugcaaaauca

SEQ ID NO: 2606639 - RNA, 15 nt, Escherichia coli CFT073
gcgaugcaaaaucag

SEQ ID NO: 2606640 - RNA, 16 nt, Escherichia coli CFT073
gcgaugcaaaaucagg

SEQ ID NO: 2606641 - RNA, 19 nt, Escherichia coli CFT073
gcgaugcacaugcuucagc

SEQ ID NO: 2606642 - RNA, 15 nt, Escherichia coli CFT073
gcgaugcgucgcugg

SEQ ID NO: 2606643 - RNA, 18 nt, Escherichia coli CFT073
gcgaugcgucgcuggcgg

SEQ ID NO: 2606644 - RNA, 14 nt, Escherichia coli CFT073
gcgaugcuggcgca

SEQ ID NO: 2606645 - RNA, 20 nt, Escherichia coli CFT073
gcgaugcuggcgcgucuuau

SEQ ID NO: 2606646 - RNA, 12 nt, Escherichia coli CFT073
gcgcaugaccuu

SEQ ID NO: 2606647 - RNA, 18 nt, Escherichia coli CFT073
gcgcaugcaggcaugcaa

SEQ ID NO: 2606648 - RNA, 22 nt, Escherichia coli CFT073
gcgcauuaaauaccaagccaag

SEQ ID NO: 2606649 - RNA, 14 nt, Escherichia coli CFT073
gcgcauugcuggcu

SEQ ID NO: 2606650 - RNA, 14 nt, Escherichia coli CFT073
gcgcauuuaccagg

SEQ ID NO: 2606651 - RNA, 16 nt, Escherichia coli CFT073
gcgcauuucccagcaa

SEQ ID NO: 2606652 - RNA, 17 nt, Escherichia coli CFT073
gcgcauuucccagcaag

SEQ ID NO: 2606653 - RNA, 22 nt, Escherichia coli CFT073
gcgcauuucccagcaagaacca

SEQ ID NO: 2606654 - RNA, 13 nt, Escherichia coli CFT073
gcgccaaacugcc

SEQ ID NO: 2606655 - RNA, 16 nt, Escherichia coli CFT073
gcgccaaccaggauga

SEQ ID NO: 2606656 - RNA, 21 nt, Escherichia coli CFT073
gcgccaaccaugccgcccagc

SEQ ID NO: 2606657 - RNA, 17 nt, Escherichia coli CFT073
gcgccaagauagaacca

SEQ ID NO: 2606658 - RNA, 21 nt, Escherichia coli CFT073
gcgccaagcccguguuucuga

SEQ ID NO: 2606659 - RNA, 18 nt, Escherichia coli CFT073
gcgccaauagccgcaccg

SEQ ID NO: 2606660 - RNA, 14 nt, Escherichia coli CFT073
gcgccaaucgccag

SEQ ID NO: 2606661 - RNA, 20 nt, Escherichia coli CFT073
gcgccaaucggcaauucagu

SEQ ID NO: 2606662 - RNA, 21 nt, Escherichia coli CFT073
gcgccacaaucgcuucaucgc

SEQ ID NO: 2606663 - RNA, 16 nt, Escherichia coli CFT073
gcgccacauccggcau

SEQ ID NO: 2606664 - RNA, 15 nt, Escherichia coli CFT073
gcgccaccaccagua

SEQ ID NO: 2606665 - RNA, 14 nt, Escherichia coli CFT073
gcgccaccacccag

SEQ ID NO: 2606666 - RNA, 21 nt, Escherichia coli CFT073
gcgccaccacgccgauggcag

SEQ ID NO: 2606667 - RNA, 23 nt, Escherichia coli CFT073
gcgccacgcucuggugagugaca

SEQ ID NO: 2606668 - RNA, 15 nt, Escherichia coli CFT073
gcgccacguacauua

SEQ ID NO: 2606669 - RNA, 18 nt, Escherichia coli CFT073
gcgccagaaagguauuua

SEQ ID NO: 2606670 - RNA, 11 nt, Escherichia coli CFT073
gcgccagacug

SEQ ID NO: 2606671 - RNA, 20 nt, Escherichia coli CFT073
gcgccagauaagaggcgcgc

SEQ ID NO: 2606672 - RNA, 17 nt, Escherichia coli CFT073
gcgccagauagccgacc

SEQ ID NO: 2606673 - RNA, 12 nt, Escherichia coli CFT073
gcgccagcaaau

SEQ ID NO: 2606674 - RNA, 11 nt, Escherichia coli CFT073
gcgccagcaag

SEQ ID NO: 2606675 - RNA, 19 nt, Escherichia coli CFT073
gcgccagcaagagcaaaua

SEQ ID NO: 2606676 - RNA, 22 nt, Escherichia coli CFT073
gcgccagcaagagcaaauaaaa

SEQ ID NO: 2606677 - RNA, 14 nt, Escherichia coli CFT073
gcgccagcacaccc

SEQ ID NO: 2606678 - RNA, 23 nt, Escherichia coli CFT073
gcgccagcauaugcacacgcagc

SEQ ID NO: 2606679 - RNA, 21 nt, Escherichia coli CFT073
gcgccagcaucgcauccggca

SEQ ID NO: 2606680 - RNA, 13 nt, Escherichia coli CFT073
gcgccagcgcgga

SEQ ID NO: 2606681 - RNA, 17 nt, Escherichia coli CFT073
gcgccagcggccagcgc

SEQ ID NO: 2606682 - RNA, 20 nt, Escherichia coli CFT073
gcgccagcggccagcgcacc

SEQ ID NO: 2606683 - RNA, 16 nt, Escherichia coli CFT073
gcgccagcuaccagaa

SEQ ID NO: 2606684 - RNA, 17 nt, Escherichia coli CFT073
gcgccagcuaccagaau

SEQ ID NO: 2606685 - RNA, 12 nt, Escherichia coli CFT073
gcgccaggcaca

SEQ ID NO: 2606686 - RNA, 22 nt, Escherichia coli CFT073
gcgccaggcgcgagaagaucca

SEQ ID NO: 2606687 - RNA, 19 nt, Escherichia coli CFT073
gcgccaggcgcugaacuuc

SEQ ID NO: 2606688 - RNA, 21 nt, Escherichia coli CFT073
gcgccaggcuucauacaccac

SEQ ID NO: 2606689 - RNA, 20 nt, Escherichia coli CFT073
gcgccaggcuuuccgucagc

SEQ ID NO: 2606690 - RNA, 13 nt, Escherichia coli CFT073
gcgccagguggca

SEQ ID NO: 2606691 - RNA, 16 nt, Escherichia coli CFT073
gcgccaguaccgccgc

SEQ ID NO: 2606692 - RNA, 18 nt, Escherichia coli CFT073
gcgccauaaccgccagca

SEQ ID NO: 2606693 - RNA, 19 nt, Escherichia coli CFT073
gcgccauaaccgccagcac

SEQ ID NO: 2606694 - RNA, 23 nt, Escherichia coli CFT073
gcgccauacgucggugcagcaug

SEQ ID NO: 2606695 - RNA, 15 nt, Escherichia coli CFT073
gcgccaucaaaucug

SEQ ID NO: 2606696 - RNA, 12 nt, Escherichia coli CFT073
gcgccauccaua

SEQ ID NO: 2606697 - RNA, 14 nt, Escherichia coli CFT073
gcgccaucgccagg

SEQ ID NO: 2606698 - RNA, 15 nt, Escherichia coli CFT073
gcgccaucgccagga

SEQ ID NO: 2606699 - RNA, 19 nt, Escherichia coli CFT073
gcgccaucgguagcaccag

SEQ ID NO: 2606700 - RNA, 14 nt, Escherichia coli CFT073
gcgccauuuuucac

SEQ ID NO: 2606701 - RNA, 22 nt, Escherichia coli CFT073
gcgccauuuuucacugcggcaa

SEQ ID NO: 2606702 - RNA, 17 nt, Escherichia coli CFT073
gcgcccaacacuucccc

SEQ ID NO: 2606703 - RNA, 13 nt, Escherichia coli CFT073
gcgcccaacagua

SEQ ID NO: 2606704 - RNA, 17 nt, Escherichia coli CFT073
gcgcccaaccagcaggu

SEQ ID NO: 2606705 - RNA, 16 nt, Escherichia coli CFT073
gcgcccaauauccuga

SEQ ID NO: 2606706 - RNA, 23 nt, Escherichia coli CFT073
gcgcccacaucacgccgcuggca

SEQ ID NO: 2606707 - RNA, 23 nt, Escherichia coli CFT073
gcgcccacucggcgaccaguucg

SEQ ID NO: 2606708 - RNA, 13 nt, Escherichia coli CFT073
gcgcccagccuga

SEQ ID NO: 2606709 - RNA, 18 nt, Escherichia coli CFT073
gcgcccagcucuuuaccu

SEQ ID NO: 2606710 - RNA, 20 nt, Escherichia coli CFT073
gcgcccaguagugcgcagaa

SEQ ID NO: 2606711 - RNA, 19 nt, Escherichia coli CFT073
gcgcccaucauugcgccga

SEQ ID NO: 2606712 - RNA, 21 nt, Escherichia coli CFT073
gcgccccacuucauaauccag

SEQ ID NO: 2606713 - RNA, 23 nt, Escherichia coli CFT073
gcgccccuggucauaggcugccg

SEQ ID NO: 2606714 - RNA, 22 nt, Escherichia coli CFT073
gcgcccgccaagcaguuggcag

SEQ ID NO: 2606715 - RNA, 15 nt, Escherichia coli CFT073
gcgcccgccagcauc

SEQ ID NO: 2606716 - RNA, 12 nt, Escherichia coli CFT073
gcgcccgccagu

SEQ ID NO: 2606717 - RNA, 13 nt, Escherichia coli CFT073
gcgcccgccaguu

SEQ ID NO: 2606718 - RNA, 19 nt, Escherichia coli CFT073
gcgcccgcuuuucgccagu

SEQ ID NO: 2606719 - RNA, 20 nt, Escherichia coli CFT073
gcgcccgcuuuucgccaguu

SEQ ID NO: 2606720 - RNA, 21 nt, Escherichia coli CFT073
gcgcccggaaacgggcgcuga

SEQ ID NO: 2606721 - RNA, 16 nt, Escherichia coli CFT073
gcgcccguaaaccaag

SEQ ID NO: 2606722 - RNA, 18 nt, Escherichia coli CFT073
gcgcccguaaaccaagcu

SEQ ID NO: 2606723 - RNA, 19 nt, Escherichia coli CFT073
gcgcccugcaucacugaca

SEQ ID NO: 2606724 - RNA, 20 nt, Escherichia coli CFT073
gcgcccuggcccauugccag

SEQ ID NO: 2606725 - RNA, 22 nt, Escherichia coli CFT073
gcgccgaagcugaccagacagu

SEQ ID NO: 2606726 - RNA, 19 nt, Escherichia coli CFT073
gcgccgacugcgccaauac

SEQ ID NO: 2606727 - RNA, 16 nt, Escherichia coli CFT073
gcgccgaguaaaaaaa

SEQ ID NO: 2606728 - RNA, 17 nt, Escherichia coli CFT073
gcgccgcauugagaucu

SEQ ID NO: 2606729 - RNA, 13 nt, Escherichia coli CFT073
gcgccgccaaccc

SEQ ID NO: 2606730 - RNA, 13 nt, Escherichia coli CFT073
gcgccgccagcca

SEQ ID NO: 2606731 - RNA, 10 nt, Escherichia coli CFT073
gcgccgccgc

SEQ ID NO: 2606732 - RNA, 22 nt, Escherichia coli CFT073
gcgccgcuacucugacccagaa

SEQ ID NO: 2606733 - RNA, 16 nt, Escherichia coli CFT073
gcgccgcucggugcgc

SEQ ID NO: 2606734 - RNA, 13 nt, Escherichia coli CFT073
gcgccgcugagaa

SEQ ID NO: 2606735 - RNA, 17 nt, Escherichia coli CFT073
gcgccgcugagaaaaag

SEQ ID NO: 2606736 - RNA, 13 nt, Escherichia coli CFT073
gcgccggaaacca

SEQ ID NO: 2606737 - RNA, 17 nt, Escherichia coli CFT073
gcgccguccacaaaccg

SEQ ID NO: 2606738 - RNA, 23 nt, Escherichia coli CFT073
gcgccgugaacgugaccaugagc

SEQ ID NO: 2606739 - RNA, 20 nt, Escherichia coli CFT073
gcgccguugcgcccaucauc

SEQ ID NO: 2606740 - RNA, 19 nt, Escherichia coli CFT073
gcgccguuucagccagaga

SEQ ID NO: 2606741 - RNA, 21 nt, Escherichia coli CFT073
gcgccguuucagccagagaag

SEQ ID NO: 2606742 - RNA, 20 nt, Escherichia coli CFT073
gcgccucaaaauaaggcugc

SEQ ID NO: 2606743 - RNA, 24 nt, Escherichia coli CFT073
gcgccucaaaauaaggcugccagu

SEQ ID NO: 2606744 - RNA, 22 nt, Escherichia coli CFT073
gcgccucaacgccuaaugccag

SEQ ID NO: 2606745 - RNA, 12 nt, Escherichia coli CFT073
gcgccucaggca

SEQ ID NO: 2606746 - RNA, 12 nt, Escherichia coli CFT073
gcgccucaguuu

SEQ ID NO: 2606747 - RNA, 23 nt, Escherichia coli CFT073
gcgccucaguuucgacaccuuca

SEQ ID NO: 2606748 - RNA, 13 nt, Escherichia coli CFT073
gcgccucuuccag

SEQ ID NO: 2606749 - RNA, 14 nt, Escherichia coli CFT073
gcgccucuuccagg

SEQ ID NO: 2606750 - RNA, 12 nt, Escherichia coli CFT073
gcgccucuuuau

SEQ ID NO: 2606751 - RNA, 16 nt, Escherichia coli CFT073
gcgccugaauaaucag

SEQ ID NO: 2606752 - RNA, 22 nt, Escherichia coli CFT073
gcgccugaccauuaucaaacag

SEQ ID NO: 2606753 - RNA, 20 nt, Escherichia coli CFT073
gcgccugcacaaagcgccag

SEQ ID NO: 2606754 - RNA, 19 nt, Escherichia coli CFT073
gcgcuguuagcgugcagga

SEQ ID NO: 2606755 - RNA, 14 nt, Escherichia coli CFT073
gcgcuguuccaggu

SEQ ID NO: 2606756 - RNA, 19 nt, Escherichia coli CFT073
gcgcuuaacgcgggcuucu

SEQ ID NO: 2606757 - RNA, 21 nt, Escherichia coli CFT073
gcgcuuaaucaauugcaggaa

SEQ ID NO: 2606758 - RNA, 19 nt, Escherichia coli CFT073
gcgcuuacacacccggccu

SEQ ID NO: 2606759 - RNA, 19 nt, Escherichia coli CFT073
gcgcuuaucagaccuacgg

SEQ ID NO: 2606760 - RNA, 18 nt, Escherichia coli CFT073
gcgcuuaucgccagcgcg

SEQ ID NO: 2606761 - RNA, 14 nt, Escherichia coli CFT073
gcgcuucagcgauc

SEQ ID NO: 2606762 - RNA, 17 nt, Escherichia coli CFT073
gcgcuuccagccaugcc

SEQ ID NO: 2606763 - RNA, 18 nt, Escherichia coli CFT073
gcgcuuccggcagcuuca

SEQ ID NO: 2606764 - RNA, 20 nt, Escherichia coli CFT073
gcgcuucggcgccuuuuuca

SEQ ID NO: 2606765 - RNA, 18 nt, Escherichia coli CFT073
gcgcuucggcuuucauuu

SEQ ID NO: 2606766 - RNA, 21 nt, Escherichia coli CFT073
gcgcuucguuuuccgccacau

SEQ ID NO: 2606767 - RNA, 13 nt, Escherichia coli CFT073
gcgcuucugccac

SEQ ID NO: 2606768 - RNA, 18 nt, Escherichia coli CFT073
gcgcuucuucuaucguuu

SEQ ID NO: 2606769 - RNA, 16 nt, Escherichia coli CFT073
gcgcuugcauccggca

SEQ ID NO: 2606770 - RNA, 18 nt, Escherichia coli CFT073
gcgcuugcggccagcaca

SEQ ID NO: 2606771 - RNA, 12 nt, Escherichia coli CFT073
gcgcuugcugcc

SEQ ID NO: 2606772 - RNA, 15 nt, Escherichia coli CFT073
gcgcuuuaccaucgc

SEQ ID NO: 2606773 - RNA, 15 nt, Escherichia coli CFT073
gcgcuuuaucaucgg

SEQ ID NO: 2606774 - RNA, 14 nt, Escherichia coli CFT073
gcgcuuugaugcgu

SEQ ID NO: 2606775 - RNA, 20 nt, Escherichia coli CFT073
gcgcuuuguuuaugccagau

SEQ ID NO: 2606776 - RNA, 23 nt, Escherichia coli CFT073
gcgcuuuuacugcacucgccagu

SEQ ID NO: 2606777 - RNA, 19 nt, Escherichia coli CFT073
gcgcuuuuauccugucagu

SEQ ID NO: 2606778 - RNA, 12 nt, Escherichia coli CFT073
gcgcuuuuucuu

SEQ ID NO: 2606779 - RNA, 23 nt, Escherichia coli CFT073
gcgcuuuuugguccgaucccugc

SEQ ID NO: 2606780 - RNA, 14 nt, Escherichia coli CFT073
gcggaaauaacgcu

SEQ ID NO: 2606781 - RNA, 15 nt, Escherichia coli CFT073
gcggaaauaacgcug

SEQ ID NO: 2606782 - RNA, 16 nt, Escherichia coli CFT073
gcggaaaucacaguau

SEQ ID NO: 2606783 - RNA, 21 nt, Escherichia coli CFT073
gcggaacgcacuauacaacca

SEQ ID NO: 2606784 - RNA, 14 nt, Escherichia coli CFT073
gcggaacuuuuuuc

SEQ ID NO: 2606785 - RNA, 17 nt, Escherichia coli CFT073
gcggaagcgaguucgcg

SEQ ID NO: 2606786 - RNA, 16 nt, Escherichia coli CFT073
gcggaauaccgacauc

SEQ ID NO: 2606787 - RNA, 17 nt, Escherichia coli CFT073
gcggaauauccaguaac

SEQ ID NO: 2606788 - RNA, 18 nt, Escherichia coli CFT073
gcggaauauccaguaacg

SEQ ID NO: 2606789 - RNA, 15 nt, Escherichia coli CFT073
gcggaauaugcugaa

SEQ ID NO: 2606790 - RNA, 15 nt, Escherichia coli CFT073
gcggaaugcagucac

SEQ ID NO: 2606791 - RNA, 21 nt, Escherichia coli CFT073
gcggacacuuuccugcucggc

SEQ ID NO: 2606792 - RNA, 14 nt, Escherichia coli CFT073
gcggacaucugguc

SEQ ID NO: 2606793 - RNA, 16 nt, Escherichia coli CFT073
gcggaccaacaaaaau

SEQ ID NO: 2606794 - RNA, 14 nt, Escherichia coli CFT073
gcggaccagcgggc

SEQ ID NO: 2606795 - RNA, 22 nt, Escherichia coli CFT073
gcggaccccgcgcucgcgcagc

SEQ ID NO: 2606796 - RNA, 16 nt, Escherichia coli CFT073
gcggacgaucgcugau

SEQ ID NO: 2606797 - RNA, 21 nt, Escherichia coli CFT073
gcggacgcacauagcgugaca

SEQ ID NO: 2606798 - RNA, 15 nt, Escherichia coli CFT073
gcggacgucgacacu

SEQ ID NO: 2606799 - RNA, 17 nt, Escherichia coli CFT073
gcggacgucuguuuaug

SEQ ID NO: 2606800 - RNA, 15 nt, Escherichia coli CFT073
gcggacgugcaccgu

SEQ ID NO: 2606801 - RNA, 21 nt, Escherichia coli CFT073
gcggagaaagucguaggccug

SEQ ID NO: 2606802 - RNA, 14 nt, Escherichia coli CFT073
gcggagaucaccac

SEQ ID NO: 2606803 - RNA, 21 nt, Escherichia coli CFT073
gcggauaaaacugccagaagc

SEQ ID NO: 2606804 - RNA, 20 nt, Escherichia coli CFT073
gcggauaaacgucuucgcca

SEQ ID NO: 2606805 - RNA, 17 nt, Escherichia coli CFT073
gcggauaaggcuuuugc

SEQ ID NO: 2606806 - RNA, 17 nt, Escherichia coli CFT073
gcggauaucuuucgcca

SEQ ID NO: 2606807 - RNA, 18 nt, Escherichia coli CFT073
gcggaucauaugcacaau

SEQ ID NO: 2606808 - RNA, 22 nt, Escherichia coli CFT073
gcggauccguugaucgcucaua

SEQ ID NO: 2606809 - RNA, 13 nt, Escherichia coli CFT073
gcggaucugcucc

SEQ ID NO: 2606810 - RNA, 17 nt, Escherichia coli CFT073
gcggaucuggaacggga

SEQ ID NO: 2606811 - RNA, 16 nt, Escherichia coli CFT073
gcggauggccucugcc

SEQ ID NO: 2606812 - RNA, 21 nt, Escherichia coli CFT073
gcggauguugcugcaccaggc

SEQ ID NO: 2606813 - RNA, 21 nt, Escherichia coli CFT073
gcggauguuggguuagccaac

SEQ ID NO: 2606814 - RNA, 19 nt, Escherichia coli CFT073
gcggauuauuggcgucagu

SEQ ID NO: 2606815 - RNA, 16 nt, Escherichia coli CFT073
gcggauuucggcggcu

SEQ ID NO: 2606816 - RNA, 18 nt, Escherichia coli CFT073
gcggauuuuauucagcag

SEQ ID NO: 2606817 - RNA, 13 nt, Escherichia coli CFT073
gcggcaaaccuuu

SEQ ID NO: 2606818 - RNA, 15 nt, Escherichia coli CFT073
gcggcaaacugcaug

SEQ ID NO: 2606819 - RNA, 15 nt, Escherichia coli CFT073
gcggcaaagcgcauc

SEQ ID NO: 2606820 - RNA, 16 nt, Escherichia coli CFT073
gcggcaacaucaucac

SEQ ID NO: 2606821 - RNA, 15 nt, Escherichia coli CFT073
gcggcaaccagcagc

SEQ ID NO: 2606822 - RNA, 18 nt, Escherichia coli CFT073
gcggcaaccagcagcauc

SEQ ID NO: 2606823 - RNA, 12 nt, Escherichia coli CFT073
gcggcaacgaau

SEQ ID NO: 2606824 - RNA, 20 nt, Escherichia coli CFT073
gcggcaacggaaaaaccccg

SEQ ID NO: 2606825 - RNA, 12 nt, Escherichia coli CFT073
gcggcaaucauc

SEQ ID NO: 2606826 - RNA, 13 nt, Escherichia coli CFT073
gcggcaaucauca

SEQ ID NO: 2606827 - RNA, 13 nt, Escherichia coli CFT073
gcggcaaucgcca

SEQ ID NO: 2606828 - RNA, 14 nt, Escherichia coli CFT073
gcggcaaucgcugc

SEQ ID NO: 2606829 - RNA, 19 nt, Escherichia coli CFT073
gcggcaauguucgccggga

SEQ ID NO: 2606830 - RNA, 23 nt, Escherichia coli CFT073
gcggcaauuagcggccagcgggc

SEQ ID NO: 2606831 - RNA, 20 nt, Escherichia coli CFT073
gcggcacaccagccaguagc

SEQ ID NO: 2606832 - RNA, 19 nt, Escherichia coli CFT073
gcggcacuccgccacguca

SEQ ID NO: 2606833 - RNA, 24 nt, Escherichia coli CFT073
gcggcacugcucuuuaacaauuua

SEQ ID NO: 2606834 - RNA, 22 nt, Escherichia coli CFT073
gcggcacugguacucaaccgcc

SEQ ID NO: 2606835 - RNA, 18 nt, Escherichia coli CFT073
gcggcacuguuucgccag

SEQ ID NO: 2606836 - RNA, 18 nt, Escherichia coli CFT073
gcggcagaacguccgcag

SEQ ID NO: 2606837 - RNA, 23 nt, Escherichia coli CFT073
gcggcagaacguccgcaggauga

SEQ ID NO: 2606838 - RNA, 19 nt, Escherichia coli CFT073
gcggcagcaaccgcuuccg

SEQ ID NO: 2606839 - RNA, 17 nt, Escherichia coli CFT073
gcggcagcaauggcacu

SEQ ID NO: 2606840 - RNA, 20 nt, Escherichia coli CFT073
gcggcagcgucgcauccaac

SEQ ID NO: 2606841 - RNA, 16 nt, Escherichia coli CFT073
gcggcagcuccagcag

SEQ ID NO: 2606842 - RNA, 22 nt, Escherichia coli CFT073
gcggcagcucuuucucgcucag

SEQ ID NO: 2606843 - RNA, 19 nt, Escherichia coli CFT073
gcggcaggaugcccaugcc

SEQ ID NO: 2606844 - RNA, 19 nt, Escherichia coli CFT073
gcggcagguugaugaugac

SEQ ID NO: 2606845 - RNA, 15 nt, Escherichia coli CFT073
gcggcaguauagcgg

SEQ ID NO: 2606846 - RNA, 18 nt, Escherichia coli CFT073
gcggcagucgcgcuucgu

SEQ ID NO: 2606847 - RNA, 17 nt, Escherichia coli CFT073
gcggcagugacagcccc

SEQ ID NO: 2606848 - RNA, 16 nt, Escherichia coli CFT073
gcggcaguuuucucga

SEQ ID NO: 2606849 - RNA, 20 nt, Escherichia coli CFT073
gcggcauaaacgccuuaucc

SEQ ID NO: 2606850 - RNA, 16 nt, Escherichia coli CFT073
gcggcaucuguacacg

SEQ ID NO: 2606851 - RNA, 14 nt, Escherichia coli CFT073
gcggcaucuucucc

SEQ ID NO: 2606852 - RNA, 16 nt, Escherichia coli CFT073
gcggcaucuucuccac

SEQ ID NO: 2606853 - RNA, 17 nt, Escherichia coli CFT073
gcggcaugaacgccuga

SEQ ID NO: 2606854 - RNA, 23 nt, Escherichia coli CFT073
gcggcauuacgcgccucuuccag

SEQ ID NO: 2606855 - RNA, 17 nt, Escherichia coli CFT073
gcggcauuuccagaccu

SEQ ID NO: 2606856 - RNA, 18 nt, Escherichia coli CFT073
gcggcauuucgccgagca

SEQ ID NO: 2606857 - RNA, 13 nt, Escherichia coli CFT073
gcggccaaaaagg

SEQ ID NO: 2606858 - RNA, 15 nt, Escherichia coli CFT073
gcggccaaagggagc

SEQ ID NO: 2606859 - RNA, 18 nt, Escherichia coli CFT073
gcggccaaagggagcaga

SEQ ID NO: 2606860 - RNA, 15 nt, Escherichia coli CFT073
gcggccaaugccuga

SEQ ID NO: 2606861 - RNA, 22 nt, Escherichia coli CFT073
gcggccagcauugcgccagcga

SEQ ID NO: 2606862 - RNA, 17 nt, Escherichia coli CFT073
gcgguaauuccggcguu

SEQ ID NO: 2606863 - RNA, 23 nt, Escherichia coli CFT073
gcgguacgguaauaaaugccgga

SEQ ID NO: 2606864 - RNA, 15 nt, Escherichia coli CFT073
gcgguacucgcgcag

SEQ ID NO: 2606865 - RNA, 23 nt, Escherichia coli CFT073
gcgguacucgcgcaguucgcaca

SEQ ID NO: 2606866 - RNA, 21 nt, Escherichia coli CFT073
gcgguacugaccaucagcagc

SEQ ID NO: 2606867 - RNA, 23 nt, Escherichia coli CFT073
gcgguagcgggcgcaaugcccgc

SEQ ID NO: 2606868 - RNA, 20 nt, Escherichia coli CFT073
gcgguaguuccaccaguucg

SEQ ID NO: 2606869 - RNA, 13 nt, Escherichia coli CFT073
gcgguaucaccac

SEQ ID NO: 2606870 - RNA, 20 nt, Escherichia coli CFT073
gcgguauggucacugagccc

SEQ ID NO: 2606871 - RNA, 18 nt, Escherichia coli CFT073
gcgguaugugaaacgccg

SEQ ID NO: 2606872 - RNA, 15 nt, Escherichia coli CFT073
gcgguauuuaaacuc

SEQ ID NO: 2606873 - RNA, 13 nt, Escherichia coli CFT073
gcggucaaccauc

SEQ ID NO: 2606874 - RNA, 15 nt, Escherichia coli CFT073
gcggucaaccaucgc

SEQ ID NO: 2606875 - RNA, 20 nt, Escherichia coli CFT073
gcggucaaguaaucaaucac

SEQ ID NO: 2606876 - RNA, 12 nt, Escherichia coli CFT073
gcggucagcgca

SEQ ID NO: 2606877 - RNA, 23 nt, Escherichia coli CFT073
gcggucaucgguaauacgugaaa

SEQ ID NO: 2606878 - RNA, 14 nt, Escherichia coli CFT073
gcggucaugacgau

SEQ ID NO: 2606879 - RNA, 22 nt, Escherichia coli CFT073
gcggucauguaccguugcugcc

SEQ ID NO: 2606880 - RNA, 16 nt, Escherichia coli CFT073
gcggucggguuaagcc

SEQ ID NO: 2606881 - RNA, 18 nt, Escherichia coli CFT073
gcggucggguuaagccca

SEQ ID NO: 2606882 - RNA, 12 nt, Escherichia coli CFT073
gcggucuggcag

SEQ ID NO: 2606883 - RNA, 17 nt, Escherichia coli CFT073
gcggucuggcagcuaau

SEQ ID NO: 2606884 - RNA, 14 nt, Escherichia coli CFT073
gcggucuguauuug

SEQ ID NO: 2606885 - RNA, 23 nt, Escherichia coli CFT073
gcggugaagccaccagcgccagc

SEQ ID NO: 2606886 - RNA, 21 nt, Escherichia coli CFT073
gcggugacuagcagcauuuca

SEQ ID NO: 2606887 - RNA, 15 nt, Escherichia coli CFT073
gcggugagucuggaa

SEQ ID NO: 2606888 - RNA, 13 nt, Escherichia coli CFT073
gcggugaugcgga

SEQ ID NO: 2606889 - RNA, 21 nt, Escherichia coli CFT073
gcggugaugcggaaauaucgg

SEQ ID NO: 2606890 - RNA, 21 nt, Escherichia coli CFT073
gcggugccauuaaaccaacaa

SEQ ID NO: 2606891 - RNA, 19 nt, Escherichia coli CFT073
gcggugguuaguuagcaga

SEQ ID NO: 2606892 - RNA, 21 nt, Escherichia coli CFT073
gcggugucuaacgaugccagc

SEQ ID NO: 2606893 - RNA, 19 nt, Escherichia coli CFT073
gcgguuaacaauacgccca

SEQ ID NO: 2606894 - RNA, 18 nt, Escherichia coli CFT073
gcgguuaacgcggcagca

SEQ ID NO: 2606895 - RNA, 16 nt, Escherichia coli CFT073
gcgguuacgcaccggu

SEQ ID NO: 2606896 - RNA, 19 nt, Escherichia coli CFT073
gcgguuacgcaccgguucc

SEQ ID NO: 2606897 - RNA, 20 nt, Escherichia coli CFT073
gcgguuagucgcugugacau

SEQ ID NO: 2606898 - RNA, 16 nt, Escherichia coli CFT073
gcgguucagcuuuuua

SEQ ID NO: 2606899 - RNA, 20 nt, Escherichia coli CFT073
gcgguugcugucggcggcga

SEQ ID NO: 2606900 - RNA, 23 nt, Escherichia coli CFT073
gcgguuggcaaucaguuuuuguu

SEQ ID NO: 2606901 - RNA, 13 nt, Escherichia coli CFT073
gcgguuguagcca

SEQ ID NO: 2606902 - RNA, 22 nt, Escherichia coli CFT073
gcgguuuacccugcucgcugga

SEQ ID NO: 2606903 - RNA, 23 nt, Escherichia coli CFT073
gcgguuucugaacuuaagcgccu

SEQ ID NO: 2606904 - RNA, 21 nt, Escherichia coli CFT073
gcgguuuucucuuuaaacaga

SEQ ID NO: 2606905 - RNA, 14 nt, Escherichia coli CFT073
gcgguuuucuucca

SEQ ID NO: 2606906 - RNA, 23 nt, Escherichia coli CFT073
gcgguuuucuuccagccacugcg

SEQ ID NO: 2606907 - RNA, 20 nt, Escherichia coli CFT073
gcgguuuucuuguuccugca

SEQ ID NO: 2606908 - RNA, 19 nt, Escherichia coli CFT073
gcgguuuuuggagagaucc

SEQ ID NO: 2606909 - RNA, 13 nt, Escherichia coli CFT073
gcguaaaauauug

SEQ ID NO: 2606910 - RNA, 13 nt, Escherichia coli CFT073
gcguaaacgccuu

SEQ ID NO: 2606911 - RNA, 13 nt, Escherichia coli CFT073
gcguaaagucaaa

SEQ ID NO: 2606912 - RNA, 14 nt, Escherichia coli CFT073
gcguaaaucaucgg

SEQ ID NO: 2606913 - RNA, 15 nt, Escherichia coli CFT073
gcguaaauccagcac

SEQ ID NO: 2606914 - RNA, 14 nt, Escherichia coli CFT073
gcguaaauugcugu

SEQ ID NO: 2606915 - RNA, 20 nt, Escherichia coli CFT073
gcguaacgcaccaggcgaaa

SEQ ID NO: 2606916 - RNA, 18 nt, Escherichia coli CFT073
gcguaacuuaucaauuga

SEQ ID NO: 2606917 - RNA, 21 nt, Escherichia coli CFT073
gcguaauaaauuuugccaccg

SEQ ID NO: 2606918 - RNA, 19 nt, Escherichia coli CFT073
gcguaauaaccaacggcga

SEQ ID NO: 2606919 - RNA, 16 nt, Escherichia coli CFT073
gcguaauagccugaug

SEQ ID NO: 2606920 - RNA, 14 nt, Escherichia coli CFT073
gcguaauuauuccc

SEQ ID NO: 2606921 - RNA, 21 nt, Escherichia coli CFT073
gcguacaaucgccacauugcu

SEQ ID NO: 2606922 - RNA, 13 nt, Escherichia coli CFT073
gcguacaccaaca

SEQ ID NO: 2606923 - RNA, 12 nt, Escherichia coli CFT073
gcguacagcgcg

SEQ ID NO: 2606924 - RNA, 14 nt, Escherichia coli CFT073
gcguaccugccgcg

SEQ ID NO: 2606925 - RNA, 19 nt, Escherichia coli CFT073
gcguacuggcaaucgccag

SEQ ID NO: 2606926 - RNA, 16 nt, Escherichia coli CFT073
gcguagaguccagcgc

SEQ ID NO: 2606927 - RNA, 16 nt, Escherichia coli CFT073
gcguagcugcugcuca

SEQ ID NO: 2606928 - RNA, 16 nt, Escherichia coli CFT073
gcguagugaaggcaaa

SEQ ID NO: 2606929 - RNA, 15 nt, Escherichia coli CFT073
gcguaguuuaugccg

SEQ ID NO: 2606930 - RNA, 17 nt, Escherichia coli CFT073
gcguaguuuaugccgga

SEQ ID NO: 2606931 - RNA, 22 nt, Escherichia coli CFT073
gcguauaaaccauaucaccgug

SEQ ID NO: 2606932 - RNA, 21 nt, Escherichia coli CFT073
gcguauccagacccagcuuca

SEQ ID NO: 2606933 - RNA, 17 nt, Escherichia coli CFT073
gcguauccagcauaccu

SEQ ID NO: 2606934 - RNA, 15 nt, Escherichia coli CFT073
gcguaucgcccugcc

SEQ ID NO: 2606935 - RNA, 22 nt, Escherichia coli CFT073
gcguaucgcccugccaaaucag

SEQ ID NO: 2606936 - RNA, 18 nt, Escherichia coli CFT073
gcguaucguucgccagcu

SEQ ID NO: 2606937 - RNA, 17 nt, Escherichia coli CFT073
gcguauugucauauaau

SEQ ID NO: 2606938 - RNA, 21 nt, Escherichia coli CFT073
gcgucaaauaaagaaguggug

SEQ ID NO: 2606939 - RNA, 19 nt, Escherichia coli CFT073
gcgucaacaacacucucug

SEQ ID NO: 2606940 - RNA, 15 nt, Escherichia coli CFT073
gcgucaaucacuuuc

SEQ ID NO: 2606941 - RNA, 19 nt, Escherichia coli CFT073
gcgucaaucacuuucugcg

SEQ ID NO: 2606942 - RNA, 19 nt, Escherichia coli CFT073
gcgucacaaauaccccugc

SEQ ID NO: 2606943 - RNA, 14 nt, Escherichia coli CFT073
gcgucacgguuuca

SEQ ID NO: 2606944 - RNA, 19 nt, Escherichia coli CFT073
gcgucacgguuucaaagaa

SEQ ID NO: 2606945 - RNA, 23 nt, Escherichia coli CFT073
gcgucagacggccccgcgccagc

SEQ ID NO: 2606946 - RNA, 16 nt, Escherichia coli CFT073
gcgucagagauuaagu

SEQ ID NO: 2606947 - RNA, 21 nt, Escherichia coli CFT073
gcgucagauucggauccagca

SEQ ID NO: 2606948 - RNA, 18 nt, Escherichia coli CFT073
gcgucagcgccaucccca

SEQ ID NO: 2606949 - RNA, 21 nt, Escherichia coli CFT073
gcgucagcgccgcauccgaca

SEQ ID NO: 2606950 - RNA, 17 nt, Escherichia coli CFT073
gcgucauauagccgccu

SEQ ID NO: 2606951 - RNA, 19 nt, Escherichia coli CFT073
gcgucaucaauccugcagc

SEQ ID NO: 2606952 - RNA, 14 nt, Escherichia coli CFT073
gcgucaucuuacug

SEQ ID NO: 2606953 - RNA, 22 nt, Escherichia coli CFT073
gcgucauuuucauugcuuucuu

SEQ ID NO: 2606954 - RNA, 15 nt, Escherichia coli CFT073
gcguccagaggaucu

SEQ ID NO: 2606955 - RNA, 17 nt, Escherichia coli CFT073
gcguccaucacuaccag

SEQ ID NO: 2606956 - RNA, 18 nt, Escherichia coli CFT073
gcgucccagauagcuguc

SEQ ID NO: 2606957 - RNA, 15 nt, Escherichia coli CFT073
gcgucccaucggcaa

SEQ ID NO: 2606958 - RNA, 18 nt, Escherichia coli CFT073
gcgucccuacugcacuca

SEQ ID NO: 2606959 - RNA, 18 nt, Escherichia coli CFT073
gcguccggcgucgcuucu

SEQ ID NO: 2606960 - RNA, 18 nt, Escherichia coli CFT073
gcguccugaucgacgcgc

SEQ ID NO: 2606961 - RNA, 19 nt, Escherichia coli CFT073
gcgucgaaaauaucgagca

SEQ ID NO: 2606962 - RNA, 16 nt, Escherichia coli CFT073
gcgucgcaucaggcaa

SEQ ID NO: 2606963 - RNA, 22 nt, Escherichia coli CFT073
gcgucgcaucaggcaaucggcg

SEQ ID NO: 2606964 - RNA, 20 nt, Escherichia coli CFT073
gcgucgcaucaggcauuaug

SEQ ID NO: 2606965 - RNA, 13 nt, Escherichia coli CFT073
gcgucgcauccga

SEQ ID NO: 2606966 - RNA, 16 nt, Escherichia coli CFT073
gcgucgccggucagga

SEQ ID NO: 2606967 - RNA, 19 nt, Escherichia coli CFT073
gcgucgcugaaccgccaac

SEQ ID NO: 2606968 - RNA, 15 nt, Escherichia coli CFT073
gcgucggcgguuucc

SEQ ID NO: 2606969 - RNA, 15 nt, Escherichia coli CFT073
gcgucguucgccagu

SEQ ID NO: 2606970 - RNA, 13 nt, Escherichia coli CFT073
gcguugucaucgg

SEQ ID NO: 2606971 - RNA, 15 nt, Escherichia coli CFT073
gcguugugucauaug

SEQ ID NO: 2606972 - RNA, 17 nt, Escherichia coli CFT073
gcguuguucaugccgga

SEQ ID NO: 2606973 - RNA, 22 nt, Escherichia coli CFT073
gcguuguuuacagcagccagcg

SEQ ID NO: 2606974 - RNA, 14 nt, Escherichia coli CFT073
gcguuuaaccaccu

SEQ ID NO: 2606975 - RNA, 15 nt, Escherichia coli CFT073
gcguuuaccugccug

SEQ ID NO: 2606976 - RNA, 20 nt, Escherichia coli CFT073
gcguuuaucaauauccaguc

SEQ ID NO: 2606977 - RNA, 23 nt, Escherichia coli CFT073
gcguuucaccaccacuucuuuca

SEQ ID NO: 2606978 - RNA, 17 nt, Escherichia coli CFT073
gcguuuccagcaccagu

SEQ ID NO: 2606979 - RNA, 12 nt, Escherichia coli CFT073
gcguuucuucac

SEQ ID NO: 2606980 - RNA, 16 nt, Escherichia coli CFT073
gcguuucuuccagcca

SEQ ID NO: 2606981 - RNA, 19 nt, Escherichia coli CFT073
gcguuucuucgaagaaaaa

SEQ ID NO: 2606982 - RNA, 21 nt, Escherichia coli CFT073
gcguuugaacugaaccccaaa

SEQ ID NO: 2606983 - RNA, 13 nt, Escherichia coli CFT073
gcguuugcagcuu

SEQ ID NO: 2606984 - RNA, 14 nt, Escherichia coli CFT073
gcguuugcuccugc

SEQ ID NO: 2606985 - RNA, 15 nt, Escherichia coli CFT073
gcguuuggcaucagc

SEQ ID NO: 2606986 - RNA, 21 nt, Escherichia coli CFT073
gcguuuuacaauauccagcgc

SEQ ID NO: 2606987 - RNA, 22 nt, Escherichia coli CFT073
gcguuuuaucacgcaucugcug

SEQ ID NO: 2606988 - RNA, 11 nt, Escherichia coli CFT073
gcguuuuccag

SEQ ID NO: 2606989 - RNA, 21 nt, Escherichia coli CFT073
gcguuuucgaaaaagcgcuga

SEQ ID NO: 2606990 - RNA, 12 nt, Escherichia coli CFT073
gcguuuucugcc

SEQ ID NO: 2606991 - RNA, 12 nt, Escherichia coli CFT073
gcguuuucuuca

SEQ ID NO: 2606992 - RNA, 19 nt, Escherichia coli CFT073
gcguuuucuuuuucagcaa

SEQ ID NO: 2606993 - RNA, 23 nt, Escherichia coli CFT073
gcguuuugauuuucaccagcauc

SEQ ID NO: 2606994 - RNA, 13 nt, Escherichia coli CFT073
gcguuuuucagaa

SEQ ID NO: 2606995 - RNA, 22 nt, Escherichia coli CFT073
gcguuuuucaucuuccggagcu

SEQ ID NO: 2606996 - RNA, 12 nt, Escherichia coli CFT073
gcguuuuuucau

SEQ ID NO: 2606997 - RNA, 14 nt, Escherichia coli CFT073
gcguuuuuucauuu

SEQ ID NO: 2606998 - RNA, 13 nt, Escherichia coli CFT073
gcuaaaaauaguu

SEQ ID NO: 2606999 - RNA, 21 nt, Escherichia coli CFT073
gcuaaaaaucccgccaucggc

SEQ ID NO: 2607000 - RNA, 20 nt, Escherichia coli CFT073
gcuaaaagcauagccccagc

SEQ ID NO: 2607001 - RNA, 18 nt, Escherichia coli CFT073
gcuaaagacuuugcugcc

SEQ ID NO: 2607002 - RNA, 15 nt, Escherichia coli CFT073
gcuaaauccgccgcc

SEQ ID NO: 2607003 - RNA, 16 nt, Escherichia coli CFT073
gcuaaauccgccgcca

SEQ ID NO: 2607004 - RNA, 22 nt, Escherichia coli CFT073
gcuaacaaaaauaucgccucua

SEQ ID NO: 2607005 - RNA, 17 nt, Escherichia coli CFT073
gcuaacacugccagccc

SEQ ID NO: 2607006 - RNA, 13 nt, Escherichia coli CFT073
gcuaacagcagca

SEQ ID NO: 2607007 - RNA, 17 nt, Escherichia coli CFT073
gcuaacagcgcaucucu

SEQ ID NO: 2607008 - RNA, 22 nt, Escherichia coli CFT073
gcuaacaguuugccaaaccagc

SEQ ID NO: 2607009 - RNA, 12 nt, Escherichia coli CFT073
gcuaaccacugu

SEQ ID NO: 2607010 - RNA, 12 nt, Escherichia coli CFT073
gcuaaccgucug

SEQ ID NO: 2607011 - RNA, 20 nt, Escherichia coli CFT073
gcuaaccuuauggugucuau

SEQ ID NO: 2607012 - RNA, 19 nt, Escherichia coli CFT073
gcuaacggagaauccagcc

SEQ ID NO: 2607013 - RNA, 18 nt, Escherichia coli CFT073
gcuaacucauugauuuuc

SEQ ID NO: 2607014 - RNA, 20 nt, Escherichia coli CFT073
gcuaacuccugauuccaggu

SEQ ID NO: 2607015 - RNA, 13 nt, Escherichia coli CFT073
gcuaacugcugcg

SEQ ID NO: 2607016 - RNA, 22 nt, Escherichia coli CFT073
gcuaacugcugcggaauagcaa

SEQ ID NO: 2607017 - RNA, 23 nt, Escherichia coli CFT073
gcuaacugcugcggaauagcaau

SEQ ID NO: 2607018 - RNA, 16 nt, Escherichia coli CFT073
gcuaacuucgccauca

SEQ ID NO: 2607019 - RNA, 20 nt, Escherichia coli CFT073
gcuaacuucgccaucagcgc

SEQ ID NO: 2607020 - RNA, 21 nt, Escherichia coli CFT073
gcuaacuucgccaucagcgcc

SEQ ID NO: 2607021 - RNA, 19 nt, Escherichia coli CFT073
gcuaagauaccccagcgca

SEQ ID NO: 2607022 - RNA, 23 nt, Escherichia coli CFT073
gcuaagcucucagcauauucuug

SEQ ID NO: 2607023 - RNA, 15 nt, Escherichia coli CFT073
gcuaaggcagugaua

SEQ ID NO: 2607024 - RNA, 17 nt, Escherichia coli CFT073
gcuaauaaacaggauau

SEQ ID NO: 2607025 - RNA, 13 nt, Escherichia coli CFT073
gcuaauaaucagc

SEQ ID NO: 2607026 - RNA, 20 nt, Escherichia coli CFT073
gcuaauaauguaauaugcag

SEQ ID NO: 2607027 - RNA, 16 nt, Escherichia coli CFT073
gcuaauaccggaugcc

SEQ ID NO: 2607028 - RNA, 23 nt, Escherichia coli CFT073
gcuaauaccgucgaugccaauaa

SEQ ID NO: 2607029 - RNA, 16 nt, Escherichia coli CFT073
gcuaauagcgcagcgg

SEQ ID NO: 2607030 - RNA, 21 nt, Escherichia coli CFT073
gcuaaucaaaucaacacguuc

SEQ ID NO: 2607031 - RNA, 23 nt, Escherichia coli CFT073
gcuaaucaucaucagcgcuuuau

SEQ ID NO: 2607032 - RNA, 17 nt, Escherichia coli CFT073
gcuaaugcagguacgca

SEQ ID NO: 2607033 - RNA, 22 nt, Escherichia coli CFT073
gcuaaugccaacguuaacgcgu

SEQ ID NO: 2607034 - RNA, 13 nt, Escherichia coli CFT073
gcuaauucaacgc

SEQ ID NO: 2607035 - RNA, 20 nt, Escherichia coli CFT073
gcuaauuugaaaugacgcuu

SEQ ID NO: 2607036 - RNA, 12 nt, Escherichia coli CFT073
gcuacaaaaugc

SEQ ID NO: 2607037 - RNA, 21 nt, Escherichia coli CFT073
gcuacacuuucugcaaacaag

SEQ ID NO: 2607038 - RNA, 21 nt, Escherichia coli CFT073
gcuacagugccccaaaugucg

SEQ ID NO: 2607039 - RNA, 15 nt, Escherichia coli CFT073
gcuacauaacgcagc

SEQ ID NO: 2607040 - RNA, 17 nt, Escherichia coli CFT073
gcuacauaacgcagcgg

SEQ ID NO: 2607041 - RNA, 21 nt, Escherichia coli CFT073
gcuaccaaaccucaugggugg

SEQ ID NO: 2607042 - RNA, 15 nt, Escherichia coli CFT073
gcuaccacuucccaa

SEQ ID NO: 2607043 - RNA, 22 nt, Escherichia coli CFT073
gcuaccagaauugaccaguaau

SEQ ID NO: 2607044 - RNA, 13 nt, Escherichia coli CFT073
gcuaccagcaaag

SEQ ID NO: 2607045 - RNA, 21 nt, Escherichia coli CFT073
gcuaccaguugaugauguuca

SEQ ID NO: 2607046 - RNA, 16 nt, Escherichia coli CFT073
gcuaccauccgcgcgc

SEQ ID NO: 2607047 - RNA, 20 nt, Escherichia coli CFT073
gcuaccaugcuaauaaucag

SEQ ID NO: 2607048 - RNA, 16 nt, Escherichia coli CFT073
gcuacccacuuccccu

SEQ ID NO: 2607049 - RNA, 13 nt, Escherichia coli CFT073
gcuacccuggcga

SEQ ID NO: 2607050 - RNA, 18 nt, Escherichia coli CFT073
gcuacccuggcgagcagc

SEQ ID NO: 2607051 - RNA, 21 nt, Escherichia coli CFT073
gcuacccuggcgagcagcaau

SEQ ID NO: 2607052 - RNA, 15 nt, Escherichia coli CFT073
gcuaccgcccugagc

SEQ ID NO: 2607053 - RNA, 20 nt, Escherichia coli CFT073
gcuaccgcccugagcaucaa

SEQ ID NO: 2607054 - RNA, 21 nt, Escherichia coli CFT073
gcuaccgcgcaggguuauuug

SEQ ID NO: 2607055 - RNA, 15 nt, Escherichia coli CFT073
gcuaccggcaaacuu

SEQ ID NO: 2607056 - RNA, 21 nt, Escherichia coli CFT073
gcuaccggcgacuuccugagc

SEQ ID NO: 2607057 - RNA, 17 nt, Escherichia coli CFT073
gcuaccggucucagccc

SEQ ID NO: 2607058 - RNA, 18 nt, Escherichia coli CFT073
gcuaccguuucaacuucu

SEQ ID NO: 2607059 - RNA, 13 nt, Escherichia coli CFT073
gcuacgcagcaug

SEQ ID NO: 2607060 - RNA, 22 nt, Escherichia coli CFT073
gcuacgccuuccgucagcaaag

SEQ ID NO: 2607061 - RNA, 17 nt, Escherichia coli CFT073
gcuacgcuuaucaggcc

SEQ ID NO: 2607062 - RNA, 20 nt, Escherichia coli CFT073
gcuacggcguuucacuucug

SEQ ID NO: 2607063 - RNA, 21 nt, Escherichia coli CFT073
gcuacggcuguaguucagaau

SEQ ID NO: 2607064 - RNA, 16 nt, Escherichia coli CFT073
gcuacguagccagauu

SEQ ID NO: 2607065 - RNA, 15 nt, Escherichia coli CFT073
gcuacguagcuguug

SEQ ID NO: 2607066 - RNA, 14 nt, Escherichia coli CFT073
gcuacgugccgggc

SEQ ID NO: 2607067 - RNA, 16 nt, Escherichia coli CFT073
gcuacguucgcgagga

SEQ ID NO: 2607068 - RNA, 18 nt, Escherichia coli CFT073
gcuacucagcuggcgggu

SEQ ID NO: 2607069 - RNA, 15 nt, Escherichia coli CFT073
gcuacuggcaauccu

SEQ ID NO: 2607070 - RNA, 13 nt, Escherichia coli CFT073
gcuagauagguca

SEQ ID NO: 2607071 - RNA, 14 nt, Escherichia coli CFT073
gcuagauauauauu

SEQ ID NO: 2607072 - RNA, 13 nt, Escherichia coli CFT073
gcuagcagcagcg

SEQ ID NO: 2607073 - RNA, 11 nt, Escherichia coli CFT073
gcuagccgcca

SEQ ID NO: 2607074 - RNA, 16 nt, Escherichia coli CFT073
gcuagcgucgcauccg

SEQ ID NO: 2607075 - RNA, 22 nt, Escherichia coli CFT073
gcuaguacaggcggcaauggcg

SEQ ID NO: 2607076 - RNA, 14 nt, Escherichia coli CFT073
gcuauacagcagcc

SEQ ID NO: 2607077 - RNA, 18 nt, Escherichia coli CFT073
gcuauaccagauaaacau

SEQ ID NO: 2607078 - RNA, 23 nt, Escherichia coli CFT073
gcucgcagaaauaccccgccagc

SEQ ID NO: 2607079 - RNA, 15 nt, Escherichia coli CFT073
gcucgccauccagug

SEQ ID NO: 2607080 - RNA, 12 nt, Escherichia coli CFT073
gcucgccauuuu

SEQ ID NO: 2607081 - RNA, 23 nt, Escherichia coli CFT073
gcucgccgcagagaucagauaau

SEQ ID NO: 2607082 - RNA, 12 nt, Escherichia coli CFT073
gcucgccgccgc

SEQ ID NO: 2607083 - RNA, 15 nt, Escherichia coli CFT073
gcucgccgccgcaga

SEQ ID NO: 2607084 - RNA, 15 nt, Escherichia coli CFT073
gcucgccuugcugcc

SEQ ID NO: 2607085 - RNA, 13 nt, Escherichia coli CFT073
gcucgcgauacgc

SEQ ID NO: 2607086 - RNA, 18 nt, Escherichia coli CFT073
gcucgcgauacgcuucaa

SEQ ID NO: 2607087 - RNA, 22 nt, Escherichia coli CFT073
gcucgcgauacgcuucaaccag

SEQ ID NO: 2607088 - RNA, 22 nt, Escherichia coli CFT073
gcucgcgccagguguuuaacca

SEQ ID NO: 2607089 - RNA, 19 nt, Escherichia coli CFT073
gcucgcgccgcauccgaca

SEQ ID NO: 2607090 - RNA, 18 nt, Escherichia coli CFT073
gcucgcgccgcauccggc

SEQ ID NO: 2607091 - RNA, 18 nt, Escherichia coli CFT073
gcucgcgguuagcggcuu

SEQ ID NO: 2607092 - RNA, 21 nt, Escherichia coli CFT073
gcucgcguucgauagcgcgcc

SEQ ID NO: 2607093 - RNA, 12 nt, Escherichia coli CFT073
gcucgcguucgg

SEQ ID NO: 2607094 - RNA, 15 nt, Escherichia coli CFT073
gcucgcguucuguca

SEQ ID NO: 2607095 - RNA, 14 nt, Escherichia coli CFT073
gcucgcuaucauuc

SEQ ID NO: 2607096 - RNA, 17 nt, Escherichia coli CFT073
gcucgcugccaucgacu

SEQ ID NO: 2607097 - RNA, 21 nt, Escherichia coli CFT073
gcucgcugccaucgacuucuc

SEQ ID NO: 2607098 - RNA, 16 nt, Escherichia coli CFT073
gcucgcuggcaggccg

SEQ ID NO: 2607099 - RNA, 15 nt, Escherichia coli CFT073
gcucggcaaacugcu

SEQ ID NO: 2607100 - RNA, 19 nt, Escherichia coli CFT073
gcucggcaaacugcugaug

SEQ ID NO: 2607101 - RNA, 22 nt, Escherichia coli CFT073
gcucggucacugacaccagcau

SEQ ID NO: 2607102 - RNA, 19 nt, Escherichia coli CFT073
gcucgucacaucaccaaca

SEQ ID NO: 2607103 - RNA, 15 nt, Escherichia coli CFT073
gcucgucauccgcua

SEQ ID NO: 2607104 - RNA, 19 nt, Escherichia coli CFT073
gcucgugcgguaucaccac

SEQ ID NO: 2607105 - RNA, 23 nt, Escherichia coli CFT073
gcucgugcgguaucaccacccag

SEQ ID NO: 2607106 - RNA, 23 nt, Escherichia coli CFT073
gcucguugguacgaucagaguug

SEQ ID NO: 2607107 - RNA, 17 nt, Escherichia coli CFT073
gcucuaaaaaguuccug

SEQ ID NO: 2607108 - RNA, 18 nt, Escherichia coli CFT073
gcucuacaauugguaaau

SEQ ID NO: 2607109 - RNA, 20 nt, Escherichia coli CFT073
gcucuauugccguaaucgcc

SEQ ID NO: 2607110 - RNA, 20 nt, Escherichia coli CFT073
gcucucacucuuucccuccu

SEQ ID NO: 2607111 - RNA, 19 nt, Escherichia coli CFT073
gcucucauccaauaacgug

SEQ ID NO: 2607112 - RNA, 14 nt, Escherichia coli CFT073
gcucucauuuuuca

SEQ ID NO: 2607113 - RNA, 21 nt, Escherichia coli CFT073
gcucucccauuuuauccucuu

SEQ ID NO: 2607114 - RNA, 15 nt, Escherichia coli CFT073
gcucucgccgcgcuc

SEQ ID NO: 2607115 - RNA, 21 nt, Escherichia coli CFT073
gcucucgccgcgcuccaucau

SEQ ID NO: 2607116 - RNA, 13 nt, Escherichia coli CFT073
gcucucuuccagu

SEQ ID NO: 2607117 - RNA, 21 nt, Escherichia coli CFT073
gcucucuuucaccagcgcgag

SEQ ID NO: 2607118 - RNA, 17 nt, Escherichia coli CFT073
gcucugaaagcggccuu

SEQ ID NO: 2607119 - RNA, 20 nt, Escherichia coli CFT073
gcucugcacuaacccucugu

SEQ ID NO: 2607120 - RNA, 21 nt, Escherichia coli CFT073
gcucugcaucccggcaggaau

SEQ ID NO: 2607121 - RNA, 22 nt, Escherichia coli CFT073
gcucugccauaaacgguuucag

SEQ ID NO: 2607122 - RNA, 13 nt, Escherichia coli CFT073
gcucugcgcccug

SEQ ID NO: 2607123 - RNA, 14 nt, Escherichia coli CFT073
gcucugcgguaucg

SEQ ID NO: 2607124 - RNA, 18 nt, Escherichia coli CFT073
gcucugcuagauaagcaa

SEQ ID NO: 2607125 - RNA, 19 nt, Escherichia coli CFT073
gcucugcugucaccgaagc

SEQ ID NO: 2607126 - RNA, 16 nt, Escherichia coli CFT073
gcucuggcaggcgacu

SEQ ID NO: 2607127 - RNA, 20 nt, Escherichia coli CFT073
gcucuggcaggcuucaauuu

SEQ ID NO: 2607128 - RNA, 15 nt, Escherichia coli CFT073
gcucuggcggcgcga

SEQ ID NO: 2607129 - RNA, 16 nt, Escherichia coli CFT073
gcucugggaucgccgg

SEQ ID NO: 2607130 - RNA, 19 nt, Escherichia coli CFT073
gcucugguuccccauucug

SEQ ID NO: 2607131 - RNA, 15 nt, Escherichia coli CFT073
gcucuguaacccugu

SEQ ID NO: 2607132 - RNA, 15 nt, Escherichia coli CFT073
gcucuguguaggccg

SEQ ID NO: 2607133 - RNA, 13 nt, Escherichia coli CFT073
gcucuguuuucug

SEQ ID NO: 2607134 - RNA, 22 nt, Escherichia coli CFT073
gcucuuaacgaaaacugacggu

SEQ ID NO: 2607135 - RNA, 20 nt, Escherichia coli CFT073
gcucuuaauacgaguuucgc

SEQ ID NO: 2607136 - RNA, 14 nt, Escherichia coli CFT073
gcucuucaacuuca

SEQ ID NO: 2607137 - RNA, 19 nt, Escherichia coli CFT073
gcucuucauacguggcaga

SEQ ID NO: 2607138 - RNA, 15 nt, Escherichia coli CFT073
gcucuucaucuucca

SEQ ID NO: 2607139 - RNA, 14 nt, Escherichia coli CFT073
gcucuucaugcagc

SEQ ID NO: 2607140 - RNA, 17 nt, Escherichia coli CFT073
gcucuucaugcagcaua

SEQ ID NO: 2607141 - RNA, 13 nt, Escherichia coli CFT073
gcucuucuucacg

SEQ ID NO: 2607142 - RNA, 14 nt, Escherichia coli CFT073
gcucuuucacuuua

SEQ ID NO: 2607143 - RNA, 19 nt, Escherichia coli CFT073
gcucuuuguaggccugaua

SEQ ID NO: 2607144 - RNA, 16 nt, Escherichia coli CFT073
gcucuuuuaacuuacg

SEQ ID NO: 2607145 - RNA, 17 nt, Escherichia coli CFT073
gcugaaaaggcuaaaau

SEQ ID NO: 2607146 - RNA, 23 nt, Escherichia coli CFT073
gcugaaacgcucgcagcccgugg

SEQ ID NO: 2607147 - RNA, 14 nt, Escherichia coli CFT073
gcugaaauguaaaa

SEQ ID NO: 2607148 - RNA, 18 nt, Escherichia coli CFT073
gcugaacacauuugucgg

SEQ ID NO: 2607149 - RNA, 17 nt, Escherichia coli CFT073
gcugaacagggcgucac

SEQ ID NO: 2607150 - RNA, 17 nt, Escherichia coli CFT073
gcugaacagucgcugau

SEQ ID NO: 2607151 - RNA, 15 nt, Escherichia coli CFT073
gcugaacgcaccuuc

SEQ ID NO: 2607152 - RNA, 12 nt, Escherichia coli CFT073
gcugaacgcagg

SEQ ID NO: 2607153 - RNA, 22 nt, Escherichia coli CFT073
gcugaacgccugcaccagccuu

SEQ ID NO: 2607154 - RNA, 17 nt, Escherichia coli CFT073
gcugaacgucgcguaau

SEQ ID NO: 2607155 - RNA, 17 nt, Escherichia coli CFT073
gcugaacgugcucugcg

SEQ ID NO: 2607156 - RNA, 17 nt, Escherichia coli CFT073
gcugaagaaaaugguuu

SEQ ID NO: 2607157 - RNA, 22 nt, Escherichia coli CFT073
gcugaagaaguaaaacagucgc

SEQ ID NO: 2607158 - RNA, 23 nt, Escherichia coli CFT073
gcugaauaauccccacaucaggc

SEQ ID NO: 2607159 - RNA, 23 nt, Escherichia coli CFT073
gcugaauaauggugaauuugucg

SEQ ID NO: 2607160 - RNA, 18 nt, Escherichia coli CFT073
gcugaauacgcaccacac

SEQ ID NO: 2607161 - RNA, 20 nt, Escherichia coli CFT073
gcugaauacgcagcgucauc

SEQ ID NO: 2607162 - RNA, 15 nt, Escherichia coli CFT073
gcugaauaucuuucu

SEQ ID NO: 2607163 - RNA, 16 nt, Escherichia coli CFT073
gcugaauaucuuucuc

SEQ ID NO: 2607164 - RNA, 19 nt, Escherichia coli CFT073
gcugaauuucaucaccagc

SEQ ID NO: 2607165 - RNA, 24 nt, Escherichia coli CFT073
gcugaauuuccugcgcuuucugcu

SEQ ID NO: 2607166 - RNA, 16 nt, Escherichia coli CFT073
gcugaauuucgccgca

SEQ ID NO: 2607167 - RNA, 23 nt, Escherichia coli CFT073
gcugaauuuuuuucucgcggcgg

SEQ ID NO: 2607168 - RNA, 16 nt, Escherichia coli CFT073
gcugacaacuccuguu

SEQ ID NO: 2607169 - RNA, 12 nt, Escherichia coli CFT073
gcugacacaucu

SEQ ID NO: 2607170 - RNA, 18 nt, Escherichia coli CFT073
gcugacaggcgcugauga

SEQ ID NO: 2607171 - RNA, 20 nt, Escherichia coli CFT073
gcugacauaaacaccagcaa

SEQ ID NO: 2607172 - RNA, 22 nt, Escherichia coli CFT073
gcugacauaaacaccagcaaua

SEQ ID NO: 2607173 - RNA, 23 nt, Escherichia coli CFT073
gcugacauaaacaccagcaauaa

SEQ ID NO: 2607174 - RNA, 19 nt, Escherichia coli CFT073
gcugacaugugauuugaug

SEQ ID NO: 2607175 - RNA, 22 nt, Escherichia coli CFT073
gcugaccagacuggagcacugc

SEQ ID NO: 2607176 - RNA, 18 nt, Escherichia coli CFT073
gcugaccgauaaccugcc

SEQ ID NO: 2607177 - RNA, 22 nt, Escherichia coli CFT073
gcugaccgcuucaucugcacgc

SEQ ID NO: 2607178 - RNA, 15 nt, Escherichia coli CFT073
gcugaccgucgcagc

SEQ ID NO: 2607179 - RNA, 20 nt, Escherichia coli CFT073
gcugacgcagcgaugguacu

SEQ ID NO: 2607180 - RNA, 17 nt, Escherichia coli CFT073
gcugacgcaucuuaucc

SEQ ID NO: 2607181 - RNA, 22 nt, Escherichia coli CFT073
gcugacgcaucuuauccagccu

SEQ ID NO: 2607182 - RNA, 19 nt, Escherichia coli CFT073
gcugacgccugccagcucu

SEQ ID NO: 2607183 - RNA, 17 nt, Escherichia coli CFT073
gcugacgcgucuuaucc

SEQ ID NO: 2607184 - RNA, 22 nt, Escherichia coli CFT073
gcugacggugauaaucauccca

SEQ ID NO: 2607185 - RNA, 16 nt, Escherichia coli CFT073
gcugacguagcagcuc

SEQ ID NO: 2607186 - RNA, 19 nt, Escherichia coli CFT073
gcugacucggcugcugcca

SEQ ID NO: 2607187 - RNA, 15 nt, Escherichia coli CFT073
gcugacugacuucaa

SEQ ID NO: 2607188 - RNA, 16 nt, Escherichia coli CFT073
gcugacuuucaaacgc

SEQ ID NO: 2607189 - RNA, 12 nt, Escherichia coli CFT073
gcugagaaaaag

SEQ ID NO: 2607190 - RNA, 22 nt, Escherichia coli CFT073
gcugagaucugccuuugccgga

SEQ ID NO: 2607191 - RNA, 21 nt, Escherichia coli CFT073
gcugagcaaacaguucugcag

SEQ ID NO: 2607192 - RNA, 15 nt, Escherichia coli CFT073
gcugagccgacgcca

SEQ ID NO: 2607193 - RNA, 23 nt, Escherichia coli CFT073
gcugagcgugccccugaauaauc

SEQ ID NO: 2607194 - RNA, 19 nt, Escherichia coli CFT073
gcugaggcguaauauaaaa

SEQ ID NO: 2607195 - RNA, 22 nt, Escherichia coli CFT073
gcugaggcguuucaacucccac

SEQ ID NO: 2607196 - RNA, 18 nt, Escherichia coli CFT073
gcugagguuaugcaaacg

SEQ ID NO: 2607197 - RNA, 18 nt, Escherichia coli CFT073
gcugagugcgaaaaucaa

SEQ ID NO: 2607198 - RNA, 23 nt, Escherichia coli CFT073
gcugagugcgaaaaucaauaaca

SEQ ID NO: 2607199 - RNA, 15 nt, Escherichia coli CFT073
gcugauaacaauauc

SEQ ID NO: 2607200 - RNA, 16 nt, Escherichia coli CFT073
gcugauaaccgccgcc

SEQ ID NO: 2607201 - RNA, 22 nt, Escherichia coli CFT073
gcugauacccggcacacaaaua

SEQ ID NO: 2607202 - RNA, 18 nt, Escherichia coli CFT073
gcugauaccgcguuggcg

SEQ ID NO: 2607203 - RNA, 13 nt, Escherichia coli CFT073
gcugauacgcgca

SEQ ID NO: 2607204 - RNA, 19 nt, Escherichia coli CFT073
gcugaucaccguagaaggc

SEQ ID NO: 2607205 - RNA, 21 nt, Escherichia coli CFT073
gcugaucaccguagaaggcga

SEQ ID NO: 2607206 - RNA, 14 nt, Escherichia coli CFT073
gcugaugcgccgcu

SEQ ID NO: 2607207 - RNA, 14 nt, Escherichia coli CFT073
gcugaugcuaccca

SEQ ID NO: 2607208 - RNA, 14 nt, Escherichia coli CFT073
gcugaugcuggcac

SEQ ID NO: 2607209 - RNA, 21 nt, Escherichia coli CFT073
gcugauggaagugacaccggu

SEQ ID NO: 2607210 - RNA, 17 nt, Escherichia coli CFT073
gcugaugugauaaugcc

SEQ ID NO: 2607211 - RNA, 23 nt, Escherichia coli CFT073
gcugauuacccacgccaacaaua

SEQ ID NO: 2607212 - RNA, 13 nt, Escherichia coli CFT073
gcugauucuuccc

SEQ ID NO: 2607213 - RNA, 14 nt, Escherichia coli CFT073
gcugauucuuccca

SEQ ID NO: 2607214 - RNA, 21 nt, Escherichia coli CFT073
gcugauugcggucagcgcagc

SEQ ID NO: 2607215 - RNA, 13 nt, Escherichia coli CFT073
gcugauuuuguug

SEQ ID NO: 2607216 - RNA, 20 nt, Escherichia coli CFT073
gcugcaaauauugccccagc

SEQ ID NO: 2607217 - RNA, 16 nt, Escherichia coli CFT073
gcugcaacagcgcggu

SEQ ID NO: 2607218 - RNA, 13 nt, Escherichia coli CFT073
gcugcaauaaaau

SEQ ID NO: 2607219 - RNA, 14 nt, Escherichia coli CFT073
gcugcacagagcua

SEQ ID NO: 2607220 - RNA, 15 nt, Escherichia coli CFT073
gcugcacagagcuau

SEQ ID NO: 2607221 - RNA, 20 nt, Escherichia coli CFT073
gcugcacauacugcaucagc

SEQ ID NO: 2607222 - RNA, 14 nt, Escherichia coli CFT073
gcugcacauccggu

SEQ ID NO: 2607223 - RNA, 22 nt, Escherichia coli CFT073
gcugcaccaacaucaugccagu

SEQ ID NO: 2607224 - RNA, 14 nt, Escherichia coli CFT073
gcugcaccagcagc

SEQ ID NO: 2607225 - RNA, 15 nt, Escherichia coli CFT073
gcugcaccagcagcg

SEQ ID NO: 2607226 - RNA, 20 nt, Escherichia coli CFT073
gcugcaccagcagcgucagc

SEQ ID NO: 2607227 - RNA, 11 nt, Escherichia coli CFT073
gcugcaccagg

SEQ ID NO: 2607228 - RNA, 15 nt, Escherichia coli CFT073
gcugcaccaguaagc

SEQ ID NO: 2607229 - RNA, 17 nt, Escherichia coli CFT073
gcugcaccccacaaaca

SEQ ID NO: 2607230 - RNA, 15 nt, Escherichia coli CFT073
gcugcacuuucagua

SEQ ID NO: 2607231 - RNA, 12 nt, Escherichia coli CFT073
gcugcaguuuac

SEQ ID NO: 2607232 - RNA, 15 nt, Escherichia coli CFT073
gcugcauacucugca

SEQ ID NO: 2607233 - RNA, 17 nt, Escherichia coli CFT073
gcugcauccugcaccac

SEQ ID NO: 2607234 - RNA, 22 nt, Escherichia coli CFT073
gcugcaucucuuugcuguugau

SEQ ID NO: 2607235 - RNA, 17 nt, Escherichia coli CFT073
gcugcauuauccucaau

SEQ ID NO: 2607236 - RNA, 13 nt, Escherichia coli CFT073
gcugcauuucugg

SEQ ID NO: 2607237 - RNA, 12 nt, Escherichia coli CFT073
gcugccacacug

SEQ ID NO: 2607238 - RNA, 13 nt, Escherichia coli CFT073
gcugccacacugc

SEQ ID NO: 2607239 - RNA, 14 nt, Escherichia coli CFT073
gcugccagaaaucg

SEQ ID NO: 2607240 - RNA, 22 nt, Escherichia coli CFT073
gcugccagaaaucggccuucca

SEQ ID NO: 2607241 - RNA, 15 nt, Escherichia coli CFT073
gcugccagaaccgcu

SEQ ID NO: 2607242 - RNA, 22 nt, Escherichia coli CFT073
gcugccagagucagcaaugcca

SEQ ID NO: 2607243 - RNA, 22 nt, Escherichia coli CFT073
gcugccaguaauuccacaccaa

SEQ ID NO: 2607244 - RNA, 17 nt, Escherichia coli CFT073
gcugccaguugucggua

SEQ ID NO: 2607245 - RNA, 18 nt, Escherichia coli CFT073
gcugccaucaauuuccgg

SEQ ID NO: 2607246 - RNA, 16 nt, Escherichia coli CFT073
gcugcccgccgcgagc

SEQ ID NO: 2607247 - RNA, 15 nt, Escherichia coli CFT073
gcugccgagcgcaag

SEQ ID NO: 2607248 - RNA, 16 nt, Escherichia coli CFT073
gcugccgcuccuucac

SEQ ID NO: 2607249 - RNA, 21 nt, Escherichia coli CFT073
gcugccggaacaggcaucacu

SEQ ID NO: 2607250 - RNA, 18 nt, Escherichia coli CFT073
gcugccggaccaucuucc

SEQ ID NO: 2607251 - RNA, 23 nt, Escherichia coli CFT073
gcugccggaccaucuuccagcug

SEQ ID NO: 2607252 - RNA, 16 nt, Escherichia coli CFT073
gcugccguagccgaug

SEQ ID NO: 2607253 - RNA, 14 nt, Escherichia coli CFT073
gcugccguuaaaga

SEQ ID NO: 2607254 - RNA, 18 nt, Escherichia coli CFT073
gcugccguucucaaaggu

SEQ ID NO: 2607255 - RNA, 15 nt, Escherichia coli CFT073
gcugccugcgccgau

SEQ ID NO: 2607256 - RNA, 20 nt, Escherichia coli CFT073
gcugccugcggcgaucuuca

SEQ ID NO: 2607257 - RNA, 19 nt, Escherichia coli CFT073
gcugccuuucgcuccggca

SEQ ID NO: 2607258 - RNA, 18 nt, Escherichia coli CFT073
gcugcgauccgcgcgggu

SEQ ID NO: 2607259 - RNA, 22 nt, Escherichia coli CFT073
gcugcgauccgcgcggguaaaa

SEQ ID NO: 2607260 - RNA, 19 nt, Escherichia coli CFT073
gcugcgcaggcaauagucg

SEQ ID NO: 2607261 - RNA, 21 nt, Escherichia coli CFT073
gcugcgcauguuuagucgcca

SEQ ID NO: 2607262 - RNA, 16 nt, Escherichia coli CFT073
gcugcgccauauaccg

SEQ ID NO: 2607263 - RNA, 13 nt, Escherichia coli CFT073
gcugcgcccaguu

SEQ ID NO: 2607264 - RNA, 11 nt, Escherichia coli CFT073
gcugcgcccgc

SEQ ID NO: 2607265 - RNA, 19 nt, Escherichia coli CFT073
gcugcgccuaacaacugcu

SEQ ID NO: 2607266 - RNA, 14 nt, Escherichia coli CFT073
gcugcgccuguggu

SEQ ID NO: 2607267 - RNA, 15 nt, Escherichia coli CFT073
gcugcgcgacggcga

SEQ ID NO: 2607268 - RNA, 18 nt, Escherichia coli CFT073
gcugcgcgauauuccgca

SEQ ID NO: 2607269 - RNA, 20 nt, Escherichia coli CFT073
gcugcgcgauauuccgcaac

SEQ ID NO: 2607270 - RNA, 18 nt, Escherichia coli CFT073
gcugcgcuucuuccagca

SEQ ID NO: 2607271 - RNA, 18 nt, Escherichia coli CFT073
gcugcgcuugcggccagc

SEQ ID NO: 2607272 - RNA, 20 nt, Escherichia coli CFT073
gcugcggcuguccggcacca

SEQ ID NO: 2607273 - RNA, 19 nt, Escherichia coli CFT073
gcugcgggaguugcuccac

SEQ ID NO: 2607274 - RNA, 21 nt, Escherichia coli CFT073
gcugcguaauucgccaccggc

SEQ ID NO: 2607275 - RNA, 15 nt, Escherichia coli CFT073
gcugcguacagcgcg

SEQ ID NO: 2607276 - RNA, 20 nt, Escherichia coli CFT073
gcugcguaguuuguccugca

SEQ ID NO: 2607277 - RNA, 16 nt, Escherichia coli CFT073
gcugcgucgcggccug

SEQ ID NO: 2607278 - RNA, 14 nt, Escherichia coli CFT073
gcugcgucuuccac

SEQ ID NO: 2607279 - RNA, 21 nt, Escherichia coli CFT073
gcugcgucuuccgcaauuccg

SEQ ID NO: 2607280 - RNA, 20 nt, Escherichia coli CFT073
gcugcguuugcccuaaagcg

SEQ ID NO: 2607281 - RNA, 23 nt, Escherichia coli CFT073
gcugcguuugcccuaaagcgcga

SEQ ID NO: 2607282 - RNA, 20 nt, Escherichia coli CFT073
gcugcguuuucacaguaauu

SEQ ID NO: 2607283 - RNA, 12 nt, Escherichia coli CFT073
gcugcuaauauu

SEQ ID NO: 2607284 - RNA, 20 nt, Escherichia coli CFT073
gcugcucacaccaugccaga

SEQ ID NO: 2607285 - RNA, 9 nt, Escherichia coli CFT073
gcugcucag

SEQ ID NO: 2607286 - RNA, 12 nt, Escherichia coli CFT073
gcugcuccagcg

SEQ ID NO: 2607287 - RNA, 14 nt, Escherichia coli CFT073
gcugcuccagcgua

SEQ ID NO: 2607288 - RNA, 15 nt, Escherichia coli CFT073
gcugcuccuuuuguu

SEQ ID NO: 2607289 - RNA, 16 nt, Escherichia coli CFT073
gcugcugaagcaacag

SEQ ID NO: 2607290 - RNA, 19 nt, Escherichia coli CFT073
gcugcugaagcaacaguaa

SEQ ID NO: 2607291 - RNA, 13 nt, Escherichia coli CFT073
gcugcugcggcga

SEQ ID NO: 2607292 - RNA, 21 nt, Escherichia coli CFT073
gcugcuggagcaggugaauca

SEQ ID NO: 2607293 - RNA, 17 nt, Escherichia coli CFT073
gcugcuggcaucaccaa

SEQ ID NO: 2607294 - RNA, 17 nt, Escherichia coli CFT073
gcuguuuguucaagcgc

SEQ ID NO: 2607295 - RNA, 19 nt, Escherichia coli CFT073
gcuguuuguucaagcgcaa

SEQ ID NO: 2607296 - RNA, 14 nt, Escherichia coli CFT073
gcuguuuucagcac

SEQ ID NO: 2607297 - RNA, 19 nt, Escherichia coli CFT073
gcuguuuuccagcaccacu

SEQ ID NO: 2607298 - RNA, 15 nt, Escherichia coli CFT073
gcuuaaauccaaacu

SEQ ID NO: 2607299 - RNA, 12 nt, Escherichia coli CFT073
gcuuaacaguuc

SEQ ID NO: 2607300 - RNA, 14 nt, Escherichia coli CFT073
gcuuaacaucccca

SEQ ID NO: 2607301 - RNA, 23 nt, Escherichia coli CFT073
gcuuaacgauuugagaucuuuaa

SEQ ID NO: 2607302 - RNA, 21 nt, Escherichia coli CFT073
gcuuaacugccauuucauaaa

SEQ ID NO: 2607303 - RNA, 16 nt, Escherichia coli CFT073
gcuuaagccaucauca

SEQ ID NO: 2607304 - RNA, 13 nt, Escherichia coli CFT073
gcuuaaugcacgg

SEQ ID NO: 2607305 - RNA, 18 nt, Escherichia coli CFT073
gcuuaauugcccaaagcc

SEQ ID NO: 2607306 - RNA, 14 nt, Escherichia coli CFT073
gcuuacacuuccuu

SEQ ID NO: 2607307 - RNA, 22 nt, Escherichia coli CFT073
gcuuacacuuccuuuacuuugc

SEQ ID NO: 2607308 - RNA, 22 nt, Escherichia coli CFT073
gcuuacaucuuuacaucauuca

SEQ ID NO: 2607309 - RNA, 16 nt, Escherichia coli CFT073
gcuuaccauccacacc

SEQ ID NO: 2607310 - RNA, 15 nt, Escherichia coli CFT073
gcuuaccaugccaac

SEQ ID NO: 2607311 - RNA, 16 nt, Escherichia coli CFT073
gcuuaccaugccaacg

SEQ ID NO: 2607312 - RNA, 22 nt, Escherichia coli CFT073
gcuuacgcaacugccaguaaag

SEQ ID NO: 2607313 - RNA, 14 nt, Escherichia coli CFT073
gcuuacggcgcugu

SEQ ID NO: 2607314 - RNA, 15 nt, Escherichia coli CFT073
gcuuacguauuucga

SEQ ID NO: 2607315 - RNA, 21 nt, Escherichia coli CFT073
gcuuacucaugaugucauaaa

SEQ ID NO: 2607316 - RNA, 18 nt, Escherichia coli CFT073
gcuuacucuucguucuuc

SEQ ID NO: 2607317 - RNA, 21 nt, Escherichia coli CFT073
gcuuacucuucguucuucuuc

SEQ ID NO: 2607318 - RNA, 15 nt, Escherichia coli CFT073
gcuuacucuuucaau

SEQ ID NO: 2607319 - RNA, 14 nt, Escherichia coli CFT073
gcuuacuggucaau

SEQ ID NO: 2607320 - RNA, 21 nt, Escherichia coli CFT073
gcuuacuugcugcucugaagu

SEQ ID NO: 2607321 - RNA, 17 nt, Escherichia coli CFT073
gcuuaggauuauuuauu

SEQ ID NO: 2607322 - RNA, 15 nt, Escherichia coli CFT073
gcuuauaacugcccg

SEQ ID NO: 2607323 - RNA, 19 nt, Escherichia coli CFT073
gcuuaucagaccuacggau

SEQ ID NO: 2607324 - RNA, 16 nt, Escherichia coli CFT073
gcuuaucaggccuaaa

SEQ ID NO: 2607325 - RNA, 16 nt, Escherichia coli CFT073
gcuuaucaggccuaca

SEQ ID NO: 2607326 - RNA, 19 nt, Escherichia coli CFT073
gcuuaucaggccuacgauc

SEQ ID NO: 2607327 - RNA, 17 nt, Escherichia coli CFT073
gcuuaucaggccugcaa

SEQ ID NO: 2607328 - RNA, 19 nt, Escherichia coli CFT073
gcuuaucgcaggcuuccug

SEQ ID NO: 2607329 - RNA, 19 nt, Escherichia coli CFT073
gcuuaucgcccugcuccag

SEQ ID NO: 2607330 - RNA, 20 nt, Escherichia coli CFT073
gcuuaucgcgauauucucgc

SEQ ID NO: 2607331 - RNA, 16 nt, Escherichia coli CFT073
gcuuaucgggccuaca

SEQ ID NO: 2607332 - RNA, 14 nt, Escherichia coli CFT073
gcuuaucuuccugu

SEQ ID NO: 2607333 - RNA, 17 nt, Escherichia coli CFT073
gcuuauucaucaauucg

SEQ ID NO: 2607334 - RNA, 18 nt, Escherichia coli CFT073
gcuuauucccuucuuucu

SEQ ID NO: 2607335 - RNA, 13 nt, Escherichia coli CFT073
gcuuauugccgga

SEQ ID NO: 2607336 - RNA, 20 nt, Escherichia coli CFT073
gcuuauugccggaugcggcg

SEQ ID NO: 2607337 - RNA, 17 nt, Escherichia coli CFT073
gcuuauuguacagcgcc

SEQ ID NO: 2607338 - RNA, 14 nt, Escherichia coli CFT073
gcuucaaaguuuug

SEQ ID NO: 2607339 - RNA, 16 nt, Escherichia coli CFT073
gcuucaacacaggccg

SEQ ID NO: 2607340 - RNA, 21 nt, Escherichia coli CFT073
gcuucaacagcggcauuacgc

SEQ ID NO: 2607341 - RNA, 17 nt, Escherichia coli CFT073
gcuucaaccagugcacc

SEQ ID NO: 2607342 - RNA, 20 nt, Escherichia coli CFT073
gcuucaaccagugcaccagc

SEQ ID NO: 2607343 - RNA, 22 nt, Escherichia coli CFT073
gcuucaaccagugcaccagcuu

SEQ ID NO: 2607344 - RNA, 19 nt, Escherichia coli CFT073
gcuucaaccguuucuuuuu

SEQ ID NO: 2607345 - RNA, 22 nt, Escherichia coli CFT073
gcuucaauacgcaucaccucac

SEQ ID NO: 2607346 - RNA, 13 nt, Escherichia coli CFT073
gcuucaauaucau

SEQ ID NO: 2607347 - RNA, 21 nt, Escherichia coli CFT073
gcuucaaucaacauauuucuc

SEQ ID NO: 2607348 - RNA, 21 nt, Escherichia coli CFT073
gcuucaaucaauaacagcgca

SEQ ID NO: 2607349 - RNA, 19 nt, Escherichia coli CFT073
gcuucaaucagcgucgcgu

SEQ ID NO: 2607350 - RNA, 12 nt, Escherichia coli CFT073
gcuucaaucuga

SEQ ID NO: 2607351 - RNA, 14 nt, Escherichia coli CFT073
gcuucaauuuuuuc

SEQ ID NO: 2607352 - RNA, 19 nt, Escherichia coli CFT073
gcuucaccgacaucuuucu

SEQ ID NO: 2607353 - RNA, 15 nt, Escherichia coli CFT073
gcuucacgcaccaua

SEQ ID NO: 2607354 - RNA, 14 nt, Escherichia coli CFT073
gcuucacgcccagc

SEQ ID NO: 2607355 - RNA, 19 nt, Escherichia coli CFT073
gcuucacgcggguugccac

SEQ ID NO: 2607356 - RNA, 21 nt, Escherichia coli CFT073
gcuucacgcggguugccaccg

SEQ ID NO: 2607357 - RNA, 20 nt, Escherichia coli CFT073
gcuucacucccugccccguc

SEQ ID NO: 2607358 - RNA, 17 nt, Escherichia coli CFT073
gcuucagauuagccgca

SEQ ID NO: 2607359 - RNA, 20 nt, Escherichia coli CFT073
gcuucagccagaggcggcaa

SEQ ID NO: 2607360 - RNA, 19 nt, Escherichia coli CFT073
gcuucagcgaucgcuuucg

SEQ ID NO: 2607361 - RNA, 23 nt, Escherichia coli CFT073
gcuucagcuugagguuggagauc

SEQ ID NO: 2607362 - RNA, 17 nt, Escherichia coli CFT073
gcuucaggaauaagaca

SEQ ID NO: 2607363 - RNA, 19 nt, Escherichia coli CFT073
gcuucauaggcuuccacuu

SEQ ID NO: 2607364 - RNA, 15 nt, Escherichia coli CFT073
gcuucaucagguuga

SEQ ID NO: 2607365 - RNA, 19 nt, Escherichia coli CFT073
gcuucaucagguugaggaa

SEQ ID NO: 2607366 - RNA, 19 nt, Escherichia coli CFT073
gcuucauccagcagcgacu

SEQ ID NO: 2607367 - RNA, 11 nt, Escherichia coli CFT073
gcuucaucgcc

SEQ ID NO: 2607368 - RNA, 15 nt, Escherichia coli CFT073
gcuucaucgcccaca

SEQ ID NO: 2607369 - RNA, 15 nt, Escherichia coli CFT073
gcuucaucugcacgc

SEQ ID NO: 2607370 - RNA, 19 nt, Escherichia coli CFT073
gcuucaucuuuaucaauca

SEQ ID NO: 2607371 - RNA, 23 nt, Escherichia coli CFT073
gcuucaucuuuaucaaucagccc

SEQ ID NO: 2607372 - RNA, 17 nt, Escherichia coli CFT073
gcuucaucuuuauucau

SEQ ID NO: 2607373 - RNA, 18 nt, Escherichia coli CFT073
gcuucauugcucucuucu

SEQ ID NO: 2607374 - RNA, 20 nt, Escherichia coli CFT073
gcuucauugcucucuucucc

SEQ ID NO: 2607375 - RNA, 13 nt, Escherichia coli CFT073
gcuuccagaaucc

SEQ ID NO: 2607376 - RNA, 18 nt, Escherichia coli CFT073
gcuuccagcaaauccauc

SEQ ID NO: 2607377 - RNA, 16 nt, Escherichia coli CFT073
gcuuccagccaugcca

SEQ ID NO: 2607378 - RNA, 13 nt, Escherichia coli CFT073
gcuuccagccggu

SEQ ID NO: 2607379 - RNA, 20 nt, Escherichia coli CFT073
gcuuccagcgucgcggucag

SEQ ID NO: 2607380 - RNA, 22 nt, Escherichia coli CFT073
gcuuccaguaacacuuccgggu

SEQ ID NO: 2607381 - RNA, 18 nt, Escherichia coli CFT073
gcuuccauauuggcgcgg

SEQ ID NO: 2607382 - RNA, 21 nt, Escherichia coli CFT073
gcuuccauauuggcgcgggcg

SEQ ID NO: 2607383 - RNA, 17 nt, Escherichia coli CFT073
gcuuccauugccugcaa

SEQ ID NO: 2607384 - RNA, 15 nt, Escherichia coli CFT073
gcuuccccaacacag

SEQ ID NO: 2607385 - RNA, 17 nt, Escherichia coli CFT073
gcuucccguagcaggaa

SEQ ID NO: 2607386 - RNA, 18 nt, Escherichia coli CFT073
gcuucccguagcaggaaa

SEQ ID NO: 2607387 - RNA, 15 nt, Escherichia coli CFT073
gcuuccgcugaaaug

SEQ ID NO: 2607388 - RNA, 16 nt, Escherichia coli CFT073
gcuuccggcaauggcu

SEQ ID NO: 2607389 - RNA, 15 nt, Escherichia coli CFT073
gcuuccggcggcggu

SEQ ID NO: 2607390 - RNA, 22 nt, Escherichia coli CFT073
gcuuccggcguggugccgauau

SEQ ID NO: 2607391 - RNA, 15 nt, Escherichia coli CFT073
gcuuccggucugcga

SEQ ID NO: 2607392 - RNA, 17 nt, Escherichia coli CFT073
gcuuccggucugcgauc

SEQ ID NO: 2607393 - RNA, 16 nt, Escherichia coli CFT073
gcuucgacuuccugca

SEQ ID NO: 2607394 - RNA, 18 nt, Escherichia coli CFT073
gcuucgagcuggaagcca

SEQ ID NO: 2607395 - RNA, 20 nt, Escherichia coli CFT073
gcuucgauaccguccaccag

SEQ ID NO: 2607396 - RNA, 20 nt, Escherichia coli CFT073
gcuucgccagcgcgcggcug

SEQ ID NO: 2607397 - RNA, 22 nt, Escherichia coli CFT073
gcuucgccagcgcgcggcuggc

SEQ ID NO: 2607398 - RNA, 21 nt, Escherichia coli CFT073
gcuucgcgaaguucuuccggc

SEQ ID NO: 2607399 - RNA, 22 nt, Escherichia coli CFT073
gcuucgcgaaguucuuccggca

SEQ ID NO: 2607400 - RNA, 12 nt, Escherichia coli CFT073
gcuucgcgcugu

SEQ ID NO: 2607401 - RNA, 19 nt, Escherichia coli CFT073
gcuucgcggacaucgucca

SEQ ID NO: 2607402 - RNA, 19 nt, Escherichia coli CFT073
gcuuuuuccaggcuggcag

SEQ ID NO: 2607403 - RNA, 19 nt, Escherichia coli CFT073
gcuuuuuccugccgcuaug

SEQ ID NO: 2607404 - RNA, 22 nt, Escherichia coli CFT073
gcuuuuucugcacacacacgcc

SEQ ID NO: 2607405 - RNA, 20 nt, Escherichia coli CFT073
gcuuuuucugcaucaaccag

SEQ ID NO: 2607406 - RNA, 17 nt, Escherichia coli CFT073
gcuuuuucugcuucugc

SEQ ID NO: 2607407 - RNA, 19 nt, Escherichia coli CFT073
gcuuuuugugggccugaua

SEQ ID NO: 2607408 - RNA, 22 nt, Escherichia coli CFT073
gcuuuuugugggccugauaaga

SEQ ID NO: 2607409 - RNA, 18 nt, Escherichia coli CFT073
gcuuuuuuacgccugcaa

SEQ ID NO: 2607410 - RNA, 20 nt, Escherichia coli CFT073
gcuuuuuuaugcaccuuuac

SEQ ID NO: 2607411 - RNA, 22 nt, Escherichia coli CFT073
gcuuuuuuauugcugcaccagc

SEQ ID NO: 2607412 - RNA, 11 nt, Escherichia coli CFT073
ggaaaaaagcc

SEQ ID NO: 2607413 - RNA, 19 nt, Escherichia coli CFT073
ggaaaaacuacccgccagu

SEQ ID NO: 2607414 - RNA, 23 nt, Escherichia coli CFT073
ggaaaaauucaggggaagccaga

SEQ ID NO: 2607415 - RNA, 12 nt, Escherichia coli CFT073
ggaaaacgugcc

SEQ ID NO: 2607416 - RNA, 16 nt, Escherichia coli CFT073
ggaaaacuuucuucag

SEQ ID NO: 2607417 - RNA, 18 nt, Escherichia coli CFT073
ggaaaaucugcgggaaca

SEQ ID NO: 2607418 - RNA, 14 nt, Escherichia coli CFT073
ggaaaaucuggcgc

SEQ ID NO: 2607419 - RNA, 18 nt, Escherichia coli CFT073
ggaaaaugaucaauaauu

SEQ ID NO: 2607420 - RNA, 16 nt, Escherichia coli CFT073
ggaaaaugccggaugg

SEQ ID NO: 2607421 - RNA, 22 nt, Escherichia coli CFT073
ggaaacagccaaucauaaacgc

SEQ ID NO: 2607422 - RNA, 18 nt, Escherichia coli CFT073
ggaaacauucaauaagcu

SEQ ID NO: 2607423 - RNA, 17 nt, Escherichia coli CFT073
ggaaaccaacuccagug

SEQ ID NO: 2607424 - RNA, 13 nt, Escherichia coli CFT073
ggaaacuccagcc

SEQ ID NO: 2607425 - RNA, 16 nt, Escherichia coli CFT073
ggaaacuggauggccu

SEQ ID NO: 2607426 - RNA, 23 nt, Escherichia coli CFT073
ggaaacugucaauaaacgccugc

SEQ ID NO: 2607427 - RNA, 19 nt, Escherichia coli CFT073
ggaaagagcaaugugaaau

SEQ ID NO: 2607428 - RNA, 12 nt, Escherichia coli CFT073
ggaaagcaacaa

SEQ ID NO: 2607429 - RNA, 14 nt, Escherichia coli CFT073
ggaaagcaccugca

SEQ ID NO: 2607430 - RNA, 15 nt, Escherichia coli CFT073
ggaaagcaccugcac

SEQ ID NO: 2607431 - RNA, 19 nt, Escherichia coli CFT073
ggaaagcagauaacccagc

SEQ ID NO: 2607432 - RNA, 23 nt, Escherichia coli CFT073
ggaaagcgaggcuuauccggcau

SEQ ID NO: 2607433 - RNA, 19 nt, Escherichia coli CFT073
ggaaagcguacccgccuga

SEQ ID NO: 2607434 - RNA, 18 nt, Escherichia coli CFT073
ggaaaggauggcgaugcu

SEQ ID NO: 2607435 - RNA, 19 nt, Escherichia coli CFT073
ggaaaguuuacgucgccag

SEQ ID NO: 2607436 - RNA, 22 nt, Escherichia coli CFT073
ggaaauaagaagccauaaucug

SEQ ID NO: 2607437 - RNA, 15 nt, Escherichia coli CFT073
ggaaaucauccagca

SEQ ID NO: 2607438 - RNA, 23 nt, Escherichia coli CFT073
ggaaaucauccagcacguuaaca

SEQ ID NO: 2607439 - RNA, 20 nt, Escherichia coli CFT073
ggaaaucaugcuccgcacgc

SEQ ID NO: 2607440 - RNA, 15 nt, Escherichia coli CFT073
ggaaaucgauaaaag

SEQ ID NO: 2607441 - RNA, 21 nt, Escherichia coli CFT073
ggaaaugggugacaucgcccu

SEQ ID NO: 2607442 - RNA, 15 nt, Escherichia coli CFT073
ggaaauuccagcggc

SEQ ID NO: 2607443 - RNA, 20 nt, Escherichia coli CFT073
ggaacaaaauuuucagcgug

SEQ ID NO: 2607444 - RNA, 19 nt, Escherichia coli CFT073
ggaacaauccucccuuacc

SEQ ID NO: 2607445 - RNA, 23 nt, Escherichia coli CFT073
ggaacacggacaauacacgcgug

SEQ ID NO: 2607446 - RNA, 19 nt, Escherichia coli CFT073
ggaacacggcuuucugcaa

SEQ ID NO: 2607447 - RNA, 11 nt, Escherichia coli CFT073
ggaacauauca

SEQ ID NO: 2607448 - RNA, 14 nt, Escherichia coli CFT073
ggaacaucagcauu

SEQ ID NO: 2607449 - RNA, 16 nt, Escherichia coli CFT073
ggaacaucgaugccgc

SEQ ID NO: 2607450 - RNA, 13 nt, Escherichia coli CFT073
ggaaccaaaugcc

SEQ ID NO: 2607451 - RNA, 16 nt, Escherichia coli CFT073
ggaaccacaaccacuu

SEQ ID NO: 2607452 - RNA, 14 nt, Escherichia coli CFT073
ggaaccacagcgcc

SEQ ID NO: 2607453 - RNA, 15 nt, Escherichia coli CFT073
ggaaccggauuuuca

SEQ ID NO: 2607454 - RNA, 17 nt, Escherichia coli CFT073
ggaaccggauuuucacc

SEQ ID NO: 2607455 - RNA, 16 nt, Escherichia coli CFT073
ggaaccugugacagca

SEQ ID NO: 2607456 - RNA, 16 nt, Escherichia coli CFT073
ggaaccuguucaacaa

SEQ ID NO: 2607457 - RNA, 21 nt, Escherichia coli CFT073
ggaacgagaacucggaagcag

SEQ ID NO: 2607458 - RNA, 20 nt, Escherichia coli CFT073
ggaacgccagcagccacgac

SEQ ID NO: 2607459 - RNA, 18 nt, Escherichia coli CFT073
ggaacgccgcugguggcg

SEQ ID NO: 2607460 - RNA, 13 nt, Escherichia coli CFT073
ggaacgcgcugca

SEQ ID NO: 2607461 - RNA, 14 nt, Escherichia coli CFT073
ggaacgcgcugcac

SEQ ID NO: 2607462 - RNA, 20 nt, Escherichia coli CFT073
ggaacgcugacugaaucagg

SEQ ID NO: 2607463 - RNA, 17 nt, Escherichia coli CFT073
ggaacggcguugcugcc

SEQ ID NO: 2607464 - RNA, 16 nt, Escherichia coli CFT073
ggaacgggagaaaccc

SEQ ID NO: 2607465 - RNA, 14 nt, Escherichia coli CFT073
ggaacuuaaccugc

SEQ ID NO: 2607466 - RNA, 21 nt, Escherichia coli CFT073
ggaacuuuuuucauccagcug

SEQ ID NO: 2607467 - RNA, 23 nt, Escherichia coli CFT073
ggaacuuuuuucauccagcugcc

SEQ ID NO: 2607468 - RNA, 18 nt, Escherichia coli CFT073
ggaagaauagucaucacu

SEQ ID NO: 2607469 - RNA, 21 nt, Escherichia coli CFT073
ggaagaccuuccagaaaaaga

SEQ ID NO: 2607470 - RNA, 17 nt, Escherichia coli CFT073
ggaagagacuauuucuu

SEQ ID NO: 2607471 - RNA, 21 nt, Escherichia coli CFT073
ggaagagcgacaaucccugca

SEQ ID NO: 2607472 - RNA, 20 nt, Escherichia coli CFT073
ggaagauuauuucgcugcgg

SEQ ID NO: 2607473 - RNA, 15 nt, Escherichia coli CFT073
ggaagcaauaagcac

SEQ ID NO: 2607474 - RNA, 15 nt, Escherichia coli CFT073
ggaagccaccacgcc

SEQ ID NO: 2607475 - RNA, 14 nt, Escherichia coli CFT073
ggaagccagacaaa

SEQ ID NO: 2607476 - RNA, 23 nt, Escherichia coli CFT073
ggaagccaucuaugccaucuucu

SEQ ID NO: 2607477 - RNA, 19 nt, Escherichia coli CFT073
ggaagccuuccgcaaacag

SEQ ID NO: 2607478 - RNA, 23 nt, Escherichia coli CFT073
ggaagccuuccgcaaacaggcgc

SEQ ID NO: 2607479 - RNA, 17 nt, Escherichia coli CFT073
ggaagcgugcaucggca

SEQ ID NO: 2607480 - RNA, 17 nt, Escherichia coli CFT073
ggaagcuaccgaccaga

SEQ ID NO: 2607481 - RNA, 15 nt, Escherichia coli CFT073
ggaagcuuauuuaua

SEQ ID NO: 2607482 - RNA, 19 nt, Escherichia coli CFT073
ggaagcuuauuuauacggc

SEQ ID NO: 2607483 - RNA, 18 nt, Escherichia coli CFT073
ggaagcuuucgcaguaga

SEQ ID NO: 2607484 - RNA, 19 nt, Escherichia coli CFT073
ggaaggguguucauccugg

SEQ ID NO: 2607485 - RNA, 15 nt, Escherichia coli CFT073
ggaaguguccaguug

SEQ ID NO: 2607486 - RNA, 13 nt, Escherichia coli CFT073
ggaaguuacucaa

SEQ ID NO: 2607487 - RNA, 14 nt, Escherichia coli CFT073
ggaauaccacuuuc

SEQ ID NO: 2607488 - RNA, 18 nt, Escherichia coli CFT073
ggaauacguugcaaauau

SEQ ID NO: 2607489 - RNA, 20 nt, Escherichia coli CFT073
ggaauagauuaugaaauuca

SEQ ID NO: 2607490 - RNA, 22 nt, Escherichia coli CFT073
ggaauagcgaagaauacgcccc

SEQ ID NO: 2607491 - RNA, 18 nt, Escherichia coli CFT073
ggaauagcucaguuggua

SEQ ID NO: 2607492 - RNA, 17 nt, Escherichia coli CFT073
ggaauagcuuuacccag

SEQ ID NO: 2607493 - RNA, 23 nt, Escherichia coli CFT073
ggaauaucaccacugaugccacu

SEQ ID NO: 2607494 - RNA, 21 nt, Escherichia coli CFT073
ggaauaucuucccgccgcuga

SEQ ID NO: 2607495 - RNA, 21 nt, Escherichia coli CFT073
ggaauaugcgccacuccacug

SEQ ID NO: 2607496 - RNA, 15 nt, Escherichia coli CFT073
ggaaucaaugugcuu

SEQ ID NO: 2607497 - RNA, 16 nt, Escherichia coli CFT073
ggaaucuuuaaugacu

SEQ ID NO: 2607498 - RNA, 19 nt, Escherichia coli CFT073
ggaaucuuuaaugacugaa

SEQ ID NO: 2607499 - RNA, 19 nt, Escherichia coli CFT073
ggaaugaccgcuaauagcg

SEQ ID NO: 2607500 - RNA, 18 nt, Escherichia coli CFT073
ggaauggaaacagcacca

SEQ ID NO: 2607501 - RNA, 12 nt, Escherichia coli CFT073
ggaauggacugu

SEQ ID NO: 2607502 - RNA, 20 nt, Escherichia coli CFT073
ggaaugucuuuugugacgac

SEQ ID NO: 2607503 - RNA, 17 nt, Escherichia coli CFT073
ggaauucaacuaacuga

SEQ ID NO: 2607504 - RNA, 16 nt, Escherichia coli CFT073
ggaauugcgcaacaga

SEQ ID NO: 2607505 - RNA, 19 nt, Escherichia coli CFT073
ggaauuguucgacugucgu

SEQ ID NO: 2607506 - RNA, 20 nt, Escherichia coli CFT073
ggaauuucaucaucacgaaa

SEQ ID NO: 2607507 - RNA, 17 nt, Escherichia coli CFT073
ggaauuuucaccacauu

SEQ ID NO: 2607508 - RNA, 19 nt, Escherichia coli CFT073
ggacaaaguaauggaaggc

SEQ ID NO: 2607509 - RNA, 23 nt, Escherichia coli CFT073
ggacaaauaaugacucaaacggu

SEQ ID NO: 2607510 - RNA, 17 nt, Escherichia coli CFT073
ggaucguggcugaguga

SEQ ID NO: 2607511 - RNA, 16 nt, Escherichia coli CFT073
ggaucguucgcugccu

SEQ ID NO: 2607512 - RNA, 13 nt, Escherichia coli CFT073
ggaucuccuccag

SEQ ID NO: 2607513 - RNA, 20 nt, Escherichia coli CFT073
ggaucugauuuucuuccagu

SEQ ID NO: 2607514 - RNA, 21 nt, Escherichia coli CFT073
ggaucugccauauccagccag

SEQ ID NO: 2607515 - RNA, 19 nt, Escherichia coli CFT073
ggaucuggauaaauaugac

SEQ ID NO: 2607516 - RNA, 19 nt, Escherichia coli CFT073
ggaucugguguucuuuuac

SEQ ID NO: 2607517 - RNA, 22 nt, Escherichia coli CFT073
ggaucuuccagcgcaucgccaa

SEQ ID NO: 2607518 - RNA, 23 nt, Escherichia coli CFT073
ggaucuuccagcgcaucgccaaa

SEQ ID NO: 2607519 - RNA, 23 nt, Escherichia coli CFT073
ggaucuuccaguucuuccgccag

SEQ ID NO: 2607520 - RNA, 16 nt, Escherichia coli CFT073
ggaucuuucaggaaca

SEQ ID NO: 2607521 - RNA, 16 nt, Escherichia coli CFT073
ggaucuuugacugaaa

SEQ ID NO: 2607522 - RNA, 14 nt, Escherichia coli CFT073
ggaugaaauccaua

SEQ ID NO: 2607523 - RNA, 13 nt, Escherichia coli CFT073
ggaugacaaaccg

SEQ ID NO: 2607524 - RNA, 17 nt, Escherichia coli CFT073
ggaugacauaaccuugc

SEQ ID NO: 2607525 - RNA, 20 nt, Escherichia coli CFT073
ggaugacccagcgccagcau

SEQ ID NO: 2607526 - RNA, 17 nt, Escherichia coli CFT073
ggaugacgaauaauugc

SEQ ID NO: 2607527 - RNA, 15 nt, Escherichia coli CFT073
ggaugacguuucgcg

SEQ ID NO: 2607528 - RNA, 22 nt, Escherichia coli CFT073
ggaugauagccaugaaaaaguu

SEQ ID NO: 2607529 - RNA, 21 nt, Escherichia coli CFT073
ggaugaucauccacgaccaga

SEQ ID NO: 2607530 - RNA, 15 nt, Escherichia coli CFT073
ggaugaucauccggc

SEQ ID NO: 2607531 - RNA, 23 nt, Escherichia coli CFT073
ggaugauuaccggagcugcagcc

SEQ ID NO: 2607532 - RNA, 15 nt, Escherichia coli CFT073
ggaugauuccgcaga

SEQ ID NO: 2607533 - RNA, 22 nt, Escherichia coli CFT073
ggaugcaaacgauuaucaacac

SEQ ID NO: 2607534 - RNA, 17 nt, Escherichia coli CFT073
ggaugcaucuucauuaa

SEQ ID NO: 2607535 - RNA, 17 nt, Escherichia coli CFT073
ggaugcccccagauugu

SEQ ID NO: 2607536 - RNA, 23 nt, Escherichia coli CFT073
ggaugcgaccagcgucguaucca

SEQ ID NO: 2607537 - RNA, 14 nt, Escherichia coli CFT073
ggaugcgccgucag

SEQ ID NO: 2607538 - RNA, 12 nt, Escherichia coli CFT073
ggaugcggcagg

SEQ ID NO: 2607539 - RNA, 11 nt, Escherichia coli CFT073
ggaugcggcgu

SEQ ID NO: 2607540 - RNA, 12 nt, Escherichia coli CFT073
ggaugcggcgug

SEQ ID NO: 2607541 - RNA, 17 nt, Escherichia coli CFT073
ggaugcggcgugauaaa

SEQ ID NO: 2607542 - RNA, 20 nt, Escherichia coli CFT073
ggaugcggugcgagcgccuu

SEQ ID NO: 2607543 - RNA, 18 nt, Escherichia coli CFT073
ggaugcgguuuauacggc

SEQ ID NO: 2607544 - RNA, 19 nt, Escherichia coli CFT073
ggaugcguuuuucggucag

SEQ ID NO: 2607545 - RNA, 17 nt, Escherichia coli CFT073
ggauggaugcccccaga

SEQ ID NO: 2607546 - RNA, 17 nt, Escherichia coli CFT073
ggauggcaacagcagcc

SEQ ID NO: 2607547 - RNA, 13 nt, Escherichia coli CFT073
ggauggcacauga

SEQ ID NO: 2607548 - RNA, 19 nt, Escherichia coli CFT073
ggauggccucugccagcug

SEQ ID NO: 2607549 - RNA, 20 nt, Escherichia coli CFT073
ggauggccugauucacgcug

SEQ ID NO: 2607550 - RNA, 19 nt, Escherichia coli CFT073
ggauggcgauacucugcca

SEQ ID NO: 2607551 - RNA, 11 nt, Escherichia coli CFT073
ggauggcggcu

SEQ ID NO: 2607552 - RNA, 19 nt, Escherichia coli CFT073
ggauggcuccgggcagggc

SEQ ID NO: 2607553 - RNA, 21 nt, Escherichia coli CFT073
ggauggucgcuugcgggcugg

SEQ ID NO: 2607554 - RNA, 23 nt, Escherichia coli CFT073
ggauggucgcuugcgggcuggcg

SEQ ID NO: 2607555 - RNA, 13 nt, Escherichia coli CFT073
ggauguugcugca

SEQ ID NO: 2607556 - RNA, 23 nt, Escherichia coli CFT073
ggauguuugcaguaaaccacauc

SEQ ID NO: 2607557 - RNA, 18 nt, Escherichia coli CFT073
ggauuaaauugcgccaga

SEQ ID NO: 2607558 - RNA, 20 nt, Escherichia coli CFT073
ggauuacccggcaucauuau

SEQ ID NO: 2607559 - RNA, 16 nt, Escherichia coli CFT073
ggauuacgcucaccaa

SEQ ID NO: 2607560 - RNA, 23 nt, Escherichia coli CFT073
ggauuagcgaccgaacaggucac

SEQ ID NO: 2607561 - RNA, 22 nt, Escherichia coli CFT073
ggauuauacgcggccugcacug

SEQ ID NO: 2607562 - RNA, 23 nt, Escherichia coli CFT073
ggauuaucaucccaguuuggauc

SEQ ID NO: 2607563 - RNA, 17 nt, Escherichia coli CFT073
ggauuaucccccgguuu

SEQ ID NO: 2607564 - RNA, 20 nt, Escherichia coli CFT073
ggauucacgccaaccagcug

SEQ ID NO: 2607565 - RNA, 22 nt, Escherichia coli CFT073
ggauucacguugaugguaggcg

SEQ ID NO: 2607566 - RNA, 13 nt, Escherichia coli CFT073
ggauucagucuua

SEQ ID NO: 2607567 - RNA, 14 nt, Escherichia coli CFT073
ggauucauacuguu

SEQ ID NO: 2607568 - RNA, 13 nt, Escherichia coli CFT073
ggauucauccggc

SEQ ID NO: 2607569 - RNA, 22 nt, Escherichia coli CFT073
ggauugcccuguuugucgauca

SEQ ID NO: 2607570 - RNA, 15 nt, Escherichia coli CFT073
ggauugccggaugcg

SEQ ID NO: 2607571 - RNA, 16 nt, Escherichia coli CFT073
ggauugcuauuuaaca

SEQ ID NO: 2607572 - RNA, 23 nt, Escherichia coli CFT073
ggauuguauugagauccugccag

SEQ ID NO: 2607573 - RNA, 15 nt, Escherichia coli CFT073
ggauuuaaugccaau

SEQ ID NO: 2607574 - RNA, 15 nt, Escherichia coli CFT073
ggauuuacuaaaacu

SEQ ID NO: 2607575 - RNA, 13 nt, Escherichia coli CFT073
ggauuugugucag

SEQ ID NO: 2607576 - RNA, 17 nt, Escherichia coli CFT073
ggauuuuauucagcaga

SEQ ID NO: 2607577 - RNA, 19 nt, Escherichia coli CFT073
ggauuuucaccaucgccau

SEQ ID NO: 2607578 - RNA, 17 nt, Escherichia coli CFT073
ggauuuugacuuuuaau

SEQ ID NO: 2607579 - RNA, 15 nt, Escherichia coli CFT073
ggauuuuuaugacgc

SEQ ID NO: 2607580 - RNA, 13 nt, Escherichia coli CFT073
ggauuuuuuauug

SEQ ID NO: 2607581 - RNA, 14 nt, Escherichia coli CFT073
ggauuuuuuuauuu

SEQ ID NO: 2607582 - RNA, 12 nt, Escherichia coli CFT073
ggcaaaaaaguc

SEQ ID NO: 2607583 - RNA, 20 nt, Escherichia coli CFT073
ggcaaaaacaaggaucgcga

SEQ ID NO: 2607584 - RNA, 20 nt, Escherichia coli CFT073
ggcaaaaacccuucuuccau

SEQ ID NO: 2607585 - RNA, 21 nt, Escherichia coli CFT073
ggcaaaaccaucaauccacuu

SEQ ID NO: 2607586 - RNA, 16 nt, Escherichia coli CFT073
ggcaaaauccuuccag

SEQ ID NO: 2607587 - RNA, 18 nt, Escherichia coli CFT073
ggcaaaauccuuccagcu

SEQ ID NO: 2607588 - RNA, 14 nt, Escherichia coli CFT073
ggcaaacaucgacu

SEQ ID NO: 2607589 - RNA, 12 nt, Escherichia coli CFT073
ggcaaacgcugg

SEQ ID NO: 2607590 - RNA, 13 nt, Escherichia coli CFT073
ggcaaacgcugga

SEQ ID NO: 2607591 - RNA, 24 nt, Escherichia coli CFT073
ggcaaacgguucgcggugcucauc

SEQ ID NO: 2607592 - RNA, 15 nt, Escherichia coli CFT073
ggcaaacugcaugaa

SEQ ID NO: 2607593 - RNA, 13 nt, Escherichia coli CFT073
ggcaaacugcuga

SEQ ID NO: 2607594 - RNA, 14 nt, Escherichia coli CFT073
ggcaaagccgucca

SEQ ID NO: 2607595 - RNA, 20 nt, Escherichia coli CFT073
ggcaaagccguccaccaccg

SEQ ID NO: 2607596 - RNA, 21 nt, Escherichia coli CFT073
ggcaaagccucccgcaacaua

SEQ ID NO: 2607597 - RNA, 19 nt, Escherichia coli CFT073
ggcaaagcgacgugcagua

SEQ ID NO: 2607598 - RNA, 14 nt, Escherichia coli CFT073
ggcaaaucaaauca

SEQ ID NO: 2607599 - RNA, 17 nt, Escherichia coli CFT073
ggcaaaugcaacauuau

SEQ ID NO: 2607600 - RNA, 19 nt, Escherichia coli CFT073
ggcaaauuggcguggcgga

SEQ ID NO: 2607601 - RNA, 19 nt, Escherichia coli CFT073
ggcaacagaacgcgccuua

SEQ ID NO: 2607602 - RNA, 15 nt, Escherichia coli CFT073
ggcaacagccaucgc

SEQ ID NO: 2607603 - RNA, 15 nt, Escherichia coli CFT073
ggcaacaucaaauac

SEQ ID NO: 2607604 - RNA, 15 nt, Escherichia coli CFT073
ggcaacaucaaauca

SEQ ID NO: 2607605 - RNA, 20 nt, Escherichia coli CFT073
ggcaaccagcagcaucacca

SEQ ID NO: 2607606 - RNA, 20 nt, Escherichia coli CFT073
ggcaaccagcggcuacugau

SEQ ID NO: 2607607 - RNA, 18 nt, Escherichia coli CFT073
ggcaacgaccgcgagcaa

SEQ ID NO: 2607608 - RNA, 21 nt, Escherichia coli CFT073
ggcaacgaccgcgagcaaaau

SEQ ID NO: 2607609 - RNA, 19 nt, Escherichia coli CFT073
ggcaacggcguuaagcaag

SEQ ID NO: 2607610 - RNA, 17 nt, Escherichia coli CFT073
ggcaacgucagucccaa

SEQ ID NO: 2607611 - RNA, 13 nt, Escherichia coli CFT073
ggcaacguuccag

SEQ ID NO: 2607612 - RNA, 20 nt, Escherichia coli CFT073
ggcaacguugaccagucaga

SEQ ID NO: 2607613 - RNA, 19 nt, Escherichia coli CFT073
ggcaagaaaaugagcauca

SEQ ID NO: 2607614 - RNA, 16 nt, Escherichia coli CFT073
ggcaagaauccgcccc

SEQ ID NO: 2607615 - RNA, 14 nt, Escherichia coli CFT073
ggcaagaucgcgau

SEQ ID NO: 2607616 - RNA, 21 nt, Escherichia coli CFT073
ggcaagaucgcgaugagucgc

SEQ ID NO: 2607617 - RNA, 13 nt, Escherichia coli CFT073
ggcaagccagcau

SEQ ID NO: 2607618 - RNA, 18 nt, Escherichia coli CFT073
ggcagcaucacgcaacau

SEQ ID NO: 2607619 - RNA, 23 nt, Escherichia coli CFT073
ggcagccagccaugcggcaucuu

SEQ ID NO: 2607620 - RNA, 21 nt, Escherichia coli CFT073
ggcagccaguucgagaaaaau

SEQ ID NO: 2607621 - RNA, 19 nt, Escherichia coli CFT073
ggcagcgggauuuccggca

SEQ ID NO: 2607622 - RNA, 17 nt, Escherichia coli CFT073
ggcagcuaaugccaacg

SEQ ID NO: 2607623 - RNA, 13 nt, Escherichia coli CFT073
ggcagcuccagca

SEQ ID NO: 2607624 - RNA, 15 nt, Escherichia coli CFT073
ggcagcucuaucugc

SEQ ID NO: 2607625 - RNA, 17 nt, Escherichia coli CFT073
ggcagcucuuucucgcu

SEQ ID NO: 2607626 - RNA, 20 nt, Escherichia coli CFT073
ggcagcuuuaccggcuucgu

SEQ ID NO: 2607627 - RNA, 16 nt, Escherichia coli CFT073
ggcaggaaaaagcgcu

SEQ ID NO: 2607628 - RNA, 19 nt, Escherichia coli CFT073
ggcaggaaaucgaguaaca

SEQ ID NO: 2607629 - RNA, 19 nt, Escherichia coli CFT073
ggcaggaaguaaaacggug

SEQ ID NO: 2607630 - RNA, 21 nt, Escherichia coli CFT073
ggcaggaaguaaaacgguggc

SEQ ID NO: 2607631 - RNA, 20 nt, Escherichia coli CFT073
ggcaggagcugagugcgaaa

SEQ ID NO: 2607632 - RNA, 13 nt, Escherichia coli CFT073
ggcaggcaaaaau

SEQ ID NO: 2607633 - RNA, 12 nt, Escherichia coli CFT073
ggcaggccaggg

SEQ ID NO: 2607634 - RNA, 20 nt, Escherichia coli CFT073
ggcaggcuucaacacaggcc

SEQ ID NO: 2607635 - RNA, 22 nt, Escherichia coli CFT073
ggcagguugagcaacaacuuca

SEQ ID NO: 2607636 - RNA, 16 nt, Escherichia coli CFT073
ggcaguaaagugaucc

SEQ ID NO: 2607637 - RNA, 21 nt, Escherichia coli CFT073
ggcaguaaaucaauauccacu

SEQ ID NO: 2607638 - RNA, 13 nt, Escherichia coli CFT073
ggcaguagcgccu

SEQ ID NO: 2607639 - RNA, 21 nt, Escherichia coli CFT073
ggcaguaucggagauaaccac

SEQ ID NO: 2607640 - RNA, 15 nt, Escherichia coli CFT073
ggcagugauuuuccc

SEQ ID NO: 2607641 - RNA, 16 nt, Escherichia coli CFT073
ggcaguguucuggcuu

SEQ ID NO: 2607642 - RNA, 18 nt, Escherichia coli CFT073
ggcaguuuuaccgccgga

SEQ ID NO: 2607643 - RNA, 20 nt, Escherichia coli CFT073
ggcaguuuuuuaacgccgcu

SEQ ID NO: 2607644 - RNA, 17 nt, Escherichia coli CFT073
ggcauaaaagggcagca

SEQ ID NO: 2607645 - RNA, 21 nt, Escherichia coli CFT073
ggcauaaaagggcagcaggau

SEQ ID NO: 2607646 - RNA, 21 nt, Escherichia coli CFT073
ggcauaaacaaagcgcacguu

SEQ ID NO: 2607647 - RNA, 16 nt, Escherichia coli CFT073
ggcauaaagcugccuu

SEQ ID NO: 2607648 - RNA, 21 nt, Escherichia coli CFT073
ggcauaaauuucaggcaacaa

SEQ ID NO: 2607649 - RNA, 13 nt, Escherichia coli CFT073
ggcauacaacgcc

SEQ ID NO: 2607650 - RNA, 19 nt, Escherichia coli CFT073
ggcauacaacgccaugaag

SEQ ID NO: 2607651 - RNA, 23 nt, Escherichia coli CFT073
ggcauacuuugauuaaccguuau

SEQ ID NO: 2607652 - RNA, 15 nt, Escherichia coli CFT073
ggcauauuuaaaaac

SEQ ID NO: 2607653 - RNA, 20 nt, Escherichia coli CFT073
ggcaucaagaaaacugguua

SEQ ID NO: 2607654 - RNA, 19 nt, Escherichia coli CFT073
ggcaucaaucgcucccagc

SEQ ID NO: 2607655 - RNA, 23 nt, Escherichia coli CFT073
ggcaucaccggaguaaagcacuu

SEQ ID NO: 2607656 - RNA, 18 nt, Escherichia coli CFT073
ggcaucacgaauccgcac

SEQ ID NO: 2607657 - RNA, 13 nt, Escherichia coli CFT073
ggcaucagcaauu

SEQ ID NO: 2607658 - RNA, 23 nt, Escherichia coli CFT073
ggcaucaggcugguguaaaaacu

SEQ ID NO: 2607659 - RNA, 14 nt, Escherichia coli CFT073
ggcaucauuauucc

SEQ ID NO: 2607660 - RNA, 22 nt, Escherichia coli CFT073
ggcauccccugccccaucugcc

SEQ ID NO: 2607661 - RNA, 19 nt, Escherichia coli CFT073
ggcauccugaucguccugc

SEQ ID NO: 2607662 - RNA, 16 nt, Escherichia coli CFT073
ggcaucgcaaaccaga

SEQ ID NO: 2607663 - RNA, 20 nt, Escherichia coli CFT073
ggcaucgccaaccaucgccg

SEQ ID NO: 2607664 - RNA, 18 nt, Escherichia coli CFT073
ggcaucggcgcacaaccg

SEQ ID NO: 2607665 - RNA, 12 nt, Escherichia coli CFT073
ggcaucuucccg

SEQ ID NO: 2607666 - RNA, 14 nt, Escherichia coli CFT073
ggcaucuucuucau

SEQ ID NO: 2607667 - RNA, 12 nt, Escherichia coli CFT073
ggcaugaaagcg

SEQ ID NO: 2607668 - RNA, 15 nt, Escherichia coli CFT073
ggcaugaagaaagua

SEQ ID NO: 2607669 - RNA, 18 nt, Escherichia coli CFT073
ggcaugaaucauggcgug

SEQ ID NO: 2607670 - RNA, 12 nt, Escherichia coli CFT073
ggcaugaccguu

SEQ ID NO: 2607671 - RNA, 22 nt, Escherichia coli CFT073
ggcaugagccgcuugugccacc

SEQ ID NO: 2607672 - RNA, 19 nt, Escherichia coli CFT073
ggcaugauaagacgcguag

SEQ ID NO: 2607673 - RNA, 12 nt, Escherichia coli CFT073
ggcaugauucau

SEQ ID NO: 2607674 - RNA, 15 nt, Escherichia coli CFT073
ggcaugcuucacuga

SEQ ID NO: 2607675 - RNA, 19 nt, Escherichia coli CFT073
ggcauguguuagcccuguc

SEQ ID NO: 2607676 - RNA, 22 nt, Escherichia coli CFT073
ggcauuacaagaaucaugccaa

SEQ ID NO: 2607677 - RNA, 18 nt, Escherichia coli CFT073
ggcauucaauuaacggcu

SEQ ID NO: 2607678 - RNA, 18 nt, Escherichia coli CFT073
ggcauucugcacauuauc

SEQ ID NO: 2607679 - RNA, 19 nt, Escherichia coli CFT073
ggcauugauucgccgccgc

SEQ ID NO: 2607680 - RNA, 19 nt, Escherichia coli CFT073
ggcauuguguagggcagcg

SEQ ID NO: 2607681 - RNA, 22 nt, Escherichia coli CFT073
ggcauuguuggaccguagacug

SEQ ID NO: 2607682 - RNA, 12 nt, Escherichia coli CFT073
ggcauuugcaac

SEQ ID NO: 2607683 - RNA, 21 nt, Escherichia coli CFT073
ggcauuuuuaucucaaaaauu

SEQ ID NO: 2607684 - RNA, 21 nt, Escherichia coli CFT073
ggcauuuuuuauggagaaaac

SEQ ID NO: 2607685 - RNA, 15 nt, Escherichia coli CFT073
ggcauuuuuuuaacc

SEQ ID NO: 2607686 - RNA, 14 nt, Escherichia coli CFT073
ggccaaaagcacaa

SEQ ID NO: 2607687 - RNA, 17 nt, Escherichia coli CFT073
ggccaaaagcuaacagc

SEQ ID NO: 2607688 - RNA, 22 nt, Escherichia coli CFT073
ggccaaacuacgcugcggcgaa

SEQ ID NO: 2607689 - RNA, 21 nt, Escherichia coli CFT073
ggccaaagcauucguaaugaa

SEQ ID NO: 2607690 - RNA, 14 nt, Escherichia coli CFT073
ggccaaagccgccg

SEQ ID NO: 2607691 - RNA, 18 nt, Escherichia coli CFT073
ggccaaagggagcagacu

SEQ ID NO: 2607692 - RNA, 17 nt, Escherichia coli CFT073
ggccaacauccaucagc

SEQ ID NO: 2607693 - RNA, 14 nt, Escherichia coli CFT073
ggccaauuuggcug

SEQ ID NO: 2607694 - RNA, 15 nt, Escherichia coli CFT073
ggccacagcgccaga

SEQ ID NO: 2607695 - RNA, 17 nt, Escherichia coli CFT073
ggccaccgcccaccaua

SEQ ID NO: 2607696 - RNA, 20 nt, Escherichia coli CFT073
ggccacgaaucagcaccgua

SEQ ID NO: 2607697 - RNA, 15 nt, Escherichia coli CFT073
ggccacgaugcacag

SEQ ID NO: 2607698 - RNA, 15 nt, Escherichia coli CFT073
ggccagacauuacaa

SEQ ID NO: 2607699 - RNA, 21 nt, Escherichia coli CFT073
ggccagauacugccgaccaga

SEQ ID NO: 2607700 - RNA, 13 nt, Escherichia coli CFT073
ggccagcauugcg

SEQ ID NO: 2607701 - RNA, 17 nt, Escherichia coli CFT073
ggccagcgccaccacca

SEQ ID NO: 2607702 - RNA, 13 nt, Escherichia coli CFT073
ggccagcggcgaa

SEQ ID NO: 2607703 - RNA, 16 nt, Escherichia coli CFT073
ggccagcguguugccg

SEQ ID NO: 2607704 - RNA, 14 nt, Escherichia coli CFT073
ggccagcuccgccg

SEQ ID NO: 2607705 - RNA, 23 nt, Escherichia coli CFT073
ggccaggaacgggauugccagca

SEQ ID NO: 2607706 - RNA, 18 nt, Escherichia coli CFT073
ggccaggcagaacgcuuu

SEQ ID NO: 2607707 - RNA, 18 nt, Escherichia coli CFT073
ggccagguuuucuuucac

SEQ ID NO: 2607708 - RNA, 21 nt, Escherichia coli CFT073
ggccagguuuucuuucaccuc

SEQ ID NO: 2607709 - RNA, 14 nt, Escherichia coli CFT073
ggccaguacgcggg

SEQ ID NO: 2607710 - RNA, 20 nt, Escherichia coli CFT073
ggccaguauuugucugccac

SEQ ID NO: 2607711 - RNA, 18 nt, Escherichia coli CFT073
ggccagucauuuucuuca

SEQ ID NO: 2607712 - RNA, 23 nt, Escherichia coli CFT073
ggccaguccccucgccccuccgg

SEQ ID NO: 2607713 - RNA, 22 nt, Escherichia coli CFT073
ggccaguccgucguucaacaag

SEQ ID NO: 2607714 - RNA, 23 nt, Escherichia coli CFT073
ggccagucgcaaaucagcggcag

SEQ ID NO: 2607715 - RNA, 23 nt, Escherichia coli CFT073
ggccagucguaaugaaucagcag

SEQ ID NO: 2607716 - RNA, 15 nt, Escherichia coli CFT073
ggccagugccagugc

SEQ ID NO: 2607717 - RNA, 22 nt, Escherichia coli CFT073
ggccaguguuuaucaucucggg

SEQ ID NO: 2607718 - RNA, 16 nt, Escherichia coli CFT073
ggccaguuugacaucg

SEQ ID NO: 2607719 - RNA, 17 nt, Escherichia coli CFT073
ggccauaaccaugcagc

SEQ ID NO: 2607720 - RNA, 14 nt, Escherichia coli CFT073
ggccauaugacacc

SEQ ID NO: 2607721 - RNA, 17 nt, Escherichia coli CFT073
ggccauccaucaacgcc

SEQ ID NO: 2607722 - RNA, 20 nt, Escherichia coli CFT073
ggccauccgcgugacgcugg

SEQ ID NO: 2607723 - RNA, 12 nt, Escherichia coli CFT073
ggccaucgccac

SEQ ID NO: 2607724 - RNA, 23 nt, Escherichia coli CFT073
ggccauugaauauuuuucgucag

SEQ ID NO: 2607725 - RNA, 17 nt, Escherichia coli CFT073
ggccauuuuuuuaccca

SEQ ID NO: 2607726 - RNA, 17 nt, Escherichia coli CFT073
ggcgaucccuaccacga

SEQ ID NO: 2607727 - RNA, 21 nt, Escherichia coli CFT073
ggcgaucgacgugggcguggg

SEQ ID NO: 2607728 - RNA, 17 nt, Escherichia coli CFT073
ggcgaucgucgccgugc

SEQ ID NO: 2607729 - RNA, 13 nt, Escherichia coli CFT073
ggcgaugcugcgu

SEQ ID NO: 2607730 - RNA, 21 nt, Escherichia coli CFT073
ggcgaugcuuugaccucccgc

SEQ ID NO: 2607731 - RNA, 13 nt, Escherichia coli CFT073
ggcgauuccacuc

SEQ ID NO: 2607732 - RNA, 20 nt, Escherichia coli CFT073
ggcgcaaaaaacuaucccau

SEQ ID NO: 2607733 - RNA, 21 nt, Escherichia coli CFT073
ggcgcaaaggcggaaacgcug

SEQ ID NO: 2607734 - RNA, 20 nt, Escherichia coli CFT073
ggcgcaacacccugaugugc

SEQ ID NO: 2607735 - RNA, 18 nt, Escherichia coli CFT073
ggcgcaaucgccagaggc

SEQ ID NO: 2607736 - RNA, 21 nt, Escherichia coli CFT073
ggcgcaaugauaucgcuggca

SEQ ID NO: 2607737 - RNA, 17 nt, Escherichia coli CFT073
ggcgcaccaguucgccg

SEQ ID NO: 2607738 - RNA, 16 nt, Escherichia coli CFT073
ggcgcaccgcauguug

SEQ ID NO: 2607739 - RNA, 14 nt, Escherichia coli CFT073
ggcgcacgcggcuc

SEQ ID NO: 2607740 - RNA, 14 nt, Escherichia coli CFT073
ggcgcagcaauuau

SEQ ID NO: 2607741 - RNA, 19 nt, Escherichia coli CFT073
ggcgcaggggcagaaacaa

SEQ ID NO: 2607742 - RNA, 19 nt, Escherichia coli CFT073
ggcgcaguugccggaugcg

SEQ ID NO: 2607743 - RNA, 21 nt, Escherichia coli CFT073
ggcgcauccaugauauuggca

SEQ ID NO: 2607744 - RNA, 21 nt, Escherichia coli CFT073
ggcgcauucgaucaccgcaga

SEQ ID NO: 2607745 - RNA, 15 nt, Escherichia coli CFT073
ggcgccgaagcgccu

SEQ ID NO: 2607746 - RNA, 22 nt, Escherichia coli CFT073
ggcgccuuuuucaguuugcuga

SEQ ID NO: 2607747 - RNA, 14 nt, Escherichia coli CFT073
ggcgcgaaauguca

SEQ ID NO: 2607748 - RNA, 18 nt, Escherichia coli CFT073
ggcgcgagcgccuuaucc

SEQ ID NO: 2607749 - RNA, 11 nt, Escherichia coli CFT073
ggcgcgccgau

SEQ ID NO: 2607750 - RNA, 21 nt, Escherichia coli CFT073
ggcgcgcggauuucggcggcu

SEQ ID NO: 2607751 - RNA, 18 nt, Escherichia coli CFT073
ggcgcggaaagcaccugc

SEQ ID NO: 2607752 - RNA, 14 nt, Escherichia coli CFT073
ggcgcggcccuggg

SEQ ID NO: 2607753 - RNA, 14 nt, Escherichia coli CFT073
ggcgcggcggcggg

SEQ ID NO: 2607754 - RNA, 11 nt, Escherichia coli CFT073
ggcgcggcggu

SEQ ID NO: 2607755 - RNA, 16 nt, Escherichia coli CFT073
ggcgcgggcaauaauc

SEQ ID NO: 2607756 - RNA, 23 nt, Escherichia coli CFT073
ggcgcgucuuauccgaccugcgg

SEQ ID NO: 2607757 - RNA, 23 nt, Escherichia coli CFT073
ggcgcguguuccagagaacgacc

SEQ ID NO: 2607758 - RNA, 19 nt, Escherichia coli CFT073
ggcgcguucggcggaugca

SEQ ID NO: 2607759 - RNA, 17 nt, Escherichia coli CFT073
ggcgcucaucaggccaa

SEQ ID NO: 2607760 - RNA, 19 nt, Escherichia coli CFT073
ggcgcuccugcgggagcgc

SEQ ID NO: 2607761 - RNA, 22 nt, Escherichia coli CFT073
ggcgcucgcgccgcauccgaca

SEQ ID NO: 2607762 - RNA, 15 nt, Escherichia coli CFT073
ggcgcugaaucccgc

SEQ ID NO: 2607763 - RNA, 15 nt, Escherichia coli CFT073
ggcgcugacgacauc

SEQ ID NO: 2607764 - RNA, 17 nt, Escherichia coli CFT073
ggcgcugaugagcaaau

SEQ ID NO: 2607765 - RNA, 12 nt, Escherichia coli CFT073
ggcgcugcucag

SEQ ID NO: 2607766 - RNA, 21 nt, Escherichia coli CFT073
ggcgcugcuggagcaggugaa

SEQ ID NO: 2607767 - RNA, 15 nt, Escherichia coli CFT073
ggcgcuggcaaaaaa

SEQ ID NO: 2607768 - RNA, 12 nt, Escherichia coli CFT073
ggcgcuggccau

SEQ ID NO: 2607769 - RNA, 18 nt, Escherichia coli CFT073
ggcgcuggccaugauuac

SEQ ID NO: 2607770 - RNA, 20 nt, Escherichia coli CFT073
ggcgcugguaaucaccaccc

SEQ ID NO: 2607771 - RNA, 18 nt, Escherichia coli CFT073
ggcgcuguuuccggcggc

SEQ ID NO: 2607772 - RNA, 17 nt, Escherichia coli CFT073
ggcgcuguuuggugcau

SEQ ID NO: 2607773 - RNA, 20 nt, Escherichia coli CFT073
ggcgcuuaucgucccaggca

SEQ ID NO: 2607774 - RNA, 14 nt, Escherichia coli CFT073
ggcgcuucggguuc

SEQ ID NO: 2607775 - RNA, 20 nt, Escherichia coli CFT073
ggcgcuucggguuccgguaa

SEQ ID NO: 2607776 - RNA, 15 nt, Escherichia coli CFT073
ggcgcuuggcuucca

SEQ ID NO: 2607777 - RNA, 14 nt, Escherichia coli CFT073
ggcgcuuuuauccu

SEQ ID NO: 2607778 - RNA, 22 nt, Escherichia coli CFT073
ggcggaacggcguugcugccag

SEQ ID NO: 2607779 - RNA, 13 nt, Escherichia coli CFT073
ggcggaugcagga

SEQ ID NO: 2607780 - RNA, 21 nt, Escherichia coli CFT073
ggcggcaaucacauccaccag

SEQ ID NO: 2607781 - RNA, 16 nt, Escherichia coli CFT073
ggcggcaaucgcugcu

SEQ ID NO: 2607782 - RNA, 14 nt, Escherichia coli CFT073
ggcggcacagccag

SEQ ID NO: 2607783 - RNA, 23 nt, Escherichia coli CFT073
ggcggcacagccagcgcaggcag

SEQ ID NO: 2607784 - RNA, 22 nt, Escherichia coli CFT073
ggcggcacaggucgcccccggc

SEQ ID NO: 2607785 - RNA, 20 nt, Escherichia coli CFT073
ggcggcagcgugccaggcgc

SEQ ID NO: 2607786 - RNA, 15 nt, Escherichia coli CFT073
ggcggcaggccuaac

SEQ ID NO: 2607787 - RNA, 16 nt, Escherichia coli CFT073
ggcggcaguauuuuua

SEQ ID NO: 2607788 - RNA, 12 nt, Escherichia coli CFT073
ggcggcggcaca

SEQ ID NO: 2607789 - RNA, 18 nt, Escherichia coli CFT073
ggcggcguuuugucgccg

SEQ ID NO: 2607790 - RNA, 14 nt, Escherichia coli CFT073
ggcggcucaccugc

SEQ ID NO: 2607791 - RNA, 14 nt, Escherichia coli CFT073
ggcggcugacaugc

SEQ ID NO: 2607792 - RNA, 12 nt, Escherichia coli CFT073
ggcgggaaaaau

SEQ ID NO: 2607793 - RNA, 13 nt, Escherichia coli CFT073
ggcgggagaaaug

SEQ ID NO: 2607794 - RNA, 22 nt, Escherichia coli CFT073
ggcggguuaaccagcaccagcu

SEQ ID NO: 2607795 - RNA, 12 nt, Escherichia coli CFT073
ggcggucuggcg

SEQ ID NO: 2607796 - RNA, 19 nt, Escherichia coli CFT073
ggcggucuguauuuggcug

SEQ ID NO: 2607797 - RNA, 17 nt, Escherichia coli CFT073
ggcggugacuagcagca

SEQ ID NO: 2607798 - RNA, 15 nt, Escherichia coli CFT073
ggcggugcuugcuca

SEQ ID NO: 2607799 - RNA, 19 nt, Escherichia coli CFT073
ggcgguuucgcaaaccaaa

SEQ ID NO: 2607800 - RNA, 14 nt, Escherichia coli CFT073
ggcgguuuggccag

SEQ ID NO: 2607801 - RNA, 18 nt, Escherichia coli CFT073
ggcgguuuggccagucgc

SEQ ID NO: 2607802 - RNA, 12 nt, Escherichia coli CFT073
ggcguaaacgcc

SEQ ID NO: 2607803 - RNA, 20 nt, Escherichia coli CFT073
ggcguaauauaaaauauugc

SEQ ID NO: 2607804 - RNA, 14 nt, Escherichia coli CFT073
ggcguacagcuggc

SEQ ID NO: 2607805 - RNA, 13 nt, Escherichia coli CFT073
ggcguaccgcaca

SEQ ID NO: 2607806 - RNA, 21 nt, Escherichia coli CFT073
ggcguagagaucccccgcaca

SEQ ID NO: 2607807 - RNA, 18 nt, Escherichia coli CFT073
ggcguauauugguaggcu

SEQ ID NO: 2607808 - RNA, 13 nt, Escherichia coli CFT073
ggcguaucuccag

SEQ ID NO: 2607809 - RNA, 16 nt, Escherichia coli CFT073
ggcguauuuaaugaca

SEQ ID NO: 2607810 - RNA, 21 nt, Escherichia coli CFT073
ggcgucaauuugcuccgccag

SEQ ID NO: 2607811 - RNA, 22 nt, Escherichia coli CFT073
ggcgucagcgcaaauggugguu

SEQ ID NO: 2607812 - RNA, 13 nt, Escherichia coli CFT073
ggcgucagcggcu

SEQ ID NO: 2607813 - RNA, 22 nt, Escherichia coli CFT073
ggcgucaguagcguaaaggcug

SEQ ID NO: 2607814 - RNA, 14 nt, Escherichia coli CFT073
ggcguccaccugcg

SEQ ID NO: 2607815 - RNA, 11 nt, Escherichia coli CFT073
ggcgucccaga

SEQ ID NO: 2607816 - RNA, 23 nt, Escherichia coli CFT073
ggcgucgaaaauaucgagcagcu

SEQ ID NO: 2607817 - RNA, 18 nt, Escherichia coli CFT073
ggcgucgaucucuuccac

SEQ ID NO: 2607818 - RNA, 22 nt, Escherichia coli CFT073
ggcgucgauugcucaacaccgu

SEQ ID NO: 2607819 - RNA, 23 nt, Escherichia coli CFT073
ggcgucguucgccagucuccagg

SEQ ID NO: 2607820 - RNA, 21 nt, Escherichia coli CFT073
ggcgucuaaaucguaccagga

SEQ ID NO: 2607821 - RNA, 19 nt, Escherichia coli CFT073
ggcgucuuguugaacagac

SEQ ID NO: 2607822 - RNA, 15 nt, Escherichia coli CFT073
ggcgugaaagaaaau

SEQ ID NO: 2607823 - RNA, 12 nt, Escherichia coli CFT073
ggcgugaacacc

SEQ ID NO: 2607824 - RNA, 18 nt, Escherichia coli CFT073
ggcgugaacaccuuaucc

SEQ ID NO: 2607825 - RNA, 17 nt, Escherichia coli CFT073
ggcgugcaucucuucaa

SEQ ID NO: 2607826 - RNA, 16 nt, Escherichia coli CFT073
ggcguggugcagccgc

SEQ ID NO: 2607827 - RNA, 19 nt, Escherichia coli CFT073
ggcguguuauugccgagaa

SEQ ID NO: 2607828 - RNA, 23 nt, Escherichia coli CFT073
ggcguguugauacacaccgagcg

SEQ ID NO: 2607829 - RNA, 18 nt, Escherichia coli CFT073
ggcguuaacaauaagauu

SEQ ID NO: 2607830 - RNA, 21 nt, Escherichia coli CFT073
ggcguuaauauaaacgacagc

SEQ ID NO: 2607831 - RNA, 15 nt, Escherichia coli CFT073
ggcguuaauauuucc

SEQ ID NO: 2607832 - RNA, 14 nt, Escherichia coli CFT073
ggcguuacagcugg

SEQ ID NO: 2607833 - RNA, 15 nt, Escherichia coli CFT073
ggcguuacagcugga

SEQ ID NO: 2607834 - RNA, 22 nt, Escherichia coli CFT073
gggaaggcccuuucccuucuug

SEQ ID NO: 2607835 - RNA, 19 nt, Escherichia coli CFT073
gggaagggucuuuuaaauc

SEQ ID NO: 2607836 - RNA, 17 nt, Escherichia coli CFT073
gggaaggucagguuuga

SEQ ID NO: 2607837 - RNA, 14 nt, Escherichia coli CFT073
gggaagugcgccca

SEQ ID NO: 2607838 - RNA, 22 nt, Escherichia coli CFT073
gggaauaguacauuguuuucca

SEQ ID NO: 2607839 - RNA, 18 nt, Escherichia coli CFT073
gggaaucgauaacugcuc

SEQ ID NO: 2607840 - RNA, 18 nt, Escherichia coli CFT073
gggacaugauacgccugc

SEQ ID NO: 2607841 - RNA, 12 nt, Escherichia coli CFT073
gggacauuuagc

SEQ ID NO: 2607842 - RNA, 13 nt, Escherichia coli CFT073
gggacgcugcacg

SEQ ID NO: 2607843 - RNA, 15 nt, Escherichia coli CFT073
gggagaaugccagca

SEQ ID NO: 2607844 - RNA, 18 nt, Escherichia coli CFT073
gggagaauuaacagguau

SEQ ID NO: 2607845 - RNA, 16 nt, Escherichia coli CFT073
gggagauaaaaucgag

SEQ ID NO: 2607846 - RNA, 18 nt, Escherichia coli CFT073
gggaggcugcauuaucca

SEQ ID NO: 2607847 - RNA, 15 nt, Escherichia coli CFT073
gggaguugaucgcca

SEQ ID NO: 2607848 - RNA, 17 nt, Escherichia coli CFT073
gggaguuggaguaaaac

SEQ ID NO: 2607849 - RNA, 15 nt, Escherichia coli CFT073
gggauaaagccccca

SEQ ID NO: 2607850 - RNA, 19 nt, Escherichia coli CFT073
gggauaaagcccccacaac

SEQ ID NO: 2607851 - RNA, 21 nt, Escherichia coli CFT073
gggauacaagccacaucgcca

SEQ ID NO: 2607852 - RNA, 20 nt, Escherichia coli CFT073
gggauauaugucaccagcau

SEQ ID NO: 2607853 - RNA, 21 nt, Escherichia coli CFT073
gggauauaugucaccagcauu

SEQ ID NO: 2607854 - RNA, 14 nt, Escherichia coli CFT073
gggauaugguggua

SEQ ID NO: 2607855 - RNA, 20 nt, Escherichia coli CFT073
gggaucauccacccgcagca

SEQ ID NO: 2607856 - RNA, 18 nt, Escherichia coli CFT073
gggaucgacgcccagcgc

SEQ ID NO: 2607857 - RNA, 22 nt, Escherichia coli CFT073
gggaucgccggaauaucaccac

SEQ ID NO: 2607858 - RNA, 18 nt, Escherichia coli CFT073
gggaucguagccuuguaa

SEQ ID NO: 2607859 - RNA, 19 nt, Escherichia coli CFT073
gggaugaagcaacugguua

SEQ ID NO: 2607860 - RNA, 22 nt, Escherichia coli CFT073
gggaugcucuuuacgcacguaa

SEQ ID NO: 2607861 - RNA, 19 nt, Escherichia coli CFT073
gggauguaauuaagcgcaa

SEQ ID NO: 2607862 - RNA, 21 nt, Escherichia coli CFT073
gggauucacguugaugguagg

SEQ ID NO: 2607863 - RNA, 13 nt, Escherichia coli CFT073
gggcaaaaucauc

SEQ ID NO: 2607864 - RNA, 16 nt, Escherichia coli CFT073
gggcaaagucuucacg

SEQ ID NO: 2607865 - RNA, 17 nt, Escherichia coli CFT073
gggcaaccucuggugug

SEQ ID NO: 2607866 - RNA, 21 nt, Escherichia coli CFT073
gggcaaccucuggugugcguu

SEQ ID NO: 2607867 - RNA, 21 nt, Escherichia coli CFT073
gggcaacggccaaaagcacaa

SEQ ID NO: 2607868 - RNA, 19 nt, Escherichia coli CFT073
gggcaagcaccuaaaucca

SEQ ID NO: 2607869 - RNA, 20 nt, Escherichia coli CFT073
gggcaagcaccuaaauccac

SEQ ID NO: 2607870 - RNA, 21 nt, Escherichia coli CFT073
gggcaagcaccuaaauccacc

SEQ ID NO: 2607871 - RNA, 17 nt, Escherichia coli CFT073
gggcaauaaucuuuaca

SEQ ID NO: 2607872 - RNA, 19 nt, Escherichia coli CFT073
gggcaccaguaaaacgggc

SEQ ID NO: 2607873 - RNA, 13 nt, Escherichia coli CFT073
gggcaccgccgcc

SEQ ID NO: 2607874 - RNA, 16 nt, Escherichia coli CFT073
gggcaccgccgccacu

SEQ ID NO: 2607875 - RNA, 13 nt, Escherichia coli CFT073
gggcagaaacaac

SEQ ID NO: 2607876 - RNA, 15 nt, Escherichia coli CFT073
gggcagacgccccug

SEQ ID NO: 2607877 - RNA, 18 nt, Escherichia coli CFT073
gggcagcaauagcaaagc

SEQ ID NO: 2607878 - RNA, 12 nt, Escherichia coli CFT073
gggcaggcgugu

SEQ ID NO: 2607879 - RNA, 23 nt, Escherichia coli CFT073
gggcaggcuucaacacaggccgg

SEQ ID NO: 2607880 - RNA, 20 nt, Escherichia coli CFT073
gggcaggugacaccaccgcc

SEQ ID NO: 2607881 - RNA, 22 nt, Escherichia coli CFT073
gggcagugcucguagaagccag

SEQ ID NO: 2607882 - RNA, 21 nt, Escherichia coli CFT073
gggcauccacaguaagccggu

SEQ ID NO: 2607883 - RNA, 15 nt, Escherichia coli CFT073
gggcauccagacgug

SEQ ID NO: 2607884 - RNA, 19 nt, Escherichia coli CFT073
gggcaucgcaaccacacag

SEQ ID NO: 2607885 - RNA, 13 nt, Escherichia coli CFT073
gggcaugaacaaa

SEQ ID NO: 2607886 - RNA, 16 nt, Escherichia coli CFT073
gggcauugaaaauuac

SEQ ID NO: 2607887 - RNA, 19 nt, Escherichia coli CFT073
gggcauuuuuuccaggggc

SEQ ID NO: 2607888 - RNA, 18 nt, Escherichia coli CFT073
gggccagcgcauccauua

SEQ ID NO: 2607889 - RNA, 15 nt, Escherichia coli CFT073
gggccuccugcagcg

SEQ ID NO: 2607890 - RNA, 12 nt, Escherichia coli CFT073
gggccugaacaa

SEQ ID NO: 2607891 - RNA, 23 nt, Escherichia coli CFT073
gggcgaaaccauauuaaauggcc

SEQ ID NO: 2607892 - RNA, 22 nt, Escherichia coli CFT073
gggcgaacgagauaauggcaau

SEQ ID NO: 2607893 - RNA, 20 nt, Escherichia coli CFT073
gggcgaaucaacuccagaau

SEQ ID NO: 2607894 - RNA, 17 nt, Escherichia coli CFT073
gggcgacaaucaucgcc

SEQ ID NO: 2607895 - RNA, 22 nt, Escherichia coli CFT073
gggcgagcuuauauacucuaaa

SEQ ID NO: 2607896 - RNA, 16 nt, Escherichia coli CFT073
gggcgagguccagcuc

SEQ ID NO: 2607897 - RNA, 19 nt, Escherichia coli CFT073
gggcgauaaaucguuucca

SEQ ID NO: 2607898 - RNA, 20 nt, Escherichia coli CFT073
gggcgauuaauaaaauuauc

SEQ ID NO: 2607899 - RNA, 22 nt, Escherichia coli CFT073
gggcgauuuucuacuucuuuca

SEQ ID NO: 2607900 - RNA, 22 nt, Escherichia coli CFT073
gggcgcaaaaacauugccggaa

SEQ ID NO: 2607901 - RNA, 18 nt, Escherichia coli CFT073
gggcgcggaaagcaccug

SEQ ID NO: 2607902 - RNA, 18 nt, Escherichia coli CFT073
gggcgcuuccagccaugc

SEQ ID NO: 2607903 - RNA, 13 nt, Escherichia coli CFT073
gggcgggaaaaga

SEQ ID NO: 2607904 - RNA, 19 nt, Escherichia coli CFT073
gggcgggaaaagaaauauc

SEQ ID NO: 2607905 - RNA, 18 nt, Escherichia coli CFT073
gggcguuuccacgcccca

SEQ ID NO: 2607906 - RNA, 16 nt, Escherichia coli CFT073
gggcuaugcgcaucaa

SEQ ID NO: 2607907 - RNA, 21 nt, Escherichia coli CFT073
gggcugacauuaucagacacc

SEQ ID NO: 2607908 - RNA, 21 nt, Escherichia coli CFT073
gggcugacguuaagaaaacgg

SEQ ID NO: 2607909 - RNA, 13 nt, Escherichia coli CFT073
gggcuggaaacgc

SEQ ID NO: 2607910 - RNA, 22 nt, Escherichia coli CFT073
gggcuggcauuuuuuauggcug

SEQ ID NO: 2607911 - RNA, 19 nt, Escherichia coli CFT073
gggcuggccaauuggcugg

SEQ ID NO: 2607912 - RNA, 11 nt, Escherichia coli CFT073
gggcugguugg

SEQ ID NO: 2607913 - RNA, 19 nt, Escherichia coli CFT073
gggcuuaaugagauaauca

SEQ ID NO: 2607914 - RNA, 15 nt, Escherichia coli CFT073
gggcuuauauaggug

SEQ ID NO: 2607915 - RNA, 18 nt, Escherichia coli CFT073
gggcuuccggcaauggcu

SEQ ID NO: 2607916 - RNA, 18 nt, Escherichia coli CFT073
gggcuuuauucaccagua

SEQ ID NO: 2607917 - RNA, 22 nt, Escherichia coli CFT073
gggcuuucucgcgcccaaccag

SEQ ID NO: 2607918 - RNA, 17 nt, Escherichia coli CFT073
gggcuuuuuuauuucau

SEQ ID NO: 2607919 - RNA, 19 nt, Escherichia coli CFT073
ggggaaacccacgaccagu

SEQ ID NO: 2607920 - RNA, 18 nt, Escherichia coli CFT073
ggggcacuguagcucgcc

SEQ ID NO: 2607921 - RNA, 15 nt, Escherichia coli CFT073
ggggcauuuuccagu

SEQ ID NO: 2607922 - RNA, 14 nt, Escherichia coli CFT073
ggggccagcgcauc

SEQ ID NO: 2607923 - RNA, 21 nt, Escherichia coli CFT073
ggggcgaccugugccgccgcc

SEQ ID NO: 2607924 - RNA, 15 nt, Escherichia coli CFT073
gggggagagccagca

SEQ ID NO: 2607925 - RNA, 13 nt, Escherichia coli CFT073
gggguuacgaccu

SEQ ID NO: 2607926 - RNA, 18 nt, Escherichia coli CFT073
gggguuucucuuucagcg

SEQ ID NO: 2607927 - RNA, 22 nt, Escherichia coli CFT073
gggguuucucuuucagcgccag

SEQ ID NO: 2607928 - RNA, 15 nt, Escherichia coli CFT073
ggguaaaaccauuuu

SEQ ID NO: 2607929 - RNA, 21 nt, Escherichia coli CFT073
ggguaaaaccccgcguacuga

SEQ ID NO: 2607930 - RNA, 17 nt, Escherichia coli CFT073
ggguaaacaccaccgaa

SEQ ID NO: 2607931 - RNA, 19 nt, Escherichia coli CFT073
ggguaaacacccaggccau

SEQ ID NO: 2607932 - RNA, 19 nt, Escherichia coli CFT073
ggguaacacucuauccagc

SEQ ID NO: 2607933 - RNA, 22 nt, Escherichia coli CFT073
ggguaaccagccaaauaaaauc

SEQ ID NO: 2607934 - RNA, 23 nt, Escherichia coli CFT073
ggguaaucagcuuauccagcaac

SEQ ID NO: 2607935 - RNA, 22 nt, Escherichia coli CFT073
gggucagcggcggcucuuuugc

SEQ ID NO: 2607936 - RNA, 18 nt, Escherichia coli CFT073
gggucaguugccagacgg

SEQ ID NO: 2607937 - RNA, 22 nt, Escherichia coli CFT073
gggucaguuucaccucuccggg

SEQ ID NO: 2607938 - RNA, 13 nt, Escherichia coli CFT073
gggucaucagcau

SEQ ID NO: 2607939 - RNA, 15 nt, Escherichia coli CFT073
gggucaucgcccugu

SEQ ID NO: 2607940 - RNA, 23 nt, Escherichia coli CFT073
gggucgcaaacaacgccacacgc

SEQ ID NO: 2607941 - RNA, 20 nt, Escherichia coli CFT073
ggucgaaaauaucgguuccg

SEQ ID NO: 2607942 - RNA, 14 nt, Escherichia coli CFT073
ggucgaugcacucg

SEQ ID NO: 2607943 - RNA, 17 nt, Escherichia coli CFT073
ggucgauugucgcggcu

SEQ ID NO: 2607944 - RNA, 16 nt, Escherichia coli CFT073
ggucgccagaagguga

SEQ ID NO: 2607945 - RNA, 15 nt, Escherichia coli CFT073
ggucgccccggaacg

SEQ ID NO: 2607946 - RNA, 11 nt, Escherichia coli CFT073
ggucgcccugu

SEQ ID NO: 2607947 - RNA, 13 nt, Escherichia coli CFT073
ggucgcgcggaag

SEQ ID NO: 2607948 - RNA, 18 nt, Escherichia coli CFT073
ggucgcucgagccgcauc

SEQ ID NO: 2607949 - RNA, 23 nt, Escherichia coli CFT073
ggucgcucgagccgcauccgaca

SEQ ID NO: 2607950 - RNA, 22 nt, Escherichia coli CFT073
ggucgcugucuuucaacagaua

SEQ ID NO: 2607951 - RNA, 14 nt, Escherichia coli CFT073
ggucggaaucccau

SEQ ID NO: 2607952 - RNA, 16 nt, Escherichia coli CFT073
ggucggauaaggcguu

SEQ ID NO: 2607953 - RNA, 17 nt, Escherichia coli CFT073
ggucggguauacagaaa

SEQ ID NO: 2607954 - RNA, 14 nt, Escherichia coli CFT073
ggucggguuaagcc

SEQ ID NO: 2607955 - RNA, 21 nt, Escherichia coli CFT073
ggucgugcgguuucagcucac

SEQ ID NO: 2607956 - RNA, 23 nt, Escherichia coli CFT073
ggucguggguucaucgagcagca

SEQ ID NO: 2607957 - RNA, 15 nt, Escherichia coli CFT073
ggucuccugaccguu

SEQ ID NO: 2607958 - RNA, 22 nt, Escherichia coli CFT073
ggucugacgcugaauacgcacc

SEQ ID NO: 2607959 - RNA, 14 nt, Escherichia coli CFT073
ggucugccaacuuu

SEQ ID NO: 2607960 - RNA, 23 nt, Escherichia coli CFT073
ggucugcgacuguucgccaaaag

SEQ ID NO: 2607961 - RNA, 22 nt, Escherichia coli CFT073
ggucuuucuuuuuuucacuuuc

SEQ ID NO: 2607962 - RNA, 13 nt, Escherichia coli CFT073
ggugaaaagagcg

SEQ ID NO: 2607963 - RNA, 19 nt, Escherichia coli CFT073
ggugaaagcaaaaaagaag

SEQ ID NO: 2607964 - RNA, 17 nt, Escherichia coli CFT073
ggugaacgccaccaacg

SEQ ID NO: 2607965 - RNA, 22 nt, Escherichia coli CFT073
ggugaagguaaguuguugauaa

SEQ ID NO: 2607966 - RNA, 18 nt, Escherichia coli CFT073
ggugaagugguugagugu

SEQ ID NO: 2607967 - RNA, 23 nt, Escherichia coli CFT073
ggugaaguuuugucgcugauucg

SEQ ID NO: 2607968 - RNA, 17 nt, Escherichia coli CFT073
ggugaaucaagcgccga

SEQ ID NO: 2607969 - RNA, 23 nt, Escherichia coli CFT073
ggugaauucaguaccagcaccug

SEQ ID NO: 2607970 - RNA, 16 nt, Escherichia coli CFT073
ggugacaagugccugu

SEQ ID NO: 2607971 - RNA, 13 nt, Escherichia coli CFT073
ggugacaucgccc

SEQ ID NO: 2607972 - RNA, 13 nt, Escherichia coli CFT073
ggugaccugcaau

SEQ ID NO: 2607973 - RNA, 20 nt, Escherichia coli CFT073
ggugacgccacaacgauaau

SEQ ID NO: 2607974 - RNA, 17 nt, Escherichia coli CFT073
ggugacgcuggcagcag

SEQ ID NO: 2607975 - RNA, 14 nt, Escherichia coli CFT073
ggugacuagcagca

SEQ ID NO: 2607976 - RNA, 19 nt, Escherichia coli CFT073
ggugacuggcuuaauaauu

SEQ ID NO: 2607977 - RNA, 21 nt, Escherichia coli CFT073
ggugagcacaucagcgcccuc

SEQ ID NO: 2607978 - RNA, 14 nt, Escherichia coli CFT073
ggugagucuggaag

SEQ ID NO: 2607979 - RNA, 12 nt, Escherichia coli CFT073
ggugauaaaccc

SEQ ID NO: 2607980 - RNA, 15 nt, Escherichia coli CFT073
ggugauaagcgaggc

SEQ ID NO: 2607981 - RNA, 20 nt, Escherichia coli CFT073
ggugauaaucaucccacaug

SEQ ID NO: 2607982 - RNA, 23 nt, Escherichia coli CFT073
ggugauaaucaucccacaugaau

SEQ ID NO: 2607983 - RNA, 22 nt, Escherichia coli CFT073
ggugauacugaucgucaucaaa

SEQ ID NO: 2607984 - RNA, 15 nt, Escherichia coli CFT073
ggugauauuuucacu

SEQ ID NO: 2607985 - RNA, 16 nt, Escherichia coli CFT073
ggugaucgugcgcgcc

SEQ ID NO: 2607986 - RNA, 17 nt, Escherichia coli CFT073
ggugaugaccacagaca

SEQ ID NO: 2607987 - RNA, 13 nt, Escherichia coli CFT073
ggugaugagcagg

SEQ ID NO: 2607988 - RNA, 14 nt, Escherichia coli CFT073
ggugaugguuucau

SEQ ID NO: 2607989 - RNA, 14 nt, Escherichia coli CFT073
ggugauuaaauuca

SEQ ID NO: 2607990 - RNA, 20 nt, Escherichia coli CFT073
ggugauuaaauucaggccgu

SEQ ID NO: 2607991 - RNA, 22 nt, Escherichia coli CFT073
ggugauuaagccaaagcgccgu

SEQ ID NO: 2607992 - RNA, 14 nt, Escherichia coli CFT073
ggugcaagccgcgg

SEQ ID NO: 2607993 - RNA, 17 nt, Escherichia coli CFT073
ggugcaccgcauccggc

SEQ ID NO: 2607994 - RNA, 22 nt, Escherichia coli CFT073
ggugcaccuuguuucagcacga

SEQ ID NO: 2607995 - RNA, 15 nt, Escherichia coli CFT073
ggugcagaaucaauc

SEQ ID NO: 2607996 - RNA, 17 nt, Escherichia coli CFT073
ggugcaggcgcucacca

SEQ ID NO: 2607997 - RNA, 22 nt, Escherichia coli CFT073
ggugcaucggggaauugugcuu

SEQ ID NO: 2607998 - RNA, 18 nt, Escherichia coli CFT073
ggugccagcgccagcacu

SEQ ID NO: 2607999 - RNA, 23 nt, Escherichia coli CFT073
ggugccaucauacagccagcaau

SEQ ID NO: 2608000 - RNA, 21 nt, Escherichia coli CFT073
ggugcccgcauagcccagcgc

SEQ ID NO: 2608001 - RNA, 21 nt, Escherichia coli CFT073
ggugcccugacaccaucaccc

SEQ ID NO: 2608002 - RNA, 20 nt, Escherichia coli CFT073
ggugccgccacgaaacugcu

SEQ ID NO: 2608003 - RNA, 19 nt, Escherichia coli CFT073
ggugccgccgucagacgcg

SEQ ID NO: 2608004 - RNA, 13 nt, Escherichia coli CFT073
ggugccuuaccgc

SEQ ID NO: 2608005 - RNA, 17 nt, Escherichia coli CFT073
ggugcgaccaaacugcu

SEQ ID NO: 2608006 - RNA, 18 nt, Escherichia coli CFT073
ggugcgaccaaacugcuc

SEQ ID NO: 2608007 - RNA, 17 nt, Escherichia coli CFT073
ggugcgagagcggaggu

SEQ ID NO: 2608008 - RNA, 17 nt, Escherichia coli CFT073
ggugcgcaccaggcgug

SEQ ID NO: 2608009 - RNA, 18 nt, Escherichia coli CFT073
ggugcgcguggcaauugc

SEQ ID NO: 2608010 - RNA, 21 nt, Escherichia coli CFT073
ggugcgggaguugaucgccag

SEQ ID NO: 2608011 - RNA, 15 nt, Escherichia coli CFT073
ggugcguugaagaua

SEQ ID NO: 2608012 - RNA, 15 nt, Escherichia coli CFT073
ggugcucauuagccc

SEQ ID NO: 2608013 - RNA, 19 nt, Escherichia coli CFT073
ggugcucauuagcccggca

SEQ ID NO: 2608014 - RNA, 16 nt, Escherichia coli CFT073
ggugcuguuuucuccc

SEQ ID NO: 2608015 - RNA, 14 nt, Escherichia coli CFT073
gguggcaaagaaau

SEQ ID NO: 2608016 - RNA, 16 nt, Escherichia coli CFT073
gguggcaaagaaauca

SEQ ID NO: 2608017 - RNA, 14 nt, Escherichia coli CFT073
gguggccaaauuca

SEQ ID NO: 2608018 - RNA, 23 nt, Escherichia coli CFT073
gguggcgauugaagcagcgcugg

SEQ ID NO: 2608019 - RNA, 19 nt, Escherichia coli CFT073
gguggcgauugucggcgcu

SEQ ID NO: 2608020 - RNA, 16 nt, Escherichia coli CFT073
gguggcguacagcugg

SEQ ID NO: 2608021 - RNA, 15 nt, Escherichia coli CFT073
ggugggcgaauacgg

SEQ ID NO: 2608022 - RNA, 24 nt, Escherichia coli CFT073
ggugggugauuaaauucaggccgu

SEQ ID NO: 2608023 - RNA, 14 nt, Escherichia coli CFT073
ggugguaucgauca

SEQ ID NO: 2608024 - RNA, 17 nt, Escherichia coli CFT073
ggugguaucgaucacuu

SEQ ID NO: 2608025 - RNA, 15 nt, Escherichia coli CFT073
gguggucgcaucauc

SEQ ID NO: 2608026 - RNA, 14 nt, Escherichia coli CFT073
gguguaaucggcuc

SEQ ID NO: 2608027 - RNA, 21 nt, Escherichia coli CFT073
gguguagccaauuaagucaac

SEQ ID NO: 2608028 - RNA, 16 nt, Escherichia coli CFT073
ggugucaauccuucuu

SEQ ID NO: 2608029 - RNA, 18 nt, Escherichia coli CFT073
ggugucacggugucggua

SEQ ID NO: 2608030 - RNA, 13 nt, Escherichia coli CFT073
ggugucaucgaca

SEQ ID NO: 2608031 - RNA, 21 nt, Escherichia coli CFT073
ggugucuaacgaugccagcgc

SEQ ID NO: 2608032 - RNA, 12 nt, Escherichia coli CFT073
gguguucacgcc

SEQ ID NO: 2608033 - RNA, 22 nt, Escherichia coli CFT073
gguguucauccuggcacagcag

SEQ ID NO: 2608034 - RNA, 16 nt, Escherichia coli CFT073
gguguuuaaccaacac

SEQ ID NO: 2608035 - RNA, 17 nt, Escherichia coli CFT073
gguuaaaucaggaaaac

SEQ ID NO: 2608036 - RNA, 16 nt, Escherichia coli CFT073
gguuaaauugaaauuu

SEQ ID NO: 2608037 - RNA, 12 nt, Escherichia coli CFT073
gguuaaccagca

SEQ ID NO: 2608038 - RNA, 12 nt, Escherichia coli CFT073
gguuaacgcagg

SEQ ID NO: 2608039 - RNA, 16 nt, Escherichia coli CFT073
gguuaaucggcaggga

SEQ ID NO: 2608040 - RNA, 18 nt, Escherichia coli CFT073
gguuacaccgcgcgucau

SEQ ID NO: 2608041 - RNA, 15 nt, Escherichia coli CFT073
gguuaccaguacacc

SEQ ID NO: 2608042 - RNA, 23 nt, Escherichia coli CFT073
gguuaccgaauccagcaagcugu

SEQ ID NO: 2608043 - RNA, 16 nt, Escherichia coli CFT073
gguuaccgccagcacc

SEQ ID NO: 2608044 - RNA, 16 nt, Escherichia coli CFT073
gguuacgcgcaguuuc

SEQ ID NO: 2608045 - RNA, 14 nt, Escherichia coli CFT073
gguuacucccggau

SEQ ID NO: 2608046 - RNA, 15 nt, Escherichia coli CFT073
gguuacucuguucau

SEQ ID NO: 2608047 - RNA, 20 nt, Escherichia coli CFT073
gguuagcaaccgccgcugcu

SEQ ID NO: 2608048 - RNA, 11 nt, Escherichia coli CFT073
gguuagccugu

SEQ ID NO: 2608049 - RNA, 19 nt, Escherichia coli CFT073
guaaagacuauccgccaua

SEQ ID NO: 2608050 - RNA, 17 nt, Escherichia coli CFT073
guaaagcaauaaaccau

SEQ ID NO: 2608051 - RNA, 13 nt, Escherichia coli CFT073
guaaagcccgcca

SEQ ID NO: 2608052 - RNA, 21 nt, Escherichia coli CFT073
guaaagcccgccaucgcccau

SEQ ID NO: 2608053 - RNA, 13 nt, Escherichia coli CFT073
guaaagccgauua

SEQ ID NO: 2608054 - RNA, 18 nt, Escherichia coli CFT073
guaaagccugcuggcagc

SEQ ID NO: 2608055 - RNA, 17 nt, Escherichia coli CFT073
guaaagcgcggcaguga

SEQ ID NO: 2608056 - RNA, 15 nt, Escherichia coli CFT073
guaaaguaacgaaua

SEQ ID NO: 2608057 - RNA, 21 nt, Escherichia coli CFT073
guaaauacugcgcauggaagc

SEQ ID NO: 2608058 - RNA, 17 nt, Escherichia coli CFT073
guaaauaguauuauucu

SEQ ID NO: 2608059 - RNA, 18 nt, Escherichia coli CFT073
guaaauaugccccacaga

SEQ ID NO: 2608060 - RNA, 18 nt, Escherichia coli CFT073
guaaaucaugcuccugua

SEQ ID NO: 2608061 - RNA, 22 nt, Escherichia coli CFT073
guaaaucggacuggguccggug

SEQ ID NO: 2608062 - RNA, 21 nt, Escherichia coli CFT073
guaaaucuucaagcaucggcg

SEQ ID NO: 2608063 - RNA, 16 nt, Escherichia coli CFT073
guaaaugcgaauagcg

SEQ ID NO: 2608064 - RNA, 14 nt, Escherichia coli CFT073
guaaaugcuuuaua

SEQ ID NO: 2608065 - RNA, 17 nt, Escherichia coli CFT073
guaaauugcaguacgau

SEQ ID NO: 2608066 - RNA, 15 nt, Escherichia coli CFT073
guaaauugccccaga

SEQ ID NO: 2608067 - RNA, 19 nt, Escherichia coli CFT073
guaaauugugcuuauuuua

SEQ ID NO: 2608068 - RNA, 20 nt, Escherichia coli CFT073
guaaauuuuuugaucaaucu

SEQ ID NO: 2608069 - RNA, 13 nt, Escherichia coli CFT073
guaacaauaaacg

SEQ ID NO: 2608070 - RNA, 17 nt, Escherichia coli CFT073
guaacaccuguaaaguc

SEQ ID NO: 2608071 - RNA, 18 nt, Escherichia coli CFT073
guaacacucgugcgucgc

SEQ ID NO: 2608072 - RNA, 15 nt, Escherichia coli CFT073
guaacagcggacggc

SEQ ID NO: 2608073 - RNA, 21 nt, Escherichia coli CFT073
guaacaguaguuacgcggaga

SEQ ID NO: 2608074 - RNA, 22 nt, Escherichia coli CFT073
guaaccaaacguggucgccagc

SEQ ID NO: 2608075 - RNA, 17 nt, Escherichia coli CFT073
guaaccaccagcacuga

SEQ ID NO: 2608076 - RNA, 18 nt, Escherichia coli CFT073
guaaccaccagcacugau

SEQ ID NO: 2608077 - RNA, 16 nt, Escherichia coli CFT073
guaaccaccgcaggca

SEQ ID NO: 2608078 - RNA, 22 nt, Escherichia coli CFT073
guaaccagccguuauguugauu

SEQ ID NO: 2608079 - RNA, 12 nt, Escherichia coli CFT073
guaacccugugg

SEQ ID NO: 2608080 - RNA, 17 nt, Escherichia coli CFT073
guaaccugcgaaaauca

SEQ ID NO: 2608081 - RNA, 17 nt, Escherichia coli CFT073
guaacgaacacgaauca

SEQ ID NO: 2608082 - RNA, 15 nt, Escherichia coli CFT073
guaacgacaggccug

SEQ ID NO: 2608083 - RNA, 17 nt, Escherichia coli CFT073
guaacgacaggccugau

SEQ ID NO: 2608084 - RNA, 17 nt, Escherichia coli CFT073
guaacgacugacuuucg

SEQ ID NO: 2608085 - RNA, 19 nt, Escherichia coli CFT073
guaacgaguacaaaaauaa

SEQ ID NO: 2608086 - RNA, 22 nt, Escherichia coli CFT073
guaacgaucgcccggcaccagc

SEQ ID NO: 2608087 - RNA, 19 nt, Escherichia coli CFT073
guaacgauggcaauuuuca

SEQ ID NO: 2608088 - RNA, 23 nt, Escherichia coli CFT073
guaacgauggcgauucagcaaca

SEQ ID NO: 2608089 - RNA, 18 nt, Escherichia coli CFT073
guaacgccuuucaggugg

SEQ ID NO: 2608090 - RNA, 17 nt, Escherichia coli CFT073
guaacgcgcuaccaacc

SEQ ID NO: 2608091 - RNA, 15 nt, Escherichia coli CFT073
guaacgcggauaaac

SEQ ID NO: 2608092 - RNA, 19 nt, Escherichia coli CFT073
guaacgcucccuggaucac

SEQ ID NO: 2608093 - RNA, 20 nt, Escherichia coli CFT073
guaacgucgcaucuggucag

SEQ ID NO: 2608094 - RNA, 17 nt, Escherichia coli CFT073
guaacgugccauagcgg

SEQ ID NO: 2608095 - RNA, 19 nt, Escherichia coli CFT073
guaacuaccguacauugcc

SEQ ID NO: 2608096 - RNA, 20 nt, Escherichia coli CFT073
guaacucaggaugagaaaag

SEQ ID NO: 2608097 - RNA, 15 nt, Escherichia coli CFT073
guaacucauugccag

SEQ ID NO: 2608098 - RNA, 14 nt, Escherichia coli CFT073
guaacucgauuuua

SEQ ID NO: 2608099 - RNA, 20 nt, Escherichia coli CFT073
guaacugccuuucccuuucu

SEQ ID NO: 2608100 - RNA, 11 nt, Escherichia coli CFT073
guaacugcgcc

SEQ ID NO: 2608101 - RNA, 22 nt, Escherichia coli CFT073
guaacugcuguaguccaggccu

SEQ ID NO: 2608102 - RNA, 15 nt, Escherichia coli CFT073
guaacugcuugaauu

SEQ ID NO: 2608103 - RNA, 14 nt, Escherichia coli CFT073
guaacuggcgcagu

SEQ ID NO: 2608104 - RNA, 20 nt, Escherichia coli CFT073
guaacuggugacuuuugccc

SEQ ID NO: 2608105 - RNA, 11 nt, Escherichia coli CFT073
guaacugucgg

SEQ ID NO: 2608106 - RNA, 21 nt, Escherichia coli CFT073
guaacugucuucaccauaguu

SEQ ID NO: 2608107 - RNA, 19 nt, Escherichia coli CFT073
guaacuuucuccgguuggu

SEQ ID NO: 2608108 - RNA, 14 nt, Escherichia coli CFT073
guaacuuuugccca

SEQ ID NO: 2608109 - RNA, 20 nt, Escherichia coli CFT073
guaacuuuugcccauaugca

SEQ ID NO: 2608110 - RNA, 14 nt, Escherichia coli CFT073
guaagaaaggcaga

SEQ ID NO: 2608111 - RNA, 14 nt, Escherichia coli CFT073
guaagaaccacagc

SEQ ID NO: 2608112 - RNA, 15 nt, Escherichia coli CFT073
guaagagaacagaua

SEQ ID NO: 2608113 - RNA, 23 nt, Escherichia coli CFT073
guaagcaaacagagcaaaacgca

SEQ ID NO: 2608114 - RNA, 18 nt, Escherichia coli CFT073
guaagcagauucuucgau

SEQ ID NO: 2608115 - RNA, 23 nt, Escherichia coli CFT073
guaagcauuaaguguaaucagcc

SEQ ID NO: 2608116 - RNA, 13 nt, Escherichia coli CFT073
guaagcccaggga

SEQ ID NO: 2608117 - RNA, 18 nt, Escherichia coli CFT073
guaagcccuuaagaaaac

SEQ ID NO: 2608118 - RNA, 15 nt, Escherichia coli CFT073
guaagccgcaaccac

SEQ ID NO: 2608119 - RNA, 16 nt, Escherichia coli CFT073
guaagccgccgccauc

SEQ ID NO: 2608120 - RNA, 18 nt, Escherichia coli CFT073
guaagccgguaaucacca

SEQ ID NO: 2608121 - RNA, 23 nt, Escherichia coli CFT073
guaagccgguaaucaccagcaac

SEQ ID NO: 2608122 - RNA, 13 nt, Escherichia coli CFT073
guaagccucuuuc

SEQ ID NO: 2608123 - RNA, 23 nt, Escherichia coli CFT073
guaagcgauaaaaauaccgagca

SEQ ID NO: 2608124 - RNA, 14 nt, Escherichia coli CFT073
guaagcgauaacgc

SEQ ID NO: 2608125 - RNA, 22 nt, Escherichia coli CFT073
guaagcgggcaauaucgcggca

SEQ ID NO: 2608126 - RNA, 17 nt, Escherichia coli CFT073
guaaggauaaaaaaggg

SEQ ID NO: 2608127 - RNA, 23 nt, Escherichia coli CFT073
guaaggauauucauuaauaacca

SEQ ID NO: 2608128 - RNA, 17 nt, Escherichia coli CFT073
guaaggcaucuucuuca

SEQ ID NO: 2608129 - RNA, 19 nt, Escherichia coli CFT073
guaaggccaaauaccggcg

SEQ ID NO: 2608130 - RNA, 20 nt, Escherichia coli CFT073
guaagguaacgcugcccgcc

SEQ ID NO: 2608131 - RNA, 14 nt, Escherichia coli CFT073
guaaguaagauaaa

SEQ ID NO: 2608132 - RNA, 15 nt, Escherichia coli CFT073
guaaguacgccaucg

SEQ ID NO: 2608133 - RNA, 20 nt, Escherichia coli CFT073
guaaguuaccggcaaugguu

SEQ ID NO: 2608134 - RNA, 21 nt, Escherichia coli CFT073
guaauaacccgucagcagauc

SEQ ID NO: 2608135 - RNA, 20 nt, Escherichia coli CFT073
guaauaagggggcuuuugug

SEQ ID NO: 2608136 - RNA, 12 nt, Escherichia coli CFT073
guaauagccuga

SEQ ID NO: 2608137 - RNA, 14 nt, Escherichia coli CFT073
guaauagccugaug

SEQ ID NO: 2608138 - RNA, 19 nt, Escherichia coli CFT073
guaauauauaacagaaggu

SEQ ID NO: 2608139 - RNA, 22 nt, Escherichia coli CFT073
guaauaugugcgccacgcagcg

SEQ ID NO: 2608140 - RNA, 17 nt, Escherichia coli CFT073
guaauauuguaauacaa

SEQ ID NO: 2608141 - RNA, 22 nt, Escherichia coli CFT073
guaaucaacgccgggccuguua

SEQ ID NO: 2608142 - RNA, 13 nt, Escherichia coli CFT073
guaaucaccagca

SEQ ID NO: 2608143 - RNA, 14 nt, Escherichia coli CFT073
guaaucagccccgg

SEQ ID NO: 2608144 - RNA, 21 nt, Escherichia coli CFT073
guaaucaguucguugaucaac

SEQ ID NO: 2608145 - RNA, 12 nt, Escherichia coli CFT073
guaaucaugaac

SEQ ID NO: 2608146 - RNA, 13 nt, Escherichia coli CFT073
guaauccagcguc

SEQ ID NO: 2608147 - RNA, 14 nt, Escherichia coli CFT073
guaauccagcgucg

SEQ ID NO: 2608148 - RNA, 18 nt, Escherichia coli CFT073
guaauccgccuguugccc

SEQ ID NO: 2608149 - RNA, 17 nt, Escherichia coli CFT073
guaauccguaugacaaa

SEQ ID NO: 2608150 - RNA, 17 nt, Escherichia coli CFT073
guaauccugcaaauuca

SEQ ID NO: 2608151 - RNA, 14 nt, Escherichia coli CFT073
guaauccuguaucu

SEQ ID NO: 2608152 - RNA, 11 nt, Escherichia coli CFT073
guaaucgaugg

SEQ ID NO: 2608153 - RNA, 14 nt, Escherichia coli CFT073
guaaucgccagcaa

SEQ ID NO: 2608154 - RNA, 18 nt, Escherichia coli CFT073
guaaucgccuuuuuucac

SEQ ID NO: 2608155 - RNA, 15 nt, Escherichia coli CFT073
guaaucgguuuuaac

SEQ ID NO: 2608156 - RNA, 15 nt, Escherichia coli CFT073
guaaucugcaccagg

SEQ ID NO: 2608157 - RNA, 15 nt, Escherichia coli CFT073
guacguuaacagccu

SEQ ID NO: 2608158 - RNA, 15 nt, Escherichia coli CFT073
guacuacgcgccgcc

SEQ ID NO: 2608159 - RNA, 22 nt, Escherichia coli CFT073
guacuacgcgccgccagccaca

SEQ ID NO: 2608160 - RNA, 14 nt, Escherichia coli CFT073
guacucaccaacgc

SEQ ID NO: 2608161 - RNA, 15 nt, Escherichia coli CFT073
guacucaccaacgca

SEQ ID NO: 2608162 - RNA, 21 nt, Escherichia coli CFT073
guacucgcacuuuucccacua

SEQ ID NO: 2608163 - RNA, 22 nt, Escherichia coli CFT073
guacucggcuacgaaccgagcg

SEQ ID NO: 2608164 - RNA, 22 nt, Escherichia coli CFT073
guacucuucaauggcaucacgc

SEQ ID NO: 2608165 - RNA, 22 nt, Escherichia coli CFT073
guacugaccaucagcagcggca

SEQ ID NO: 2608166 - RNA, 24 nt, Escherichia coli CFT073
guacugaccgucgccuucaacgua

SEQ ID NO: 2608167 - RNA, 18 nt, Escherichia coli CFT073
guacuggcaaucgccagc

SEQ ID NO: 2608168 - RNA, 21 nt, Escherichia coli CFT073
guacuggcaaucgccagcggc

SEQ ID NO: 2608169 - RNA, 22 nt, Escherichia coli CFT073
guacuggcaaucgccagcggca

SEQ ID NO: 2608170 - RNA, 16 nt, Escherichia coli CFT073
guacugguaagcaaag

SEQ ID NO: 2608171 - RNA, 21 nt, Escherichia coli CFT073
guacuuaaaacucacccugau

SEQ ID NO: 2608172 - RNA, 13 nt, Escherichia coli CFT073
guacuuaacugcc

SEQ ID NO: 2608173 - RNA, 14 nt, Escherichia coli CFT073
guacuuuaaaauaa

SEQ ID NO: 2608174 - RNA, 22 nt, Escherichia coli CFT073
guagaaccgguugccgguagcu

SEQ ID NO: 2608175 - RNA, 22 nt, Escherichia coli CFT073
guagacaccaaggaacugugca

SEQ ID NO: 2608176 - RNA, 13 nt, Escherichia coli CFT073
guagacagcaucg

SEQ ID NO: 2608177 - RNA, 14 nt, Escherichia coli CFT073
guagacauaaccgg

SEQ ID NO: 2608178 - RNA, 11 nt, Escherichia coli CFT073
guagacuuagc

SEQ ID NO: 2608179 - RNA, 15 nt, Escherichia coli CFT073
guagagagauuaaug

SEQ ID NO: 2608180 - RNA, 14 nt, Escherichia coli CFT073
guagagaucgagcg

SEQ ID NO: 2608181 - RNA, 15 nt, Escherichia coli CFT073
guagagauuuuuccc

SEQ ID NO: 2608182 - RNA, 19 nt, Escherichia coli CFT073
guagagcagcacgcaguga

SEQ ID NO: 2608183 - RNA, 22 nt, Escherichia coli CFT073
guagauuucguugugucgccag

SEQ ID NO: 2608184 - RNA, 23 nt, Escherichia coli CFT073
guagcaacgauaacaaucaccaa

SEQ ID NO: 2608185 - RNA, 15 nt, Escherichia coli CFT073
guagcagcagcgcca

SEQ ID NO: 2608186 - RNA, 20 nt, Escherichia coli CFT073
guagcagcagcgccaggcac

SEQ ID NO: 2608187 - RNA, 12 nt, Escherichia coli CFT073
guagcaggaaau

SEQ ID NO: 2608188 - RNA, 19 nt, Escherichia coli CFT073
guagcaggccggagacgac

SEQ ID NO: 2608189 - RNA, 19 nt, Escherichia coli CFT073
guagcagguaaucugccau

SEQ ID NO: 2608190 - RNA, 18 nt, Escherichia coli CFT073
guagcaugaacauugcug

SEQ ID NO: 2608191 - RNA, 20 nt, Escherichia coli CFT073
guagcaugaacauugcugcu

SEQ ID NO: 2608192 - RNA, 20 nt, Escherichia coli CFT073
guagccaaucccggaagcca

SEQ ID NO: 2608193 - RNA, 18 nt, Escherichia coli CFT073
guagccagcugccugcca

SEQ ID NO: 2608194 - RNA, 18 nt, Escherichia coli CFT073
guagccccagucuuccug

SEQ ID NO: 2608195 - RNA, 15 nt, Escherichia coli CFT073
guagcccuucagcuu

SEQ ID NO: 2608196 - RNA, 17 nt, Escherichia coli CFT073
guagccgauccgcguca

SEQ ID NO: 2608197 - RNA, 16 nt, Escherichia coli CFT073
guagccgccaaacgcc

SEQ ID NO: 2608198 - RNA, 22 nt, Escherichia coli CFT073
guagccucugcguuauuuucag

SEQ ID NO: 2608199 - RNA, 17 nt, Escherichia coli CFT073
guagccuuuuucagccg

SEQ ID NO: 2608200 - RNA, 21 nt, Escherichia coli CFT073
guagccuuuuuuaauauuuca

SEQ ID NO: 2608201 - RNA, 15 nt, Escherichia coli CFT073
guagcgcagcagaua

SEQ ID NO: 2608202 - RNA, 21 nt, Escherichia coli CFT073
guagcgcauuucauggcggaa

SEQ ID NO: 2608203 - RNA, 14 nt, Escherichia coli CFT073
guagcgugauuuug

SEQ ID NO: 2608204 - RNA, 23 nt, Escherichia coli CFT073
guagcuaaacugaucuuuaucaa

SEQ ID NO: 2608205 - RNA, 20 nt, Escherichia coli CFT073
guagcuaccuugcucggcgc

SEQ ID NO: 2608206 - RNA, 16 nt, Escherichia coli CFT073
guagcucaaacuggcu

SEQ ID NO: 2608207 - RNA, 16 nt, Escherichia coli CFT073
guagcucaccagcagg

SEQ ID NO: 2608208 - RNA, 18 nt, Escherichia coli CFT073
guagcucaccagcaggca

SEQ ID NO: 2608209 - RNA, 14 nt, Escherichia coli CFT073
guagcucaucuuca

SEQ ID NO: 2608210 - RNA, 17 nt, Escherichia coli CFT073
guagcucaucuucauaa

SEQ ID NO: 2608211 - RNA, 20 nt, Escherichia coli CFT073
guagcucaucuucauaacuu

SEQ ID NO: 2608212 - RNA, 14 nt, Escherichia coli CFT073
guagcucuggguaa

SEQ ID NO: 2608213 - RNA, 23 nt, Escherichia coli CFT073
guagcugaaaaucagauccgcac

SEQ ID NO: 2608214 - RNA, 13 nt, Escherichia coli CFT073
guagcuggcggca

SEQ ID NO: 2608215 - RNA, 20 nt, Escherichia coli CFT073
  misc_feature (7)..(7): n is a, c, g or u
guagcungcaggauaaacgc

SEQ ID NO: 2608216 - RNA, 21 nt, Escherichia coli CFT073
  misc_feature (7)..(7): n is a, c, g or u
guagcungcaggauaaacgcc

SEQ ID NO: 2608217 - RNA, 19 nt, Escherichia coli CFT073
guaggccagauaagacgcg

SEQ ID NO: 2608218 - RNA, 22 nt, Escherichia coli CFT073
guaggccagauaagacgcguca

SEQ ID NO: 2608219 - RNA, 19 nt, Escherichia coli CFT073
guaggccagauaaggcguu

SEQ ID NO: 2608220 - RNA, 19 nt, Escherichia coli CFT073
guaggccggagaaggcguu

SEQ ID NO: 2608221 - RNA, 16 nt, Escherichia coli CFT073
guaggccggauaaggc

SEQ ID NO: 2608222 - RNA, 19 nt, Escherichia coli CFT073
guaggccggauaagguguu

SEQ ID NO: 2608223 - RNA, 17 nt, Escherichia coli CFT073
guaggccugagaagcgc

SEQ ID NO: 2608224 - RNA, 12 nt, Escherichia coli CFT073
guaggccugaua

SEQ ID NO: 2608225 - RNA, 19 nt, Escherichia coli CFT073
guaggccugauaagacgcg

SEQ ID NO: 2608226 - RNA, 22 nt, Escherichia coli CFT073
guaggucauaucgaccagcgca

SEQ ID NO: 2608227 - RNA, 23 nt, Escherichia coli CFT073
guaggucgcauaaggugcgaccu

SEQ ID NO: 2608228 - RNA, 19 nt, Escherichia coli CFT073
guaggucggauaagacgcg

SEQ ID NO: 2608229 - RNA, 19 nt, Escherichia coli CFT073
guaggucggauaaggcguu

SEQ ID NO: 2608230 - RNA, 16 nt, Escherichia coli CFT073
guaguacgcgggaaua

SEQ ID NO: 2608231 - RNA, 16 nt, Escherichia coli CFT073
guagucaauuuuucag

SEQ ID NO: 2608232 - RNA, 14 nt, Escherichia coli CFT073
guagucaggaagcc

SEQ ID NO: 2608233 - RNA, 17 nt, Escherichia coli CFT073
guaguccaggccugauu

SEQ ID NO: 2608234 - RNA, 19 nt, Escherichia coli CFT073
guaguccggauaaggcguu

SEQ ID NO: 2608235 - RNA, 16 nt, Escherichia coli CFT073
guagucggacaaacac

SEQ ID NO: 2608236 - RNA, 15 nt, Escherichia coli CFT073
guagucugaccucuu

SEQ ID NO: 2608237 - RNA, 21 nt, Escherichia coli CFT073
guagugauaccccgcaucgug

SEQ ID NO: 2608238 - RNA, 22 nt, Escherichia coli CFT073
guagugauccugcauacugaca

SEQ ID NO: 2608239 - RNA, 15 nt, Escherichia coli CFT073
guaguguaaaugcaa

SEQ ID NO: 2608240 - RNA, 17 nt, Escherichia coli CFT073
guaguguaaaugcaaau

SEQ ID NO: 2608241 - RNA, 20 nt, Escherichia coli CFT073
guaguguuuuauaccaacaa

SEQ ID NO: 2608242 - RNA, 14 nt, Escherichia coli CFT073
guaguuccagcaug

SEQ ID NO: 2608243 - RNA, 23 nt, Escherichia coli CFT073
guaguugugugggucuaaaaaca

SEQ ID NO: 2608244 - RNA, 20 nt, Escherichia coli CFT073
guaguuugaugagaacacca

SEQ ID NO: 2608245 - RNA, 13 nt, Escherichia coli CFT073
guauaaaggguau

SEQ ID NO: 2608246 - RNA, 12 nt, Escherichia coli CFT073
guauaacacacc

SEQ ID NO: 2608247 - RNA, 15 nt, Escherichia coli CFT073
guauaacacaucccg

SEQ ID NO: 2608248 - RNA, 16 nt, Escherichia coli CFT073
guauaacucgccuuca

SEQ ID NO: 2608249 - RNA, 14 nt, Escherichia coli CFT073
guauaauauacagc

SEQ ID NO: 2608250 - RNA, 18 nt, Escherichia coli CFT073
guauaccgaaaucgccau

SEQ ID NO: 2608251 - RNA, 21 nt, Escherichia coli CFT073
guauacgacugaugcgacgca

SEQ ID NO: 2608252 - RNA, 17 nt, Escherichia coli CFT073
guauacgggcuuuuuaa

SEQ ID NO: 2608253 - RNA, 21 nt, Escherichia coli CFT073
guauacugcagcggucacaug

SEQ ID NO: 2608254 - RNA, 15 nt, Escherichia coli CFT073
guauaggauuaucau

SEQ ID NO: 2608255 - RNA, 18 nt, Escherichia coli CFT073
guauaggauuaucauccc

SEQ ID NO: 2608256 - RNA, 13 nt, Escherichia coli CFT073
guauaggcaugua

SEQ ID NO: 2608257 - RNA, 16 nt, Escherichia coli CFT073
guauaguccgccagaa

SEQ ID NO: 2608258 - RNA, 15 nt, Escherichia coli CFT073
guauaugauuucgau

SEQ ID NO: 2608259 - RNA, 22 nt, Escherichia coli CFT073
guauauuauccaucaaagguuu

SEQ ID NO: 2608260 - RNA, 20 nt, Escherichia coli CFT073
guaucaaaaacuuucgccag

SEQ ID NO: 2608261 - RNA, 13 nt, Escherichia coli CFT073
guaucaaacacag

SEQ ID NO: 2608262 - RNA, 14 nt, Escherichia coli CFT073
guaucaaacacagg

SEQ ID NO: 2608263 - RNA, 22 nt, Escherichia coli CFT073
guaucacucgugauaaccuguu

SEQ ID NO: 2608264 - RNA, 20 nt, Escherichia coli CFT073
guaucacuggccucuucucu

SEQ ID NO: 2608265 - RNA, 12 nt, Escherichia coli CFT073
gucaaucugcuc

SEQ ID NO: 2608266 - RNA, 15 nt, Escherichia coli CFT073
gucaaugccggucgg

SEQ ID NO: 2608267 - RNA, 20 nt, Escherichia coli CFT073
gucaaugccgucaccagcau

SEQ ID NO: 2608268 - RNA, 18 nt, Escherichia coli CFT073
gucaauugagacaacuca

SEQ ID NO: 2608269 - RNA, 15 nt, Escherichia coli CFT073
gucaauuucaauagc

SEQ ID NO: 2608270 - RNA, 21 nt, Escherichia coli CFT073
gucaauuuuucaggaucaagc

SEQ ID NO: 2608271 - RNA, 19 nt, Escherichia coli CFT073
gucacaacauugcgggcga

SEQ ID NO: 2608272 - RNA, 21 nt, Escherichia coli CFT073
gucacaaugggcgugaaaggu

SEQ ID NO: 2608273 - RNA, 11 nt, Escherichia coli CFT073
gucacacacaa

SEQ ID NO: 2608274 - RNA, 16 nt, Escherichia coli CFT073
gucacaggccaucaca

SEQ ID NO: 2608275 - RNA, 12 nt, Escherichia coli CFT073
gucacaguuaac

SEQ ID NO: 2608276 - RNA, 19 nt, Escherichia coli CFT073
gucacaguuaaccaguuuu

SEQ ID NO: 2608277 - RNA, 17 nt, Escherichia coli CFT073
gucacaucaccaacacc

SEQ ID NO: 2608278 - RNA, 16 nt, Escherichia coli CFT073
gucacaucaggccauc

SEQ ID NO: 2608279 - RNA, 22 nt, Escherichia coli CFT073
gucaccaaucagguaagcgaag

SEQ ID NO: 2608280 - RNA, 21 nt, Escherichia coli CFT073
gucaccaaucugaaaccagcg

SEQ ID NO: 2608281 - RNA, 17 nt, Escherichia coli CFT073
gucaccagcaucaacaa

SEQ ID NO: 2608282 - RNA, 15 nt, Escherichia coli CFT073
gucaccgccagguga

SEQ ID NO: 2608283 - RNA, 18 nt, Escherichia coli CFT073
gucaccgccuccaccuga

SEQ ID NO: 2608284 - RNA, 12 nt, Escherichia coli CFT073
gucaccgguucg

SEQ ID NO: 2608285 - RNA, 18 nt, Escherichia coli CFT073
gucaccgucacaucaauu

SEQ ID NO: 2608286 - RNA, 17 nt, Escherichia coli CFT073
gucaccuucuggcgacc

SEQ ID NO: 2608287 - RNA, 16 nt, Escherichia coli CFT073
gucacgauaucgauau

SEQ ID NO: 2608288 - RNA, 17 nt, Escherichia coli CFT073
gucacgauggaaccgua

SEQ ID NO: 2608289 - RNA, 13 nt, Escherichia coli CFT073
gucacgcagcagg

SEQ ID NO: 2608290 - RNA, 15 nt, Escherichia coli CFT073
gucacgcagcagggc

SEQ ID NO: 2608291 - RNA, 14 nt, Escherichia coli CFT073
gucacgcagggcau

SEQ ID NO: 2608292 - RNA, 14 nt, Escherichia coli CFT073
gucacgcaucacga

SEQ ID NO: 2608293 - RNA, 16 nt, Escherichia coli CFT073
gucacgcaucacgaca

SEQ ID NO: 2608294 - RNA, 16 nt, Escherichia coli CFT073
gucacgccgaccagac

SEQ ID NO: 2608295 - RNA, 18 nt, Escherichia coli CFT073
gucacgcggucaucggua

SEQ ID NO: 2608296 - RNA, 18 nt, Escherichia coli CFT073
gucacgcgguuaucccaa

SEQ ID NO: 2608297 - RNA, 16 nt, Escherichia coli CFT073
gucacgcuggcagauu

SEQ ID NO: 2608298 - RNA, 15 nt, Escherichia coli CFT073
gucacggaaucccgu

SEQ ID NO: 2608299 - RNA, 16 nt, Escherichia coli CFT073
gucacuggccagcggc

SEQ ID NO: 2608300 - RNA, 23 nt, Escherichia coli CFT073
gucacuggugugucaucugcgac

SEQ ID NO: 2608301 - RNA, 23 nt, Escherichia coli CFT073
gucacugugacgcggugcuuccg

SEQ ID NO: 2608302 - RNA, 20 nt, Escherichia coli CFT073
gucacuuccugauccgcuuu

SEQ ID NO: 2608303 - RNA, 22 nt, Escherichia coli CFT073
gucagaaacaguuguaaaguac

SEQ ID NO: 2608304 - RNA, 14 nt, Escherichia coli CFT073
gucagaacaaugau

SEQ ID NO: 2608305 - RNA, 20 nt, Escherichia coli CFT073
gucagaccggcaaccagcac

SEQ ID NO: 2608306 - RNA, 12 nt, Escherichia coli CFT073
gucagacgcgcg

SEQ ID NO: 2608307 - RNA, 18 nt, Escherichia coli CFT073
gucagagagccagcccca

SEQ ID NO: 2608308 - RNA, 13 nt, Escherichia coli CFT073
gucagagcauuac

SEQ ID NO: 2608309 - RNA, 13 nt, Escherichia coli CFT073
gucagauccgcca

SEQ ID NO: 2608310 - RNA, 14 nt, Escherichia coli CFT073
gucagauccgccag

SEQ ID NO: 2608311 - RNA, 15 nt, Escherichia coli CFT073
gucagauccgccagu

SEQ ID NO: 2608312 - RNA, 22 nt, Escherichia coli CFT073
gucagaucgccccggucaucaa

SEQ ID NO: 2608313 - RNA, 18 nt, Escherichia coli CFT073
gucagauucggauccagc

SEQ ID NO: 2608314 - RNA, 17 nt, Escherichia coli CFT073
gucagcaaugccagagu

SEQ ID NO: 2608315 - RNA, 17 nt, Escherichia coli CFT073
gucagcacaaacaauuu

SEQ ID NO: 2608316 - RNA, 15 nt, Escherichia coli CFT073
gucagcacauccagu

SEQ ID NO: 2608317 - RNA, 15 nt, Escherichia coli CFT073
gucagcaccagacgc

SEQ ID NO: 2608318 - RNA, 20 nt, Escherichia coli CFT073
gucagcacucacgccaggca

SEQ ID NO: 2608319 - RNA, 23 nt, Escherichia coli CFT073
gucagcacuggcgaauucugcag

SEQ ID NO: 2608320 - RNA, 19 nt, Escherichia coli CFT073
gucagcaguguccaguaau

SEQ ID NO: 2608321 - RNA, 14 nt, Escherichia coli CFT073
gucagcaucucugc

SEQ ID NO: 2608322 - RNA, 17 nt, Escherichia coli CFT073
gucagcaugucuugccu

SEQ ID NO: 2608323 - RNA, 15 nt, Escherichia coli CFT073
gucagccaaucacau

SEQ ID NO: 2608324 - RNA, 12 nt, Escherichia coli CFT073
gucagccagcac

SEQ ID NO: 2608325 - RNA, 14 nt, Escherichia coli CFT073
gucagccagcacug

SEQ ID NO: 2608326 - RNA, 13 nt, Escherichia coli CFT073
gucagccagcggc

SEQ ID NO: 2608327 - RNA, 19 nt, Escherichia coli CFT073
gucagcccuuauucacgcc

SEQ ID NO: 2608328 - RNA, 20 nt, Escherichia coli CFT073
gucagcccuucccggugcgc

SEQ ID NO: 2608329 - RNA, 19 nt, Escherichia coli CFT073
gucagcgaacaccagcagu

SEQ ID NO: 2608330 - RNA, 16 nt, Escherichia coli CFT073
gucagcgaucagcauu

SEQ ID NO: 2608331 - RNA, 21 nt, Escherichia coli CFT073
gucagcgucucaacaaacgau

SEQ ID NO: 2608332 - RNA, 14 nt, Escherichia coli CFT073
gucaggaagaagcc

SEQ ID NO: 2608333 - RNA, 16 nt, Escherichia coli CFT073
gucaggaagaagccca

SEQ ID NO: 2608334 - RNA, 19 nt, Escherichia coli CFT073
gucaggaaggcgauauccg

SEQ ID NO: 2608335 - RNA, 19 nt, Escherichia coli CFT073
gucaggaucaccaauacca

SEQ ID NO: 2608336 - RNA, 20 nt, Escherichia coli CFT073
gucaggcaugaucagcgucc

SEQ ID NO: 2608337 - RNA, 23 nt, Escherichia coli CFT073
gucaggccaacauccaucagcgu

SEQ ID NO: 2608338 - RNA, 14 nt, Escherichia coli CFT073
gucaggccgccacu

SEQ ID NO: 2608339 - RNA, 16 nt, Escherichia coli CFT073
gucaggcggauaaggc

SEQ ID NO: 2608340 - RNA, 14 nt, Escherichia coli CFT073
gucaggcgucgcgc

SEQ ID NO: 2608341 - RNA, 20 nt, Escherichia coli CFT073
gucaggcuaauaccgucgau

SEQ ID NO: 2608342 - RNA, 12 nt, Escherichia coli CFT073
gucagggccugc

SEQ ID NO: 2608343 - RNA, 15 nt, Escherichia coli CFT073
gucagggccugcgug

SEQ ID NO: 2608344 - RNA, 15 nt, Escherichia coli CFT073
gucaggggagugagg

SEQ ID NO: 2608345 - RNA, 16 nt, Escherichia coli CFT073
gucaggggcauuuucc

SEQ ID NO: 2608346 - RNA, 15 nt, Escherichia coli CFT073
gucaggguugacuug

SEQ ID NO: 2608347 - RNA, 22 nt, Escherichia coli CFT073
gucaguacggcaaagauauuca

SEQ ID NO: 2608348 - RNA, 14 nt, Escherichia coli CFT073
gucaguagaauaau

SEQ ID NO: 2608349 - RNA, 14 nt, Escherichia coli CFT073
gucaguagcgcaau

SEQ ID NO: 2608350 - RNA, 23 nt, Escherichia coli CFT073
gucaguaguuuuugcagauggau

SEQ ID NO: 2608351 - RNA, 19 nt, Escherichia coli CFT073
gucaguauuccagagcuuu

SEQ ID NO: 2608352 - RNA, 13 nt, Escherichia coli CFT073
gucaguauuuucc

SEQ ID NO: 2608353 - RNA, 22 nt, Escherichia coli CFT073
gucagucccugcucuuucagca

SEQ ID NO: 2608354 - RNA, 23 nt, Escherichia coli CFT073
gucagugccugcgccaccguuuc

SEQ ID NO: 2608355 - RNA, 12 nt, Escherichia coli CFT073
gucagugguggc

SEQ ID NO: 2608356 - RNA, 23 nt, Escherichia coli CFT073
gucaguucaggcugaggcguuuc

SEQ ID NO: 2608357 - RNA, 14 nt, Escherichia coli CFT073
gucaguuccauaau

SEQ ID NO: 2608358 - RNA, 15 nt, Escherichia coli CFT073
gucaguugcggcagg

SEQ ID NO: 2608359 - RNA, 19 nt, Escherichia coli CFT073
gucaguugugccaguuuca

SEQ ID NO: 2608360 - RNA, 21 nt, Escherichia coli CFT073
gucaguuuaaacagaauaccc

SEQ ID NO: 2608361 - RNA, 11 nt, Escherichia coli CFT073
gucaguuucac

SEQ ID NO: 2608362 - RNA, 13 nt, Escherichia coli CFT073
gucauaaaaauga

SEQ ID NO: 2608363 - RNA, 23 nt, Escherichia coli CFT073
gucauaaaaaugaggggcuaaaa

SEQ ID NO: 2608364 - RNA, 17 nt, Escherichia coli CFT073
gucauaauaugaccuga

SEQ ID NO: 2608365 - RNA, 21 nt, Escherichia coli CFT073
gucauacuccagucgcugcug

SEQ ID NO: 2608366 - RNA, 20 nt, Escherichia coli CFT073
gucauaggcugccgacgcca

SEQ ID NO: 2608367 - RNA, 21 nt, Escherichia coli CFT073
gucauauagccgcgcaguuuc

SEQ ID NO: 2608368 - RNA, 16 nt, Escherichia coli CFT073
gucauaucgaccagcg

SEQ ID NO: 2608369 - RNA, 11 nt, Escherichia coli CFT073
gucauaugcaa

SEQ ID NO: 2608370 - RNA, 22 nt, Escherichia coli CFT073
gucaucaaacggcauaugccau

SEQ ID NO: 2608371 - RNA, 16 nt, Escherichia coli CFT073
gucaucacaucccagc

SEQ ID NO: 2608372 - RNA, 21 nt, Escherichia coli CFT073
gucaucacaucccagcagaga

SEQ ID NO: 2608373 - RNA, 22 nt, Escherichia coli CFT073
gucaucacuugcucccgggcau

SEQ ID NO: 2608374 - RNA, 16 nt, Escherichia coli CFT073
gucgagcagagaaacg

SEQ ID NO: 2608375 - RNA, 17 nt, Escherichia coli CFT073
gucgagcaguugcugaa

SEQ ID NO: 2608376 - RNA, 14 nt, Escherichia coli CFT073
gucgaggcaaccag

SEQ ID NO: 2608377 - RNA, 15 nt, Escherichia coli CFT073
gucgaggcaaccagc

SEQ ID NO: 2608378 - RNA, 20 nt, Escherichia coli CFT073
gucgaggccaauuuggcugc

SEQ ID NO: 2608379 - RNA, 14 nt, Escherichia coli CFT073
gucgaggcugacgu

SEQ ID NO: 2608380 - RNA, 21 nt, Escherichia coli CFT073
gucgaguagcccuucagcuug

SEQ ID NO: 2608381 - RNA, 23 nt, Escherichia coli CFT073
gucgauaucaggcaaacagaauu

SEQ ID NO: 2608382 - RNA, 19 nt, Escherichia coli CFT073
gucgauauuacgggucaca

SEQ ID NO: 2608383 - RNA, 13 nt, Escherichia coli CFT073
gucgaucuccggc

SEQ ID NO: 2608384 - RNA, 17 nt, Escherichia coli CFT073
gucgaugcgcaacgcaa

SEQ ID NO: 2608385 - RNA, 16 nt, Escherichia coli CFT073
gucgaugggggagguc

SEQ ID NO: 2608386 - RNA, 16 nt, Escherichia coli CFT073
gucgauucgccgaugc

SEQ ID NO: 2608387 - RNA, 19 nt, Escherichia coli CFT073
gucgauucgccgaugcaua

SEQ ID NO: 2608388 - RNA, 22 nt, Escherichia coli CFT073
gucgcaaacaacgccacacgca

SEQ ID NO: 2608389 - RNA, 17 nt, Escherichia coli CFT073
gucgcaagacgaaaaau

SEQ ID NO: 2608390 - RNA, 20 nt, Escherichia coli CFT073
gucgcaauacccugacccag

SEQ ID NO: 2608391 - RNA, 15 nt, Escherichia coli CFT073
gucgcaucaggcaau

SEQ ID NO: 2608392 - RNA, 23 nt, Escherichia coli CFT073
gucgcaucaggcacacugccagu

SEQ ID NO: 2608393 - RNA, 14 nt, Escherichia coli CFT073
gucgcaucaggcau

SEQ ID NO: 2608394 - RNA, 15 nt, Escherichia coli CFT073
gucgcauccaacaau

SEQ ID NO: 2608395 - RNA, 15 nt, Escherichia coli CFT073
gucgcauccggcaau

SEQ ID NO: 2608396 - RNA, 21 nt, Escherichia coli CFT073
gucgcaucuggucagaugcga

SEQ ID NO: 2608397 - RNA, 15 nt, Escherichia coli CFT073
gucgccacaaucagc

SEQ ID NO: 2608398 - RNA, 15 nt, Escherichia coli CFT073
gucgccagaaaucag

SEQ ID NO: 2608399 - RNA, 14 nt, Escherichia coli CFT073
gucgccagcaauac

SEQ ID NO: 2608400 - RNA, 16 nt, Escherichia coli CFT073
gucgccagcagcucac

SEQ ID NO: 2608401 - RNA, 18 nt, Escherichia coli CFT073
gucgccaguaccagcagc

SEQ ID NO: 2608402 - RNA, 16 nt, Escherichia coli CFT073
gucgccagucccuuuc

SEQ ID NO: 2608403 - RNA, 18 nt, Escherichia coli CFT073
gucgccaguccuucaaua

SEQ ID NO: 2608404 - RNA, 14 nt, Escherichia coli CFT073
gucgccaucaaagg

SEQ ID NO: 2608405 - RNA, 12 nt, Escherichia coli CFT073
gucgccaucguc

SEQ ID NO: 2608406 - RNA, 23 nt, Escherichia coli CFT073
gucgccaucguuaaaaaacagug

SEQ ID NO: 2608407 - RNA, 13 nt, Escherichia coli CFT073
gucgcccgaccau

SEQ ID NO: 2608408 - RNA, 21 nt, Escherichia coli CFT073
gucgccgaagcagcugcuggu

SEQ ID NO: 2608409 - RNA, 17 nt, Escherichia coli CFT073
gucgccgcgcaaaucca

SEQ ID NO: 2608410 - RNA, 23 nt, Escherichia coli CFT073
gucgccggaugcggugcgagcgc

SEQ ID NO: 2608411 - RNA, 19 nt, Escherichia coli CFT073
gucgccggcggauucagua

SEQ ID NO: 2608412 - RNA, 17 nt, Escherichia coli CFT073
gucgccugcuuuaucga

SEQ ID NO: 2608413 - RNA, 13 nt, Escherichia coli CFT073
gucgcgcagcacu

SEQ ID NO: 2608414 - RNA, 15 nt, Escherichia coli CFT073
gucgcgcgaaucuuc

SEQ ID NO: 2608415 - RNA, 17 nt, Escherichia coli CFT073
gucgcgcgaaucuucau

SEQ ID NO: 2608416 - RNA, 16 nt, Escherichia coli CFT073
gucgcggaccaacaaa

SEQ ID NO: 2608417 - RNA, 19 nt, Escherichia coli CFT073
gucgcgguccgggccgcaa

SEQ ID NO: 2608418 - RNA, 23 nt, Escherichia coli CFT073
gucgcggucgccgucaggcaagc

SEQ ID NO: 2608419 - RNA, 16 nt, Escherichia coli CFT073
gucgcguagccaggcg

SEQ ID NO: 2608420 - RNA, 19 nt, Escherichia coli CFT073
gucgcguagccaggcggca

SEQ ID NO: 2608421 - RNA, 14 nt, Escherichia coli CFT073
gucgcucacuucac

SEQ ID NO: 2608422 - RNA, 18 nt, Escherichia coli CFT073
gucgcugauauugcucca

SEQ ID NO: 2608423 - RNA, 23 nt, Escherichia coli CFT073
gucgcugauauugcuccagacgu

SEQ ID NO: 2608424 - RNA, 14 nt, Escherichia coli CFT073
gucgcuggccggac

SEQ ID NO: 2608425 - RNA, 22 nt, Escherichia coli CFT073
gucgcuggucgauggccgggug

SEQ ID NO: 2608426 - RNA, 12 nt, Escherichia coli CFT073
gucgcuucacgc

SEQ ID NO: 2608427 - RNA, 18 nt, Escherichia coli CFT073
gucgcuugcgggcuggcg

SEQ ID NO: 2608428 - RNA, 11 nt, Escherichia coli CFT073
gucgcuuugac

SEQ ID NO: 2608429 - RNA, 20 nt, Escherichia coli CFT073
gucgcuuuugcaucuucagu

SEQ ID NO: 2608430 - RNA, 19 nt, Escherichia coli CFT073
gucggaaccgguuuagaaa

SEQ ID NO: 2608431 - RNA, 21 nt, Escherichia coli CFT073
gucggacgcuguuccggcggc

SEQ ID NO: 2608432 - RNA, 20 nt, Escherichia coli CFT073
gucggauaagacgcgccagc

SEQ ID NO: 2608433 - RNA, 18 nt, Escherichia coli CFT073
gucggauaagacgcguca

SEQ ID NO: 2608434 - RNA, 22 nt, Escherichia coli CFT073
gucggaucgcugaacgcaccuu

SEQ ID NO: 2608435 - RNA, 14 nt, Escherichia coli CFT073
gucggaugcggcgc

SEQ ID NO: 2608436 - RNA, 19 nt, Escherichia coli CFT073
gucggaugcggcgcgagcg

SEQ ID NO: 2608437 - RNA, 13 nt, Escherichia coli CFT073
gucggaugcggcu

SEQ ID NO: 2608438 - RNA, 14 nt, Escherichia coli CFT073
gucggaugcggcuc

SEQ ID NO: 2608439 - RNA, 19 nt, Escherichia coli CFT073
gucggaugcggcucgagcg

SEQ ID NO: 2608440 - RNA, 16 nt, Escherichia coli CFT073
gucggcauauuuaaaa

SEQ ID NO: 2608441 - RNA, 15 nt, Escherichia coli CFT073
gucggcaucaggcaa

SEQ ID NO: 2608442 - RNA, 17 nt, Escherichia coli CFT073
gucggcgagauauuccc

SEQ ID NO: 2608443 - RNA, 21 nt, Escherichia coli CFT073
gucggcggcgaucgccugcug

SEQ ID NO: 2608444 - RNA, 18 nt, Escherichia coli CFT073
gucggcgucagcgccauc

SEQ ID NO: 2608445 - RNA, 23 nt, Escherichia coli CFT073
gucggcuuugcccaucugggcug

SEQ ID NO: 2608446 - RNA, 18 nt, Escherichia coli CFT073
gucgggauauucagcuca

SEQ ID NO: 2608447 - RNA, 21 nt, Escherichia coli CFT073
gucggggggaggcugcauuau

SEQ ID NO: 2608448 - RNA, 17 nt, Escherichia coli CFT073
gucgggucgccguaagc

SEQ ID NO: 2608449 - RNA, 21 nt, Escherichia coli CFT073
gucgggugcgacaggagccgc

SEQ ID NO: 2608450 - RNA, 16 nt, Escherichia coli CFT073
gucgguaauuucacug

SEQ ID NO: 2608451 - RNA, 22 nt, Escherichia coli CFT073
gucggucgauugucgcggcuaa

SEQ ID NO: 2608452 - RNA, 22 nt, Escherichia coli CFT073
gucgguggcaucuggugccagc

SEQ ID NO: 2608453 - RNA, 17 nt, Escherichia coli CFT073
gucgguguccacuuccg

SEQ ID NO: 2608454 - RNA, 18 nt, Escherichia coli CFT073
gucgguuacaccgcgcgu

SEQ ID NO: 2608455 - RNA, 12 nt, Escherichia coli CFT073
gucgguuucauu

SEQ ID NO: 2608456 - RNA, 20 nt, Escherichia coli CFT073
gucguaccagugcagaugca

SEQ ID NO: 2608457 - RNA, 14 nt, Escherichia coli CFT073
gucguauuucagcc

SEQ ID NO: 2608458 - RNA, 18 nt, Escherichia coli CFT073
gucguauuucagccccag

SEQ ID NO: 2608459 - RNA, 16 nt, Escherichia coli CFT073
gucgucacucacgcug

SEQ ID NO: 2608460 - RNA, 20 nt, Escherichia coli CFT073
gucguccagauguucuucaa

SEQ ID NO: 2608461 - RNA, 18 nt, Escherichia coli CFT073
gucguccauuauuuucgu

SEQ ID NO: 2608462 - RNA, 19 nt, Escherichia coli CFT073
gucgucgccaaugcgcaau

SEQ ID NO: 2608463 - RNA, 19 nt, Escherichia coli CFT073
gucgucgcgcgaaucuuca

SEQ ID NO: 2608464 - RNA, 14 nt, Escherichia coli CFT073
gucgucuucguccc

SEQ ID NO: 2608465 - RNA, 21 nt, Escherichia coli CFT073
gucgugaaugccguaggccca

SEQ ID NO: 2608466 - RNA, 18 nt, Escherichia coli CFT073
gucgugaucgugguggug

SEQ ID NO: 2608467 - RNA, 15 nt, Escherichia coli CFT073
gucgugccagaaaau

SEQ ID NO: 2608468 - RNA, 20 nt, Escherichia coli CFT073
gucguggguucaucgagcag

SEQ ID NO: 2608469 - RNA, 16 nt, Escherichia coli CFT073
gucgugguaucgccac

SEQ ID NO: 2608470 - RNA, 14 nt, Escherichia coli CFT073
gucguuagaaagcu

SEQ ID NO: 2608471 - RNA, 16 nt, Escherichia coli CFT073
gucguuccccaucacc

SEQ ID NO: 2608472 - RNA, 23 nt, Escherichia coli CFT073
gucguuccccaucaccugacagc

SEQ ID NO: 2608473 - RNA, 22 nt, Escherichia coli CFT073
gucguugcaaucagcggugccg

SEQ ID NO: 2608474 - RNA, 20 nt, Escherichia coli CFT073
gucguugccacacgacgcca

SEQ ID NO: 2608475 - RNA, 17 nt, Escherichia coli CFT073
gucguuguacaaaccau

SEQ ID NO: 2608476 - RNA, 17 nt, Escherichia coli CFT073
gucguugucuggcuggu

SEQ ID NO: 2608477 - RNA, 14 nt, Escherichia coli CFT073
gucguuuuccugca

SEQ ID NO: 2608478 - RNA, 17 nt, Escherichia coli CFT073
gucuaagcggccucgau

SEQ ID NO: 2608479 - RNA, 17 nt, Escherichia coli CFT073
gucuaccagcaccugcu

SEQ ID NO: 2608480 - RNA, 16 nt, Escherichia coli CFT073
gucuaccaguuuggug

SEQ ID NO: 2608481 - RNA, 22 nt, Escherichia coli CFT073
gucucaacaaacgauuuaucga

SEQ ID NO: 2608482 - RNA, 12 nt, Escherichia coli CFT073
gugaaugccuga

SEQ ID NO: 2608483 - RNA, 17 nt, Escherichia coli CFT073
gugaaugguggcgauga

SEQ ID NO: 2608484 - RNA, 15 nt, Escherichia coli CFT073
gugaauuucacuuuc

SEQ ID NO: 2608485 - RNA, 22 nt, Escherichia coli CFT073
gugaauuucacuuucugaccau

SEQ ID NO: 2608486 - RNA, 14 nt, Escherichia coli CFT073
gugacaaacacagc

SEQ ID NO: 2608487 - RNA, 17 nt, Escherichia coli CFT073
gugacaaacuaaccaga

SEQ ID NO: 2608488 - RNA, 21 nt, Escherichia coli CFT073
gugacaauaauucccagcacc

SEQ ID NO: 2608489 - RNA, 22 nt, Escherichia coli CFT073
gugacaccagcacaucaucaaa

SEQ ID NO: 2608490 - RNA, 22 nt, Escherichia coli CFT073
gugacacuuugugccaucgcca

SEQ ID NO: 2608491 - RNA, 15 nt, Escherichia coli CFT073
gugacagaggauauu

SEQ ID NO: 2608492 - RNA, 23 nt, Escherichia coli CFT073
gugacagcauaccuucacaaaau

SEQ ID NO: 2608493 - RNA, 18 nt, Escherichia coli CFT073
gugacagcccggcauguu

SEQ ID NO: 2608494 - RNA, 13 nt, Escherichia coli CFT073
gugacagcgguga

SEQ ID NO: 2608495 - RNA, 22 nt, Escherichia coli CFT073
gugacauagagauaacuggcaa

SEQ ID NO: 2608496 - RNA, 22 nt, Escherichia coli CFT073
gugacauccagaucacgcagca

SEQ ID NO: 2608497 - RNA, 18 nt, Escherichia coli CFT073
gugacccgcagccagcac

SEQ ID NO: 2608498 - RNA, 21 nt, Escherichia coli CFT073
gugaccgaaccuguuuucacc

SEQ ID NO: 2608499 - RNA, 22 nt, Escherichia coli CFT073
gugaccgaaccuguuuucaccg

SEQ ID NO: 2608500 - RNA, 16 nt, Escherichia coli CFT073
gugaccgucgagcaga

SEQ ID NO: 2608501 - RNA, 16 nt, Escherichia coli CFT073
gugacgaguccuuccu

SEQ ID NO: 2608502 - RNA, 21 nt, Escherichia coli CFT073
gugacgccugcuccaucaucc

SEQ ID NO: 2608503 - RNA, 12 nt, Escherichia coli CFT073
gugacgcuggca

SEQ ID NO: 2608504 - RNA, 17 nt, Escherichia coli CFT073
gugacggaacucuuccg

SEQ ID NO: 2608505 - RNA, 21 nt, Escherichia coli CFT073
gugacgguuuuacgcucccac

SEQ ID NO: 2608506 - RNA, 15 nt, Escherichia coli CFT073
gugacugccgccagc

SEQ ID NO: 2608507 - RNA, 11 nt, Escherichia coli CFT073
gugacugcuga

SEQ ID NO: 2608508 - RNA, 14 nt, Escherichia coli CFT073
gugagaccagacca

SEQ ID NO: 2608509 - RNA, 13 nt, Escherichia coli CFT073
gugagagaaaauc

SEQ ID NO: 2608510 - RNA, 21 nt, Escherichia coli CFT073
gugagaucauuauuaaacagg

SEQ ID NO: 2608511 - RNA, 14 nt, Escherichia coli CFT073
gugagauugcugcg

SEQ ID NO: 2608512 - RNA, 12 nt, Escherichia coli CFT073
gugagcgugcgg

SEQ ID NO: 2608513 - RNA, 14 nt, Escherichia coli CFT073
gugaggaucaccag

SEQ ID NO: 2608514 - RNA, 22 nt, Escherichia coli CFT073
gugaggggaacccguuggcaca

SEQ ID NO: 2608515 - RNA, 15 nt, Escherichia coli CFT073
gugaguggcgcgcgc

SEQ ID NO: 2608516 - RNA, 21 nt, Escherichia coli CFT073
gugauaaccuguuaaugcgaa

SEQ ID NO: 2608517 - RNA, 14 nt, Escherichia coli CFT073
gugauacagcaaaa

SEQ ID NO: 2608518 - RNA, 15 nt, Escherichia coli CFT073
gugauaccccgcauc

SEQ ID NO: 2608519 - RNA, 22 nt, Escherichia coli CFT073
gugauaggguacgacccagguu

SEQ ID NO: 2608520 - RNA, 22 nt, Escherichia coli CFT073
gugauauacgccacuucaucgu

SEQ ID NO: 2608521 - RNA, 22 nt, Escherichia coli CFT073
gugauauuacauaccagcagca

SEQ ID NO: 2608522 - RNA, 21 nt, Escherichia coli CFT073
gugauauucacguuuuucauc

SEQ ID NO: 2608523 - RNA, 14 nt, Escherichia coli CFT073
gugauauuuucacu

SEQ ID NO: 2608524 - RNA, 12 nt, Escherichia coli CFT073
gugaucaacaca

SEQ ID NO: 2608525 - RNA, 15 nt, Escherichia coli CFT073
gugaucagcgucagu

SEQ ID NO: 2608526 - RNA, 15 nt, Escherichia coli CFT073
gugauccacgguucu

SEQ ID NO: 2608527 - RNA, 20 nt, Escherichia coli CFT073
gugaucccgcuaccugccgc

SEQ ID NO: 2608528 - RNA, 22 nt, Escherichia coli CFT073
gugaucgccccggaagccagac

SEQ ID NO: 2608529 - RNA, 18 nt, Escherichia coli CFT073
gugaucgccugcauguug

SEQ ID NO: 2608530 - RNA, 21 nt, Escherichia coli CFT073
gugaucgggucaccugccagg

SEQ ID NO: 2608531 - RNA, 22 nt, Escherichia coli CFT073
gugaucggucggguauacagaa

SEQ ID NO: 2608532 - RNA, 11 nt, Escherichia coli CFT073
gugaucuggcu

SEQ ID NO: 2608533 - RNA, 15 nt, Escherichia coli CFT073
gugaugacgccagcc

SEQ ID NO: 2608534 - RNA, 16 nt, Escherichia coli CFT073
gugaugccaaucggcg

SEQ ID NO: 2608535 - RNA, 19 nt, Escherichia coli CFT073
gugaugcggucgcugccgc

SEQ ID NO: 2608536 - RNA, 13 nt, Escherichia coli CFT073
gugaugcguccgc

SEQ ID NO: 2608537 - RNA, 21 nt, Escherichia coli CFT073
gugauggccagauaacccagg

SEQ ID NO: 2608538 - RNA, 17 nt, Escherichia coli CFT073
gugaugguaacgcgcca

SEQ ID NO: 2608539 - RNA, 21 nt, Escherichia coli CFT073
gugauguagucaucugcaccg

SEQ ID NO: 2608540 - RNA, 14 nt, Escherichia coli CFT073
gugauuaaauucag

SEQ ID NO: 2608541 - RNA, 22 nt, Escherichia coli CFT073
gugauuacagccaggcgcugcu

SEQ ID NO: 2608542 - RNA, 20 nt, Escherichia coli CFT073
gugauuauuuaggugccaac

SEQ ID NO: 2608543 - RNA, 12 nt, Escherichia coli CFT073
gugauucauagu

SEQ ID NO: 2608544 - RNA, 19 nt, Escherichia coli CFT073
gugauucauaguaagcaga

SEQ ID NO: 2608545 - RNA, 21 nt, Escherichia coli CFT073
gugauucauaguaagcagauu

SEQ ID NO: 2608546 - RNA, 21 nt, Escherichia coli CFT073
gugauuccguucaguaaucaa

SEQ ID NO: 2608547 - RNA, 22 nt, Escherichia coli CFT073
gugauugccgcgacgguugcgg

SEQ ID NO: 2608548 - RNA, 13 nt, Escherichia coli CFT073
gugauuguuuaaa

SEQ ID NO: 2608549 - RNA, 19 nt, Escherichia coli CFT073
gugauuuccccuaacucuu

SEQ ID NO: 2608550 - RNA, 18 nt, Escherichia coli CFT073
gugauuuccgccgccagc

SEQ ID NO: 2608551 - RNA, 22 nt, Escherichia coli CFT073
gugauuuccgccgccagcagac

SEQ ID NO: 2608552 - RNA, 12 nt, Escherichia coli CFT073
gugauuucugac

SEQ ID NO: 2608553 - RNA, 22 nt, Escherichia coli CFT073
gugauuuugccugugcaaccuu

SEQ ID NO: 2608554 - RNA, 20 nt, Escherichia coli CFT073
gugauuuuugcugaacgcca

SEQ ID NO: 2608555 - RNA, 12 nt, Escherichia coli CFT073
gugcaaaaaaau

SEQ ID NO: 2608556 - RNA, 13 nt, Escherichia coli CFT073
gugcaaaaucaaa

SEQ ID NO: 2608557 - RNA, 20 nt, Escherichia coli CFT073
gugcaaaaucaaacagaaua

SEQ ID NO: 2608558 - RNA, 19 nt, Escherichia coli CFT073
gugcaaaggccaaugguua

SEQ ID NO: 2608559 - RNA, 14 nt, Escherichia coli CFT073
gugcaacagagagc

SEQ ID NO: 2608560 - RNA, 21 nt, Escherichia coli CFT073
gugcaaccgggcuauuugaau

SEQ ID NO: 2608561 - RNA, 18 nt, Escherichia coli CFT073
gugcaacuuucaauaacc

SEQ ID NO: 2608562 - RNA, 12 nt, Escherichia coli CFT073
gugcaaucagcg

SEQ ID NO: 2608563 - RNA, 19 nt, Escherichia coli CFT073
gugcacaaacuucuucagu

SEQ ID NO: 2608564 - RNA, 17 nt, Escherichia coli CFT073
gugcacagguaaacgca

SEQ ID NO: 2608565 - RNA, 20 nt, Escherichia coli CFT073
gugcaccacuguuuuucagc

SEQ ID NO: 2608566 - RNA, 14 nt, Escherichia coli CFT073
gugcaccagcuggc

SEQ ID NO: 2608567 - RNA, 18 nt, Escherichia coli CFT073
gugcaccgcgcuggcuga

SEQ ID NO: 2608568 - RNA, 14 nt, Escherichia coli CFT073
gugcaccuuguuuc

SEQ ID NO: 2608569 - RNA, 13 nt, Escherichia coli CFT073
gugcacgcagcaa

SEQ ID NO: 2608570 - RNA, 15 nt, Escherichia coli CFT073
gugcacgugccagau

SEQ ID NO: 2608571 - RNA, 15 nt, Escherichia coli CFT073
gugcacuuacaaggu

SEQ ID NO: 2608572 - RNA, 21 nt, Escherichia coli CFT073
gugcagaacggugagcgugcg

SEQ ID NO: 2608573 - RNA, 19 nt, Escherichia coli CFT073
gugcagaaucaaucucagc

SEQ ID NO: 2608574 - RNA, 15 nt, Escherichia coli CFT073
gugcagauaccacca

SEQ ID NO: 2608575 - RNA, 17 nt, Escherichia coli CFT073
gugcagauaccaccagc

SEQ ID NO: 2608576 - RNA, 19 nt, Escherichia coli CFT073
gugcagauaccaccagcgc

SEQ ID NO: 2608577 - RNA, 11 nt, Escherichia coli CFT073
gugcagcaucg

SEQ ID NO: 2608578 - RNA, 23 nt, Escherichia coli CFT073
gugcagccggagcuucacccgca

SEQ ID NO: 2608579 - RNA, 15 nt, Escherichia coli CFT073
gugcagcgugccugg

SEQ ID NO: 2608580 - RNA, 22 nt, Escherichia coli CFT073
gugcauaggccaucggcagcau

SEQ ID NO: 2608581 - RNA, 23 nt, Escherichia coli CFT073
gugcauauacaaccaauaacuca

SEQ ID NO: 2608582 - RNA, 22 nt, Escherichia coli CFT073
gugcauccacuuugguuacacg

SEQ ID NO: 2608583 - RNA, 12 nt, Escherichia coli CFT073
gugcaucccaga

SEQ ID NO: 2608584 - RNA, 14 nt, Escherichia coli CFT073
gugcaucgcgacca

SEQ ID NO: 2608585 - RNA, 23 nt, Escherichia coli CFT073
gugcaucgcgaccaaucacacaa

SEQ ID NO: 2608586 - RNA, 17 nt, Escherichia coli CFT073
gugccaacaccacaaau

SEQ ID NO: 2608587 - RNA, 22 nt, Escherichia coli CFT073
gugccaaugauuuugaucccgc

SEQ ID NO: 2608588 - RNA, 14 nt, Escherichia coli CFT073
gugccacauccagc

SEQ ID NO: 2608589 - RNA, 14 nt, Escherichia coli CFT073
gugccacgccccgc

SEQ ID NO: 2608590 - RNA, 14 nt, Escherichia coli CFT073
guggaacaaagaaa

SEQ ID NO: 2608591 - RNA, 15 nt, Escherichia coli CFT073
guggaacggugaaaa

SEQ ID NO: 2608592 - RNA, 15 nt, Escherichia coli CFT073
guggaacucuucaca

SEQ ID NO: 2608593 - RNA, 17 nt, Escherichia coli CFT073
guggaaucaaugugcuu

SEQ ID NO: 2608594 - RNA, 21 nt, Escherichia coli CFT073
guggacauguuuuuauuaaag

SEQ ID NO: 2608595 - RNA, 20 nt, Escherichia coli CFT073
guggauauggaacggaugca

SEQ ID NO: 2608596 - RNA, 19 nt, Escherichia coli CFT073
guggaucacaucgccggug

SEQ ID NO: 2608597 - RNA, 18 nt, Escherichia coli CFT073
guggaucgaacuccgccc

SEQ ID NO: 2608598 - RNA, 15 nt, Escherichia coli CFT073
guggaucgauuucaa

SEQ ID NO: 2608599 - RNA, 16 nt, Escherichia coli CFT073
guggaucgauuucaau

SEQ ID NO: 2608600 - RNA, 22 nt, Escherichia coli CFT073
guggauuuuucgcgaccgccuc

SEQ ID NO: 2608601 - RNA, 18 nt, Escherichia coli CFT073
guggauuuuuguuucaca

SEQ ID NO: 2608602 - RNA, 22 nt, Escherichia coli CFT073
guggauuuuuguuucacacuga

SEQ ID NO: 2608603 - RNA, 15 nt, Escherichia coli CFT073
guggcaaaauccaac

SEQ ID NO: 2608604 - RNA, 19 nt, Escherichia coli CFT073
guggcaaaguuggcgcuga

SEQ ID NO: 2608605 - RNA, 15 nt, Escherichia coli CFT073
guggcaaauugccca

SEQ ID NO: 2608606 - RNA, 16 nt, Escherichia coli CFT073
guggcaaauugcccaa

SEQ ID NO: 2608607 - RNA, 11 nt, Escherichia coli CFT073
guggcaaccgc

SEQ ID NO: 2608608 - RNA, 22 nt, Escherichia coli CFT073
guggcaagaccugccgggcuga

SEQ ID NO: 2608609 - RNA, 17 nt, Escherichia coli CFT073
guggcaauagagacaaa

SEQ ID NO: 2608610 - RNA, 22 nt, Escherichia coli CFT073
guggcacacacuaccgccgagc

SEQ ID NO: 2608611 - RNA, 14 nt, Escherichia coli CFT073
guggcagaaugguu

SEQ ID NO: 2608612 - RNA, 15 nt, Escherichia coli CFT073
guggcagggcagcga

SEQ ID NO: 2608613 - RNA, 21 nt, Escherichia coli CFT073
guggcagucacuuccugaucc

SEQ ID NO: 2608614 - RNA, 17 nt, Escherichia coli CFT073
guggcaguuacugcccg

SEQ ID NO: 2608615 - RNA, 22 nt, Escherichia coli CFT073
guggcaucuggugccagcgcca

SEQ ID NO: 2608616 - RNA, 14 nt, Escherichia coli CFT073
guggcauuacgcag

SEQ ID NO: 2608617 - RNA, 21 nt, Escherichia coli CFT073
guggccagcaacagcgcguca

SEQ ID NO: 2608618 - RNA, 22 nt, Escherichia coli CFT073
guggccauaaccaugcagcgcc

SEQ ID NO: 2608619 - RNA, 14 nt, Escherichia coli CFT073
guggccaugaccac

SEQ ID NO: 2608620 - RNA, 19 nt, Escherichia coli CFT073
guggcccgauggugaugcc

SEQ ID NO: 2608621 - RNA, 12 nt, Escherichia coli CFT073
guggccgagagg

SEQ ID NO: 2608622 - RNA, 14 nt, Escherichia coli CFT073
guggccuccaaaaa

SEQ ID NO: 2608623 - RNA, 14 nt, Escherichia coli CFT073
guggccugcuuuug

SEQ ID NO: 2608624 - RNA, 16 nt, Escherichia coli CFT073
guggcgauaaucagcg

SEQ ID NO: 2608625 - RNA, 19 nt, Escherichia coli CFT073
guggcgauaaucagcgcca

SEQ ID NO: 2608626 - RNA, 13 nt, Escherichia coli CFT073
guggcgauugucg

SEQ ID NO: 2608627 - RNA, 20 nt, Escherichia coli CFT073
guggcgcaggggcagaaaca

SEQ ID NO: 2608628 - RNA, 16 nt, Escherichia coli CFT073
guggcgccccacuuca

SEQ ID NO: 2608629 - RNA, 20 nt, Escherichia coli CFT073
guggcggcgucagcggcugu

SEQ ID NO: 2608630 - RNA, 20 nt, Escherichia coli CFT073
guggcguaaacgccuuaucc

SEQ ID NO: 2608631 - RNA, 23 nt, Escherichia coli CFT073
guggcguaaacgccuuauccggc

SEQ ID NO: 2608632 - RNA, 14 nt, Escherichia coli CFT073
guggcguacagcug

SEQ ID NO: 2608633 - RNA, 16 nt, Escherichia coli CFT073
guggcgucaaaaagcu

SEQ ID NO: 2608634 - RNA, 16 nt, Escherichia coli CFT073
guggcguuuccagcag

SEQ ID NO: 2608635 - RNA, 21 nt, Escherichia coli CFT073
guggcucagccagacgcguca

SEQ ID NO: 2608636 - RNA, 18 nt, Escherichia coli CFT073
guggcucaggcucucauu

SEQ ID NO: 2608637 - RNA, 13 nt, Escherichia coli CFT073
guggcugagugau

SEQ ID NO: 2608638 - RNA, 15 nt, Escherichia coli CFT073
guggcugcguuucau

SEQ ID NO: 2608639 - RNA, 18 nt, Escherichia coli CFT073
guggcugggguacgagga

SEQ ID NO: 2608640 - RNA, 21 nt, Escherichia coli CFT073
gugggauuaaggcuuccagcg

SEQ ID NO: 2608641 - RNA, 18 nt, Escherichia coli CFT073
gugggauuccagcgccgc

SEQ ID NO: 2608642 - RNA, 22 nt, Escherichia coli CFT073
gugggcaggaaaaucagcauca

SEQ ID NO: 2608643 - RNA, 17 nt, Escherichia coli CFT073
gugggcuaacacugcca

SEQ ID NO: 2608644 - RNA, 21 nt, Escherichia coli CFT073
gugggguucccgagcggccaa

SEQ ID NO: 2608645 - RNA, 13 nt, Escherichia coli CFT073
guggguucaucga

SEQ ID NO: 2608646 - RNA, 23 nt, Escherichia coli CFT073
gugguaacgcucacaucugcaau

SEQ ID NO: 2608647 - RNA, 19 nt, Escherichia coli CFT073
gugguaccaggaucagcaa

SEQ ID NO: 2608648 - RNA, 13 nt, Escherichia coli CFT073
gugguagcggcuc

SEQ ID NO: 2608649 - RNA, 21 nt, Escherichia coli CFT073
gugguauagaaugcagcagca

SEQ ID NO: 2608650 - RNA, 13 nt, Escherichia coli CFT073
gugguaucaaaau

SEQ ID NO: 2608651 - RNA, 13 nt, Escherichia coli CFT073
gugguaucgccac

SEQ ID NO: 2608652 - RNA, 15 nt, Escherichia coli CFT073
gugguaugaauuuuc

SEQ ID NO: 2608653 - RNA, 18 nt, Escherichia coli CFT073
gugguauugcagcucugu

SEQ ID NO: 2608654 - RNA, 13 nt, Escherichia coli CFT073
guggucagcacaa

SEQ ID NO: 2608655 - RNA, 20 nt, Escherichia coli CFT073
guggucgaauccccucaaua

SEQ ID NO: 2608656 - RNA, 19 nt, Escherichia coli CFT073
guggugaacgacacacagu

SEQ ID NO: 2608657 - RNA, 23 nt, Escherichia coli CFT073
guggugccagugcacuaccguaa

SEQ ID NO: 2608658 - RNA, 19 nt, Escherichia coli CFT073
guggugccgacauuaucac

SEQ ID NO: 2608659 - RNA, 21 nt, Escherichia coli CFT073
guggugcgcaccaggcgugga

SEQ ID NO: 2608660 - RNA, 21 nt, Escherichia coli CFT073
guggugcgguuuuuggagaga

SEQ ID NO: 2608661 - RNA, 17 nt, Escherichia coli CFT073
gugguuaccaucaacca

SEQ ID NO: 2608662 - RNA, 21 nt, Escherichia coli CFT073
gugguuaccgaauccagcaag

SEQ ID NO: 2608663 - RNA, 15 nt, Escherichia coli CFT073
gugguuaccgccagc

SEQ ID NO: 2608664 - RNA, 21 nt, Escherichia coli CFT073
gugguuccauucaaggacaaa

SEQ ID NO: 2608665 - RNA, 16 nt, Escherichia coli CFT073
gugguugcggacugcc

SEQ ID NO: 2608666 - RNA, 12 nt, Escherichia coli CFT073
gugguuucuccc

SEQ ID NO: 2608667 - RNA, 17 nt, Escherichia coli CFT073
gugguuuucucuuguuc

SEQ ID NO: 2608668 - RNA, 17 nt, Escherichia coli CFT073
guguaaaaaaucccagc

SEQ ID NO: 2608669 - RNA, 14 nt, Escherichia coli CFT073
guguaaaugccggu

SEQ ID NO: 2608670 - RNA, 15 nt, Escherichia coli CFT073
guguaacccgccuga

SEQ ID NO: 2608671 - RNA, 18 nt, Escherichia coli CFT073
guguaaccgcaacggcga

SEQ ID NO: 2608672 - RNA, 18 nt, Escherichia coli CFT073
guguaagaaaggcagaga

SEQ ID NO: 2608673 - RNA, 19 nt, Escherichia coli CFT073
guguaagaaugcuccccag

SEQ ID NO: 2608674 - RNA, 18 nt, Escherichia coli CFT073
guguaauacguuuuauca

SEQ ID NO: 2608675 - RNA, 21 nt, Escherichia coli CFT073
guguaauccugccagugcaaa

SEQ ID NO: 2608676 - RNA, 20 nt, Escherichia coli CFT073
guguaccugucgggacacga

SEQ ID NO: 2608677 - RNA, 21 nt, Escherichia coli CFT073
guguacgaacgguccccucgc

SEQ ID NO: 2608678 - RNA, 21 nt, Escherichia coli CFT073
guguagcggguguaggccgga

SEQ ID NO: 2608679 - RNA, 15 nt, Escherichia coli CFT073
guguaggaaaucagc

SEQ ID NO: 2608680 - RNA, 12 nt, Escherichia coli CFT073
guguaggcaaag

SEQ ID NO: 2608681 - RNA, 18 nt, Escherichia coli CFT073
guguauguuggcuuuaua

SEQ ID NO: 2608682 - RNA, 14 nt, Escherichia coli CFT073
guguauuaccuccg

SEQ ID NO: 2608683 - RNA, 18 nt, Escherichia coli CFT073
guguauuuugcaucgagc

SEQ ID NO: 2608684 - RNA, 22 nt, Escherichia coli CFT073
gugucaauaauauuuguacugu

SEQ ID NO: 2608685 - RNA, 15 nt, Escherichia coli CFT073
gugucagugucagaa

SEQ ID NO: 2608686 - RNA, 18 nt, Escherichia coli CFT073
guguccaaaugcagcacg

SEQ ID NO: 2608687 - RNA, 13 nt, Escherichia coli CFT073
guguccacuuccg

SEQ ID NO: 2608688 - RNA, 19 nt, Escherichia coli CFT073
gugucgauaccgaagugga

SEQ ID NO: 2608689 - RNA, 14 nt, Escherichia coli CFT073
gugucgccaucaaa

SEQ ID NO: 2608690 - RNA, 15 nt, Escherichia coli CFT073
gugucgccgaagcag

SEQ ID NO: 2608691 - RNA, 15 nt, Escherichia coli CFT073
gugucgccugcagga

SEQ ID NO: 2608692 - RNA, 16 nt, Escherichia coli CFT073
gugucugauugccgga

SEQ ID NO: 2608693 - RNA, 16 nt, Escherichia coli CFT073
gugucuggaucuucuu

SEQ ID NO: 2608694 - RNA, 22 nt, Escherichia coli CFT073
gugucuggcgaauuuauaaaac

SEQ ID NO: 2608695 - RNA, 15 nt, Escherichia coli CFT073
gugucuuuucaggcc

SEQ ID NO: 2608696 - RNA, 19 nt, Escherichia coli CFT073
gugugaaacaguaaguuca

SEQ ID NO: 2608697 - RNA, 20 nt, Escherichia coli CFT073
gugugacguuauugguggug

SEQ ID NO: 2608698 - RNA, 20 nt, Escherichia coli CFT073
guuagacgcguuuacagagc

SEQ ID NO: 2608699 - RNA, 23 nt, Escherichia coli CFT073
guuagcauggcugaaaucgauca

SEQ ID NO: 2608700 - RNA, 19 nt, Escherichia coli CFT073
guuagccgcguacauugcu

SEQ ID NO: 2608701 - RNA, 17 nt, Escherichia coli CFT073
guuagccggauaagcaa

SEQ ID NO: 2608702 - RNA, 22 nt, Escherichia coli CFT073
guuagcggacucaccgagcagc

SEQ ID NO: 2608703 - RNA, 18 nt, Escherichia coli CFT073
guuagcgugcaggacggu

SEQ ID NO: 2608704 - RNA, 16 nt, Escherichia coli CFT073
guuaggaccgguuuca

SEQ ID NO: 2608705 - RNA, 16 nt, Escherichia coli CFT073
guuagucgcugugaca

SEQ ID NO: 2608706 - RNA, 23 nt, Escherichia coli CFT073
guuagucgcugugacauccagau

SEQ ID NO: 2608707 - RNA, 23 nt, Escherichia coli CFT073
guuagucgcuuucauucagaaca

SEQ ID NO: 2608708 - RNA, 12 nt, Escherichia coli CFT073
guuagucucuuc

SEQ ID NO: 2608709 - RNA, 13 nt, Escherichia coli CFT073
guuauaaaacaca

SEQ ID NO: 2608710 - RNA, 14 nt, Escherichia coli CFT073
guuauaaaacacau

SEQ ID NO: 2608711 - RNA, 21 nt, Escherichia coli CFT073
guuauaaacgcucggcaacac

SEQ ID NO: 2608712 - RNA, 12 nt, Escherichia coli CFT073
guuauaacucuu

SEQ ID NO: 2608713 - RNA, 22 nt, Escherichia coli CFT073
guuauaagcgucguuaaucgcc

SEQ ID NO: 2608714 - RNA, 19 nt, Escherichia coli CFT073
guuauaccacuuacauucc

SEQ ID NO: 2608715 - RNA, 14 nt, Escherichia coli CFT073
guuauaccagucca

SEQ ID NO: 2608716 - RNA, 20 nt, Escherichia coli CFT073
guuauagcgauuuuucauca

SEQ ID NO: 2608717 - RNA, 23 nt, Escherichia coli CFT073
guuauagcgauuuuucaucacug

SEQ ID NO: 2608718 - RNA, 22 nt, Escherichia coli CFT073
guuauagcgcaugacaugcggu

SEQ ID NO: 2608719 - RNA, 17 nt, Escherichia coli CFT073
guuauaggcauucucgc

SEQ ID NO: 2608720 - RNA, 15 nt, Escherichia coli CFT073
guuauaggccccagc

SEQ ID NO: 2608721 - RNA, 18 nt, Escherichia coli CFT073
guuauaugaauacgcgau

SEQ ID NO: 2608722 - RNA, 14 nt, Escherichia coli CFT073
guuaucagacacca

SEQ ID NO: 2608723 - RNA, 18 nt, Escherichia coli CFT073
guuaucagcaauaaaaaa

SEQ ID NO: 2608724 - RNA, 15 nt, Escherichia coli CFT073
guuauccagcaacca

SEQ ID NO: 2608725 - RNA, 16 nt, Escherichia coli CFT073
guuauccagcaaccag

SEQ ID NO: 2608726 - RNA, 15 nt, Escherichia coli CFT073
guuaucccauuccac

SEQ ID NO: 2608727 - RNA, 22 nt, Escherichia coli CFT073
guuauccguuaacgccgcugcu

SEQ ID NO: 2608728 - RNA, 19 nt, Escherichia coli CFT073
guuauccugcaaauaacgc

SEQ ID NO: 2608729 - RNA, 18 nt, Escherichia coli CFT073
guuaucgauauacaaaca

SEQ ID NO: 2608730 - RNA, 19 nt, Escherichia coli CFT073
guuaucgccugcgccacca

SEQ ID NO: 2608731 - RNA, 21 nt, Escherichia coli CFT073
guuaucgcugagccgacgcca

SEQ ID NO: 2608732 - RNA, 14 nt, Escherichia coli CFT073
guuaucugaccguu

SEQ ID NO: 2608733 - RNA, 23 nt, Escherichia coli CFT073
guuaucuuccagcggccagacac

SEQ ID NO: 2608734 - RNA, 13 nt, Escherichia coli CFT073
guuaugaaacucc

SEQ ID NO: 2608735 - RNA, 16 nt, Escherichia coli CFT073
guuaugcucaacggug

SEQ ID NO: 2608736 - RNA, 13 nt, Escherichia coli CFT073
guuaugcucggca

SEQ ID NO: 2608737 - RNA, 16 nt, Escherichia coli CFT073
guuauggcaaucuucc

SEQ ID NO: 2608738 - RNA, 21 nt, Escherichia coli CFT073
guuauguacgcguaaaauauu

SEQ ID NO: 2608739 - RNA, 15 nt, Escherichia coli CFT073
guuaugucauugccu

SEQ ID NO: 2608740 - RNA, 14 nt, Escherichia coli CFT073
guuauuaaaaaugg

SEQ ID NO: 2608741 - RNA, 17 nt, Escherichia coli CFT073
guuauuaccaaaaacgg

SEQ ID NO: 2608742 - RNA, 16 nt, Escherichia coli CFT073
guuauuauucauaaau

SEQ ID NO: 2608743 - RNA, 12 nt, Escherichia coli CFT073
guuauucaauua

SEQ ID NO: 2608744 - RNA, 17 nt, Escherichia coli CFT073
guuauucauugccacgu

SEQ ID NO: 2608745 - RNA, 19 nt, Escherichia coli CFT073
guuauucccguggccugca

SEQ ID NO: 2608746 - RNA, 15 nt, Escherichia coli CFT073
guuauucgcuuccuc

SEQ ID NO: 2608747 - RNA, 20 nt, Escherichia coli CFT073
guuauucgcuuccuccacca

SEQ ID NO: 2608748 - RNA, 20 nt, Escherichia coli CFT073
guuauugauaucuuccaugc

SEQ ID NO: 2608749 - RNA, 13 nt, Escherichia coli CFT073
guuauugccaauc

SEQ ID NO: 2608750 - RNA, 18 nt, Escherichia coli CFT073
guuauuuguucagcaaau

SEQ ID NO: 2608751 - RNA, 23 nt, Escherichia coli CFT073
guuauuuguugccggaugcggcg

SEQ ID NO: 2608752 - RNA, 18 nt, Escherichia coli CFT073
guucaaacaccaguucac

SEQ ID NO: 2608753 - RNA, 18 nt, Escherichia coli CFT073
guucaaaccguaaagcac

SEQ ID NO: 2608754 - RNA, 23 nt, Escherichia coli CFT073
guucaaacgauucggcaaucaca

SEQ ID NO: 2608755 - RNA, 18 nt, Escherichia coli CFT073
guucaaagcguggugaga

SEQ ID NO: 2608756 - RNA, 22 nt, Escherichia coli CFT073
guucaaaugcgcucagaguacc

SEQ ID NO: 2608757 - RNA, 20 nt, Escherichia coli CFT073
guucaacaagccacgcacca

SEQ ID NO: 2608758 - RNA, 19 nt, Escherichia coli CFT073
guucaaccucaagcacagc

SEQ ID NO: 2608759 - RNA, 22 nt, Escherichia coli CFT073
guucaaggauguguuccuuggg

SEQ ID NO: 2608760 - RNA, 13 nt, Escherichia coli CFT073
guucaaguaaaac

SEQ ID NO: 2608761 - RNA, 15 nt, Escherichia coli CFT073
guucaauaauauuaa

SEQ ID NO: 2608762 - RNA, 13 nt, Escherichia coli CFT073
guucaaucugucc

SEQ ID NO: 2608763 - RNA, 18 nt, Escherichia coli CFT073
guucaaucuguccuucca

SEQ ID NO: 2608764 - RNA, 16 nt, Escherichia coli CFT073
guucaaugauaauuca

SEQ ID NO: 2608765 - RNA, 19 nt, Escherichia coli CFT073
guucaaugcccacugcaca

SEQ ID NO: 2608766 - RNA, 23 nt, Escherichia coli CFT073
guucaaugcgccggcgcaccggu

SEQ ID NO: 2608767 - RNA, 18 nt, Escherichia coli CFT073
guucacaccaucaucggc

SEQ ID NO: 2608768 - RNA, 15 nt, Escherichia coli CFT073
guucaccaccuggcg

SEQ ID NO: 2608769 - RNA, 14 nt, Escherichia coli CFT073
guucaccagguuuu

SEQ ID NO: 2608770 - RNA, 14 nt, Escherichia coli CFT073
guucaccugguuca

SEQ ID NO: 2608771 - RNA, 19 nt, Escherichia coli CFT073
guucaccugguucagucgu

SEQ ID NO: 2608772 - RNA, 20 nt, Escherichia coli CFT073
guucacgccgcauccggcca

SEQ ID NO: 2608773 - RNA, 21 nt, Escherichia coli CFT073
guucacgcgauuuuucaucga

SEQ ID NO: 2608774 - RNA, 19 nt, Escherichia coli CFT073
guucacugccguacaggca

SEQ ID NO: 2608775 - RNA, 16 nt, Escherichia coli CFT073
guucacugcgaccagc

SEQ ID NO: 2608776 - RNA, 15 nt, Escherichia coli CFT073
guucacuuuucuucu

SEQ ID NO: 2608777 - RNA, 20 nt, Escherichia coli CFT073
guucagaaagcgccagcaag

SEQ ID NO: 2608778 - RNA, 12 nt, Escherichia coli CFT073
guucagauaaau

SEQ ID NO: 2608779 - RNA, 21 nt, Escherichia coli CFT073
guucagaucaucaaagaacag

SEQ ID NO: 2608780 - RNA, 15 nt, Escherichia coli CFT073
guucagcaguucugc

SEQ ID NO: 2608781 - RNA, 18 nt, Escherichia coli CFT073
guucagcaguucugccag

SEQ ID NO: 2608782 - RNA, 17 nt, Escherichia coli CFT073
guucagccgcuuuaucu

SEQ ID NO: 2608783 - RNA, 23 nt, Escherichia coli CFT073
guucagcgguccguugaugcggu

SEQ ID NO: 2608784 - RNA, 15 nt, Escherichia coli CFT073
guucagcggugucug

SEQ ID NO: 2608785 - RNA, 21 nt, Escherichia coli CFT073
guucaggauauuuauauuuug

SEQ ID NO: 2608786 - RNA, 22 nt, Escherichia coli CFT073
guucaggcgauaguagagaucc

SEQ ID NO: 2608787 - RNA, 18 nt, Escherichia coli CFT073
guucaguacgaaauaacu

SEQ ID NO: 2608788 - RNA, 11 nt, Escherichia coli CFT073
guucagugaau

SEQ ID NO: 2608789 - RNA, 14 nt, Escherichia coli CFT073
guucagugaucgcc

SEQ ID NO: 2608790 - RNA, 16 nt, Escherichia coli CFT073
guucagugauggcaca

SEQ ID NO: 2608791 - RNA, 18 nt, Escherichia coli CFT073
guucauaccacgccauca

SEQ ID NO: 2608792 - RNA, 20 nt, Escherichia coli CFT073
guucauauuaaccucucaga

SEQ ID NO: 2608793 - RNA, 23 nt, Escherichia coli CFT073
guucauauugcggcauuugucug

SEQ ID NO: 2608794 - RNA, 12 nt, Escherichia coli CFT073
guucaucaugaa

SEQ ID NO: 2608795 - RNA, 16 nt, Escherichia coli CFT073
guucauccagacgggu

SEQ ID NO: 2608796 - RNA, 24 nt, Escherichia coli CFT073
guucauccagacggguaaacggca

SEQ ID NO: 2608797 - RNA, 18 nt, Escherichia coli CFT073
guucauccccucuuccau

SEQ ID NO: 2608798 - RNA, 23 nt, Escherichia coli CFT073
guucauccgcuucaggaauaaga

SEQ ID NO: 2608799 - RNA, 13 nt, Escherichia coli CFT073
guucaucugacca

SEQ ID NO: 2608800 - RNA, 17 nt, Escherichia coli CFT073
guucaugacgcaggcgu

SEQ ID NO: 2608801 - RNA, 17 nt, Escherichia coli CFT073
guucaugccggaugcgg

SEQ ID NO: 2608802 - RNA, 18 nt, Escherichia coli CFT073
guucaugcugcggcuguc

SEQ ID NO: 2608803 - RNA, 16 nt, Escherichia coli CFT073
guucaugguuagccug

SEQ ID NO: 2608804 - RNA, 17 nt, Escherichia coli CFT073
guucauuggguucaucu

SEQ ID NO: 2608805 - RNA, 19 nt, Escherichia coli CFT073
guucauuucacgcagcgga

SEQ ID NO: 2608806 - RNA, 18 nt, Escherichia coli CFT073
guugacucaaagaugaaa

SEQ ID NO: 2608807 - RNA, 21 nt, Escherichia coli CFT073
guugagcaaucgacgccguuu

SEQ ID NO: 2608808 - RNA, 16 nt, Escherichia coli CFT073
guugagcagcagauga

SEQ ID NO: 2608809 - RNA, 21 nt, Escherichia coli CFT073
guugagcgccguucaaugacg

SEQ ID NO: 2608810 - RNA, 18 nt, Escherichia coli CFT073
guugaggaacuuccagcc

SEQ ID NO: 2608811 - RNA, 11 nt, Escherichia coli CFT073
guugaggaagc

SEQ ID NO: 2608812 - RNA, 19 nt, Escherichia coli CFT073
guugaguacgcauccccag

SEQ ID NO: 2608813 - RNA, 19 nt, Escherichia coli CFT073
guugaguccgguagcgagg

SEQ ID NO: 2608814 - RNA, 19 nt, Escherichia coli CFT073
guugaguucgucgaguuua

SEQ ID NO: 2608815 - RNA, 16 nt, Escherichia coli CFT073
guugauaaugauuuug

SEQ ID NO: 2608816 - RNA, 16 nt, Escherichia coli CFT073
guugauacaggaacag

SEQ ID NO: 2608817 - RNA, 17 nt, Escherichia coli CFT073
guugauccaugccgcca

SEQ ID NO: 2608818 - RNA, 13 nt, Escherichia coli CFT073
guugaucccugca

SEQ ID NO: 2608819 - RNA, 19 nt, Escherichia coli CFT073
guugaucccugcaccaaug

SEQ ID NO: 2608820 - RNA, 20 nt, Escherichia coli CFT073
guugaucgcuuucagcgucu

SEQ ID NO: 2608821 - RNA, 17 nt, Escherichia coli CFT073
guugaucugccccauag

SEQ ID NO: 2608822 - RNA, 13 nt, Escherichia coli CFT073
guugaugaugacg

SEQ ID NO: 2608823 - RNA, 13 nt, Escherichia coli CFT073
guugaugcucagc

SEQ ID NO: 2608824 - RNA, 22 nt, Escherichia coli CFT073
guugaugguguagaaccgguug

SEQ ID NO: 2608825 - RNA, 16 nt, Escherichia coli CFT073
guugauuggcgcaggu

SEQ ID NO: 2608826 - RNA, 19 nt, Escherichia coli CFT073
guugauuggcgcgaaccau

SEQ ID NO: 2608827 - RNA, 19 nt, Escherichia coli CFT073
guugauuucaccaucuuca

SEQ ID NO: 2608828 - RNA, 22 nt, Escherichia coli CFT073
guugauuucaccaucuucacug

SEQ ID NO: 2608829 - RNA, 11 nt, Escherichia coli CFT073
guugauuucca

SEQ ID NO: 2608830 - RNA, 20 nt, Escherichia coli CFT073
guugauuuuguucaauaaga

SEQ ID NO: 2608831 - RNA, 16 nt, Escherichia coli CFT073
guugcaaauauuccau

SEQ ID NO: 2608832 - RNA, 12 nt, Escherichia coli CFT073
guugcaccagca

SEQ ID NO: 2608833 - RNA, 18 nt, Escherichia coli CFT073
guugcacccaguacgggc

SEQ ID NO: 2608834 - RNA, 16 nt, Escherichia coli CFT073
guugcacuauugcgug

SEQ ID NO: 2608835 - RNA, 17 nt, Escherichia coli CFT073
guugcagauuugccagu

SEQ ID NO: 2608836 - RNA, 15 nt, Escherichia coli CFT073
guugcaggaaggcga

SEQ ID NO: 2608837 - RNA, 13 nt, Escherichia coli CFT073
guugcaguaaaau

SEQ ID NO: 2608838 - RNA, 14 nt, Escherichia coli CFT073
guugcauaaagcuc

SEQ ID NO: 2608839 - RNA, 19 nt, Escherichia coli CFT073
guugccaccgguacaaaca

SEQ ID NO: 2608840 - RNA, 19 nt, Escherichia coli CFT073
guugccacguugguggcaa

SEQ ID NO: 2608841 - RNA, 12 nt, Escherichia coli CFT073
guugccagcaac

SEQ ID NO: 2608842 - RNA, 23 nt, Escherichia coli CFT073
guugccagcaacuguaacgcaga

SEQ ID NO: 2608843 - RNA, 13 nt, Escherichia coli CFT073
guugccagcagca

SEQ ID NO: 2608844 - RNA, 13 nt, Escherichia coli CFT073
guugccagcgaca

SEQ ID NO: 2608845 - RNA, 20 nt, Escherichia coli CFT073
guugccagcgacagaaauca

SEQ ID NO: 2608846 - RNA, 15 nt, Escherichia coli CFT073
guugccagcgccagc

SEQ ID NO: 2608847 - RNA, 18 nt, Escherichia coli CFT073
guugccaguaccaucaau

SEQ ID NO: 2608848 - RNA, 23 nt, Escherichia coli CFT073
guugcccgcagauccagugcuca

SEQ ID NO: 2608849 - RNA, 16 nt, Escherichia coli CFT073
guugccgcuuuuucca

SEQ ID NO: 2608850 - RNA, 18 nt, Escherichia coli CFT073
guugccggagaaacuccg

SEQ ID NO: 2608851 - RNA, 22 nt, Escherichia coli CFT073
guugccggaucuuucaggaaca

SEQ ID NO: 2608852 - RNA, 13 nt, Escherichia coli CFT073
guugccggaugcg

SEQ ID NO: 2608853 - RNA, 24 nt, Escherichia coli CFT073
guugccggauggcacgcauccggc

SEQ ID NO: 2608854 - RNA, 18 nt, Escherichia coli CFT073
guugccguccagcgccug

SEQ ID NO: 2608855 - RNA, 17 nt, Escherichia coli CFT073
guugccugaauacacug

SEQ ID NO: 2608856 - RNA, 21 nt, Escherichia coli CFT073
guugccugaauacacugcuga

SEQ ID NO: 2608857 - RNA, 19 nt, Escherichia coli CFT073
guugcgaacuucaggcagg

SEQ ID NO: 2608858 - RNA, 14 nt, Escherichia coli CFT073
guugcgacaaacca

SEQ ID NO: 2608859 - RNA, 22 nt, Escherichia coli CFT073
guugcgacagagauauucagcc

SEQ ID NO: 2608860 - RNA, 18 nt, Escherichia coli CFT073
guugcgcccaucaucauc

SEQ ID NO: 2608861 - RNA, 15 nt, Escherichia coli CFT073
guugcgcuccgcgac

SEQ ID NO: 2608862 - RNA, 21 nt, Escherichia coli CFT073
guugcgcugaaacuucaccaa

SEQ ID NO: 2608863 - RNA, 14 nt, Escherichia coli CFT073
guugcgcuucacca

SEQ ID NO: 2608864 - RNA, 23 nt, Escherichia coli CFT073
guugcgcuucacgaucuucacgg

SEQ ID NO: 2608865 - RNA, 20 nt, Escherichia coli CFT073
guugcgcuucccgaaucaug

SEQ ID NO: 2608866 - RNA, 21 nt, Escherichia coli CFT073
guugcggacugcccgaggcga

SEQ ID NO: 2608867 - RNA, 21 nt, Escherichia coli CFT073
guugcggguaaucaucgccuu

SEQ ID NO: 2608868 - RNA, 17 nt, Escherichia coli CFT073
guugcgguuucucccgu

SEQ ID NO: 2608869 - RNA, 14 nt, Escherichia coli CFT073
guugcgugccuaau

SEQ ID NO: 2608870 - RNA, 19 nt, Escherichia coli CFT073
guugcguuuuuaucuucac

SEQ ID NO: 2608871 - RNA, 17 nt, Escherichia coli CFT073
guugcucaugcaacaca

SEQ ID NO: 2608872 - RNA, 18 nt, Escherichia coli CFT073
guugcuuaaauacgccuc

SEQ ID NO: 2608873 - RNA, 23 nt, Escherichia coli CFT073
guugcuucacggaucgcuuuuac

SEQ ID NO: 2608874 - RNA, 20 nt, Escherichia coli CFT073
guuggacggucuaccaguuu

SEQ ID NO: 2608875 - RNA, 13 nt, Escherichia coli CFT073
guuggcaacgcaa

SEQ ID NO: 2608876 - RNA, 18 nt, Escherichia coli CFT073
guuggcagagauucuuca

SEQ ID NO: 2608877 - RNA, 22 nt, Escherichia coli CFT073
guuggcagaucgguuaucuugc

SEQ ID NO: 2608878 - RNA, 22 nt, Escherichia coli CFT073
guuggcagcggcaagcuggcga

SEQ ID NO: 2608879 - RNA, 17 nt, Escherichia coli CFT073
guuggcgaauaaccgcu

SEQ ID NO: 2608880 - RNA, 19 nt, Escherichia coli CFT073
guuggcgauaaaacccaga

SEQ ID NO: 2608881 - RNA, 17 nt, Escherichia coli CFT073
guuggcgucagaccggc

SEQ ID NO: 2608882 - RNA, 15 nt, Escherichia coli CFT073
guuggguugccagcg

SEQ ID NO: 2608883 - RNA, 18 nt, Escherichia coli CFT073
guugguaccguaaaaaua

SEQ ID NO: 2608884 - RNA, 20 nt, Escherichia coli CFT073
guugguagagcacgaccuug

SEQ ID NO: 2608885 - RNA, 22 nt, Escherichia coli CFT073
guugguagagcacgaccuugcc

SEQ ID NO: 2608886 - RNA, 23 nt, Escherichia coli CFT073
guuggucaucaucaggaacaucc

SEQ ID NO: 2608887 - RNA, 18 nt, Escherichia coli CFT073
guugguccacacgcgccc

SEQ ID NO: 2608888 - RNA, 16 nt, Escherichia coli CFT073
guuggugcgccgguaa

SEQ ID NO: 2608889 - RNA, 15 nt, Escherichia coli CFT073
guuguaaucaccacu

SEQ ID NO: 2608890 - RNA, 22 nt, Escherichia coli CFT073
guuguagccacgucugccacgg

SEQ ID NO: 2608891 - RNA, 22 nt, Escherichia coli CFT073
guuguaguuggaugacauugau

SEQ ID NO: 2608892 - RNA, 21 nt, Escherichia coli CFT073
guugucaccccuaaaccucuu

SEQ ID NO: 2608893 - RNA, 15 nt, Escherichia coli CFT073
guugucgccaguaau

SEQ ID NO: 2608894 - RNA, 22 nt, Escherichia coli CFT073
guugucgguaauugcgccguug

SEQ ID NO: 2608895 - RNA, 23 nt, Escherichia coli CFT073
guugugaauauugccgcugacac

SEQ ID NO: 2608896 - RNA, 16 nt, Escherichia coli CFT073
guugugaauguucaau

SEQ ID NO: 2608897 - RNA, 12 nt, Escherichia coli CFT073
guugugaugcaa

SEQ ID NO: 2608898 - RNA, 14 nt, Escherichia coli CFT073
guugugcaaugucu

SEQ ID NO: 2608899 - RNA, 22 nt, Escherichia coli CFT073
guugugccagaccgaacagcau

SEQ ID NO: 2608900 - RNA, 20 nt, Escherichia coli CFT073
guuguugaacggcaaacgca

SEQ ID NO: 2608901 - RNA, 18 nt, Escherichia coli CFT073
guuguugauaagccccag

SEQ ID NO: 2608902 - RNA, 17 nt, Escherichia coli CFT073
guuguuuaacgguggug

SEQ ID NO: 2608903 - RNA, 15 nt, Escherichia coli CFT073
guuguuuaccaacgc

SEQ ID NO: 2608904 - RNA, 16 nt, Escherichia coli CFT073
guuguuuaccaacgcc

SEQ ID NO: 2608905 - RNA, 17 nt, Escherichia coli CFT073
guuguuuaccaacgccg

SEQ ID NO: 2608906 - RNA, 23 nt, Escherichia coli CFT073
guuuaaaaauacacaauccgcug

SEQ ID NO: 2608907 - RNA, 20 nt, Escherichia coli CFT073
guuuaaaugccggaaugcug

SEQ ID NO: 2608908 - RNA, 14 nt, Escherichia coli CFT073
guuuaaccaacaca

SEQ ID NO: 2608909 - RNA, 19 nt, Escherichia coli CFT073
guuuaaccgggagauuuuc

SEQ ID NO: 2608910 - RNA, 20 nt, Escherichia coli CFT073
guuuaacgguuucaaccagc

SEQ ID NO: 2608911 - RNA, 14 nt, Escherichia coli CFT073
guuuaaggaaaaac

SEQ ID NO: 2608912 - RNA, 19 nt, Escherichia coli CFT073
guuuaaggucguuuugccc

SEQ ID NO: 2608913 - RNA, 20 nt, Escherichia coli CFT073
guuuaaggucguuuugcccg

SEQ ID NO: 2608914 - RNA, 16 nt, Escherichia coli CFT073
guuugaucacuuccag

SEQ ID NO: 2608915 - RNA, 15 nt, Escherichia coli CFT073
guuugaucgcuucca

SEQ ID NO: 2608916 - RNA, 18 nt, Escherichia coli CFT073
guuugaucgcuuccauug

SEQ ID NO: 2608917 - RNA, 21 nt, Escherichia coli CFT073
guuugaugcgcgagguaacaa

SEQ ID NO: 2608918 - RNA, 19 nt, Escherichia coli CFT073
guuugcagcuuacgcgcca

SEQ ID NO: 2608919 - RNA, 16 nt, Escherichia coli CFT073
guuugccaaaccagcu

SEQ ID NO: 2608920 - RNA, 16 nt, Escherichia coli CFT073
guuugccaccugugca

SEQ ID NO: 2608921 - RNA, 12 nt, Escherichia coli CFT073
guuugccagcag

SEQ ID NO: 2608922 - RNA, 14 nt, Escherichia coli CFT073
guuugccagcagag

SEQ ID NO: 2608923 - RNA, 18 nt, Escherichia coli CFT073
guuugccauaaccugcca

SEQ ID NO: 2608924 - RNA, 24 nt, Escherichia coli CFT073
guuugccccauugcucuuucacuu

SEQ ID NO: 2608925 - RNA, 19 nt, Escherichia coli CFT073
guuugcccgucugcugcug

SEQ ID NO: 2608926 - RNA, 15 nt, Escherichia coli CFT073
guuugccgcugucca

SEQ ID NO: 2608927 - RNA, 19 nt, Escherichia coli CFT073
guuugccguuaaucucucc

SEQ ID NO: 2608928 - RNA, 16 nt, Escherichia coli CFT073
guuugcgacaaacuuc

SEQ ID NO: 2608929 - RNA, 21 nt, Escherichia coli CFT073
guuugcgcagccaguuaaccu

SEQ ID NO: 2608930 - RNA, 15 nt, Escherichia coli CFT073
guuugcgcccaguua

SEQ ID NO: 2608931 - RNA, 20 nt, Escherichia coli CFT073
guuugcgcgacguugcuucu

SEQ ID NO: 2608932 - RNA, 20 nt, Escherichia coli CFT073
guuugcggaauaugcugaau

SEQ ID NO: 2608933 - RNA, 17 nt, Escherichia coli CFT073
guuugcgggacaacuug

SEQ ID NO: 2608934 - RNA, 15 nt, Escherichia coli CFT073
guuugcgucauggua

SEQ ID NO: 2608935 - RNA, 18 nt, Escherichia coli CFT073
guuuggaagaccuuccag

SEQ ID NO: 2608936 - RNA, 17 nt, Escherichia coli CFT073
guuuggagccgcuggca

SEQ ID NO: 2608937 - RNA, 12 nt, Escherichia coli CFT073
guuuggcaucag

SEQ ID NO: 2608938 - RNA, 19 nt, Escherichia coli CFT073
guuugggcguuacagcugg

SEQ ID NO: 2608939 - RNA, 14 nt, Escherichia coli CFT073
guuuggucuccugc

SEQ ID NO: 2608940 - RNA, 20 nt, Escherichia coli CFT073
guuugucccuugucuggcau

SEQ ID NO: 2608941 - RNA, 14 nt, Escherichia coli CFT073
guuugucuauuccg

SEQ ID NO: 2608942 - RNA, 18 nt, Escherichia coli CFT073
guuugugacuuuaaaaaa

SEQ ID NO: 2608943 - RNA, 18 nt, Escherichia coli CFT073
guuuguugagauaauuua

SEQ ID NO: 2608944 - RNA, 14 nt, Escherichia coli CFT073
guuuuaaacgcagu

SEQ ID NO: 2608945 - RNA, 19 nt, Escherichia coli CFT073
guuuuaaaucgccgcauca

SEQ ID NO: 2608946 - RNA, 13 nt, Escherichia coli CFT073
guuuuaagguuuc

SEQ ID NO: 2608947 - RNA, 20 nt, Escherichia coli CFT073
guuuuacaauauccagcgcg

SEQ ID NO: 2608948 - RNA, 23 nt, Escherichia coli CFT073
guuuuacaauguccguaacauaa

SEQ ID NO: 2608949 - RNA, 17 nt, Escherichia coli CFT073
guuuuaccggcaacucu

SEQ ID NO: 2608950 - RNA, 22 nt, Escherichia coli CFT073
guuuuaccugcuauagccuccu

SEQ ID NO: 2608951 - RNA, 14 nt, Escherichia coli CFT073
guuuuacgcgucac

SEQ ID NO: 2608952 - RNA, 20 nt, Escherichia coli CFT073
guuuuauagcgggaaauacu

SEQ ID NO: 2608953 - RNA, 16 nt, Escherichia coli CFT073
guuuuauccagugccg

SEQ ID NO: 2608954 - RNA, 16 nt, Escherichia coli CFT073
guuuuaucuccauccg

SEQ ID NO: 2608955 - RNA, 16 nt, Escherichia coli CFT073
guuuuauuauuccauc

SEQ ID NO: 2608956 - RNA, 19 nt, Escherichia coli CFT073
guuuuauuauuccauccug

SEQ ID NO: 2608957 - RNA, 22 nt, Escherichia coli CFT073
guuuuauuauuccauccugcuc

SEQ ID NO: 2608958 - RNA, 18 nt, Escherichia coli CFT073
guuuucaaugucuccguu

SEQ ID NO: 2608959 - RNA, 17 nt, Escherichia coli CFT073
guuuucaguagcaugaa

SEQ ID NO: 2608960 - RNA, 14 nt, Escherichia coli CFT073
guuuuccagguuau

SEQ ID NO: 2608961 - RNA, 14 nt, Escherichia coli CFT073
guuuuccaguuucu

SEQ ID NO: 2608962 - RNA, 19 nt, Escherichia coli CFT073
guuuuccauccuccgcagc

SEQ ID NO: 2608963 - RNA, 21 nt, Escherichia coli CFT073
guuuucccuuuuucauccccg

SEQ ID NO: 2608964 - RNA, 15 nt, Escherichia coli CFT073
guuuucgauuuuuuc

SEQ ID NO: 2608965 - RNA, 20 nt, Escherichia coli CFT073
guuuucgauuuuuuccagcg

SEQ ID NO: 2608966 - RNA, 18 nt, Escherichia coli CFT073
guuuucgcaccugccagu

SEQ ID NO: 2608967 - RNA, 23 nt, Escherichia coli CFT073
guuuucgucgccaucaauaacca

SEQ ID NO: 2608968 - RNA, 21 nt, Escherichia coli CFT073
guuuucgucguacugaccgua

SEQ ID NO: 2608969 - RNA, 19 nt, Escherichia coli CFT073
guuuucucaaugaugccgc

SEQ ID NO: 2608970 - RNA, 21 nt, Escherichia coli CFT073
guuuucuccaaccagcuguuc

SEQ ID NO: 2608971 - RNA, 14 nt, Escherichia coli CFT073
guuuucuccagcgc

SEQ ID NO: 2608972 - RNA, 15 nt, Escherichia coli CFT073
guuuucucccggcac

SEQ ID NO: 2608973 - RNA, 22 nt, Escherichia coli CFT073
guuuucucguuggguugccagc

SEQ ID NO: 2608974 - RNA, 17 nt, Escherichia coli CFT073
guuuucucuuuccagca

SEQ ID NO: 2608975 - RNA, 14 nt, Escherichia coli CFT073
guuuucugccagac

SEQ ID NO: 2608976 - RNA, 19 nt, Escherichia coli CFT073
guuuucugccagacaaaac

SEQ ID NO: 2608977 - RNA, 15 nt, Escherichia coli CFT073
guuuucuggcugaca

SEQ ID NO: 2608978 - RNA, 15 nt, Escherichia coli CFT073
guuuucuucaaugaa

SEQ ID NO: 2608979 - RNA, 14 nt, Escherichia coli CFT073
guuuucuuccagcc

SEQ ID NO: 2608980 - RNA, 17 nt, Escherichia coli CFT073
guuuucuuguuccugca

SEQ ID NO: 2608981 - RNA, 16 nt, Escherichia coli CFT073
guuuucuuguugccug

SEQ ID NO: 2608982 - RNA, 19 nt, Escherichia coli CFT073
guuuucuuuaccaccaaau

SEQ ID NO: 2608983 - RNA, 21 nt, Escherichia coli CFT073
guuuugacagcucacgcgcca

SEQ ID NO: 2608984 - RNA, 20 nt, Escherichia coli CFT073
guuuugagccucgcugcuca

SEQ ID NO: 2608985 - RNA, 17 nt, Escherichia coli CFT073
guuuugcaaucaucgca

SEQ ID NO: 2608986 - RNA, 23 nt, Escherichia coli CFT073
guuuugccagucaggcaugauca

SEQ ID NO: 2608987 - RNA, 17 nt, Escherichia coli CFT073
guuuugcggcgugaccu

SEQ ID NO: 2608988 - RNA, 17 nt, Escherichia coli CFT073
guuuugcuguuccagca

SEQ ID NO: 2608989 - RNA, 22 nt, Escherichia coli CFT073
guuuugguuaacugaauauucc

SEQ ID NO: 2608990 - RNA, 15 nt, Escherichia coli CFT073
guuuuguagaccuga

SEQ ID NO: 2608991 - RNA, 14 nt, Escherichia coli CFT073
guuuuguggcaaac

SEQ ID NO: 2608992 - RNA, 22 nt, Escherichia coli CFT073
guuuuuauuauuaaaccaggaa

SEQ ID NO: 2608993 - RNA, 12 nt, Escherichia coli CFT073
guuuuucaacac

SEQ ID NO: 2608994 - RNA, 19 nt, Escherichia coli CFT073
guuuuucagcgccagcgcg

SEQ ID NO: 2608995 - RNA, 12 nt, Escherichia coli CFT073
guuuuuccagcu

SEQ ID NO: 2608996 - RNA, 13 nt, Escherichia coli CFT073
guuuuuccagcuu

SEQ ID NO: 2608997 - RNA, 15 nt, Escherichia coli CFT073
guuuuuccccugcca

SEQ ID NO: 2608998 - RNA, 19 nt, Escherichia coli CFT073
guuuuucggaucgaggcga

SEQ ID NO: 2608999 - RNA, 19 nt, Escherichia coli CFT073
guuuuucuuccggcagcaa

SEQ ID NO: 2609000 - RNA, 10 nt, Escherichia coli CFT073
guuuuugcau

SEQ ID NO: 2609001 - RNA, 14 nt, Escherichia coli CFT073
guuuuugcccauca

SEQ ID NO: 2609002 - RNA, 12 nt, Escherichia coli CFT073
guuuuugcuucu

SEQ ID NO: 2609003 - RNA, 22 nt, Escherichia coli CFT073
guuuuuguccccgcaucaguga

SEQ ID NO: 2609004 - RNA, 15 nt, Escherichia coli CFT073
guuuuuguugauaaa

SEQ ID NO: 2609005 - RNA, 16 nt, Escherichia coli CFT073
guuuuuuaauucagga

SEQ ID NO: 2609006 - RNA, 16 nt, Escherichia coli CFT073
guuuuuuacgaugcaa

SEQ ID NO: 2609007 - RNA, 14 nt, Escherichia coli CFT073
guuuuuuauacuca

SEQ ID NO: 2609008 - RNA, 22 nt, Escherichia coli CFT073
guuuuuuauauucaugaauaaa

SEQ ID NO: 2609009 - RNA, 11 nt, Escherichia coli CFT073
guuuuuuauuu

SEQ ID NO: 2609010 - RNA, 13 nt, Escherichia coli CFT073
guuuuuucaucga

SEQ ID NO: 2609011 - RNA, 23 nt, Escherichia coli CFT073
guuuuuucgcuugaucuuccuga

SEQ ID NO: 2609012 - RNA, 18 nt, Escherichia coli CFT073
guuuuuucuguauucauc

SEQ ID NO: 2609013 - RNA, 21 nt, Escherichia coli CFT073
guuuuuugggaugauagccau

SEQ ID NO: 2609014 - RNA, 15 nt, Escherichia coli CFT073
guuuuuuguugccug

SEQ ID NO: 2609015 - RNA, 17 nt, Escherichia coli CFT073
guuuuuuuauagcuuau

SEQ ID NO: 2609016 - RNA, 17 nt, Escherichia coli CFT073
guuuuuuuauaucucag

SEQ ID NO: 2609017 - RNA, 20 nt, Escherichia coli CFT073
guuuuuuuauaucucagaua

SEQ ID NO: 2609018 - RNA, 23 nt, Escherichia coli CFT073
guuuuuuuauaucucagauaaau

SEQ ID NO: 2609019 - RNA, 17 nt, Escherichia coli CFT073
uaaaaaaacgccagaau

SEQ ID NO: 2609020 - RNA, 22 nt, Escherichia coli CFT073
uaaaaaaacgcgugccucuucu

SEQ ID NO: 2609021 - RNA, 17 nt, Escherichia coli CFT073
uaaaaaaaugaguauua

SEQ ID NO: 2609022 - RNA, 19 nt, Escherichia coli CFT073
uaaacccuuucugcugcuu

SEQ ID NO: 2609023 - RNA, 14 nt, Escherichia coli CFT073
uaaaccgagccaaa

SEQ ID NO: 2609024 - RNA, 12 nt, Escherichia coli CFT073
uaaaccgccagu

SEQ ID NO: 2609025 - RNA, 15 nt, Escherichia coli CFT073
uaaaccgggucagcc

SEQ ID NO: 2609026 - RNA, 19 nt, Escherichia coli CFT073
uaaaccguccccaaaaaag

SEQ ID NO: 2609027 - RNA, 15 nt, Escherichia coli CFT073
uaaaccgugauauug

SEQ ID NO: 2609028 - RNA, 17 nt, Escherichia coli CFT073
uaaaccuccagcaucag

SEQ ID NO: 2609029 - RNA, 17 nt, Escherichia coli CFT073
uaaacgauaauacgucg

SEQ ID NO: 2609030 - RNA, 19 nt, Escherichia coli CFT073
uaaacgcaguaaacgccag

SEQ ID NO: 2609031 - RNA, 17 nt, Escherichia coli CFT073
uaaacgcauaucgcccu

SEQ ID NO: 2609032 - RNA, 12 nt, Escherichia coli CFT073
uaaacgccaggu

SEQ ID NO: 2609033 - RNA, 15 nt, Escherichia coli CFT073
uaaacgccuuaucag

SEQ ID NO: 2609034 - RNA, 23 nt, Escherichia coli CFT073
uaaacgcgcuaaccuguuuucga

SEQ ID NO: 2609035 - RNA, 21 nt, Escherichia coli CFT073
uaaacggcauaaauuucaggc

SEQ ID NO: 2609036 - RNA, 14 nt, Escherichia coli CFT073
uaaacggugauacu

SEQ ID NO: 2609037 - RNA, 20 nt, Escherichia coli CFT073
uaaacgguguaaaauucaca

SEQ ID NO: 2609038 - RNA, 18 nt, Escherichia coli CFT073
uaaacgguuucagcagug

SEQ ID NO: 2609039 - RNA, 19 nt, Escherichia coli CFT073
uaaacguacuggcgauugu

SEQ ID NO: 2609040 - RNA, 20 nt, Escherichia coli CFT073
uaaacguagcggaaaucaca

SEQ ID NO: 2609041 - RNA, 12 nt, Escherichia coli CFT073
uaaacuccuuuc

SEQ ID NO: 2609042 - RNA, 15 nt, Escherichia coli CFT073
uaaacuggaaaaccg

SEQ ID NO: 2609043 - RNA, 16 nt, Escherichia coli CFT073
uaaacugucaacacca

SEQ ID NO: 2609044 - RNA, 21 nt, Escherichia coli CFT073
uaaacugucaacaccagggaa

SEQ ID NO: 2609045 - RNA, 15 nt, Escherichia coli CFT073
uaaacuguuuccagu

SEQ ID NO: 2609046 - RNA, 20 nt, Escherichia coli CFT073
uaaacuuacugacaucaaac

SEQ ID NO: 2609047 - RNA, 12 nt, Escherichia coli CFT073
uaaacuucaacg

SEQ ID NO: 2609048 - RNA, 13 nt, Escherichia coli CFT073
uaaacuucaccag

SEQ ID NO: 2609049 - RNA, 14 nt, Escherichia coli CFT073
uaaacuuuagcaca

SEQ ID NO: 2609050 - RNA, 22 nt, Escherichia coli CFT073
uaaagaaaacgaauugcagaac

SEQ ID NO: 2609051 - RNA, 20 nt, Escherichia coli CFT073
uaaagaaacggagccuuucg

SEQ ID NO: 2609052 - RNA, 14 nt, Escherichia coli CFT073
uaaagaaacugguu

SEQ ID NO: 2609053 - RNA, 22 nt, Escherichia coli CFT073
uaaagaaauuucccaccgaaac

SEQ ID NO: 2609054 - RNA, 18 nt, Escherichia coli CFT073
uaaagaacgcaccgacca

SEQ ID NO: 2609055 - RNA, 16 nt, Escherichia coli CFT073
uaaagacauuagugau

SEQ ID NO: 2609056 - RNA, 22 nt, Escherichia coli CFT073
uaaagaccauugaugcucuccg

SEQ ID NO: 2609057 - RNA, 23 nt, Escherichia coli CFT073
uaaagacgguggcacauaauuga

SEQ ID NO: 2609058 - RNA, 22 nt, Escherichia coli CFT073
uaaagauaaugccagccugcaa

SEQ ID NO: 2609059 - RNA, 13 nt, Escherichia coli CFT073
uaaagaucuuauu

SEQ ID NO: 2609060 - RNA, 23 nt, Escherichia coli CFT073
uaaagaugaaaacgccaccagau

SEQ ID NO: 2609061 - RNA, 17 nt, Escherichia coli CFT073
uaaagcaacuccaucaa

SEQ ID NO: 2609062 - RNA, 11 nt, Escherichia coli CFT073
uaaagcaauga

SEQ ID NO: 2609063 - RNA, 15 nt, Escherichia coli CFT073
uaaagccagcggcac

SEQ ID NO: 2609064 - RNA, 19 nt, Escherichia coli CFT073
uaaagcccauaccacagca

SEQ ID NO: 2609065 - RNA, 19 nt, Escherichia coli CFT073
uaaagcccccacaacauug

SEQ ID NO: 2609066 - RNA, 17 nt, Escherichia coli CFT073
uaaagcccgcagcgucc

SEQ ID NO: 2609067 - RNA, 12 nt, Escherichia coli CFT073
uaaagcccgcca

SEQ ID NO: 2609068 - RNA, 21 nt, Escherichia coli CFT073
uaaagcccucaccgaagcgag

SEQ ID NO: 2609069 - RNA, 20 nt, Escherichia coli CFT073
uaaagcccugcucgcgcaga

SEQ ID NO: 2609070 - RNA, 15 nt, Escherichia coli CFT073
uaaagccgcgaaacu

SEQ ID NO: 2609071 - RNA, 14 nt, Escherichia coli CFT073
uaaagccugcuggc

SEQ ID NO: 2609072 - RNA, 16 nt, Escherichia coli CFT073
uaaagccugcuggcag

SEQ ID NO: 2609073 - RNA, 18 nt, Escherichia coli CFT073
uaaagccuguaaugccuu

SEQ ID NO: 2609074 - RNA, 20 nt, Escherichia coli CFT073
uaaagcgaaacagcgcccca

SEQ ID NO: 2609075 - RNA, 17 nt, Escherichia coli CFT073
uaaagcgauccaguucc

SEQ ID NO: 2609076 - RNA, 17 nt, Escherichia coli CFT073
uaaagcgcaugaugucu

SEQ ID NO: 2609077 - RNA, 19 nt, Escherichia coli CFT073
uaaagcgcgaucgcuaccu

SEQ ID NO: 2609078 - RNA, 21 nt, Escherichia coli CFT073
uaaagcgcguaguuugucuuc

SEQ ID NO: 2609079 - RNA, 22 nt, Escherichia coli CFT073
uaaagcgguguuucgggcagcc

SEQ ID NO: 2609080 - RNA, 17 nt, Escherichia coli CFT073
uaaagcguuccagcagc

SEQ ID NO: 2609081 - RNA, 14 nt, Escherichia coli CFT073
uaaagcuaucccuu

SEQ ID NO: 2609082 - RNA, 13 nt, Escherichia coli CFT073
uaaagcuuuaaua

SEQ ID NO: 2609083 - RNA, 19 nt, Escherichia coli CFT073
uaaaggaguaacagauugu

SEQ ID NO: 2609084 - RNA, 17 nt, Escherichia coli CFT073
uaaaggauuuacuaaaa

SEQ ID NO: 2609085 - RNA, 14 nt, Escherichia coli CFT073
uaaaggucaauucc

SEQ ID NO: 2609086 - RNA, 14 nt, Escherichia coli CFT073
uaaaggucaucaca

SEQ ID NO: 2609087 - RNA, 15 nt, Escherichia coli CFT073
uaaaggucaucacau

SEQ ID NO: 2609088 - RNA, 16 nt, Escherichia coli CFT073
uaaaggugucaauaau

SEQ ID NO: 2609089 - RNA, 16 nt, Escherichia coli CFT073
uaaaguacaauaucgc

SEQ ID NO: 2609090 - RNA, 18 nt, Escherichia coli CFT073
uaaaguaucaaacagaaa

SEQ ID NO: 2609091 - RNA, 22 nt, Escherichia coli CFT073
uaaagucagcguuauagcgcau

SEQ ID NO: 2609092 - RNA, 23 nt, Escherichia coli CFT073
uaaaguccgguaauggagauugu

SEQ ID NO: 2609093 - RNA, 14 nt, Escherichia coli CFT073
uaaagucuggaaga

SEQ ID NO: 2609094 - RNA, 13 nt, Escherichia coli CFT073
uaaagugaaauau

SEQ ID NO: 2609095 - RNA, 18 nt, Escherichia coli CFT073
uaaagugaaauauuucuu

SEQ ID NO: 2609096 - RNA, 20 nt, Escherichia coli CFT073
uaaaguggcggggaucacuc

SEQ ID NO: 2609097 - RNA, 16 nt, Escherichia coli CFT073
uaaaguguuccggcug

SEQ ID NO: 2609098 - RNA, 16 nt, Escherichia coli CFT073
uaaaguuaguaccgaa

SEQ ID NO: 2609099 - RNA, 16 nt, Escherichia coli CFT073
uaaauaaacaccagca

SEQ ID NO: 2609100 - RNA, 21 nt, Escherichia coli CFT073
uaaauaaaugucgauuaucga

SEQ ID NO: 2609101 - RNA, 13 nt, Escherichia coli CFT073
uaaauaauaagua

SEQ ID NO: 2609102 - RNA, 12 nt, Escherichia coli CFT073
uaaauaauaucc

SEQ ID NO: 2609103 - RNA, 14 nt, Escherichia coli CFT073
uaaauaaucgauca

SEQ ID NO: 2609104 - RNA, 15 nt, Escherichia coli CFT073
uaaauaaucucuucc

SEQ ID NO: 2609105 - RNA, 12 nt, Escherichia coli CFT073
uaaauaaugcuu

SEQ ID NO: 2609106 - RNA, 19 nt, Escherichia coli CFT073
uaaauaauuugaacugguu

SEQ ID NO: 2609107 - RNA, 11 nt, Escherichia coli CFT073
uaaauacagag

SEQ ID NO: 2609108 - RNA, 14 nt, Escherichia coli CFT073
uaaauacagagcac

SEQ ID NO: 2609109 - RNA, 17 nt, Escherichia coli CFT073
uaaauaccggcauguuu

SEQ ID NO: 2609110 - RNA, 15 nt, Escherichia coli CFT073
uaaauaccguucauu

SEQ ID NO: 2609111 - RNA, 22 nt, Escherichia coli CFT073
uaaauaccguucauuaacgccc

SEQ ID NO: 2609112 - RNA, 21 nt, Escherichia coli CFT073
uaaauacgccucuucauacau

SEQ ID NO: 2609113 - RNA, 17 nt, Escherichia coli CFT073
uaaauacucauuaauuu

SEQ ID NO: 2609114 - RNA, 12 nt, Escherichia coli CFT073
uaaauaguggca

SEQ ID NO: 2609115 - RNA, 20 nt, Escherichia coli CFT073
uaaauaguuuuuuacgaugc

SEQ ID NO: 2609116 - RNA, 13 nt, Escherichia coli CFT073
uaaauaucaaaaa

SEQ ID NO: 2609117 - RNA, 12 nt, Escherichia coli CFT073
uaaauauuauau

SEQ ID NO: 2609118 - RNA, 15 nt, Escherichia coli CFT073
uaaauauuauuguuu

SEQ ID NO: 2609119 - RNA, 16 nt, Escherichia coli CFT073
uaaauauuguuuuuau

SEQ ID NO: 2609120 - RNA, 18 nt, Escherichia coli CFT073
uaaauauuuuuuagcaca

SEQ ID NO: 2609121 - RNA, 16 nt, Escherichia coli CFT073
uaaaucaacgccagau

SEQ ID NO: 2609122 - RNA, 20 nt, Escherichia coli CFT073
uaaaucaagcgccgccaguc

SEQ ID NO: 2609123 - RNA, 15 nt, Escherichia coli CFT073
uaaaucacgcuuauc

SEQ ID NO: 2609124 - RNA, 20 nt, Escherichia coli CFT073
uaaaucacgcuuaucgcccu

SEQ ID NO: 2609125 - RNA, 11 nt, Escherichia coli CFT073
uaaaucagauc

SEQ ID NO: 2609126 - RNA, 18 nt, Escherichia coli CFT073
uaaaucagccuuaaucuu

SEQ ID NO: 2609127 - RNA, 14 nt, Escherichia coli CFT073
uaaauccauaagau

SEQ ID NO: 2609128 - RNA, 22 nt, Escherichia coli CFT073
uaaaucccgccgcuucgccaau

SEQ ID NO: 2609129 - RNA, 17 nt, Escherichia coli CFT073
uaaaucccgucuggcga

SEQ ID NO: 2609130 - RNA, 15 nt, Escherichia coli CFT073
uaaauccgccgccac

SEQ ID NO: 2609131 - RNA, 12 nt, Escherichia coli CFT073
uaaccaucagcu

SEQ ID NO: 2609132 - RNA, 20 nt, Escherichia coli CFT073
uaaccaucagcuccgggcua

SEQ ID NO: 2609133 - RNA, 20 nt, Escherichia coli CFT073
uaaccauccauauuuggcau

SEQ ID NO: 2609134 - RNA, 12 nt, Escherichia coli CFT073
uaaccaucccuu

SEQ ID NO: 2609135 - RNA, 16 nt, Escherichia coli CFT073
uaaccaugcagcgccg

SEQ ID NO: 2609136 - RNA, 16 nt, Escherichia coli CFT073
uaaccauggcuggcac

SEQ ID NO: 2609137 - RNA, 13 nt, Escherichia coli CFT073
uaacccacaccau

SEQ ID NO: 2609138 - RNA, 22 nt, Escherichia coli CFT073
uaacccaccaccgcuaacugcu

SEQ ID NO: 2609139 - RNA, 18 nt, Escherichia coli CFT073
uaacccagcaccaacaaa

SEQ ID NO: 2609140 - RNA, 21 nt, Escherichia coli CFT073
uaacccauccagcagagauac

SEQ ID NO: 2609141 - RNA, 13 nt, Escherichia coli CFT073
uaaccccagacca

SEQ ID NO: 2609142 - RNA, 13 nt, Escherichia coli CFT073
uaacccccugccc

SEQ ID NO: 2609143 - RNA, 18 nt, Escherichia coli CFT073
uaacccgcgacgacgaca

SEQ ID NO: 2609144 - RNA, 20 nt, Escherichia coli CFT073
uaacccugcauauaaucgau

SEQ ID NO: 2609145 - RNA, 13 nt, Escherichia coli CFT073
uaacccuuccaga

SEQ ID NO: 2609146 - RNA, 23 nt, Escherichia coli CFT073
uaaccgaccgguccacuuccugc

SEQ ID NO: 2609147 - RNA, 17 nt, Escherichia coli CFT073
uaaccgagaauuuccag

SEQ ID NO: 2609148 - RNA, 18 nt, Escherichia coli CFT073
uaaccgagaauuuccaga

SEQ ID NO: 2609149 - RNA, 14 nt, Escherichia coli CFT073
uaaccgccaccagg

SEQ ID NO: 2609150 - RNA, 17 nt, Escherichia coli CFT073
uaaccgccagcacagcc

SEQ ID NO: 2609151 - RNA, 19 nt, Escherichia coli CFT073
uaaccgccagcacagccag

SEQ ID NO: 2609152 - RNA, 15 nt, Escherichia coli CFT073
uaaccgcccaccgcc

SEQ ID NO: 2609153 - RNA, 17 nt, Escherichia coli CFT073
uaaccgccguucuucag

SEQ ID NO: 2609154 - RNA, 17 nt, Escherichia coli CFT073
uaaccgcuuaagcugcc

SEQ ID NO: 2609155 - RNA, 18 nt, Escherichia coli CFT073
uaaccgcuucgcuggcag

SEQ ID NO: 2609156 - RNA, 18 nt, Escherichia coli CFT073
uaaccggauaucuaaugc

SEQ ID NO: 2609157 - RNA, 19 nt, Escherichia coli CFT073
uaaccgggguuucacccac

SEQ ID NO: 2609158 - RNA, 20 nt, Escherichia coli CFT073
uaaccgguauugcuccagau

SEQ ID NO: 2609159 - RNA, 14 nt, Escherichia coli CFT073
uaaccguccaguug

SEQ ID NO: 2609160 - RNA, 17 nt, Escherichia coli CFT073
uaaccuguuuauuaugc

SEQ ID NO: 2609161 - RNA, 18 nt, Escherichia coli CFT073
uaaccuuugaacagccag

SEQ ID NO: 2609162 - RNA, 19 nt, Escherichia coli CFT073
uaaccuuugaacagccaga

SEQ ID NO: 2609163 - RNA, 22 nt, Escherichia coli CFT073
uaaccuuuucccgauauaacca

SEQ ID NO: 2609164 - RNA, 14 nt, Escherichia coli CFT073
uaacgaacgcagug

SEQ ID NO: 2609165 - RNA, 20 nt, Escherichia coli CFT073
uaacgaacgcagugauaacu

SEQ ID NO: 2609166 - RNA, 21 nt, Escherichia coli CFT073
uaacgaaggugaacgccacca

SEQ ID NO: 2609167 - RNA, 23 nt, Escherichia coli CFT073
uaacgaaggugaacgccaccaac

SEQ ID NO: 2609168 - RNA, 23 nt, Escherichia coli CFT073
uaacgaagucguuaguaaccacu

SEQ ID NO: 2609169 - RNA, 16 nt, Escherichia coli CFT073
uaacgaauaauccagc

SEQ ID NO: 2609170 - RNA, 17 nt, Escherichia coli CFT073
uaacgaauaauccagcg

SEQ ID NO: 2609171 - RNA, 21 nt, Escherichia coli CFT073
uaacgaggcgacgguuuccag

SEQ ID NO: 2609172 - RNA, 18 nt, Escherichia coli CFT073
uaacgauaccaacgcauu

SEQ ID NO: 2609173 - RNA, 21 nt, Escherichia coli CFT073
uaacgauaccaacgcauuuau

SEQ ID NO: 2609174 - RNA, 13 nt, Escherichia coli CFT073
uaacgauacggcg

SEQ ID NO: 2609175 - RNA, 15 nt, Escherichia coli CFT073
uaacgaugccagcgc

SEQ ID NO: 2609176 - RNA, 20 nt, Escherichia coli CFT073
uaacgcagaaucuucuucuc

SEQ ID NO: 2609177 - RNA, 20 nt, Escherichia coli CFT073
uaacgcauucgccguuacca

SEQ ID NO: 2609178 - RNA, 21 nt, Escherichia coli CFT073
uaacgccaauucauuccuuga

SEQ ID NO: 2609179 - RNA, 19 nt, Escherichia coli CFT073
uaacgccacgccaccagcg

SEQ ID NO: 2609180 - RNA, 14 nt, Escherichia coli CFT073
uaacgccagacucg

SEQ ID NO: 2609181 - RNA, 20 nt, Escherichia coli CFT073
uaacgccagacucgccaggc

SEQ ID NO: 2609182 - RNA, 14 nt, Escherichia coli CFT073
uaacgccagccaca

SEQ ID NO: 2609183 - RNA, 20 nt, Escherichia coli CFT073
uaacgccagccacaaaccau

SEQ ID NO: 2609184 - RNA, 15 nt, Escherichia coli CFT073
uaacgccagugaugu

SEQ ID NO: 2609185 - RNA, 15 nt, Escherichia coli CFT073
uaacgccccaaucca

SEQ ID NO: 2609186 - RNA, 20 nt, Escherichia coli CFT073
uaacgcccgagccgguugcc

SEQ ID NO: 2609187 - RNA, 19 nt, Escherichia coli CFT073
uaacgccgcauccggcaua

SEQ ID NO: 2609188 - RNA, 17 nt, Escherichia coli CFT073
uaacgccgcgcccgcua

SEQ ID NO: 2609189 - RNA, 18 nt, Escherichia coli CFT073
uaacgccuggcaguggug

SEQ ID NO: 2609190 - RNA, 19 nt, Escherichia coli CFT073
uaacgccuucccuuucagc

SEQ ID NO: 2609191 - RNA, 19 nt, Escherichia coli CFT073
uaacgcgggcuucuucuuu

SEQ ID NO: 2609192 - RNA, 19 nt, Escherichia coli CFT073
uaacgcguccuguaacgca

SEQ ID NO: 2609193 - RNA, 18 nt, Escherichia coli CFT073
uaacgcuggcagcaagug

SEQ ID NO: 2609194 - RNA, 19 nt, Escherichia coli CFT073
uaacgcuggggccaucgcc

SEQ ID NO: 2609195 - RNA, 18 nt, Escherichia coli CFT073
uaacggcagaagcagcag

SEQ ID NO: 2609196 - RNA, 22 nt, Escherichia coli CFT073
uaacggcagaagcagcaggacc

SEQ ID NO: 2609197 - RNA, 22 nt, Escherichia coli CFT073
uaacggcagaucgguaauugcc

SEQ ID NO: 2609198 - RNA, 16 nt, Escherichia coli CFT073
uaacggcauuuuccag

SEQ ID NO: 2609199 - RNA, 22 nt, Escherichia coli CFT073
uaacggccaggcgcuuuuucuu

SEQ ID NO: 2609200 - RNA, 14 nt, Escherichia coli CFT073
uaacggccugacca

SEQ ID NO: 2609201 - RNA, 21 nt, Escherichia coli CFT073
uaacggcgguaaacucgugau

SEQ ID NO: 2609202 - RNA, 16 nt, Escherichia coli CFT073
uaacggcucaccccca

SEQ ID NO: 2609203 - RNA, 21 nt, Escherichia coli CFT073
uaacggcugauaacaauauca

SEQ ID NO: 2609204 - RNA, 21 nt, Escherichia coli CFT073
uaacgguaaagcccucaccga

SEQ ID NO: 2609205 - RNA, 18 nt, Escherichia coli CFT073
uaacgguucggcaaucca

SEQ ID NO: 2609206 - RNA, 19 nt, Escherichia coli CFT073
uaacguaaaaacccgcuuc

SEQ ID NO: 2609207 - RNA, 13 nt, Escherichia coli CFT073
uaacguaaaccaa

SEQ ID NO: 2609208 - RNA, 17 nt, Escherichia coli CFT073
uaacguacuacuuuguu

SEQ ID NO: 2609209 - RNA, 16 nt, Escherichia coli CFT073
uaacguagcccugccg

SEQ ID NO: 2609210 - RNA, 15 nt, Escherichia coli CFT073
uaacguauugggaug

SEQ ID NO: 2609211 - RNA, 22 nt, Escherichia coli CFT073
uaacgucauauacccugccaga

SEQ ID NO: 2609212 - RNA, 21 nt, Escherichia coli CFT073
uaacguccauucccuggcacu

SEQ ID NO: 2609213 - RNA, 21 nt, Escherichia coli CFT073
uaacgucgcaagacgaaaaau

SEQ ID NO: 2609214 - RNA, 22 nt, Escherichia coli CFT073
uaacgucgccagaaaucagcag

SEQ ID NO: 2609215 - RNA, 20 nt, Escherichia coli CFT073
uaacgucgcgcggauuuguu

SEQ ID NO: 2609216 - RNA, 21 nt, Escherichia coli CFT073
uaacgucgcgcggauuuguuc

SEQ ID NO: 2609217 - RNA, 15 nt, Escherichia coli CFT073
uaacguggcagcagg

SEQ ID NO: 2609218 - RNA, 16 nt, Escherichia coli CFT073
uaacguuauaaccgcc

SEQ ID NO: 2609219 - RNA, 15 nt, Escherichia coli CFT073
uaacguugaaccgcc

SEQ ID NO: 2609220 - RNA, 22 nt, Escherichia coli CFT073
uaacguugggugcaaucaguac

SEQ ID NO: 2609221 - RNA, 22 nt, Escherichia coli CFT073
uaacguuuagcgguggcaagca

SEQ ID NO: 2609222 - RNA, 18 nt, Escherichia coli CFT073
uaacguuuaucccaguca

SEQ ID NO: 2609223 - RNA, 18 nt, Escherichia coli CFT073
uaacguuucuuucaucag

SEQ ID NO: 2609224 - RNA, 16 nt, Escherichia coli CFT073
uaacguuugccagcca

SEQ ID NO: 2609225 - RNA, 18 nt, Escherichia coli CFT073
uaacguuugccagccaca

SEQ ID NO: 2609226 - RNA, 19 nt, Escherichia coli CFT073
uaacguuugccagccacac

SEQ ID NO: 2609227 - RNA, 21 nt, Escherichia coli CFT073
uaacuaacgguagccugcaau

SEQ ID NO: 2609228 - RNA, 19 nt, Escherichia coli CFT073
uaacuauaugacucauaaa

SEQ ID NO: 2609229 - RNA, 22 nt, Escherichia coli CFT073
uaacuaucaggucuuucugaaa

SEQ ID NO: 2609230 - RNA, 20 nt, Escherichia coli CFT073
uaacucaaaaauaaucaucu

SEQ ID NO: 2609231 - RNA, 12 nt, Escherichia coli CFT073
uaacucaccauc

SEQ ID NO: 2609232 - RNA, 16 nt, Escherichia coli CFT073
uaacucacuggcgcgc

SEQ ID NO: 2609233 - RNA, 16 nt, Escherichia coli CFT073
uaacucaggaugagaa

SEQ ID NO: 2609234 - RNA, 17 nt, Escherichia coli CFT073
uaacucauugauuuuca

SEQ ID NO: 2609235 - RNA, 19 nt, Escherichia coli CFT073
uaacucauugccagcccua

SEQ ID NO: 2609236 - RNA, 15 nt, Escherichia coli CFT073
uaacuccugauucca

SEQ ID NO: 2609237 - RNA, 20 nt, Escherichia coli CFT073
uaacuccugcgucggaacau

SEQ ID NO: 2609238 - RNA, 19 nt, Escherichia coli CFT073
uaaucagaacaauuccugu

SEQ ID NO: 2609239 - RNA, 22 nt, Escherichia coli CFT073
uaaucagaucguugaccuggau

SEQ ID NO: 2609240 - RNA, 13 nt, Escherichia coli CFT073
uaaucaggcuauc

SEQ ID NO: 2609241 - RNA, 20 nt, Escherichia coli CFT073
uaaucaguuuaucaaucuca

SEQ ID NO: 2609242 - RNA, 14 nt, Escherichia coli CFT073
uaaucauaaaacac

SEQ ID NO: 2609243 - RNA, 17 nt, Escherichia coli CFT073
uaaucauaauuauaaua

SEQ ID NO: 2609244 - RNA, 11 nt, Escherichia coli CFT073
uaaucaucaug

SEQ ID NO: 2609245 - RNA, 14 nt, Escherichia coli CFT073
uaaucaucaugcuu

SEQ ID NO: 2609246 - RNA, 22 nt, Escherichia coli CFT073
uaaucaucaugcuuaaauauuu

SEQ ID NO: 2609247 - RNA, 18 nt, Escherichia coli CFT073
uaaucaucccacaugaau

SEQ ID NO: 2609248 - RNA, 19 nt, Escherichia coli CFT073
uaaucaucgccuucaucug

SEQ ID NO: 2609249 - RNA, 13 nt, Escherichia coli CFT073
uaaucaucuucau

SEQ ID NO: 2609250 - RNA, 12 nt, Escherichia coli CFT073
uaaucaugaacg

SEQ ID NO: 2609251 - RNA, 21 nt, Escherichia coli CFT073
uaaucaugcagcgcagaccau

SEQ ID NO: 2609252 - RNA, 13 nt, Escherichia coli CFT073
uaaucauucgccc

SEQ ID NO: 2609253 - RNA, 14 nt, Escherichia coli CFT073
uaauccacagcaau

SEQ ID NO: 2609254 - RNA, 14 nt, Escherichia coli CFT073
uaauccacuuucuu

SEQ ID NO: 2609255 - RNA, 23 nt, Escherichia coli CFT073
uaauccagacugcgcauuaaaua

SEQ ID NO: 2609256 - RNA, 11 nt, Escherichia coli CFT073
uaauccagcaa

SEQ ID NO: 2609257 - RNA, 20 nt, Escherichia coli CFT073
uaauccagcgucgccagcag

SEQ ID NO: 2609258 - RNA, 23 nt, Escherichia coli CFT073
uaauccagcgucgccagcagaga

SEQ ID NO: 2609259 - RNA, 16 nt, Escherichia coli CFT073
uaauccaugccaacgg

SEQ ID NO: 2609260 - RNA, 20 nt, Escherichia coli CFT073
uaaucccggcaccaaucacc

SEQ ID NO: 2609261 - RNA, 22 nt, Escherichia coli CFT073
uaaucccuccaaccagauaucc

SEQ ID NO: 2609262 - RNA, 15 nt, Escherichia coli CFT073
uaaucccuucccgca

SEQ ID NO: 2609263 - RNA, 18 nt, Escherichia coli CFT073
uaauccgccgcuguggca

SEQ ID NO: 2609264 - RNA, 14 nt, Escherichia coli CFT073
uaauccgcugcacg

SEQ ID NO: 2609265 - RNA, 20 nt, Escherichia coli CFT073
uaauccgcuguaauugccgc

SEQ ID NO: 2609266 - RNA, 22 nt, Escherichia coli CFT073
uaauccggguucggauaaauga

SEQ ID NO: 2609267 - RNA, 16 nt, Escherichia coli CFT073
uaauccguaaagccca

SEQ ID NO: 2609268 - RNA, 13 nt, Escherichia coli CFT073
uaauccuggcagc

SEQ ID NO: 2609269 - RNA, 15 nt, Escherichia coli CFT073
uaaucgaaaacauca

SEQ ID NO: 2609270 - RNA, 21 nt, Escherichia coli CFT073
uaaucgaaaacaucaugguuu

SEQ ID NO: 2609271 - RNA, 18 nt, Escherichia coli CFT073
uaaucgaaaccuucagca

SEQ ID NO: 2609272 - RNA, 13 nt, Escherichia coli CFT073
uaaucgaaccaaa

SEQ ID NO: 2609273 - RNA, 15 nt, Escherichia coli CFT073
uaaucgacgaggaaa

SEQ ID NO: 2609274 - RNA, 15 nt, Escherichia coli CFT073
uaaucgauuuagaac

SEQ ID NO: 2609275 - RNA, 22 nt, Escherichia coli CFT073
uaaucgcaaagcuguuaucgau

SEQ ID NO: 2609276 - RNA, 21 nt, Escherichia coli CFT073
uaaucgccagcaaaaucacca

SEQ ID NO: 2609277 - RNA, 14 nt, Escherichia coli CFT073
uaaucgccaguuca

SEQ ID NO: 2609278 - RNA, 16 nt, Escherichia coli CFT073
uaaucgcccggauauc

SEQ ID NO: 2609279 - RNA, 17 nt, Escherichia coli CFT073
uaaucgcccucgccuuu

SEQ ID NO: 2609280 - RNA, 19 nt, Escherichia coli CFT073
uaaucgccgcauaauaucu

SEQ ID NO: 2609281 - RNA, 22 nt, Escherichia coli CFT073
uaaucgccgcauaauaucuuuc

SEQ ID NO: 2609282 - RNA, 20 nt, Escherichia coli CFT073
uaaucgccuuacccugaccg

SEQ ID NO: 2609283 - RNA, 18 nt, Escherichia coli CFT073
uaaucgcuucaaucagcg

SEQ ID NO: 2609284 - RNA, 15 nt, Escherichia coli CFT073
uaaucgggccgacaa

SEQ ID NO: 2609285 - RNA, 15 nt, Escherichia coli CFT073
uaaucgucaucagcg

SEQ ID NO: 2609286 - RNA, 13 nt, Escherichia coli CFT073
uaaucuaaucugu

SEQ ID NO: 2609287 - RNA, 14 nt, Escherichia coli CFT073
uaaucuauauaugu

SEQ ID NO: 2609288 - RNA, 19 nt, Escherichia coli CFT073
uaaucuauauauguuuuuu

SEQ ID NO: 2609289 - RNA, 14 nt, Escherichia coli CFT073
uaaucuauauuucu

SEQ ID NO: 2609290 - RNA, 15 nt, Escherichia coli CFT073
uaaucuauauuucug

SEQ ID NO: 2609291 - RNA, 12 nt, Escherichia coli CFT073
uaaucucaccaa

SEQ ID NO: 2609292 - RNA, 14 nt, Escherichia coli CFT073
uaaucucaccauuu

SEQ ID NO: 2609293 - RNA, 18 nt, Escherichia coli CFT073
uaaucucucaacaccgcu

SEQ ID NO: 2609294 - RNA, 18 nt, Escherichia coli CFT073
uaaucucuuuccauucuu

SEQ ID NO: 2609295 - RNA, 22 nt, Escherichia coli CFT073
uaaucuggauguucggcgucuu

SEQ ID NO: 2609296 - RNA, 22 nt, Escherichia coli CFT073
uaaucuguugauuuaacagcaa

SEQ ID NO: 2609297 - RNA, 22 nt, Escherichia coli CFT073
uaaucuuccagaucaccgcaga

SEQ ID NO: 2609298 - RNA, 16 nt, Escherichia coli CFT073
uaaucuuuacaccaac

SEQ ID NO: 2609299 - RNA, 13 nt, Escherichia coli CFT073
uaaugaaaacucg

SEQ ID NO: 2609300 - RNA, 17 nt, Escherichia coli CFT073
uaaugacagcggcguuu

SEQ ID NO: 2609301 - RNA, 17 nt, Escherichia coli CFT073
uaaugacggacaguacu

SEQ ID NO: 2609302 - RNA, 13 nt, Escherichia coli CFT073
uaaugacguguau

SEQ ID NO: 2609303 - RNA, 17 nt, Escherichia coli CFT073
uaaugauaucccugcug

SEQ ID NO: 2609304 - RNA, 18 nt, Escherichia coli CFT073
uaaugaucugaucaaacu

SEQ ID NO: 2609305 - RNA, 16 nt, Escherichia coli CFT073
uaaugaugagauccgc

SEQ ID NO: 2609306 - RNA, 13 nt, Escherichia coli CFT073
uaaugauucauaa

SEQ ID NO: 2609307 - RNA, 13 nt, Escherichia coli CFT073
uaaugauuuccag

SEQ ID NO: 2609308 - RNA, 15 nt, Escherichia coli CFT073
uaaugcaaaaugccg

SEQ ID NO: 2609309 - RNA, 13 nt, Escherichia coli CFT073
uaaugcaacacua

SEQ ID NO: 2609310 - RNA, 18 nt, Escherichia coli CFT073
uaaugcacuccgccgcac

SEQ ID NO: 2609311 - RNA, 19 nt, Escherichia coli CFT073
uaaugcaggcagcacugcu

SEQ ID NO: 2609312 - RNA, 13 nt, Escherichia coli CFT073
uaaugcaugacug

SEQ ID NO: 2609313 - RNA, 14 nt, Escherichia coli CFT073
uaaugcauggccug

SEQ ID NO: 2609314 - RNA, 22 nt, Escherichia coli CFT073
uaaugccaaucuucacaucauc

SEQ ID NO: 2609315 - RNA, 15 nt, Escherichia coli CFT073
uaaugccaccagugc

SEQ ID NO: 2609316 - RNA, 20 nt, Escherichia coli CFT073
uaaugccauuaacaucccuu

SEQ ID NO: 2609317 - RNA, 14 nt, Escherichia coli CFT073
uaaugcccaucagu

SEQ ID NO: 2609318 - RNA, 12 nt, Escherichia coli CFT073
uaaugccggacu

SEQ ID NO: 2609319 - RNA, 16 nt, Escherichia coli CFT073
uaaugccggacuccag

SEQ ID NO: 2609320 - RNA, 16 nt, Escherichia coli CFT073
uaaugccucuccccag

SEQ ID NO: 2609321 - RNA, 16 nt, Escherichia coli CFT073
uaaugccuuuuccagc

SEQ ID NO: 2609322 - RNA, 17 nt, Escherichia coli CFT073
uaaugccuuuuccagcg

SEQ ID NO: 2609323 - RNA, 16 nt, Escherichia coli CFT073
uaaugcgacccacgcc

SEQ ID NO: 2609324 - RNA, 23 nt, Escherichia coli CFT073
uaaugcuacuccaggaauaccac

SEQ ID NO: 2609325 - RNA, 20 nt, Escherichia coli CFT073
uaaugcuauaaaaauaaaca

SEQ ID NO: 2609326 - RNA, 18 nt, Escherichia coli CFT073
uaaugcuucgcacugugu

SEQ ID NO: 2609327 - RNA, 23 nt, Escherichia coli CFT073
uaaugcuucuaucgcauuauccu

SEQ ID NO: 2609328 - RNA, 19 nt, Escherichia coli CFT073
uaauggacuguaagccauc

SEQ ID NO: 2609329 - RNA, 13 nt, Escherichia coli CFT073
uaauggcaauggu

SEQ ID NO: 2609330 - RNA, 21 nt, Escherichia coli CFT073
uaauggccucagccacacuua

SEQ ID NO: 2609331 - RNA, 19 nt, Escherichia coli CFT073
uaauggccuuuucgccacc

SEQ ID NO: 2609332 - RNA, 14 nt, Escherichia coli CFT073
uaauggcgcaauca

SEQ ID NO: 2609333 - RNA, 22 nt, Escherichia coli CFT073
uaauggcuaucgaaaucaaagu

SEQ ID NO: 2609334 - RNA, 19 nt, Escherichia coli CFT073
uaauggcuuccaguacugg

SEQ ID NO: 2609335 - RNA, 21 nt, Escherichia coli CFT073
uaaugggcgguuggccugaua

SEQ ID NO: 2609336 - RNA, 14 nt, Escherichia coli CFT073
uaaugguauuaagc

SEQ ID NO: 2609337 - RNA, 13 nt, Escherichia coli CFT073
uaaugguuugccc

SEQ ID NO: 2609338 - RNA, 16 nt, Escherichia coli CFT073
uaauguaaauauuggu

SEQ ID NO: 2609339 - RNA, 19 nt, Escherichia coli CFT073
uaauguaugugcgaaaauu

SEQ ID NO: 2609340 - RNA, 17 nt, Escherichia coli CFT073
uaaugucgacauaauca

SEQ ID NO: 2609341 - RNA, 17 nt, Escherichia coli CFT073
uaaugucgcuggccgga

SEQ ID NO: 2609342 - RNA, 23 nt, Escherichia coli CFT073
uaaugucucgguagagaaaacca

SEQ ID NO: 2609343 - RNA, 17 nt, Escherichia coli CFT073
uaaugugccgaauccaa

SEQ ID NO: 2609344 - RNA, 20 nt, Escherichia coli CFT073
uaaugugucugaaagcagac

SEQ ID NO: 2609345 - RNA, 15 nt, Escherichia coli CFT073
uaauguguucaacuu

SEQ ID NO: 2609346 - RNA, 17 nt, Escherichia coli CFT073
uaauguucguugcauuc

SEQ ID NO: 2609347 - RNA, 16 nt, Escherichia coli CFT073
uacacgaaacgaaacc

SEQ ID NO: 2609348 - RNA, 17 nt, Escherichia coli CFT073
uacacgaaacgaaaccc

SEQ ID NO: 2609349 - RNA, 17 nt, Escherichia coli CFT073
uacacgaaaugaauaau

SEQ ID NO: 2609350 - RNA, 17 nt, Escherichia coli CFT073
uacacgcacggcauauu

SEQ ID NO: 2609351 - RNA, 21 nt, Escherichia coli CFT073
uacacgccgggcagccuuuca

SEQ ID NO: 2609352 - RNA, 23 nt, Escherichia coli CFT073
uacacggugcgaugcaaaaucag

SEQ ID NO: 2609353 - RNA, 17 nt, Escherichia coli CFT073
uacacguugaaacuuau

SEQ ID NO: 2609354 - RNA, 15 nt, Escherichia coli CFT073
uacacugguucccaa

SEQ ID NO: 2609355 - RNA, 14 nt, Escherichia coli CFT073
uacagaaaguagcg

SEQ ID NO: 2609356 - RNA, 14 nt, Escherichia coli CFT073
uacagaacgcugca

SEQ ID NO: 2609357 - RNA, 17 nt, Escherichia coli CFT073
uacagacaccaaucagc

SEQ ID NO: 2609358 - RNA, 14 nt, Escherichia coli CFT073
uacagaugaaauac

SEQ ID NO: 2609359 - RNA, 13 nt, Escherichia coli CFT073
uacagaugcugcu

SEQ ID NO: 2609360 - RNA, 15 nt, Escherichia coli CFT073
uacagcaaaauacca

SEQ ID NO: 2609361 - RNA, 16 nt, Escherichia coli CFT073
uacagcaauggaaaaa

SEQ ID NO: 2609362 - RNA, 20 nt, Escherichia coli CFT073
uacagcaauggaaaaaguuu

SEQ ID NO: 2609363 - RNA, 13 nt, Escherichia coli CFT073
uacagcaccgccc

SEQ ID NO: 2609364 - RNA, 16 nt, Escherichia coli CFT073
uacagcaccgcccguu

SEQ ID NO: 2609365 - RNA, 21 nt, Escherichia coli CFT073
uacagcagccagcgcuuugau

SEQ ID NO: 2609366 - RNA, 21 nt, Escherichia coli CFT073
uacagcaguacgccgagaaua

SEQ ID NO: 2609367 - RNA, 18 nt, Escherichia coli CFT073
  misc_feature (8)..(8): n is a, c, g or u
uacagcanuaucgucugg

SEQ ID NO: 2609368 - RNA, 14 nt, Escherichia coli CFT073
uacagccagcaaua

SEQ ID NO: 2609369 - RNA, 14 nt, Escherichia coli CFT073
uacagcccgccgga

SEQ ID NO: 2609370 - RNA, 13 nt, Escherichia coli CFT073
uacagccgccaga

SEQ ID NO: 2609371 - RNA, 13 nt, Escherichia coli CFT073
uacagccggaacg

SEQ ID NO: 2609372 - RNA, 23 nt, Escherichia coli CFT073
uacagcgaauaguggaguaugag

SEQ ID NO: 2609373 - RNA, 17 nt, Escherichia coli CFT073
uacagcgcauaaaagcu

SEQ ID NO: 2609374 - RNA, 20 nt, Escherichia coli CFT073
uacagcgcccagacaauuaa

SEQ ID NO: 2609375 - RNA, 24 nt, Escherichia coli CFT073
uacagcggaacuuuuuucauccag

SEQ ID NO: 2609376 - RNA, 17 nt, Escherichia coli CFT073
uacagcguuuugccauc

SEQ ID NO: 2609377 - RNA, 20 nt, Escherichia coli CFT073
uacagcguuuugccaucggc

SEQ ID NO: 2609378 - RNA, 16 nt, Escherichia coli CFT073
uacagcucucacuuau

SEQ ID NO: 2609379 - RNA, 13 nt, Escherichia coli CFT073
uacagcuggagua

SEQ ID NO: 2609380 - RNA, 18 nt, Escherichia coli CFT073
uacagcuuaaucaccagc

SEQ ID NO: 2609381 - RNA, 20 nt, Escherichia coli CFT073
uacagcuuaaucaccagcgc

SEQ ID NO: 2609382 - RNA, 15 nt, Escherichia coli CFT073
uacaggaaaccggcg

SEQ ID NO: 2609383 - RNA, 21 nt, Escherichia coli CFT073
uacaggaaauaagaagccaua

SEQ ID NO: 2609384 - RNA, 14 nt, Escherichia coli CFT073
uacaggauauauuu

SEQ ID NO: 2609385 - RNA, 17 nt, Escherichia coli CFT073
uacaggauauauuucau

SEQ ID NO: 2609386 - RNA, 22 nt, Escherichia coli CFT073
uacaggauauauuucaucaacu

SEQ ID NO: 2609387 - RNA, 16 nt, Escherichia coli CFT073
uacaggcagauaaaau

SEQ ID NO: 2609388 - RNA, 23 nt, Escherichia coli CFT073
uacaggcagcuuagaaaggaaca

SEQ ID NO: 2609389 - RNA, 22 nt, Escherichia coli CFT073
uacaggcaucgggaauggcaua

SEQ ID NO: 2609390 - RNA, 13 nt, Escherichia coli CFT073
uacaggcaucuuc

SEQ ID NO: 2609391 - RNA, 16 nt, Escherichia coli CFT073
uacaggcaucuuccag

SEQ ID NO: 2609392 - RNA, 23 nt, Escherichia coli CFT073
uacaggccaccaggccacggcga

SEQ ID NO: 2609393 - RNA, 21 nt, Escherichia coli CFT073
uacaggcuacucccaguagug

SEQ ID NO: 2609394 - RNA, 23 nt, Escherichia coli CFT073
uacaggcuaucggccagguauug

SEQ ID NO: 2609395 - RNA, 13 nt, Escherichia coli CFT073
uacaggggccagc

SEQ ID NO: 2609396 - RNA, 16 nt, Escherichia coli CFT073
uacaggguaaaaagag

SEQ ID NO: 2609397 - RNA, 16 nt, Escherichia coli CFT073
uacagguaagcacaca

SEQ ID NO: 2609398 - RNA, 19 nt, Escherichia coli CFT073
uacagguuguugaagaugc

SEQ ID NO: 2609399 - RNA, 21 nt, Escherichia coli CFT073
uacagucaaggaaugaaauau

SEQ ID NO: 2609400 - RNA, 17 nt, Escherichia coli CFT073
uacagugccccaaaugu

SEQ ID NO: 2609401 - RNA, 19 nt, Escherichia coli CFT073
uacagugccccaaaugucg

SEQ ID NO: 2609402 - RNA, 14 nt, Escherichia coli CFT073
uacaguuaagcccu

SEQ ID NO: 2609403 - RNA, 12 nt, Escherichia coli CFT073
uacaguuuccuu

SEQ ID NO: 2609404 - RNA, 20 nt, Escherichia coli CFT073
uacauaacagaauaucugcg

SEQ ID NO: 2609405 - RNA, 14 nt, Escherichia coli CFT073
uacauaagcaccga

SEQ ID NO: 2609406 - RNA, 21 nt, Escherichia coli CFT073
uacauaagcaccgaacaagaa

SEQ ID NO: 2609407 - RNA, 13 nt, Escherichia coli CFT073
uacauaccagcag

SEQ ID NO: 2609408 - RNA, 15 nt, Escherichia coli CFT073
uacauaccagcagca

SEQ ID NO: 2609409 - RNA, 11 nt, Escherichia coli CFT073
uacauacugag

SEQ ID NO: 2609410 - RNA, 19 nt, Escherichia coli CFT073
uacauacuguaaauaguau

SEQ ID NO: 2609411 - RNA, 21 nt, Escherichia coli CFT073
uacauagccaucugccugauc

SEQ ID NO: 2609412 - RNA, 20 nt, Escherichia coli CFT073
uacauagcgccucuuuauaa

SEQ ID NO: 2609413 - RNA, 14 nt, Escherichia coli CFT073
uacauauauuacuc

SEQ ID NO: 2609414 - RNA, 22 nt, Escherichia coli CFT073
uacaucacgauuuuuccgcugg

SEQ ID NO: 2609415 - RNA, 11 nt, Escherichia coli CFT073
uacaucaucag

SEQ ID NO: 2609416 - RNA, 15 nt, Escherichia coli CFT073
uacaucgauuucgcu

SEQ ID NO: 2609417 - RNA, 15 nt, Escherichia coli CFT073
uacaucgcgccaaca

SEQ ID NO: 2609418 - RNA, 18 nt, Escherichia coli CFT073
uacaucugcaucaaguuc

SEQ ID NO: 2609419 - RNA, 12 nt, Escherichia coli CFT073
uacauggcagac

SEQ ID NO: 2609420 - RNA, 22 nt, Escherichia coli CFT073
uacauuaaccgccguucuucag

SEQ ID NO: 2609421 - RNA, 21 nt, Escherichia coli CFT073
uacauuaauuuucaauugaua

SEQ ID NO: 2609422 - RNA, 14 nt, Escherichia coli CFT073
uacauucauauacu

SEQ ID NO: 2609423 - RNA, 21 nt, Escherichia coli CFT073
uacauuccggccugcagugca

SEQ ID NO: 2609424 - RNA, 19 nt, Escherichia coli CFT073
uacauugccaccaccagcg

SEQ ID NO: 2609425 - RNA, 14 nt, Escherichia coli CFT073
uacauugcgaacag

SEQ ID NO: 2609426 - RNA, 21 nt, Escherichia coli CFT073
uaccaaaaucaucaauugcca

SEQ ID NO: 2609427 - RNA, 19 nt, Escherichia coli CFT073
uaccaaaauugaugaguau

SEQ ID NO: 2609428 - RNA, 17 nt, Escherichia coli CFT073
uaccaaauugguaaaau

SEQ ID NO: 2609429 - RNA, 14 nt, Escherichia coli CFT073
uaccaacacacuga

SEQ ID NO: 2609430 - RNA, 22 nt, Escherichia coli CFT073
uaccaacauauugcuccauaau

SEQ ID NO: 2609431 - RNA, 21 nt, Escherichia coli CFT073
uaccaaccagauuaccgccuu

SEQ ID NO: 2609432 - RNA, 13 nt, Escherichia coli CFT073
uaccaagccaagc

SEQ ID NO: 2609433 - RNA, 21 nt, Escherichia coli CFT073
uaccaauacguuucuuccaca

SEQ ID NO: 2609434 - RNA, 16 nt, Escherichia coli CFT073
uaccacaacaaaucgu

SEQ ID NO: 2609435 - RNA, 15 nt, Escherichia coli CFT073
uaccacagcaaaacg

SEQ ID NO: 2609436 - RNA, 20 nt, Escherichia coli CFT073
uaccacaucaacccgcccag

SEQ ID NO: 2609437 - RNA, 23 nt, Escherichia coli CFT073
uaccaccaauguggaaagcccca

SEQ ID NO: 2609438 - RNA, 19 nt, Escherichia coli CFT073
uaccacccuugcccaccag

SEQ ID NO: 2609439 - RNA, 22 nt, Escherichia coli CFT073
uaccaccgccagauugcugcug

SEQ ID NO: 2609440 - RNA, 22 nt, Escherichia coli CFT073
uaccaccuuacuuacacaucau

SEQ ID NO: 2609441 - RNA, 18 nt, Escherichia coli CFT073
uaccaccuuuuuaaucuc

SEQ ID NO: 2609442 - RNA, 14 nt, Escherichia coli CFT073
uaccacgcaaagca

SEQ ID NO: 2609443 - RNA, 17 nt, Escherichia coli CFT073
uaccacgcaaagcacgc

SEQ ID NO: 2609444 - RNA, 18 nt, Escherichia coli CFT073
uaccacggcauuuccgcc

SEQ ID NO: 2609445 - RNA, 13 nt, Escherichia coli CFT073
uaccacuucaucc

SEQ ID NO: 2609446 - RNA, 14 nt, Escherichia coli CFT073
uaccacuucauccg

SEQ ID NO: 2609447 - RNA, 15 nt, Escherichia coli CFT073
uaccacuuccagcag

SEQ ID NO: 2609448 - RNA, 19 nt, Escherichia coli CFT073
uaccacuuccagcagacca

SEQ ID NO: 2609449 - RNA, 15 nt, Escherichia coli CFT073
uaccacuucccaacg

SEQ ID NO: 2609450 - RNA, 18 nt, Escherichia coli CFT073
uaccagaccgcacaccga

SEQ ID NO: 2609451 - RNA, 16 nt, Escherichia coli CFT073
uaccagagucuuugcu

SEQ ID NO: 2609452 - RNA, 23 nt, Escherichia coli CFT073
uaccagauaaucacccgccuuca

SEQ ID NO: 2609453 - RNA, 20 nt, Escherichia coli CFT073
uaccagcaacgcuucaacca

SEQ ID NO: 2609454 - RNA, 14 nt, Escherichia coli CFT073
uaccagcagcauca

SEQ ID NO: 2609455 - RNA, 18 nt, Escherichia coli CFT073
uaccggcaggaaauuaag

SEQ ID NO: 2609456 - RNA, 16 nt, Escherichia coli CFT073
uaccggcauccagacc

SEQ ID NO: 2609457 - RNA, 18 nt, Escherichia coli CFT073
uaccggcccaccaaagaa

SEQ ID NO: 2609458 - RNA, 19 nt, Escherichia coli CFT073
uaccggcccaccaaagaac

SEQ ID NO: 2609459 - RNA, 16 nt, Escherichia coli CFT073
uaccggcugcaaaccc

SEQ ID NO: 2609460 - RNA, 19 nt, Escherichia coli CFT073
uaccggcuggcgcauacca

SEQ ID NO: 2609461 - RNA, 15 nt, Escherichia coli CFT073
uaccggcuucgucgc

SEQ ID NO: 2609462 - RNA, 23 nt, Escherichia coli CFT073
uaccgggcuuuuuugaucaaaau

SEQ ID NO: 2609463 - RNA, 19 nt, Escherichia coli CFT073
uaccggucaguucaaccgg

SEQ ID NO: 2609464 - RNA, 17 nt, Escherichia coli CFT073
uaccggucaugucggca

SEQ ID NO: 2609465 - RNA, 17 nt, Escherichia coli CFT073
uaccggugccagcaacu

SEQ ID NO: 2609466 - RNA, 18 nt, Escherichia coli CFT073
uaccgguuucaauccagg

SEQ ID NO: 2609467 - RNA, 13 nt, Escherichia coli CFT073
uaccguaaaaaua

SEQ ID NO: 2609468 - RNA, 14 nt, Escherichia coli CFT073
uaccguaggccagc

SEQ ID NO: 2609469 - RNA, 21 nt, Escherichia coli CFT073
uaccgucagaaauuaaacugu

SEQ ID NO: 2609470 - RNA, 16 nt, Escherichia coli CFT073
uaccgucaucgcccac

SEQ ID NO: 2609471 - RNA, 21 nt, Escherichia coli CFT073
uaccgucgccuuucacuuccg

SEQ ID NO: 2609472 - RNA, 12 nt, Escherichia coli CFT073
uaccgugcagca

SEQ ID NO: 2609473 - RNA, 13 nt, Escherichia coli CFT073
uaccgugcagcac

SEQ ID NO: 2609474 - RNA, 16 nt, Escherichia coli CFT073
uaccgugguuuuggua

SEQ ID NO: 2609475 - RNA, 18 nt, Escherichia coli CFT073
uaccguucauuaacgccc

SEQ ID NO: 2609476 - RNA, 21 nt, Escherichia coli CFT073
uaccguugaccauaucaucaa

SEQ ID NO: 2609477 - RNA, 18 nt, Escherichia coli CFT073
uaccguugccgguuaucc

SEQ ID NO: 2609478 - RNA, 14 nt, Escherichia coli CFT073
uaccguugcggcgu

SEQ ID NO: 2609479 - RNA, 16 nt, Escherichia coli CFT073
uaccguugcggcucca

SEQ ID NO: 2609480 - RNA, 18 nt, Escherichia coli CFT073
uaccuaaaagcacgccag

SEQ ID NO: 2609481 - RNA, 22 nt, Escherichia coli CFT073
uaccuaacacgaucagccauac

SEQ ID NO: 2609482 - RNA, 22 nt, Escherichia coli CFT073
uaccuccugucuaaccgccugc

SEQ ID NO: 2609483 - RNA, 17 nt, Escherichia coli CFT073
uaccugaaacucgauga

SEQ ID NO: 2609484 - RNA, 13 nt, Escherichia coli CFT073
uaccugauccacu

SEQ ID NO: 2609485 - RNA, 13 nt, Escherichia coli CFT073
uaccugauuacca

SEQ ID NO: 2609486 - RNA, 14 nt, Escherichia coli CFT073
uaccugcauuagca

SEQ ID NO: 2609487 - RNA, 16 nt, Escherichia coli CFT073
uaccugcuuaaucaua

SEQ ID NO: 2609488 - RNA, 21 nt, Escherichia coli CFT073
uaccuggaacucgaaaauauu

SEQ ID NO: 2609489 - RNA, 15 nt, Escherichia coli CFT073
uaccuggagcaguau

SEQ ID NO: 2609490 - RNA, 20 nt, Escherichia coli CFT073
uaccuggagcaguauugaua

SEQ ID NO: 2609491 - RNA, 22 nt, Escherichia coli CFT073
uaccuggccccuggcuggucag

SEQ ID NO: 2609492 - RNA, 21 nt, Escherichia coli CFT073
uaccugucgcgucaaucacuu

SEQ ID NO: 2609493 - RNA, 19 nt, Escherichia coli CFT073
uaccuguuaauucucccug

SEQ ID NO: 2609494 - RNA, 20 nt, Escherichia coli CFT073
uaccuguucgcgguuuucuu

SEQ ID NO: 2609495 - RNA, 16 nt, Escherichia coli CFT073
uaccuuauccagcaga

SEQ ID NO: 2609496 - RNA, 17 nt, Escherichia coli CFT073
uaccuuauccagcagau

SEQ ID NO: 2609497 - RNA, 18 nt, Escherichia coli CFT073
uaccuuauccagcagauc

SEQ ID NO: 2609498 - RNA, 18 nt, Escherichia coli CFT073
uaccuucaauacuggcaa

SEQ ID NO: 2609499 - RNA, 17 nt, Escherichia coli CFT073
uaccuuccacaauggca

SEQ ID NO: 2609500 - RNA, 19 nt, Escherichia coli CFT073
uaccuuccacuuucacgcc

SEQ ID NO: 2609501 - RNA, 19 nt, Escherichia coli CFT073
uaccuuccuacaagagguc

SEQ ID NO: 2609502 - RNA, 16 nt, Escherichia coli CFT073
uaccuucguccauccc

SEQ ID NO: 2609503 - RNA, 12 nt, Escherichia coli CFT073
uaccuucuuccu

SEQ ID NO: 2609504 - RNA, 14 nt, Escherichia coli CFT073
uaccuugcugcucc

SEQ ID NO: 2609505 - RNA, 20 nt, Escherichia coli CFT073
uaccuugcuucuuacuauau

SEQ ID NO: 2609506 - RNA, 21 nt, Escherichia coli CFT073
uaccuuuaaacuguuuccagu

SEQ ID NO: 2609507 - RNA, 23 nt, Escherichia coli CFT073
uaccuuuaaagcggaugcgauuu

SEQ ID NO: 2609508 - RNA, 19 nt, Escherichia coli CFT073
uaccuuuaugcgaugaaac

SEQ ID NO: 2609509 - RNA, 20 nt, Escherichia coli CFT073
uaccuuucgcaacuucuguc

SEQ ID NO: 2609510 - RNA, 13 nt, Escherichia coli CFT073
uacgaaaauuugg

SEQ ID NO: 2609511 - RNA, 13 nt, Escherichia coli CFT073
uacgaagcagcau

SEQ ID NO: 2609512 - RNA, 16 nt, Escherichia coli CFT073
uacgaaucacaucguc

SEQ ID NO: 2609513 - RNA, 24 nt, Escherichia coli CFT073
uacgacccgauucggucaugguga

SEQ ID NO: 2609514 - RNA, 19 nt, Escherichia coli CFT073
uacgagcuucgacuuccug

SEQ ID NO: 2609515 - RNA, 22 nt, Escherichia coli CFT073
uacgagucgccuguacuuccug

SEQ ID NO: 2609516 - RNA, 19 nt, Escherichia coli CFT073
uacgagugcgcucuucaac

SEQ ID NO: 2609517 - RNA, 18 nt, Escherichia coli CFT073
uacgauacaaaagcaccg

SEQ ID NO: 2609518 - RNA, 22 nt, Escherichia coli CFT073
uacgauccaccaccgcaaaaua

SEQ ID NO: 2609519 - RNA, 20 nt, Escherichia coli CFT073
uacgaucuucgccugaaaca

SEQ ID NO: 2609520 - RNA, 20 nt, Escherichia coli CFT073
uacgauggugcacgaugcau

SEQ ID NO: 2609521 - RNA, 16 nt, Escherichia coli CFT073
uacgcaaaauaucgau

SEQ ID NO: 2609522 - RNA, 11 nt, Escherichia coli CFT073
uacgcaaagag

SEQ ID NO: 2609523 - RNA, 15 nt, Escherichia coli CFT073
uacgcaccacaccgu

SEQ ID NO: 2609524 - RNA, 21 nt, Escherichia coli CFT073
uacgcaccggaaauugcugcc

SEQ ID NO: 2609525 - RNA, 21 nt, Escherichia coli CFT073
uacgcaggagcagaacagguu

SEQ ID NO: 2609526 - RNA, 18 nt, Escherichia coli CFT073
uacgcaggcggcuggcau

SEQ ID NO: 2609527 - RNA, 19 nt, Escherichia coli CFT073
uacgcaguaaauaaaaaau

SEQ ID NO: 2609528 - RNA, 18 nt, Escherichia coli CFT073
uacgcaucaccccuuccu

SEQ ID NO: 2609529 - RNA, 16 nt, Escherichia coli CFT073
uacgcaucaguuucau

SEQ ID NO: 2609530 - RNA, 13 nt, Escherichia coli CFT073
uacgcauccccag

SEQ ID NO: 2609531 - RNA, 21 nt, Escherichia coli CFT073
uacgcauccccagcgcaaggc

SEQ ID NO: 2609532 - RNA, 19 nt, Escherichia coli CFT073
uacgcaucgcgcaccagcg

SEQ ID NO: 2609533 - RNA, 20 nt, Escherichia coli CFT073
uacgcauucgaguagcguuc

SEQ ID NO: 2609534 - RNA, 13 nt, Escherichia coli CFT073
uacgcauuugagc

SEQ ID NO: 2609535 - RNA, 15 nt, Escherichia coli CFT073
uacgccaaucugcaa

SEQ ID NO: 2609536 - RNA, 13 nt, Escherichia coli CFT073
uacgccacuucau

SEQ ID NO: 2609537 - RNA, 23 nt, Escherichia coli CFT073
uacgccacuucaucgucauaaug

SEQ ID NO: 2609538 - RNA, 13 nt, Escherichia coli CFT073
uacgccagacucu

SEQ ID NO: 2609539 - RNA, 13 nt, Escherichia coli CFT073
uacgccaucuguu

SEQ ID NO: 2609540 - RNA, 18 nt, Escherichia coli CFT073
uacgccauuucgggugua

SEQ ID NO: 2609541 - RNA, 14 nt, Escherichia coli CFT073
uacgcccacgccag

SEQ ID NO: 2609542 - RNA, 16 nt, Escherichia coli CFT073
uacgcccacgcuucac

SEQ ID NO: 2609543 - RNA, 20 nt, Escherichia coli CFT073
uacgcccauauggucggcua

SEQ ID NO: 2609544 - RNA, 13 nt, Escherichia coli CFT073
uacgcccgcgaac

SEQ ID NO: 2609545 - RNA, 20 nt, Escherichia coli CFT073
uacgcccgcugcgcccaguu

SEQ ID NO: 2609546 - RNA, 15 nt, Escherichia coli CFT073
uacgcccucacccgu

SEQ ID NO: 2609547 - RNA, 15 nt, Escherichia coli CFT073
uacgcccuuccccca

SEQ ID NO: 2609548 - RNA, 19 nt, Escherichia coli CFT073
uacgccgcaaaucgccgag

SEQ ID NO: 2609549 - RNA, 19 nt, Escherichia coli CFT073
uacgccgcacccggcacua

SEQ ID NO: 2609550 - RNA, 17 nt, Escherichia coli CFT073
uacgccggaaaguuaau

SEQ ID NO: 2609551 - RNA, 14 nt, Escherichia coli CFT073
uacgccucagccga

SEQ ID NO: 2609552 - RNA, 20 nt, Escherichia coli CFT073
uacgccucagccgaaacaca

SEQ ID NO: 2609553 - RNA, 22 nt, Escherichia coli CFT073
uacgccugcaauuuaccuuucc

SEQ ID NO: 2609554 - RNA, 18 nt, Escherichia coli CFT073
uacgccuuccgucagcaa

SEQ ID NO: 2609555 - RNA, 16 nt, Escherichia coli CFT073
uacgcgauaaaaaacc

SEQ ID NO: 2609556 - RNA, 16 nt, Escherichia coli CFT073
uacgcgcaccgcguga

SEQ ID NO: 2609557 - RNA, 21 nt, Escherichia coli CFT073
uacgcgccaaucggcaauuca

SEQ ID NO: 2609558 - RNA, 13 nt, Escherichia coli CFT073
uacgcgccagagc

SEQ ID NO: 2609559 - RNA, 17 nt, Escherichia coli CFT073
uacgcgccgccagccac

SEQ ID NO: 2609560 - RNA, 15 nt, Escherichia coli CFT073
uacgcgcguuuucaa

SEQ ID NO: 2609561 - RNA, 17 nt, Escherichia coli CFT073
uacgcgcugaccuucag

SEQ ID NO: 2609562 - RNA, 18 nt, Escherichia coli CFT073
uacgcggacacuuuccug

SEQ ID NO: 2609563 - RNA, 17 nt, Escherichia coli CFT073
uacugcauggccagaca

SEQ ID NO: 2609564 - RNA, 18 nt, Escherichia coli CFT073
uacugcccgcacaccuca

SEQ ID NO: 2609565 - RNA, 15 nt, Escherichia coli CFT073
uacugccgaccagag

SEQ ID NO: 2609566 - RNA, 16 nt, Escherichia coli CFT073
uacugccgaccagagc

SEQ ID NO: 2609567 - RNA, 12 nt, Escherichia coli CFT073
uacugccgggaa

SEQ ID NO: 2609568 - RNA, 19 nt, Escherichia coli CFT073
uacugccguagugaugcau

SEQ ID NO: 2609569 - RNA, 20 nt, Escherichia coli CFT073
uacugccguagugaugcauc

SEQ ID NO: 2609570 - RNA, 23 nt, Escherichia coli CFT073
uacugccuuucccuuacccucuc

SEQ ID NO: 2609571 - RNA, 14 nt, Escherichia coli CFT073
uacugcgaauuucc

SEQ ID NO: 2609572 - RNA, 15 nt, Escherichia coli CFT073
uacugcgaauuuccu

SEQ ID NO: 2609573 - RNA, 18 nt, Escherichia coli CFT073
uacugcgaauuuccugcc

SEQ ID NO: 2609574 - RNA, 14 nt, Escherichia coli CFT073
uacugcgcuuuuaa

SEQ ID NO: 2609575 - RNA, 22 nt, Escherichia coli CFT073
uacugcugaaugaggcuuuaau

SEQ ID NO: 2609576 - RNA, 19 nt, Escherichia coli CFT073
uacuggaagcaggucacca

SEQ ID NO: 2609577 - RNA, 22 nt, Escherichia coli CFT073
uacuggaagccauuuugcauga

SEQ ID NO: 2609578 - RNA, 21 nt, Escherichia coli CFT073
uacuggagcuggcgaacaagu

SEQ ID NO: 2609579 - RNA, 11 nt, Escherichia coli CFT073
uacuggcaaua

SEQ ID NO: 2609580 - RNA, 22 nt, Escherichia coli CFT073
uacuggcaaucgccagcggcag

SEQ ID NO: 2609581 - RNA, 22 nt, Escherichia coli CFT073
uacuggcauacaucaacgcgca

SEQ ID NO: 2609582 - RNA, 21 nt, Escherichia coli CFT073
uacuggcguuacccagcgcca

SEQ ID NO: 2609583 - RNA, 13 nt, Escherichia coli CFT073
uacugguauucgc

SEQ ID NO: 2609584 - RNA, 18 nt, Escherichia coli CFT073
uacugguugauuuuaaag

SEQ ID NO: 2609585 - RNA, 22 nt, Escherichia coli CFT073
uacugguugauuuuaaaggauu

SEQ ID NO: 2609586 - RNA, 13 nt, Escherichia coli CFT073
uacugguuuuacc

SEQ ID NO: 2609587 - RNA, 12 nt, Escherichia coli CFT073
uacuguacaauc

SEQ ID NO: 2609588 - RNA, 16 nt, Escherichia coli CFT073
uacuguccugcggcgu

SEQ ID NO: 2609589 - RNA, 23 nt, Escherichia coli CFT073
uacuguuuaccggugccagcaac

SEQ ID NO: 2609590 - RNA, 23 nt, Escherichia coli CFT073
uacuuaacacccccugcaaaacu

SEQ ID NO: 2609591 - RNA, 14 nt, Escherichia coli CFT073
uacuuacacaucau

SEQ ID NO: 2609592 - RNA, 15 nt, Escherichia coli CFT073
uacuucaacacauaa

SEQ ID NO: 2609593 - RNA, 13 nt, Escherichia coli CFT073
uacuucacaucau

SEQ ID NO: 2609594 - RNA, 16 nt, Escherichia coli CFT073
uacuucacggcugcua

SEQ ID NO: 2609595 - RNA, 23 nt, Escherichia coli CFT073
uacuuccccggcagugcuuucau

SEQ ID NO: 2609596 - RNA, 12 nt, Escherichia coli CFT073
uacuucugcugc

SEQ ID NO: 2609597 - RNA, 17 nt, Escherichia coli CFT073
uacuugucgauaaacgg

SEQ ID NO: 2609598 - RNA, 16 nt, Escherichia coli CFT073
uacuuuccauuuugga

SEQ ID NO: 2609599 - RNA, 19 nt, Escherichia coli CFT073
uacuuuccauuuuggaaua

SEQ ID NO: 2609600 - RNA, 19 nt, Escherichia coli CFT073
uacuuugaccguaauagcu

SEQ ID NO: 2609601 - RNA, 12 nt, Escherichia coli CFT073
uacuuugccuuu

SEQ ID NO: 2609602 - RNA, 20 nt, Escherichia coli CFT073
uacuuuugaaggaauuaauc

SEQ ID NO: 2609603 - RNA, 13 nt, Escherichia coli CFT073
uagaaaaauucaa

SEQ ID NO: 2609604 - RNA, 15 nt, Escherichia coli CFT073
uagaaaagaguauua

SEQ ID NO: 2609605 - RNA, 23 nt, Escherichia coli CFT073
uagaaaagaguauuacaucacuu

SEQ ID NO: 2609606 - RNA, 19 nt, Escherichia coli CFT073
uagaaaccauccagcagac

SEQ ID NO: 2609607 - RNA, 14 nt, Escherichia coli CFT073
uagaacaauuaaua

SEQ ID NO: 2609608 - RNA, 17 nt, Escherichia coli CFT073
uagaacauaauguaaac

SEQ ID NO: 2609609 - RNA, 17 nt, Escherichia coli CFT073
uagaaccaaaguuugca

SEQ ID NO: 2609610 - RNA, 22 nt, Escherichia coli CFT073
uagaaccaaaguuugcaaaccc

SEQ ID NO: 2609611 - RNA, 14 nt, Escherichia coli CFT073
uagaacggcagaga

SEQ ID NO: 2609612 - RNA, 15 nt, Escherichia coli CFT073
uagaacguuuaucug

SEQ ID NO: 2609613 - RNA, 19 nt, Escherichia coli CFT073
uagaacugcggcagguuga

SEQ ID NO: 2609614 - RNA, 22 nt, Escherichia coli CFT073
uagaagacgcagggcgaauucc

SEQ ID NO: 2609615 - RNA, 19 nt, Escherichia coli CFT073
uagaagccaguacacgcug

SEQ ID NO: 2609616 - RNA, 13 nt, Escherichia coli CFT073
uagaagcgacuga

SEQ ID NO: 2609617 - RNA, 17 nt, Escherichia coli CFT073
uagaaggcgacaaagcc

SEQ ID NO: 2609618 - RNA, 19 nt, Escherichia coli CFT073
uagaaggcgacaaagccuc

SEQ ID NO: 2609619 - RNA, 13 nt, Escherichia coli CFT073
uagaaugcagcag

SEQ ID NO: 2609620 - RNA, 14 nt, Escherichia coli CFT073
uagaauuauuagca

SEQ ID NO: 2609621 - RNA, 22 nt, Escherichia coli CFT073
uagacaauguaucuuucaucau

SEQ ID NO: 2609622 - RNA, 23 nt, Escherichia coli CFT073
uagacaauguaucuuucaucauu

SEQ ID NO: 2609623 - RNA, 15 nt, Escherichia coli CFT073
uagacagccacaucc

SEQ ID NO: 2609624 - RNA, 16 nt, Escherichia coli CFT073
uagacagcuucggguu

SEQ ID NO: 2609625 - RNA, 20 nt, Escherichia coli CFT073
uagacaucaaaauuaccuuu

SEQ ID NO: 2609626 - RNA, 14 nt, Escherichia coli CFT073
uagacauuacgcau

SEQ ID NO: 2609627 - RNA, 22 nt, Escherichia coli CFT073
uagaccaguccggcuuaucugc

SEQ ID NO: 2609628 - RNA, 22 nt, Escherichia coli CFT073
uagacgauagaaccuuccacgu

SEQ ID NO: 2609629 - RNA, 16 nt, Escherichia coli CFT073
uagacgccauuuugca

SEQ ID NO: 2609630 - RNA, 18 nt, Escherichia coli CFT073
uagacggugacacuuugu

SEQ ID NO: 2609631 - RNA, 21 nt, Escherichia coli CFT073
uagacuguugaaauacaaaca

SEQ ID NO: 2609632 - RNA, 18 nt, Escherichia coli CFT073
uagacuuugucaucaguc

SEQ ID NO: 2609633 - RNA, 17 nt, Escherichia coli CFT073
uagagagauguugcugc

SEQ ID NO: 2609634 - RNA, 23 nt, Escherichia coli CFT073
uagagagcagucagguucagcgu

SEQ ID NO: 2609635 - RNA, 14 nt, Escherichia coli CFT073
uagagaucuucaua

SEQ ID NO: 2609636 - RNA, 15 nt, Escherichia coli CFT073
uagagaucuucauac

SEQ ID NO: 2609637 - RNA, 18 nt, Escherichia coli CFT073
uagagaucuugcgcuacc

SEQ ID NO: 2609638 - RNA, 12 nt, Escherichia coli CFT073
uagagcagcacg

SEQ ID NO: 2609639 - RNA, 12 nt, Escherichia coli CFT073
uagagcccaugc

SEQ ID NO: 2609640 - RNA, 20 nt, Escherichia coli CFT073
uagagccgguuuugguuuuc

SEQ ID NO: 2609641 - RNA, 21 nt, Escherichia coli CFT073
uagagcugguuucuggcggua

SEQ ID NO: 2609642 - RNA, 18 nt, Escherichia coli CFT073
uagaggcguuccugcaac

SEQ ID NO: 2609643 - RNA, 13 nt, Escherichia coli CFT073
uagauaagcaagg

SEQ ID NO: 2609644 - RNA, 17 nt, Escherichia coli CFT073
uagauaauaaaacgcgg

SEQ ID NO: 2609645 - RNA, 19 nt, Escherichia coli CFT073
uagauaauuuugaaauaaa

SEQ ID NO: 2609646 - RNA, 21 nt, Escherichia coli CFT073
uagauaauuuugaaauaaaau

SEQ ID NO: 2609647 - RNA, 13 nt, Escherichia coli CFT073
uagauagcguucu

SEQ ID NO: 2609648 - RNA, 14 nt, Escherichia coli CFT073
uagauagcguucuu

SEQ ID NO: 2609649 - RNA, 15 nt, Escherichia coli CFT073
uagauauauccugaa

SEQ ID NO: 2609650 - RNA, 18 nt, Escherichia coli CFT073
uagauauauccugaacuu

SEQ ID NO: 2609651 - RNA, 16 nt, Escherichia coli CFT073
uagauauccacaacaa

SEQ ID NO: 2609652 - RNA, 17 nt, Escherichia coli CFT073
uagauauccacaacaau

SEQ ID NO: 2609653 - RNA, 17 nt, Escherichia coli CFT073
uagauauucaucaaaau

SEQ ID NO: 2609654 - RNA, 13 nt, Escherichia coli CFT073
uagaucacugaaa

SEQ ID NO: 2609655 - RNA, 21 nt, Escherichia coli CFT073
uagaucacugaaauuguaggc

SEQ ID NO: 2609656 - RNA, 20 nt, Escherichia coli CFT073
uagauggcggaaauaacgcu

SEQ ID NO: 2609657 - RNA, 21 nt, Escherichia coli CFT073
uagaugugccaauugccuggu

SEQ ID NO: 2609658 - RNA, 21 nt, Escherichia coli CFT073
uagauuaccagagaaaagaua

SEQ ID NO: 2609659 - RNA, 16 nt, Escherichia coli CFT073
uagauucgggcuaauu

SEQ ID NO: 2609660 - RNA, 23 nt, Escherichia coli CFT073
uagauucgggcuaauuuccugga

SEQ ID NO: 2609661 - RNA, 17 nt, Escherichia coli CFT073
uagauuucauccggcug

SEQ ID NO: 2609662 - RNA, 20 nt, Escherichia coli CFT073
uagauuucguugugucgcca

SEQ ID NO: 2609663 - RNA, 23 nt, Escherichia coli CFT073
uagauuucguugugucgccagca

SEQ ID NO: 2609664 - RNA, 13 nt, Escherichia coli CFT073
uagauuucucuaa

SEQ ID NO: 2609665 - RNA, 11 nt, Escherichia coli CFT073
uagauuuugca

SEQ ID NO: 2609666 - RNA, 19 nt, Escherichia coli CFT073
uagauuuugcagaucacca

SEQ ID NO: 2609667 - RNA, 14 nt, Escherichia coli CFT073
uagcaaacaaaaag

SEQ ID NO: 2609668 - RNA, 23 nt, Escherichia coli CFT073
uagcaaagaacguaaucaacgcc

SEQ ID NO: 2609669 - RNA, 20 nt, Escherichia coli CFT073
uagcaaauuaucccccagca

SEQ ID NO: 2609670 - RNA, 16 nt, Escherichia coli CFT073
uagcaacaaaaaaacc

SEQ ID NO: 2609671 - RNA, 18 nt, Escherichia coli CFT073
uaggccugauaagacgcg

SEQ ID NO: 2609672 - RNA, 15 nt, Escherichia coli CFT073
uaggccugauaagcg

SEQ ID NO: 2609673 - RNA, 17 nt, Escherichia coli CFT073
uagggaaacuccagccc

SEQ ID NO: 2609674 - RNA, 11 nt, Escherichia coli CFT073
uagggaaguag

SEQ ID NO: 2609675 - RNA, 14 nt, Escherichia coli CFT073
uagggcgaaaccau

SEQ ID NO: 2609676 - RNA, 20 nt, Escherichia coli CFT073
uagggcgagaaauugagaua

SEQ ID NO: 2609677 - RNA, 14 nt, Escherichia coli CFT073
uaggggauuuugac

SEQ ID NO: 2609678 - RNA, 17 nt, Escherichia coli CFT073
uaggggauuuugacuuu

SEQ ID NO: 2609679 - RNA, 18 nt, Escherichia coli CFT073
uagggggggcucuuucca

SEQ ID NO: 2609680 - RNA, 18 nt, Escherichia coli CFT073
uaggguggggaaaaaaca

SEQ ID NO: 2609681 - RNA, 14 nt, Escherichia coli CFT073
uagguacaaagcca

SEQ ID NO: 2609682 - RNA, 12 nt, Escherichia coli CFT073
uaggucaccaga

SEQ ID NO: 2609683 - RNA, 17 nt, Escherichia coli CFT073
uaggucggauaagacgc

SEQ ID NO: 2609684 - RNA, 19 nt, Escherichia coli CFT073
uaggucggauaagacgcac

SEQ ID NO: 2609685 - RNA, 20 nt, Escherichia coli CFT073
uaggucggauaagacgcguc

SEQ ID NO: 2609686 - RNA, 20 nt, Escherichia coli CFT073
uaggucggauaaggcguuua

SEQ ID NO: 2609687 - RNA, 23 nt, Escherichia coli CFT073
uaggucuuugacgucgaaacuga

SEQ ID NO: 2609688 - RNA, 23 nt, Escherichia coli CFT073
uagguggcaaagaaaucaacaaa

SEQ ID NO: 2609689 - RNA, 16 nt, Escherichia coli CFT073
uaggugguauagaaug

SEQ ID NO: 2609690 - RNA, 16 nt, Escherichia coli CFT073
uagguguaaauaucag

SEQ ID NO: 2609691 - RNA, 20 nt, Escherichia coli CFT073
uagguuccggcaaucaacag

SEQ ID NO: 2609692 - RNA, 21 nt, Escherichia coli CFT073
uagguuccggcaaucaacaga

SEQ ID NO: 2609693 - RNA, 17 nt, Escherichia coli CFT073
uagguugaaauaaaccg

SEQ ID NO: 2609694 - RNA, 20 nt, Escherichia coli CFT073
uagguugaaauaaaccgugc

SEQ ID NO: 2609695 - RNA, 17 nt, Escherichia coli CFT073
uagguugugaucauccg

SEQ ID NO: 2609696 - RNA, 22 nt, Escherichia coli CFT073
uaguaaaaggcaccauaacuag

SEQ ID NO: 2609697 - RNA, 19 nt, Escherichia coli CFT073
uaguaaagcuaccggcaaa

SEQ ID NO: 2609698 - RNA, 13 nt, Escherichia coli CFT073
uaguaacgcggca

SEQ ID NO: 2609699 - RNA, 22 nt, Escherichia coli CFT073
uaguaaugcguaacguuucuuu

SEQ ID NO: 2609700 - RNA, 17 nt, Escherichia coli CFT073
uaguacauuguuuucca

SEQ ID NO: 2609701 - RNA, 19 nt, Escherichia coli CFT073
uaguacccucugcaccaga

SEQ ID NO: 2609702 - RNA, 22 nt, Escherichia coli CFT073
uaguacgccaaucugcaaaaua

SEQ ID NO: 2609703 - RNA, 22 nt, Escherichia coli CFT073
uaguacgggcaauuucacgcuc

SEQ ID NO: 2609704 - RNA, 19 nt, Escherichia coli CFT073
uaguacuggaagaaaacau

SEQ ID NO: 2609705 - RNA, 14 nt, Escherichia coli CFT073
uaguagagauccug

SEQ ID NO: 2609706 - RNA, 16 nt, Escherichia coli CFT073
uaguaguucauccccu

SEQ ID NO: 2609707 - RNA, 21 nt, Escherichia coli CFT073
uaguaguucauccccucuucc

SEQ ID NO: 2609708 - RNA, 16 nt, Escherichia coli CFT073
uaguaucgcucaauau

SEQ ID NO: 2609709 - RNA, 18 nt, Escherichia coli CFT073
uaguauuuuauggcagaa

SEQ ID NO: 2609710 - RNA, 13 nt, Escherichia coli CFT073
uagucacaaaucu

SEQ ID NO: 2609711 - RNA, 16 nt, Escherichia coli CFT073
uagucaguauuuuccc

SEQ ID NO: 2609712 - RNA, 13 nt, Escherichia coli CFT073
uagucauuuuuug

SEQ ID NO: 2609713 - RNA, 15 nt, Escherichia coli CFT073
uagucccaaacagca

SEQ ID NO: 2609714 - RNA, 19 nt, Escherichia coli CFT073
uaguccgccagaauacccg

SEQ ID NO: 2609715 - RNA, 20 nt, Escherichia coli CFT073
uaguccggauaaggcguuca

SEQ ID NO: 2609716 - RNA, 23 nt, Escherichia coli CFT073
uagucgcccaucuucguaccaaa

SEQ ID NO: 2609717 - RNA, 19 nt, Escherichia coli CFT073
uagucuccaaccaucacca

SEQ ID NO: 2609718 - RNA, 18 nt, Escherichia coli CFT073
uagucugguugagcagua

SEQ ID NO: 2609719 - RNA, 14 nt, Escherichia coli CFT073
uagugaauugccca

SEQ ID NO: 2609720 - RNA, 22 nt, Escherichia coli CFT073
uagugauaugggcaaacaaaaa

SEQ ID NO: 2609721 - RNA, 13 nt, Escherichia coli CFT073
uagugaucagccu

SEQ ID NO: 2609722 - RNA, 17 nt, Escherichia coli CFT073
uagugaucguucaccgu

SEQ ID NO: 2609723 - RNA, 22 nt, Escherichia coli CFT073
uagugaugcaucauaugcgcca

SEQ ID NO: 2609724 - RNA, 12 nt, Escherichia coli CFT073
uagugcccggca

SEQ ID NO: 2609725 - RNA, 14 nt, Escherichia coli CFT073
uagugccugcacaa

SEQ ID NO: 2609726 - RNA, 16 nt, Escherichia coli CFT073
uagugcgcaguugccg

SEQ ID NO: 2609727 - RNA, 19 nt, Escherichia coli CFT073
uagugcuucaaauauugau

SEQ ID NO: 2609728 - RNA, 18 nt, Escherichia coli CFT073
uagugcuuucagcgaaaa

SEQ ID NO: 2609729 - RNA, 16 nt, Escherichia coli CFT073
uaguggcaaauucuug

SEQ ID NO: 2609730 - RNA, 16 nt, Escherichia coli CFT073
uaguguaaaugcaaau

SEQ ID NO: 2609731 - RNA, 15 nt, Escherichia coli CFT073
uagugugcaaucacu

SEQ ID NO: 2609732 - RNA, 13 nt, Escherichia coli CFT073
uaguguuccugcg

SEQ ID NO: 2609733 - RNA, 23 nt, Escherichia coli CFT073
uaguguugcguuuuuaucuucac

SEQ ID NO: 2609734 - RNA, 17 nt, Escherichia coli CFT073
uaguuaaaccagcuguc

SEQ ID NO: 2609735 - RNA, 16 nt, Escherichia coli CFT073
uaguuaaacuuucaua

SEQ ID NO: 2609736 - RNA, 17 nt, Escherichia coli CFT073
uaguuaaucaguacgca

SEQ ID NO: 2609737 - RNA, 22 nt, Escherichia coli CFT073
uaguuacgaaaaggauaaauaa

SEQ ID NO: 2609738 - RNA, 23 nt, Escherichia coli CFT073
uaguuagcagauuaauuuaacga

SEQ ID NO: 2609739 - RNA, 13 nt, Escherichia coli CFT073
uaguucauccccu

SEQ ID NO: 2609740 - RNA, 16 nt, Escherichia coli CFT073
uaguucauccccucuu

SEQ ID NO: 2609741 - RNA, 12 nt, Escherichia coli CFT073
uaguugauuuua

SEQ ID NO: 2609742 - RNA, 22 nt, Escherichia coli CFT073
uaguugcgcugguggcaggcaa

SEQ ID NO: 2609743 - RNA, 11 nt, Escherichia coli CFT073
uaguugcugcg

SEQ ID NO: 2609744 - RNA, 19 nt, Escherichia coli CFT073
uaguugcugucgacaaagc

SEQ ID NO: 2609745 - RNA, 18 nt, Escherichia coli CFT073
uaguuucaaugccuuucu

SEQ ID NO: 2609746 - RNA, 20 nt, Escherichia coli CFT073
uaguuucaaugccuuucuuu

SEQ ID NO: 2609747 - RNA, 12 nt, Escherichia coli CFT073
uaguuugguuaa

SEQ ID NO: 2609748 - RNA, 13 nt, Escherichia coli CFT073
uauaaaaaauacg

SEQ ID NO: 2609749 - RNA, 15 nt, Escherichia coli CFT073
uauaaaaagaagauc

SEQ ID NO: 2609750 - RNA, 21 nt, Escherichia coli CFT073
uauaaaacacauuaaacuuaa

SEQ ID NO: 2609751 - RNA, 21 nt, Escherichia coli CFT073
uauaaacauaucacuuuuaua

SEQ ID NO: 2609752 - RNA, 21 nt, Escherichia coli CFT073
uauaaacccccugaccggaaa

SEQ ID NO: 2609753 - RNA, 16 nt, Escherichia coli CFT073
uauaaacucgccaaac

SEQ ID NO: 2609754 - RNA, 17 nt, Escherichia coli CFT073
uauaaagaaugaaauuc

SEQ ID NO: 2609755 - RNA, 23 nt, Escherichia coli CFT073
uauaaagcagaaugguuuuguca

SEQ ID NO: 2609756 - RNA, 22 nt, Escherichia coli CFT073
uauaaagcccaucguugaaaaa

SEQ ID NO: 2609757 - RNA, 18 nt, Escherichia coli CFT073
uauaaauauacauacugu

SEQ ID NO: 2609758 - RNA, 21 nt, Escherichia coli CFT073
uauaaaugccggguaaagauu

SEQ ID NO: 2609759 - RNA, 23 nt, Escherichia coli CFT073
uauaacauggugaaagcauggca

SEQ ID NO: 2609760 - RNA, 19 nt, Escherichia coli CFT073
uauaaccagacgauuuucc

SEQ ID NO: 2609761 - RNA, 18 nt, Escherichia coli CFT073
uauaacuauaugacucau

SEQ ID NO: 2609762 - RNA, 17 nt, Escherichia coli CFT073
uauaacuuuaguaucac

SEQ ID NO: 2609763 - RNA, 13 nt, Escherichia coli CFT073
uauaaggcaucag

SEQ ID NO: 2609764 - RNA, 17 nt, Escherichia coli CFT073
uauaaguacuaaauaau

SEQ ID NO: 2609765 - RNA, 22 nt, Escherichia coli CFT073
uauaaguggagcccucaagcca

SEQ ID NO: 2609766 - RNA, 18 nt, Escherichia coli CFT073
uauaaguucaaguaaaac

SEQ ID NO: 2609767 - RNA, 15 nt, Escherichia coli CFT073
uauaauaaauauuau

SEQ ID NO: 2609768 - RNA, 13 nt, Escherichia coli CFT073
uauaauaagaaua

SEQ ID NO: 2609769 - RNA, 19 nt, Escherichia coli CFT073
uauaauagugcuucaaaua

SEQ ID NO: 2609770 - RNA, 23 nt, Escherichia coli CFT073
uauaauuuauuagcagugauuua

SEQ ID NO: 2609771 - RNA, 19 nt, Escherichia coli CFT073
uauaauuuuuuuaaucuau

SEQ ID NO: 2609772 - RNA, 15 nt, Escherichia coli CFT073
uauacaaacauaaag

SEQ ID NO: 2609773 - RNA, 16 nt, Escherichia coli CFT073
uauacaaccaauaacu

SEQ ID NO: 2609774 - RNA, 19 nt, Escherichia coli CFT073
uauacaaccaauaacucaa

SEQ ID NO: 2609775 - RNA, 15 nt, Escherichia coli CFT073
uauacacgaaaugaa

SEQ ID NO: 2609776 - RNA, 16 nt, Escherichia coli CFT073
uauacacgaaaugaau

SEQ ID NO: 2609777 - RNA, 16 nt, Escherichia coli CFT073
uauacagacucaaacc

SEQ ID NO: 2609778 - RNA, 17 nt, Escherichia coli CFT073
uauacagacucaaacca

SEQ ID NO: 2609779 - RNA, 20 nt, Escherichia coli CFT073
uaucccauuucuccacuggg

SEQ ID NO: 2609780 - RNA, 13 nt, Escherichia coli CFT073
uauccccagccua

SEQ ID NO: 2609781 - RNA, 14 nt, Escherichia coli CFT073
uaucccugcugucc

SEQ ID NO: 2609782 - RNA, 16 nt, Escherichia coli CFT073
uaucccugcuguccug

SEQ ID NO: 2609783 - RNA, 14 nt, Escherichia coli CFT073
uaucccuucuccac

SEQ ID NO: 2609784 - RNA, 23 nt, Escherichia coli CFT073
uaucccuugucuuuuauuauaau

SEQ ID NO: 2609785 - RNA, 19 nt, Escherichia coli CFT073
uauccgaguagcucaccag

SEQ ID NO: 2609786 - RNA, 21 nt, Escherichia coli CFT073
uauccgccagcgccaaagcca

SEQ ID NO: 2609787 - RNA, 16 nt, Escherichia coli CFT073
uauccgcuguuauugu

SEQ ID NO: 2609788 - RNA, 16 nt, Escherichia coli CFT073
uauccggaaacuggau

SEQ ID NO: 2609789 - RNA, 15 nt, Escherichia coli CFT073
uauccggccaacaaa

SEQ ID NO: 2609790 - RNA, 20 nt, Escherichia coli CFT073
uauccggccaacaaaaaauu

SEQ ID NO: 2609791 - RNA, 14 nt, Escherichia coli CFT073
uauccggccuacaa

SEQ ID NO: 2609792 - RNA, 15 nt, Escherichia coli CFT073
uauccggccuacgaa

SEQ ID NO: 2609793 - RNA, 15 nt, Escherichia coli CFT073
uauccggccugcaaa

SEQ ID NO: 2609794 - RNA, 14 nt, Escherichia coli CFT073
uauccgggcaaaaa

SEQ ID NO: 2609795 - RNA, 18 nt, Escherichia coli CFT073
uauccgucgcguuucucc

SEQ ID NO: 2609796 - RNA, 19 nt, Escherichia coli CFT073
uauccuaauccuggccaua

SEQ ID NO: 2609797 - RNA, 23 nt, Escherichia coli CFT073
uauccugaacuuguuuacaaaua

SEQ ID NO: 2609798 - RNA, 21 nt, Escherichia coli CFT073
uauccugcccgcuccagcuau

SEQ ID NO: 2609799 - RNA, 15 nt, Escherichia coli CFT073
uauccugccggugau

SEQ ID NO: 2609800 - RNA, 22 nt, Escherichia coli CFT073
uauccugcgguuugucaucauu

SEQ ID NO: 2609801 - RNA, 16 nt, Escherichia coli CFT073
uauccugggagaugau

SEQ ID NO: 2609802 - RNA, 12 nt, Escherichia coli CFT073
uauccuggucaa

SEQ ID NO: 2609803 - RNA, 20 nt, Escherichia coli CFT073
uauccuguggacgcagcuca

SEQ ID NO: 2609804 - RNA, 14 nt, Escherichia coli CFT073
uauccuguuuuuaa

SEQ ID NO: 2609805 - RNA, 18 nt, Escherichia coli CFT073
uauccuucugcguuuuug

SEQ ID NO: 2609806 - RNA, 16 nt, Escherichia coli CFT073
uaucgaacguuuucac

SEQ ID NO: 2609807 - RNA, 20 nt, Escherichia coli CFT073
uaucgaacguuuucaccacu

SEQ ID NO: 2609808 - RNA, 14 nt, Escherichia coli CFT073
uaucgaauaaagau

SEQ ID NO: 2609809 - RNA, 17 nt, Escherichia coli CFT073
uaucgacuaacuucuga

SEQ ID NO: 2609810 - RNA, 17 nt, Escherichia coli CFT073
uaucgauaaauggcgca

SEQ ID NO: 2609811 - RNA, 22 nt, Escherichia coli CFT073
uaucgauauacaccggcaucaa

SEQ ID NO: 2609812 - RNA, 15 nt, Escherichia coli CFT073
uaucgcauuaucaaa

SEQ ID NO: 2609813 - RNA, 12 nt, Escherichia coli CFT073
uaucgccagcgc

SEQ ID NO: 2609814 - RNA, 11 nt, Escherichia coli CFT073
uaucgcccacg

SEQ ID NO: 2609815 - RNA, 15 nt, Escherichia coli CFT073
uaucgcccugccagc

SEQ ID NO: 2609816 - RNA, 19 nt, Escherichia coli CFT073
uaucgcgaaaaaaaagaug

SEQ ID NO: 2609817 - RNA, 21 nt, Escherichia coli CFT073
uaucgcgacgaauagguaacg

SEQ ID NO: 2609818 - RNA, 17 nt, Escherichia coli CFT073
uaucgcgccagccagua

SEQ ID NO: 2609819 - RNA, 18 nt, Escherichia coli CFT073
uaucgcgccaucaaaucu

SEQ ID NO: 2609820 - RNA, 15 nt, Escherichia coli CFT073
uaucgcguaaugcuu

SEQ ID NO: 2609821 - RNA, 20 nt, Escherichia coli CFT073
uaucgcgucaacagggcaga

SEQ ID NO: 2609822 - RNA, 22 nt, Escherichia coli CFT073
uaucgcgucaacagggcagaca

SEQ ID NO: 2609823 - RNA, 19 nt, Escherichia coli CFT073
uaucgcucaauauccugac

SEQ ID NO: 2609824 - RNA, 13 nt, Escherichia coli CFT073
uaucggcaaaaau

SEQ ID NO: 2609825 - RNA, 14 nt, Escherichia coli CFT073
uaucggccauaugu

SEQ ID NO: 2609826 - RNA, 17 nt, Escherichia coli CFT073
uaucggcgaagugcaga

SEQ ID NO: 2609827 - RNA, 16 nt, Escherichia coli CFT073
uaucggcgcagagccc

SEQ ID NO: 2609828 - RNA, 19 nt, Escherichia coli CFT073
uaucgguagggaaugccgg

SEQ ID NO: 2609829 - RNA, 16 nt, Escherichia coli CFT073
uaucgguguuuuccac

SEQ ID NO: 2609830 - RNA, 21 nt, Escherichia coli CFT073
uaucguaaucagcaccgaagu

SEQ ID NO: 2609831 - RNA, 20 nt, Escherichia coli CFT073
uaucguauccgguuuuccag

SEQ ID NO: 2609832 - RNA, 18 nt, Escherichia coli CFT073
uaucguuagcauggguau

SEQ ID NO: 2609833 - RNA, 14 nt, Escherichia coli CFT073
uaucguuuuucauu

SEQ ID NO: 2609834 - RNA, 14 nt, Escherichia coli CFT073
uaucuaauaaacau

SEQ ID NO: 2609835 - RNA, 14 nt, Escherichia coli CFT073
uaucuaaugccauu

SEQ ID NO: 2609836 - RNA, 12 nt, Escherichia coli CFT073
uaucuaucacua

SEQ ID NO: 2609837 - RNA, 18 nt, Escherichia coli CFT073
uaucuaucacuauaaaua

SEQ ID NO: 2609838 - RNA, 19 nt, Escherichia coli CFT073
uaucuaucacuauaaauau

SEQ ID NO: 2609839 - RNA, 15 nt, Escherichia coli CFT073
uaucuauuacagcgc

SEQ ID NO: 2609840 - RNA, 13 nt, Escherichia coli CFT073
uaucucaaaaauu

SEQ ID NO: 2609841 - RNA, 18 nt, Escherichia coli CFT073
uaucucgucacuuuucuu

SEQ ID NO: 2609842 - RNA, 23 nt, Escherichia coli CFT073
uaucugaugcgcuucgcuuacca

SEQ ID NO: 2609843 - RNA, 21 nt, Escherichia coli CFT073
uaucugauuacucauuaauca

SEQ ID NO: 2609844 - RNA, 16 nt, Escherichia coli CFT073
uaucugauuuaaaaau

SEQ ID NO: 2609845 - RNA, 15 nt, Escherichia coli CFT073
uaucugccagccagu

SEQ ID NO: 2609846 - RNA, 12 nt, Escherichia coli CFT073
uaucuggaggug

SEQ ID NO: 2609847 - RNA, 11 nt, Escherichia coli CFT073
uaucuggcaag

SEQ ID NO: 2609848 - RNA, 16 nt, Escherichia coli CFT073
uaucuguaauuaaauu

SEQ ID NO: 2609849 - RNA, 20 nt, Escherichia coli CFT073
uaucuguacaguuaagcccu

SEQ ID NO: 2609850 - RNA, 17 nt, Escherichia coli CFT073
uaucuguacuuaaaacu

SEQ ID NO: 2609851 - RNA, 23 nt, Escherichia coli CFT073
uaucugugcuuguaaaacagcca

SEQ ID NO: 2609852 - RNA, 22 nt, Escherichia coli CFT073
uaucuguguaaugaauggaguu

SEQ ID NO: 2609853 - RNA, 14 nt, Escherichia coli CFT073
uaucuuauucccac

SEQ ID NO: 2609854 - RNA, 12 nt, Escherichia coli CFT073
uaucuuauugaa

SEQ ID NO: 2609855 - RNA, 16 nt, Escherichia coli CFT073
uaucuucaaagccaca

SEQ ID NO: 2609856 - RNA, 18 nt, Escherichia coli CFT073
uaucuucaaucagaugug

SEQ ID NO: 2609857 - RNA, 23 nt, Escherichia coli CFT073
uaucuucauccgccccggcuuca

SEQ ID NO: 2609858 - RNA, 18 nt, Escherichia coli CFT073
uaucuuccagcauuucca

SEQ ID NO: 2609859 - RNA, 15 nt, Escherichia coli CFT073
uaucuucccagccca

SEQ ID NO: 2609860 - RNA, 19 nt, Escherichia coli CFT073
uaucuuccguauuugucuc

SEQ ID NO: 2609861 - RNA, 19 nt, Escherichia coli CFT073
uaucuucgauaaacucaau

SEQ ID NO: 2609862 - RNA, 14 nt, Escherichia coli CFT073
uaucuuuaucugcc

SEQ ID NO: 2609863 - RNA, 17 nt, Escherichia coli CFT073
uaucuuuaucugccagc

SEQ ID NO: 2609864 - RNA, 13 nt, Escherichia coli CFT073
uaucuuucaucau

SEQ ID NO: 2609865 - RNA, 14 nt, Escherichia coli CFT073
uaucuuucaucauu

SEQ ID NO: 2609866 - RNA, 12 nt, Escherichia coli CFT073
uaucuuuccagc

SEQ ID NO: 2609867 - RNA, 13 nt, Escherichia coli CFT073
uaucuuuccagcc

SEQ ID NO: 2609868 - RNA, 20 nt, Escherichia coli CFT073
uaucuuugauugaagaaauc

SEQ ID NO: 2609869 - RNA, 14 nt, Escherichia coli CFT073
uaucuuuuucggua

SEQ ID NO: 2609870 - RNA, 16 nt, Escherichia coli CFT073
uaugaaacuccaccgg

SEQ ID NO: 2609871 - RNA, 15 nt, Escherichia coli CFT073
uaugaacuugcucau

SEQ ID NO: 2609872 - RNA, 20 nt, Escherichia coli CFT073
uaugaauagcggaaaucucc

SEQ ID NO: 2609873 - RNA, 13 nt, Escherichia coli CFT073
uaugacccagcgc

SEQ ID NO: 2609874 - RNA, 19 nt, Escherichia coli CFT073
uaugacucauaaaaauaua

SEQ ID NO: 2609875 - RNA, 20 nt, Escherichia coli CFT073
uaugacucauaaaaauauau

SEQ ID NO: 2609876 - RNA, 16 nt, Escherichia coli CFT073
uaugacuuaaaucucu

SEQ ID NO: 2609877 - RNA, 19 nt, Escherichia coli CFT073
uaugauccagcuugucaga

SEQ ID NO: 2609878 - RNA, 18 nt, Escherichia coli CFT073
uaugaugagaacuccugg

SEQ ID NO: 2609879 - RNA, 22 nt, Escherichia coli CFT073
uaugaugagaacuccuggcgaa

SEQ ID NO: 2609880 - RNA, 17 nt, Escherichia coli CFT073
uaugauguauauuucug

SEQ ID NO: 2609881 - RNA, 18 nt, Escherichia coli CFT073
uaugauguauauuucugu

SEQ ID NO: 2609882 - RNA, 13 nt, Escherichia coli CFT073
uaugauuuuccug

SEQ ID NO: 2609883 - RNA, 18 nt, Escherichia coli CFT073
uaugcaaaugagaaucua

SEQ ID NO: 2609884 - RNA, 21 nt, Escherichia coli CFT073
uaugcaauuguuuacuaaaag

SEQ ID NO: 2609885 - RNA, 18 nt, Escherichia coli CFT073
uaugcagagcauccagca

SEQ ID NO: 2609886 - RNA, 16 nt, Escherichia coli CFT073
uaugcauaaaccgggu

SEQ ID NO: 2609887 - RNA, 20 nt, Escherichia coli CFT073
uaugcaucgguggcgauacu

SEQ ID NO: 2609888 - RNA, 12 nt, Escherichia coli CFT073
uauucuuugauc

SEQ ID NO: 2609889 - RNA, 18 nt, Escherichia coli CFT073
uauucuuuuuugauucca

SEQ ID NO: 2609890 - RNA, 13 nt, Escherichia coli CFT073
uauugagaucgcu

SEQ ID NO: 2609891 - RNA, 21 nt, Escherichia coli CFT073
uauugagcgcaaauugcuggu

SEQ ID NO: 2609892 - RNA, 13 nt, Escherichia coli CFT073
uauugauaaccgu

SEQ ID NO: 2609893 - RNA, 18 nt, Escherichia coli CFT073
uauugauauccgcaggug

SEQ ID NO: 2609894 - RNA, 13 nt, Escherichia coli CFT073
uauugauggugug

SEQ ID NO: 2609895 - RNA, 21 nt, Escherichia coli CFT073
uauugauucaucucuucuucc

SEQ ID NO: 2609896 - RNA, 17 nt, Escherichia coli CFT073
uauugauuguuuuaaau

SEQ ID NO: 2609897 - RNA, 19 nt, Escherichia coli CFT073
uauugauuguuuuaaauau

SEQ ID NO: 2609898 - RNA, 20 nt, Escherichia coli CFT073
uauugcaccagaucuuccag

SEQ ID NO: 2609899 - RNA, 22 nt, Escherichia coli CFT073
uauugcauuggguguaaacguu

SEQ ID NO: 2609900 - RNA, 18 nt, Escherichia coli CFT073
uauugccccggagaaauc

SEQ ID NO: 2609901 - RNA, 21 nt, Escherichia coli CFT073
uauugccgacgguauuaacuc

SEQ ID NO: 2609902 - RNA, 17 nt, Escherichia coli CFT073
uauugcgcaugacacac

SEQ ID NO: 2609903 - RNA, 22 nt, Escherichia coli CFT073
uauugcuaugguccguucucac

SEQ ID NO: 2609904 - RNA, 14 nt, Escherichia coli CFT073
uauugcugaaaagg

SEQ ID NO: 2609905 - RNA, 15 nt, Escherichia coli CFT073
uauugcugcaccagc

SEQ ID NO: 2609906 - RNA, 15 nt, Escherichia coli CFT073
uauugcuguaaagua

SEQ ID NO: 2609907 - RNA, 17 nt, Escherichia coli CFT073
uauugcuugaucaggaa

SEQ ID NO: 2609908 - RNA, 15 nt, Escherichia coli CFT073
uauugguguugugaa

SEQ ID NO: 2609909 - RNA, 20 nt, Escherichia coli CFT073
uauuguucgugcaauucggc

SEQ ID NO: 2609910 - RNA, 19 nt, Escherichia coli CFT073
uauuguuuagcguuauauu

SEQ ID NO: 2609911 - RNA, 18 nt, Escherichia coli CFT073
uauuguuugucgccuuuu

SEQ ID NO: 2609912 - RNA, 17 nt, Escherichia coli CFT073
uauuguuuuuauuguca

SEQ ID NO: 2609913 - RNA, 15 nt, Escherichia coli CFT073
uauuuaaacucgcug

SEQ ID NO: 2609914 - RNA, 17 nt, Escherichia coli CFT073
uauuuaaacuucacgcu

SEQ ID NO: 2609915 - RNA, 12 nt, Escherichia coli CFT073
uauuuaacaauu

SEQ ID NO: 2609916 - RNA, 13 nt, Escherichia coli CFT073
uauuuaacaucau

SEQ ID NO: 2609917 - RNA, 18 nt, Escherichia coli CFT073
uauuuaagccugcaucac

SEQ ID NO: 2609918 - RNA, 18 nt, Escherichia coli CFT073
uauuuacagauuucccau

SEQ ID NO: 2609919 - RNA, 23 nt, Escherichia coli CFT073
uauuuaccagagucuuugcuugc

SEQ ID NO: 2609920 - RNA, 20 nt, Escherichia coli CFT073
uauuuacgguauaacccagu

SEQ ID NO: 2609921 - RNA, 17 nt, Escherichia coli CFT073
uauuuagauaaacggaa

SEQ ID NO: 2609922 - RNA, 15 nt, Escherichia coli CFT073
uauuuauuaauccag

SEQ ID NO: 2609923 - RNA, 19 nt, Escherichia coli CFT073
uauuucacauaacugccuc

SEQ ID NO: 2609924 - RNA, 14 nt, Escherichia coli CFT073
uauuucagaccugu

SEQ ID NO: 2609925 - RNA, 13 nt, Escherichia coli CFT073
uauuucagcccca

SEQ ID NO: 2609926 - RNA, 22 nt, Escherichia coli CFT073
uauuucauagauuaauuuccca

SEQ ID NO: 2609927 - RNA, 16 nt, Escherichia coli CFT073
uauuucccggauggca

SEQ ID NO: 2609928 - RNA, 16 nt, Escherichia coli CFT073
uauuucucauuuugau

SEQ ID NO: 2609929 - RNA, 11 nt, Escherichia coli CFT073
uauuucugguc

SEQ ID NO: 2609930 - RNA, 16 nt, Escherichia coli CFT073
uauuucuguuugcguc

SEQ ID NO: 2609931 - RNA, 12 nt, Escherichia coli CFT073
uauuugaauucc

SEQ ID NO: 2609932 - RNA, 15 nt, Escherichia coli CFT073
uauuugacauuuuuu

SEQ ID NO: 2609933 - RNA, 22 nt, Escherichia coli CFT073
uauuugacccgcaguaaaucag

SEQ ID NO: 2609934 - RNA, 18 nt, Escherichia coli CFT073
uauuugaguucacugccg

SEQ ID NO: 2609935 - RNA, 12 nt, Escherichia coli CFT073
uauuugauggga

SEQ ID NO: 2609936 - RNA, 17 nt, Escherichia coli CFT073
uauuugcaccuaaagcg

SEQ ID NO: 2609937 - RNA, 21 nt, Escherichia coli CFT073
uauuuggcugccgagcaaauc

SEQ ID NO: 2609938 - RNA, 14 nt, Escherichia coli CFT073
uauuuguucagcaa

SEQ ID NO: 2609939 - RNA, 23 nt, Escherichia coli CFT073
uauuuguuuuucaggaaauaaau

SEQ ID NO: 2609940 - RNA, 16 nt, Escherichia coli CFT073
uauuuuaccauauaaa

SEQ ID NO: 2609941 - RNA, 13 nt, Escherichia coli CFT073
uauuuuccagauu

SEQ ID NO: 2609942 - RNA, 19 nt, Escherichia coli CFT073
uauuuuccccacaaucggc

SEQ ID NO: 2609943 - RNA, 20 nt, Escherichia coli CFT073
uauuuuccgagguuaauauu

SEQ ID NO: 2609944 - RNA, 21 nt, Escherichia coli CFT073
uauuuuccgagguuaauauuu

SEQ ID NO: 2609945 - RNA, 14 nt, Escherichia coli CFT073
uauuuugaaucggu

SEQ ID NO: 2609946 - RNA, 17 nt, Escherichia coli CFT073
uauuuugcuuccggcaa

SEQ ID NO: 2609947 - RNA, 16 nt, Escherichia coli CFT073
uauuuuguaccguaca

SEQ ID NO: 2609948 - RNA, 14 nt, Escherichia coli CFT073
uauuuuguauuguu

SEQ ID NO: 2609949 - RNA, 13 nt, Escherichia coli CFT073
uauuuuuccagcu

SEQ ID NO: 2609950 - RNA, 18 nt, Escherichia coli CFT073
uauuuuuuuccuaaaccc

SEQ ID NO: 2609951 - RNA, 22 nt, Escherichia coli CFT073
ucaaaaaaaucuucacugaaua

SEQ ID NO: 2609952 - RNA, 13 nt, Escherichia coli CFT073
ucaaaaacaaaau

SEQ ID NO: 2609953 - RNA, 14 nt, Escherichia coli CFT073
ucaaaaacaaagaa

SEQ ID NO: 2609954 - RNA, 16 nt, Escherichia coli CFT073
ucaaaaccuaacucuu

SEQ ID NO: 2609955 - RNA, 16 nt, Escherichia coli CFT073
ucaaaacuuuucacca

SEQ ID NO: 2609956 - RNA, 18 nt, Escherichia coli CFT073
ucaaaagcguaccgccaa

SEQ ID NO: 2609957 - RNA, 22 nt, Escherichia coli CFT073
ucaaaagcguaccgccaauuac

SEQ ID NO: 2609958 - RNA, 23 nt, Escherichia coli CFT073
ucaaaagcguaccgccaauuacc

SEQ ID NO: 2609959 - RNA, 20 nt, Escherichia coli CFT073
ucaaaauaucgacauucaau

SEQ ID NO: 2609960 - RNA, 16 nt, Escherichia coli CFT073
ucaaaaucaccgauga

SEQ ID NO: 2609961 - RNA, 17 nt, Escherichia coli CFT073
ucaaaaucaucauugcu

SEQ ID NO: 2609962 - RNA, 14 nt, Escherichia coli CFT073
ucaaaaugaacauu

SEQ ID NO: 2609963 - RNA, 17 nt, Escherichia coli CFT073
ucaaaaugaacauuggc

SEQ ID NO: 2609964 - RNA, 18 nt, Escherichia coli CFT073
ucaaaaugaacauuggca

SEQ ID NO: 2609965 - RNA, 16 nt, Escherichia coli CFT073
ucaaaauuaccuuuac

SEQ ID NO: 2609966 - RNA, 22 nt, Escherichia coli CFT073
ucaaaauuaccuuuacaugaaa

SEQ ID NO: 2609967 - RNA, 17 nt, Escherichia coli CFT073
ucaaaauucaacuugga

SEQ ID NO: 2609968 - RNA, 15 nt, Escherichia coli CFT073
ucaaacacaggcaga

SEQ ID NO: 2609969 - RNA, 20 nt, Escherichia coli CFT073
ucaaacacaggcagaacacu

SEQ ID NO: 2609970 - RNA, 17 nt, Escherichia coli CFT073
ucaaacagaaaaacgaa

SEQ ID NO: 2609971 - RNA, 16 nt, Escherichia coli CFT073
ucaaacaggcggucug

SEQ ID NO: 2609972 - RNA, 12 nt, Escherichia coli CFT073
ucaaacaggcug

SEQ ID NO: 2609973 - RNA, 18 nt, Escherichia coli CFT073
ucaaacagguuauugacc

SEQ ID NO: 2609974 - RNA, 13 nt, Escherichia coli CFT073
ucaaaccaauggc

SEQ ID NO: 2609975 - RNA, 20 nt, Escherichia coli CFT073
ucaaaccaauggcguuggca

SEQ ID NO: 2609976 - RNA, 19 nt, Escherichia coli CFT073
ucaaaccauucccggcuuu

SEQ ID NO: 2609977 - RNA, 22 nt, Escherichia coli CFT073
ucaaaccauucccggcuuugca

SEQ ID NO: 2609978 - RNA, 21 nt, Escherichia coli CFT073
ucaaacgauucggcaaucaca

SEQ ID NO: 2609979 - RNA, 20 nt, Escherichia coli CFT073
ucaaacgcugacggugccag

SEQ ID NO: 2609980 - RNA, 13 nt, Escherichia coli CFT073
ucaaacggcguuu

SEQ ID NO: 2609981 - RNA, 15 nt, Escherichia coli CFT073
ucaaacggucagucg

SEQ ID NO: 2609982 - RNA, 16 nt, Escherichia coli CFT073
ucaaacgguugauaaa

SEQ ID NO: 2609983 - RNA, 17 nt, Escherichia coli CFT073
ucaaacgguugauaaau

SEQ ID NO: 2609984 - RNA, 13 nt, Escherichia coli CFT073
ucaaacuggcggc

SEQ ID NO: 2609985 - RNA, 19 nt, Escherichia coli CFT073
ucaaacuggcggcggcggu

SEQ ID NO: 2609986 - RNA, 21 nt, Escherichia coli CFT073
ucaaacuggcugaugcuggca

SEQ ID NO: 2609987 - RNA, 15 nt, Escherichia coli CFT073
ucaaacuuuuaaauu

SEQ ID NO: 2609988 - RNA, 20 nt, Escherichia coli CFT073
ucaaacuuuuaaauugaaga

SEQ ID NO: 2609989 - RNA, 17 nt, Escherichia coli CFT073
ucaaagaacucacgcgc

SEQ ID NO: 2609990 - RNA, 15 nt, Escherichia coli CFT073
ucaaagaaucaacga

SEQ ID NO: 2609991 - RNA, 19 nt, Escherichia coli CFT073
ucaaagacgcuuucacccg

SEQ ID NO: 2609992 - RNA, 16 nt, Escherichia coli CFT073
ucaaagagagcagucc

SEQ ID NO: 2609993 - RNA, 14 nt, Escherichia coli CFT073
ucaaagaugaaaua

SEQ ID NO: 2609994 - RNA, 15 nt, Escherichia coli CFT073
ucaaagcgccagcgc

SEQ ID NO: 2609995 - RNA, 17 nt, Escherichia coli CFT073
ucaaagcggucauguac

SEQ ID NO: 2609996 - RNA, 19 nt, Escherichia coli CFT073
ucaaagcggugaucaaaac

SEQ ID NO: 2609997 - RNA, 18 nt, Escherichia coli CFT073
ucaacguugaauuucagg

SEQ ID NO: 2609998 - RNA, 21 nt, Escherichia coli CFT073
ucaacuacggcuuuuuucauu

SEQ ID NO: 2609999 - RNA, 22 nt, Escherichia coli CFT073
ucaacuacggcuuuuuucauuu

SEQ ID NO: 2610000 - RNA, 18 nt, Escherichia coli CFT073
ucaacucacacaacgagu

SEQ ID NO: 2610001 - RNA, 12 nt, Escherichia coli CFT073
ucaacucacugu

SEQ ID NO: 2610002 - RNA, 23 nt, Escherichia coli CFT073
ucaacuccagaauaccgccgaua

SEQ ID NO: 2610003 - RNA, 23 nt, Escherichia coli CFT073
ucaacuccccgcauuuacucuca

SEQ ID NO: 2610004 - RNA, 17 nt, Escherichia coli CFT073
ucaacuccgccagcaac

SEQ ID NO: 2610005 - RNA, 18 nt, Escherichia coli CFT073
ucaacuccgccagcaacu

SEQ ID NO: 2610006 - RNA, 15 nt, Escherichia coli CFT073
ucaacugacugacgu

SEQ ID NO: 2610007 - RNA, 12 nt, Escherichia coli CFT073
ucaacuuaauac

SEQ ID NO: 2610008 - RNA, 11 nt, Escherichia coli CFT073
ucaacuuauug

SEQ ID NO: 2610009 - RNA, 16 nt, Escherichia coli CFT073
ucaacuucagcagcag

SEQ ID NO: 2610010 - RNA, 23 nt, Escherichia coli CFT073
ucaacuucgcuuaaccggcuucg

SEQ ID NO: 2610011 - RNA, 22 nt, Escherichia coli CFT073
ucaacuuuguugcgaacuucag

SEQ ID NO: 2610012 - RNA, 11 nt, Escherichia coli CFT073
ucaagaaaaau

SEQ ID NO: 2610013 - RNA, 12 nt, Escherichia coli CFT073
ucaagaaaugca

SEQ ID NO: 2610014 - RNA, 18 nt, Escherichia coli CFT073
ucaagaacggcaauaaag

SEQ ID NO: 2610015 - RNA, 18 nt, Escherichia coli CFT073
ucaagaacggcuuucaua

SEQ ID NO: 2610016 - RNA, 23 nt, Escherichia coli CFT073
ucaagaaugcucgcuggcaggcc

SEQ ID NO: 2610017 - RNA, 19 nt, Escherichia coli CFT073
ucaagauggcucucaucca

SEQ ID NO: 2610018 - RNA, 17 nt, Escherichia coli CFT073
ucaagauggggaauaag

SEQ ID NO: 2610019 - RNA, 18 nt, Escherichia coli CFT073
ucaagauggggaauaagc

SEQ ID NO: 2610020 - RNA, 22 nt, Escherichia coli CFT073
ucaagauggggaauaagcugua

SEQ ID NO: 2610021 - RNA, 14 nt, Escherichia coli CFT073
ucaagcaaccaggu

SEQ ID NO: 2610022 - RNA, 21 nt, Escherichia coli CFT073
ucaagcaaggccagguuuucu

SEQ ID NO: 2610023 - RNA, 19 nt, Escherichia coli CFT073
ucaagcaaucaagcccugg

SEQ ID NO: 2610024 - RNA, 17 nt, Escherichia coli CFT073
ucaagcacccaaugcca

SEQ ID NO: 2610025 - RNA, 19 nt, Escherichia coli CFT073
ucaagcauuuucucacugg

SEQ ID NO: 2610026 - RNA, 22 nt, Escherichia coli CFT073
ucaagcgaaaucaacacgccug

SEQ ID NO: 2610027 - RNA, 23 nt, Escherichia coli CFT073
ucaagcggacgaucgcugaugaa

SEQ ID NO: 2610028 - RNA, 19 nt, Escherichia coli CFT073
ucaagcgguaaccauccau

SEQ ID NO: 2610029 - RNA, 20 nt, Escherichia coli CFT073
ucaagcguuucaucuucagu

SEQ ID NO: 2610030 - RNA, 14 nt, Escherichia coli CFT073
ucaagcuaaaccaa

SEQ ID NO: 2610031 - RNA, 17 nt, Escherichia coli CFT073
ucaagcucaucaaugau

SEQ ID NO: 2610032 - RNA, 20 nt, Escherichia coli CFT073
ucaagcugaccgauaaccug

SEQ ID NO: 2610033 - RNA, 19 nt, Escherichia coli CFT073
ucaagcugaguauuaaccg

SEQ ID NO: 2610034 - RNA, 13 nt, Escherichia coli CFT073
ucaagcugcaucu

SEQ ID NO: 2610035 - RNA, 19 nt, Escherichia coli CFT073
ucaagcugcaucuggcgau

SEQ ID NO: 2610036 - RNA, 18 nt, Escherichia coli CFT073
ucaagcugugccugaaua

SEQ ID NO: 2610037 - RNA, 22 nt, Escherichia coli CFT073
ucaagcugugccugaauauacg

SEQ ID NO: 2610038 - RNA, 20 nt, Escherichia coli CFT073
ucaagcuugcagaauuggcg

SEQ ID NO: 2610039 - RNA, 19 nt, Escherichia coli CFT073
ucaaggaaugaaauauuau

SEQ ID NO: 2610040 - RNA, 19 nt, Escherichia coli CFT073
ucaaggcagagucaucucu

SEQ ID NO: 2610041 - RNA, 21 nt, Escherichia coli CFT073
ucaaggcugauguugauaaag

SEQ ID NO: 2610042 - RNA, 22 nt, Escherichia coli CFT073
ucaaggcugauguugauaaaga

SEQ ID NO: 2610043 - RNA, 14 nt, Escherichia coli CFT073
ucaaggucaacauu

SEQ ID NO: 2610044 - RNA, 19 nt, Escherichia coli CFT073
ucaaggucaugaugcuccg

SEQ ID NO: 2610045 - RNA, 20 nt, Escherichia coli CFT073
ucaaggugauauccaccgcg

SEQ ID NO: 2610046 - RNA, 13 nt, Escherichia coli CFT073
ucaaguaaccuuu

SEQ ID NO: 2610047 - RNA, 22 nt, Escherichia coli CFT073
ucaagucuggguauucagcgau

SEQ ID NO: 2610048 - RNA, 18 nt, Escherichia coli CFT073
ucaaguguggccgccagu

SEQ ID NO: 2610049 - RNA, 16 nt, Escherichia coli CFT073
ucaaguuccguuucca

SEQ ID NO: 2610050 - RNA, 17 nt, Escherichia coli CFT073
ucaauaaacccuucacu

SEQ ID NO: 2610051 - RNA, 19 nt, Escherichia coli CFT073
ucaauaaauugcaggaacu

SEQ ID NO: 2610052 - RNA, 19 nt, Escherichia coli CFT073
ucaauaacaaagggaaacg

SEQ ID NO: 2610053 - RNA, 17 nt, Escherichia coli CFT073
ucaauaacauaccaggu

SEQ ID NO: 2610054 - RNA, 19 nt, Escherichia coli CFT073
ucaauaagcuguucagaua

SEQ ID NO: 2610055 - RNA, 15 nt, Escherichia coli CFT073
ucaauaauaaccaaa

SEQ ID NO: 2610056 - RNA, 20 nt, Escherichia coli CFT073
ucaauaccauagacaaugua

SEQ ID NO: 2610057 - RNA, 19 nt, Escherichia coli CFT073
ucaauacgcaucaccucac

SEQ ID NO: 2610058 - RNA, 14 nt, Escherichia coli CFT073
ucaauacuuuccag

SEQ ID NO: 2610059 - RNA, 19 nt, Escherichia coli CFT073
ucaauagcgugcuuaccuu

SEQ ID NO: 2610060 - RNA, 16 nt, Escherichia coli CFT073
ucaauauccagcaggu

SEQ ID NO: 2610061 - RNA, 17 nt, Escherichia coli CFT073
ucaauaugaauuaacgu

SEQ ID NO: 2610062 - RNA, 15 nt, Escherichia coli CFT073
ucaauaugggcacgc

SEQ ID NO: 2610063 - RNA, 15 nt, Escherichia coli CFT073
ucaauauuaaugcug

SEQ ID NO: 2610064 - RNA, 12 nt, Escherichia coli CFT073
ucaaucaacaua

SEQ ID NO: 2610065 - RNA, 13 nt, Escherichia coli CFT073
ucaaucacacuga

SEQ ID NO: 2610066 - RNA, 15 nt, Escherichia coli CFT073
ucaaucaccgcuuca

SEQ ID NO: 2610067 - RNA, 19 nt, Escherichia coli CFT073
ucaaucacuuucugcgcca

SEQ ID NO: 2610068 - RNA, 14 nt, Escherichia coli CFT073
ucaaucagccccuu

SEQ ID NO: 2610069 - RNA, 20 nt, Escherichia coli CFT073
ucaaucagccccuucgccag

SEQ ID NO: 2610070 - RNA, 22 nt, Escherichia coli CFT073
ucaaucagcgucgcguuuuucu

SEQ ID NO: 2610071 - RNA, 14 nt, Escherichia coli CFT073
ucaaucaggcuauc

SEQ ID NO: 2610072 - RNA, 23 nt, Escherichia coli CFT073
ucaaucaggcuaucgaacaugcg

SEQ ID NO: 2610073 - RNA, 14 nt, Escherichia coli CFT073
ucaaucaguucauu

SEQ ID NO: 2610074 - RNA, 15 nt, Escherichia coli CFT073
ucaaucauugauaau

SEQ ID NO: 2610075 - RNA, 16 nt, Escherichia coli CFT073
ucaaucauugauaaua

SEQ ID NO: 2610076 - RNA, 14 nt, Escherichia coli CFT073
ucaauccugcagca

SEQ ID NO: 2610077 - RNA, 18 nt, Escherichia coli CFT073
ucaaucgaacgcagcaac

SEQ ID NO: 2610078 - RNA, 15 nt, Escherichia coli CFT073
ucaaucgcaaucugg

SEQ ID NO: 2610079 - RNA, 12 nt, Escherichia coli CFT073
ucaaucgccaaa

SEQ ID NO: 2610080 - RNA, 22 nt, Escherichia coli CFT073
ucaaucgccucgccgaaacgcu

SEQ ID NO: 2610081 - RNA, 17 nt, Escherichia coli CFT073
ucaaucggaaaacaacc

SEQ ID NO: 2610082 - RNA, 17 nt, Escherichia coli CFT073
ucaaucugcuccauuaa

SEQ ID NO: 2610083 - RNA, 16 nt, Escherichia coli CFT073
ucaaucuggcugauga

SEQ ID NO: 2610084 - RNA, 19 nt, Escherichia coli CFT073
ucaaucuguccuuccagua

SEQ ID NO: 2610085 - RNA, 13 nt, Escherichia coli CFT073
ucaaucuucucuu

SEQ ID NO: 2610086 - RNA, 21 nt, Escherichia coli CFT073
ucaaucuuuuucaugcuauuc

SEQ ID NO: 2610087 - RNA, 19 nt, Escherichia coli CFT073
ucaaugaaucgcagucucu

SEQ ID NO: 2610088 - RNA, 15 nt, Escherichia coli CFT073
ucaaugaaugcuucg

SEQ ID NO: 2610089 - RNA, 15 nt, Escherichia coli CFT073
ucaaugacgcgaacu

SEQ ID NO: 2610090 - RNA, 12 nt, Escherichia coli CFT073
ucaaugauaaag

SEQ ID NO: 2610091 - RNA, 14 nt, Escherichia coli CFT073
ucaaugauaacguc

SEQ ID NO: 2610092 - RNA, 20 nt, Escherichia coli CFT073
ucaaugauaauucaacagau

SEQ ID NO: 2610093 - RNA, 15 nt, Escherichia coli CFT073
ucaaugaugccgcca

SEQ ID NO: 2610094 - RNA, 12 nt, Escherichia coli CFT073
ucaaugcauauc

SEQ ID NO: 2610095 - RNA, 21 nt, Escherichia coli CFT073
ucaaugcccacugcacagugu

SEQ ID NO: 2610096 - RNA, 22 nt, Escherichia coli CFT073
ucaaugcccacugcacaguguu

SEQ ID NO: 2610097 - RNA, 17 nt, Escherichia coli CFT073
ucaaugccccaccacuc

SEQ ID NO: 2610098 - RNA, 18 nt, Escherichia coli CFT073
ucaaugccggacuguaaa

SEQ ID NO: 2610099 - RNA, 18 nt, Escherichia coli CFT073
ucaaugccgucaccagca

SEQ ID NO: 2610100 - RNA, 16 nt, Escherichia coli CFT073
ucaaugccuuucuuug

SEQ ID NO: 2610101 - RNA, 23 nt, Escherichia coli CFT073
ucaaugcguuguagcuuuuuccu

SEQ ID NO: 2610102 - RNA, 21 nt, Escherichia coli CFT073
ucaaugcugaaagcagcaaga

SEQ ID NO: 2610103 - RNA, 15 nt, Escherichia coli CFT073
ucaauggaugcaucu

SEQ ID NO: 2610104 - RNA, 17 nt, Escherichia coli CFT073
ucaauggcagcaucacg

SEQ ID NO: 2610105 - RNA, 16 nt, Escherichia coli CFT073
ucaccagcaaaacggu

SEQ ID NO: 2610106 - RNA, 17 nt, Escherichia coli CFT073
ucaccagcaucagcgau

SEQ ID NO: 2610107 - RNA, 18 nt, Escherichia coli CFT073
ucaccagguucgccaaca

SEQ ID NO: 2610108 - RNA, 23 nt, Escherichia coli CFT073
ucaccagguucgccaacaacgca

SEQ ID NO: 2610109 - RNA, 12 nt, Escherichia coli CFT073
ucaccaguaccg

SEQ ID NO: 2610110 - RNA, 16 nt, Escherichia coli CFT073
ucaccaguccaucggc

SEQ ID NO: 2610111 - RNA, 15 nt, Escherichia coli CFT073
ucaccagucccugaa

SEQ ID NO: 2610112 - RNA, 21 nt, Escherichia coli CFT073
ucaccaguugugaugccacuu

SEQ ID NO: 2610113 - RNA, 21 nt, Escherichia coli CFT073
ucaccauaaaacgcgcuacug

SEQ ID NO: 2610114 - RNA, 18 nt, Escherichia coli CFT073
ucaccauaaaucagaucg

SEQ ID NO: 2610115 - RNA, 15 nt, Escherichia coli CFT073
ucaccaucagcagca

SEQ ID NO: 2610116 - RNA, 19 nt, Escherichia coli CFT073
ucaccauccugaucgccau

SEQ ID NO: 2610117 - RNA, 13 nt, Escherichia coli CFT073
ucaccaucuucac

SEQ ID NO: 2610118 - RNA, 13 nt, Escherichia coli CFT073
ucacccaacucuc

SEQ ID NO: 2610119 - RNA, 18 nt, Escherichia coli CFT073
ucacccaucgauacccag

SEQ ID NO: 2610120 - RNA, 19 nt, Escherichia coli CFT073
ucacccaucgauacccaga

SEQ ID NO: 2610121 - RNA, 22 nt, Escherichia coli CFT073
ucacccccguuaaccacuucag

SEQ ID NO: 2610122 - RNA, 20 nt, Escherichia coli CFT073
ucaccccgcgcucacaccac

SEQ ID NO: 2610123 - RNA, 23 nt, Escherichia coli CFT073
ucacccgagagaacugcugcauc

SEQ ID NO: 2610124 - RNA, 18 nt, Escherichia coli CFT073
ucacccgauaaauaauaa

SEQ ID NO: 2610125 - RNA, 19 nt, Escherichia coli CFT073
ucacccgcauaugcggcgc

SEQ ID NO: 2610126 - RNA, 12 nt, Escherichia coli CFT073
ucacccgccagc

SEQ ID NO: 2610127 - RNA, 22 nt, Escherichia coli CFT073
ucacccgcgccuaaauuuuucc

SEQ ID NO: 2610128 - RNA, 19 nt, Escherichia coli CFT073
ucacccgcguuacgccauc

SEQ ID NO: 2610129 - RNA, 19 nt, Escherichia coli CFT073
ucacccggaucaauuaauc

SEQ ID NO: 2610130 - RNA, 18 nt, Escherichia coli CFT073
ucacccgguacaucaaua

SEQ ID NO: 2610131 - RNA, 12 nt, Escherichia coli CFT073
ucaccgaugaca

SEQ ID NO: 2610132 - RNA, 19 nt, Escherichia coli CFT073
ucaccgaugacagaaucag

SEQ ID NO: 2610133 - RNA, 19 nt, Escherichia coli CFT073
ucaccgaugcacagaaccg

SEQ ID NO: 2610134 - RNA, 18 nt, Escherichia coli CFT073
ucaccgauuuugccuuca

SEQ ID NO: 2610135 - RNA, 18 nt, Escherichia coli CFT073
ucaccgcaaagucggcac

SEQ ID NO: 2610136 - RNA, 20 nt, Escherichia coli CFT073
ucaccgcaaagucggcacca

SEQ ID NO: 2610137 - RNA, 12 nt, Escherichia coli CFT073
ucaccgccgccu

SEQ ID NO: 2610138 - RNA, 15 nt, Escherichia coli CFT073
ucaccgccuccaccu

SEQ ID NO: 2610139 - RNA, 14 nt, Escherichia coli CFT073
ucaccgccuuacca

SEQ ID NO: 2610140 - RNA, 20 nt, Escherichia coli CFT073
ucaccgcuuuuuucaucucu

SEQ ID NO: 2610141 - RNA, 15 nt, Escherichia coli CFT073
ucaccggaacuuuca

SEQ ID NO: 2610142 - RNA, 17 nt, Escherichia coli CFT073
ucaccggagcugccagc

SEQ ID NO: 2610143 - RNA, 15 nt, Escherichia coli CFT073
ucaccggcaaaacca

SEQ ID NO: 2610144 - RNA, 22 nt, Escherichia coli CFT073
ucaccggcauuuuuuagcgcca

SEQ ID NO: 2610145 - RNA, 13 nt, Escherichia coli CFT073
ucaccggucagac

SEQ ID NO: 2610146 - RNA, 20 nt, Escherichia coli CFT073
ucaccgguccccggaugagu

SEQ ID NO: 2610147 - RNA, 18 nt, Escherichia coli CFT073
ucaccgguguucccgucc

SEQ ID NO: 2610148 - RNA, 21 nt, Escherichia coli CFT073
ucaccgguucaucacgaaaau

SEQ ID NO: 2610149 - RNA, 18 nt, Escherichia coli CFT073
ucaccguaaccaccagca

SEQ ID NO: 2610150 - RNA, 16 nt, Escherichia coli CFT073
ucaccgugauccccac

SEQ ID NO: 2610151 - RNA, 18 nt, Escherichia coli CFT073
ucaccguucagcuugcgu

SEQ ID NO: 2610152 - RNA, 20 nt, Escherichia coli CFT073
ucaccguuuaauaacagcug

SEQ ID NO: 2610153 - RNA, 20 nt, Escherichia coli CFT073
ucaccuacagccacaccuuc

SEQ ID NO: 2610154 - RNA, 13 nt, Escherichia coli CFT073
ucaccuacaugac

SEQ ID NO: 2610155 - RNA, 19 nt, Escherichia coli CFT073
ucaccucuccgggcggcgu

SEQ ID NO: 2610156 - RNA, 12 nt, Escherichia coli CFT073
ucaccucugcaa

SEQ ID NO: 2610157 - RNA, 14 nt, Escherichia coli CFT073
ucaccucugucgau

SEQ ID NO: 2610158 - RNA, 15 nt, Escherichia coli CFT073
ucaccucuucaccgu

SEQ ID NO: 2610159 - RNA, 19 nt, Escherichia coli CFT073
ucaccucuucauuaaacca

SEQ ID NO: 2610160 - RNA, 14 nt, Escherichia coli CFT073
ucaccucuuuguac

SEQ ID NO: 2610161 - RNA, 16 nt, Escherichia coli CFT073
ucaccugacagcagag

SEQ ID NO: 2610162 - RNA, 18 nt, Escherichia coli CFT073
ucaccugauuaccuacca

SEQ ID NO: 2610163 - RNA, 15 nt, Escherichia coli CFT073
ucaccugcccuccgg

SEQ ID NO: 2610164 - RNA, 20 nt, Escherichia coli CFT073
ucaccugccugcagcugcuc

SEQ ID NO: 2610165 - RNA, 17 nt, Escherichia coli CFT073
ucaccugcggugcagcc

SEQ ID NO: 2610166 - RNA, 18 nt, Escherichia coli CFT073
ucaccugguagcggguga

SEQ ID NO: 2610167 - RNA, 21 nt, Escherichia coli CFT073
ucaccuuacaucaaaaaaaau

SEQ ID NO: 2610168 - RNA, 15 nt, Escherichia coli CFT073
ucaccuucaaaauuu

SEQ ID NO: 2610169 - RNA, 16 nt, Escherichia coli CFT073
ucaccuugagggauuc

SEQ ID NO: 2610170 - RNA, 16 nt, Escherichia coli CFT073
ucaccuuguaugacaa

SEQ ID NO: 2610171 - RNA, 15 nt, Escherichia coli CFT073
ucaccuuucgguuca

SEQ ID NO: 2610172 - RNA, 23 nt, Escherichia coli CFT073
ucaccuuuuaccguacugccguc

SEQ ID NO: 2610173 - RNA, 23 nt, Escherichia coli CFT073
ucaccuuuuguugcuuuggcuuu

SEQ ID NO: 2610174 - RNA, 22 nt, Escherichia coli CFT073
ucacgaacguuccccggaaaau

SEQ ID NO: 2610175 - RNA, 14 nt, Escherichia coli CFT073
ucacgaaucgccuc

SEQ ID NO: 2610176 - RNA, 22 nt, Escherichia coli CFT073
ucacgacaaagacgucaaaccc

SEQ ID NO: 2610177 - RNA, 19 nt, Escherichia coli CFT073
ucacgacaaaugcgccgcc

SEQ ID NO: 2610178 - RNA, 20 nt, Escherichia coli CFT073
ucacgacaaaugcgccgcca

SEQ ID NO: 2610179 - RNA, 22 nt, Escherichia coli CFT073
ucacgacaaaugcgccgccaaa

SEQ ID NO: 2610180 - RNA, 14 nt, Escherichia coli CFT073
ucacgacacauaaa

SEQ ID NO: 2610181 - RNA, 22 nt, Escherichia coli CFT073
ucacgacagcaccacuggcgau

SEQ ID NO: 2610182 - RNA, 16 nt, Escherichia coli CFT073
ucacgaccaucaaccu

SEQ ID NO: 2610183 - RNA, 18 nt, Escherichia coli CFT073
ucacgaccaucaaccuuc

SEQ ID NO: 2610184 - RNA, 20 nt, Escherichia coli CFT073
ucacgagagcgggaaaacau

SEQ ID NO: 2610185 - RNA, 20 nt, Escherichia coli CFT073
ucacgaugcaaauuuuuaau

SEQ ID NO: 2610186 - RNA, 15 nt, Escherichia coli CFT073
ucacgauggcgggcc

SEQ ID NO: 2610187 - RNA, 14 nt, Escherichia coli CFT073
ucacgauuauuaag

SEQ ID NO: 2610188 - RNA, 16 nt, Escherichia coli CFT073
ucacgauuguuaauca

SEQ ID NO: 2610189 - RNA, 22 nt, Escherichia coli CFT073
ucacgauuugcguaaaaccugc

SEQ ID NO: 2610190 - RNA, 20 nt, Escherichia coli CFT073
ucacgcaccaacuccucuuu

SEQ ID NO: 2610191 - RNA, 15 nt, Escherichia coli CFT073
ucacgcaccauaaua

SEQ ID NO: 2610192 - RNA, 19 nt, Escherichia coli CFT073
ucacgcacucgacgcagca

SEQ ID NO: 2610193 - RNA, 16 nt, Escherichia coli CFT073
ucacgcagagcaucau

SEQ ID NO: 2610194 - RNA, 17 nt, Escherichia coli CFT073
ucacgcagauacuggaa

SEQ ID NO: 2610195 - RNA, 19 nt, Escherichia coli CFT073
ucacgcagauacuggaaaa

SEQ ID NO: 2610196 - RNA, 21 nt, Escherichia coli CFT073
ucacgcagcggaccgcuuugc

SEQ ID NO: 2610197 - RNA, 17 nt, Escherichia coli CFT073
ucacgcagcggcggcac

SEQ ID NO: 2610198 - RNA, 20 nt, Escherichia coli CFT073
ucacgcagcgugaagcuacc

SEQ ID NO: 2610199 - RNA, 16 nt, Escherichia coli CFT073
ucacgcagcucacgca

SEQ ID NO: 2610200 - RNA, 22 nt, Escherichia coli CFT073
ucacgcagguuggaauaaacaa

SEQ ID NO: 2610201 - RNA, 16 nt, Escherichia coli CFT073
ucacgcagugucagca

SEQ ID NO: 2610202 - RNA, 13 nt, Escherichia coli CFT073
ucacgcaguuuau

SEQ ID NO: 2610203 - RNA, 19 nt, Escherichia coli CFT073
ucacgcaguuuauccaucu

SEQ ID NO: 2610204 - RNA, 16 nt, Escherichia coli CFT073
ucacgcaguuucgcgu

SEQ ID NO: 2610205 - RNA, 13 nt, Escherichia coli CFT073
ucacgccaaccag

SEQ ID NO: 2610206 - RNA, 15 nt, Escherichia coli CFT073
ucacgccaauaaucg

SEQ ID NO: 2610207 - RNA, 17 nt, Escherichia coli CFT073
ucacgccaauaaucgau

SEQ ID NO: 2610208 - RNA, 21 nt, Escherichia coli CFT073
ucacgccacgcggcggcguag

SEQ ID NO: 2610209 - RNA, 12 nt, Escherichia coli CFT073
ucacgccaggca

SEQ ID NO: 2610210 - RNA, 18 nt, Escherichia coli CFT073
ucacgccaucauccugau

SEQ ID NO: 2610211 - RNA, 14 nt, Escherichia coli CFT073
ucacgcccgccaga

SEQ ID NO: 2610212 - RNA, 15 nt, Escherichia coli CFT073
ucacgcccgccccag

SEQ ID NO: 2610213 - RNA, 18 nt, Escherichia coli CFT073
ucagaaugagguucagcc

SEQ ID NO: 2610214 - RNA, 18 nt, Escherichia coli CFT073
ucagaaugcgcucuuccg

SEQ ID NO: 2610215 - RNA, 16 nt, Escherichia coli CFT073
ucagacaccggcgcac

SEQ ID NO: 2610216 - RNA, 21 nt, Escherichia coli CFT073
ucagacaccggcgcacaaccg

SEQ ID NO: 2610217 - RNA, 19 nt, Escherichia coli CFT073
ucagacacgccgccagacc

SEQ ID NO: 2610218 - RNA, 15 nt, Escherichia coli CFT073
ucagacaggcgaaac

SEQ ID NO: 2610219 - RNA, 20 nt, Escherichia coli CFT073
ucagacaggcgaaaccagca

SEQ ID NO: 2610220 - RNA, 23 nt, Escherichia coli CFT073
ucagacaggcgaaaccagcagcc

SEQ ID NO: 2610221 - RNA, 14 nt, Escherichia coli CFT073
ucagacauuaagca

SEQ ID NO: 2610222 - RNA, 14 nt, Escherichia coli CFT073
ucagacccacccaa

SEQ ID NO: 2610223 - RNA, 18 nt, Escherichia coli CFT073
ucagacccacccaacaug

SEQ ID NO: 2610224 - RNA, 14 nt, Escherichia coli CFT073
ucagacccagaacc

SEQ ID NO: 2610225 - RNA, 18 nt, Escherichia coli CFT073
ucagaccgccaaucagca

SEQ ID NO: 2610226 - RNA, 18 nt, Escherichia coli CFT073
ucagaccggcaaccagca

SEQ ID NO: 2610227 - RNA, 20 nt, Escherichia coli CFT073
ucagaccgugcgagaacgac

SEQ ID NO: 2610228 - RNA, 21 nt, Escherichia coli CFT073
ucagaccuccguuuuucuguu

SEQ ID NO: 2610229 - RNA, 16 nt, Escherichia coli CFT073
ucagaccuguugccca

SEQ ID NO: 2610230 - RNA, 21 nt, Escherichia coli CFT073
ucagacgacccacgauaacgu

SEQ ID NO: 2610231 - RNA, 13 nt, Escherichia coli CFT073
ucagacgccacuu

SEQ ID NO: 2610232 - RNA, 12 nt, Escherichia coli CFT073
ucagacgcugca

SEQ ID NO: 2610233 - RNA, 14 nt, Escherichia coli CFT073
ucagacggcuguua

SEQ ID NO: 2610234 - RNA, 14 nt, Escherichia coli CFT073
ucagacgggccaug

SEQ ID NO: 2610235 - RNA, 13 nt, Escherichia coli CFT073
ucagacguucuuc

SEQ ID NO: 2610236 - RNA, 22 nt, Escherichia coli CFT073
ucagacguuuguaacccaccau

SEQ ID NO: 2610237 - RNA, 17 nt, Escherichia coli CFT073
ucagacucgaaggaaua

SEQ ID NO: 2610238 - RNA, 13 nt, Escherichia coli CFT073
ucagacugagauc

SEQ ID NO: 2610239 - RNA, 16 nt, Escherichia coli CFT073
ucagacugcuuuuccc

SEQ ID NO: 2610240 - RNA, 17 nt, Escherichia coli CFT073
ucagacuuugcgccauc

SEQ ID NO: 2610241 - RNA, 14 nt, Escherichia coli CFT073
ucagagaagcaccg

SEQ ID NO: 2610242 - RNA, 13 nt, Escherichia coli CFT073
ucagagagccagc

SEQ ID NO: 2610243 - RNA, 14 nt, Escherichia coli CFT073
ucagagagccagcc

SEQ ID NO: 2610244 - RNA, 13 nt, Escherichia coli CFT073
ucagagauuaagu

SEQ ID NO: 2610245 - RNA, 22 nt, Escherichia coli CFT073
ucagagccgcgguauccggcuc

SEQ ID NO: 2610246 - RNA, 19 nt, Escherichia coli CFT073
ucagagcggccuucuucuu

SEQ ID NO: 2610247 - RNA, 23 nt, Escherichia coli CFT073
ucagagcggccuucuucuuucag

SEQ ID NO: 2610248 - RNA, 12 nt, Escherichia coli CFT073
ucagagugccca

SEQ ID NO: 2610249 - RNA, 13 nt, Escherichia coli CFT073
ucagagugcccac

SEQ ID NO: 2610250 - RNA, 17 nt, Escherichia coli CFT073
ucagaguugcaccagca

SEQ ID NO: 2610251 - RNA, 17 nt, Escherichia coli CFT073
ucagaguuguaccaccc

SEQ ID NO: 2610252 - RNA, 13 nt, Escherichia coli CFT073
ucagaguuugcca

SEQ ID NO: 2610253 - RNA, 22 nt, Escherichia coli CFT073
ucagaguuugccaccaacagua

SEQ ID NO: 2610254 - RNA, 13 nt, Escherichia coli CFT073
ucagauaaaugca

SEQ ID NO: 2610255 - RNA, 20 nt, Escherichia coli CFT073
ucagauaaaugcaaacgcau

SEQ ID NO: 2610256 - RNA, 18 nt, Escherichia coli CFT073
ucagauaauagguaaaca

SEQ ID NO: 2610257 - RNA, 21 nt, Escherichia coli CFT073
ucagauaccaauuuauuuuau

SEQ ID NO: 2610258 - RNA, 13 nt, Escherichia coli CFT073
ucagauaugcgcu

SEQ ID NO: 2610259 - RNA, 22 nt, Escherichia coli CFT073
ucagauaugcgcugucauucau

SEQ ID NO: 2610260 - RNA, 21 nt, Escherichia coli CFT073
ucagaucagccacuuccugcu

SEQ ID NO: 2610261 - RNA, 16 nt, Escherichia coli CFT073
ucagauccagugcuuu

SEQ ID NO: 2610262 - RNA, 18 nt, Escherichia coli CFT073
ucagauccgcacccgcac

SEQ ID NO: 2610263 - RNA, 17 nt, Escherichia coli CFT073
ucagaucguucgcacca

SEQ ID NO: 2610264 - RNA, 16 nt, Escherichia coli CFT073
ucagaucguugaccug

SEQ ID NO: 2610265 - RNA, 22 nt, Escherichia coli CFT073
ucagaugaacgugucaacgcuu

SEQ ID NO: 2610266 - RNA, 22 nt, Escherichia coli CFT073
ucagaugaccaauaacccguug

SEQ ID NO: 2610267 - RNA, 16 nt, Escherichia coli CFT073
ucagauggcggcuggc

SEQ ID NO: 2610268 - RNA, 19 nt, Escherichia coli CFT073
ucagauggcggcuggcgca

SEQ ID NO: 2610269 - RNA, 20 nt, Escherichia coli CFT073
ucagauuagaacugauaaac

SEQ ID NO: 2610270 - RNA, 21 nt, Escherichia coli CFT073
ucagauucagcgucgccagca

SEQ ID NO: 2610271 - RNA, 19 nt, Escherichia coli CFT073
ucagauucggauccagcac

SEQ ID NO: 2610272 - RNA, 20 nt, Escherichia coli CFT073
ucagauugcaccacaucggu

SEQ ID NO: 2610273 - RNA, 21 nt, Escherichia coli CFT073
ucagauugcugacaacgugcg

SEQ ID NO: 2610274 - RNA, 18 nt, Escherichia coli CFT073
ucagauuggcuucacuga

SEQ ID NO: 2610275 - RNA, 20 nt, Escherichia coli CFT073
ucagauuggcuucacugauu

SEQ ID NO: 2610276 - RNA, 23 nt, Escherichia coli CFT073
ucagauuguagugauccugcaua

SEQ ID NO: 2610277 - RNA, 22 nt, Escherichia coli CFT073
ucagcaaaguaccaucguccag

SEQ ID NO: 2610278 - RNA, 19 nt, Escherichia coli CFT073
ucagcaaauaauucaucuu

SEQ ID NO: 2610279 - RNA, 22 nt, Escherichia coli CFT073
ucagcaaauaauucaucuuuca

SEQ ID NO: 2610280 - RNA, 17 nt, Escherichia coli CFT073
ucagcaaauagauaaac

SEQ ID NO: 2610281 - RNA, 16 nt, Escherichia coli CFT073
ucagcaacagguaacc

SEQ ID NO: 2610282 - RNA, 18 nt, Escherichia coli CFT073
ucagcaacagguaaccca

SEQ ID NO: 2610283 - RNA, 13 nt, Escherichia coli CFT073
ucagcaacaucac

SEQ ID NO: 2610284 - RNA, 21 nt, Escherichia coli CFT073
ucagcaaggaagcugauuuua

SEQ ID NO: 2610285 - RNA, 12 nt, Escherichia coli CFT073
ucagcaaggcuu

SEQ ID NO: 2610286 - RNA, 16 nt, Escherichia coli CFT073
ucagcaaucucuucaa

SEQ ID NO: 2610287 - RNA, 22 nt, Escherichia coli CFT073
ucagcaaugguucgugcaacuu

SEQ ID NO: 2610288 - RNA, 12 nt, Escherichia coli CFT073
ucagcaauuucu

SEQ ID NO: 2610289 - RNA, 19 nt, Escherichia coli CFT073
ucagcaauuuuaauaucca

SEQ ID NO: 2610290 - RNA, 14 nt, Escherichia coli CFT073
ucagcacacauaac

SEQ ID NO: 2610291 - RNA, 16 nt, Escherichia coli CFT073
ucagcacagagauaaa

SEQ ID NO: 2610292 - RNA, 20 nt, Escherichia coli CFT073
ucagcacagagauaaaaggc

SEQ ID NO: 2610293 - RNA, 17 nt, Escherichia coli CFT073
ucagcaccagacgcaac

SEQ ID NO: 2610294 - RNA, 22 nt, Escherichia coli CFT073
ucagcaccgaaguuaugccagu

SEQ ID NO: 2610295 - RNA, 17 nt, Escherichia coli CFT073
ucagcaccugcaucacg

SEQ ID NO: 2610296 - RNA, 19 nt, Escherichia coli CFT073
ucagcacgacauaagcgca

SEQ ID NO: 2610297 - RNA, 21 nt, Escherichia coli CFT073
ucagcacgacauaagcgcaug

SEQ ID NO: 2610298 - RNA, 18 nt, Escherichia coli CFT073
ucagcacguuaaguucau

SEQ ID NO: 2610299 - RNA, 19 nt, Escherichia coli CFT073
ucagcacguuaaguucauu

SEQ ID NO: 2610300 - RNA, 18 nt, Escherichia coli CFT073
ucagcacuacugccagau

SEQ ID NO: 2610301 - RNA, 22 nt, Escherichia coli CFT073
ucagcacuucacccaucgccag

SEQ ID NO: 2610302 - RNA, 14 nt, Escherichia coli CFT073
ucagcagauaccaa

SEQ ID NO: 2610303 - RNA, 18 nt, Escherichia coli CFT073
ucagcagauaccaacccu

SEQ ID NO: 2610304 - RNA, 14 nt, Escherichia coli CFT073
ucagcagcaccacc

SEQ ID NO: 2610305 - RNA, 22 nt, Escherichia coli CFT073
ucagcagcccggcaaccacgcg

SEQ ID NO: 2610306 - RNA, 20 nt, Escherichia coli CFT073
ucagcagugaaguaauaauc

SEQ ID NO: 2610307 - RNA, 14 nt, Escherichia coli CFT073
ucagcaguucagca

SEQ ID NO: 2610308 - RNA, 20 nt, Escherichia coli CFT073
ucagcaguucagucagcagu

SEQ ID NO: 2610309 - RNA, 12 nt, Escherichia coli CFT073
ucagcaguucgu

SEQ ID NO: 2610310 - RNA, 14 nt, Escherichia coli CFT073
ucagcaguucugcc

SEQ ID NO: 2610311 - RNA, 20 nt, Escherichia coli CFT073
ucagcaguuuuaccgaugcg

SEQ ID NO: 2610312 - RNA, 18 nt, Escherichia coli CFT073
ucagcauaaucaccagua

SEQ ID NO: 2610313 - RNA, 14 nt, Escherichia coli CFT073
ucagcauacgccac

SEQ ID NO: 2610314 - RNA, 14 nt, Escherichia coli CFT073
ucagcauacuccag

SEQ ID NO: 2610315 - RNA, 15 nt, Escherichia coli CFT073
ucagcaucaaugacc

SEQ ID NO: 2610316 - RNA, 19 nt, Escherichia coli CFT073
ucagcauccauaucgccau

SEQ ID NO: 2610317 - RNA, 22 nt, Escherichia coli CFT073
ucagcaucccaccugaaauggu

SEQ ID NO: 2610318 - RNA, 16 nt, Escherichia coli CFT073
ucagcaucccaggcau

SEQ ID NO: 2610319 - RNA, 15 nt, Escherichia coli CFT073
ucagcaugacaaaaa

SEQ ID NO: 2610320 - RNA, 17 nt, Escherichia coli CFT073
ucagcaugacaaaaaag

SEQ ID NO: 2610321 - RNA, 15 nt, Escherichia coli CFT073
ucaggccggaauaac

SEQ ID NO: 2610322 - RNA, 13 nt, Escherichia coli CFT073
ucaggccuacaua

SEQ ID NO: 2610323 - RNA, 22 nt, Escherichia coli CFT073
ucaggccugugaaggggcgcaa

SEQ ID NO: 2610324 - RNA, 18 nt, Escherichia coli CFT073
ucaggcgagugguaugac

SEQ ID NO: 2610325 - RNA, 23 nt, Escherichia coli CFT073
ucaggcgagugguaugacuuaaa

SEQ ID NO: 2610326 - RNA, 19 nt, Escherichia coli CFT073
ucaggcgcgugaaugccug

SEQ ID NO: 2610327 - RNA, 14 nt, Escherichia coli CFT073
ucaggcguuucuuc

SEQ ID NO: 2610328 - RNA, 20 nt, Escherichia coli CFT073
ucaggcugaggcguuucaac

SEQ ID NO: 2610329 - RNA, 21 nt, Escherichia coli CFT073
ucaggcuuuauucugacgcca

SEQ ID NO: 2610330 - RNA, 20 nt, Escherichia coli CFT073
ucagggagcggaauugcgca

SEQ ID NO: 2610331 - RNA, 17 nt, Escherichia coli CFT073
ucagggcgaacuuccau

SEQ ID NO: 2610332 - RNA, 19 nt, Escherichia coli CFT073
ucagggcgcacgcacggcg

SEQ ID NO: 2610333 - RNA, 15 nt, Escherichia coli CFT073
ucagggcggcuaucc

SEQ ID NO: 2610334 - RNA, 13 nt, Escherichia coli CFT073
ucaggggagugag

SEQ ID NO: 2610335 - RNA, 16 nt, Escherichia coli CFT073
ucaggggcauuuucca

SEQ ID NO: 2610336 - RNA, 18 nt, Escherichia coli CFT073
ucaggggcauuuuccagu

SEQ ID NO: 2610337 - RNA, 18 nt, Escherichia coli CFT073
ucaggggcuuccagcaaa

SEQ ID NO: 2610338 - RNA, 21 nt, Escherichia coli CFT073
ucaggggcuuccagcaaaucc

SEQ ID NO: 2610339 - RNA, 19 nt, Escherichia coli CFT073
ucagggguaggaaaagucg

SEQ ID NO: 2610340 - RNA, 14 nt, Escherichia coli CFT073
ucagguaacaggga

SEQ ID NO: 2610341 - RNA, 15 nt, Escherichia coli CFT073
ucagguaacagggaa

SEQ ID NO: 2610342 - RNA, 17 nt, Escherichia coli CFT073
ucagguaacagggaacu

SEQ ID NO: 2610343 - RNA, 12 nt, Escherichia coli CFT073
ucagguaauuuu

SEQ ID NO: 2610344 - RNA, 19 nt, Escherichia coli CFT073
ucaggucacccaugcgcgc

SEQ ID NO: 2610345 - RNA, 20 nt, Escherichia coli CFT073
ucaggucacccaugcgcgcc

SEQ ID NO: 2610346 - RNA, 14 nt, Escherichia coli CFT073
ucaggucguucagu

SEQ ID NO: 2610347 - RNA, 19 nt, Escherichia coli CFT073
ucagguggccaaauucagu

SEQ ID NO: 2610348 - RNA, 13 nt, Escherichia coli CFT073
ucagguggcggua

SEQ ID NO: 2610349 - RNA, 20 nt, Escherichia coli CFT073
ucagguggcgguauuugaua

SEQ ID NO: 2610350 - RNA, 17 nt, Escherichia coli CFT073
ucagguguuacgccgca

SEQ ID NO: 2610351 - RNA, 21 nt, Escherichia coli CFT073
ucagguuacgcccuuccccca

SEQ ID NO: 2610352 - RNA, 20 nt, Escherichia coli CFT073
ucagguucugaccagccagc

SEQ ID NO: 2610353 - RNA, 18 nt, Escherichia coli CFT073
ucagguuuuucagcugcc

SEQ ID NO: 2610354 - RNA, 20 nt, Escherichia coli CFT073
ucagguuuuucagcugccca

SEQ ID NO: 2610355 - RNA, 19 nt, Escherichia coli CFT073
ucaguaaugaucugaucaa

SEQ ID NO: 2610356 - RNA, 18 nt, Escherichia coli CFT073
ucaguacccgcguucugg

SEQ ID NO: 2610357 - RNA, 17 nt, Escherichia coli CFT073
ucaguacggcaaagaua

SEQ ID NO: 2610358 - RNA, 19 nt, Escherichia coli CFT073
ucaguacggcaaagauauu

SEQ ID NO: 2610359 - RNA, 19 nt, Escherichia coli CFT073
ucaguagcaguaauuuaua

SEQ ID NO: 2610360 - RNA, 20 nt, Escherichia coli CFT073
ucaguauauugcagaaaucc

SEQ ID NO: 2610361 - RNA, 13 nt, Escherichia coli CFT073
ucaguaugcaguc

SEQ ID NO: 2610362 - RNA, 15 nt, Escherichia coli CFT073
ucaguauugagcaac

SEQ ID NO: 2610363 - RNA, 13 nt, Escherichia coli CFT073
ucagucacagggg

SEQ ID NO: 2610364 - RNA, 20 nt, Escherichia coli CFT073
ucagucauaacguucagcac

SEQ ID NO: 2610365 - RNA, 14 nt, Escherichia coli CFT073
ucaguccacaucuc

SEQ ID NO: 2610366 - RNA, 22 nt, Escherichia coli CFT073
ucagucccugaaucgccacgcc

SEQ ID NO: 2610367 - RNA, 16 nt, Escherichia coli CFT073
ucagucgcaucuucac

SEQ ID NO: 2610368 - RNA, 16 nt, Escherichia coli CFT073
ucagucuuaagcggcu

SEQ ID NO: 2610369 - RNA, 17 nt, Escherichia coli CFT073
ucagugaccagcggcag

SEQ ID NO: 2610370 - RNA, 19 nt, Escherichia coli CFT073
ucagugacugcuuuuucaa

SEQ ID NO: 2610371 - RNA, 20 nt, Escherichia coli CFT073
ucagugagcugucugucaaa

SEQ ID NO: 2610372 - RNA, 20 nt, Escherichia coli CFT073
ucagugauaucgcucugguu

SEQ ID NO: 2610373 - RNA, 18 nt, Escherichia coli CFT073
ucagugcaaucagcggcg

SEQ ID NO: 2610374 - RNA, 15 nt, Escherichia coli CFT073
ucaguucaaauucau

SEQ ID NO: 2610375 - RNA, 12 nt, Escherichia coli CFT073
ucaguucaacgg

SEQ ID NO: 2610376 - RNA, 17 nt, Escherichia coli CFT073
ucaguucacacaaggua

SEQ ID NO: 2610377 - RNA, 14 nt, Escherichia coli CFT073
ucaguuccaguuca

SEQ ID NO: 2610378 - RNA, 18 nt, Escherichia coli CFT073
ucaguuccgggaucacca

SEQ ID NO: 2610379 - RNA, 21 nt, Escherichia coli CFT073
ucaguuccugaucgauaaauu

SEQ ID NO: 2610380 - RNA, 19 nt, Escherichia coli CFT073
ucaguucgucacaguuaac

SEQ ID NO: 2610381 - RNA, 14 nt, Escherichia coli CFT073
ucaguugauuauga

SEQ ID NO: 2610382 - RNA, 14 nt, Escherichia coli CFT073
ucaguuggcagcaa

SEQ ID NO: 2610383 - RNA, 23 nt, Escherichia coli CFT073
ucaguugguagagcacgaccuug

SEQ ID NO: 2610384 - RNA, 21 nt, Escherichia coli CFT073
ucaguugguuagagcacauca

SEQ ID NO: 2610385 - RNA, 23 nt, Escherichia coli CFT073
ucaguuguaugucauaaaaauga

SEQ ID NO: 2610386 - RNA, 17 nt, Escherichia coli CFT073
ucaguuuaaccgggaga

SEQ ID NO: 2610387 - RNA, 18 nt, Escherichia coli CFT073
ucaguuuauagaacggca

SEQ ID NO: 2610388 - RNA, 22 nt, Escherichia coli CFT073
ucaguuucgcauccagagauuu

SEQ ID NO: 2610389 - RNA, 20 nt, Escherichia coli CFT073
ucaguuugccgcucaguucc

SEQ ID NO: 2610390 - RNA, 22 nt, Escherichia coli CFT073
ucaguuuuuguugauaaacaaa

SEQ ID NO: 2610391 - RNA, 18 nt, Escherichia coli CFT073
ucauaaaaauauauuccu

SEQ ID NO: 2610392 - RNA, 18 nt, Escherichia coli CFT073
ucauaaaaaucaaaugcu

SEQ ID NO: 2610393 - RNA, 19 nt, Escherichia coli CFT073
ucauaaaccagcggcacgc

SEQ ID NO: 2610394 - RNA, 23 nt, Escherichia coli CFT073
ucauaaauacagagcacgcaagg

SEQ ID NO: 2610395 - RNA, 19 nt, Escherichia coli CFT073
ucauaaauuaccaccagcg

SEQ ID NO: 2610396 - RNA, 20 nt, Escherichia coli CFT073
ucauaaauuaccaccagcga

SEQ ID NO: 2610397 - RNA, 22 nt, Escherichia coli CFT073
ucauaacucuccuguuuaauau

SEQ ID NO: 2610398 - RNA, 14 nt, Escherichia coli CFT073
ucauaagcgauacc

SEQ ID NO: 2610399 - RNA, 13 nt, Escherichia coli CFT073
ucauaauaguagg

SEQ ID NO: 2610400 - RNA, 21 nt, Escherichia coli CFT073
ucauaaucauuaacggccacg

SEQ ID NO: 2610401 - RNA, 14 nt, Escherichia coli CFT073
ucauaauccggcaa

SEQ ID NO: 2610402 - RNA, 17 nt, Escherichia coli CFT073
ucauaaugcccagcguu

SEQ ID NO: 2610403 - RNA, 13 nt, Escherichia coli CFT073
ucauaaugggcgc

SEQ ID NO: 2610404 - RNA, 18 nt, Escherichia coli CFT073
ucauaaugggcgcgggca

SEQ ID NO: 2610405 - RNA, 16 nt, Escherichia coli CFT073
ucauacaaucgguaac

SEQ ID NO: 2610406 - RNA, 16 nt, Escherichia coli CFT073
ucauacacgccgccua

SEQ ID NO: 2610407 - RNA, 21 nt, Escherichia coli CFT073
ucauacagaugcugcucuuca

SEQ ID NO: 2610408 - RNA, 20 nt, Escherichia coli CFT073
ucauacaggcggaaacguaa

SEQ ID NO: 2610409 - RNA, 19 nt, Escherichia coli CFT073
ucauacuccagucgcugcu

SEQ ID NO: 2610410 - RNA, 13 nt, Escherichia coli CFT073
ucauacugaacuu

SEQ ID NO: 2610411 - RNA, 17 nt, Escherichia coli CFT073
ucauacugauuguacug

SEQ ID NO: 2610412 - RNA, 24 nt, Escherichia coli CFT073
ucauacugccgaccaucuguucug

SEQ ID NO: 2610413 - RNA, 13 nt, Escherichia coli CFT073
ucauagaauaaag

SEQ ID NO: 2610414 - RNA, 16 nt, Escherichia coli CFT073
ucauagagcgcaucca

SEQ ID NO: 2610415 - RNA, 22 nt, Escherichia coli CFT073
ucauagauuaauuucccaccac

SEQ ID NO: 2610416 - RNA, 15 nt, Escherichia coli CFT073
ucauagcaaauuccu

SEQ ID NO: 2610417 - RNA, 16 nt, Escherichia coli CFT073
ucauaggcuuccacuu

SEQ ID NO: 2610418 - RNA, 17 nt, Escherichia coli CFT073
ucauagguaaacaucac

SEQ ID NO: 2610419 - RNA, 22 nt, Escherichia coli CFT073
ucauaguaaguguuguauuaua

SEQ ID NO: 2610420 - RNA, 13 nt, Escherichia coli CFT073
ucauaucaccguu

SEQ ID NO: 2610421 - RNA, 12 nt, Escherichia coli CFT073
ucauauccagca

SEQ ID NO: 2610422 - RNA, 15 nt, Escherichia coli CFT073
ucauauccggcacuu

SEQ ID NO: 2610423 - RNA, 17 nt, Escherichia coli CFT073
ucauauccggcauuuuu

SEQ ID NO: 2610424 - RNA, 23 nt, Escherichia coli CFT073
ucauaucuucaggccaauucacu

SEQ ID NO: 2610425 - RNA, 16 nt, Escherichia coli CFT073
ucauaugauaggcuuc

SEQ ID NO: 2610426 - RNA, 23 nt, Escherichia coli CFT073
ucauaugauaggcuucaaccguu

SEQ ID NO: 2610427 - RNA, 15 nt, Escherichia coli CFT073
ucauaugauucauau

SEQ ID NO: 2610428 - RNA, 21 nt, Escherichia coli CFT073
ucauaugcaaugcaucuauag

SEQ ID NO: 2610429 - RNA, 19 nt, Escherichia coli CFT073
ucaucgucauaaugggcgc

SEQ ID NO: 2610430 - RNA, 14 nt, Escherichia coli CFT073
ucaucgucguuucu

SEQ ID NO: 2610431 - RNA, 22 nt, Escherichia coli CFT073
ucaucguucaucuguaacaggu

SEQ ID NO: 2610432 - RNA, 13 nt, Escherichia coli CFT073
ucaucucaucaau

SEQ ID NO: 2610433 - RNA, 22 nt, Escherichia coli CFT073
ucaucuccaguuucgagaaauu

SEQ ID NO: 2610434 - RNA, 15 nt, Escherichia coli CFT073
ucaucucuucaauau

SEQ ID NO: 2610435 - RNA, 21 nt, Escherichia coli CFT073
ucaucuggcgguaacgcgcuu

SEQ ID NO: 2610436 - RNA, 20 nt, Escherichia coli CFT073
ucaucugguuccuaaauaac

SEQ ID NO: 2610437 - RNA, 16 nt, Escherichia coli CFT073
ucaucuguaagcaauu

SEQ ID NO: 2610438 - RNA, 23 nt, Escherichia coli CFT073
ucaucuguuuuccgucugucaaa

SEQ ID NO: 2610439 - RNA, 15 nt, Escherichia coli CFT073
ucaucuucagucagg

SEQ ID NO: 2610440 - RNA, 16 nt, Escherichia coli CFT073
ucaucuuccacuuugu

SEQ ID NO: 2610441 - RNA, 11 nt, Escherichia coli CFT073
ucaucuuccag

SEQ ID NO: 2610442 - RNA, 17 nt, Escherichia coli CFT073
ucaucuuccaguugccg

SEQ ID NO: 2610443 - RNA, 18 nt, Escherichia coli CFT073
ucaucuuccauucuccgc

SEQ ID NO: 2610444 - RNA, 16 nt, Escherichia coli CFT073
ucaucuuccgggcaac

SEQ ID NO: 2610445 - RNA, 13 nt, Escherichia coli CFT073
ucaucuucuucug

SEQ ID NO: 2610446 - RNA, 16 nt, Escherichia coli CFT073
ucaucuuucaucuguu

SEQ ID NO: 2610447 - RNA, 20 nt, Escherichia coli CFT073
ucaugaagcaacucaccauu

SEQ ID NO: 2610448 - RNA, 14 nt, Escherichia coli CFT073
ucaugaauaaaaaa

SEQ ID NO: 2610449 - RNA, 13 nt, Escherichia coli CFT073
ucaugaccgugau

SEQ ID NO: 2610450 - RNA, 19 nt, Escherichia coli CFT073
ucaugaccuuccagcgcug

SEQ ID NO: 2610451 - RNA, 17 nt, Escherichia coli CFT073
ucaugauacagccgaca

SEQ ID NO: 2610452 - RNA, 24 nt, Escherichia coli CFT073
ucaugaucguggcaauagagacaa

SEQ ID NO: 2610453 - RNA, 16 nt, Escherichia coli CFT073
ucaugaugaugccaaa

SEQ ID NO: 2610454 - RNA, 19 nt, Escherichia coli CFT073
ucaugaugaugccaaaaug

SEQ ID NO: 2610455 - RNA, 16 nt, Escherichia coli CFT073
ucaugaugcuccgcca

SEQ ID NO: 2610456 - RNA, 13 nt, Escherichia coli CFT073
ucaugcagcgcag

SEQ ID NO: 2610457 - RNA, 16 nt, Escherichia coli CFT073
ucaugcaucgguuuug

SEQ ID NO: 2610458 - RNA, 14 nt, Escherichia coli CFT073
ucaugccaaaaaua

SEQ ID NO: 2610459 - RNA, 18 nt, Escherichia coli CFT073
ucaugccaaaaauaaucu

SEQ ID NO: 2610460 - RNA, 17 nt, Escherichia coli CFT073
ucaugcccacgcaaacc

SEQ ID NO: 2610461 - RNA, 17 nt, Escherichia coli CFT073
ucaugccuacgaguucg

SEQ ID NO: 2610462 - RNA, 15 nt, Escherichia coli CFT073
ucaugcgccagguaa

SEQ ID NO: 2610463 - RNA, 21 nt, Escherichia coli CFT073
ucaugcgccagguaacgaaga

SEQ ID NO: 2610464 - RNA, 20 nt, Escherichia coli CFT073
ucaugcgggcgaggggagac

SEQ ID NO: 2610465 - RNA, 16 nt, Escherichia coli CFT073
ucaugcgucaccagca

SEQ ID NO: 2610466 - RNA, 16 nt, Escherichia coli CFT073
ucaugcuauuccuuga

SEQ ID NO: 2610467 - RNA, 17 nt, Escherichia coli CFT073
ucaugcucaagcugacc

SEQ ID NO: 2610468 - RNA, 22 nt, Escherichia coli CFT073
ucaugcugcggcuguccggcac

SEQ ID NO: 2610469 - RNA, 18 nt, Escherichia coli CFT073
ucaugcuggauggcgcaa

SEQ ID NO: 2610470 - RNA, 21 nt, Escherichia coli CFT073
ucaugcuggauggcgcaaugc

SEQ ID NO: 2610471 - RNA, 23 nt, Escherichia coli CFT073
ucauggcauuaauaugcucaaca

SEQ ID NO: 2610472 - RNA, 20 nt, Escherichia coli CFT073
ucauggcgaaaagcuuuaca

SEQ ID NO: 2610473 - RNA, 16 nt, Escherichia coli CFT073
ucaugguguaccgggu

SEQ ID NO: 2610474 - RNA, 20 nt, Escherichia coli CFT073
ucaugguuacgccggugauu

SEQ ID NO: 2610475 - RNA, 15 nt, Escherichia coli CFT073
ucauguaacgcugca

SEQ ID NO: 2610476 - RNA, 22 nt, Escherichia coli CFT073
ucauguagcaaauuucgucgua

SEQ ID NO: 2610477 - RNA, 16 nt, Escherichia coli CFT073
ucauguaguaaugcuu

SEQ ID NO: 2610478 - RNA, 17 nt, Escherichia coli CFT073
ucauguagucggacaaa

SEQ ID NO: 2610479 - RNA, 19 nt, Escherichia coli CFT073
ucauguauauuauccauca

SEQ ID NO: 2610480 - RNA, 17 nt, Escherichia coli CFT073
ucauguauucuggcuaa

SEQ ID NO: 2610481 - RNA, 21 nt, Escherichia coli CFT073
ucaugucgcgcaaaguaaagc

SEQ ID NO: 2610482 - RNA, 17 nt, Escherichia coli CFT073
ucaugucggcagugauu

SEQ ID NO: 2610483 - RNA, 22 nt, Escherichia coli CFT073
ucaugucgguuacuauccugaa

SEQ ID NO: 2610484 - RNA, 18 nt, Escherichia coli CFT073
ucaugucucucagagaau

SEQ ID NO: 2610485 - RNA, 15 nt, Escherichia coli CFT073
ucauguucgguaaac

SEQ ID NO: 2610486 - RNA, 13 nt, Escherichia coli CFT073
ucauguuuauuca

SEQ ID NO: 2610487 - RNA, 17 nt, Escherichia coli CFT073
ucauguuuauucacaua

SEQ ID NO: 2610488 - RNA, 20 nt, Escherichia coli CFT073
ucauguuuauucacauagau

SEQ ID NO: 2610489 - RNA, 14 nt, Escherichia coli CFT073
ucauuaaaccacuu

SEQ ID NO: 2610490 - RNA, 16 nt, Escherichia coli CFT073
ucauuaaagccgccca

SEQ ID NO: 2610491 - RNA, 15 nt, Escherichia coli CFT073
ucauuaagccgaucg

SEQ ID NO: 2610492 - RNA, 22 nt, Escherichia coli CFT073
ucauuaauaaccauuaaauagu

SEQ ID NO: 2610493 - RNA, 16 nt, Escherichia coli CFT073
ucauuaaucaccaguc

SEQ ID NO: 2610494 - RNA, 22 nt, Escherichia coli CFT073
ucauuaauuucaggcugucagu

SEQ ID NO: 2610495 - RNA, 17 nt, Escherichia coli CFT073
ucauuaccacaacaaau

SEQ ID NO: 2610496 - RNA, 20 nt, Escherichia coli CFT073
ucauuaccacaacaaaucgu

SEQ ID NO: 2610497 - RNA, 21 nt, Escherichia coli CFT073
ucauuaccacaacaaaucgua

SEQ ID NO: 2610498 - RNA, 15 nt, Escherichia coli CFT073
ucauuacgccagucg

SEQ ID NO: 2610499 - RNA, 19 nt, Escherichia coli CFT073
ucauuacgccagucgcgau

SEQ ID NO: 2610500 - RNA, 13 nt, Escherichia coli CFT073
ucauuacuuaucu

SEQ ID NO: 2610501 - RNA, 18 nt, Escherichia coli CFT073
ucauuagucacaaaucuc

SEQ ID NO: 2610502 - RNA, 13 nt, Escherichia coli CFT073
ucauuauaucuua

SEQ ID NO: 2610503 - RNA, 23 nt, Escherichia coli CFT073
ucauuaucaauugcuucaauaau

SEQ ID NO: 2610504 - RNA, 13 nt, Escherichia coli CFT073
ucauuaugcugga

SEQ ID NO: 2610505 - RNA, 13 nt, Escherichia coli CFT073
ucauuauuaauau

SEQ ID NO: 2610506 - RNA, 12 nt, Escherichia coli CFT073
ucauuauucccc

SEQ ID NO: 2610507 - RNA, 13 nt, Escherichia coli CFT073
ucauucaccaguu

SEQ ID NO: 2610508 - RNA, 22 nt, Escherichia coli CFT073
ucauucacgccguuaacuucac

SEQ ID NO: 2610509 - RNA, 15 nt, Escherichia coli CFT073
ucauucagaaaaacu

SEQ ID NO: 2610510 - RNA, 19 nt, Escherichia coli CFT073
ucauucagaucguuaauga

SEQ ID NO: 2610511 - RNA, 19 nt, Escherichia coli CFT073
ucauucagauucaaaucca

SEQ ID NO: 2610512 - RNA, 20 nt, Escherichia coli CFT073
ucauucaggccaaagccgcc

SEQ ID NO: 2610513 - RNA, 22 nt, Escherichia coli CFT073
ucauucccuacgcgauaaaaaa

SEQ ID NO: 2610514 - RNA, 15 nt, Escherichia coli CFT073
ucauucgcagcugca

SEQ ID NO: 2610515 - RNA, 22 nt, Escherichia coli CFT073
ucauucgcagcugcaguaccag

SEQ ID NO: 2610516 - RNA, 16 nt, Escherichia coli CFT073
ucauucguccaggauu

SEQ ID NO: 2610517 - RNA, 19 nt, Escherichia coli CFT073
ucauucguccaggauuuuc

SEQ ID NO: 2610518 - RNA, 19 nt, Escherichia coli CFT073
ucauugacaaucgccgcca

SEQ ID NO: 2610519 - RNA, 16 nt, Escherichia coli CFT073
ucauugauaauaacgu

SEQ ID NO: 2610520 - RNA, 17 nt, Escherichia coli CFT073
ucauugauaauauccgu

SEQ ID NO: 2610521 - RNA, 22 nt, Escherichia coli CFT073
ucauugaugcugccaucaucuu

SEQ ID NO: 2610522 - RNA, 17 nt, Escherichia coli CFT073
ucauugauggcaaaauc

SEQ ID NO: 2610523 - RNA, 17 nt, Escherichia coli CFT073
ucauugcaaucuccugu

SEQ ID NO: 2610524 - RNA, 22 nt, Escherichia coli CFT073
ucauugccacgucaucuguaag

SEQ ID NO: 2610525 - RNA, 15 nt, Escherichia coli CFT073
ucauugccgguuggc

SEQ ID NO: 2610526 - RNA, 15 nt, Escherichia coli CFT073
ucauugccugauguu

SEQ ID NO: 2610527 - RNA, 15 nt, Escherichia coli CFT073
ucauugcguuauagc

SEQ ID NO: 2610528 - RNA, 18 nt, Escherichia coli CFT073
ucauugcuauuucccccu

SEQ ID NO: 2610529 - RNA, 17 nt, Escherichia coli CFT073
ucauugcucuuaaucgu

SEQ ID NO: 2610530 - RNA, 23 nt, Escherichia coli CFT073
ucauugcuguuuuacagcugcuc

SEQ ID NO: 2610531 - RNA, 21 nt, Escherichia coli CFT073
ucauuggccggaauaccacuu

SEQ ID NO: 2610532 - RNA, 18 nt, Escherichia coli CFT073
ucauuguaaauugcagua

SEQ ID NO: 2610533 - RNA, 17 nt, Escherichia coli CFT073
ucauuguccgucugaaa

SEQ ID NO: 2610534 - RNA, 16 nt, Escherichia coli CFT073
ucauuguuaucagcaa

SEQ ID NO: 2610535 - RNA, 18 nt, Escherichia coli CFT073
ucauuguugguuaaauaa

SEQ ID NO: 2610536 - RNA, 21 nt, Escherichia coli CFT073
ucauuguugguuaaauaauau

SEQ ID NO: 2610537 - RNA, 16 nt, Escherichia coli CFT073
uccagaccuaaaaauu

SEQ ID NO: 2610538 - RNA, 20 nt, Escherichia coli CFT073
uccagacggagcugccaggc

SEQ ID NO: 2610539 - RNA, 23 nt, Escherichia coli CFT073
uccagacggagcugccaggccgc

SEQ ID NO: 2610540 - RNA, 21 nt, Escherichia coli CFT073
uccagacgggucauaaucaga

SEQ ID NO: 2610541 - RNA, 13 nt, Escherichia coli CFT073
uccagacugcugc

SEQ ID NO: 2610542 - RNA, 20 nt, Escherichia coli CFT073
uccagagagguuuucaacuc

SEQ ID NO: 2610543 - RNA, 23 nt, Escherichia coli CFT073
uccagauaaaacaucucuuccca

SEQ ID NO: 2610544 - RNA, 19 nt, Escherichia coli CFT073
uccagauaacaaucaucaa

SEQ ID NO: 2610545 - RNA, 21 nt, Escherichia coli CFT073
uccagauaacaaucaucaacc

SEQ ID NO: 2610546 - RNA, 18 nt, Escherichia coli CFT073
uccagauauguaucuacc

SEQ ID NO: 2610547 - RNA, 23 nt, Escherichia coli CFT073
uccagauauguaucuaccccaga

SEQ ID NO: 2610548 - RNA, 13 nt, Escherichia coli CFT073
uccagauauucau

SEQ ID NO: 2610549 - RNA, 20 nt, Escherichia coli CFT073
uccagauauucauagagaag

SEQ ID NO: 2610550 - RNA, 19 nt, Escherichia coli CFT073
uccagaucggcuucaaucu

SEQ ID NO: 2610551 - RNA, 20 nt, Escherichia coli CFT073
uccagaugcuguaccaggug

SEQ ID NO: 2610552 - RNA, 22 nt, Escherichia coli CFT073
uccagauucaguuucaccgcgu

SEQ ID NO: 2610553 - RNA, 14 nt, Escherichia coli CFT073
uccagauucucaua

SEQ ID NO: 2610554 - RNA, 20 nt, Escherichia coli CFT073
uccagauucuccaccugcgg

SEQ ID NO: 2610555 - RNA, 14 nt, Escherichia coli CFT073
uccagauuuuucag

SEQ ID NO: 2610556 - RNA, 19 nt, Escherichia coli CFT073
uccagcaaagcgucaagau

SEQ ID NO: 2610557 - RNA, 14 nt, Escherichia coli CFT073
uccagcaacaacag

SEQ ID NO: 2610558 - RNA, 15 nt, Escherichia coli CFT073
uccagcaacaacagc

SEQ ID NO: 2610559 - RNA, 22 nt, Escherichia coli CFT073
uccagcaacguuucgcuggaug

SEQ ID NO: 2610560 - RNA, 22 nt, Escherichia coli CFT073
uccagcacacuguaagccaccg

SEQ ID NO: 2610561 - RNA, 11 nt, Escherichia coli CFT073
uccagcaccac

SEQ ID NO: 2610562 - RNA, 13 nt, Escherichia coli CFT073
uccagcaccacua

SEQ ID NO: 2610563 - RNA, 14 nt, Escherichia coli CFT073
uccagcaccacuac

SEQ ID NO: 2610564 - RNA, 20 nt, Escherichia coli CFT073
uccagcaccacuuccggcaa

SEQ ID NO: 2610565 - RNA, 14 nt, Escherichia coli CFT073
uccagcaccaguuc

SEQ ID NO: 2610566 - RNA, 19 nt, Escherichia coli CFT073
uccagcacgaagaggccgc

SEQ ID NO: 2610567 - RNA, 17 nt, Escherichia coli CFT073
uccagcacggugaagaa

SEQ ID NO: 2610568 - RNA, 19 nt, Escherichia coli CFT073
uccagcagaucgaucuugu

SEQ ID NO: 2610569 - RNA, 14 nt, Escherichia coli CFT073
uccagcagccagag

SEQ ID NO: 2610570 - RNA, 19 nt, Escherichia coli CFT073
uccagcagcucaaucgccu

SEQ ID NO: 2610571 - RNA, 19 nt, Escherichia coli CFT073
uccagcagcuccggcucua

SEQ ID NO: 2610572 - RNA, 15 nt, Escherichia coli CFT073
uccagcauaaugacu

SEQ ID NO: 2610573 - RNA, 15 nt, Escherichia coli CFT073
uccagcauaccuucc

SEQ ID NO: 2610574 - RNA, 21 nt, Escherichia coli CFT073
uccagcaucacaucaaauccc

SEQ ID NO: 2610575 - RNA, 16 nt, Escherichia coli CFT073
uccagcauccgcgcac

SEQ ID NO: 2610576 - RNA, 17 nt, Escherichia coli CFT073
uccagcaucgaccagga

SEQ ID NO: 2610577 - RNA, 14 nt, Escherichia coli CFT073
uccagcaucgccac

SEQ ID NO: 2610578 - RNA, 16 nt, Escherichia coli CFT073
uccagcaucuguucuu

SEQ ID NO: 2610579 - RNA, 17 nt, Escherichia coli CFT073
uccagcaugcucacuac

SEQ ID NO: 2610580 - RNA, 19 nt, Escherichia coli CFT073
uccagcauucccgccacca

SEQ ID NO: 2610581 - RNA, 12 nt, Escherichia coli CFT073
uccagccaggcg

SEQ ID NO: 2610582 - RNA, 15 nt, Escherichia coli CFT073
uccagccaguuggug

SEQ ID NO: 2610583 - RNA, 19 nt, Escherichia coli CFT073
uccagccaucaaucccauc

SEQ ID NO: 2610584 - RNA, 18 nt, Escherichia coli CFT073
uccagccccaccagcaaa

SEQ ID NO: 2610585 - RNA, 16 nt, Escherichia coli CFT073
uccagcccuccucacu

SEQ ID NO: 2610586 - RNA, 21 nt, Escherichia coli CFT073
uccagccuacagaacgcugca

SEQ ID NO: 2610587 - RNA, 22 nt, Escherichia coli CFT073
uccagccucugucuuccgggaa

SEQ ID NO: 2610588 - RNA, 16 nt, Escherichia coli CFT073
uccagcgaaauaaaag

SEQ ID NO: 2610589 - RNA, 16 nt, Escherichia coli CFT073
uccagcgacuccaguu

SEQ ID NO: 2610590 - RNA, 19 nt, Escherichia coli CFT073
uccagcgacuccaguucgu

SEQ ID NO: 2610591 - RNA, 16 nt, Escherichia coli CFT073
uccagcgagcuggcgc

SEQ ID NO: 2610592 - RNA, 17 nt, Escherichia coli CFT073
uccagcgcaucgaucuu

SEQ ID NO: 2610593 - RNA, 18 nt, Escherichia coli CFT073
uccagcgccaguaauucu

SEQ ID NO: 2610594 - RNA, 23 nt, Escherichia coli CFT073
uccagcgccaguaauucuucaau

SEQ ID NO: 2610595 - RNA, 13 nt, Escherichia coli CFT073
uccagcgccgcca

SEQ ID NO: 2610596 - RNA, 15 nt, Escherichia coli CFT073
uccagcgccgcgcgu

SEQ ID NO: 2610597 - RNA, 22 nt, Escherichia coli CFT073
uccagcgccugaauaaucagau

SEQ ID NO: 2610598 - RNA, 23 nt, Escherichia coli CFT073
uccagcgccuggcgaaucgccug

SEQ ID NO: 2610599 - RNA, 19 nt, Escherichia coli CFT073
uccagcgcguuugucagca

SEQ ID NO: 2610600 - RNA, 17 nt, Escherichia coli CFT073
uccagcgguaaaucauu

SEQ ID NO: 2610601 - RNA, 19 nt, Escherichia coli CFT073
uccagcgguuguagccacg

SEQ ID NO: 2610602 - RNA, 15 nt, Escherichia coli CFT073
uccagcgucuccaga

SEQ ID NO: 2610603 - RNA, 17 nt, Escherichia coli CFT073
uccagcguuaccggcuu

SEQ ID NO: 2610604 - RNA, 17 nt, Escherichia coli CFT073
uccagcguucccuuccc

SEQ ID NO: 2610605 - RNA, 18 nt, Escherichia coli CFT073
uccagcuaaccauccaca

SEQ ID NO: 2610606 - RNA, 13 nt, Escherichia coli CFT073
uccagcucaacca

SEQ ID NO: 2610607 - RNA, 21 nt, Escherichia coli CFT073
uccagcucaagugccagauca

SEQ ID NO: 2610608 - RNA, 17 nt, Escherichia coli CFT073
uccagcucacugauaau

SEQ ID NO: 2610609 - RNA, 21 nt, Escherichia coli CFT073
uccagcuccagccgcuccccu

SEQ ID NO: 2610610 - RNA, 23 nt, Escherichia coli CFT073
uccagcuccguccagccaccgcg

SEQ ID NO: 2610611 - RNA, 20 nt, Escherichia coli CFT073
uccagcucgcguucugucag

SEQ ID NO: 2610612 - RNA, 20 nt, Escherichia coli CFT073
uccagcucggcgcuaaucau

SEQ ID NO: 2610613 - RNA, 13 nt, Escherichia coli CFT073
uccagcugccugc

SEQ ID NO: 2610614 - RNA, 15 nt, Escherichia coli CFT073
uccagcugccugcgg

SEQ ID NO: 2610615 - RNA, 16 nt, Escherichia coli CFT073
uccagcuguaccagca

SEQ ID NO: 2610616 - RNA, 14 nt, Escherichia coli CFT073
uccagcuuaauucu

SEQ ID NO: 2610617 - RNA, 15 nt, Escherichia coli CFT073
uccagcuucagacgg

SEQ ID NO: 2610618 - RNA, 17 nt, Escherichia coli CFT073
uccagcuucagauuagc

SEQ ID NO: 2610619 - RNA, 16 nt, Escherichia coli CFT073
uccagcuucagauuca

SEQ ID NO: 2610620 - RNA, 18 nt, Escherichia coli CFT073
uccagcuuccaggcaauc

SEQ ID NO: 2610621 - RNA, 15 nt, Escherichia coli CFT073
uccagcuucgccagc

SEQ ID NO: 2610622 - RNA, 18 nt, Escherichia coli CFT073
uccaggccagauacugcc

SEQ ID NO: 2610623 - RNA, 19 nt, Escherichia coli CFT073
uccaggcgaagacaaaacc

SEQ ID NO: 2610624 - RNA, 13 nt, Escherichia coli CFT073
uccaggcuggcag

SEQ ID NO: 2610625 - RNA, 22 nt, Escherichia coli CFT073
uccaggcuggucgcgcggaagu

SEQ ID NO: 2610626 - RNA, 22 nt, Escherichia coli CFT073
uccagggccaguacacaauccu

SEQ ID NO: 2610627 - RNA, 23 nt, Escherichia coli CFT073
uccaggguuuuauuauuccaucc

SEQ ID NO: 2610628 - RNA, 18 nt, Escherichia coli CFT073
uccaggucaaucccagga

SEQ ID NO: 2610629 - RNA, 23 nt, Escherichia coli CFT073
uccagguuaugguugaacacauc

SEQ ID NO: 2610630 - RNA, 14 nt, Escherichia coli CFT073
uccaguaacacuuc

SEQ ID NO: 2610631 - RNA, 20 nt, Escherichia coli CFT073
uccaguaacacuuccggguc

SEQ ID NO: 2610632 - RNA, 21 nt, Escherichia coli CFT073
uccaguaaugcgcccaugccg

SEQ ID NO: 2610633 - RNA, 17 nt, Escherichia coli CFT073
uccaguaccaggcaaua

SEQ ID NO: 2610634 - RNA, 14 nt, Escherichia coli CFT073
uccaguagaauaau

SEQ ID NO: 2610635 - RNA, 22 nt, Escherichia coli CFT073
uccaguagaauaaugaucccuu

SEQ ID NO: 2610636 - RNA, 23 nt, Escherichia coli CFT073
uccaguagaauaaugaucccuuc

SEQ ID NO: 2610637 - RNA, 18 nt, Escherichia coli CFT073
uccaguagcgagccgucg

SEQ ID NO: 2610638 - RNA, 15 nt, Escherichia coli CFT073
uccaguagcgccaua

SEQ ID NO: 2610639 - RNA, 20 nt, Escherichia coli CFT073
uccaguauauugcugauuuu

SEQ ID NO: 2610640 - RNA, 22 nt, Escherichia coli CFT073
uccagucagcaccagacgcaac

SEQ ID NO: 2610641 - RNA, 23 nt, Escherichia coli CFT073
uccagucauacuuauugaaagca

SEQ ID NO: 2610642 - RNA, 19 nt, Escherichia coli CFT073
uccagucguuaugcacgcu

SEQ ID NO: 2610643 - RNA, 14 nt, Escherichia coli CFT073
uccagucuuucgcc

SEQ ID NO: 2610644 - RNA, 14 nt, Escherichia coli CFT073
ucccauuucuccac

SEQ ID NO: 2610645 - RNA, 20 nt, Escherichia coli CFT073
ucccauuuuauccucuucaa

SEQ ID NO: 2610646 - RNA, 23 nt, Escherichia coli CFT073
uccccaagaaucgucgcccgaug

SEQ ID NO: 2610647 - RNA, 19 nt, Escherichia coli CFT073
uccccaagaucaauacaac

SEQ ID NO: 2610648 - RNA, 15 nt, Escherichia coli CFT073
uccccacaaaccacc

SEQ ID NO: 2610649 - RNA, 23 nt, Escherichia coli CFT073
uccccacaaucggcgggaaaaau

SEQ ID NO: 2610650 - RNA, 16 nt, Escherichia coli CFT073
uccccacagaaacaau

SEQ ID NO: 2610651 - RNA, 15 nt, Escherichia coli CFT073
uccccacaucacacc

SEQ ID NO: 2610652 - RNA, 12 nt, Escherichia coli CFT073
uccccacaucag

SEQ ID NO: 2610653 - RNA, 21 nt, Escherichia coli CFT073
uccccaccccaguucggcguu

SEQ ID NO: 2610654 - RNA, 18 nt, Escherichia coli CFT073
uccccaccugaacuucuu

SEQ ID NO: 2610655 - RNA, 22 nt, Escherichia coli CFT073
uccccacgggacgcugcacgga

SEQ ID NO: 2610656 - RNA, 20 nt, Escherichia coli CFT073
uccccacugcauggcggcgu

SEQ ID NO: 2610657 - RNA, 15 nt, Escherichia coli CFT073
uccccacuucauccg

SEQ ID NO: 2610658 - RNA, 17 nt, Escherichia coli CFT073
uccccacuucauccgac

SEQ ID NO: 2610659 - RNA, 14 nt, Escherichia coli CFT073
uccccagaagcuuu

SEQ ID NO: 2610660 - RNA, 13 nt, Escherichia coli CFT073
uccccagacaaaa

SEQ ID NO: 2610661 - RNA, 12 nt, Escherichia coli CFT073
uccccagccacg

SEQ ID NO: 2610662 - RNA, 18 nt, Escherichia coli CFT073
uccccagccgaucagcgg

SEQ ID NO: 2610663 - RNA, 17 nt, Escherichia coli CFT073
uccccagcggaaaauau

SEQ ID NO: 2610664 - RNA, 22 nt, Escherichia coli CFT073
uccccagcggaaaauaucacca

SEQ ID NO: 2610665 - RNA, 19 nt, Escherichia coli CFT073
uccccagcgucagcagcaa

SEQ ID NO: 2610666 - RNA, 13 nt, Escherichia coli CFT073
uccccauaucccg

SEQ ID NO: 2610667 - RNA, 15 nt, Escherichia coli CFT073
uccccauaucccgga

SEQ ID NO: 2610668 - RNA, 23 nt, Escherichia coli CFT073
uccccaucagguuugccgacguu

SEQ ID NO: 2610669 - RNA, 15 nt, Escherichia coli CFT073
uccccaucgccgcac

SEQ ID NO: 2610670 - RNA, 23 nt, Escherichia coli CFT073
uccccauucugcgcugacucuac

SEQ ID NO: 2610671 - RNA, 14 nt, Escherichia coli CFT073
ucccccacagcucu

SEQ ID NO: 2610672 - RNA, 13 nt, Escherichia coli CFT073
ucccccaccacca

SEQ ID NO: 2610673 - RNA, 15 nt, Escherichia coli CFT073
ucccccaccaccauc

SEQ ID NO: 2610674 - RNA, 22 nt, Escherichia coli CFT073
ucccccaccaccaucucaagca

SEQ ID NO: 2610675 - RNA, 16 nt, Escherichia coli CFT073
ucccccaccgccgccg

SEQ ID NO: 2610676 - RNA, 21 nt, Escherichia coli CFT073
ucccccauuauuaacaagaug

SEQ ID NO: 2610677 - RNA, 14 nt, Escherichia coli CFT073
ucccccauugccgc

SEQ ID NO: 2610678 - RNA, 17 nt, Escherichia coli CFT073
uccccccggcagcugcc

SEQ ID NO: 2610679 - RNA, 15 nt, Escherichia coli CFT073
ucccccgcacacucc

SEQ ID NO: 2610680 - RNA, 12 nt, Escherichia coli CFT073
ucccccuccccc

SEQ ID NO: 2610681 - RNA, 20 nt, Escherichia coli CFT073
ucccccuuaccccgcccgau

SEQ ID NO: 2610682 - RNA, 20 nt, Escherichia coli CFT073
uccccgcagcaaacagagau

SEQ ID NO: 2610683 - RNA, 19 nt, Escherichia coli CFT073
uccccgcaggucggauaag

SEQ ID NO: 2610684 - RNA, 14 nt, Escherichia coli CFT073
uccccgccagcguu

SEQ ID NO: 2610685 - RNA, 15 nt, Escherichia coli CFT073
uccccgccucaccgc

SEQ ID NO: 2610686 - RNA, 13 nt, Escherichia coli CFT073
uccccgcucucga

SEQ ID NO: 2610687 - RNA, 16 nt, Escherichia coli CFT073
uccccgcuucgcccgc

SEQ ID NO: 2610688 - RNA, 14 nt, Escherichia coli CFT073
uccccggcagcauc

SEQ ID NO: 2610689 - RNA, 17 nt, Escherichia coli CFT073
uccccggcagugcuuuc

SEQ ID NO: 2610690 - RNA, 15 nt, Escherichia coli CFT073
uccccggucagcagc

SEQ ID NO: 2610691 - RNA, 16 nt, Escherichia coli CFT073
uccccggucagcagca

SEQ ID NO: 2610692 - RNA, 21 nt, Escherichia coli CFT073
uccccggucugauauucagga

SEQ ID NO: 2610693 - RNA, 16 nt, Escherichia coli CFT073
uccccggugaaaagac

SEQ ID NO: 2610694 - RNA, 17 nt, Escherichia coli CFT073
uccccggugaaaagacg

SEQ ID NO: 2610695 - RNA, 23 nt, Escherichia coli CFT073
uccccguaaagcggcaacuuuau

SEQ ID NO: 2610696 - RNA, 15 nt, Escherichia coli CFT073
uccccuacucucugu

SEQ ID NO: 2610697 - RNA, 23 nt, Escherichia coli CFT073
uccccucagggcggcuaucccaa

SEQ ID NO: 2610698 - RNA, 16 nt, Escherichia coli CFT073
uccccuccagcgagcu

SEQ ID NO: 2610699 - RNA, 13 nt, Escherichia coli CFT073
uccccugaaauau

SEQ ID NO: 2610700 - RNA, 12 nt, Escherichia coli CFT073
uccccugacugu

SEQ ID NO: 2610701 - RNA, 18 nt, Escherichia coli CFT073
uccccugagcauacauug

SEQ ID NO: 2610702 - RNA, 21 nt, Escherichia coli CFT073
uccccugagcauacauugccg

SEQ ID NO: 2610703 - RNA, 21 nt, Escherichia coli CFT073
uccccugcccgcgauccagcg

SEQ ID NO: 2610704 - RNA, 15 nt, Escherichia coli CFT073
uccccuucagcaagg

SEQ ID NO: 2610705 - RNA, 21 nt, Escherichia coli CFT073
uccccuuucacauugaugaag

SEQ ID NO: 2610706 - RNA, 19 nt, Escherichia coli CFT073
uccccuuuugccuucugag

SEQ ID NO: 2610707 - RNA, 21 nt, Escherichia coli CFT073
ucccgaacucgaccugcaacu

SEQ ID NO: 2610708 - RNA, 18 nt, Escherichia coli CFT073
ucccgacacggcucaacc

SEQ ID NO: 2610709 - RNA, 23 nt, Escherichia coli CFT073
ucccgaccaauuacacacaacac

SEQ ID NO: 2610710 - RNA, 16 nt, Escherichia coli CFT073
ucccgauaaccgcaaa

SEQ ID NO: 2610711 - RNA, 22 nt, Escherichia coli CFT073
ucccgcagccacgucaccugcc

SEQ ID NO: 2610712 - RNA, 18 nt, Escherichia coli CFT073
ucccgcauuccauugucc

SEQ ID NO: 2610713 - RNA, 14 nt, Escherichia coli CFT073
ucccgccagaugau

SEQ ID NO: 2610714 - RNA, 15 nt, Escherichia coli CFT073
ucccgccagcaccag

SEQ ID NO: 2610715 - RNA, 17 nt, Escherichia coli CFT073
ucccgccaucguugaug

SEQ ID NO: 2610716 - RNA, 16 nt, Escherichia coli CFT073
ucccgcccccgccagc

SEQ ID NO: 2610717 - RNA, 23 nt, Escherichia coli CFT073
ucccgccgaagacgcuuacucuu

SEQ ID NO: 2610718 - RNA, 16 nt, Escherichia coli CFT073
ucccgccgaccaacgc

SEQ ID NO: 2610719 - RNA, 19 nt, Escherichia coli CFT073
ucccgccugcugcgucgcg

SEQ ID NO: 2610720 - RNA, 21 nt, Escherichia coli CFT073
ucccgcgacaaucgcccccau

SEQ ID NO: 2610721 - RNA, 19 nt, Escherichia coli CFT073
ucccgcgauuuccugaccc

SEQ ID NO: 2610722 - RNA, 21 nt, Escherichia coli CFT073
ucccgcgcacgaggugccacc

SEQ ID NO: 2610723 - RNA, 16 nt, Escherichia coli CFT073
ucccgcgcccgugcau

SEQ ID NO: 2610724 - RNA, 12 nt, Escherichia coli CFT073
ucccgcggcgca

SEQ ID NO: 2610725 - RNA, 14 nt, Escherichia coli CFT073
ucccgcggcgcagc

SEQ ID NO: 2610726 - RNA, 23 nt, Escherichia coli CFT073
ucccgcuguuuguucaucaugaa

SEQ ID NO: 2610727 - RNA, 19 nt, Escherichia coli CFT073
ucccggauaaaucuccauu

SEQ ID NO: 2610728 - RNA, 21 nt, Escherichia coli CFT073
ucccggauggcaacagcagcc

SEQ ID NO: 2610729 - RNA, 15 nt, Escherichia coli CFT073
ucccggcaaaaaaca

SEQ ID NO: 2610730 - RNA, 21 nt, Escherichia coli CFT073
ucccggcaaucaccgccagcg

SEQ ID NO: 2610731 - RNA, 14 nt, Escherichia coli CFT073
ucccggcagagaaa

SEQ ID NO: 2610732 - RNA, 15 nt, Escherichia coli CFT073
ucccggcagagaaaa

SEQ ID NO: 2610733 - RNA, 17 nt, Escherichia coli CFT073
ucccggccaaagcgcga

SEQ ID NO: 2610734 - RNA, 21 nt, Escherichia coli CFT073
ucccgggucgcgacugccagc

SEQ ID NO: 2610735 - RNA, 19 nt, Escherichia coli CFT073
ucccgguauaacuugccag

SEQ ID NO: 2610736 - RNA, 21 nt, Escherichia coli CFT073
ucccgguauaacuugccaggc

SEQ ID NO: 2610737 - RNA, 22 nt, Escherichia coli CFT073
ucccgguauaacuugccaggcc

SEQ ID NO: 2610738 - RNA, 22 nt, Escherichia coli CFT073
ucccggugaauucaguaccagc

SEQ ID NO: 2610739 - RNA, 21 nt, Escherichia coli CFT073
ucccguaauccguaaagccca

SEQ ID NO: 2610740 - RNA, 13 nt, Escherichia coli CFT073
ucccgucgcccac

SEQ ID NO: 2610741 - RNA, 21 nt, Escherichia coli CFT073
ucccguugaggugucgcgcac

SEQ ID NO: 2610742 - RNA, 19 nt, Escherichia coli CFT073
ucccguugccacucaggca

SEQ ID NO: 2610743 - RNA, 19 nt, Escherichia coli CFT073
ucccuaacagcguggugac

SEQ ID NO: 2610744 - RNA, 17 nt, Escherichia coli CFT073
ucccuaauaccguucca

SEQ ID NO: 2610745 - RNA, 19 nt, Escherichia coli CFT073
ucccuacucucgcaugggg

SEQ ID NO: 2610746 - RNA, 16 nt, Escherichia coli CFT073
ucccuacugcacucau

SEQ ID NO: 2610747 - RNA, 19 nt, Escherichia coli CFT073
ucccuauaaugcgccacca

SEQ ID NO: 2610748 - RNA, 22 nt, Escherichia coli CFT073
ucccucacccccacucccgcau

SEQ ID NO: 2610749 - RNA, 20 nt, Escherichia coli CFT073
ucccucacgcuucugaauau

SEQ ID NO: 2610750 - RNA, 16 nt, Escherichia coli CFT073
ucccucagguauagga

SEQ ID NO: 2610751 - RNA, 14 nt, Escherichia coli CFT073
ucccucauuuucaa

SEQ ID NO: 2610752 - RNA, 15 nt, Escherichia coli CFT073
uccggacguucagcc

SEQ ID NO: 2610753 - RNA, 20 nt, Escherichia coli CFT073
uccggacguucagccauacg

SEQ ID NO: 2610754 - RNA, 14 nt, Escherichia coli CFT073
uccggacuggcauu

SEQ ID NO: 2610755 - RNA, 18 nt, Escherichia coli CFT073
uccggaguaaugaaaccg

SEQ ID NO: 2610756 - RNA, 21 nt, Escherichia coli CFT073
uccggagucaacaucucaaua

SEQ ID NO: 2610757 - RNA, 17 nt, Escherichia coli CFT073
uccggauucaaaccuaa

SEQ ID NO: 2610758 - RNA, 21 nt, Escherichia coli CFT073
uccggcaaauuaagaagcggc

SEQ ID NO: 2610759 - RNA, 22 nt, Escherichia coli CFT073
uccggcaaauuaagaagcggcu

SEQ ID NO: 2610760 - RNA, 23 nt, Escherichia coli CFT073
uccggcaacaucaaaucacagca

SEQ ID NO: 2610761 - RNA, 13 nt, Escherichia coli CFT073
uccggcaaggcgc

SEQ ID NO: 2610762 - RNA, 21 nt, Escherichia coli CFT073
uccggcaaucaacagauaaau

SEQ ID NO: 2610763 - RNA, 12 nt, Escherichia coli CFT073
uccggcaauuac

SEQ ID NO: 2610764 - RNA, 22 nt, Escherichia coli CFT073
uccggcacaucgccgaagcuug

SEQ ID NO: 2610765 - RNA, 18 nt, Escherichia coli CFT073
uccggcacauuucauuca

SEQ ID NO: 2610766 - RNA, 22 nt, Escherichia coli CFT073
uccggcacauuucauucacgcc

SEQ ID NO: 2610767 - RNA, 19 nt, Escherichia coli CFT073
uccggcacgcauugccgcc

SEQ ID NO: 2610768 - RNA, 19 nt, Escherichia coli CFT073
uccggcacgccguuaccuu

SEQ ID NO: 2610769 - RNA, 20 nt, Escherichia coli CFT073
uccggcacuuuuucaucagg

SEQ ID NO: 2610770 - RNA, 21 nt, Escherichia coli CFT073
uccggcagcaaauucaccgcc

SEQ ID NO: 2610771 - RNA, 13 nt, Escherichia coli CFT073
uccggcagccagg

SEQ ID NO: 2610772 - RNA, 15 nt, Escherichia coli CFT073
uccggcagccaggau

SEQ ID NO: 2610773 - RNA, 22 nt, Escherichia coli CFT073
uccggcagcgcauaagccacaa

SEQ ID NO: 2610774 - RNA, 20 nt, Escherichia coli CFT073
uccggcagcuuuaccggcuu

SEQ ID NO: 2610775 - RNA, 14 nt, Escherichia coli CFT073
uccggcaguuucau

SEQ ID NO: 2610776 - RNA, 19 nt, Escherichia coli CFT073
uccggcauuaaguggcgau

SEQ ID NO: 2610777 - RNA, 19 nt, Escherichia coli CFT073
uccggcauuaucacaucag

SEQ ID NO: 2610778 - RNA, 21 nt, Escherichia coli CFT073
uccggcauuugagcaggaugc

SEQ ID NO: 2610779 - RNA, 17 nt, Escherichia coli CFT073
uccggcauuugagcaua

SEQ ID NO: 2610780 - RNA, 19 nt, Escherichia coli CFT073
uccggccagcaugccugug

SEQ ID NO: 2610781 - RNA, 20 nt, Escherichia coli CFT073
uccggccagcaugccugugg

SEQ ID NO: 2610782 - RNA, 13 nt, Escherichia coli CFT073
uccggccaucagu

SEQ ID NO: 2610783 - RNA, 20 nt, Escherichia coli CFT073
uccggccuacauuggucugg

SEQ ID NO: 2610784 - RNA, 22 nt, Escherichia coli CFT073
uccggccuaccgcaucuuaauc

SEQ ID NO: 2610785 - RNA, 14 nt, Escherichia coli CFT073
uccggccuacggga

SEQ ID NO: 2610786 - RNA, 17 nt, Escherichia coli CFT073
uccggccuacgggaaca

SEQ ID NO: 2610787 - RNA, 22 nt, Escherichia coli CFT073
uccggccugcacugcaggccgg

SEQ ID NO: 2610788 - RNA, 21 nt, Escherichia coli CFT073
uccggcgaaaaucccggcaac

SEQ ID NO: 2610789 - RNA, 15 nt, Escherichia coli CFT073
uccggcgacacaucu

SEQ ID NO: 2610790 - RNA, 14 nt, Escherichia coli CFT073
uccggcgacaggaa

SEQ ID NO: 2610791 - RNA, 12 nt, Escherichia coli CFT073
uccggcgcacug

SEQ ID NO: 2610792 - RNA, 16 nt, Escherichia coli CFT073
uccggcgcucaucagg

SEQ ID NO: 2610793 - RNA, 22 nt, Escherichia coli CFT073
uccggcggcacagccagcgcag

SEQ ID NO: 2610794 - RNA, 13 nt, Escherichia coli CFT073
uccggcggcggaa

SEQ ID NO: 2610795 - RNA, 16 nt, Escherichia coli CFT073
uccggcuguuccagca

SEQ ID NO: 2610796 - RNA, 20 nt, Escherichia coli CFT073
uccggcuuaaugcacggcag

SEQ ID NO: 2610797 - RNA, 14 nt, Escherichia coli CFT073
uccggcuuucacuu

SEQ ID NO: 2610798 - RNA, 21 nt, Escherichia coli CFT073
uccgggaugcggauaauaugu

SEQ ID NO: 2610799 - RNA, 19 nt, Escherichia coli CFT073
uccgggccgaacaucagau

SEQ ID NO: 2610800 - RNA, 12 nt, Escherichia coli CFT073
uccgggcuauac

SEQ ID NO: 2610801 - RNA, 20 nt, Escherichia coli CFT073
uccgggcuauacacccuucu

SEQ ID NO: 2610802 - RNA, 15 nt, Escherichia coli CFT073
uccgggcuaucaugc

SEQ ID NO: 2610803 - RNA, 23 nt, Escherichia coli CFT073
uccgggcugguuuucagcgaaac

SEQ ID NO: 2610804 - RNA, 18 nt, Escherichia coli CFT073
uccgggcuguuuuccagc

SEQ ID NO: 2610805 - RNA, 16 nt, Escherichia coli CFT073
uccggggcaauuucag

SEQ ID NO: 2610806 - RNA, 16 nt, Escherichia coli CFT073
uccgggguucgaaucc

SEQ ID NO: 2610807 - RNA, 15 nt, Escherichia coli CFT073
uccggguagcgcggc

SEQ ID NO: 2610808 - RNA, 20 nt, Escherichia coli CFT073
uccgggugugacaacaacau

SEQ ID NO: 2610809 - RNA, 14 nt, Escherichia coli CFT073
uccggguuuucaac

SEQ ID NO: 2610810 - RNA, 21 nt, Escherichia coli CFT073
uccgguaaaucgacccugaug

SEQ ID NO: 2610811 - RNA, 14 nt, Escherichia coli CFT073
uccgguacgugcgu

SEQ ID NO: 2610812 - RNA, 15 nt, Escherichia coli CFT073
uccgguacuuuccuu

SEQ ID NO: 2610813 - RNA, 14 nt, Escherichia coli CFT073
uccggugccaaagu

SEQ ID NO: 2610814 - RNA, 22 nt, Escherichia coli CFT073
uccgguuauacgucauuaauac

SEQ ID NO: 2610815 - RNA, 20 nt, Escherichia coli CFT073
uccgguucauggucgccaag

SEQ ID NO: 2610816 - RNA, 14 nt, Escherichia coli CFT073
uccgguuguucaac

SEQ ID NO: 2610817 - RNA, 15 nt, Escherichia coli CFT073
uccgguuuacucaau

SEQ ID NO: 2610818 - RNA, 15 nt, Escherichia coli CFT073
uccgguuucaucagc

SEQ ID NO: 2610819 - RNA, 21 nt, Escherichia coli CFT073
uccguaaaugggggagagcca

SEQ ID NO: 2610820 - RNA, 22 nt, Escherichia coli CFT073
uccguaacgcucaagaacggca

SEQ ID NO: 2610821 - RNA, 22 nt, Escherichia coli CFT073
uccguaacucaggaugagaaaa

SEQ ID NO: 2610822 - RNA, 20 nt, Escherichia coli CFT073
uccguacgcuuuuccacuca

SEQ ID NO: 2610823 - RNA, 18 nt, Escherichia coli CFT073
uccguacucaaugccagc

SEQ ID NO: 2610824 - RNA, 15 nt, Escherichia coli CFT073
uccguaucugucaga

SEQ ID NO: 2610825 - RNA, 19 nt, Escherichia coli CFT073
uccgucaucgacgucagca

SEQ ID NO: 2610826 - RNA, 18 nt, Escherichia coli CFT073
uccgucaugucucucaga

SEQ ID NO: 2610827 - RNA, 23 nt, Escherichia coli CFT073
uccguccgcaaacguaaaugcca

SEQ ID NO: 2610828 - RNA, 20 nt, Escherichia coli CFT073
uccgucgaaagcccaucauc

SEQ ID NO: 2610829 - RNA, 13 nt, Escherichia coli CFT073
uccgucgccguaa

SEQ ID NO: 2610830 - RNA, 16 nt, Escherichia coli CFT073
uccgucguucaacaag

SEQ ID NO: 2610831 - RNA, 14 nt, Escherichia coli CFT073
uccgucucaauggu

SEQ ID NO: 2610832 - RNA, 13 nt, Escherichia coli CFT073
uccgucuggccag

SEQ ID NO: 2610833 - RNA, 16 nt, Escherichia coli CFT073
uccgugcauuccagca

SEQ ID NO: 2610834 - RNA, 18 nt, Escherichia coli CFT073
uccgugcuggcugcgcuu

SEQ ID NO: 2610835 - RNA, 19 nt, Escherichia coli CFT073
uccguguuguacggcaaua

SEQ ID NO: 2610836 - RNA, 13 nt, Escherichia coli CFT073
uccguucagaucg

SEQ ID NO: 2610837 - RNA, 16 nt, Escherichia coli CFT073
uccguucaguaaucaa

SEQ ID NO: 2610838 - RNA, 17 nt, Escherichia coli CFT073
uccguucuggacuuccc

SEQ ID NO: 2610839 - RNA, 20 nt, Escherichia coli CFT073
uccguuguaacuucuuuacu

SEQ ID NO: 2610840 - RNA, 14 nt, Escherichia coli CFT073
uccguuuuucuguu

SEQ ID NO: 2610841 - RNA, 17 nt, Escherichia coli CFT073
uccuauuggagaauaug

SEQ ID NO: 2610842 - RNA, 20 nt, Escherichia coli CFT073
uccucaaacgugcggcaggc

SEQ ID NO: 2610843 - RNA, 23 nt, Escherichia coli CFT073
uccucaaacgugcggcaggcaca

SEQ ID NO: 2610844 - RNA, 17 nt, Escherichia coli CFT073
uccucaaaucagccaua

SEQ ID NO: 2610845 - RNA, 14 nt, Escherichia coli CFT073
uccucaacgccgca

SEQ ID NO: 2610846 - RNA, 22 nt, Escherichia coli CFT073
uccucaacuuuguugcgaacuu

SEQ ID NO: 2610847 - RNA, 16 nt, Escherichia coli CFT073
uccucaaucggaaaac

SEQ ID NO: 2610848 - RNA, 23 nt, Escherichia coli CFT073
uccucaccguuuaauaacagcug

SEQ ID NO: 2610849 - RNA, 22 nt, Escherichia coli CFT073
uccucacuuaaagcaacaccau

SEQ ID NO: 2610850 - RNA, 14 nt, Escherichia coli CFT073
uccucaucaauauu

SEQ ID NO: 2610851 - RNA, 15 nt, Escherichia coli CFT073
uccucaucauccucu

SEQ ID NO: 2610852 - RNA, 17 nt, Escherichia coli CFT073
uccucaucauccucuuc

SEQ ID NO: 2610853 - RNA, 17 nt, Escherichia coli CFT073
uccucauuucauugucc

SEQ ID NO: 2610854 - RNA, 13 nt, Escherichia coli CFT073
uccucccguuaug

SEQ ID NO: 2610855 - RNA, 23 nt, Escherichia coli CFT073
uccuccggcauagccggagguuu

SEQ ID NO: 2610856 - RNA, 19 nt, Escherichia coli CFT073
uccuccggcaucuuuaacg

SEQ ID NO: 2610857 - RNA, 21 nt, Escherichia coli CFT073
uccuccggcaucuuuaacgug

SEQ ID NO: 2610858 - RNA, 21 nt, Escherichia coli CFT073
uccuccuggaacacgcgcaua

SEQ ID NO: 2610859 - RNA, 15 nt, Escherichia coli CFT073
uccucgagccuuauc

SEQ ID NO: 2610860 - RNA, 17 nt, Escherichia coli CFT073
ucgaauaacuccgcgcc

SEQ ID NO: 2610861 - RNA, 23 nt, Escherichia coli CFT073
ucgaaucaaacauggagaguuuu

SEQ ID NO: 2610862 - RNA, 11 nt, Escherichia coli CFT073
ucgaaucacca

SEQ ID NO: 2610863 - RNA, 15 nt, Escherichia coli CFT073
ucgaaucgguuguuc

SEQ ID NO: 2610864 - RNA, 15 nt, Escherichia coli CFT073
ucgaaugccgcagca

SEQ ID NO: 2610865 - RNA, 21 nt, Escherichia coli CFT073
ucgaauguugcguucaucagu

SEQ ID NO: 2610866 - RNA, 15 nt, Escherichia coli CFT073
ucgacaaaaacccug

SEQ ID NO: 2610867 - RNA, 21 nt, Escherichia coli CFT073
ucgacaaaaacccugccgucu

SEQ ID NO: 2610868 - RNA, 17 nt, Escherichia coli CFT073
ucgacaaaaucagaaac

SEQ ID NO: 2610869 - RNA, 17 nt, Escherichia coli CFT073
ucgacaaacuccgcgac

SEQ ID NO: 2610870 - RNA, 23 nt, Escherichia coli CFT073
ucgacaacguuuucaacaaucca

SEQ ID NO: 2610871 - RNA, 15 nt, Escherichia coli CFT073
ucgacaagacgucca

SEQ ID NO: 2610872 - RNA, 12 nt, Escherichia coli CFT073
ucgacaauaacg

SEQ ID NO: 2610873 - RNA, 22 nt, Escherichia coli CFT073
ucgacaauccagucagcgguuu

SEQ ID NO: 2610874 - RNA, 12 nt, Escherichia coli CFT073
ucgacaccagcc

SEQ ID NO: 2610875 - RNA, 14 nt, Escherichia coli CFT073
ucgacacuacaguc

SEQ ID NO: 2610876 - RNA, 15 nt, Escherichia coli CFT073
ucgacagacgccagc

SEQ ID NO: 2610877 - RNA, 21 nt, Escherichia coli CFT073
ucgacagacgccagcgcuuuu

SEQ ID NO: 2610878 - RNA, 20 nt, Escherichia coli CFT073
ucgacagcgauuccaguuca

SEQ ID NO: 2610879 - RNA, 14 nt, Escherichia coli CFT073
ucgacauaacgacc

SEQ ID NO: 2610880 - RNA, 17 nt, Escherichia coli CFT073
ucgacauacuugacuaa

SEQ ID NO: 2610881 - RNA, 14 nt, Escherichia coli CFT073
ucgacauugaccag

SEQ ID NO: 2610882 - RNA, 21 nt, Escherichia coli CFT073
ucgaccaccgguuuuaauagu

SEQ ID NO: 2610883 - RNA, 21 nt, Escherichia coli CFT073
ucgaccagcgcacugccgcca

SEQ ID NO: 2610884 - RNA, 21 nt, Escherichia coli CFT073
ucgaccaggccaucagcagcg

SEQ ID NO: 2610885 - RNA, 14 nt, Escherichia coli CFT073
ucgaccgacuuuag

SEQ ID NO: 2610886 - RNA, 13 nt, Escherichia coli CFT073
ucgaccgucacca

SEQ ID NO: 2610887 - RNA, 14 nt, Escherichia coli CFT073
ucgaccgucaccag

SEQ ID NO: 2610888 - RNA, 14 nt, Escherichia coli CFT073
ucgaccuuacgcag

SEQ ID NO: 2610889 - RNA, 17 nt, Escherichia coli CFT073
ucgacgagaauuuccuu

SEQ ID NO: 2610890 - RNA, 13 nt, Escherichia coli CFT073
ucgacgcagcaga

SEQ ID NO: 2610891 - RNA, 22 nt, Escherichia coli CFT073
ucgacgcccagcgcggcagcgg

SEQ ID NO: 2610892 - RNA, 15 nt, Escherichia coli CFT073
ucgacggaauaaacc

SEQ ID NO: 2610893 - RNA, 16 nt, Escherichia coli CFT073
ucgacguccaaucagc

SEQ ID NO: 2610894 - RNA, 17 nt, Escherichia coli CFT073
ucgacguccaaucagca

SEQ ID NO: 2610895 - RNA, 14 nt, Escherichia coli CFT073
ucgacuaacuucug

SEQ ID NO: 2610896 - RNA, 19 nt, Escherichia coli CFT073
ucgacuaucuuauaaaggc

SEQ ID NO: 2610897 - RNA, 16 nt, Escherichia coli CFT073
ucgacucaccacggug

SEQ ID NO: 2610898 - RNA, 18 nt, Escherichia coli CFT073
ucgacucgcaauuauaau

SEQ ID NO: 2610899 - RNA, 22 nt, Escherichia coli CFT073
ucgacucggugcgcccgccagu

SEQ ID NO: 2610900 - RNA, 17 nt, Escherichia coli CFT073
ucgacugcgccuuccag

SEQ ID NO: 2610901 - RNA, 18 nt, Escherichia coli CFT073
ucgacuuccaccagcggc

SEQ ID NO: 2610902 - RNA, 19 nt, Escherichia coli CFT073
ucgacuuccaccagcggcu

SEQ ID NO: 2610903 - RNA, 19 nt, Escherichia coli CFT073
ucgacuuccugcaaucuuu

SEQ ID NO: 2610904 - RNA, 20 nt, Escherichia coli CFT073
ucgacuucuucauucauccg

SEQ ID NO: 2610905 - RNA, 12 nt, Escherichia coli CFT073
ucgacuuucgca

SEQ ID NO: 2610906 - RNA, 23 nt, Escherichia coli CFT073
ucgacuuuuuucggguuauuggu

SEQ ID NO: 2610907 - RNA, 23 nt, Escherichia coli CFT073
ucgagaagacaauccccgccagc

SEQ ID NO: 2610908 - RNA, 22 nt, Escherichia coli CFT073
ucgagaauauacagcgucugcc

SEQ ID NO: 2610909 - RNA, 19 nt, Escherichia coli CFT073
ucgagaaucaacacaccgc

SEQ ID NO: 2610910 - RNA, 22 nt, Escherichia coli CFT073
ucgagaaucgggauauugcccu

SEQ ID NO: 2610911 - RNA, 18 nt, Escherichia coli CFT073
ucgagauauuucaccagc

SEQ ID NO: 2610912 - RNA, 15 nt, Escherichia coli CFT073
ucgagaucgacaccg

SEQ ID NO: 2610913 - RNA, 14 nt, Escherichia coli CFT073
ucgagaucgccaaa

SEQ ID NO: 2610914 - RNA, 20 nt, Escherichia coli CFT073
ucgagauucauccaguucca

SEQ ID NO: 2610915 - RNA, 19 nt, Escherichia coli CFT073
ucgagcaauaaacacugcu

SEQ ID NO: 2610916 - RNA, 20 nt, Escherichia coli CFT073
ucgagcagcuccugcucuga

SEQ ID NO: 2610917 - RNA, 17 nt, Escherichia coli CFT073
ucgagcaguaauccagc

SEQ ID NO: 2610918 - RNA, 18 nt, Escherichia coli CFT073
ucgagcaguaauccagca

SEQ ID NO: 2610919 - RNA, 16 nt, Escherichia coli CFT073
ucgagcauugccagca

SEQ ID NO: 2610920 - RNA, 19 nt, Escherichia coli CFT073
ucgagcgcagcaacaucac

SEQ ID NO: 2610921 - RNA, 15 nt, Escherichia coli CFT073
ucgagcguugccgcu

SEQ ID NO: 2610922 - RNA, 14 nt, Escherichia coli CFT073
ucgagcugccugcg

SEQ ID NO: 2610923 - RNA, 15 nt, Escherichia coli CFT073
ucgaggcaaccagca

SEQ ID NO: 2610924 - RNA, 23 nt, Escherichia coli CFT073
ucgaggccaauuuggcugccaug

SEQ ID NO: 2610925 - RNA, 22 nt, Escherichia coli CFT073
ucgaggccgcggcucaggcgca

SEQ ID NO: 2610926 - RNA, 18 nt, Escherichia coli CFT073
ucgagguuaguaauguuu

SEQ ID NO: 2610927 - RNA, 16 nt, Escherichia coli CFT073
ucgaguaacauuugca

SEQ ID NO: 2610928 - RNA, 18 nt, Escherichia coli CFT073
ucgaguuugccgcugucc

SEQ ID NO: 2610929 - RNA, 14 nt, Escherichia coli CFT073
ucgauaaacagcgu

SEQ ID NO: 2610930 - RNA, 22 nt, Escherichia coli CFT073
ucgauaaacaguuccgcaaagc

SEQ ID NO: 2610931 - RNA, 14 nt, Escherichia coli CFT073
ucgauaaacucaau

SEQ ID NO: 2610932 - RNA, 19 nt, Escherichia coli CFT073
ucgauaaacucaaucaggc

SEQ ID NO: 2610933 - RNA, 14 nt, Escherichia coli CFT073
ucgauaaagcgauc

SEQ ID NO: 2610934 - RNA, 22 nt, Escherichia coli CFT073
ucgauaaauggcgcauccagcc

SEQ ID NO: 2610935 - RNA, 18 nt, Escherichia coli CFT073
ucgauaaucaucagacug

SEQ ID NO: 2610936 - RNA, 21 nt, Escherichia coli CFT073
ucgauaaucuucaaauaaacg

SEQ ID NO: 2610937 - RNA, 21 nt, Escherichia coli CFT073
ucgauacaaaaacccgcuuca

SEQ ID NO: 2610938 - RNA, 18 nt, Escherichia coli CFT073
ucgauaccguccaccaga

SEQ ID NO: 2610939 - RNA, 17 nt, Escherichia coli CFT073
ucgauaccuucauccag

SEQ ID NO: 2610940 - RNA, 19 nt, Escherichia coli CFT073
ucgauaccuucauccaggg

SEQ ID NO: 2610941 - RNA, 16 nt, Escherichia coli CFT073
ucgauauacaccggca

SEQ ID NO: 2610942 - RNA, 14 nt, Escherichia coli CFT073
ucgauaucaccaau

SEQ ID NO: 2610943 - RNA, 21 nt, Escherichia coli CFT073
ucgauaucaggcaaacagaau

SEQ ID NO: 2610944 - RNA, 22 nt, Escherichia coli CFT073
ucgauaucaggcaaacagaauu

SEQ ID NO: 2610945 - RNA, 18 nt, Escherichia coli CFT073
ucgauauggccuucuuca

SEQ ID NO: 2610946 - RNA, 12 nt, Escherichia coli CFT073
ucgaucacuuuu

SEQ ID NO: 2610947 - RNA, 16 nt, Escherichia coli CFT073
ucgaucagaccgugcg

SEQ ID NO: 2610948 - RNA, 16 nt, Escherichia coli CFT073
ucgaucagacgaucgc

SEQ ID NO: 2610949 - RNA, 13 nt, Escherichia coli CFT073
ucgaucagcaauu

SEQ ID NO: 2610950 - RNA, 13 nt, Escherichia coli CFT073
ucgaucaguucag

SEQ ID NO: 2610951 - RNA, 16 nt, Escherichia coli CFT073
ucgauccagugauucc

SEQ ID NO: 2610952 - RNA, 22 nt, Escherichia coli CFT073
ucgauccccugcccgauaaaag

SEQ ID NO: 2610953 - RNA, 21 nt, Escherichia coli CFT073
ucgaucccgguuaacugcaug

SEQ ID NO: 2610954 - RNA, 14 nt, Escherichia coli CFT073
ucgaucucuuccac

SEQ ID NO: 2610955 - RNA, 18 nt, Escherichia coli CFT073
ucgaugauaugcagacga

SEQ ID NO: 2610956 - RNA, 20 nt, Escherichia coli CFT073
ucgaugauuuccgccagcgg

SEQ ID NO: 2610957 - RNA, 14 nt, Escherichia coli CFT073
ucgaugccgcuuau

SEQ ID NO: 2610958 - RNA, 20 nt, Escherichia coli CFT073
ucgaugcggauacggcgcaa

SEQ ID NO: 2610959 - RNA, 23 nt, Escherichia coli CFT073
ucgauggcuucuggcugcuccag

SEQ ID NO: 2610960 - RNA, 20 nt, Escherichia coli CFT073
ucgauguagcgauuuacuau

SEQ ID NO: 2610961 - RNA, 15 nt, Escherichia coli CFT073
ucgauuaaguuuucc

SEQ ID NO: 2610962 - RNA, 13 nt, Escherichia coli CFT073
ucgauuaccgcca

SEQ ID NO: 2610963 - RNA, 21 nt, Escherichia coli CFT073
ucgauuaccgccagcaacaau

SEQ ID NO: 2610964 - RNA, 22 nt, Escherichia coli CFT073
ucgauucgccgucucuuucaug

SEQ ID NO: 2610965 - RNA, 20 nt, Escherichia coli CFT073
ucgauucgguucggcucaau

SEQ ID NO: 2610966 - RNA, 19 nt, Escherichia coli CFT073
ucgauugcucaacaccguu

SEQ ID NO: 2610967 - RNA, 23 nt, Escherichia coli CFT073
ucgauugucgcggcuaacuccug

SEQ ID NO: 2610968 - RNA, 22 nt, Escherichia coli CFT073
ucgcccucuuucaccagaucgc

SEQ ID NO: 2610969 - RNA, 18 nt, Escherichia coli CFT073
ucgcccugccaaaucagu

SEQ ID NO: 2610970 - RNA, 16 nt, Escherichia coli CFT073
ucgcccugccagcgau

SEQ ID NO: 2610971 - RNA, 15 nt, Escherichia coli CFT073
ucgcccuuaccauuc

SEQ ID NO: 2610972 - RNA, 18 nt, Escherichia coli CFT073
ucgccgaaauuucgccgc

SEQ ID NO: 2610973 - RNA, 16 nt, Escherichia coli CFT073
ucgccgacaaucucuu

SEQ ID NO: 2610974 - RNA, 20 nt, Escherichia coli CFT073
ucgccgagaucaacagcaua

SEQ ID NO: 2610975 - RNA, 19 nt, Escherichia coli CFT073
ucgccgcaaaacccaggcu

SEQ ID NO: 2610976 - RNA, 19 nt, Escherichia coli CFT073
ucgccgcacccgccagaau

SEQ ID NO: 2610977 - RNA, 16 nt, Escherichia coli CFT073
ucgccgcauaauaucu

SEQ ID NO: 2610978 - RNA, 15 nt, Escherichia coli CFT073
ucgccgcaucgucac

SEQ ID NO: 2610979 - RNA, 14 nt, Escherichia coli CFT073
ucgccgcauugccc

SEQ ID NO: 2610980 - RNA, 13 nt, Escherichia coli CFT073
ucgccgccagcgg

SEQ ID NO: 2610981 - RNA, 20 nt, Escherichia coli CFT073
ucgccgccagcgucugagca

SEQ ID NO: 2610982 - RNA, 16 nt, Escherichia coli CFT073
ucgccgccaguuccag

SEQ ID NO: 2610983 - RNA, 14 nt, Escherichia coli CFT073
ucgccgccgaggcg

SEQ ID NO: 2610984 - RNA, 21 nt, Escherichia coli CFT073
ucgccgccgcauaucaucaag

SEQ ID NO: 2610985 - RNA, 18 nt, Escherichia coli CFT073
ucgccgcgcuccaucaug

SEQ ID NO: 2610986 - RNA, 19 nt, Escherichia coli CFT073
ucgccgcugcgaucgcaaa

SEQ ID NO: 2610987 - RNA, 18 nt, Escherichia coli CFT073
ucgccgcugcgauuucag

SEQ ID NO: 2610988 - RNA, 23 nt, Escherichia coli CFT073
ucgccggaauuucuuucagcagu

SEQ ID NO: 2610989 - RNA, 22 nt, Escherichia coli CFT073
ucgccgggaguuucagcggcgu

SEQ ID NO: 2610990 - RNA, 23 nt, Escherichia coli CFT073
ucgccgggauauaugucaccagc

SEQ ID NO: 2610991 - RNA, 23 nt, Escherichia coli CFT073
ucgccggucaggauguugccacg

SEQ ID NO: 2610992 - RNA, 15 nt, Escherichia coli CFT073
ucgccgguuuuucaa

SEQ ID NO: 2610993 - RNA, 15 nt, Escherichia coli CFT073
ucgccguaaacauca

SEQ ID NO: 2610994 - RNA, 18 nt, Escherichia coli CFT073
ucgccgucaaaaggcgug

SEQ ID NO: 2610995 - RNA, 18 nt, Escherichia coli CFT073
ucgccguuaccagcaccg

SEQ ID NO: 2610996 - RNA, 18 nt, Escherichia coli CFT073
ucgccguuccggcgguga

SEQ ID NO: 2610997 - RNA, 17 nt, Escherichia coli CFT073
ucgccucguugauguuc

SEQ ID NO: 2610998 - RNA, 15 nt, Escherichia coli CFT073
ucgccugaugcgaca

SEQ ID NO: 2610999 - RNA, 15 nt, Escherichia coli CFT073
ucgccugccacaucc

SEQ ID NO: 2611000 - RNA, 13 nt, Escherichia coli CFT073
ucgccugccagau

SEQ ID NO: 2611001 - RNA, 20 nt, Escherichia coli CFT073
ucgccugcgaaucuaaauca

SEQ ID NO: 2611002 - RNA, 13 nt, Escherichia coli CFT073
ucgccugcggcgc

SEQ ID NO: 2611003 - RNA, 21 nt, Escherichia coli CFT073
ucgccuuaugcugcuucauug

SEQ ID NO: 2611004 - RNA, 16 nt, Escherichia coli CFT073
ucgccuuccagcagcu

SEQ ID NO: 2611005 - RNA, 19 nt, Escherichia coli CFT073
ucgccuugcguaccggcgu

SEQ ID NO: 2611006 - RNA, 15 nt, Escherichia coli CFT073
ucgccuugcugccag

SEQ ID NO: 2611007 - RNA, 12 nt, Escherichia coli CFT073
ucgcgaaaaaaa

SEQ ID NO: 2611008 - RNA, 21 nt, Escherichia coli CFT073
ucgcgaaucgccacaacuuca

SEQ ID NO: 2611009 - RNA, 12 nt, Escherichia coli CFT073
ucgcgaaugcuu

SEQ ID NO: 2611010 - RNA, 21 nt, Escherichia coli CFT073
ucgcgaaugcuuaacgccaga

SEQ ID NO: 2611011 - RNA, 14 nt, Escherichia coli CFT073
ucgcgaauucaugu

SEQ ID NO: 2611012 - RNA, 18 nt, Escherichia coli CFT073
ucgcgacaucgcccggcg

SEQ ID NO: 2611013 - RNA, 23 nt, Escherichia coli CFT073
ucgcgaccgccucacgccagcgu

SEQ ID NO: 2611014 - RNA, 18 nt, Escherichia coli CFT073
ucgcgaccgccuucaguc

SEQ ID NO: 2611015 - RNA, 18 nt, Escherichia coli CFT073
ucgcgacgaccacccacc

SEQ ID NO: 2611016 - RNA, 17 nt, Escherichia coli CFT073
ucgcgagaacggcgcac

SEQ ID NO: 2611017 - RNA, 15 nt, Escherichia coli CFT073
ucgcgaguucgaguc

SEQ ID NO: 2611018 - RNA, 15 nt, Escherichia coli CFT073
ucgcgauacgcuuca

SEQ ID NO: 2611019 - RNA, 18 nt, Escherichia coli CFT073
ucgcgauacgcuucaacc

SEQ ID NO: 2611020 - RNA, 15 nt, Escherichia coli CFT073
ucgcgauauugcugc

SEQ ID NO: 2611021 - RNA, 13 nt, Escherichia coli CFT073
ucgcgcaccagcg

SEQ ID NO: 2611022 - RNA, 13 nt, Escherichia coli CFT073
ucgcgcagcacuu

SEQ ID NO: 2611023 - RNA, 22 nt, Escherichia coli CFT073
ucgcgcagcgguuuuacaggaa

SEQ ID NO: 2611024 - RNA, 16 nt, Escherichia coli CFT073
ucgcgcagcucaucaa

SEQ ID NO: 2611025 - RNA, 18 nt, Escherichia coli CFT073
ucgcgcaguuuaugcagu

SEQ ID NO: 2611026 - RNA, 16 nt, Escherichia coli CFT073
ucgcgccaaacucggu

SEQ ID NO: 2611027 - RNA, 15 nt, Escherichia coli CFT073
ucgcgccaaccagga

SEQ ID NO: 2611028 - RNA, 17 nt, Escherichia coli CFT073
ucgcgccaucaaaucug

SEQ ID NO: 2611029 - RNA, 16 nt, Escherichia coli CFT073
ucgcgcccaaccagca

SEQ ID NO: 2611030 - RNA, 19 nt, Escherichia coli CFT073
ucgcgcccaaccagcaggu

SEQ ID NO: 2611031 - RNA, 17 nt, Escherichia coli CFT073
ucgcgcgccuuacgggc

SEQ ID NO: 2611032 - RNA, 12 nt, Escherichia coli CFT073
ucgcgcgcugcc

SEQ ID NO: 2611033 - RNA, 15 nt, Escherichia coli CFT073
ucgcgcucaucaggu

SEQ ID NO: 2611034 - RNA, 17 nt, Escherichia coli CFT073
ucgcggaauauccagua

SEQ ID NO: 2611035 - RNA, 17 nt, Escherichia coli CFT073
ucgcggcaaacugcaug

SEQ ID NO: 2611036 - RNA, 19 nt, Escherichia coli CFT073
ucgcggcacagaaacgcca

SEQ ID NO: 2611037 - RNA, 21 nt, Escherichia coli CFT073
ucgcggcugacguaaucauga

SEQ ID NO: 2611038 - RNA, 17 nt, Escherichia coli CFT073
ucgcggguaaugucucg

SEQ ID NO: 2611039 - RNA, 15 nt, Escherichia coli CFT073
ucgcggucagcugcu

SEQ ID NO: 2611040 - RNA, 18 nt, Escherichia coli CFT073
ucgcgguuaugccgccga

SEQ ID NO: 2611041 - RNA, 22 nt, Escherichia coli CFT073
ucgcguaaugcuucuaccgucu

SEQ ID NO: 2611042 - RNA, 21 nt, Escherichia coli CFT073
ucgcgucgccggucaggaugu

SEQ ID NO: 2611043 - RNA, 19 nt, Escherichia coli CFT073
ucgcguucgauagcgcgcc

SEQ ID NO: 2611044 - RNA, 17 nt, Escherichia coli CFT073
ucgcguugucauacgag

SEQ ID NO: 2611045 - RNA, 19 nt, Escherichia coli CFT073
ucgcuaagcggcuccgguc

SEQ ID NO: 2611046 - RNA, 20 nt, Escherichia coli CFT073
ucgcuaaggguauagaaacc

SEQ ID NO: 2611047 - RNA, 20 nt, Escherichia coli CFT073
ucgcuacaccaaucgucaau

SEQ ID NO: 2611048 - RNA, 15 nt, Escherichia coli CFT073
ucgcuagaagcuccg

SEQ ID NO: 2611049 - RNA, 18 nt, Escherichia coli CFT073
ucgcuagauauauauuau

SEQ ID NO: 2611050 - RNA, 23 nt, Escherichia coli CFT073
ucgcuauagacaccuugcaacuc

SEQ ID NO: 2611051 - RNA, 14 nt, Escherichia coli CFT073
ucgcuauucaacgu

SEQ ID NO: 2611052 - RNA, 16 nt, Escherichia coli CFT073
ucgcucaauauccuga

SEQ ID NO: 2611053 - RNA, 12 nt, Escherichia coli CFT073
ucgcucacauca

SEQ ID NO: 2611054 - RNA, 19 nt, Escherichia coli CFT073
ucgcucacuucacgcugcc

SEQ ID NO: 2611055 - RNA, 22 nt, Escherichia coli CFT073
ucgcucaguugggccagaaagg

SEQ ID NO: 2611056 - RNA, 14 nt, Escherichia coli CFT073
ucgcucauagaaua

SEQ ID NO: 2611057 - RNA, 18 nt, Escherichia coli CFT073
ucgcucuucacauccugc

SEQ ID NO: 2611058 - RNA, 15 nt, Escherichia coli CFT073
ucgcugaaccgccaa

SEQ ID NO: 2611059 - RNA, 20 nt, Escherichia coli CFT073
ucgcugaacgggccauccau

SEQ ID NO: 2611060 - RNA, 21 nt, Escherichia coli CFT073
ucgcugaacgggccauccauc

SEQ ID NO: 2611061 - RNA, 18 nt, Escherichia coli CFT073
ucgcugaauaucuaauua

SEQ ID NO: 2611062 - RNA, 21 nt, Escherichia coli CFT073
ucgcugaauaucuaauuauua

SEQ ID NO: 2611063 - RNA, 13 nt, Escherichia coli CFT073
ucgcugacaugug

SEQ ID NO: 2611064 - RNA, 20 nt, Escherichia coli CFT073
ucgcugauauacccuucauc

SEQ ID NO: 2611065 - RNA, 22 nt, Escherichia coli CFT073
ucgcugaugaauuuaucuuuca

SEQ ID NO: 2611066 - RNA, 17 nt, Escherichia coli CFT073
ucgcugauucgcuucaa

SEQ ID NO: 2611067 - RNA, 18 nt, Escherichia coli CFT073
ucgcugcaaaacagguca

SEQ ID NO: 2611068 - RNA, 11 nt, Escherichia coli CFT073
ucgcugccaca

SEQ ID NO: 2611069 - RNA, 22 nt, Escherichia coli CFT073
ucgcugcuaauuuaucggcguu

SEQ ID NO: 2611070 - RNA, 19 nt, Escherichia coli CFT073
ucgcugcucacaccaugcc

SEQ ID NO: 2611071 - RNA, 14 nt, Escherichia coli CFT073
ucgcugcugccugc

SEQ ID NO: 2611072 - RNA, 18 nt, Escherichia coli CFT073
ucgcuggaggcaucugau

SEQ ID NO: 2611073 - RNA, 21 nt, Escherichia coli CFT073
ucgcuggauguuggcggcaac

SEQ ID NO: 2611074 - RNA, 13 nt, Escherichia coli CFT073
ucgcuggcaggcc

SEQ ID NO: 2611075 - RNA, 21 nt, Escherichia coli CFT073
ucgcuggcguuguccgccaga

SEQ ID NO: 2611076 - RNA, 18 nt, Escherichia coli CFT073
ucgcugguguacugcaac

SEQ ID NO: 2611077 - RNA, 16 nt, Escherichia coli CFT073
ucgcuguacucaccaa

SEQ ID NO: 2611078 - RNA, 19 nt, Escherichia coli CFT073
ucgcugucgccaccccagu

SEQ ID NO: 2611079 - RNA, 14 nt, Escherichia coli CFT073
ucgcugucuuucaa

SEQ ID NO: 2611080 - RNA, 17 nt, Escherichia coli CFT073
ucgcuguguaaacccag

SEQ ID NO: 2611081 - RNA, 17 nt, Escherichia coli CFT073
ucgcuguuggcgauaag

SEQ ID NO: 2611082 - RNA, 23 nt, Escherichia coli CFT073
ucgcuguuuuucggaucgaggcg

SEQ ID NO: 2611083 - RNA, 13 nt, Escherichia coli CFT073
ucgcuuaagccau

SEQ ID NO: 2611084 - RNA, 22 nt, Escherichia coli CFT073
ucgcuuaagccaucaucaauau

SEQ ID NO: 2611085 - RNA, 23 nt, Escherichia coli CFT073
ucgcuuaauagguuaaugacgaa

SEQ ID NO: 2611086 - RNA, 21 nt, Escherichia coli CFT073
ucgcuuaauggaaaacuguuu

SEQ ID NO: 2611087 - RNA, 17 nt, Escherichia coli CFT073
ucgcuuagagcccaugc

SEQ ID NO: 2611088 - RNA, 17 nt, Escherichia coli CFT073
ucgcuuaucaggcauug

SEQ ID NO: 2611089 - RNA, 18 nt, Escherichia coli CFT073
ucgcuucaagcauugauu

SEQ ID NO: 2611090 - RNA, 18 nt, Escherichia coli CFT073
ucgcuucaauacgcucca

SEQ ID NO: 2611091 - RNA, 23 nt, Escherichia coli CFT073
ucgcuucaauacgcuccaguacc

SEQ ID NO: 2611092 - RNA, 12 nt, Escherichia coli CFT073
ucgcuucauuua

SEQ ID NO: 2611093 - RNA, 20 nt, Escherichia coli CFT073
ucgcuuccggugaaucaauc

SEQ ID NO: 2611094 - RNA, 13 nt, Escherichia coli CFT073
ucgcuuccuccac

SEQ ID NO: 2611095 - RNA, 16 nt, Escherichia coli CFT073
ucgcuuccuccaccac

SEQ ID NO: 2611096 - RNA, 18 nt, Escherichia coli CFT073
ucgcuuccuccaccacuu

SEQ ID NO: 2611097 - RNA, 23 nt, Escherichia coli CFT073
ucgcuucgauucccagcuuuuaa

SEQ ID NO: 2611098 - RNA, 21 nt, Escherichia coli CFT073
ucgcuucgcuaacauuuuagu

SEQ ID NO: 2611099 - RNA, 16 nt, Escherichia coli CFT073
ucgcuuuaaacggcug

SEQ ID NO: 2611100 - RNA, 13 nt, Escherichia coli CFT073
ucgcuuuccaggu

SEQ ID NO: 2611101 - RNA, 13 nt, Escherichia coli CFT073
ucgcuuucucuuc

SEQ ID NO: 2611102 - RNA, 17 nt, Escherichia coli CFT073
ucgcuuuuaugccuggc

SEQ ID NO: 2611103 - RNA, 17 nt, Escherichia coli CFT073
ucgcuuuuauuucugcu

SEQ ID NO: 2611104 - RNA, 19 nt, Escherichia coli CFT073
ucggacauguuuuccagca

SEQ ID NO: 2611105 - RNA, 15 nt, Escherichia coli CFT073
ucggaccaaugccca

SEQ ID NO: 2611106 - RNA, 19 nt, Escherichia coli CFT073
ucggacgcggcacgcccug

SEQ ID NO: 2611107 - RNA, 21 nt, Escherichia coli CFT073
ucggagaacugcaacucaccu

SEQ ID NO: 2611108 - RNA, 18 nt, Escherichia coli CFT073
ucggagcucccccucuuc

SEQ ID NO: 2611109 - RNA, 20 nt, Escherichia coli CFT073
ucggagcucccccucuuccg

SEQ ID NO: 2611110 - RNA, 16 nt, Escherichia coli CFT073
ucggagguucgaaucc

SEQ ID NO: 2611111 - RNA, 15 nt, Escherichia coli CFT073
ucggauaaccaauca

SEQ ID NO: 2611112 - RNA, 13 nt, Escherichia coli CFT073
ucggauaaggcgu

SEQ ID NO: 2611113 - RNA, 17 nt, Escherichia coli CFT073
ucggauaaggcguucac

SEQ ID NO: 2611114 - RNA, 14 nt, Escherichia coli CFT073
ucggauaaggcuuc

SEQ ID NO: 2611115 - RNA, 19 nt, Escherichia coli CFT073
ucggauauuuuccagcaac

SEQ ID NO: 2611116 - RNA, 17 nt, Escherichia coli CFT073
ucggaucaauccccaga

SEQ ID NO: 2611117 - RNA, 17 nt, Escherichia coli CFT073
ucggaucgcgugcggca

SEQ ID NO: 2611118 - RNA, 21 nt, Escherichia coli CFT073
ucggaugacccagcgccagca

SEQ ID NO: 2611119 - RNA, 21 nt, Escherichia coli CFT073
ucggaugcggcgugaacgccu

SEQ ID NO: 2611120 - RNA, 16 nt, Escherichia coli CFT073
ucggauuacccggcau

SEQ ID NO: 2611121 - RNA, 17 nt, Escherichia coli CFT073
ucggauuacccggcauc

SEQ ID NO: 2611122 - RNA, 23 nt, Escherichia coli CFT073
ucggcaaaaauaaucucaccauu

SEQ ID NO: 2611123 - RNA, 14 nt, Escherichia coli CFT073
ucggcaaaauacau

SEQ ID NO: 2611124 - RNA, 16 nt, Escherichia coli CFT073
ucggcaaacaguugcu

SEQ ID NO: 2611125 - RNA, 17 nt, Escherichia coli CFT073
ucggcaaggccaauacc

SEQ ID NO: 2611126 - RNA, 18 nt, Escherichia coli CFT073
ucggcaaucacaucguag

SEQ ID NO: 2611127 - RNA, 16 nt, Escherichia coli CFT073
ucggcaauuucagugc

SEQ ID NO: 2611128 - RNA, 18 nt, Escherichia coli CFT073
ucggcaauuucagugcug

SEQ ID NO: 2611129 - RNA, 22 nt, Escherichia coli CFT073
ucggcacccaucgccagcacuu

SEQ ID NO: 2611130 - RNA, 18 nt, Escherichia coli CFT073
ucggcaccgccgccaaag

SEQ ID NO: 2611131 - RNA, 22 nt, Escherichia coli CFT073
ucggcacugaccaccaccaccu

SEQ ID NO: 2611132 - RNA, 21 nt, Escherichia coli CFT073
ucggcagcagaccaaucugga

SEQ ID NO: 2611133 - RNA, 15 nt, Escherichia coli CFT073
ucggcaggaaaauag

SEQ ID NO: 2611134 - RNA, 20 nt, Escherichia coli CFT073
ucggcaggguauugcgcgcc

SEQ ID NO: 2611135 - RNA, 11 nt, Escherichia coli CFT073
ucggcaguuuu

SEQ ID NO: 2611136 - RNA, 20 nt, Escherichia coli CFT073
ucggcaguuuuaccgccgga

SEQ ID NO: 2611137 - RNA, 19 nt, Escherichia coli CFT073
ucggcauacaccaccacau

SEQ ID NO: 2611138 - RNA, 21 nt, Escherichia coli CFT073
ucggcauauaccgucagcguc

SEQ ID NO: 2611139 - RNA, 22 nt, Escherichia coli CFT073
ucggcauauaccgucagcgucu

SEQ ID NO: 2611140 - RNA, 14 nt, Escherichia coli CFT073
ucggcaucaauaaa

SEQ ID NO: 2611141 - RNA, 21 nt, Escherichia coli CFT073
ucggcaucaauaaagccggua

SEQ ID NO: 2611142 - RNA, 20 nt, Escherichia coli CFT073
ucggcauggaucgccgcggu

SEQ ID NO: 2611143 - RNA, 22 nt, Escherichia coli CFT073
ucggccaguauuugucugccac

SEQ ID NO: 2611144 - RNA, 15 nt, Escherichia coli CFT073
ucggcccguguccca

SEQ ID NO: 2611145 - RNA, 21 nt, Escherichia coli CFT073
ucggccuaccaugaucugcaa

SEQ ID NO: 2611146 - RNA, 22 nt, Escherichia coli CFT073
ucggccuaccaugaucugcaaa

SEQ ID NO: 2611147 - RNA, 15 nt, Escherichia coli CFT073
ucggcgcacaaccgc

SEQ ID NO: 2611148 - RNA, 22 nt, Escherichia coli CFT073
ucggcgcuacggcguuucacuu

SEQ ID NO: 2611149 - RNA, 15 nt, Escherichia coli CFT073
ucggcgcugaccacu

SEQ ID NO: 2611150 - RNA, 18 nt, Escherichia coli CFT073
ucggcggugacuagcagc

SEQ ID NO: 2611151 - RNA, 20 nt, Escherichia coli CFT073
ucggcggugacuagcagcau

SEQ ID NO: 2611152 - RNA, 20 nt, Escherichia coli CFT073
ucggcgguuuuuuauugccu

SEQ ID NO: 2611153 - RNA, 19 nt, Escherichia coli CFT073
ucggcguaauccugaaagc

SEQ ID NO: 2611154 - RNA, 18 nt, Escherichia coli CFT073
ucggcgucauuuugucga

SEQ ID NO: 2611155 - RNA, 11 nt, Escherichia coli CFT073
ucggcgucgcc

SEQ ID NO: 2611156 - RNA, 15 nt, Escherichia coli CFT073
ucggcgucgguuucg

SEQ ID NO: 2611157 - RNA, 22 nt, Escherichia coli CFT073
ucggcgugaacgcgcucgacuu

SEQ ID NO: 2611158 - RNA, 17 nt, Escherichia coli CFT073
ucggcgugcaucucuuc

SEQ ID NO: 2611159 - RNA, 17 nt, Escherichia coli CFT073
ucggcuccguuauucaa

SEQ ID NO: 2611160 - RNA, 21 nt, Escherichia coli CFT073
ucggcugcgcuucuuccagca

SEQ ID NO: 2611161 - RNA, 22 nt, Escherichia coli CFT073
ucggcugcguaccuucgaugaa

SEQ ID NO: 2611162 - RNA, 15 nt, Escherichia coli CFT073
ucggcuucacgccca

SEQ ID NO: 2611163 - RNA, 22 nt, Escherichia coli CFT073
ucggcuucuaccuuauccagca

SEQ ID NO: 2611164 - RNA, 18 nt, Escherichia coli CFT073
ucggcuugaguucauaua

SEQ ID NO: 2611165 - RNA, 22 nt, Escherichia coli CFT073
ucggcuuuauuuuccagcguua

SEQ ID NO: 2611166 - RNA, 16 nt, Escherichia coli CFT073
ucggcuuuuuucucaa

SEQ ID NO: 2611167 - RNA, 18 nt, Escherichia coli CFT073
ucgggaacgcuuuugcau

SEQ ID NO: 2611168 - RNA, 17 nt, Escherichia coli CFT073
ucgggaagaucaccaca

SEQ ID NO: 2611169 - RNA, 22 nt, Escherichia coli CFT073
ucgggaaggcccuuucccuucu

SEQ ID NO: 2611170 - RNA, 13 nt, Escherichia coli CFT073
ucgggaccaacgc

SEQ ID NO: 2611171 - RNA, 21 nt, Escherichia coli CFT073
ucgggauaucgccgguaguca

SEQ ID NO: 2611172 - RNA, 23 nt, Escherichia coli CFT073
ucgggaugagcaucgugccggaa

SEQ ID NO: 2611173 - RNA, 21 nt, Escherichia coli CFT073
ucgggcaacguugaccaguca

SEQ ID NO: 2611174 - RNA, 15 nt, Escherichia coli CFT073
ucgggcagcuaacag

SEQ ID NO: 2611175 - RNA, 17 nt, Escherichia coli CFT073
ucgggcaggcuucaaca

SEQ ID NO: 2611176 - RNA, 15 nt, Escherichia coli CFT073
ucgggcauuuccauu

SEQ ID NO: 2611177 - RNA, 14 nt, Escherichia coli CFT073
ucgggcggaaaacu

SEQ ID NO: 2611178 - RNA, 18 nt, Escherichia coli CFT073
ucggggagaaaguuucaa

SEQ ID NO: 2611179 - RNA, 23 nt, Escherichia coli CFT073
ucggggcgaucgcgccaaucagc

SEQ ID NO: 2611180 - RNA, 19 nt, Escherichia coli CFT073
ucgggggagacgggcggag

SEQ ID NO: 2611181 - RNA, 19 nt, Escherichia coli CFT073
ucggguaaauaauaucccc

SEQ ID NO: 2611182 - RNA, 22 nt, Escherichia coli CFT073
ucggguccgggcaucaacagca

SEQ ID NO: 2611183 - RNA, 15 nt, Escherichia coli CFT073
ucguguccggcaaua

SEQ ID NO: 2611184 - RNA, 13 nt, Escherichia coli CFT073
ucguuaaucgccu

SEQ ID NO: 2611185 - RNA, 14 nt, Escherichia coli CFT073
ucguuaaugcgccc

SEQ ID NO: 2611186 - RNA, 18 nt, Escherichia coli CFT073
ucguuaaugcgcccagua

SEQ ID NO: 2611187 - RNA, 15 nt, Escherichia coli CFT073
ucguuaauuucugcu

SEQ ID NO: 2611188 - RNA, 16 nt, Escherichia coli CFT073
ucguuaccguguaguc

SEQ ID NO: 2611189 - RNA, 22 nt, Escherichia coli CFT073
ucguuaccuuugcagucaaauc

SEQ ID NO: 2611190 - RNA, 13 nt, Escherichia coli CFT073
ucguucacaaaca

SEQ ID NO: 2611191 - RNA, 22 nt, Escherichia coli CFT073
ucguucauaccacgccaucaac

SEQ ID NO: 2611192 - RNA, 19 nt, Escherichia coli CFT073
ucguucccaccucgugcac

SEQ ID NO: 2611193 - RNA, 15 nt, Escherichia coli CFT073
ucguucgccagcucc

SEQ ID NO: 2611194 - RNA, 17 nt, Escherichia coli CFT073
ucguucgcgccaacagc

SEQ ID NO: 2611195 - RNA, 14 nt, Escherichia coli CFT073
ucguugaagucagg

SEQ ID NO: 2611196 - RNA, 20 nt, Escherichia coli CFT073
ucguugaguuugauuccugc

SEQ ID NO: 2611197 - RNA, 16 nt, Escherichia coli CFT073
ucguugauaccgugcg

SEQ ID NO: 2611198 - RNA, 19 nt, Escherichia coli CFT073
ucguugauuucaccaucuu

SEQ ID NO: 2611199 - RNA, 23 nt, Escherichia coli CFT073
ucguugcccgcagauccagugcu

SEQ ID NO: 2611200 - RNA, 22 nt, Escherichia coli CFT073
ucguugcgccgggaugauggcu

SEQ ID NO: 2611201 - RNA, 22 nt, Escherichia coli CFT073
ucguugcugucgcgcagcacuu

SEQ ID NO: 2611202 - RNA, 15 nt, Escherichia coli CFT073
ucguuggcagacguu

SEQ ID NO: 2611203 - RNA, 20 nt, Escherichia coli CFT073
ucguugguacgaucagaguu

SEQ ID NO: 2611204 - RNA, 15 nt, Escherichia coli CFT073
ucguuguaacugucu

SEQ ID NO: 2611205 - RNA, 18 nt, Escherichia coli CFT073
ucguugugccuuccaucc

SEQ ID NO: 2611206 - RNA, 21 nt, Escherichia coli CFT073
ucguugugggccgaaaugaga

SEQ ID NO: 2611207 - RNA, 14 nt, Escherichia coli CFT073
ucguuuauuucgcg

SEQ ID NO: 2611208 - RNA, 20 nt, Escherichia coli CFT073
ucguuuugcuguuccagcau

SEQ ID NO: 2611209 - RNA, 20 nt, Escherichia coli CFT073
ucuaaagcaacuccaucaag

SEQ ID NO: 2611210 - RNA, 21 nt, Escherichia coli CFT073
ucuaacaaucuugccauucca

SEQ ID NO: 2611211 - RNA, 16 nt, Escherichia coli CFT073
ucuaacucuucugaaa

SEQ ID NO: 2611212 - RNA, 22 nt, Escherichia coli CFT073
ucuaagcugacuugcucaaucu

SEQ ID NO: 2611213 - RNA, 22 nt, Escherichia coli CFT073
ucuaagucuuucugugcaauca

SEQ ID NO: 2611214 - RNA, 14 nt, Escherichia coli CFT073
ucuaauaaacauug

SEQ ID NO: 2611215 - RNA, 15 nt, Escherichia coli CFT073
ucuaaugacaaacgc

SEQ ID NO: 2611216 - RNA, 16 nt, Escherichia coli CFT073
ucuaaugauucauaaa

SEQ ID NO: 2611217 - RNA, 18 nt, Escherichia coli CFT073
ucuaaugauucauaaaca

SEQ ID NO: 2611218 - RNA, 22 nt, Escherichia coli CFT073
ucuacacccagccccgguuuuu

SEQ ID NO: 2611219 - RNA, 11 nt, Escherichia coli CFT073
ucuacaguacg

SEQ ID NO: 2611220 - RNA, 21 nt, Escherichia coli CFT073
ucuacaguagccuuuuuuaau

SEQ ID NO: 2611221 - RNA, 15 nt, Escherichia coli CFT073
ucuacauguguucug

SEQ ID NO: 2611222 - RNA, 19 nt, Escherichia coli CFT073
ucuacauuucuguaguccc

SEQ ID NO: 2611223 - RNA, 16 nt, Escherichia coli CFT073
ucuaccagcacgcagg

SEQ ID NO: 2611224 - RNA, 18 nt, Escherichia coli CFT073
ucuaccgauccggcacca

SEQ ID NO: 2611225 - RNA, 14 nt, Escherichia coli CFT073
ucuaccgcaccuuc

SEQ ID NO: 2611226 - RNA, 23 nt, Escherichia coli CFT073
ucuaccgggcugagucccccaag

SEQ ID NO: 2611227 - RNA, 22 nt, Escherichia coli CFT073
ucuaccuguucgcgguuuucuu

SEQ ID NO: 2611228 - RNA, 17 nt, Escherichia coli CFT073
ucuaccuuauccagcag

SEQ ID NO: 2611229 - RNA, 19 nt, Escherichia coli CFT073
ucuaccuuauccagcagau

SEQ ID NO: 2611230 - RNA, 22 nt, Escherichia coli CFT073
ucuaccuuccuacaagagguca

SEQ ID NO: 2611231 - RNA, 16 nt, Escherichia coli CFT073
ucuacgaacugagacu

SEQ ID NO: 2611232 - RNA, 22 nt, Escherichia coli CFT073
ucuacgaacugagacugucugu

SEQ ID NO: 2611233 - RNA, 16 nt, Escherichia coli CFT073
ucuacgccaucaguuu

SEQ ID NO: 2611234 - RNA, 23 nt, Escherichia coli CFT073
ucuacggaagaguuuuucaggcu

SEQ ID NO: 2611235 - RNA, 16 nt, Escherichia coli CFT073
ucuacuaacuggcaau

SEQ ID NO: 2611236 - RNA, 16 nt, Escherichia coli CFT073
ucuacuuauucaccac

SEQ ID NO: 2611237 - RNA, 21 nt, Escherichia coli CFT073
ucuacuucacggcugcuaaua

SEQ ID NO: 2611238 - RNA, 17 nt, Escherichia coli CFT073
ucuacuucuuucaccau

SEQ ID NO: 2611239 - RNA, 15 nt, Escherichia coli CFT073
ucuacuuuuucuuaa

SEQ ID NO: 2611240 - RNA, 18 nt, Escherichia coli CFT073
ucuacuuuuucuuaacgu

SEQ ID NO: 2611241 - RNA, 17 nt, Escherichia coli CFT073
ucuaucacuauaaauau

SEQ ID NO: 2611242 - RNA, 11 nt, Escherichia coli CFT073
ucuauccagcc

SEQ ID NO: 2611243 - RNA, 22 nt, Escherichia coli CFT073
ucuaucccuucaagcguccauu

SEQ ID NO: 2611244 - RNA, 18 nt, Escherichia coli CFT073
ucuaucgcauuauccuuu

SEQ ID NO: 2611245 - RNA, 20 nt, Escherichia coli CFT073
ucuaucgccgguugauuuuu

SEQ ID NO: 2611246 - RNA, 10 nt, Escherichia coli CFT073
ucuaucugcc

SEQ ID NO: 2611247 - RNA, 14 nt, Escherichia coli CFT073
ucuauuaaccaaua

SEQ ID NO: 2611248 - RNA, 14 nt, Escherichia coli CFT073
ucuauucaccagca

SEQ ID NO: 2611249 - RNA, 24 nt, Escherichia coli CFT073
ucuauucgaccacgcugcgcugca

SEQ ID NO: 2611250 - RNA, 21 nt, Escherichia coli CFT073
ucuauugcaggggcuuauaua

SEQ ID NO: 2611251 - RNA, 22 nt, Escherichia coli CFT073
ucuauugcaggggcuuauauag

SEQ ID NO: 2611252 - RNA, 12 nt, Escherichia coli CFT073
ucucaaaacuga

SEQ ID NO: 2611253 - RNA, 18 nt, Escherichia coli CFT073
ucucaauaccaaugaauu

SEQ ID NO: 2611254 - RNA, 19 nt, Escherichia coli CFT073
ucucaaucgcacccgccau

SEQ ID NO: 2611255 - RNA, 18 nt, Escherichia coli CFT073
ucucaauguauucccgua

SEQ ID NO: 2611256 - RNA, 13 nt, Escherichia coli CFT073
ucucaauuaccgu

SEQ ID NO: 2611257 - RNA, 17 nt, Escherichia coli CFT073
ucucaauuccuuugcug

SEQ ID NO: 2611258 - RNA, 18 nt, Escherichia coli CFT073
ucucaauuccuuugcugc

SEQ ID NO: 2611259 - RNA, 16 nt, Escherichia coli CFT073
ucucacaaucaucgca

SEQ ID NO: 2611260 - RNA, 21 nt, Escherichia coli CFT073
ucucaccaucaaacagccccu

SEQ ID NO: 2611261 - RNA, 18 nt, Escherichia coli CFT073
ucucaccgcaggcggcaa

SEQ ID NO: 2611262 - RNA, 15 nt, Escherichia coli CFT073
ucucaccuacagcca

SEQ ID NO: 2611263 - RNA, 21 nt, Escherichia coli CFT073
ucucacgacgcugguuacauc

SEQ ID NO: 2611264 - RNA, 19 nt, Escherichia coli CFT073
ucucacguccaccaaugcc

SEQ ID NO: 2611265 - RNA, 14 nt, Escherichia coli CFT073
ucucacucuuuccc

SEQ ID NO: 2611266 - RNA, 18 nt, Escherichia coli CFT073
ucucacuuggguaacagc

SEQ ID NO: 2611267 - RNA, 20 nt, Escherichia coli CFT073
ucucacuuggguaacagccc

SEQ ID NO: 2611268 - RNA, 15 nt, Escherichia coli CFT073
ucucagauaaaugca

SEQ ID NO: 2611269 - RNA, 24 nt, Escherichia coli CFT073
ucucaguuguuugcggaauaugcu

SEQ ID NO: 2611270 - RNA, 20 nt, Escherichia coli CFT073
ucucauagacuuuacuaaua

SEQ ID NO: 2611271 - RNA, 13 nt, Escherichia coli CFT073
ucucauccaucaa

SEQ ID NO: 2611272 - RNA, 15 nt, Escherichia coli CFT073
ucucauccggccugg

SEQ ID NO: 2611273 - RNA, 13 nt, Escherichia coli CFT073
ucucaucggcguc

SEQ ID NO: 2611274 - RNA, 21 nt, Escherichia coli CFT073
ucucaucuuucagaaucagau

SEQ ID NO: 2611275 - RNA, 13 nt, Escherichia coli CFT073
ucucauuuuucag

SEQ ID NO: 2611276 - RNA, 15 nt, Escherichia coli CFT073
ucuccaaccagcugu

SEQ ID NO: 2611277 - RNA, 17 nt, Escherichia coli CFT073
ucuccaaccagcuguuc

SEQ ID NO: 2611278 - RNA, 21 nt, Escherichia coli CFT073
ucuccacgcaggcguuucacu

SEQ ID NO: 2611279 - RNA, 21 nt, Escherichia coli CFT073
ucuccacucugccaggcagcg

SEQ ID NO: 2611280 - RNA, 14 nt, Escherichia coli CFT073
ucuccagacugcug

SEQ ID NO: 2611281 - RNA, 16 nt, Escherichia coli CFT073
ucuccagauaauuaug

SEQ ID NO: 2611282 - RNA, 21 nt, Escherichia coli CFT073
ucuccagcaucgaaaaugcca

SEQ ID NO: 2611283 - RNA, 22 nt, Escherichia coli CFT073
ucuccagcguugacgcuuuacu

SEQ ID NO: 2611284 - RNA, 12 nt, Escherichia coli CFT073
ucuccaguuccc

SEQ ID NO: 2611285 - RNA, 17 nt, Escherichia coli CFT073
ucuccaguuucgagaaa

SEQ ID NO: 2611286 - RNA, 23 nt, Escherichia coli CFT073
ucuccauacucguugacgaccag

SEQ ID NO: 2611287 - RNA, 19 nt, Escherichia coli CFT073
ucuccauuaccgcauuauc

SEQ ID NO: 2611288 - RNA, 15 nt, Escherichia coli CFT073
ucuccauuucauuga

SEQ ID NO: 2611289 - RNA, 13 nt, Escherichia coli CFT073
ucucccaguaagc

SEQ ID NO: 2611290 - RNA, 20 nt, Escherichia coli CFT073
ucucccauuuuauccucuuc

SEQ ID NO: 2611291 - RNA, 13 nt, Escherichia coli CFT073
ucugcauuuucuc

SEQ ID NO: 2611292 - RNA, 20 nt, Escherichia coli CFT073
ucugccaaacgcucccagcc

SEQ ID NO: 2611293 - RNA, 13 nt, Escherichia coli CFT073
ucugccacuucuu

SEQ ID NO: 2611294 - RNA, 23 nt, Escherichia coli CFT073
ucugccagacaaaacugacgcca

SEQ ID NO: 2611295 - RNA, 14 nt, Escherichia coli CFT073
ucugccagacgugu

SEQ ID NO: 2611296 - RNA, 20 nt, Escherichia coli CFT073
ucugccagccagucagucuc

SEQ ID NO: 2611297 - RNA, 21 nt, Escherichia coli CFT073
ucugccaggcagcgauuaacu

SEQ ID NO: 2611298 - RNA, 19 nt, Escherichia coli CFT073
ucugccaggugcagcccau

SEQ ID NO: 2611299 - RNA, 14 nt, Escherichia coli CFT073
ucugccaguacugc

SEQ ID NO: 2611300 - RNA, 18 nt, Escherichia coli CFT073
ucugccaguacugcaggu

SEQ ID NO: 2611301 - RNA, 21 nt, Escherichia coli CFT073
ucugccauuguugcuggaucc

SEQ ID NO: 2611302 - RNA, 19 nt, Escherichia coli CFT073
ucugccccgccaacagugc

SEQ ID NO: 2611303 - RNA, 15 nt, Escherichia coli CFT073
ucugccccgccgccg

SEQ ID NO: 2611304 - RNA, 12 nt, Escherichia coli CFT073
ucugcccggcau

SEQ ID NO: 2611305 - RNA, 21 nt, Escherichia coli CFT073
ucugcccguacccaacacucg

SEQ ID NO: 2611306 - RNA, 15 nt, Escherichia coli CFT073
ucugcccuuuaguau

SEQ ID NO: 2611307 - RNA, 13 nt, Escherichia coli CFT073
ucugccgcaauuc

SEQ ID NO: 2611308 - RNA, 16 nt, Escherichia coli CFT073
ucugccggaagacaca

SEQ ID NO: 2611309 - RNA, 13 nt, Escherichia coli CFT073
ucugccgguucca

SEQ ID NO: 2611310 - RNA, 20 nt, Escherichia coli CFT073
ucugccguaccaucgccagc

SEQ ID NO: 2611311 - RNA, 15 nt, Escherichia coli CFT073
ucugccgucaucgac

SEQ ID NO: 2611312 - RNA, 13 nt, Escherichia coli CFT073
ucugccucccauu

SEQ ID NO: 2611313 - RNA, 17 nt, Escherichia coli CFT073
ucugccugaucuuucug

SEQ ID NO: 2611314 - RNA, 23 nt, Escherichia coli CFT073
ucugccuugaguuuuucaucccu

SEQ ID NO: 2611315 - RNA, 21 nt, Escherichia coli CFT073
ucugcgaauugagaugacgcc

SEQ ID NO: 2611316 - RNA, 13 nt, Escherichia coli CFT073
ucugcgacagcca

SEQ ID NO: 2611317 - RNA, 13 nt, Escherichia coli CFT073
ucugcgacgcgcg

SEQ ID NO: 2611318 - RNA, 16 nt, Escherichia coli CFT073
ucugcgacgguuucug

SEQ ID NO: 2611319 - RNA, 21 nt, Escherichia coli CFT073
ucugcgacgguuucuggcgua

SEQ ID NO: 2611320 - RNA, 19 nt, Escherichia coli CFT073
ucugcgacgugcccuuuca

SEQ ID NO: 2611321 - RNA, 21 nt, Escherichia coli CFT073
ucugcgagcuuucgaccagcc

SEQ ID NO: 2611322 - RNA, 21 nt, Escherichia coli CFT073
ucugcgaucgucgugcgguga

SEQ ID NO: 2611323 - RNA, 12 nt, Escherichia coli CFT073
ucugcgcaaugc

SEQ ID NO: 2611324 - RNA, 20 nt, Escherichia coli CFT073
ucugcgcauuucccagcaag

SEQ ID NO: 2611325 - RNA, 14 nt, Escherichia coli CFT073
ucugcgccacgaaa

SEQ ID NO: 2611326 - RNA, 15 nt, Escherichia coli CFT073
ucugcgcccagcaac

SEQ ID NO: 2611327 - RNA, 19 nt, Escherichia coli CFT073
ucugcgccgaucgucgcuc

SEQ ID NO: 2611328 - RNA, 20 nt, Escherichia coli CFT073
ucugcgccuuugaugccacc

SEQ ID NO: 2611329 - RNA, 16 nt, Escherichia coli CFT073
ucugcgcgacggcggu

SEQ ID NO: 2611330 - RNA, 21 nt, Escherichia coli CFT073
ucugcgcggauagccagcauc

SEQ ID NO: 2611331 - RNA, 16 nt, Escherichia coli CFT073
ucugcgcuucugccac

SEQ ID NO: 2611332 - RNA, 22 nt, Escherichia coli CFT073
ucugcggcguaacgcaccaggc

SEQ ID NO: 2611333 - RNA, 14 nt, Escherichia coli CFT073
ucugcgucgcaucu

SEQ ID NO: 2611334 - RNA, 21 nt, Escherichia coli CFT073
ucugcguucucuucacgccaa

SEQ ID NO: 2611335 - RNA, 16 nt, Escherichia coli CFT073
ucugcuaauaauguaa

SEQ ID NO: 2611336 - RNA, 16 nt, Escherichia coli CFT073
ucugcuagauaagcaa

SEQ ID NO: 2611337 - RNA, 19 nt, Escherichia coli CFT073
ucugcuccaucgcaugcca

SEQ ID NO: 2611338 - RNA, 17 nt, Escherichia coli CFT073
ucugcucccggcaaugc

SEQ ID NO: 2611339 - RNA, 20 nt, Escherichia coli CFT073
ucugcugacgaaauugcuga

SEQ ID NO: 2611340 - RNA, 13 nt, Escherichia coli CFT073
ucugcugccgcua

SEQ ID NO: 2611341 - RNA, 12 nt, Escherichia coli CFT073
ucugcuggcaaa

SEQ ID NO: 2611342 - RNA, 17 nt, Escherichia coli CFT073
ucugcuggcaaacguca

SEQ ID NO: 2611343 - RNA, 18 nt, Escherichia coli CFT073
ucugcugucaccgaagcg

SEQ ID NO: 2611344 - RNA, 23 nt, Escherichia coli CFT073
ucugcuucguuaacgugucauaa

SEQ ID NO: 2611345 - RNA, 20 nt, Escherichia coli CFT073
ucuggaaauuaagcggcaaa

SEQ ID NO: 2611346 - RNA, 20 nt, Escherichia coli CFT073
ucuggaaccucgcgaaugcu

SEQ ID NO: 2611347 - RNA, 13 nt, Escherichia coli CFT073
ucuggaagaauag

SEQ ID NO: 2611348 - RNA, 19 nt, Escherichia coli CFT073
ucuggaagaauagucauca

SEQ ID NO: 2611349 - RNA, 23 nt, Escherichia coli CFT073
ucuggaauggaaacagcaccauc

SEQ ID NO: 2611350 - RNA, 17 nt, Escherichia coli CFT073
ucuggacuuccccugcc

SEQ ID NO: 2611351 - RNA, 13 nt, Escherichia coli CFT073
ucuggagaaauau

SEQ ID NO: 2611352 - RNA, 12 nt, Escherichia coli CFT073
ucuggagucgga

SEQ ID NO: 2611353 - RNA, 15 nt, Escherichia coli CFT073
ucuggaguguaaaaa

SEQ ID NO: 2611354 - RNA, 11 nt, Escherichia coli CFT073
ucuggauauac

SEQ ID NO: 2611355 - RNA, 15 nt, Escherichia coli CFT073
ucuggaugccaucgc

SEQ ID NO: 2611356 - RNA, 20 nt, Escherichia coli CFT073
ucuggaugccaucgcaugac

SEQ ID NO: 2611357 - RNA, 21 nt, Escherichia coli CFT073
ucuggauggcgcuccagcauc

SEQ ID NO: 2611358 - RNA, 23 nt, Escherichia coli CFT073
ucuggcaauucgugaugcccuga

SEQ ID NO: 2611359 - RNA, 21 nt, Escherichia coli CFT073
ucuggcaccgguacacaaccg

SEQ ID NO: 2611360 - RNA, 17 nt, Escherichia coli CFT073
ucuggcacugccgacaa

SEQ ID NO: 2611361 - RNA, 16 nt, Escherichia coli CFT073
ucuggcagauccugaa

SEQ ID NO: 2611362 - RNA, 17 nt, Escherichia coli CFT073
ucuggcagauccugaaa

SEQ ID NO: 2611363 - RNA, 20 nt, Escherichia coli CFT073
ucuggcagcaccacgcagaa

SEQ ID NO: 2611364 - RNA, 20 nt, Escherichia coli CFT073
ucuggcauaaacaaagcgca

SEQ ID NO: 2611365 - RNA, 16 nt, Escherichia coli CFT073
ucuggcaucggcgcac

SEQ ID NO: 2611366 - RNA, 21 nt, Escherichia coli CFT073
ucuggcaucggcgcacaaccg

SEQ ID NO: 2611367 - RNA, 21 nt, Escherichia coli CFT073
ucuggcauuaacgcgaaauaa

SEQ ID NO: 2611368 - RNA, 15 nt, Escherichia coli CFT073
ucuggccaguucgga

SEQ ID NO: 2611369 - RNA, 19 nt, Escherichia coli CFT073
ucuggccccaccugcucga

SEQ ID NO: 2611370 - RNA, 15 nt, Escherichia coli CFT073
ucuggcgaauuuaua

SEQ ID NO: 2611371 - RNA, 14 nt, Escherichia coli CFT073
ucuggcggaucuga

SEQ ID NO: 2611372 - RNA, 21 nt, Escherichia coli CFT073
ucuggcgucuccucccgagcg

SEQ ID NO: 2611373 - RNA, 19 nt, Escherichia coli CFT073
ucuggcuaaaacugauaau

SEQ ID NO: 2611374 - RNA, 19 nt, Escherichia coli CFT073
ucuggcucaucgccuucca

SEQ ID NO: 2611375 - RNA, 23 nt, Escherichia coli CFT073
ucuggcucgaauauaacuaauca

SEQ ID NO: 2611376 - RNA, 15 nt, Escherichia coli CFT073
ucuggcuguuucgcu

SEQ ID NO: 2611377 - RNA, 20 nt, Escherichia coli CFT073
ucugggcaaaaucaucacuc

SEQ ID NO: 2611378 - RNA, 17 nt, Escherichia coli CFT073
ucugguaacccauccag

SEQ ID NO: 2611379 - RNA, 17 nt, Escherichia coli CFT073
ucuggucaacaaccagu

SEQ ID NO: 2611380 - RNA, 14 nt, Escherichia coli CFT073
ucuggucuggugaa

SEQ ID NO: 2611381 - RNA, 13 nt, Escherichia coli CFT073
ucuggugaauauc

SEQ ID NO: 2611382 - RNA, 14 nt, Escherichia coli CFT073
ucuggugccagcgc

SEQ ID NO: 2611383 - RNA, 22 nt, Escherichia coli CFT073
ucugguucgccaaaugucacca

SEQ ID NO: 2611384 - RNA, 23 nt, Escherichia coli CFT073
ucugguucgccaaaugucaccag

SEQ ID NO: 2611385 - RNA, 13 nt, Escherichia coli CFT073
ucuguaacaaggu

SEQ ID NO: 2611386 - RNA, 21 nt, Escherichia coli CFT073
ucuguaacaggucaauuucaa

SEQ ID NO: 2611387 - RNA, 14 nt, Escherichia coli CFT073
ucuguaacucgaau

SEQ ID NO: 2611388 - RNA, 15 nt, Escherichia coli CFT073
ucuguaccaaaauug

SEQ ID NO: 2611389 - RNA, 15 nt, Escherichia coli CFT073
ucuguaccaccagaa

SEQ ID NO: 2611390 - RNA, 12 nt, Escherichia coli CFT073
ucuguauucauc

SEQ ID NO: 2611391 - RNA, 22 nt, Escherichia coli CFT073
ucugucacgcuggcaucaaucg

SEQ ID NO: 2611392 - RNA, 15 nt, Escherichia coli CFT073
ucugucagaaaugau

SEQ ID NO: 2611393 - RNA, 18 nt, Escherichia coli CFT073
ucugucaguuggcugugg

SEQ ID NO: 2611394 - RNA, 22 nt, Escherichia coli CFT073
ucuguccaaauccuucagcaau

SEQ ID NO: 2611395 - RNA, 15 nt, Escherichia coli CFT073
ucuguccugaaaauu

SEQ ID NO: 2611396 - RNA, 14 nt, Escherichia coli CFT073
ucuguccuuccagu

SEQ ID NO: 2611397 - RNA, 20 nt, Escherichia coli CFT073
ucuguccuuccaguaaccag

SEQ ID NO: 2611398 - RNA, 22 nt, Escherichia coli CFT073
ucugugaagcaugaguaacccg

SEQ ID NO: 2611399 - RNA, 17 nt, Escherichia coli CFT073
ucuucgaccgucaccag

SEQ ID NO: 2611400 - RNA, 20 nt, Escherichia coli CFT073
ucuucgaccgucaccagucc

SEQ ID NO: 2611401 - RNA, 14 nt, Escherichia coli CFT073
ucuucgagugucac

SEQ ID NO: 2611402 - RNA, 17 nt, Escherichia coli CFT073
ucuucgauauugacgau

SEQ ID NO: 2611403 - RNA, 21 nt, Escherichia coli CFT073
ucuucgauuuaaccgcuuuca

SEQ ID NO: 2611404 - RNA, 23 nt, Escherichia coli CFT073
ucuucgauuuaaccgcuuucacc

SEQ ID NO: 2611405 - RNA, 19 nt, Escherichia coli CFT073
ucuucgcacuuaccuucac

SEQ ID NO: 2611406 - RNA, 22 nt, Escherichia coli CFT073
ucuucgccgucaguugugccag

SEQ ID NO: 2611407 - RNA, 20 nt, Escherichia coli CFT073
ucuucgcguuacggaucaga

SEQ ID NO: 2611408 - RNA, 17 nt, Escherichia coli CFT073
ucuucgcuggaucgaac

SEQ ID NO: 2611409 - RNA, 17 nt, Escherichia coli CFT073
ucuucggcaaguguugg

SEQ ID NO: 2611410 - RNA, 17 nt, Escherichia coli CFT073
ucuucggcgaaaaucau

SEQ ID NO: 2611411 - RNA, 21 nt, Escherichia coli CFT073
ucuucggcgcugaccacuuug

SEQ ID NO: 2611412 - RNA, 21 nt, Escherichia coli CFT073
ucuucgguggucauuuuauug

SEQ ID NO: 2611413 - RNA, 15 nt, Escherichia coli CFT073
ucuucguacauggua

SEQ ID NO: 2611414 - RNA, 13 nt, Escherichia coli CFT073
ucuucguaccaaa

SEQ ID NO: 2611415 - RNA, 22 nt, Escherichia coli CFT073
ucuucguacugcggaaccgggu

SEQ ID NO: 2611416 - RNA, 19 nt, Escherichia coli CFT073
ucuucgucaaagauauuau

SEQ ID NO: 2611417 - RNA, 19 nt, Escherichia coli CFT073
ucuucguuaauuucugcuu

SEQ ID NO: 2611418 - RNA, 22 nt, Escherichia coli CFT073
ucuucguuaauuucugcuuuac

SEQ ID NO: 2611419 - RNA, 14 nt, Escherichia coli CFT073
ucuucguucuucuu

SEQ ID NO: 2611420 - RNA, 15 nt, Escherichia coli CFT073
ucuucguuuucugcg

SEQ ID NO: 2611421 - RNA, 14 nt, Escherichia coli CFT073
ucuucuaauugugc

SEQ ID NO: 2611422 - RNA, 14 nt, Escherichia coli CFT073
ucuucuacauuucu

SEQ ID NO: 2611423 - RNA, 19 nt, Escherichia coli CFT073
ucuucuccagcugcgcgcg

SEQ ID NO: 2611424 - RNA, 22 nt, Escherichia coli CFT073
ucuucucgaaacgcuuuuaacg

SEQ ID NO: 2611425 - RNA, 15 nt, Escherichia coli CFT073
ucuucucgcacuucu

SEQ ID NO: 2611426 - RNA, 12 nt, Escherichia coli CFT073
ucuucucucauc

SEQ ID NO: 2611427 - RNA, 15 nt, Escherichia coli CFT073
ucuucugaaaagguu

SEQ ID NO: 2611428 - RNA, 17 nt, Escherichia coli CFT073
ucuucugaaucagauca

SEQ ID NO: 2611429 - RNA, 20 nt, Escherichia coli CFT073
ucuucugaaucagaucaagu

SEQ ID NO: 2611430 - RNA, 18 nt, Escherichia coli CFT073
ucuucugcuucauguugc

SEQ ID NO: 2611431 - RNA, 20 nt, Escherichia coli CFT073
ucuucuggaucaaagucauc

SEQ ID NO: 2611432 - RNA, 19 nt, Escherichia coli CFT073
ucuucuggcaccaguaaac

SEQ ID NO: 2611433 - RNA, 11 nt, Escherichia coli CFT073
ucuucuucaug

SEQ ID NO: 2611434 - RNA, 20 nt, Escherichia coli CFT073
ucuucuugcagcuuaaucau

SEQ ID NO: 2611435 - RNA, 19 nt, Escherichia coli CFT073
ucuucuugcguuuuuugau

SEQ ID NO: 2611436 - RNA, 13 nt, Escherichia coli CFT073
ucuucuuuaauua

SEQ ID NO: 2611437 - RNA, 12 nt, Escherichia coli CFT073
ucuucuuucagg

SEQ ID NO: 2611438 - RNA, 13 nt, Escherichia coli CFT073
ucuucuuucaggu

SEQ ID NO: 2611439 - RNA, 14 nt, Escherichia coli CFT073
ucuucuuucaucau

SEQ ID NO: 2611440 - RNA, 14 nt, Escherichia coli CFT073
ucuucuuucucggc

SEQ ID NO: 2611441 - RNA, 16 nt, Escherichia coli CFT073
ucuugacauccagcgu

SEQ ID NO: 2611442 - RNA, 12 nt, Escherichia coli CFT073
ucuugacuauca

SEQ ID NO: 2611443 - RNA, 23 nt, Escherichia coli CFT073
ucuugagacagaaacaaaugaaa

SEQ ID NO: 2611444 - RNA, 16 nt, Escherichia coli CFT073
ucuugcagcuuaauca

SEQ ID NO: 2611445 - RNA, 15 nt, Escherichia coli CFT073
ucuugccacuggccu

SEQ ID NO: 2611446 - RNA, 20 nt, Escherichia coli CFT073
ucuugccacuggccucccag

SEQ ID NO: 2611447 - RNA, 17 nt, Escherichia coli CFT073
ucuugccagauuuucuu

SEQ ID NO: 2611448 - RNA, 14 nt, Escherichia coli CFT073
ucuugccucccugc

SEQ ID NO: 2611449 - RNA, 14 nt, Escherichia coli CFT073
ucuugcucuaccag

SEQ ID NO: 2611450 - RNA, 15 nt, Escherichia coli CFT073
ucuugcucuaccagc

SEQ ID NO: 2611451 - RNA, 18 nt, Escherichia coli CFT073
ucuugcugauacuauuca

SEQ ID NO: 2611452 - RNA, 20 nt, Escherichia coli CFT073
ucuugcuggcauuacaagaa

SEQ ID NO: 2611453 - RNA, 23 nt, Escherichia coli CFT073
ucuugcuggcauuacaagaauca

SEQ ID NO: 2611454 - RNA, 20 nt, Escherichia coli CFT073
ucuuggcgugcucacugaaa

SEQ ID NO: 2611455 - RNA, 18 nt, Escherichia coli CFT073
ucuuggcuuugauauuca

SEQ ID NO: 2611456 - RNA, 23 nt, Escherichia coli CFT073
ucuuguaacgaguacaaaaauaa

SEQ ID NO: 2611457 - RNA, 13 nt, Escherichia coli CFT073
ucuuguacuuccg

SEQ ID NO: 2611458 - RNA, 15 nt, Escherichia coli CFT073
ucuuguacuuccgga

SEQ ID NO: 2611459 - RNA, 15 nt, Escherichia coli CFT073
ucuugucacuggcga

SEQ ID NO: 2611460 - RNA, 21 nt, Escherichia coli CFT073
ucuugucaggccggaauaacu

SEQ ID NO: 2611461 - RNA, 14 nt, Escherichia coli CFT073
ucuuguugaacaga

SEQ ID NO: 2611462 - RNA, 21 nt, Escherichia coli CFT073
ucuuuaacaucgcaaaauaca

SEQ ID NO: 2611463 - RNA, 16 nt, Escherichia coli CFT073
ucuuuaaccaggcaag

SEQ ID NO: 2611464 - RNA, 16 nt, Escherichia coli CFT073
ucuuuaacggccugac

SEQ ID NO: 2611465 - RNA, 17 nt, Escherichia coli CFT073
ucuuuaauacacggcag

SEQ ID NO: 2611466 - RNA, 16 nt, Escherichia coli CFT073
ucuuuaauagauaauu

SEQ ID NO: 2611467 - RNA, 23 nt, Escherichia coli CFT073
ucuuuaauagauaauuuugaaau

SEQ ID NO: 2611468 - RNA, 20 nt, Escherichia coli CFT073
ucuuuaccgcugucgaucag

SEQ ID NO: 2611469 - RNA, 21 nt, Escherichia coli CFT073
ucuuuaccgcugucgaucaga

SEQ ID NO: 2611470 - RNA, 16 nt, Escherichia coli CFT073
ucuuuagcauucagcg

SEQ ID NO: 2611471 - RNA, 16 nt, Escherichia coli CFT073
ucuuuaguuaauuucg

SEQ ID NO: 2611472 - RNA, 17 nt, Escherichia coli CFT073
ucuuuaguuaauuucgc

SEQ ID NO: 2611473 - RNA, 14 nt, Escherichia coli CFT073
ucuuuauaaaguaa

SEQ ID NO: 2611474 - RNA, 18 nt, Escherichia coli CFT073
ucuuuauaaauaucaaaa

SEQ ID NO: 2611475 - RNA, 13 nt, Escherichia coli CFT073
ucuuuaucaauca

SEQ ID NO: 2611476 - RNA, 16 nt, Escherichia coli CFT073
ucuuuaucaccaauga

SEQ ID NO: 2611477 - RNA, 18 nt, Escherichia coli CFT073
ucuuuauccagcaccacu

SEQ ID NO: 2611478 - RNA, 15 nt, Escherichia coli CFT073
ucuuuauccagcagc

SEQ ID NO: 2611479 - RNA, 16 nt, Escherichia coli CFT073
ucuuuaucgacauaaa

SEQ ID NO: 2611480 - RNA, 19 nt, Escherichia coli CFT073
ucuuuauggguuucuaauu

SEQ ID NO: 2611481 - RNA, 13 nt, Escherichia coli CFT073
ucuuuauguaaua

SEQ ID NO: 2611482 - RNA, 14 nt, Escherichia coli CFT073
ucuuuauucauaau

SEQ ID NO: 2611483 - RNA, 19 nt, Escherichia coli CFT073
ucuuucaacacaugcacau

SEQ ID NO: 2611484 - RNA, 14 nt, Escherichia coli CFT073
ucuuucaauuugca

SEQ ID NO: 2611485 - RNA, 13 nt, Escherichia coli CFT073
ucuuucacaaaga

SEQ ID NO: 2611486 - RNA, 14 nt, Escherichia coli CFT073
ucuuucaccaacug

SEQ ID NO: 2611487 - RNA, 13 nt, Escherichia coli CFT073
ucuuucaccagug

SEQ ID NO: 2611488 - RNA, 17 nt, Escherichia coli CFT073
ucuuucacgcccagucc

SEQ ID NO: 2611489 - RNA, 23 nt, Escherichia coli CFT073
ucuuucagacgacugucuuccug

SEQ ID NO: 2611490 - RNA, 19 nt, Escherichia coli CFT073
ucuuucagcgccagaaagg

SEQ ID NO: 2611491 - RNA, 19 nt, Escherichia coli CFT073
ucuuucaguucgccuucca

SEQ ID NO: 2611492 - RNA, 23 nt, Escherichia coli CFT073
ucuuucaguucgccuuccagcag

SEQ ID NO: 2611493 - RNA, 15 nt, Escherichia coli CFT073
ucuuuccguuuucac

SEQ ID NO: 2611494 - RNA, 14 nt, Escherichia coli CFT073
ucuuuccugcacaa

SEQ ID NO: 2611495 - RNA, 14 nt, Escherichia coli CFT073
ucuuucgcaucgcu

SEQ ID NO: 2611496 - RNA, 19 nt, Escherichia coli CFT073
ucuuucucagucauaacgu

SEQ ID NO: 2611497 - RNA, 21 nt, Escherichia coli CFT073
ucuuucucgcugacaucaaca

SEQ ID NO: 2611498 - RNA, 17 nt, Escherichia coli CFT073
ucuuucucggccaccgu

SEQ ID NO: 2611499 - RNA, 15 nt, Escherichia coli CFT073
ucuuucucuucuagu

SEQ ID NO: 2611500 - RNA, 12 nt, Escherichia coli CFT073
ucuuucugaaau

SEQ ID NO: 2611501 - RNA, 20 nt, Escherichia coli CFT073
ucuuucugacgaauuaccaa

SEQ ID NO: 2611502 - RNA, 22 nt, Escherichia coli CFT073
ucuuucugacgaauuaccaaca

SEQ ID NO: 2611503 - RNA, 20 nt, Escherichia coli CFT073
ucuuucugugcaaucacaaa

SEQ ID NO: 2611504 - RNA, 19 nt, Escherichia coli CFT073
ucuuugaacaguuuucgca

SEQ ID NO: 2611505 - RNA, 17 nt, Escherichia coli CFT073
ucuuugacuguccgcau

SEQ ID NO: 2611506 - RNA, 14 nt, Escherichia coli CFT073
ucuuugaugccuuc

SEQ ID NO: 2611507 - RNA, 18 nt, Escherichia coli CFT073
ucuuugcccauacccggu

SEQ ID NO: 2611508 - RNA, 17 nt, Escherichia coli CFT073
ugaacgccaaauucuuu

SEQ ID NO: 2611509 - RNA, 14 nt, Escherichia coli CFT073
ugaacgccaccaac

SEQ ID NO: 2611510 - RNA, 22 nt, Escherichia coli CFT073
ugaacgccaccccacaccagug

SEQ ID NO: 2611511 - RNA, 21 nt, Escherichia coli CFT073
ugaacgccacgcucacucauc

SEQ ID NO: 2611512 - RNA, 18 nt, Escherichia coli CFT073
ugaacgccugcaccagcc

SEQ ID NO: 2611513 - RNA, 20 nt, Escherichia coli CFT073
ugaacgccuuauccgaccua

SEQ ID NO: 2611514 - RNA, 20 nt, Escherichia coli CFT073
ugaacgccuuauccggccua

SEQ ID NO: 2611515 - RNA, 20 nt, Escherichia coli CFT073
ugaacgccuuauccggucua

SEQ ID NO: 2611516 - RNA, 20 nt, Escherichia coli CFT073
ugaacgccuucuccggccua

SEQ ID NO: 2611517 - RNA, 19 nt, Escherichia coli CFT073
ugaacgcguuauccggcca

SEQ ID NO: 2611518 - RNA, 22 nt, Escherichia coli CFT073
ugaacgcuaucggcauaaccaa

SEQ ID NO: 2611519 - RNA, 14 nt, Escherichia coli CFT073
ugaacgugcaaaau

SEQ ID NO: 2611520 - RNA, 21 nt, Escherichia coli CFT073
ugaacguuuggccacaccauc

SEQ ID NO: 2611521 - RNA, 18 nt, Escherichia coli CFT073
ugaacucaggcugccaga

SEQ ID NO: 2611522 - RNA, 16 nt, Escherichia coli CFT073
ugaacugacugauugc

SEQ ID NO: 2611523 - RNA, 13 nt, Escherichia coli CFT073
ugaacuggaaaaa

SEQ ID NO: 2611524 - RNA, 17 nt, Escherichia coli CFT073
ugaacugguuaaauuua

SEQ ID NO: 2611525 - RNA, 16 nt, Escherichia coli CFT073
ugaacuucgccaggau

SEQ ID NO: 2611526 - RNA, 19 nt, Escherichia coli CFT073
ugaacuucuucgccagguu

SEQ ID NO: 2611527 - RNA, 20 nt, Escherichia coli CFT073
ugaacuuguuuacaaauaau

SEQ ID NO: 2611528 - RNA, 13 nt, Escherichia coli CFT073
ugaacuuuuucuu

SEQ ID NO: 2611529 - RNA, 17 nt, Escherichia coli CFT073
ugaacuuuuucuucacc

SEQ ID NO: 2611530 - RNA, 19 nt, Escherichia coli CFT073
ugaagaaccaagccugcug

SEQ ID NO: 2611531 - RNA, 23 nt, Escherichia coli CFT073
ugaagaaccgcaccaggcaguuu

SEQ ID NO: 2611532 - RNA, 18 nt, Escherichia coli CFT073
ugaagacaacauugauuu

SEQ ID NO: 2611533 - RNA, 21 nt, Escherichia coli CFT073
ugaagacagaccuggcgcuuc

SEQ ID NO: 2611534 - RNA, 18 nt, Escherichia coli CFT073
ugaagacucaacuuuaaa

SEQ ID NO: 2611535 - RNA, 14 nt, Escherichia coli CFT073
ugaagagauaaacg

SEQ ID NO: 2611536 - RNA, 17 nt, Escherichia coli CFT073
ugaagaguuugaucaug

SEQ ID NO: 2611537 - RNA, 23 nt, Escherichia coli CFT073
ugaagauuugcagaucgcggccu

SEQ ID NO: 2611538 - RNA, 13 nt, Escherichia coli CFT073
ugaagcagcgcug

SEQ ID NO: 2611539 - RNA, 14 nt, Escherichia coli CFT073
ugaagcagcgcugg

SEQ ID NO: 2611540 - RNA, 18 nt, Escherichia coli CFT073
ugaagcagcgcuggagag

SEQ ID NO: 2611541 - RNA, 18 nt, Escherichia coli CFT073
ugaagcauauucccuagu

SEQ ID NO: 2611542 - RNA, 17 nt, Escherichia coli CFT073
ugaagcaugaguaaccc

SEQ ID NO: 2611543 - RNA, 20 nt, Escherichia coli CFT073
ugaagccaaccgggccgcag

SEQ ID NO: 2611544 - RNA, 21 nt, Escherichia coli CFT073
ugaagccaaccgggccgcaga

SEQ ID NO: 2611545 - RNA, 15 nt, Escherichia coli CFT073
ugaagccaccagcgc

SEQ ID NO: 2611546 - RNA, 15 nt, Escherichia coli CFT073
ugaagccauuaccga

SEQ ID NO: 2611547 - RNA, 16 nt, Escherichia coli CFT073
ugaagccgaacagucg

SEQ ID NO: 2611548 - RNA, 14 nt, Escherichia coli CFT073
ugaagcggcagagg

SEQ ID NO: 2611549 - RNA, 18 nt, Escherichia coli CFT073
ugaagcggcggucuucuc

SEQ ID NO: 2611550 - RNA, 16 nt, Escherichia coli CFT073
ugaagcugaacagucg

SEQ ID NO: 2611551 - RNA, 13 nt, Escherichia coli CFT073
ugaaggaaaaauc

SEQ ID NO: 2611552 - RNA, 17 nt, Escherichia coli CFT073
ugaaggaauuaaucccu

SEQ ID NO: 2611553 - RNA, 19 nt, Escherichia coli CFT073
ugaaggaauuaaucccuua

SEQ ID NO: 2611554 - RNA, 14 nt, Escherichia coli CFT073
ugaaggauaagacg

SEQ ID NO: 2611555 - RNA, 19 nt, Escherichia coli CFT073
ugaaggcaaacuucucacc

SEQ ID NO: 2611556 - RNA, 20 nt, Escherichia coli CFT073
ugaaggcgcauugcuggcug

SEQ ID NO: 2611557 - RNA, 14 nt, Escherichia coli CFT073
ugaagggaugcugu

SEQ ID NO: 2611558 - RNA, 15 nt, Escherichia coli CFT073
ugaagggaugcugug

SEQ ID NO: 2611559 - RNA, 22 nt, Escherichia coli CFT073
ugaaggggcgcaauuaauugaa

SEQ ID NO: 2611560 - RNA, 19 nt, Escherichia coli CFT073
ugaaggggucuucuuccgc

SEQ ID NO: 2611561 - RNA, 17 nt, Escherichia coli CFT073
ugaagguaagcaacaga

SEQ ID NO: 2611562 - RNA, 15 nt, Escherichia coli CFT073
ugaaggugcuaugca

SEQ ID NO: 2611563 - RNA, 21 nt, Escherichia coli CFT073
ugaaggugguuaccgccagca

SEQ ID NO: 2611564 - RNA, 20 nt, Escherichia coli CFT073
ugaaguaaagaaacugguug

SEQ ID NO: 2611565 - RNA, 22 nt, Escherichia coli CFT073
ugaaguaacagagugaauggug

SEQ ID NO: 2611566 - RNA, 13 nt, Escherichia coli CFT073
ugaaguaauaauc

SEQ ID NO: 2611567 - RNA, 14 nt, Escherichia coli CFT073
ugaaguaauaauca

SEQ ID NO: 2611568 - RNA, 17 nt, Escherichia coli CFT073
ugaaguaauaaucaacg

SEQ ID NO: 2611569 - RNA, 18 nt, Escherichia coli CFT073
ugaaguaugacgaguaua

SEQ ID NO: 2611570 - RNA, 16 nt, Escherichia coli CFT073
ugaaguauuuaaaaau

SEQ ID NO: 2611571 - RNA, 16 nt, Escherichia coli CFT073
ugaagucagcacaucc

SEQ ID NO: 2611572 - RNA, 16 nt, Escherichia coli CFT073
ugaagucaggggcuuc

SEQ ID NO: 2611573 - RNA, 17 nt, Escherichia coli CFT073
ugaagucaggugaaauu

SEQ ID NO: 2611574 - RNA, 14 nt, Escherichia coli CFT073
ugaagucauugaua

SEQ ID NO: 2611575 - RNA, 18 nt, Escherichia coli CFT073
ugaagucgcgcucaucag

SEQ ID NO: 2611576 - RNA, 17 nt, Escherichia coli CFT073
ugaagucucauauauuu

SEQ ID NO: 2611577 - RNA, 13 nt, Escherichia coli CFT073
ugaaguggcugac

SEQ ID NO: 2611578 - RNA, 22 nt, Escherichia coli CFT073
ugaaguggguaaugucacacca

SEQ ID NO: 2611579 - RNA, 22 nt, Escherichia coli CFT073
ugaagugugcaaacgauaaaag

SEQ ID NO: 2611580 - RNA, 19 nt, Escherichia coli CFT073
ugaaguuacugacaucgcu

SEQ ID NO: 2611581 - RNA, 21 nt, Escherichia coli CFT073
ugaaguuacugacaucgcuua

SEQ ID NO: 2611582 - RNA, 11 nt, Escherichia coli CFT073
ugaaguucugg

SEQ ID NO: 2611583 - RNA, 15 nt, Escherichia coli CFT073
ugaaguugaaaucac

SEQ ID NO: 2611584 - RNA, 22 nt, Escherichia coli CFT073
ugaaguuuguuaaccaccagua

SEQ ID NO: 2611585 - RNA, 15 nt, Escherichia coli CFT073
ugaauaaaaaaacuu

SEQ ID NO: 2611586 - RNA, 20 nt, Escherichia coli CFT073
ugaauaaaaaaacuuuuguc

SEQ ID NO: 2611587 - RNA, 13 nt, Escherichia coli CFT073
ugaauaaaagaaa

SEQ ID NO: 2611588 - RNA, 13 nt, Escherichia coli CFT073
ugaauaaacgcca

SEQ ID NO: 2611589 - RNA, 22 nt, Escherichia coli CFT073
ugaauaaacgccauauucugau

SEQ ID NO: 2611590 - RNA, 20 nt, Escherichia coli CFT073
ugaauaaaguuuuaguugcc

SEQ ID NO: 2611591 - RNA, 19 nt, Escherichia coli CFT073
ugaauaaauuggcuggggu

SEQ ID NO: 2611592 - RNA, 22 nt, Escherichia coli CFT073
ugaauaacgccgacaguggauc

SEQ ID NO: 2611593 - RNA, 12 nt, Escherichia coli CFT073
ugaauaacuucc

SEQ ID NO: 2611594 - RNA, 14 nt, Escherichia coli CFT073
ugaauaacuuccug

SEQ ID NO: 2611595 - RNA, 15 nt, Escherichia coli CFT073
ugaauaauacacaca

SEQ ID NO: 2611596 - RNA, 19 nt, Escherichia coli CFT073
ugaauaauccccacaucag

SEQ ID NO: 2611597 - RNA, 23 nt, Escherichia coli CFT073
ugaauaaucguucccgcggcgca

SEQ ID NO: 2611598 - RNA, 16 nt, Escherichia coli CFT073
ugaauaaucugaaaac

SEQ ID NO: 2611599 - RNA, 18 nt, Escherichia coli CFT073
ugaauaccaagucucaag

SEQ ID NO: 2611600 - RNA, 14 nt, Escherichia coli CFT073
ugaauacccgccag

SEQ ID NO: 2611601 - RNA, 20 nt, Escherichia coli CFT073
ugaauagcggaaaucuccag

SEQ ID NO: 2611602 - RNA, 22 nt, Escherichia coli CFT073
ugaauaguauccaacugugaau

SEQ ID NO: 2611603 - RNA, 15 nt, Escherichia coli CFT073
ugaauaucgaauggc

SEQ ID NO: 2611604 - RNA, 23 nt, Escherichia coli CFT073
ugaauaugacccacgccuuuuuc

SEQ ID NO: 2611605 - RNA, 14 nt, Escherichia coli CFT073
ugaauauucagaau

SEQ ID NO: 2611606 - RNA, 17 nt, Escherichia coli CFT073
ugaauauucggcuccag

SEQ ID NO: 2611607 - RNA, 17 nt, Escherichia coli CFT073
ugaauauugccgcugac

SEQ ID NO: 2611608 - RNA, 22 nt, Escherichia coli CFT073
ugaaucaaauaagguuccagua

SEQ ID NO: 2611609 - RNA, 13 nt, Escherichia coli CFT073
ugaaucaacacca

SEQ ID NO: 2611610 - RNA, 20 nt, Escherichia coli CFT073
ugaaucaccugauugaccgc

SEQ ID NO: 2611611 - RNA, 21 nt, Escherichia coli CFT073
ugaaucagcagauccaucgcc

SEQ ID NO: 2611612 - RNA, 23 nt, Escherichia coli CFT073
ugaaucagucccugaaucgccac

SEQ ID NO: 2611613 - RNA, 14 nt, Escherichia coli CFT073
ugaaucaucgcugu

SEQ ID NO: 2611614 - RNA, 14 nt, Escherichia coli CFT073
ugaauccacuggcu

SEQ ID NO: 2611615 - RNA, 15 nt, Escherichia coli CFT073
ugaauccacuggcug

SEQ ID NO: 2611616 - RNA, 18 nt, Escherichia coli CFT073
ugacauuaucagacaccg

SEQ ID NO: 2611617 - RNA, 20 nt, Escherichia coli CFT073
ugacauucacgcugucggca

SEQ ID NO: 2611618 - RNA, 20 nt, Escherichia coli CFT073
ugacauucugacuggucagu

SEQ ID NO: 2611619 - RNA, 20 nt, Escherichia coli CFT073
ugacauugaugcgccauaug

SEQ ID NO: 2611620 - RNA, 20 nt, Escherichia coli CFT073
ugacauuuccguaauaucuu

SEQ ID NO: 2611621 - RNA, 21 nt, Escherichia coli CFT073
ugacauuuccguaauaucuuc

SEQ ID NO: 2611622 - RNA, 19 nt, Escherichia coli CFT073
ugacauuuuuucaucuguu

SEQ ID NO: 2611623 - RNA, 11 nt, Escherichia coli CFT073
ugaccaaaucu

SEQ ID NO: 2611624 - RNA, 14 nt, Escherichia coli CFT073
ugaccaauaacccg

SEQ ID NO: 2611625 - RNA, 22 nt, Escherichia coli CFT073
ugaccaauaacccguuguaaau

SEQ ID NO: 2611626 - RNA, 13 nt, Escherichia coli CFT073
ugaccacaaagca

SEQ ID NO: 2611627 - RNA, 16 nt, Escherichia coli CFT073
ugaccaccaacccaac

SEQ ID NO: 2611628 - RNA, 12 nt, Escherichia coli CFT073
ugaccaccagca

SEQ ID NO: 2611629 - RNA, 14 nt, Escherichia coli CFT073
ugaccacccgcugg

SEQ ID NO: 2611630 - RNA, 19 nt, Escherichia coli CFT073
ugaccaccgcagcaaccgu

SEQ ID NO: 2611631 - RNA, 16 nt, Escherichia coli CFT073
ugaccacuuugcgcuc

SEQ ID NO: 2611632 - RNA, 18 nt, Escherichia coli CFT073
ugaccacuuugcgcuccu

SEQ ID NO: 2611633 - RNA, 16 nt, Escherichia coli CFT073
ugaccagacuggagca

SEQ ID NO: 2611634 - RNA, 23 nt, Escherichia coli CFT073
ugaccaguaauauccccagccua

SEQ ID NO: 2611635 - RNA, 20 nt, Escherichia coli CFT073
ugaccagugcagacucaccu

SEQ ID NO: 2611636 - RNA, 14 nt, Escherichia coli CFT073
ugaccauaaaaggc

SEQ ID NO: 2611637 - RNA, 15 nt, Escherichia coli CFT073
ugaccaucagcagcg

SEQ ID NO: 2611638 - RNA, 16 nt, Escherichia coli CFT073
ugaccaucuuccagca

SEQ ID NO: 2611639 - RNA, 18 nt, Escherichia coli CFT073
ugaccaugagccaguucu

SEQ ID NO: 2611640 - RNA, 14 nt, Escherichia coli CFT073
ugaccauucgccgu

SEQ ID NO: 2611641 - RNA, 20 nt, Escherichia coli CFT073
ugacccacgccuuuuucucc

SEQ ID NO: 2611642 - RNA, 15 nt, Escherichia coli CFT073
ugacccagcgcgauc

SEQ ID NO: 2611643 - RNA, 17 nt, Escherichia coli CFT073
ugacccgcagccagcac

SEQ ID NO: 2611644 - RNA, 18 nt, Escherichia coli CFT073
ugacccgcagccagcacu

SEQ ID NO: 2611645 - RNA, 22 nt, Escherichia coli CFT073
ugaccgacguuaugcucggcag

SEQ ID NO: 2611646 - RNA, 22 nt, Escherichia coli CFT073
ugaccgauaugaauaauuucgg

SEQ ID NO: 2611647 - RNA, 17 nt, Escherichia coli CFT073
ugaccgccagcgccauc

SEQ ID NO: 2611648 - RNA, 14 nt, Escherichia coli CFT073
ugaccgccuaauac

SEQ ID NO: 2611649 - RNA, 13 nt, Escherichia coli CFT073
ugaccgccugcgg

SEQ ID NO: 2611650 - RNA, 16 nt, Escherichia coli CFT073
ugaccgccugcggaga

SEQ ID NO: 2611651 - RNA, 20 nt, Escherichia coli CFT073
ugaccgccuuauccggccua

SEQ ID NO: 2611652 - RNA, 17 nt, Escherichia coli CFT073
ugaccgcuucaucugca

SEQ ID NO: 2611653 - RNA, 15 nt, Escherichia coli CFT073
ugaccgggauuuuca

SEQ ID NO: 2611654 - RNA, 19 nt, Escherichia coli CFT073
ugaccgucgcagccagcgc

SEQ ID NO: 2611655 - RNA, 20 nt, Escherichia coli CFT073
ugaccgucgccuucaacgua

SEQ ID NO: 2611656 - RNA, 15 nt, Escherichia coli CFT073
ugaccguuacugaua

SEQ ID NO: 2611657 - RNA, 23 nt, Escherichia coli CFT073
ugaccguuagcauauugcaggcu

SEQ ID NO: 2611658 - RNA, 17 nt, Escherichia coli CFT073
ugaccguucgccccaua

SEQ ID NO: 2611659 - RNA, 17 nt, Escherichia coli CFT073
ugaccguuuuccccaac

SEQ ID NO: 2611660 - RNA, 19 nt, Escherichia coli CFT073
ugaccuuucaguuugccgc

SEQ ID NO: 2611661 - RNA, 14 nt, Escherichia coli CFT073
ugaccuuuuuucag

SEQ ID NO: 2611662 - RNA, 16 nt, Escherichia coli CFT073
ugacgaacaauaucgc

SEQ ID NO: 2611663 - RNA, 23 nt, Escherichia coli CFT073
ugacgaauaccguauucaacgaa

SEQ ID NO: 2611664 - RNA, 13 nt, Escherichia coli CFT073
ugacgaccagucc

SEQ ID NO: 2611665 - RNA, 12 nt, Escherichia coli CFT073
ugacgaccaugc

SEQ ID NO: 2611666 - RNA, 18 nt, Escherichia coli CFT073
ugacgaggaaaacgccuu

SEQ ID NO: 2611667 - RNA, 15 nt, Escherichia coli CFT073
ugacgaguccuuccu

SEQ ID NO: 2611668 - RNA, 22 nt, Escherichia coli CFT073
ugacgauaggucauaucaucaa

SEQ ID NO: 2611669 - RNA, 19 nt, Escherichia coli CFT073
ugacgaucauuccgcccag

SEQ ID NO: 2611670 - RNA, 20 nt, Escherichia coli CFT073
ugacgaucauuccgcccaga

SEQ ID NO: 2611671 - RNA, 18 nt, Escherichia coli CFT073
ugacgaucggcaucgggc

SEQ ID NO: 2611672 - RNA, 14 nt, Escherichia coli CFT073
ugacgaugauuguc

SEQ ID NO: 2611673 - RNA, 15 nt, Escherichia coli CFT073
ugacgcagcagaccg

SEQ ID NO: 2611674 - RNA, 19 nt, Escherichia coli CFT073
ugacgcaucuuauccagcc

SEQ ID NO: 2611675 - RNA, 14 nt, Escherichia coli CFT073
ugacgccacaacga

SEQ ID NO: 2611676 - RNA, 15 nt, Escherichia coli CFT073
ugacgccacuggcug

SEQ ID NO: 2611677 - RNA, 21 nt, Escherichia coli CFT073
ugacgccagccgauccggaug

SEQ ID NO: 2611678 - RNA, 15 nt, Escherichia coli CFT073
ugacgcccaguuucg

SEQ ID NO: 2611679 - RNA, 14 nt, Escherichia coli CFT073
ugacgccugccagc

SEQ ID NO: 2611680 - RNA, 16 nt, Escherichia coli CFT073
ugacgccugcuccauc

SEQ ID NO: 2611681 - RNA, 21 nt, Escherichia coli CFT073
ugacgcgcauacucuccucca

SEQ ID NO: 2611682 - RNA, 16 nt, Escherichia coli CFT073
ugacgcgucuuaucag

SEQ ID NO: 2611683 - RNA, 17 nt, Escherichia coli CFT073
ugacgcgucuuauccga

SEQ ID NO: 2611684 - RNA, 14 nt, Escherichia coli CFT073
ugacgcugcaaggc

SEQ ID NO: 2611685 - RNA, 12 nt, Escherichia coli CFT073
ugacgcugcuca

SEQ ID NO: 2611686 - RNA, 16 nt, Escherichia coli CFT073
ugacgcuggcagaaag

SEQ ID NO: 2611687 - RNA, 15 nt, Escherichia coli CFT073
ugacgcuggcagcag

SEQ ID NO: 2611688 - RNA, 16 nt, Escherichia coli CFT073
ugacgcuggcagcaga

SEQ ID NO: 2611689 - RNA, 17 nt, Escherichia coli CFT073
ugacgcuggcagcagaa

SEQ ID NO: 2611690 - RNA, 17 nt, Escherichia coli CFT073
ugacgcugucuuaucag

SEQ ID NO: 2611691 - RNA, 19 nt, Escherichia coli CFT073
ugacggaaauggacgucaa

SEQ ID NO: 2611692 - RNA, 19 nt, Escherichia coli CFT073
ugacggagaaaauccgcca

SEQ ID NO: 2611693 - RNA, 20 nt, Escherichia coli CFT073
ugacggagaaaauccgccaa

SEQ ID NO: 2611694 - RNA, 15 nt, Escherichia coli CFT073
ugacgggcaaggcug

SEQ ID NO: 2611695 - RNA, 23 nt, Escherichia coli CFT073
ugacggucgaugcgcaacgcaau

SEQ ID NO: 2611696 - RNA, 23 nt, Escherichia coli CFT073
ugacggucgguaaacccggccug

SEQ ID NO: 2611697 - RNA, 16 nt, Escherichia coli CFT073
ugacggugauaaucau

SEQ ID NO: 2611698 - RNA, 17 nt, Escherichia coli CFT073
ugacggugauacagcaa

SEQ ID NO: 2611699 - RNA, 18 nt, Escherichia coli CFT073
ugacgguuucucccgccu

SEQ ID NO: 2611700 - RNA, 21 nt, Escherichia coli CFT073
ugacguaaacccguugcuuca

SEQ ID NO: 2611701 - RNA, 16 nt, Escherichia coli CFT073
ugacguccggcauacu

SEQ ID NO: 2611702 - RNA, 18 nt, Escherichia coli CFT073
ugacgucgaaacugacau

SEQ ID NO: 2611703 - RNA, 14 nt, Escherichia coli CFT073
ugacgucucaauca

SEQ ID NO: 2611704 - RNA, 13 nt, Escherichia coli CFT073
ugacgugauuggu

SEQ ID NO: 2611705 - RNA, 21 nt, Escherichia coli CFT073
ugacgugugauaaugucagac

SEQ ID NO: 2611706 - RNA, 17 nt, Escherichia coli CFT073
ugacguuaagaaaacgg

SEQ ID NO: 2611707 - RNA, 14 nt, Escherichia coli CFT073
ugacguuauuggug

SEQ ID NO: 2611708 - RNA, 14 nt, Escherichia coli CFT073
ugacguuuaauugc

SEQ ID NO: 2611709 - RNA, 19 nt, Escherichia coli CFT073
ugacguuuuuacagacuaa

SEQ ID NO: 2611710 - RNA, 19 nt, Escherichia coli CFT073
ugacuaagcguuuucugcc

SEQ ID NO: 2611711 - RNA, 20 nt, Escherichia coli CFT073
ugacuaagcguuuucugcca

SEQ ID NO: 2611712 - RNA, 19 nt, Escherichia coli CFT073
ugacuacaaaaaaagccac

SEQ ID NO: 2611713 - RNA, 13 nt, Escherichia coli CFT073
ugacuagcagcau

SEQ ID NO: 2611714 - RNA, 16 nt, Escherichia coli CFT073
ugacuaucugacuuuc

SEQ ID NO: 2611715 - RNA, 22 nt, Escherichia coli CFT073
ugacucaggaaccgaucagauu

SEQ ID NO: 2611716 - RNA, 17 nt, Escherichia coli CFT073
ugacucauaaaaauaua

SEQ ID NO: 2611717 - RNA, 21 nt, Escherichia coli CFT073
ugacuccgauauuugccgcga

SEQ ID NO: 2611718 - RNA, 22 nt, Escherichia coli CFT073
ugacuccgauauuugccgcgac

SEQ ID NO: 2611719 - RNA, 17 nt, Escherichia coli CFT073
ugacuccugacagguau

SEQ ID NO: 2611720 - RNA, 17 nt, Escherichia coli CFT073
ugacucggguucuacaa

SEQ ID NO: 2611721 - RNA, 21 nt, Escherichia coli CFT073
ugacucguuauuguuugucgc

SEQ ID NO: 2611722 - RNA, 21 nt, Escherichia coli CFT073
ugacucuacugaaggcgcauu

SEQ ID NO: 2611723 - RNA, 17 nt, Escherichia coli CFT073
ugacugaaccuucacgc

SEQ ID NO: 2611724 - RNA, 13 nt, Escherichia coli CFT073
ugaguggcuccau

SEQ ID NO: 2611725 - RNA, 14 nt, Escherichia coli CFT073
ugaguguggccagu

SEQ ID NO: 2611726 - RNA, 13 nt, Escherichia coli CFT073
ugaguuaccugau

SEQ ID NO: 2611727 - RNA, 16 nt, Escherichia coli CFT073
ugaguuagcacaacca

SEQ ID NO: 2611728 - RNA, 14 nt, Escherichia coli CFT073
ugaguuauuucauu

SEQ ID NO: 2611729 - RNA, 20 nt, Escherichia coli CFT073
ugaguucaaauuccacaccu

SEQ ID NO: 2611730 - RNA, 15 nt, Escherichia coli CFT073
ugauaaaaaacccgc

SEQ ID NO: 2611731 - RNA, 22 nt, Escherichia coli CFT073
ugauaaaugcacgcugccuggu

SEQ ID NO: 2611732 - RNA, 17 nt, Escherichia coli CFT073
ugauaaauugccugcgu

SEQ ID NO: 2611733 - RNA, 13 nt, Escherichia coli CFT073
ugauaaccacgcg

SEQ ID NO: 2611734 - RNA, 19 nt, Escherichia coli CFT073
ugauaaccggauggcgcga

SEQ ID NO: 2611735 - RNA, 15 nt, Escherichia coli CFT073
ugauaaccuuccagc

SEQ ID NO: 2611736 - RNA, 18 nt, Escherichia coli CFT073
ugauaacgaauugcugcg

SEQ ID NO: 2611737 - RNA, 20 nt, Escherichia coli CFT073
ugauaacgaauugcugcgcc

SEQ ID NO: 2611738 - RNA, 21 nt, Escherichia coli CFT073
ugauaacgucggcauauuuaa

SEQ ID NO: 2611739 - RNA, 15 nt, Escherichia coli CFT073
ugauaagacgcggca

SEQ ID NO: 2611740 - RNA, 20 nt, Escherichia coli CFT073
ugauaagacgcguuaagcgu

SEQ ID NO: 2611741 - RNA, 21 nt, Escherichia coli CFT073
ugauaagcugagcacaaaaca

SEQ ID NO: 2611742 - RNA, 21 nt, Escherichia coli CFT073
ugauaaggcguuuacgccgca

SEQ ID NO: 2611743 - RNA, 23 nt, Escherichia coli CFT073
ugauaaggcguuuacgccgcauc

SEQ ID NO: 2611744 - RNA, 12 nt, Escherichia coli CFT073
ugauaaucaaca

SEQ ID NO: 2611745 - RNA, 18 nt, Escherichia coli CFT073
ugauaaucaacaggaaca

SEQ ID NO: 2611746 - RNA, 16 nt, Escherichia coli CFT073
ugauaauucaacagau

SEQ ID NO: 2611747 - RNA, 12 nt, Escherichia coli CFT073
ugauacagaaag

SEQ ID NO: 2611748 - RNA, 22 nt, Escherichia coli CFT073
ugauacagcucgugcgcuuuca

SEQ ID NO: 2611749 - RNA, 14 nt, Escherichia coli CFT073
ugauacaggcgcug

SEQ ID NO: 2611750 - RNA, 17 nt, Escherichia coli CFT073
ugauacaucaagucaga

SEQ ID NO: 2611751 - RNA, 19 nt, Escherichia coli CFT073
ugauacaucugguaauuga

SEQ ID NO: 2611752 - RNA, 14 nt, Escherichia coli CFT073
ugauaccgugcagc

SEQ ID NO: 2611753 - RNA, 23 nt, Escherichia coli CFT073
ugauacgagcaaaagccuuaucc

SEQ ID NO: 2611754 - RNA, 19 nt, Escherichia coli CFT073
ugauacgggaggucaucag

SEQ ID NO: 2611755 - RNA, 15 nt, Escherichia coli CFT073
ugauacuauucauug

SEQ ID NO: 2611756 - RNA, 17 nt, Escherichia coli CFT073
ugauagaacugcggcag

SEQ ID NO: 2611757 - RNA, 23 nt, Escherichia coli CFT073
ugauagcaaugccaucaccaacg

SEQ ID NO: 2611758 - RNA, 22 nt, Escherichia coli CFT073
ugauagcccaacgaucccaacu

SEQ ID NO: 2611759 - RNA, 18 nt, Escherichia coli CFT073
ugauagcuuacggcgcug

SEQ ID NO: 2611760 - RNA, 22 nt, Escherichia coli CFT073
ugauaggucaugccaaccgcga

SEQ ID NO: 2611761 - RNA, 16 nt, Escherichia coli CFT073
ugauauaccguagauu

SEQ ID NO: 2611762 - RNA, 22 nt, Escherichia coli CFT073
ugauauaccguagauucgggcu

SEQ ID NO: 2611763 - RNA, 22 nt, Escherichia coli CFT073
ugauauacgccacuucaucguc

SEQ ID NO: 2611764 - RNA, 18 nt, Escherichia coli CFT073
ugauaucagccugcaaac

SEQ ID NO: 2611765 - RNA, 17 nt, Escherichia coli CFT073
ugauauccagccagguc

SEQ ID NO: 2611766 - RNA, 21 nt, Escherichia coli CFT073
ugauauccagguuacgcaugg

SEQ ID NO: 2611767 - RNA, 13 nt, Escherichia coli CFT073
ugauauccauaaa

SEQ ID NO: 2611768 - RNA, 22 nt, Escherichia coli CFT073
ugauaucccguacaguuuccuu

SEQ ID NO: 2611769 - RNA, 13 nt, Escherichia coli CFT073
ugauaucccugcu

SEQ ID NO: 2611770 - RNA, 22 nt, Escherichia coli CFT073
ugauaucggcucauaaaaacuc

SEQ ID NO: 2611771 - RNA, 14 nt, Escherichia coli CFT073
ugauauguauuaua

SEQ ID NO: 2611772 - RNA, 19 nt, Escherichia coli CFT073
ugauauguucucuaaucuc

SEQ ID NO: 2611773 - RNA, 15 nt, Escherichia coli CFT073
ugauauguuuauuag

SEQ ID NO: 2611774 - RNA, 20 nt, Escherichia coli CFT073
ugauauguuuauuagcccag

SEQ ID NO: 2611775 - RNA, 16 nt, Escherichia coli CFT073
ugauauuaauuuguau

SEQ ID NO: 2611776 - RNA, 17 nt, Escherichia coli CFT073
ugauauuacauaccagc

SEQ ID NO: 2611777 - RNA, 15 nt, Escherichia coli CFT073
ugauauugauaauaa

SEQ ID NO: 2611778 - RNA, 13 nt, Escherichia coli CFT073
ugauauugugagc

SEQ ID NO: 2611779 - RNA, 14 nt, Escherichia coli CFT073
ugauauuuucugcc

SEQ ID NO: 2611780 - RNA, 12 nt, Escherichia coli CFT073
ugaucaaaaaaa

SEQ ID NO: 2611781 - RNA, 12 nt, Escherichia coli CFT073
ugaucaacgacc

SEQ ID NO: 2611782 - RNA, 23 nt, Escherichia coli CFT073
ugaucaacgaccagaaagacuga

SEQ ID NO: 2611783 - RNA, 17 nt, Escherichia coli CFT073
ugaucaagcaccgccau

SEQ ID NO: 2611784 - RNA, 13 nt, Escherichia coli CFT073
ugaucaagcguag

SEQ ID NO: 2611785 - RNA, 16 nt, Escherichia coli CFT073
ugaucaagcguagugg

SEQ ID NO: 2611786 - RNA, 14 nt, Escherichia coli CFT073
ugaucaauaauuaa

SEQ ID NO: 2611787 - RNA, 22 nt, Escherichia coli CFT073
ugaucaauuucugcgcggauag

SEQ ID NO: 2611788 - RNA, 21 nt, Escherichia coli CFT073
ugaucacaucaucuaccagca

SEQ ID NO: 2611789 - RNA, 19 nt, Escherichia coli CFT073
ugaucacccacaucaacgg

SEQ ID NO: 2611790 - RNA, 16 nt, Escherichia coli CFT073
ugaucacguuuuccuu

SEQ ID NO: 2611791 - RNA, 15 nt, Escherichia coli CFT073
ugaucagccacaguu

SEQ ID NO: 2611792 - RNA, 21 nt, Escherichia coli CFT073
ugaucagccacaguuuuccgc

SEQ ID NO: 2611793 - RNA, 23 nt, Escherichia coli CFT073
ugaucagccucucucugagggug

SEQ ID NO: 2611794 - RNA, 20 nt, Escherichia coli CFT073
ugaucagcgaagcgcaucag

SEQ ID NO: 2611795 - RNA, 15 nt, Escherichia coli CFT073
ugaucagcgguuuug

SEQ ID NO: 2611796 - RNA, 19 nt, Escherichia coli CFT073
ugaucauagcgaauaaucc

SEQ ID NO: 2611797 - RNA, 22 nt, Escherichia coli CFT073
ugaucauccgccucuaacagau

SEQ ID NO: 2611798 - RNA, 23 nt, Escherichia coli CFT073
ugaucauccgccucuaacagauc

SEQ ID NO: 2611799 - RNA, 16 nt, Escherichia coli CFT073
ugaucauucaccagcc

SEQ ID NO: 2611800 - RNA, 13 nt, Escherichia coli CFT073
ugauccacugcag

SEQ ID NO: 2611801 - RNA, 22 nt, Escherichia coli CFT073
ugauccagcucuuccucgcucu

SEQ ID NO: 2611802 - RNA, 16 nt, Escherichia coli CFT073
ugaucccagaaccagu

SEQ ID NO: 2611803 - RNA, 19 nt, Escherichia coli CFT073
ugaucccccugggccaccu

SEQ ID NO: 2611804 - RNA, 13 nt, Escherichia coli CFT073
ugaucccgccauc

SEQ ID NO: 2611805 - RNA, 17 nt, Escherichia coli CFT073
ugaucccggcuuccugc

SEQ ID NO: 2611806 - RNA, 18 nt, Escherichia coli CFT073
ugaucccuucgcuggcaa

SEQ ID NO: 2611807 - RNA, 14 nt, Escherichia coli CFT073
ugauccgugaugau

SEQ ID NO: 2611808 - RNA, 21 nt, Escherichia coli CFT073
ugauccucuauaaaagaggcg

SEQ ID NO: 2611809 - RNA, 12 nt, Escherichia coli CFT073
ugauccugagcu

SEQ ID NO: 2611810 - RNA, 17 nt, Escherichia coli CFT073
ugauccugcaacaacac

SEQ ID NO: 2611811 - RNA, 16 nt, Escherichia coli CFT073
ugaucgaagauuacgc

SEQ ID NO: 2611812 - RNA, 22 nt, Escherichia coli CFT073
ugaucgacaaaaucccggcgca

SEQ ID NO: 2611813 - RNA, 18 nt, Escherichia coli CFT073
ugaucgacaguugcugcg

SEQ ID NO: 2611814 - RNA, 15 nt, Escherichia coli CFT073
ugaucgauaagccag

SEQ ID NO: 2611815 - RNA, 18 nt, Escherichia coli CFT073
ugaucgcaauucuucauu

SEQ ID NO: 2611816 - RNA, 22 nt, Escherichia coli CFT073
ugaucgcgcgccuuacgggcgu

SEQ ID NO: 2611817 - RNA, 20 nt, Escherichia coli CFT073
ugaucgucuucaaccgcagu

SEQ ID NO: 2611818 - RNA, 21 nt, Escherichia coli CFT073
ugaucuaaaagcaaacugugc

SEQ ID NO: 2611819 - RNA, 18 nt, Escherichia coli CFT073
ugaucuccuuuguaccag

SEQ ID NO: 2611820 - RNA, 19 nt, Escherichia coli CFT073
ugaucugaucaaacucgcu

SEQ ID NO: 2611821 - RNA, 15 nt, Escherichia coli CFT073
ugaucugcaaauuca

SEQ ID NO: 2611822 - RNA, 19 nt, Escherichia coli CFT073
ugaucugcacagcauucag

SEQ ID NO: 2611823 - RNA, 21 nt, Escherichia coli CFT073
ugaucugcgucgcuuuccagu

SEQ ID NO: 2611824 - RNA, 22 nt, Escherichia coli CFT073
ugaucuucucuuauauuucauu

SEQ ID NO: 2611825 - RNA, 22 nt, Escherichia coli CFT073
ugaucuuuaucaagcaccaacu

SEQ ID NO: 2611826 - RNA, 12 nt, Escherichia coli CFT073
ugaugaaaaaac

SEQ ID NO: 2611827 - RNA, 17 nt, Escherichia coli CFT073
ugaugaaaaaaccagaa

SEQ ID NO: 2611828 - RNA, 22 nt, Escherichia coli CFT073
ugaugaaaagauuaacgugacc

SEQ ID NO: 2611829 - RNA, 17 nt, Escherichia coli CFT073
ugaugaaagcaugucag

SEQ ID NO: 2611830 - RNA, 14 nt, Escherichia coli CFT073
ugaugaagacagac

SEQ ID NO: 2611831 - RNA, 18 nt, Escherichia coli CFT073
ugaugacaaacgcaaaac

SEQ ID NO: 2611832 - RNA, 13 nt, Escherichia coli CFT073
ugauuuauuucuc

SEQ ID NO: 2611833 - RNA, 14 nt, Escherichia coli CFT073
ugauuuauuucuca

SEQ ID NO: 2611834 - RNA, 13 nt, Escherichia coli CFT073
ugauuuauuuucc

SEQ ID NO: 2611835 - RNA, 15 nt, Escherichia coli CFT073
ugauuuauuuuuacu

SEQ ID NO: 2611836 - RNA, 23 nt, Escherichia coli CFT073
ugauuucaaaauuaaagccgcga

SEQ ID NO: 2611837 - RNA, 15 nt, Escherichia coli CFT073
ugauuucaaccggua

SEQ ID NO: 2611838 - RNA, 13 nt, Escherichia coli CFT073
ugauuucaggaua

SEQ ID NO: 2611839 - RNA, 19 nt, Escherichia coli CFT073
ugauuucaggauaauuaug

SEQ ID NO: 2611840 - RNA, 22 nt, Escherichia coli CFT073
ugauuuccccuaacucuuucaa

SEQ ID NO: 2611841 - RNA, 12 nt, Escherichia coli CFT073
ugauuucgaacu

SEQ ID NO: 2611842 - RNA, 12 nt, Escherichia coli CFT073
ugauuucuuauu

SEQ ID NO: 2611843 - RNA, 14 nt, Escherichia coli CFT073
ugauuucuuauuca

SEQ ID NO: 2611844 - RNA, 17 nt, Escherichia coli CFT073
ugauuucuuauucauau

SEQ ID NO: 2611845 - RNA, 12 nt, Escherichia coli CFT073
ugauuugcugga

SEQ ID NO: 2611846 - RNA, 13 nt, Escherichia coli CFT073
ugauuugucauau

SEQ ID NO: 2611847 - RNA, 13 nt, Escherichia coli CFT073
ugauuugucugcc

SEQ ID NO: 2611848 - RNA, 18 nt, Escherichia coli CFT073
ugauuuucaccagcaucg

SEQ ID NO: 2611849 - RNA, 20 nt, Escherichia coli CFT073
ugauuuugccugugcaaccu

SEQ ID NO: 2611850 - RNA, 19 nt, Escherichia coli CFT073
ugauuuuguaaucaacaaa

SEQ ID NO: 2611851 - RNA, 18 nt, Escherichia coli CFT073
ugauuuuucguuuuaaug

SEQ ID NO: 2611852 - RNA, 19 nt, Escherichia coli CFT073
ugauuuuucguuuuaaugc

SEQ ID NO: 2611853 - RNA, 17 nt, Escherichia coli CFT073
ugauuuuugcugaacgc

SEQ ID NO: 2611854 - RNA, 22 nt, Escherichia coli CFT073
ugcaaaaaaauuucauuuucag

SEQ ID NO: 2611855 - RNA, 22 nt, Escherichia coli CFT073
ugcaaaagcaggagcaauuuuc

SEQ ID NO: 2611856 - RNA, 15 nt, Escherichia coli CFT073
ugcaaacaacgcuuc

SEQ ID NO: 2611857 - RNA, 19 nt, Escherichia coli CFT073
ugcaaacaacgcuucaaac

SEQ ID NO: 2611858 - RNA, 17 nt, Escherichia coli CFT073
ugcaaacaguaacccag

SEQ ID NO: 2611859 - RNA, 18 nt, Escherichia coli CFT073
ugcaaacaguaacccagc

SEQ ID NO: 2611860 - RNA, 14 nt, Escherichia coli CFT073
ugcaaaccguacaa

SEQ ID NO: 2611861 - RNA, 16 nt, Escherichia coli CFT073
ugcaaacgauuaucaa

SEQ ID NO: 2611862 - RNA, 13 nt, Escherichia coli CFT073
ugcaaagacaucg

SEQ ID NO: 2611863 - RNA, 16 nt, Escherichia coli CFT073
ugcaaauacccaaaaa

SEQ ID NO: 2611864 - RNA, 14 nt, Escherichia coli CFT073
ugcaaaucaccaca

SEQ ID NO: 2611865 - RNA, 17 nt, Escherichia coli CFT073
ugcaaaucggcaaucuc

SEQ ID NO: 2611866 - RNA, 15 nt, Escherichia coli CFT073
ugcaaauucggucag

SEQ ID NO: 2611867 - RNA, 18 nt, Escherichia coli CFT073
ugcaacaacaccagcagg

SEQ ID NO: 2611868 - RNA, 19 nt, Escherichia coli CFT073
ugcaacaacucuaauucau

SEQ ID NO: 2611869 - RNA, 14 nt, Escherichia coli CFT073
ugcaacacuuccgc

SEQ ID NO: 2611870 - RNA, 23 nt, Escherichia coli CFT073
ugcaacauuaucugaugcgcuuc

SEQ ID NO: 2611871 - RNA, 15 nt, Escherichia coli CFT073
ugcaaccagaaaguc

SEQ ID NO: 2611872 - RNA, 14 nt, Escherichia coli CFT073
ugcaaccuuuucca

SEQ ID NO: 2611873 - RNA, 17 nt, Escherichia coli CFT073
ugcaaccuuuuccauug

SEQ ID NO: 2611874 - RNA, 14 nt, Escherichia coli CFT073
ugcaacugaugacu

SEQ ID NO: 2611875 - RNA, 13 nt, Escherichia coli CFT073
ugcaacugcccag

SEQ ID NO: 2611876 - RNA, 20 nt, Escherichia coli CFT073
ugcaacugcccaggcaaaaa

SEQ ID NO: 2611877 - RNA, 14 nt, Escherichia coli CFT073
ugcaacuggcugcc

SEQ ID NO: 2611878 - RNA, 17 nt, Escherichia coli CFT073
ugcaacuguuuuaccaa

SEQ ID NO: 2611879 - RNA, 16 nt, Escherichia coli CFT073
ugcaacuuuacuaaaa

SEQ ID NO: 2611880 - RNA, 13 nt, Escherichia coli CFT073
ugcaacuuucaau

SEQ ID NO: 2611881 - RNA, 15 nt, Escherichia coli CFT073
ugcaaggagagccag

SEQ ID NO: 2611882 - RNA, 16 nt, Escherichia coli CFT073
ugcaaggagagccagu

SEQ ID NO: 2611883 - RNA, 16 nt, Escherichia coli CFT073
ugcaaggcaacgcagc

SEQ ID NO: 2611884 - RNA, 19 nt, Escherichia coli CFT073
ugcaaggccaucggcagcg

SEQ ID NO: 2611885 - RNA, 15 nt, Escherichia coli CFT073
ugcaagucuugcugc

SEQ ID NO: 2611886 - RNA, 18 nt, Escherichia coli CFT073
ugcaagugagucggcuuu

SEQ ID NO: 2611887 - RNA, 16 nt, Escherichia coli CFT073
ugcaaguggaaauccc

SEQ ID NO: 2611888 - RNA, 20 nt, Escherichia coli CFT073
ugcaauagcgccugcugcug

SEQ ID NO: 2611889 - RNA, 22 nt, Escherichia coli CFT073
ugcaauaugguuauuaccaaaa

SEQ ID NO: 2611890 - RNA, 19 nt, Escherichia coli CFT073
ugcaauauuaugcguagcc

SEQ ID NO: 2611891 - RNA, 19 nt, Escherichia coli CFT073
ugcaaucacugccaccagg

SEQ ID NO: 2611892 - RNA, 16 nt, Escherichia coli CFT073
ugcaaucacuuccuca

SEQ ID NO: 2611893 - RNA, 12 nt, Escherichia coli CFT073
ugcaaucagcgg

SEQ ID NO: 2611894 - RNA, 21 nt, Escherichia coli CFT073
ugcaaucaguacguuaucacc

SEQ ID NO: 2611895 - RNA, 19 nt, Escherichia coli CFT073
ugcaauccacaagcacagg

SEQ ID NO: 2611896 - RNA, 15 nt, Escherichia coli CFT073
ugcaaucgauuugaa

SEQ ID NO: 2611897 - RNA, 15 nt, Escherichia coli CFT073
ugcaaucuacaaaag

SEQ ID NO: 2611898 - RNA, 24 nt, Escherichia coli CFT073
ugcaaucuacaaaagauuauugcu

SEQ ID NO: 2611899 - RNA, 20 nt, Escherichia coli CFT073
ugcaaucuuuccugcacaau

SEQ ID NO: 2611900 - RNA, 23 nt, Escherichia coli CFT073
ugcaaugccguuugcugcaugau

SEQ ID NO: 2611901 - RNA, 22 nt, Escherichia coli CFT073
ugcaauguuaacuguuuaucgu

SEQ ID NO: 2611902 - RNA, 22 nt, Escherichia coli CFT073
ugcaauuacgcuauacaaccac

SEQ ID NO: 2611903 - RNA, 14 nt, Escherichia coli CFT073
ugcaauucggcuuu

SEQ ID NO: 2611904 - RNA, 18 nt, Escherichia coli CFT073
ugcaauuuccgcuuucaa

SEQ ID NO: 2611905 - RNA, 15 nt, Escherichia coli CFT073
ugcaauuugcgguga

SEQ ID NO: 2611906 - RNA, 15 nt, Escherichia coli CFT073
ugcacaaauuugccg

SEQ ID NO: 2611907 - RNA, 14 nt, Escherichia coli CFT073
ugcacaagcggcag

SEQ ID NO: 2611908 - RNA, 22 nt, Escherichia coli CFT073
ugcacacggauaaacguggugc

SEQ ID NO: 2611909 - RNA, 20 nt, Escherichia coli CFT073
ugcacacggaucugaugagu

SEQ ID NO: 2611910 - RNA, 23 nt, Escherichia coli CFT073
ugcacagaaaagcagagugugaa

SEQ ID NO: 2611911 - RNA, 16 nt, Escherichia coli CFT073
ugcacagagcuaugaa

SEQ ID NO: 2611912 - RNA, 22 nt, Escherichia coli CFT073
ugcacagcauucagcuuccaga

SEQ ID NO: 2611913 - RNA, 19 nt, Escherichia coli CFT073
ugcacaggagacaccagcg

SEQ ID NO: 2611914 - RNA, 17 nt, Escherichia coli CFT073
ugcacaggcauucagau

SEQ ID NO: 2611915 - RNA, 21 nt, Escherichia coli CFT073
ugcacauacugcaucagcgcc

SEQ ID NO: 2611916 - RNA, 14 nt, Escherichia coli CFT073
ugcacauuccagau

SEQ ID NO: 2611917 - RNA, 22 nt, Escherichia coli CFT073
ugcacauucccugcagucaccu

SEQ ID NO: 2611918 - RNA, 22 nt, Escherichia coli CFT073
ugcaccaacccuaacccaacau

SEQ ID NO: 2611919 - RNA, 16 nt, Escherichia coli CFT073
ugcaccaaguucuuca

SEQ ID NO: 2611920 - RNA, 17 nt, Escherichia coli CFT073
ugcaccaaguucuucac

SEQ ID NO: 2611921 - RNA, 15 nt, Escherichia coli CFT073
ugcaccagaacuccc

SEQ ID NO: 2611922 - RNA, 16 nt, Escherichia coli CFT073
ugcaccagaacucccu

SEQ ID NO: 2611923 - RNA, 16 nt, Escherichia coli CFT073
ugcaccagcaauaagc

SEQ ID NO: 2611924 - RNA, 13 nt, Escherichia coli CFT073
ugcaccagcagcg

SEQ ID NO: 2611925 - RNA, 19 nt, Escherichia coli CFT073
ugcaccagcagcgucagca

SEQ ID NO: 2611926 - RNA, 15 nt, Escherichia coli CFT073
ugcaccagcuggcug

SEQ ID NO: 2611927 - RNA, 23 nt, Escherichia coli CFT073
ugcaccagcuggcugucgaucuc

SEQ ID NO: 2611928 - RNA, 20 nt, Escherichia coli CFT073
ugcaccagcuuguuguccgg

SEQ ID NO: 2611929 - RNA, 16 nt, Escherichia coli CFT073
ugcaccagguuuucgu

SEQ ID NO: 2611930 - RNA, 17 nt, Escherichia coli CFT073
ugcaccagguuuucguc

SEQ ID NO: 2611931 - RNA, 20 nt, Escherichia coli CFT073
ugcaccauccccuuuucacg

SEQ ID NO: 2611932 - RNA, 17 nt, Escherichia coli CFT073
ugcaccccacaaacaga

SEQ ID NO: 2611933 - RNA, 22 nt, Escherichia coli CFT073
ugcaccgacaauccaguugguu

SEQ ID NO: 2611934 - RNA, 18 nt, Escherichia coli CFT073
ugcaccgccuccagcgac

SEQ ID NO: 2611935 - RNA, 16 nt, Escherichia coli CFT073
ugcaccgcgccacugg

SEQ ID NO: 2611936 - RNA, 20 nt, Escherichia coli CFT073
ugcaccggcgauaucccagg

SEQ ID NO: 2611937 - RNA, 16 nt, Escherichia coli CFT073
ugcaccgucacuucuu

SEQ ID NO: 2611938 - RNA, 17 nt, Escherichia coli CFT073
ugcaccugauccagcuc

SEQ ID NO: 2611939 - RNA, 23 nt, Escherichia coli CFT073
ugcaccugauccagcucuuccuc

SEQ ID NO: 2611940 - RNA, 15 nt, Escherichia coli CFT073
ugcagggugagggca

SEQ ID NO: 2611941 - RNA, 20 nt, Escherichia coli CFT073
ugcagggugagggcaauaau

SEQ ID NO: 2611942 - RNA, 23 nt, Escherichia coli CFT073
ugcaggucguccugcaaagcuga

SEQ ID NO: 2611943 - RNA, 16 nt, Escherichia coli CFT073
ugcagguugcaguugg

SEQ ID NO: 2611944 - RNA, 14 nt, Escherichia coli CFT073
ugcaguaacugcug

SEQ ID NO: 2611945 - RNA, 19 nt, Escherichia coli CFT073
ugcaguacgauaauggcuu

SEQ ID NO: 2611946 - RNA, 13 nt, Escherichia coli CFT073
ugcaguacgucga

SEQ ID NO: 2611947 - RNA, 14 nt, Escherichia coli CFT073
ugcaguagcagcag

SEQ ID NO: 2611948 - RNA, 20 nt, Escherichia coli CFT073
ugcaguaugaaacgccugau

SEQ ID NO: 2611949 - RNA, 14 nt, Escherichia coli CFT073
ugcagucagccagc

SEQ ID NO: 2611950 - RNA, 22 nt, Escherichia coli CFT073
ugcagucucaugcgucaugagc

SEQ ID NO: 2611951 - RNA, 21 nt, Escherichia coli CFT073
ugcauaaaccgggucagcccc

SEQ ID NO: 2611952 - RNA, 18 nt, Escherichia coli CFT073
ugcauaaaggcaaaacag

SEQ ID NO: 2611953 - RNA, 15 nt, Escherichia coli CFT073
ugcauaaaugccgca

SEQ ID NO: 2611954 - RNA, 14 nt, Escherichia coli CFT073
ugcauaacacaaua

SEQ ID NO: 2611955 - RNA, 19 nt, Escherichia coli CFT073
ugcauaaccaacaucuuua

SEQ ID NO: 2611956 - RNA, 22 nt, Escherichia coli CFT073
ugcauaagucccgaccacacaa

SEQ ID NO: 2611957 - RNA, 15 nt, Escherichia coli CFT073
ugcauaauccgccgc

SEQ ID NO: 2611958 - RNA, 16 nt, Escherichia coli CFT073
ugcauaaugguggagu

SEQ ID NO: 2611959 - RNA, 17 nt, Escherichia coli CFT073
ugcauaauuucuucguu

SEQ ID NO: 2611960 - RNA, 16 nt, Escherichia coli CFT073
ugcauacaguacgugu

SEQ ID NO: 2611961 - RNA, 21 nt, Escherichia coli CFT073
ugcauacucgcgucuggcauu

SEQ ID NO: 2611962 - RNA, 14 nt, Escherichia coli CFT073
ugcauaggccaucg

SEQ ID NO: 2611963 - RNA, 21 nt, Escherichia coli CFT073
ugcauauaagaugcgccaaca

SEQ ID NO: 2611964 - RNA, 14 nt, Escherichia coli CFT073
ugcauaucaauuag

SEQ ID NO: 2611965 - RNA, 19 nt, Escherichia coli CFT073
ugcauaucgguaaaugcuu

SEQ ID NO: 2611966 - RNA, 17 nt, Escherichia coli CFT073
ugcaucaacaucauuaa

SEQ ID NO: 2611967 - RNA, 11 nt, Escherichia coli CFT073
ugcaucaacca

SEQ ID NO: 2611968 - RNA, 19 nt, Escherichia coli CFT073
ugcaucaaguucuuucgcu

SEQ ID NO: 2611969 - RNA, 18 nt, Escherichia coli CFT073
ugcaucaaguugauuuuu

SEQ ID NO: 2611970 - RNA, 12 nt, Escherichia coli CFT073
ugcaucacgagc

SEQ ID NO: 2611971 - RNA, 17 nt, Escherichia coli CFT073
ugcaucacgcucgcagg

SEQ ID NO: 2611972 - RNA, 16 nt, Escherichia coli CFT073
ugcauccacuuugguu

SEQ ID NO: 2611973 - RNA, 19 nt, Escherichia coli CFT073
ugcauccacuuugguuaca

SEQ ID NO: 2611974 - RNA, 22 nt, Escherichia coli CFT073
ugcaucccggcaggaauaucga

SEQ ID NO: 2611975 - RNA, 20 nt, Escherichia coli CFT073
ugcauccgauuguuccugcu

SEQ ID NO: 2611976 - RNA, 17 nt, Escherichia coli CFT073
ugcauccggcacgccgu

SEQ ID NO: 2611977 - RNA, 21 nt, Escherichia coli CFT073
ugcauccugcaccacaacacc

SEQ ID NO: 2611978 - RNA, 20 nt, Escherichia coli CFT073
ugcaucgagcgcagcaacau

SEQ ID NO: 2611979 - RNA, 14 nt, Escherichia coli CFT073
ugcaucgccugauu

SEQ ID NO: 2611980 - RNA, 16 nt, Escherichia coli CFT073
ugcaucgccugcgcga

SEQ ID NO: 2611981 - RNA, 17 nt, Escherichia coli CFT073
ugcaucgcgaccaauca

SEQ ID NO: 2611982 - RNA, 18 nt, Escherichia coli CFT073
ugcaucgcgaccaaucac

SEQ ID NO: 2611983 - RNA, 11 nt, Escherichia coli CFT073
ugcaucggcaa

SEQ ID NO: 2611984 - RNA, 18 nt, Escherichia coli CFT073
ugcaucggggaauugugc

SEQ ID NO: 2611985 - RNA, 23 nt, Escherichia coli CFT073
ugcaucggggaauugugcuuuca

SEQ ID NO: 2611986 - RNA, 21 nt, Escherichia coli CFT073
ugcaucgguggcgauacuggc

SEQ ID NO: 2611987 - RNA, 23 nt, Escherichia coli CFT073
ugcaucgguggcgauacuggcgu

SEQ ID NO: 2611988 - RNA, 22 nt, Escherichia coli CFT073
ugcaucuccugauuuucuucau

SEQ ID NO: 2611989 - RNA, 15 nt, Escherichia coli CFT073
ugcaucucuucaaau

SEQ ID NO: 2611990 - RNA, 14 nt, Escherichia coli CFT073
ugcaucucuuugcu

SEQ ID NO: 2611991 - RNA, 17 nt, Escherichia coli CFT073
ugcaucuucacacugau

SEQ ID NO: 2611992 - RNA, 17 nt, Escherichia coli CFT073
ugcaugauuagcacuuu

SEQ ID NO: 2611993 - RNA, 16 nt, Escherichia coli CFT073
ugcauggcaacuuuaa

SEQ ID NO: 2611994 - RNA, 22 nt, Escherichia coli CFT073
ugcauggcaacuuuaauaaucu

SEQ ID NO: 2611995 - RNA, 16 nt, Escherichia coli CFT073
ugcauguaaaucaagc

SEQ ID NO: 2611996 - RNA, 21 nt, Escherichia coli CFT073
ugcauuaauauaaucgugguu

SEQ ID NO: 2611997 - RNA, 20 nt, Escherichia coli CFT073
ugcauuacuggcuguauaua

SEQ ID NO: 2611998 - RNA, 22 nt, Escherichia coli CFT073
ugcauuccagaugaacggcuuu

SEQ ID NO: 2611999 - RNA, 20 nt, Escherichia coli CFT073
ugcauuccaguccacaucaa

SEQ ID NO: 2612000 - RNA, 19 nt, Escherichia coli CFT073
ugcauugaaggcaauugca

SEQ ID NO: 2612001 - RNA, 17 nt, Escherichia coli CFT073
ugcauugcgcugaacau

SEQ ID NO: 2612002 - RNA, 20 nt, Escherichia coli CFT073
ugcauugcgcugaacaucgu

SEQ ID NO: 2612003 - RNA, 19 nt, Escherichia coli CFT073
ugcauugcuucccauguca

SEQ ID NO: 2612004 - RNA, 15 nt, Escherichia coli CFT073
ugcauuucauugagc

SEQ ID NO: 2612005 - RNA, 19 nt, Escherichia coli CFT073
ugcauuuccgcugauucaa

SEQ ID NO: 2612006 - RNA, 12 nt, Escherichia coli CFT073
ugcauuucugga

SEQ ID NO: 2612007 - RNA, 18 nt, Escherichia coli CFT073
ugcauuuucuaugcugcc

SEQ ID NO: 2612008 - RNA, 13 nt, Escherichia coli CFT073
ugcauuuuucgcu

SEQ ID NO: 2612009 - RNA, 14 nt, Escherichia coli CFT073
ugcauuuuucgcuu

SEQ ID NO: 2612010 - RNA, 16 nt, Escherichia coli CFT073
ugcauuuuucgcuuuu

SEQ ID NO: 2612011 - RNA, 16 nt, Escherichia coli CFT073
ugcauuuuuugucggc

SEQ ID NO: 2612012 - RNA, 12 nt, Escherichia coli CFT073
ugccaaaaugca

SEQ ID NO: 2612013 - RNA, 18 nt, Escherichia coli CFT073
ugccaaacgcguccauca

SEQ ID NO: 2612014 - RNA, 16 nt, Escherichia coli CFT073
ugccaaagaaugcagu

SEQ ID NO: 2612015 - RNA, 22 nt, Escherichia coli CFT073
ugccaaagaaugcagucaguac

SEQ ID NO: 2612016 - RNA, 20 nt, Escherichia coli CFT073
ugccaaauauuucuuuauca

SEQ ID NO: 2612017 - RNA, 13 nt, Escherichia coli CFT073
ugccaaauuuacu

SEQ ID NO: 2612018 - RNA, 19 nt, Escherichia coli CFT073
ugccaaccaacgcgccgca

SEQ ID NO: 2612019 - RNA, 20 nt, Escherichia coli CFT073
ugccaaccaacgcgccgcaa

SEQ ID NO: 2612020 - RNA, 15 nt, Escherichia coli CFT073
ugccaacuuugccgu

SEQ ID NO: 2612021 - RNA, 13 nt, Escherichia coli CFT073
ugccaaggucggg

SEQ ID NO: 2612022 - RNA, 17 nt, Escherichia coli CFT073
ugccaaggucggggucg

SEQ ID NO: 2612023 - RNA, 17 nt, Escherichia coli CFT073
ugccaaguccugccaga

SEQ ID NO: 2612024 - RNA, 22 nt, Escherichia coli CFT073
ugccaauaaaacgcaccggcaa

SEQ ID NO: 2612025 - RNA, 20 nt, Escherichia coli CFT073
ugccaauaaauccuuuguac

SEQ ID NO: 2612026 - RNA, 17 nt, Escherichia coli CFT073
ugccaaucggcggcacu

SEQ ID NO: 2612027 - RNA, 22 nt, Escherichia coli CFT073
ugccaaucggcggcacucgcug

SEQ ID NO: 2612028 - RNA, 23 nt, Escherichia coli CFT073
ugccaauguugauaaucaccgaa

SEQ ID NO: 2612029 - RNA, 22 nt, Escherichia coli CFT073
ugccaauugccuggugcccauc

SEQ ID NO: 2612030 - RNA, 15 nt, Escherichia coli CFT073
ugccacaaacuggcu

SEQ ID NO: 2612031 - RNA, 19 nt, Escherichia coli CFT073
ugccacaaucucgcccgcu

SEQ ID NO: 2612032 - RNA, 23 nt, Escherichia coli CFT073
ugccacaaucucgcccgcuucau

SEQ ID NO: 2612033 - RNA, 16 nt, Escherichia coli CFT073
ugccacacaggccauu

SEQ ID NO: 2612034 - RNA, 16 nt, Escherichia coli CFT073
ugccacacgacgccag

SEQ ID NO: 2612035 - RNA, 17 nt, Escherichia coli CFT073
ugccacacgacgccagc

SEQ ID NO: 2612036 - RNA, 18 nt, Escherichia coli CFT073
ugccacaguaaaaccggu

SEQ ID NO: 2612037 - RNA, 23 nt, Escherichia coli CFT073
ugccacaguuuuacugcagccag

SEQ ID NO: 2612038 - RNA, 16 nt, Escherichia coli CFT073
ugccacauccccuccc

SEQ ID NO: 2612039 - RNA, 22 nt, Escherichia coli CFT073
ugccaccaccagcguaccgaua

SEQ ID NO: 2612040 - RNA, 12 nt, Escherichia coli CFT073
ugccaccagcac

SEQ ID NO: 2612041 - RNA, 17 nt, Escherichia coli CFT073
ugccaccagcauuccua

SEQ ID NO: 2612042 - RNA, 13 nt, Escherichia coli CFT073
ugccaccaggcag

SEQ ID NO: 2612043 - RNA, 19 nt, Escherichia coli CFT073
ugccaccauucccuggcgu

SEQ ID NO: 2612044 - RNA, 14 nt, Escherichia coli CFT073
ugccacccagcgag

SEQ ID NO: 2612045 - RNA, 21 nt, Escherichia coli CFT073
ugccaccgguacaaacaucau

SEQ ID NO: 2612046 - RNA, 15 nt, Escherichia coli CFT073
ugccaccugugcaau

SEQ ID NO: 2612047 - RNA, 15 nt, Escherichia coli CFT073
ugccacucaggcaaa

SEQ ID NO: 2612048 - RNA, 14 nt, Escherichia coli CFT073
ugccauucaguuug

SEQ ID NO: 2612049 - RNA, 16 nt, Escherichia coli CFT073
ugccauucaguuugca

SEQ ID NO: 2612050 - RNA, 16 nt, Escherichia coli CFT073
ugccauuccacaaaaa

SEQ ID NO: 2612051 - RNA, 20 nt, Escherichia coli CFT073
ugccauuccacaaaaaccac

SEQ ID NO: 2612052 - RNA, 21 nt, Escherichia coli CFT073
ugccauuccacaaaaaccacu

SEQ ID NO: 2612053 - RNA, 12 nt, Escherichia coli CFT073
ugccauugcucu

SEQ ID NO: 2612054 - RNA, 16 nt, Escherichia coli CFT073
ugccauuugaugaauu

SEQ ID NO: 2612055 - RNA, 13 nt, Escherichia coli CFT073
ugccauuuucacg

SEQ ID NO: 2612056 - RNA, 14 nt, Escherichia coli CFT073
ugcccaaagccaau

SEQ ID NO: 2612057 - RNA, 16 nt, Escherichia coli CFT073
ugcccaaagccaaucu

SEQ ID NO: 2612058 - RNA, 16 nt, Escherichia coli CFT073
ugcccaaucaaacuuc

SEQ ID NO: 2612059 - RNA, 22 nt, Escherichia coli CFT073
ugcccaaugcugguaauggcuu

SEQ ID NO: 2612060 - RNA, 23 nt, Escherichia coli CFT073
ugcccacgcaaaccaccuggcag

SEQ ID NO: 2612061 - RNA, 19 nt, Escherichia coli CFT073
ugcccacugcggcgcaaca

SEQ ID NO: 2612062 - RNA, 18 nt, Escherichia coli CFT073
ugcccagaaucgccaacg

SEQ ID NO: 2612063 - RNA, 20 nt, Escherichia coli CFT073
ugcccaguguuguauucaga

SEQ ID NO: 2612064 - RNA, 12 nt, Escherichia coli CFT073
ugcccaugcuuc

SEQ ID NO: 2612065 - RNA, 16 nt, Escherichia coli CFT073
ugccccagaauuuucc

SEQ ID NO: 2612066 - RNA, 21 nt, Escherichia coli CFT073
ugccccagagacaacccgcca

SEQ ID NO: 2612067 - RNA, 22 nt, Escherichia coli CFT073
ugccccagcgcacuacgccgca

SEQ ID NO: 2612068 - RNA, 14 nt, Escherichia coli CFT073
ugccccagugggcu

SEQ ID NO: 2612069 - RNA, 17 nt, Escherichia coli CFT073
ugccccgccaacagugc

SEQ ID NO: 2612070 - RNA, 14 nt, Escherichia coli CFT073
ugccccucacgcuu

SEQ ID NO: 2612071 - RNA, 15 nt, Escherichia coli CFT073
ugccccugaauaauc

SEQ ID NO: 2612072 - RNA, 15 nt, Escherichia coli CFT073
ugcccgaucaacgga

SEQ ID NO: 2612073 - RNA, 14 nt, Escherichia coli CFT073
ugcccgcagaucca

SEQ ID NO: 2612074 - RNA, 17 nt, Escherichia coli CFT073
ugcccgcccgacaaagc

SEQ ID NO: 2612075 - RNA, 20 nt, Escherichia coli CFT073
ugcccgcguuucgcugcguc

SEQ ID NO: 2612076 - RNA, 22 nt, Escherichia coli CFT073
ugcccgcguuucgcugcgucuu

SEQ ID NO: 2612077 - RNA, 13 nt, Escherichia coli CFT073
ugcccgcugcgca

SEQ ID NO: 2612078 - RNA, 17 nt, Escherichia coli CFT073
ugcccgcuuaacguacu

SEQ ID NO: 2612079 - RNA, 22 nt, Escherichia coli CFT073
ugcccgcuuaacguacugcuga

SEQ ID NO: 2612080 - RNA, 18 nt, Escherichia coli CFT073
ugcccgcuuuuacgcggg

SEQ ID NO: 2612081 - RNA, 22 nt, Escherichia coli CFT073
ugcccggaucucuccgggcaug

SEQ ID NO: 2612082 - RNA, 20 nt, Escherichia coli CFT073
ugcccggcaauacacgccgg

SEQ ID NO: 2612083 - RNA, 17 nt, Escherichia coli CFT073
ugcccggcccggaggau

SEQ ID NO: 2612084 - RNA, 17 nt, Escherichia coli CFT073
ugcccggcgaaccgggc

SEQ ID NO: 2612085 - RNA, 18 nt, Escherichia coli CFT073
ugcccggucgggugcuca

SEQ ID NO: 2612086 - RNA, 19 nt, Escherichia coli CFT073
ugcccgguugcuuuucaca

SEQ ID NO: 2612087 - RNA, 17 nt, Escherichia coli CFT073
ugcccguagcccaucag

SEQ ID NO: 2612088 - RNA, 13 nt, Escherichia coli CFT073
ugcccgucugcug

SEQ ID NO: 2612089 - RNA, 15 nt, Escherichia coli CFT073
ugcccgucugcugcu

SEQ ID NO: 2612090 - RNA, 16 nt, Escherichia coli CFT073
ugcccguuauucccac

SEQ ID NO: 2612091 - RNA, 19 nt, Escherichia coli CFT073
ugcccugacgcucaucacg

SEQ ID NO: 2612092 - RNA, 12 nt, Escherichia coli CFT073
ugcccuuucaac

SEQ ID NO: 2612093 - RNA, 12 nt, Escherichia coli CFT073
ugcccuuucagu

SEQ ID NO: 2612094 - RNA, 16 nt, Escherichia coli CFT073
ugcccuuugcuggcau

SEQ ID NO: 2612095 - RNA, 14 nt, Escherichia coli CFT073
ugccgaauccaaua

SEQ ID NO: 2612096 - RNA, 13 nt, Escherichia coli CFT073
ugccgacaaacag

SEQ ID NO: 2612097 - RNA, 14 nt, Escherichia coli CFT073
ugccgacaaccuga

SEQ ID NO: 2612098 - RNA, 15 nt, Escherichia coli CFT073
ugccgacaucgccac

SEQ ID NO: 2612099 - RNA, 22 nt, Escherichia coli CFT073
ugccgacguugcguugccgcca

SEQ ID NO: 2612100 - RNA, 14 nt, Escherichia coli CFT073
ugccgacuggcauc

SEQ ID NO: 2612101 - RNA, 13 nt, Escherichia coli CFT073
ugccgauaucgau

SEQ ID NO: 2612102 - RNA, 16 nt, Escherichia coli CFT073
ugccgauggcaaaagu

SEQ ID NO: 2612103 - RNA, 15 nt, Escherichia coli CFT073
ugccgauuucaacca

SEQ ID NO: 2612104 - RNA, 19 nt, Escherichia coli CFT073
ugccgauuucaaccacuca

SEQ ID NO: 2612105 - RNA, 13 nt, Escherichia coli CFT073
ugccgcacaucac

SEQ ID NO: 2612106 - RNA, 15 nt, Escherichia coli CFT073
ugccgcacaucaccg

SEQ ID NO: 2612107 - RNA, 13 nt, Escherichia coli CFT073
ugccgcagcaccc

SEQ ID NO: 2612108 - RNA, 12 nt, Escherichia coli CFT073
ugccgcaggcaa

SEQ ID NO: 2612109 - RNA, 15 nt, Escherichia coli CFT073
ugccgcaucagugau

SEQ ID NO: 2612110 - RNA, 18 nt, Escherichia coli CFT073
ugccgccaagcauuacga

SEQ ID NO: 2612111 - RNA, 21 nt, Escherichia coli CFT073
ugccgccaaucgucgccguca

SEQ ID NO: 2612112 - RNA, 18 nt, Escherichia coli CFT073
ugccgccagguuauccag

SEQ ID NO: 2612113 - RNA, 16 nt, Escherichia coli CFT073
ugccgcccguuuucuc

SEQ ID NO: 2612114 - RNA, 22 nt, Escherichia coli CFT073
ugccgcccguuuucuccagcgc

SEQ ID NO: 2612115 - RNA, 16 nt, Escherichia coli CFT073
ugccgccgacaguuau

SEQ ID NO: 2612116 - RNA, 17 nt, Escherichia coli CFT073
ugccgccggaaacauaa

SEQ ID NO: 2612117 - RNA, 18 nt, Escherichia coli CFT073
ugccgccggaaacauaaa

SEQ ID NO: 2612118 - RNA, 21 nt, Escherichia coli CFT073
ugccgcgccagaucagggaag

SEQ ID NO: 2612119 - RNA, 14 nt, Escherichia coli CFT073
ugccgcgccccauc

SEQ ID NO: 2612120 - RNA, 18 nt, Escherichia coli CFT073
ugccgcgccugcgccauc

SEQ ID NO: 2612121 - RNA, 23 nt, Escherichia coli CFT073
ugccgcggcgcggcggguuaacc

SEQ ID NO: 2612122 - RNA, 19 nt, Escherichia coli CFT073
ugccgcguuuugacagcuc

SEQ ID NO: 2612123 - RNA, 16 nt, Escherichia coli CFT073
ugccgcuacugcuugc

SEQ ID NO: 2612124 - RNA, 21 nt, Escherichia coli CFT073
ugccgcuacugcuugccaccg

SEQ ID NO: 2612125 - RNA, 23 nt, Escherichia coli CFT073
ugccgcuaguucucgggcggcag

SEQ ID NO: 2612126 - RNA, 14 nt, Escherichia coli CFT073
ugccgcuaucaggc

SEQ ID NO: 2612127 - RNA, 13 nt, Escherichia coli CFT073
ugccgcucccggc

SEQ ID NO: 2612128 - RNA, 17 nt, Escherichia coli CFT073
ugccgcucccggcauaa

SEQ ID NO: 2612129 - RNA, 18 nt, Escherichia coli CFT073
ugccgcucguuugcagau

SEQ ID NO: 2612130 - RNA, 16 nt, Escherichia coli CFT073
ugccgcucuuuuauua

SEQ ID NO: 2612131 - RNA, 21 nt, Escherichia coli CFT073
ugccgcugcgcgugaagcacg

SEQ ID NO: 2612132 - RNA, 12 nt, Escherichia coli CFT073
ugccgcuggcau

SEQ ID NO: 2612133 - RNA, 19 nt, Escherichia coli CFT073
ugccgcuuuaugugcuucu

SEQ ID NO: 2612134 - RNA, 12 nt, Escherichia coli CFT073
ugccgcuuuuaa

SEQ ID NO: 2612135 - RNA, 16 nt, Escherichia coli CFT073
ugccgcuuuuaugugc

SEQ ID NO: 2612136 - RNA, 14 nt, Escherichia coli CFT073
ugccggaacgccgc

SEQ ID NO: 2612137 - RNA, 15 nt, Escherichia coli CFT073
ugccggaagcagcaa

SEQ ID NO: 2612138 - RNA, 18 nt, Escherichia coli CFT073
ugccggaauuaauaaucc

SEQ ID NO: 2612139 - RNA, 23 nt, Escherichia coli CFT073
ugccggaauuaauaauccggcau

SEQ ID NO: 2612140 - RNA, 18 nt, Escherichia coli CFT073
ugccggaggagugcgcca

SEQ ID NO: 2612141 - RNA, 13 nt, Escherichia coli CFT073
ugccggaggcgcu

SEQ ID NO: 2612142 - RNA, 15 nt, Escherichia coli CFT073
ugccggaggcgcugg

SEQ ID NO: 2612143 - RNA, 19 nt, Escherichia coli CFT073
ugccggauaagacgcggcu

SEQ ID NO: 2612144 - RNA, 21 nt, Escherichia coli CFT073
ugccggaucaauuugccaucc

SEQ ID NO: 2612145 - RNA, 16 nt, Escherichia coli CFT073
ugccggauccagcggu

SEQ ID NO: 2612146 - RNA, 20 nt, Escherichia coli CFT073
ugccggaugacgccucaggc

SEQ ID NO: 2612147 - RNA, 21 nt, Escherichia coli CFT073
ugccggaugcaaacgauuauc

SEQ ID NO: 2612148 - RNA, 16 nt, Escherichia coli CFT073
ugccggaugcgacgca

SEQ ID NO: 2612149 - RNA, 23 nt, Escherichia coli CFT073
ugccggaugcgacgcaaacgccu

SEQ ID NO: 2612150 - RNA, 23 nt, Escherichia coli CFT073
ugccggaugcggcgaaaacgccu

SEQ ID NO: 2612151 - RNA, 15 nt, Escherichia coli CFT073
ugccggaugcggcgc

SEQ ID NO: 2612152 - RNA, 23 nt, Escherichia coli CFT073
ugccggaugcggcguaaacgccu

SEQ ID NO: 2612153 - RNA, 20 nt, Escherichia coli CFT073
ugccggauguggcacaucau

SEQ ID NO: 2612154 - RNA, 21 nt, Escherichia coli CFT073
ugccggcaucaaacgguugau

SEQ ID NO: 2612155 - RNA, 22 nt, Escherichia coli CFT073
ugccgggaagaaguuagagccg

SEQ ID NO: 2612156 - RNA, 23 nt, Escherichia coli CFT073
ugccggggaaguaaacccggcau

SEQ ID NO: 2612157 - RNA, 15 nt, Escherichia coli CFT073
ugcgagugcauccag

SEQ ID NO: 2612158 - RNA, 16 nt, Escherichia coli CFT073
ugcgauaaccaggcag

SEQ ID NO: 2612159 - RNA, 18 nt, Escherichia coli CFT073
ugcgauaaccaggcaguu

SEQ ID NO: 2612160 - RNA, 21 nt, Escherichia coli CFT073
ugcgaucccggcucauccccu

SEQ ID NO: 2612161 - RNA, 14 nt, Escherichia coli CFT073
ugcgauccugcaga

SEQ ID NO: 2612162 - RNA, 15 nt, Escherichia coli CFT073
ugcgauccugcagau

SEQ ID NO: 2612163 - RNA, 15 nt, Escherichia coli CFT073
ugcgaucgcccgcaa

SEQ ID NO: 2612164 - RNA, 17 nt, Escherichia coli CFT073
ugcgaugaucgccgcca

SEQ ID NO: 2612165 - RNA, 16 nt, Escherichia coli CFT073
ugcgaugcauccggca

SEQ ID NO: 2612166 - RNA, 17 nt, Escherichia coli CFT073
ugcgauguucccccagc

SEQ ID NO: 2612167 - RNA, 18 nt, Escherichia coli CFT073
ugcgauguucccccagcc

SEQ ID NO: 2612168 - RNA, 15 nt, Escherichia coli CFT073
ugcgauguucuucac

SEQ ID NO: 2612169 - RNA, 14 nt, Escherichia coli CFT073
ugcgauugccggau

SEQ ID NO: 2612170 - RNA, 21 nt, Escherichia coli CFT073
ugcgauuuuugacuuccagac

SEQ ID NO: 2612171 - RNA, 18 nt, Escherichia coli CFT073
ugcgcaaccgcccggccu

SEQ ID NO: 2612172 - RNA, 17 nt, Escherichia coli CFT073
ugcgcaacgcaaucccc

SEQ ID NO: 2612173 - RNA, 21 nt, Escherichia coli CFT073
ugcgcaauaaccguaacgcau

SEQ ID NO: 2612174 - RNA, 20 nt, Escherichia coli CFT073
ugcgcaauacguugcaaaau

SEQ ID NO: 2612175 - RNA, 11 nt, Escherichia coli CFT073
ugcgcaccagg

SEQ ID NO: 2612176 - RNA, 16 nt, Escherichia coli CFT073
ugcgcaccaggcgugg

SEQ ID NO: 2612177 - RNA, 14 nt, Escherichia coli CFT073
ugcgcaccuuuacc

SEQ ID NO: 2612178 - RNA, 22 nt, Escherichia coli CFT073
ugcgcacgcguaauauccagcg

SEQ ID NO: 2612179 - RNA, 19 nt, Escherichia coli CFT073
ugcgcagaguuuccaggcu

SEQ ID NO: 2612180 - RNA, 20 nt, Escherichia coli CFT073
ugcgcagcggugagccagga

SEQ ID NO: 2612181 - RNA, 23 nt, Escherichia coli CFT073
ugcgcaguaaaucgucuguuugc

SEQ ID NO: 2612182 - RNA, 15 nt, Escherichia coli CFT073
ugcgcaguugccgga

SEQ ID NO: 2612183 - RNA, 16 nt, Escherichia coli CFT073
ugcgcaguugccggau

SEQ ID NO: 2612184 - RNA, 18 nt, Escherichia coli CFT073
ugcgcauaacccaccggu

SEQ ID NO: 2612185 - RNA, 21 nt, Escherichia coli CFT073
ugcgcauaagaccgugagcaa

SEQ ID NO: 2612186 - RNA, 13 nt, Escherichia coli CFT073
ugcgcaugacaca

SEQ ID NO: 2612187 - RNA, 16 nt, Escherichia coli CFT073
ugcgcaugaccuuuca

SEQ ID NO: 2612188 - RNA, 18 nt, Escherichia coli CFT073
ugcgccaacgucugccug

SEQ ID NO: 2612189 - RNA, 19 nt, Escherichia coli CFT073
ugcgccaacgucugccugg

SEQ ID NO: 2612190 - RNA, 13 nt, Escherichia coli CFT073
ugcgccaaucgcc

SEQ ID NO: 2612191 - RNA, 17 nt, Escherichia coli CFT073
ugcgccaauguacggaa

SEQ ID NO: 2612192 - RNA, 18 nt, Escherichia coli CFT073
ugcgccacauccggcaua

SEQ ID NO: 2612193 - RNA, 18 nt, Escherichia coli CFT073
ugcgccacgaaaacccuc

SEQ ID NO: 2612194 - RNA, 20 nt, Escherichia coli CFT073
ugcgccacucgauaccagau

SEQ ID NO: 2612195 - RNA, 22 nt, Escherichia coli CFT073
ugcgccagaaaguuuuucaaca

SEQ ID NO: 2612196 - RNA, 14 nt, Escherichia coli CFT073
ugcgccagagcgcg

SEQ ID NO: 2612197 - RNA, 12 nt, Escherichia coli CFT073
ugcgccagcgag

SEQ ID NO: 2612198 - RNA, 18 nt, Escherichia coli CFT073
ugcgccagcgggaucgcc

SEQ ID NO: 2612199 - RNA, 12 nt, Escherichia coli CFT073
ugcgccagcucg

SEQ ID NO: 2612200 - RNA, 17 nt, Escherichia coli CFT073
ugcgccaguucauccag

SEQ ID NO: 2612201 - RNA, 22 nt, Escherichia coli CFT073
ugcgccauaccaugcaccaacc

SEQ ID NO: 2612202 - RNA, 21 nt, Escherichia coli CFT073
ugcgccccuggucauaggcug

SEQ ID NO: 2612203 - RNA, 11 nt, Escherichia coli CFT073
ugcgcccgcca

SEQ ID NO: 2612204 - RNA, 13 nt, Escherichia coli CFT073
ugcgcccgccagc

SEQ ID NO: 2612205 - RNA, 16 nt, Escherichia coli CFT073
ugcgcccgguuauuuu

SEQ ID NO: 2612206 - RNA, 14 nt, Escherichia coli CFT073
ugcgcccugcauca

SEQ ID NO: 2612207 - RNA, 15 nt, Escherichia coli CFT073
ugcgcccugggcuuc

SEQ ID NO: 2612208 - RNA, 18 nt, Escherichia coli CFT073
ugcgccgcauucagggca

SEQ ID NO: 2612209 - RNA, 15 nt, Escherichia coli CFT073
ugcgccgcccgccgg

SEQ ID NO: 2612210 - RNA, 22 nt, Escherichia coli CFT073
ugcgccgccgacaucugccagu

SEQ ID NO: 2612211 - RNA, 16 nt, Escherichia coli CFT073
ugcgccgcgagcauuu

SEQ ID NO: 2612212 - RNA, 15 nt, Escherichia coli CFT073
ugcgccggcgcaccg

SEQ ID NO: 2612213 - RNA, 21 nt, Escherichia coli CFT073
ugcgccguacaaguccugaau

SEQ ID NO: 2612214 - RNA, 16 nt, Escherichia coli CFT073
ugcgccgugcgaauaa

SEQ ID NO: 2612215 - RNA, 20 nt, Escherichia coli CFT073
ugcgccuacggcauucugca

SEQ ID NO: 2612216 - RNA, 22 nt, Escherichia coli CFT073
ugcgccucaagaaucacuucau

SEQ ID NO: 2612217 - RNA, 16 nt, Escherichia coli CFT073
ugcgcgaaaacgcaua

SEQ ID NO: 2612218 - RNA, 21 nt, Escherichia coli CFT073
ugcgcgaagaaacgaccucca

SEQ ID NO: 2612219 - RNA, 22 nt, Escherichia coli CFT073
ugcgcgaaucgccccagcaccc

SEQ ID NO: 2612220 - RNA, 17 nt, Escherichia coli CFT073
ugcgcgacguugcuucu

SEQ ID NO: 2612221 - RNA, 24 nt, Escherichia coli CFT073
ugcgcgacguugcuucucuugcug

SEQ ID NO: 2612222 - RNA, 19 nt, Escherichia coli CFT073
ugcgcgagguaacaauaaa

SEQ ID NO: 2612223 - RNA, 18 nt, Escherichia coli CFT073
ugcgcgcaaucagcaccg

SEQ ID NO: 2612224 - RNA, 16 nt, Escherichia coli CFT073
ugcgcgcuuucuccag

SEQ ID NO: 2612225 - RNA, 23 nt, Escherichia coli CFT073
ugcgcggauggccucugccagcu

SEQ ID NO: 2612226 - RNA, 14 nt, Escherichia coli CFT073
ugcgcgguguugau

SEQ ID NO: 2612227 - RNA, 21 nt, Escherichia coli CFT073
ugcgcguacuucacauacuca

SEQ ID NO: 2612228 - RNA, 21 nt, Escherichia coli CFT073
ugcgcguuauuuguugccgga

SEQ ID NO: 2612229 - RNA, 15 nt, Escherichia coli CFT073
ugcgcuacgcuuauc

SEQ ID NO: 2612230 - RNA, 22 nt, Escherichia coli CFT073
ugcgcuauaucgcugauaucaa

SEQ ID NO: 2612231 - RNA, 22 nt, Escherichia coli CFT073
ugcgcuccgcuuaucaggccua

SEQ ID NO: 2612232 - RNA, 17 nt, Escherichia coli CFT073
ugcgcucgaucaguuca

SEQ ID NO: 2612233 - RNA, 22 nt, Escherichia coli CFT073
ugcgcucgcauccugccaggac

SEQ ID NO: 2612234 - RNA, 19 nt, Escherichia coli CFT073
ugcgcucuaaaaucaucac

SEQ ID NO: 2612235 - RNA, 21 nt, Escherichia coli CFT073
ugcgcucuucaacuucagcag

SEQ ID NO: 2612236 - RNA, 15 nt, Escherichia coli CFT073
ugcgcugcaccagua

SEQ ID NO: 2612237 - RNA, 19 nt, Escherichia coli CFT073
ugcgcugcgcuuaucaggc

SEQ ID NO: 2612238 - RNA, 13 nt, Escherichia coli CFT073
ugcgcugcgcuuc

SEQ ID NO: 2612239 - RNA, 23 nt, Escherichia coli CFT073
ugcgcuggcaagaagaucagcaa

SEQ ID NO: 2612240 - RNA, 22 nt, Escherichia coli CFT073
ugcgcugggcgguaauguuuug

SEQ ID NO: 2612241 - RNA, 15 nt, Escherichia coli CFT073
ugcgcugguggcagg

SEQ ID NO: 2612242 - RNA, 13 nt, Escherichia coli CFT073
ugcgcuucaccag

SEQ ID NO: 2612243 - RNA, 16 nt, Escherichia coli CFT073
ugcgcuuccaguucca

SEQ ID NO: 2612244 - RNA, 21 nt, Escherichia coli CFT073
ugcgcuuccaguuccauccac

SEQ ID NO: 2612245 - RNA, 19 nt, Escherichia coli CFT073
ugcgcuuccggcagcuuca

SEQ ID NO: 2612246 - RNA, 14 nt, Escherichia coli CFT073
ugcgcuucugccac

SEQ ID NO: 2612247 - RNA, 20 nt, Escherichia coli CFT073
ugcgcuucuuuaaagcguuc

SEQ ID NO: 2612248 - RNA, 14 nt, Escherichia coli CFT073
ugcgcuugcagacg

SEQ ID NO: 2612249 - RNA, 16 nt, Escherichia coli CFT073
ugcgcuugcugccagu

SEQ ID NO: 2612250 - RNA, 16 nt, Escherichia coli CFT073
ugcgcuuuauucagau

SEQ ID NO: 2612251 - RNA, 14 nt, Escherichia coli CFT073
ugcggaaagagcau

SEQ ID NO: 2612252 - RNA, 16 nt, Escherichia coli CFT073
ugcggaggcaaagccu

SEQ ID NO: 2612253 - RNA, 14 nt, Escherichia coli CFT073
ugcggauaaacaua

SEQ ID NO: 2612254 - RNA, 15 nt, Escherichia coli CFT073
ugcggauaggacaag

SEQ ID NO: 2612255 - RNA, 17 nt, Escherichia coli CFT073
ugcggaucauaugcaca

SEQ ID NO: 2612256 - RNA, 21 nt, Escherichia coli CFT073
ugcggauccccugaaauauug

SEQ ID NO: 2612257 - RNA, 20 nt, Escherichia coli CFT073
ugcggauccugagcaaacag

SEQ ID NO: 2612258 - RNA, 17 nt, Escherichia coli CFT073
ugcggaucggcuggcgg

SEQ ID NO: 2612259 - RNA, 13 nt, Escherichia coli CFT073
ugcggaugcgccg

SEQ ID NO: 2612260 - RNA, 20 nt, Escherichia coli CFT073
ugcggauuaauaaggaugca

SEQ ID NO: 2612261 - RNA, 18 nt, Escherichia coli CFT073
ugcggcaauguucgccgg

SEQ ID NO: 2612262 - RNA, 20 nt, Escherichia coli CFT073
ugcggcacccauuuauccag

SEQ ID NO: 2612263 - RNA, 17 nt, Escherichia coli CFT073
ugcggcagcuccagcag

SEQ ID NO: 2612264 - RNA, 22 nt, Escherichia coli CFT073
ugcggcaggucaucgugcguca

SEQ ID NO: 2612265 - RNA, 19 nt, Escherichia coli CFT073
ugcuccaucgcaugccagc

SEQ ID NO: 2612266 - RNA, 22 nt, Escherichia coli CFT073
ugcuccauuccgugcuggcugc

SEQ ID NO: 2612267 - RNA, 14 nt, Escherichia coli CFT073
ugcucccagcgcau

SEQ ID NO: 2612268 - RNA, 13 nt, Escherichia coli CFT073
ugcuccccagacc

SEQ ID NO: 2612269 - RNA, 19 nt, Escherichia coli CFT073
ugcuccgccagugacugcg

SEQ ID NO: 2612270 - RNA, 15 nt, Escherichia coli CFT073
ugcuccgcucaucag

SEQ ID NO: 2612271 - RNA, 23 nt, Escherichia coli CFT073
ugcuccgguuuuuuauuauccgc

SEQ ID NO: 2612272 - RNA, 22 nt, Escherichia coli CFT073
ugcucgaacauccccacagaaa

SEQ ID NO: 2612273 - RNA, 17 nt, Escherichia coli CFT073
ugcucgaucagacgauc

SEQ ID NO: 2612274 - RNA, 16 nt, Escherichia coli CFT073
ugcucgccuugcugcc

SEQ ID NO: 2612275 - RNA, 16 nt, Escherichia coli CFT073
ugcucgcuggcaggcc

SEQ ID NO: 2612276 - RNA, 22 nt, Escherichia coli CFT073
ugcucguaaagcaucagacugc

SEQ ID NO: 2612277 - RNA, 16 nt, Escherichia coli CFT073
ugcucguagaagccag

SEQ ID NO: 2612278 - RNA, 17 nt, Escherichia coli CFT073
ugcucuaaaaaguuccu

SEQ ID NO: 2612279 - RNA, 22 nt, Escherichia coli CFT073
ugcucuaacccuuccagauuca

SEQ ID NO: 2612280 - RNA, 23 nt, Escherichia coli CFT073
ugcucuauugccguaaucgccuc

SEQ ID NO: 2612281 - RNA, 14 nt, Escherichia coli CFT073
ugcucuggcaggcg

SEQ ID NO: 2612282 - RNA, 14 nt, Escherichia coli CFT073
ugcucuuucacuuu

SEQ ID NO: 2612283 - RNA, 22 nt, Escherichia coli CFT073
ugcucuuugguuucgaugccuu

SEQ ID NO: 2612284 - RNA, 16 nt, Escherichia coli CFT073
ugcucuuuuugcauaa

SEQ ID NO: 2612285 - RNA, 19 nt, Escherichia coli CFT073
ugcugaacagcuuuuuccu

SEQ ID NO: 2612286 - RNA, 18 nt, Escherichia coli CFT073
ugcugaagggcaucagcc

SEQ ID NO: 2612287 - RNA, 14 nt, Escherichia coli CFT073
ugcugaccaaaucu

SEQ ID NO: 2612288 - RNA, 21 nt, Escherichia coli CFT073
ugcugacguaucuuacagagc

SEQ ID NO: 2612289 - RNA, 15 nt, Escherichia coli CFT073
ugcugacuugcggcc

SEQ ID NO: 2612290 - RNA, 22 nt, Escherichia coli CFT073
ugcugagaacauaaacacccac

SEQ ID NO: 2612291 - RNA, 20 nt, Escherichia coli CFT073
ugcugagcggcguacccucc

SEQ ID NO: 2612292 - RNA, 24 nt, Escherichia coli CFT073
ugcugaguuaccugaugcgacgcc

SEQ ID NO: 2612293 - RNA, 17 nt, Escherichia coli CFT073
ugcugauaaccgccgcc

SEQ ID NO: 2612294 - RNA, 17 nt, Escherichia coli CFT073
ugcugauacuauucauu

SEQ ID NO: 2612295 - RNA, 23 nt, Escherichia coli CFT073
ugcugauugcggucagcgcagca

SEQ ID NO: 2612296 - RNA, 17 nt, Escherichia coli CFT073
ugcugauuuuauuucac

SEQ ID NO: 2612297 - RNA, 12 nt, Escherichia coli CFT073
ugcugcaacagc

SEQ ID NO: 2612298 - RNA, 19 nt, Escherichia coli CFT073
ugcugcaaggugauuugcg

SEQ ID NO: 2612299 - RNA, 15 nt, Escherichia coli CFT073
ugcugcaaugccauu

SEQ ID NO: 2612300 - RNA, 16 nt, Escherichia coli CFT073
ugcugcaauugcggca

SEQ ID NO: 2612301 - RNA, 12 nt, Escherichia coli CFT073
ugcugcacacca

SEQ ID NO: 2612302 - RNA, 13 nt, Escherichia coli CFT073
ugcugcaccagca

SEQ ID NO: 2612303 - RNA, 15 nt, Escherichia coli CFT073
ugcugcaccccacaa

SEQ ID NO: 2612304 - RNA, 22 nt, Escherichia coli CFT073
ugcugcaccccacaaacagaau

SEQ ID NO: 2612305 - RNA, 14 nt, Escherichia coli CFT073
ugcugcacgaaauu

SEQ ID NO: 2612306 - RNA, 22 nt, Escherichia coli CFT073
ugcugcaguuuacgagugcgcu

SEQ ID NO: 2612307 - RNA, 18 nt, Escherichia coli CFT073
ugcugcaucucuuugcug

SEQ ID NO: 2612308 - RNA, 16 nt, Escherichia coli CFT073
ugcugccacucuccug

SEQ ID NO: 2612309 - RNA, 13 nt, Escherichia coli CFT073
ugcugccgcgcca

SEQ ID NO: 2612310 - RNA, 16 nt, Escherichia coli CFT073
ugcugccgcgccagau

SEQ ID NO: 2612311 - RNA, 15 nt, Escherichia coli CFT073
ugcugccggaacagg

SEQ ID NO: 2612312 - RNA, 20 nt, Escherichia coli CFT073
ugcugccguuccuggcacca

SEQ ID NO: 2612313 - RNA, 19 nt, Escherichia coli CFT073
ugcugccuucacggcuuug

SEQ ID NO: 2612314 - RNA, 14 nt, Escherichia coli CFT073
ugcugccuuucgcu

SEQ ID NO: 2612315 - RNA, 15 nt, Escherichia coli CFT073
ugcugcgcacaaaca

SEQ ID NO: 2612316 - RNA, 14 nt, Escherichia coli CFT073
ugcugcgccagcgg

SEQ ID NO: 2612317 - RNA, 20 nt, Escherichia coli CFT073
ugcugcgccauauaccgcgg

SEQ ID NO: 2612318 - RNA, 19 nt, Escherichia coli CFT073
ugcugcgggcgaucauauc

SEQ ID NO: 2612319 - RNA, 22 nt, Escherichia coli CFT073
ugcugcguuugcccuaaagcgc

SEQ ID NO: 2612320 - RNA, 15 nt, Escherichia coli CFT073
ugcugcuaaaucggg

SEQ ID NO: 2612321 - RNA, 23 nt, Escherichia coli CFT073
ugcugcuccagcguaccugccgc

SEQ ID NO: 2612322 - RNA, 22 nt, Escherichia coli CFT073
ugcugcucugguggggcaaaaa

SEQ ID NO: 2612323 - RNA, 15 nt, Escherichia coli CFT073
ugcugcucuugaucc

SEQ ID NO: 2612324 - RNA, 11 nt, Escherichia coli CFT073
ugcugcuggca

SEQ ID NO: 2612325 - RNA, 15 nt, Escherichia coli CFT073
ugcugcuggcaucac

SEQ ID NO: 2612326 - RNA, 14 nt, Escherichia coli CFT073
ugcugcuucauugc

SEQ ID NO: 2612327 - RNA, 18 nt, Escherichia coli CFT073
ugcugcuuuaucagauca

SEQ ID NO: 2612328 - RNA, 21 nt, Escherichia coli CFT073
ugcugcuuuaucagcucauag

SEQ ID NO: 2612329 - RNA, 14 nt, Escherichia coli CFT073
ugcuggauccccug

SEQ ID NO: 2612330 - RNA, 18 nt, Escherichia coli CFT073
ugcuggaugcaugccaac

SEQ ID NO: 2612331 - RNA, 14 nt, Escherichia coli CFT073
ugcuggcaccguga

SEQ ID NO: 2612332 - RNA, 12 nt, Escherichia coli CFT073
ugcuggcauuac

SEQ ID NO: 2612333 - RNA, 15 nt, Escherichia coli CFT073
ugcuggcgcauuaac

SEQ ID NO: 2612334 - RNA, 14 nt, Escherichia coli CFT073
ugcuggcggccuga

SEQ ID NO: 2612335 - RNA, 17 nt, Escherichia coli CFT073
ugcuggcguugucaucg

SEQ ID NO: 2612336 - RNA, 16 nt, Escherichia coli CFT073
ugcugggauaauugcg

SEQ ID NO: 2612337 - RNA, 20 nt, Escherichia coli CFT073
ugcugggcaacuucagcuuc

SEQ ID NO: 2612338 - RNA, 22 nt, Escherichia coli CFT073
ugcugggcgaucggcaggaaaa

SEQ ID NO: 2612339 - RNA, 11 nt, Escherichia coli CFT073
ugcugguuuug

SEQ ID NO: 2612340 - RNA, 15 nt, Escherichia coli CFT073
ugcuguaaagcacag

SEQ ID NO: 2612341 - RNA, 19 nt, Escherichia coli CFT073
ugcuguacccaaauaaacu

SEQ ID NO: 2612342 - RNA, 17 nt, Escherichia coli CFT073
ugcugucaccgaagcgg

SEQ ID NO: 2612343 - RNA, 22 nt, Escherichia coli CFT073
ugcuguccagaucgggccuggc

SEQ ID NO: 2612344 - RNA, 15 nt, Escherichia coli CFT073
ugcugugaagcaccu

SEQ ID NO: 2612345 - RNA, 19 nt, Escherichia coli CFT073
ugcuguuccagcaucacau

SEQ ID NO: 2612346 - RNA, 20 nt, Escherichia coli CFT073
ugcuguuguuccagcuucca

SEQ ID NO: 2612347 - RNA, 22 nt, Escherichia coli CFT073
ugcuguuuagugguaguugauu

SEQ ID NO: 2612348 - RNA, 23 nt, Escherichia coli CFT073
ugcuguuucgccaguuuuuucgc

SEQ ID NO: 2612349 - RNA, 12 nt, Escherichia coli CFT073
ugcuguuuuaca

SEQ ID NO: 2612350 - RNA, 23 nt, Escherichia coli CFT073
ugcuuaaauuucuuaccacuacc

SEQ ID NO: 2612351 - RNA, 22 nt, Escherichia coli CFT073
ugcuuaacauuggucagagcau

SEQ ID NO: 2612352 - RNA, 23 nt, Escherichia coli CFT073
ugcuuaagacguuguugaauagu

SEQ ID NO: 2612353 - RNA, 16 nt, Escherichia coli CFT073
ugcuuacgcagacaac

SEQ ID NO: 2612354 - RNA, 23 nt, Escherichia coli CFT073
ugcuuaucgcccugcuccagcag

SEQ ID NO: 2612355 - RNA, 20 nt, Escherichia coli CFT073
ugcuuauuaaugcuuucagu

SEQ ID NO: 2612356 - RNA, 14 nt, Escherichia coli CFT073
ugcuucaaauauug

SEQ ID NO: 2612357 - RNA, 12 nt, Escherichia coli CFT073
ugcuucagaaga

SEQ ID NO: 2612358 - RNA, 15 nt, Escherichia coli CFT073
ugcuucagcacuucu

SEQ ID NO: 2612359 - RNA, 15 nt, Escherichia coli CFT073
ugcuucagccaaagc

SEQ ID NO: 2612360 - RNA, 13 nt, Escherichia coli CFT073
ugcuucagccaga

SEQ ID NO: 2612361 - RNA, 22 nt, Escherichia coli CFT073
ugcuucagcuugagguuggaga

SEQ ID NO: 2612362 - RNA, 17 nt, Escherichia coli CFT073
ugcuucagugagcuguc

SEQ ID NO: 2612363 - RNA, 21 nt, Escherichia coli CFT073
ugcuucagugagcugucuguc

SEQ ID NO: 2612364 - RNA, 16 nt, Escherichia coli CFT073
ugcuucaguuccugau

SEQ ID NO: 2612365 - RNA, 15 nt, Escherichia coli CFT073
ugcuuccggcaagca

SEQ ID NO: 2612366 - RNA, 21 nt, Escherichia coli CFT073
ugcuuccggcaagcaaauuaa

SEQ ID NO: 2612367 - RNA, 19 nt, Escherichia coli CFT073
ugcuucgcucucuuucacc

SEQ ID NO: 2612368 - RNA, 22 nt, Escherichia coli CFT073
ugcuucggucagaauuucgacu

SEQ ID NO: 2612369 - RNA, 16 nt, Escherichia coli CFT073
ugcuucggucagcacg

SEQ ID NO: 2612370 - RNA, 19 nt, Escherichia coli CFT073
ugcuucguuaacgugucau

SEQ ID NO: 2612371 - RNA, 22 nt, Escherichia coli CFT073
ugcuucuaacaucaugauuuua

SEQ ID NO: 2612372 - RNA, 13 nt, Escherichia coli CFT073
ugcuucuagugcc

SEQ ID NO: 2612373 - RNA, 14 nt, Escherichia coli CFT073
uggcaaaauccaac

SEQ ID NO: 2612374 - RNA, 19 nt, Escherichia coli CFT073
uggcaaaauccaacauagc

SEQ ID NO: 2612375 - RNA, 19 nt, Escherichia coli CFT073
uggcaaaccaguacugacu

SEQ ID NO: 2612376 - RNA, 19 nt, Escherichia coli CFT073
uggcaaaucgacgccacua

SEQ ID NO: 2612377 - RNA, 19 nt, Escherichia coli CFT073
uggcaaaugcauagcguuc

SEQ ID NO: 2612378 - RNA, 16 nt, Escherichia coli CFT073
uggcaacauaaucaac

SEQ ID NO: 2612379 - RNA, 22 nt, Escherichia coli CFT073
uggcaacccagcguugcagaga

SEQ ID NO: 2612380 - RNA, 20 nt, Escherichia coli CFT073
uggcaacgacgguaaaccac

SEQ ID NO: 2612381 - RNA, 15 nt, Escherichia coli CFT073
uggcaacuuuguauu

SEQ ID NO: 2612382 - RNA, 21 nt, Escherichia coli CFT073
uggcaagaaacgcuccaccac

SEQ ID NO: 2612383 - RNA, 20 nt, Escherichia coli CFT073
uggcaagccugaaaacgaaa

SEQ ID NO: 2612384 - RNA, 20 nt, Escherichia coli CFT073
uggcaauacgauccugagca

SEQ ID NO: 2612385 - RNA, 19 nt, Escherichia coli CFT073
uggcaaucagcggcaguuc

SEQ ID NO: 2612386 - RNA, 14 nt, Escherichia coli CFT073
uggcaauccugcuu

SEQ ID NO: 2612387 - RNA, 23 nt, Escherichia coli CFT073
uggcaaucgccagcggcagcucg

SEQ ID NO: 2612388 - RNA, 18 nt, Escherichia coli CFT073
uggcaaucuuccucgcca

SEQ ID NO: 2612389 - RNA, 20 nt, Escherichia coli CFT073
uggcaaugaguaguuugguu

SEQ ID NO: 2612390 - RNA, 20 nt, Escherichia coli CFT073
uggcaaugcccgguguuccc

SEQ ID NO: 2612391 - RNA, 22 nt, Escherichia coli CFT073
uggcaauggucuugacauccag

SEQ ID NO: 2612392 - RNA, 20 nt, Escherichia coli CFT073
uggcaauuaacgcacaacca

SEQ ID NO: 2612393 - RNA, 21 nt, Escherichia coli CFT073
uggcaauucgugaugcccuga

SEQ ID NO: 2612394 - RNA, 19 nt, Escherichia coli CFT073
uggcaauugccauaaaaac

SEQ ID NO: 2612395 - RNA, 14 nt, Escherichia coli CFT073
uggcacaagacuga

SEQ ID NO: 2612396 - RNA, 18 nt, Escherichia coli CFT073
uggcacaagacugacaau

SEQ ID NO: 2612397 - RNA, 14 nt, Escherichia coli CFT073
uggcacacaccaga

SEQ ID NO: 2612398 - RNA, 19 nt, Escherichia coli CFT073
uggcacauaauugagcagc

SEQ ID NO: 2612399 - RNA, 19 nt, Escherichia coli CFT073
uggcacaugcauaaagcgg

SEQ ID NO: 2612400 - RNA, 14 nt, Escherichia coli CFT073
uggcacccagcgcu

SEQ ID NO: 2612401 - RNA, 24 nt, Escherichia coli CFT073
uggcaccccugcauaauuacgcca

SEQ ID NO: 2612402 - RNA, 19 nt, Escherichia coli CFT073
uggcaccgguacacaaccg

SEQ ID NO: 2612403 - RNA, 15 nt, Escherichia coli CFT073
uggcaccgugaaaga

SEQ ID NO: 2612404 - RNA, 18 nt, Escherichia coli CFT073
uggcacgcauccggcaau

SEQ ID NO: 2612405 - RNA, 21 nt, Escherichia coli CFT073
uggcacgcuucaucugccauu

SEQ ID NO: 2612406 - RNA, 19 nt, Escherichia coli CFT073
uggcacguugcugcggcgu

SEQ ID NO: 2612407 - RNA, 19 nt, Escherichia coli CFT073
uggcacuaauuaagacuga

SEQ ID NO: 2612408 - RNA, 20 nt, Escherichia coli CFT073
uggcacuaauuaagacugau

SEQ ID NO: 2612409 - RNA, 21 nt, Escherichia coli CFT073
uggcacuaauuaagacugaug

SEQ ID NO: 2612410 - RNA, 15 nt, Escherichia coli CFT073
uggcacucuuccaga

SEQ ID NO: 2612411 - RNA, 23 nt, Escherichia coli CFT073
uggcagaauacuucacaugauaa

SEQ ID NO: 2612412 - RNA, 18 nt, Escherichia coli CFT073
uggcagaaugguuucauu

SEQ ID NO: 2612413 - RNA, 22 nt, Escherichia coli CFT073
uggcagaauuugaggaagcugc

SEQ ID NO: 2612414 - RNA, 17 nt, Escherichia coli CFT073
uggcagaccagagcuga

SEQ ID NO: 2612415 - RNA, 15 nt, Escherichia coli CFT073
uggcagauaaccacu

SEQ ID NO: 2612416 - RNA, 17 nt, Escherichia coli CFT073
uggcagauacauugcca

SEQ ID NO: 2612417 - RNA, 18 nt, Escherichia coli CFT073
uggcagcaagugcggcgc

SEQ ID NO: 2612418 - RNA, 20 nt, Escherichia coli CFT073
uggcagcaccacgcagaaaa

SEQ ID NO: 2612419 - RNA, 16 nt, Escherichia coli CFT073
uggcagcaucagacua

SEQ ID NO: 2612420 - RNA, 16 nt, Escherichia coli CFT073
uggcagcaugcugcca

SEQ ID NO: 2612421 - RNA, 18 nt, Escherichia coli CFT073
uggcagcgugcguugacc

SEQ ID NO: 2612422 - RNA, 20 nt, Escherichia coli CFT073
uggcagcgugcguugaccgc

SEQ ID NO: 2612423 - RNA, 14 nt, Escherichia coli CFT073
uggcaggcaaaaau

SEQ ID NO: 2612424 - RNA, 18 nt, Escherichia coli CFT073
uggcaggccccgucagca

SEQ ID NO: 2612425 - RNA, 17 nt, Escherichia coli CFT073
uggcagugguaucaaua

SEQ ID NO: 2612426 - RNA, 16 nt, Escherichia coli CFT073
uggcagugugccugau

SEQ ID NO: 2612427 - RNA, 17 nt, Escherichia coli CFT073
uggcaguuacugcccgc

SEQ ID NO: 2612428 - RNA, 18 nt, Escherichia coli CFT073
uggcauaacgcagaaaaa

SEQ ID NO: 2612429 - RNA, 16 nt, Escherichia coli CFT073
uggcauaacguugcag

SEQ ID NO: 2612430 - RNA, 19 nt, Escherichia coli CFT073
uggcauacaacgccaugaa

SEQ ID NO: 2612431 - RNA, 15 nt, Escherichia coli CFT073
uggcauauuccgcca

SEQ ID NO: 2612432 - RNA, 16 nt, Escherichia coli CFT073
uggcauauuccgccac

SEQ ID NO: 2612433 - RNA, 16 nt, Escherichia coli CFT073
uggcaucaagaaaacu

SEQ ID NO: 2612434 - RNA, 20 nt, Escherichia coli CFT073
uggcaucaaugauaugugca

SEQ ID NO: 2612435 - RNA, 19 nt, Escherichia coli CFT073
uggcaucaccaucgggcca

SEQ ID NO: 2612436 - RNA, 19 nt, Escherichia coli CFT073
uggcaucacgcaauugcug

SEQ ID NO: 2612437 - RNA, 15 nt, Escherichia coli CFT073
uggcauccagcguuc

SEQ ID NO: 2612438 - RNA, 12 nt, Escherichia coli CFT073
uggcauccgcua

SEQ ID NO: 2612439 - RNA, 20 nt, Escherichia coli CFT073
uggcaucugauaagcccagc

SEQ ID NO: 2612440 - RNA, 17 nt, Escherichia coli CFT073
uggcaucuggugccagc

SEQ ID NO: 2612441 - RNA, 15 nt, Escherichia coli CFT073
uggcaucuucugccg

SEQ ID NO: 2612442 - RNA, 17 nt, Escherichia coli CFT073
uggcauuaacgcgaaau

SEQ ID NO: 2612443 - RNA, 22 nt, Escherichia coli CFT073
uggcauugauucgccgccgcau

SEQ ID NO: 2612444 - RNA, 21 nt, Escherichia coli CFT073
uggcauugggugcuugaggcu

SEQ ID NO: 2612445 - RNA, 22 nt, Escherichia coli CFT073
uggcauugggugcuugaggcug

SEQ ID NO: 2612446 - RNA, 22 nt, Escherichia coli CFT073
uggcauugguauuccaguucag

SEQ ID NO: 2612447 - RNA, 23 nt, Escherichia coli CFT073
uggcauuuucucgugccgccagu

SEQ ID NO: 2612448 - RNA, 14 nt, Escherichia coli CFT073
uggcauuuucugcc

SEQ ID NO: 2612449 - RNA, 22 nt, Escherichia coli CFT073
uggccaaauucagugugccacu

SEQ ID NO: 2612450 - RNA, 16 nt, Escherichia coli CFT073
uggccaacgcuuucga

SEQ ID NO: 2612451 - RNA, 20 nt, Escherichia coli CFT073
uggccaauaaagaaucacug

SEQ ID NO: 2612452 - RNA, 11 nt, Escherichia coli CFT073
uggccacagca

SEQ ID NO: 2612453 - RNA, 12 nt, Escherichia coli CFT073
uggccacagcaa

SEQ ID NO: 2612454 - RNA, 15 nt, Escherichia coli CFT073
uggccacagcaagca

SEQ ID NO: 2612455 - RNA, 18 nt, Escherichia coli CFT073
uggccagcacauuaaaau

SEQ ID NO: 2612456 - RNA, 21 nt, Escherichia coli CFT073
uggccagcggugaaaacggca

SEQ ID NO: 2612457 - RNA, 22 nt, Escherichia coli CFT073
uggccagcggugaaaacggcaa

SEQ ID NO: 2612458 - RNA, 21 nt, Escherichia coli CFT073
uggccagucgcaaaucagcgg

SEQ ID NO: 2612459 - RNA, 15 nt, Escherichia coli CFT073
uggccaguuuucaga

SEQ ID NO: 2612460 - RNA, 21 nt, Escherichia coli CFT073
uggccaucggcccguuaacca

SEQ ID NO: 2612461 - RNA, 18 nt, Escherichia coli CFT073
uggccaugaccaccgcag

SEQ ID NO: 2612462 - RNA, 18 nt, Escherichia coli CFT073
uggccaugauuaccagca

SEQ ID NO: 2612463 - RNA, 17 nt, Escherichia coli CFT073
uggccauggauucaagc

SEQ ID NO: 2612464 - RNA, 17 nt, Escherichia coli CFT073
uggcccauugccagcgc

SEQ ID NO: 2612465 - RNA, 17 nt, Escherichia coli CFT073
uggccccaggcauagaa

SEQ ID NO: 2612466 - RNA, 20 nt, Escherichia coli CFT073
uggccccagguaucguugau

SEQ ID NO: 2612467 - RNA, 16 nt, Escherichia coli CFT073
uggcccgccaagcauc

SEQ ID NO: 2612468 - RNA, 13 nt, Escherichia coli CFT073
uggcccgcgcagc

SEQ ID NO: 2612469 - RNA, 23 nt, Escherichia coli CFT073
uggccgcaagaguauuacgaucg

SEQ ID NO: 2612470 - RNA, 14 nt, Escherichia coli CFT073
uggccgccacgcgu

SEQ ID NO: 2612471 - RNA, 17 nt, Escherichia coli CFT073
uggccgcgcaauugcug

SEQ ID NO: 2612472 - RNA, 22 nt, Escherichia coli CFT073
uggccgcuccaaggucuccgcc

SEQ ID NO: 2612473 - RNA, 17 nt, Escherichia coli CFT073
uggccgggcgaugcagc

SEQ ID NO: 2612474 - RNA, 16 nt, Escherichia coli CFT073
uggccgguuugccaua

SEQ ID NO: 2612475 - RNA, 20 nt, Escherichia coli CFT073
uggccuccagcacuuccuga

SEQ ID NO: 2612476 - RNA, 23 nt, Escherichia coli CFT073
uggccucguggaaaccgagauaa

SEQ ID NO: 2612477 - RNA, 20 nt, Escherichia coli CFT073
uggccucugccagcugcuca

SEQ ID NO: 2612478 - RNA, 14 nt, Escherichia coli CFT073
uggccucuggugca

SEQ ID NO: 2612479 - RNA, 21 nt, Escherichia coli CFT073
uggccugaugcgcuuaucaga

SEQ ID NO: 2612480 - RNA, 16 nt, Escherichia coli CFT073
ugggcaaaaucaucac

SEQ ID NO: 2612481 - RNA, 15 nt, Escherichia coli CFT073
ugggcaauuucuuuc

SEQ ID NO: 2612482 - RNA, 20 nt, Escherichia coli CFT073
ugggcaccaggcaauuggca

SEQ ID NO: 2612483 - RNA, 18 nt, Escherichia coli CFT073
ugggcagcucuaucugca

SEQ ID NO: 2612484 - RNA, 24 nt, Escherichia coli CFT073
ugggcaucgcgacagugcauaaau

SEQ ID NO: 2612485 - RNA, 16 nt, Escherichia coli CFT073
ugggcaugcuucacug

SEQ ID NO: 2612486 - RNA, 17 nt, Escherichia coli CFT073
ugggcauuggcaaucac

SEQ ID NO: 2612487 - RNA, 21 nt, Escherichia coli CFT073
ugggccaccucuuuugcgauu

SEQ ID NO: 2612488 - RNA, 17 nt, Escherichia coli CFT073
ugggccauccaccagug

SEQ ID NO: 2612489 - RNA, 21 nt, Escherichia coli CFT073
ugggccugaaagcucauaacg

SEQ ID NO: 2612490 - RNA, 14 nt, Escherichia coli CFT073
ugggccuuucgcuu

SEQ ID NO: 2612491 - RNA, 22 nt, Escherichia coli CFT073
ugggcgacaaaguugaagccga

SEQ ID NO: 2612492 - RNA, 21 nt, Escherichia coli CFT073
ugggcgacggcuugccaugcc

SEQ ID NO: 2612493 - RNA, 15 nt, Escherichia coli CFT073
ugggcgauaaaauca

SEQ ID NO: 2612494 - RNA, 15 nt, Escherichia coli CFT073
ugggcgaucggcagg

SEQ ID NO: 2612495 - RNA, 17 nt, Escherichia coli CFT073
ugggcgcaccugaaucg

SEQ ID NO: 2612496 - RNA, 18 nt, Escherichia coli CFT073
ugggcgggaucuccacaa

SEQ ID NO: 2612497 - RNA, 12 nt, Escherichia coli CFT073
ugggcugguugg

SEQ ID NO: 2612498 - RNA, 18 nt, Escherichia coli CFT073
ugggcuucaccaccagaa

SEQ ID NO: 2612499 - RNA, 19 nt, Escherichia coli CFT073
ugggcuucauccagcagcg

SEQ ID NO: 2612500 - RNA, 21 nt, Escherichia coli CFT073
ugggcuucgauacugccuuuc

SEQ ID NO: 2612501 - RNA, 13 nt, Escherichia coli CFT073
uggggaaguggug

SEQ ID NO: 2612502 - RNA, 20 nt, Escherichia coli CFT073
uggggaauuugcgaguccgc

SEQ ID NO: 2612503 - RNA, 17 nt, Escherichia coli CFT073
uggggacaucaaagaaa

SEQ ID NO: 2612504 - RNA, 23 nt, Escherichia coli CFT073
uggggagaaaaacggaaagcaac

SEQ ID NO: 2612505 - RNA, 14 nt, Escherichia coli CFT073
uggggcauuuuuuc

SEQ ID NO: 2612506 - RNA, 17 nt, Escherichia coli CFT073
uggguagaaacccgcaa

SEQ ID NO: 2612507 - RNA, 16 nt, Escherichia coli CFT073
uggguauguuuugucu

SEQ ID NO: 2612508 - RNA, 22 nt, Escherichia coli CFT073
ugggucccagaagaaaaucaau

SEQ ID NO: 2612509 - RNA, 21 nt, Escherichia coli CFT073
ugggucuaaaaacaauucuuc

SEQ ID NO: 2612510 - RNA, 13 nt, Escherichia coli CFT073
uggguugccagcg

SEQ ID NO: 2612511 - RNA, 15 nt, Escherichia coli CFT073
uggguugccagcgac

SEQ ID NO: 2612512 - RNA, 13 nt, Escherichia coli CFT073
uggguuguugcac

SEQ ID NO: 2612513 - RNA, 16 nt, Escherichia coli CFT073
uggguuucuaauuuuu

SEQ ID NO: 2612514 - RNA, 16 nt, Escherichia coli CFT073
uggguuuuuuguugcc

SEQ ID NO: 2612515 - RNA, 14 nt, Escherichia coli CFT073
ugguaaagcaauaa

SEQ ID NO: 2612516 - RNA, 21 nt, Escherichia coli CFT073
ugguaaagcaauaaaccauaa

SEQ ID NO: 2612517 - RNA, 18 nt, Escherichia coli CFT073
ugguaacaguccguggca

SEQ ID NO: 2612518 - RNA, 13 nt, Escherichia coli CFT073
ugguaacgcgcca

SEQ ID NO: 2612519 - RNA, 20 nt, Escherichia coli CFT073
ugguaacuuacugaugcgca

SEQ ID NO: 2612520 - RNA, 21 nt, Escherichia coli CFT073
ugguaagcaaagcaaaggcga

SEQ ID NO: 2612521 - RNA, 14 nt, Escherichia coli CFT073
ugguaauacccaga

SEQ ID NO: 2612522 - RNA, 17 nt, Escherichia coli CFT073
ugguaauucgccagcca

SEQ ID NO: 2612523 - RNA, 22 nt, Escherichia coli CFT073
ugguacaccugcugugucucuu

SEQ ID NO: 2612524 - RNA, 17 nt, Escherichia coli CFT073
ugguacagagaacaccc

SEQ ID NO: 2612525 - RNA, 14 nt, Escherichia coli CFT073
ugguaccaggauca

SEQ ID NO: 2612526 - RNA, 15 nt, Escherichia coli CFT073
ugguaccaggaucag

SEQ ID NO: 2612527 - RNA, 20 nt, Escherichia coli CFT073
ugguacgaucagaguuggua

SEQ ID NO: 2612528 - RNA, 19 nt, Escherichia coli CFT073
ugguacgggacagcagguu

SEQ ID NO: 2612529 - RNA, 13 nt, Escherichia coli CFT073
ugguacuggcgac

SEQ ID NO: 2612530 - RNA, 20 nt, Escherichia coli CFT073
ugguacuucaaucgccacca

SEQ ID NO: 2612531 - RNA, 20 nt, Escherichia coli CFT073
ugguagaaacgcugaaugcu

SEQ ID NO: 2612532 - RNA, 12 nt, Escherichia coli CFT073
ugguagaaaucu

SEQ ID NO: 2612533 - RNA, 20 nt, Escherichia coli CFT073
ugguagagauuuuuccccac

SEQ ID NO: 2612534 - RNA, 15 nt, Escherichia coli CFT073
ugguagagcacgacc

SEQ ID NO: 2612535 - RNA, 22 nt, Escherichia coli CFT073
ugguagagcacgaccuugccaa

SEQ ID NO: 2612536 - RNA, 21 nt, Escherichia coli CFT073
ugguauaaggagcaauaauca

SEQ ID NO: 2612537 - RNA, 14 nt, Escherichia coli CFT073
ugguauagaaugca

SEQ ID NO: 2612538 - RNA, 21 nt, Escherichia coli CFT073
ugguauagaaugcagcagcaa

SEQ ID NO: 2612539 - RNA, 12 nt, Escherichia coli CFT073
ugguaucaaaau

SEQ ID NO: 2612540 - RNA, 13 nt, Escherichia coli CFT073
ugguaucaaacag

SEQ ID NO: 2612541 - RNA, 22 nt, Escherichia coli CFT073
ugguauccacacugguucccag

SEQ ID NO: 2612542 - RNA, 21 nt, Escherichia coli CFT073
ugguaugccauccggcucgca

SEQ ID NO: 2612543 - RNA, 23 nt, Escherichia coli CFT073
uggucaacaaccaguugagcgga

SEQ ID NO: 2612544 - RNA, 13 nt, Escherichia coli CFT073
uggucagagcauu

SEQ ID NO: 2612545 - RNA, 18 nt, Escherichia coli CFT073
uggucagaucagccacuu

SEQ ID NO: 2612546 - RNA, 13 nt, Escherichia coli CFT073
uggucaguuaaca

SEQ ID NO: 2612547 - RNA, 12 nt, Escherichia coli CFT073
uggucaucauca

SEQ ID NO: 2612548 - RNA, 13 nt, Escherichia coli CFT073
uggucaucaucag

SEQ ID NO: 2612549 - RNA, 13 nt, Escherichia coli CFT073
uggucaucaucau

SEQ ID NO: 2612550 - RNA, 14 nt, Escherichia coli CFT073
uggucauucgucca

SEQ ID NO: 2612551 - RNA, 14 nt, Escherichia coli CFT073
uggucauuuuauug

SEQ ID NO: 2612552 - RNA, 21 nt, Escherichia coli CFT073
ugguccacacgcgcccagccu

SEQ ID NO: 2612553 - RNA, 14 nt, Escherichia coli CFT073
ugguccaguuaagc

SEQ ID NO: 2612554 - RNA, 13 nt, Escherichia coli CFT073
ugguccgauugua

SEQ ID NO: 2612555 - RNA, 18 nt, Escherichia coli CFT073
ugguccggcgguguaaug

SEQ ID NO: 2612556 - RNA, 23 nt, Escherichia coli CFT073
ugguccuugguggccauguuguu

SEQ ID NO: 2612557 - RNA, 13 nt, Escherichia coli CFT073
uggucgacaacca

SEQ ID NO: 2612558 - RNA, 14 nt, Escherichia coli CFT073
uggucgcaucaucc

SEQ ID NO: 2612559 - RNA, 19 nt, Escherichia coli CFT073
uggucgcucgagccgcauc

SEQ ID NO: 2612560 - RNA, 13 nt, Escherichia coli CFT073
uggucgugguaau

SEQ ID NO: 2612561 - RNA, 23 nt, Escherichia coli CFT073
uggucugacgcugaauacgcacc

SEQ ID NO: 2612562 - RNA, 13 nt, Escherichia coli CFT073
uggucugccauca

SEQ ID NO: 2612563 - RNA, 17 nt, Escherichia coli CFT073
uggugagggcaaacaga

SEQ ID NO: 2612564 - RNA, 17 nt, Escherichia coli CFT073
uggugagugcgguuuug

SEQ ID NO: 2612565 - RNA, 15 nt, Escherichia coli CFT073
uggugaguggcgcga

SEQ ID NO: 2612566 - RNA, 19 nt, Escherichia coli CFT073
uggugaugagcugaccaga

SEQ ID NO: 2612567 - RNA, 13 nt, Escherichia coli CFT073
uggugaugccauc

SEQ ID NO: 2612568 - RNA, 13 nt, Escherichia coli CFT073
uggugauugcaaa

SEQ ID NO: 2612569 - RNA, 20 nt, Escherichia coli CFT073
uggugcaauccacaagcaca

SEQ ID NO: 2612570 - RNA, 15 nt, Escherichia coli CFT073
uggugcauaacacaa

SEQ ID NO: 2612571 - RNA, 16 nt, Escherichia coli CFT073
uggugccagcgccagc

SEQ ID NO: 2612572 - RNA, 22 nt, Escherichia coli CFT073
uggugcccaggguaagaugaau

SEQ ID NO: 2612573 - RNA, 20 nt, Escherichia coli CFT073
uggugcgaaacggaaucacc

SEQ ID NO: 2612574 - RNA, 22 nt, Escherichia coli CFT073
uggugcuaauuugaaaugacgc

SEQ ID NO: 2612575 - RNA, 16 nt, Escherichia coli CFT073
uggugcuguuuucucc

SEQ ID NO: 2612576 - RNA, 22 nt, Escherichia coli CFT073
uggugcuuuauguaauccugua

SEQ ID NO: 2612577 - RNA, 14 nt, Escherichia coli CFT073
ugguggcagccagc

SEQ ID NO: 2612578 - RNA, 21 nt, Escherichia coli CFT073
ugguggccgccacgcgugagc

SEQ ID NO: 2612579 - RNA, 18 nt, Escherichia coli CFT073
ugguggggcauugaaaau

SEQ ID NO: 2612580 - RNA, 15 nt, Escherichia coli CFT073
uggugguaacgcuca

SEQ ID NO: 2612581 - RNA, 13 nt, Escherichia coli CFT073
ugguggucgcauc

SEQ ID NO: 2612582 - RNA, 16 nt, Escherichia coli CFT073
ugguguaaccuucacc

SEQ ID NO: 2612583 - RNA, 14 nt, Escherichia coli CFT073
ugguguaguuaaua

SEQ ID NO: 2612584 - RNA, 18 nt, Escherichia coli CFT073
ugguguauuuacccggau

SEQ ID NO: 2612585 - RNA, 18 nt, Escherichia coli CFT073
uggugucgcaccuuucaa

SEQ ID NO: 2612586 - RNA, 19 nt, Escherichia coli CFT073
uggugucgcaccuuucaac

SEQ ID NO: 2612587 - RNA, 23 nt, Escherichia coli CFT073
ugguguggagugcagcacucgau

SEQ ID NO: 2612588 - RNA, 23 nt, Escherichia coli CFT073
ugguuaaacgugaauuuuuacuu

SEQ ID NO: 2612589 - RNA, 18 nt, Escherichia coli CFT073
uguagauauccacaacaa

SEQ ID NO: 2612590 - RNA, 17 nt, Escherichia coli CFT073
uguagauauucuuccag

SEQ ID NO: 2612591 - RNA, 20 nt, Escherichia coli CFT073
uguagauugcacaugcuaaa

SEQ ID NO: 2612592 - RNA, 12 nt, Escherichia coli CFT073
uguagccgccau

SEQ ID NO: 2612593 - RNA, 15 nt, Escherichia coli CFT073
uguagcgcuguaagc

SEQ ID NO: 2612594 - RNA, 18 nt, Escherichia coli CFT073
uguagcggaucgccgccg

SEQ ID NO: 2612595 - RNA, 17 nt, Escherichia coli CFT073
uguagcggcguuuuccc

SEQ ID NO: 2612596 - RNA, 19 nt, Escherichia coli CFT073
uguaggcaggauaaggcgu

SEQ ID NO: 2612597 - RNA, 14 nt, Escherichia coli CFT073
uguaggccagauaa

SEQ ID NO: 2612598 - RNA, 20 nt, Escherichia coli CFT073
uguaggccagauaagacgcg

SEQ ID NO: 2612599 - RNA, 18 nt, Escherichia coli CFT073
uguaggcccgauaagcuu

SEQ ID NO: 2612600 - RNA, 20 nt, Escherichia coli CFT073
uguaggccgaauaaggcggu

SEQ ID NO: 2612601 - RNA, 21 nt, Escherichia coli CFT073
uguaggccgaauaaggcgguu

SEQ ID NO: 2612602 - RNA, 20 nt, Escherichia coli CFT073
uguaggccggauaaggcauu

SEQ ID NO: 2612603 - RNA, 20 nt, Escherichia coli CFT073
uguaggccggauaaggcgcg

SEQ ID NO: 2612604 - RNA, 20 nt, Escherichia coli CFT073
uguaggccggaugaggcguu

SEQ ID NO: 2612605 - RNA, 11 nt, Escherichia coli CFT073
uguaggccuga

SEQ ID NO: 2612606 - RNA, 20 nt, Escherichia coli CFT073
uguaggccugauaagacacg

SEQ ID NO: 2612607 - RNA, 20 nt, Escherichia coli CFT073
uguaggccugauaagacgcg

SEQ ID NO: 2612608 - RNA, 20 nt, Escherichia coli CFT073
uguaggccugauaagcggag

SEQ ID NO: 2612609 - RNA, 21 nt, Escherichia coli CFT073
uguaggccugaucagcgaagc

SEQ ID NO: 2612610 - RNA, 16 nt, Escherichia coli CFT073
uguaggcguuauacau

SEQ ID NO: 2612611 - RNA, 19 nt, Escherichia coli CFT073
uguaggcuggauaaggcgu

SEQ ID NO: 2612612 - RNA, 18 nt, Escherichia coli CFT073
uguagggcagcguugcca

SEQ ID NO: 2612613 - RNA, 16 nt, Escherichia coli CFT073
uguaggguggcgucaa

SEQ ID NO: 2612614 - RNA, 21 nt, Escherichia coli CFT073
uguaggguggggaaaaaacac

SEQ ID NO: 2612615 - RNA, 18 nt, Escherichia coli CFT073
uguagucauuuuuugcaa

SEQ ID NO: 2612616 - RNA, 20 nt, Escherichia coli CFT073
uguaguccggauaaggcguu

SEQ ID NO: 2612617 - RNA, 19 nt, Escherichia coli CFT073
uguaguuaaaaaaugcagc

SEQ ID NO: 2612618 - RNA, 16 nt, Escherichia coli CFT073
uguauacaaaaucugu

SEQ ID NO: 2612619 - RNA, 19 nt, Escherichia coli CFT073
uguauaccaaucguccucc

SEQ ID NO: 2612620 - RNA, 19 nt, Escherichia coli CFT073
uguauacgggcuuuuuaau

SEQ ID NO: 2612621 - RNA, 11 nt, Escherichia coli CFT073
uguaucaccac

SEQ ID NO: 2612622 - RNA, 17 nt, Escherichia coli CFT073
uguaucgcaucaggcau

SEQ ID NO: 2612623 - RNA, 14 nt, Escherichia coli CFT073
uguaucguaaaaug

SEQ ID NO: 2612624 - RNA, 12 nt, Escherichia coli CFT073
uguaucuucauc

SEQ ID NO: 2612625 - RNA, 12 nt, Escherichia coli CFT073
uguaucuuucau

SEQ ID NO: 2612626 - RNA, 14 nt, Escherichia coli CFT073
uguaugacaaaaga

SEQ ID NO: 2612627 - RNA, 19 nt, Escherichia coli CFT073
uguaugcacacggaucuga

SEQ ID NO: 2612628 - RNA, 18 nt, Escherichia coli CFT073
uguauggccuggugagug

SEQ ID NO: 2612629 - RNA, 15 nt, Escherichia coli CFT073
uguaugucauaaaaa

SEQ ID NO: 2612630 - RNA, 19 nt, Escherichia coli CFT073
uguauuaauaccagaauaa

SEQ ID NO: 2612631 - RNA, 13 nt, Escherichia coli CFT073
uguauucaugccc

SEQ ID NO: 2612632 - RNA, 17 nt, Escherichia coli CFT073
uguauucaugcccugcc

SEQ ID NO: 2612633 - RNA, 17 nt, Escherichia coli CFT073
uguauuccgggaacgau

SEQ ID NO: 2612634 - RNA, 12 nt, Escherichia coli CFT073
uguauuuacccg

SEQ ID NO: 2612635 - RNA, 13 nt, Escherichia coli CFT073
ugucaacagcguu

SEQ ID NO: 2612636 - RNA, 20 nt, Escherichia coli CFT073
ugucaacugcgccacucgau

SEQ ID NO: 2612637 - RNA, 13 nt, Escherichia coli CFT073
ugucaauaaacgc

SEQ ID NO: 2612638 - RNA, 12 nt, Escherichia coli CFT073
ugucaauaauau

SEQ ID NO: 2612639 - RNA, 16 nt, Escherichia coli CFT073
ugucaccacccugccc

SEQ ID NO: 2612640 - RNA, 22 nt, Escherichia coli CFT073
ugucaccauuggcauugguauc

SEQ ID NO: 2612641 - RNA, 14 nt, Escherichia coli CFT073
ugucaccgccucca

SEQ ID NO: 2612642 - RNA, 17 nt, Escherichia coli CFT073
ugucaccgucacaucaa

SEQ ID NO: 2612643 - RNA, 17 nt, Escherichia coli CFT073
ugucaccuaauuuaaaa

SEQ ID NO: 2612644 - RNA, 18 nt, Escherichia coli CFT073
ugucacgucaucccccag

SEQ ID NO: 2612645 - RNA, 16 nt, Escherichia coli CFT073
ugucacgucucaucag

SEQ ID NO: 2612646 - RNA, 18 nt, Escherichia coli CFT073
ugucacgucucaucaggc

SEQ ID NO: 2612647 - RNA, 20 nt, Escherichia coli CFT073
ugucacuacgguguaacccg

SEQ ID NO: 2612648 - RNA, 16 nt, Escherichia coli CFT073
ugucacuggccagcgg

SEQ ID NO: 2612649 - RNA, 17 nt, Escherichia coli CFT073
ugucagaaagaaauuuc

SEQ ID NO: 2612650 - RNA, 16 nt, Escherichia coli CFT073
ugucagaaaugauggg

SEQ ID NO: 2612651 - RNA, 14 nt, Escherichia coli CFT073
ugucagaaguugca

SEQ ID NO: 2612652 - RNA, 21 nt, Escherichia coli CFT073
ugucagacuaucuuuggcauu

SEQ ID NO: 2612653 - RNA, 14 nt, Escherichia coli CFT073
ugucagaugcggca

SEQ ID NO: 2612654 - RNA, 15 nt, Escherichia coli CFT073
ugucagcaccagaga

SEQ ID NO: 2612655 - RNA, 19 nt, Escherichia coli CFT073
ugucagcaccagagaacug

SEQ ID NO: 2612656 - RNA, 20 nt, Escherichia coli CFT073
ugucagcaccagagaacuga

SEQ ID NO: 2612657 - RNA, 18 nt, Escherichia coli CFT073
ugucagcaugucuugccu

SEQ ID NO: 2612658 - RNA, 13 nt, Escherichia coli CFT073
ugucagcccuucc

SEQ ID NO: 2612659 - RNA, 15 nt, Escherichia coli CFT073
ugucagcucauccag

SEQ ID NO: 2612660 - RNA, 16 nt, Escherichia coli CFT073
ugucagcucauccagc

SEQ ID NO: 2612661 - RNA, 16 nt, Escherichia coli CFT073
ugucaggaucaccaau

SEQ ID NO: 2612662 - RNA, 23 nt, Escherichia coli CFT073
ugucagugcccggcccggaggau

SEQ ID NO: 2612663 - RNA, 13 nt, Escherichia coli CFT073
ugucagugcgcga

SEQ ID NO: 2612664 - RNA, 23 nt, Escherichia coli CFT073
ugucauaccacauacauaauaau

SEQ ID NO: 2612665 - RNA, 16 nt, Escherichia coli CFT073
ugucauauaauguauc

SEQ ID NO: 2612666 - RNA, 17 nt, Escherichia coli CFT073
ugucauaugcaaugcau

SEQ ID NO: 2612667 - RNA, 11 nt, Escherichia coli CFT073
ugucaucaauu

SEQ ID NO: 2612668 - RNA, 17 nt, Escherichia coli CFT073
ugucaucagucagagcc

SEQ ID NO: 2612669 - RNA, 13 nt, Escherichia coli CFT073
ugucaucagucuu

SEQ ID NO: 2612670 - RNA, 20 nt, Escherichia coli CFT073
ugucaucaucgcucccaaac

SEQ ID NO: 2612671 - RNA, 21 nt, Escherichia coli CFT073
ugucaucauugguuaacucca

SEQ ID NO: 2612672 - RNA, 18 nt, Escherichia coli CFT073
ugucaucccuuccugccc

SEQ ID NO: 2612673 - RNA, 15 nt, Escherichia coli CFT073
ugucauuauaucuua

SEQ ID NO: 2612674 - RNA, 16 nt, Escherichia coli CFT073
ugucauucauucagau

SEQ ID NO: 2612675 - RNA, 12 nt, Escherichia coli CFT073
ugucauucgccu

SEQ ID NO: 2612676 - RNA, 14 nt, Escherichia coli CFT073
ugucauugaauguu

SEQ ID NO: 2612677 - RNA, 18 nt, Escherichia coli CFT073
ugucauuguuauaauguu

SEQ ID NO: 2612678 - RNA, 19 nt, Escherichia coli CFT073
ugucauuuugccuuugguc

SEQ ID NO: 2612679 - RNA, 13 nt, Escherichia coli CFT073
uguccaaauccuu

SEQ ID NO: 2612680 - RNA, 12 nt, Escherichia coli CFT073
uguccacgccgc

SEQ ID NO: 2612681 - RNA, 22 nt, Escherichia coli CFT073
uguccacgccgcugucuaccag

SEQ ID NO: 2612682 - RNA, 13 nt, Escherichia coli CFT073
uguccagaucuuu

SEQ ID NO: 2612683 - RNA, 18 nt, Escherichia coli CFT073
uguccagaugcuguacca

SEQ ID NO: 2612684 - RNA, 18 nt, Escherichia coli CFT073
uguccagcuuaauucugu

SEQ ID NO: 2612685 - RNA, 19 nt, Escherichia coli CFT073
uguccagggcgaaaagcuu

SEQ ID NO: 2612686 - RNA, 19 nt, Escherichia coli CFT073
uguccagugcaacuuuacu

SEQ ID NO: 2612687 - RNA, 18 nt, Escherichia coli CFT073
uguccggcaccauuggaa

SEQ ID NO: 2612688 - RNA, 23 nt, Escherichia coli CFT073
uguccggcagagaggacucugcc

SEQ ID NO: 2612689 - RNA, 18 nt, Escherichia coli CFT073
uguccggcgcacuggugc

SEQ ID NO: 2612690 - RNA, 14 nt, Escherichia coli CFT073
uguccguaucccac

SEQ ID NO: 2612691 - RNA, 20 nt, Escherichia coli CFT073
uguccugcggcguaccaaua

SEQ ID NO: 2612692 - RNA, 13 nt, Escherichia coli CFT073
uguccuucucauc

SEQ ID NO: 2612693 - RNA, 18 nt, Escherichia coli CFT073
ugucgauuaucgacucgc

SEQ ID NO: 2612694 - RNA, 19 nt, Escherichia coli CFT073
ugucgcacggcgcaccgca

SEQ ID NO: 2612695 - RNA, 13 nt, Escherichia coli CFT073
ugucgcaucaggc

SEQ ID NO: 2612696 - RNA, 14 nt, Escherichia coli CFT073
ugucgcaucaggca

SEQ ID NO: 2612697 - RNA, 16 nt, Escherichia coli CFT073
ugucgcaucaggcauc

SEQ ID NO: 2612698 - RNA, 18 nt, Escherichia coli CFT073
uuaaacacgggguuaaau

SEQ ID NO: 2612699 - RNA, 21 nt, Escherichia coli CFT073
uuaaacagaauacccagcaau

SEQ ID NO: 2612700 - RNA, 16 nt, Escherichia coli CFT073
uuaaacagcacagcca

SEQ ID NO: 2612701 - RNA, 19 nt, Escherichia coli CFT073
uuaaacagcacagccagug

SEQ ID NO: 2612702 - RNA, 23 nt, Escherichia coli CFT073
uuaaacagcccuuugauuugucu

SEQ ID NO: 2612703 - RNA, 18 nt, Escherichia coli CFT073
uuaaaccaacaaaacuca

SEQ ID NO: 2612704 - RNA, 23 nt, Escherichia coli CFT073
uuaaaccacuuaacguuaccuuu

SEQ ID NO: 2612705 - RNA, 17 nt, Escherichia coli CFT073
uuaaaccagaucugacg

SEQ ID NO: 2612706 - RNA, 22 nt, Escherichia coli CFT073
uuaaaccagugcccgaccacuu

SEQ ID NO: 2612707 - RNA, 15 nt, Escherichia coli CFT073
uuaaaccaucagcca

SEQ ID NO: 2612708 - RNA, 18 nt, Escherichia coli CFT073
uuaaaccuuguuuaaucu

SEQ ID NO: 2612709 - RNA, 22 nt, Escherichia coli CFT073
uuaaacgcaguaaacgccaggg

SEQ ID NO: 2612710 - RNA, 17 nt, Escherichia coli CFT073
uuaaacgggucaucaaa

SEQ ID NO: 2612711 - RNA, 20 nt, Escherichia coli CFT073
uuaaacgggucaucaaaauc

SEQ ID NO: 2612712 - RNA, 15 nt, Escherichia coli CFT073
uuaaacuuucauaaa

SEQ ID NO: 2612713 - RNA, 14 nt, Escherichia coli CFT073
uuaaagagaucaaa

SEQ ID NO: 2612714 - RNA, 17 nt, Escherichia coli CFT073
uuaaagauaaugccagc

SEQ ID NO: 2612715 - RNA, 14 nt, Escherichia coli CFT073
uuaaagcacaaaaa

SEQ ID NO: 2612716 - RNA, 19 nt, Escherichia coli CFT073
uuaaagcguuccagcagcu

SEQ ID NO: 2612717 - RNA, 23 nt, Escherichia coli CFT073
uuaaagcuacccgcgcagugcag

SEQ ID NO: 2612718 - RNA, 19 nt, Escherichia coli CFT073
uuaaagcucuucuuacgug

SEQ ID NO: 2612719 - RNA, 19 nt, Escherichia coli CFT073
uuaaagcuuuacuccuaau

SEQ ID NO: 2612720 - RNA, 17 nt, Escherichia coli CFT073
uuaaaggcaccaauauu

SEQ ID NO: 2612721 - RNA, 17 nt, Escherichia coli CFT073
uuaaaggugucaauaau

SEQ ID NO: 2612722 - RNA, 18 nt, Escherichia coli CFT073
uuaaaggugucaauaaua

SEQ ID NO: 2612723 - RNA, 21 nt, Escherichia coli CFT073
uuaaaguuaguaccgaacagc

SEQ ID NO: 2612724 - RNA, 15 nt, Escherichia coli CFT073
uuaaauauccuugca

SEQ ID NO: 2612725 - RNA, 23 nt, Escherichia coli CFT073
uuaaaucauccuguucauuuuua

SEQ ID NO: 2612726 - RNA, 21 nt, Escherichia coli CFT073
uuaaauccuuagcagacguuu

SEQ ID NO: 2612727 - RNA, 17 nt, Escherichia coli CFT073
uuaaauggacgcaaaaa

SEQ ID NO: 2612728 - RNA, 12 nt, Escherichia coli CFT073
uuaaauucagca

SEQ ID NO: 2612729 - RNA, 14 nt, Escherichia coli CFT073
uuaaauucaggccg

SEQ ID NO: 2612730 - RNA, 17 nt, Escherichia coli CFT073
uuaaauugccugugaag

SEQ ID NO: 2612731 - RNA, 22 nt, Escherichia coli CFT073
uuaaauugcgacugaaccagcg

SEQ ID NO: 2612732 - RNA, 18 nt, Escherichia coli CFT073
uuaacaauauuaacaaca

SEQ ID NO: 2612733 - RNA, 16 nt, Escherichia coli CFT073
uuaacacacaauuacc

SEQ ID NO: 2612734 - RNA, 19 nt, Escherichia coli CFT073
uuaacacacaauuaccuuc

SEQ ID NO: 2612735 - RNA, 18 nt, Escherichia coli CFT073
uuaacacaguuguaauaa

SEQ ID NO: 2612736 - RNA, 17 nt, Escherichia coli CFT073
uuaacaguuccagcaaa

SEQ ID NO: 2612737 - RNA, 12 nt, Escherichia coli CFT073
uuaacaucccca

SEQ ID NO: 2612738 - RNA, 13 nt, Escherichia coli CFT073
uuaacauccccau

SEQ ID NO: 2612739 - RNA, 18 nt, Escherichia coli CFT073
uuaacaucuuaauagcug

SEQ ID NO: 2612740 - RNA, 17 nt, Escherichia coli CFT073
uuaaccacuucagaacc

SEQ ID NO: 2612741 - RNA, 15 nt, Escherichia coli CFT073
uuaaccagcaccagc

SEQ ID NO: 2612742 - RNA, 13 nt, Escherichia coli CFT073
uuaaccaggcaag

SEQ ID NO: 2612743 - RNA, 19 nt, Escherichia coli CFT073
uuaacccauuuaaaaauca

SEQ ID NO: 2612744 - RNA, 17 nt, Escherichia coli CFT073
uuaaccccagaggcgau

SEQ ID NO: 2612745 - RNA, 23 nt, Escherichia coli CFT073
uuaacccguaaaaaucggcaaca

SEQ ID NO: 2612746 - RNA, 22 nt, Escherichia coli CFT073
uuaaccucaggaaauugcacca

SEQ ID NO: 2612747 - RNA, 22 nt, Escherichia coli CFT073
uuaacgaaggugaacgccacca

SEQ ID NO: 2612748 - RNA, 19 nt, Escherichia coli CFT073
uuaacgagucauuguaaau

SEQ ID NO: 2612749 - RNA, 23 nt, Escherichia coli CFT073
uuaacgcagcaaaagcaggcacc

SEQ ID NO: 2612750 - RNA, 20 nt, Escherichia coli CFT073
uuaacgcccugaugcaucaa

SEQ ID NO: 2612751 - RNA, 21 nt, Escherichia coli CFT073
uuaacgccuucccuuucagca

SEQ ID NO: 2612752 - RNA, 17 nt, Escherichia coli CFT073
uuaacgcgaaauaauca

SEQ ID NO: 2612753 - RNA, 19 nt, Escherichia coli CFT073
uuaacggaggagagugcaa

SEQ ID NO: 2612754 - RNA, 20 nt, Escherichia coli CFT073
uuaacggccacgaugcacag

SEQ ID NO: 2612755 - RNA, 14 nt, Escherichia coli CFT073
uuaacgguaucuuu

SEQ ID NO: 2612756 - RNA, 23 nt, Escherichia coli CFT073
uuaacggucauucgacgcgcgca

SEQ ID NO: 2612757 - RNA, 17 nt, Escherichia coli CFT073
uuaacuaaaugaaauau

SEQ ID NO: 2612758 - RNA, 19 nt, Escherichia coli CFT073
uuaacuaaaugaaauauuu

SEQ ID NO: 2612759 - RNA, 18 nt, Escherichia coli CFT073
uuaacuccuucuaaagca

SEQ ID NO: 2612760 - RNA, 19 nt, Escherichia coli CFT073
uuaacugccauuucauaaa

SEQ ID NO: 2612761 - RNA, 21 nt, Escherichia coli CFT073
uuaacugcccgaucaacggau

SEQ ID NO: 2612762 - RNA, 17 nt, Escherichia coli CFT073
uuaacuucaucggcaaa

SEQ ID NO: 2612763 - RNA, 20 nt, Escherichia coli CFT073
uuaagaauuucucaguuguu

SEQ ID NO: 2612764 - RNA, 16 nt, Escherichia coli CFT073
uuaagcauuggcaugc

SEQ ID NO: 2612765 - RNA, 18 nt, Escherichia coli CFT073
uuaagccaguucucacca

SEQ ID NO: 2612766 - RNA, 20 nt, Escherichia coli CFT073
uuaagccaguucucaccaaa

SEQ ID NO: 2612767 - RNA, 15 nt, Escherichia coli CFT073
uuaagccaucaucaa

SEQ ID NO: 2612768 - RNA, 18 nt, Escherichia coli CFT073
uuaagccaucaucaauau

SEQ ID NO: 2612769 - RNA, 14 nt, Escherichia coli CFT073
uuaagccgcugugu

SEQ ID NO: 2612770 - RNA, 15 nt, Escherichia coli CFT073
uuaagcgucgcauca

SEQ ID NO: 2612771 - RNA, 18 nt, Escherichia coli CFT073
uuaagcgucgcaucaggc

SEQ ID NO: 2612772 - RNA, 19 nt, Escherichia coli CFT073
uuaagcguucugcaauuug

SEQ ID NO: 2612773 - RNA, 21 nt, Escherichia coli CFT073
uuaagcuaacgcguuaucaga

SEQ ID NO: 2612774 - RNA, 15 nt, Escherichia coli CFT073
uuaaggaaaaacgaa

SEQ ID NO: 2612775 - RNA, 13 nt, Escherichia coli CFT073
uuaaggguaaaaa

SEQ ID NO: 2612776 - RNA, 14 nt, Escherichia coli CFT073
uuaagguuuuuucc

SEQ ID NO: 2612777 - RNA, 23 nt, Escherichia coli CFT073
uuaagugaaccuuaagaguucaa

SEQ ID NO: 2612778 - RNA, 16 nt, Escherichia coli CFT073
uuaaguguaaucagcc

SEQ ID NO: 2612779 - RNA, 20 nt, Escherichia coli CFT073
uuaaguguccgccaauuuca

SEQ ID NO: 2612780 - RNA, 15 nt, Escherichia coli CFT073
uuaauaaaacgggau

SEQ ID NO: 2612781 - RNA, 14 nt, Escherichia coli CFT073
uuaauaauauaaau

SEQ ID NO: 2612782 - RNA, 14 nt, Escherichia coli CFT073
uuaauaccaucggc

SEQ ID NO: 2612783 - RNA, 23 nt, Escherichia coli CFT073
uuaauaccggcauccagaccgcu

SEQ ID NO: 2612784 - RNA, 18 nt, Escherichia coli CFT073
uuaauagugguaccagga

SEQ ID NO: 2612785 - RNA, 19 nt, Escherichia coli CFT073
uuaauauaaacgacagcgu

SEQ ID NO: 2612786 - RNA, 14 nt, Escherichia coli CFT073
uuaauauauauuau

SEQ ID NO: 2612787 - RNA, 19 nt, Escherichia coli CFT073
uuaauaugcucaacaauaa

SEQ ID NO: 2612788 - RNA, 14 nt, Escherichia coli CFT073
uuaauauguugacu

SEQ ID NO: 2612789 - RNA, 14 nt, Escherichia coli CFT073
uuaaucaacucacg

SEQ ID NO: 2612790 - RNA, 13 nt, Escherichia coli CFT073
uuaaucaccagcg

SEQ ID NO: 2612791 - RNA, 13 nt, Escherichia coli CFT073
uuaaucagugcaa

SEQ ID NO: 2612792 - RNA, 19 nt, Escherichia coli CFT073
uuaaucagugcaaucagcg

SEQ ID NO: 2612793 - RNA, 13 nt, Escherichia coli CFT073
uuaaucaucaaug

SEQ ID NO: 2612794 - RNA, 19 nt, Escherichia coli CFT073
uuaaucaucaaugccagca

SEQ ID NO: 2612795 - RNA, 16 nt, Escherichia coli CFT073
uuaaucaucaugcuua

SEQ ID NO: 2612796 - RNA, 20 nt, Escherichia coli CFT073
uuaaucaucaugcuuaaaua

SEQ ID NO: 2612797 - RNA, 19 nt, Escherichia coli CFT073
uuaauccauaaccauaauu

SEQ ID NO: 2612798 - RNA, 20 nt, Escherichia coli CFT073
uuaauccauaaccauaauuu

SEQ ID NO: 2612799 - RNA, 17 nt, Escherichia coli CFT073
uuaaucccuuaaaaccg

SEQ ID NO: 2612800 - RNA, 21 nt, Escherichia coli CFT073
uuaaucccuuuacaggcguga

SEQ ID NO: 2612801 - RNA, 11 nt, Escherichia coli CFT073
uuaauccugau

SEQ ID NO: 2612802 - RNA, 19 nt, Escherichia coli CFT073
uuaaucgccaguuucugcc

SEQ ID NO: 2612803 - RNA, 17 nt, Escherichia coli CFT073
uuaaucgccuuccggca

SEQ ID NO: 2612804 - RNA, 15 nt, Escherichia coli CFT073
uuaaucgcuucaauc

SEQ ID NO: 2612805 - RNA, 19 nt, Escherichia coli CFT073
uuaaucggaugaucaucca

SEQ ID NO: 2612806 - RNA, 16 nt, Escherichia coli CFT073
uuacuaaaaagugaua

SEQ ID NO: 2612807 - RNA, 19 nt, Escherichia coli CFT073
uuacuaauuaauaauauaa

SEQ ID NO: 2612808 - RNA, 20 nt, Escherichia coli CFT073
uuacuacugacuccagguga

SEQ ID NO: 2612809 - RNA, 18 nt, Escherichia coli CFT073
uuacuauauaaaccuucu

SEQ ID NO: 2612810 - RNA, 17 nt, Escherichia coli CFT073
uuacuauccugaaagcu

SEQ ID NO: 2612811 - RNA, 19 nt, Escherichia coli CFT073
uuacucaacaaccaggcca

SEQ ID NO: 2612812 - RNA, 17 nt, Escherichia coli CFT073
uuacucacaucugacaa

SEQ ID NO: 2612813 - RNA, 22 nt, Escherichia coli CFT073
uuacucccggauaaaucuccau

SEQ ID NO: 2612814 - RNA, 16 nt, Escherichia coli CFT073
uuacucguccauagua

SEQ ID NO: 2612815 - RNA, 17 nt, Escherichia coli CFT073
uuacucucguuccacuc

SEQ ID NO: 2612816 - RNA, 20 nt, Escherichia coli CFT073
uuacucucuuucgcuugaca

SEQ ID NO: 2612817 - RNA, 13 nt, Escherichia coli CFT073
uuacucuuaucaa

SEQ ID NO: 2612818 - RNA, 13 nt, Escherichia coli CFT073
uuacugacaucaa

SEQ ID NO: 2612819 - RNA, 13 nt, Escherichia coli CFT073
uuacugaugcgca

SEQ ID NO: 2612820 - RNA, 22 nt, Escherichia coli CFT073
uuacugaugcgcacacgcgcug

SEQ ID NO: 2612821 - RNA, 22 nt, Escherichia coli CFT073
uuacuggaguaaaucagaggau

SEQ ID NO: 2612822 - RNA, 16 nt, Escherichia coli CFT073
uuacuggcauacauca

SEQ ID NO: 2612823 - RNA, 17 nt, Escherichia coli CFT073
uuacuggcuuucauuuu

SEQ ID NO: 2612824 - RNA, 15 nt, Escherichia coli CFT073
uuacuguaggccagu

SEQ ID NO: 2612825 - RNA, 15 nt, Escherichia coli CFT073
uuacugucguuuaga

SEQ ID NO: 2612826 - RNA, 23 nt, Escherichia coli CFT073
uuacuucugcugcacgaaauuac

SEQ ID NO: 2612827 - RNA, 23 nt, Escherichia coli CFT073
uuacuugcugcucugaaguuugu

SEQ ID NO: 2612828 - RNA, 13 nt, Escherichia coli CFT073
uuagaacugauca

SEQ ID NO: 2612829 - RNA, 20 nt, Escherichia coli CFT073
uuagacacaucagcaacgcu

SEQ ID NO: 2612830 - RNA, 15 nt, Escherichia coli CFT073
uuagacggaaaagac

SEQ ID NO: 2612831 - RNA, 17 nt, Escherichia coli CFT073
uuagauuguuuucaauu

SEQ ID NO: 2612832 - RNA, 14 nt, Escherichia coli CFT073
uuagcaaacgacac

SEQ ID NO: 2612833 - RNA, 21 nt, Escherichia coli CFT073
uuagcaaacgacacaugcuga

SEQ ID NO: 2612834 - RNA, 20 nt, Escherichia coli CFT073
uuagcaaagaacguaaucaa

SEQ ID NO: 2612835 - RNA, 19 nt, Escherichia coli CFT073
uuagcaaauuaucccccag

SEQ ID NO: 2612836 - RNA, 22 nt, Escherichia coli CFT073
uuagcagagcguuuaauaaaac

SEQ ID NO: 2612837 - RNA, 16 nt, Escherichia coli CFT073
uuagcaucaagaaaaa

SEQ ID NO: 2612838 - RNA, 12 nt, Escherichia coli CFT073
uuagcaugugca

SEQ ID NO: 2612839 - RNA, 21 nt, Escherichia coli CFT073
uuagcaugugcaaucuacaaa

SEQ ID NO: 2612840 - RNA, 15 nt, Escherichia coli CFT073
uuagcauuaacagua

SEQ ID NO: 2612841 - RNA, 19 nt, Escherichia coli CFT073
uuagccaaccucaaaaaga

SEQ ID NO: 2612842 - RNA, 13 nt, Escherichia coli CFT073
uuagccaucauuu

SEQ ID NO: 2612843 - RNA, 19 nt, Escherichia coli CFT073
uuagccauucuuucuuccc

SEQ ID NO: 2612844 - RNA, 14 nt, Escherichia coli CFT073
uuagcccuuuguag

SEQ ID NO: 2612845 - RNA, 22 nt, Escherichia coli CFT073
uuagccgccggggucaaaccug

SEQ ID NO: 2612846 - RNA, 16 nt, Escherichia coli CFT073
uuagccggauaagcaa

SEQ ID NO: 2612847 - RNA, 17 nt, Escherichia coli CFT073
uuagccucuacaguauc

SEQ ID NO: 2612848 - RNA, 19 nt, Escherichia coli CFT073
uuagcgacaaaucuuucac

SEQ ID NO: 2612849 - RNA, 17 nt, Escherichia coli CFT073
uuagcgcagcuacccga

SEQ ID NO: 2612850 - RNA, 21 nt, Escherichia coli CFT073
uuagcgcauaaaagauaaacg

SEQ ID NO: 2612851 - RNA, 17 nt, Escherichia coli CFT073
uuagcuggagaguuaga

SEQ ID NO: 2612852 - RNA, 12 nt, Escherichia coli CFT073
uuagcuggccug

SEQ ID NO: 2612853 - RNA, 15 nt, Escherichia coli CFT073
uuaggcacaucaaca

SEQ ID NO: 2612854 - RNA, 14 nt, Escherichia coli CFT073
uuaggcgcaggaua

SEQ ID NO: 2612855 - RNA, 17 nt, Escherichia coli CFT073
uuaggcuucguccccag

SEQ ID NO: 2612856 - RNA, 15 nt, Escherichia coli CFT073
uuaguaggccugaua

SEQ ID NO: 2612857 - RNA, 18 nt, Escherichia coli CFT073
uuaguaggccugauaagc

SEQ ID NO: 2612858 - RNA, 20 nt, Escherichia coli CFT073
uuaguauuuuauggcagaau

SEQ ID NO: 2612859 - RNA, 16 nt, Escherichia coli CFT073
uuagucauuacucauc

SEQ ID NO: 2612860 - RNA, 23 nt, Escherichia coli CFT073
uuagucugggcgagguccagcuc

SEQ ID NO: 2612861 - RNA, 16 nt, Escherichia coli CFT073
uuagucuuauuuaaug

SEQ ID NO: 2612862 - RNA, 14 nt, Escherichia coli CFT073
uuagugauuucgaa

SEQ ID NO: 2612863 - RNA, 20 nt, Escherichia coli CFT073
uuagugcacuucuucacauc

SEQ ID NO: 2612864 - RNA, 21 nt, Escherichia coli CFT073
uuagugcgcaguugccggaug

SEQ ID NO: 2612865 - RNA, 18 nt, Escherichia coli CFT073
uuaguuagcagauuaauu

SEQ ID NO: 2612866 - RNA, 17 nt, Escherichia coli CFT073
uuauaaaguaaaacccc

SEQ ID NO: 2612867 - RNA, 22 nt, Escherichia coli CFT073
uuauaaaucccugccgccauca

SEQ ID NO: 2612868 - RNA, 13 nt, Escherichia coli CFT073
uuauaacugucuu

SEQ ID NO: 2612869 - RNA, 22 nt, Escherichia coli CFT073
uuauaagauagucgaaucagua

SEQ ID NO: 2612870 - RNA, 16 nt, Escherichia coli CFT073
uuauaaguucaaguaa

SEQ ID NO: 2612871 - RNA, 15 nt, Escherichia coli CFT073
uuauaauaaauauua

SEQ ID NO: 2612872 - RNA, 21 nt, Escherichia coli CFT073
uuauaauaaauauuauuguuu

SEQ ID NO: 2612873 - RNA, 15 nt, Escherichia coli CFT073
uuauacaucgcuuuc

SEQ ID NO: 2612874 - RNA, 20 nt, Escherichia coli CFT073
uuauaccacuuacauuccgg

SEQ ID NO: 2612875 - RNA, 19 nt, Escherichia coli CFT073
uuauacucacgaaucauag

SEQ ID NO: 2612876 - RNA, 20 nt, Escherichia coli CFT073
uuauagaacagagucugacc

SEQ ID NO: 2612877 - RNA, 17 nt, Escherichia coli CFT073
uuauagagcugaauaag

SEQ ID NO: 2612878 - RNA, 16 nt, Escherichia coli CFT073
uuauagcgauuuuuca

SEQ ID NO: 2612879 - RNA, 16 nt, Escherichia coli CFT073
uuauagcgcaugacau

SEQ ID NO: 2612880 - RNA, 17 nt, Escherichia coli CFT073
uuauagcucaacgcugc

SEQ ID NO: 2612881 - RNA, 15 nt, Escherichia coli CFT073
uuauagcugauauca

SEQ ID NO: 2612882 - RNA, 19 nt, Escherichia coli CFT073
uuauauacucuaaauaauu

SEQ ID NO: 2612883 - RNA, 14 nt, Escherichia coli CFT073
uuaucaacaauaaa

SEQ ID NO: 2612884 - RNA, 23 nt, Escherichia coli CFT073
uuaucaaucucugcaagagauaa

SEQ ID NO: 2612885 - RNA, 12 nt, Escherichia coli CFT073
uuaucaauuccu

SEQ ID NO: 2612886 - RNA, 22 nt, Escherichia coli CFT073
uuaucagacaccgauugccccu

SEQ ID NO: 2612887 - RNA, 11 nt, Escherichia coli CFT073
uuaucaggccu

SEQ ID NO: 2612888 - RNA, 14 nt, Escherichia coli CFT073
uuaucaggccuaca

SEQ ID NO: 2612889 - RNA, 18 nt, Escherichia coli CFT073
uuaucaggccuacaaucc

SEQ ID NO: 2612890 - RNA, 21 nt, Escherichia coli CFT073
uuaucaggccuacauuggugc

SEQ ID NO: 2612891 - RNA, 15 nt, Escherichia coli CFT073
uuaucaggccugcaa

SEQ ID NO: 2612892 - RNA, 16 nt, Escherichia coli CFT073
uuaucaguuguauguc

SEQ ID NO: 2612893 - RNA, 12 nt, Escherichia coli CFT073
uuauccaucaaa

SEQ ID NO: 2612894 - RNA, 21 nt, Escherichia coli CFT073
uuaucccccgauaaaacauua

SEQ ID NO: 2612895 - RNA, 22 nt, Escherichia coli CFT073
uuaucccccgauaaaacauuac

SEQ ID NO: 2612896 - RNA, 21 nt, Escherichia coli CFT073
uuaucccgauuaaucagugca

SEQ ID NO: 2612897 - RNA, 12 nt, Escherichia coli CFT073
uuaucccggcaa

SEQ ID NO: 2612898 - RNA, 18 nt, Escherichia coli CFT073
uuaucccggcaaaaaaca

SEQ ID NO: 2612899 - RNA, 21 nt, Escherichia coli CFT073
uuauccgacuugucaggcgga

SEQ ID NO: 2612900 - RNA, 21 nt, Escherichia coli CFT073
uuauccgaguagcucaccagc

SEQ ID NO: 2612901 - RNA, 11 nt, Escherichia coli CFT073
uuauccggccu

SEQ ID NO: 2612902 - RNA, 17 nt, Escherichia coli CFT073
uuauccggccuacauug

SEQ ID NO: 2612903 - RNA, 22 nt, Escherichia coli CFT073
uuauccguacagucgagcacca

SEQ ID NO: 2612904 - RNA, 14 nt, Escherichia coli CFT073
uuauccucuucaag

SEQ ID NO: 2612905 - RNA, 14 nt, Escherichia coli CFT073
uuauccugcccgcu

SEQ ID NO: 2612906 - RNA, 20 nt, Escherichia coli CFT073
uuauccugcguuuguccgcc

SEQ ID NO: 2612907 - RNA, 13 nt, Escherichia coli CFT073
uuaucgagauauu

SEQ ID NO: 2612908 - RNA, 19 nt, Escherichia coli CFT073
uuaucgaucacauccagua

SEQ ID NO: 2612909 - RNA, 15 nt, Escherichia coli CFT073
uuaucgauuaccgcc

SEQ ID NO: 2612910 - RNA, 21 nt, Escherichia coli CFT073
uuaucgccaagcgcaauauca

SEQ ID NO: 2612911 - RNA, 13 nt, Escherichia coli CFT073
uuaucgccaucca

SEQ ID NO: 2612912 - RNA, 16 nt, Escherichia coli CFT073
uuaucgcgccaucaaa

SEQ ID NO: 2612913 - RNA, 17 nt, Escherichia coli CFT073
uuaucgcgcugaauaau

SEQ ID NO: 2612914 - RNA, 21 nt, Escherichia coli CFT073
uucacaaagacgccaucaauu

SEQ ID NO: 2612915 - RNA, 17 nt, Escherichia coli CFT073
uucacaagacuguaaau

SEQ ID NO: 2612916 - RNA, 12 nt, Escherichia coli CFT073
uucacaaucuga

SEQ ID NO: 2612917 - RNA, 21 nt, Escherichia coli CFT073
uucacacacaucaacccagaa

SEQ ID NO: 2612918 - RNA, 18 nt, Escherichia coli CFT073
uucacaggccgccaggca

SEQ ID NO: 2612919 - RNA, 19 nt, Escherichia coli CFT073
uucacaggccgccaggcag

SEQ ID NO: 2612920 - RNA, 16 nt, Escherichia coli CFT073
uucacauauugcagcu

SEQ ID NO: 2612921 - RNA, 19 nt, Escherichia coli CFT073
uucacauccugccaggguc

SEQ ID NO: 2612922 - RNA, 18 nt, Escherichia coli CFT073
uucacaucguugauauuu

SEQ ID NO: 2612923 - RNA, 19 nt, Escherichia coli CFT073
uucaccaccaucaaaugcg

SEQ ID NO: 2612924 - RNA, 18 nt, Escherichia coli CFT073
uucaccaccgcaaagaaa

SEQ ID NO: 2612925 - RNA, 16 nt, Escherichia coli CFT073
uucaccagcaucgccg

SEQ ID NO: 2612926 - RNA, 14 nt, Escherichia coli CFT073
uucacccaacucuc

SEQ ID NO: 2612927 - RNA, 15 nt, Escherichia coli CFT073
uucacccaccggaau

SEQ ID NO: 2612928 - RNA, 17 nt, Escherichia coli CFT073
uucacccgcagcacggc

SEQ ID NO: 2612929 - RNA, 17 nt, Escherichia coli CFT073
uucacccugacuguuuu

SEQ ID NO: 2612930 - RNA, 23 nt, Escherichia coli CFT073
uucaccgcguaugcccagcgcag

SEQ ID NO: 2612931 - RNA, 20 nt, Escherichia coli CFT073
uucaccgguaguaagcguuu

SEQ ID NO: 2612932 - RNA, 14 nt, Escherichia coli CFT073
uucaccguccaucc

SEQ ID NO: 2612933 - RNA, 19 nt, Escherichia coli CFT073
uucaccucuuucaccaacu

SEQ ID NO: 2612934 - RNA, 13 nt, Escherichia coli CFT073
uucaccugccugc

SEQ ID NO: 2612935 - RNA, 20 nt, Escherichia coli CFT073
uucaccugguucagucguau

SEQ ID NO: 2612936 - RNA, 23 nt, Escherichia coli CFT073
uucacgaagauauucaucagcau

SEQ ID NO: 2612937 - RNA, 21 nt, Escherichia coli CFT073
uucacgcccgccccaguaaau

SEQ ID NO: 2612938 - RNA, 14 nt, Escherichia coli CFT073
uucacgccgcauca

SEQ ID NO: 2612939 - RNA, 17 nt, Escherichia coli CFT073
uucacgccgcaucaggc

SEQ ID NO: 2612940 - RNA, 18 nt, Escherichia coli CFT073
uucacgccgcauccggca

SEQ ID NO: 2612941 - RNA, 19 nt, Escherichia coli CFT073
uucacgccgcauccggcaa

SEQ ID NO: 2612942 - RNA, 14 nt, Escherichia coli CFT073
uucacgccgccaaa

SEQ ID NO: 2612943 - RNA, 18 nt, Escherichia coli CFT073
uucacgcuuacucuucgu

SEQ ID NO: 2612944 - RNA, 18 nt, Escherichia coli CFT073
uucacggaucgcuuuuac

SEQ ID NO: 2612945 - RNA, 16 nt, Escherichia coli CFT073
uucacggaugauuacc

SEQ ID NO: 2612946 - RNA, 14 nt, Escherichia coli CFT073
uucacggcaccagc

SEQ ID NO: 2612947 - RNA, 17 nt, Escherichia coli CFT073
uucacggcaccagccau

SEQ ID NO: 2612948 - RNA, 21 nt, Escherichia coli CFT073
uucacggcgauaccaguaaua

SEQ ID NO: 2612949 - RNA, 20 nt, Escherichia coli CFT073
uucacggcuuugucauuaaa

SEQ ID NO: 2612950 - RNA, 14 nt, Escherichia coli CFT073
uucacguccggcag

SEQ ID NO: 2612951 - RNA, 12 nt, Escherichia coli CFT073
uucacuccauug

SEQ ID NO: 2612952 - RNA, 17 nt, Escherichia coli CFT073
uucacucugcugccaca

SEQ ID NO: 2612953 - RNA, 13 nt, Escherichia coli CFT073
uucacucugcugu

SEQ ID NO: 2612954 - RNA, 17 nt, Escherichia coli CFT073
uucacugaaaaucaccu

SEQ ID NO: 2612955 - RNA, 21 nt, Escherichia coli CFT073
uucacugaaacagauaaaagu

SEQ ID NO: 2612956 - RNA, 19 nt, Escherichia coli CFT073
uucacugccguacaggcag

SEQ ID NO: 2612957 - RNA, 17 nt, Escherichia coli CFT073
uucacuucaaccacauu

SEQ ID NO: 2612958 - RNA, 21 nt, Escherichia coli CFT073
uucacuucacggccccaaaua

SEQ ID NO: 2612959 - RNA, 12 nt, Escherichia coli CFT073
uucacuucauag

SEQ ID NO: 2612960 - RNA, 13 nt, Escherichia coli CFT073
uucacuucgucag

SEQ ID NO: 2612961 - RNA, 23 nt, Escherichia coli CFT073
uucacuucuguuuuaucaauucu

SEQ ID NO: 2612962 - RNA, 20 nt, Escherichia coli CFT073
uucacuuuugccagacgaau

SEQ ID NO: 2612963 - RNA, 19 nt, Escherichia coli CFT073
uucagaaagccgcaccugc

SEQ ID NO: 2612964 - RNA, 17 nt, Escherichia coli CFT073
uucagaagauucgaaau

SEQ ID NO: 2612965 - RNA, 9 nt, Escherichia coli CFT073
uucagaaua

SEQ ID NO: 2612966 - RNA, 17 nt, Escherichia coli CFT073
uucagaauuugagcuug

SEQ ID NO: 2612967 - RNA, 21 nt, Escherichia coli CFT073
uucagacaggcgaaaccagca

SEQ ID NO: 2612968 - RNA, 13 nt, Escherichia coli CFT073
uucagaccaauaa

SEQ ID NO: 2612969 - RNA, 14 nt, Escherichia coli CFT073
uucagaccaauaau

SEQ ID NO: 2612970 - RNA, 16 nt, Escherichia coli CFT073
uucagacguucuuccu

SEQ ID NO: 2612971 - RNA, 21 nt, Escherichia coli CFT073
uucagagcgaauuaagaauuu

SEQ ID NO: 2612972 - RNA, 14 nt, Escherichia coli CFT073
uucagaguugcacc

SEQ ID NO: 2612973 - RNA, 13 nt, Escherichia coli CFT073
uucagauaaaagc

SEQ ID NO: 2612974 - RNA, 23 nt, Escherichia coli CFT073
uucagauaauagguaaacauccg

SEQ ID NO: 2612975 - RNA, 13 nt, Escherichia coli CFT073
uucagauucaguc

SEQ ID NO: 2612976 - RNA, 21 nt, Escherichia coli CFT073
uucagauuggugacaagugcc

SEQ ID NO: 2612977 - RNA, 15 nt, Escherichia coli CFT073
uucagcaaaugaccc

SEQ ID NO: 2612978 - RNA, 18 nt, Escherichia coli CFT073
uucagcaauaacuccccu

SEQ ID NO: 2612979 - RNA, 20 nt, Escherichia coli CFT073
uucagcaaugacauacagca

SEQ ID NO: 2612980 - RNA, 11 nt, Escherichia coli CFT073
uucagcaccag

SEQ ID NO: 2612981 - RNA, 12 nt, Escherichia coli CFT073
uucagcaccaga

SEQ ID NO: 2612982 - RNA, 14 nt, Escherichia coli CFT073
uucagcaccagaua

SEQ ID NO: 2612983 - RNA, 23 nt, Escherichia coli CFT073
uucagcacgguguuaccguacca

SEQ ID NO: 2612984 - RNA, 20 nt, Escherichia coli CFT073
uucagcacuggcggcagcag

SEQ ID NO: 2612985 - RNA, 16 nt, Escherichia coli CFT073
uucagcacuuaucucu

SEQ ID NO: 2612986 - RNA, 18 nt, Escherichia coli CFT073
uucagcaguggcacacaa

SEQ ID NO: 2612987 - RNA, 15 nt, Escherichia coli CFT073
uucagcaguucaguc

SEQ ID NO: 2612988 - RNA, 16 nt, Escherichia coli CFT073
uucagcaguucugcca

SEQ ID NO: 2612989 - RNA, 20 nt, Escherichia coli CFT073
uucagcaucccaggcaucca

SEQ ID NO: 2612990 - RNA, 21 nt, Escherichia coli CFT073
uucagcaucgacauucaacau

SEQ ID NO: 2612991 - RNA, 20 nt, Escherichia coli CFT073
uucagccaaugccugagaca

SEQ ID NO: 2612992 - RNA, 18 nt, Escherichia coli CFT073
uucagccagaggcggcaa

SEQ ID NO: 2612993 - RNA, 23 nt, Escherichia coli CFT073
uucagccagaggcggcaaaauca

SEQ ID NO: 2612994 - RNA, 21 nt, Escherichia coli CFT073
uucagccagggauaagccaga

SEQ ID NO: 2612995 - RNA, 21 nt, Escherichia coli CFT073
uucagccccagcacuucgcug

SEQ ID NO: 2612996 - RNA, 14 nt, Escherichia coli CFT073
uucagccccaucag

SEQ ID NO: 2612997 - RNA, 19 nt, Escherichia coli CFT073
uucagccguuuaauugccu

SEQ ID NO: 2612998 - RNA, 15 nt, Escherichia coli CFT073
uucagcgacagauua

SEQ ID NO: 2612999 - RNA, 23 nt, Escherichia coli CFT073
uucagcgagggcuaugcgcauca

SEQ ID NO: 2613000 - RNA, 22 nt, Escherichia coli CFT073
uucagcgauaccccuucucguc

SEQ ID NO: 2613001 - RNA, 16 nt, Escherichia coli CFT073
uucagcgaucguuuuu

SEQ ID NO: 2613002 - RNA, 16 nt, Escherichia coli CFT073
uucagcgccagcuucg

SEQ ID NO: 2613003 - RNA, 16 nt, Escherichia coli CFT073
uucagcguauccagca

SEQ ID NO: 2613004 - RNA, 22 nt, Escherichia coli CFT073
uucagcguaucccagugcagca

SEQ ID NO: 2613005 - RNA, 16 nt, Escherichia coli CFT073
uucagcguuccccaga

SEQ ID NO: 2613006 - RNA, 16 nt, Escherichia coli CFT073
uucagcucaagaaucu

SEQ ID NO: 2613007 - RNA, 21 nt, Escherichia coli CFT073
uucagcugccaguuucgucag

SEQ ID NO: 2613008 - RNA, 16 nt, Escherichia coli CFT073
uucagcuuauccagcg

SEQ ID NO: 2613009 - RNA, 17 nt, Escherichia coli CFT073
uucagcuuauucaucaa

SEQ ID NO: 2613010 - RNA, 15 nt, Escherichia coli CFT073
uucagcuuccagaau

SEQ ID NO: 2613011 - RNA, 17 nt, Escherichia coli CFT073
uucagcuuccagaaucc

SEQ ID NO: 2613012 - RNA, 15 nt, Escherichia coli CFT073
uucaggcaacaaaaa

SEQ ID NO: 2613013 - RNA, 18 nt, Escherichia coli CFT073
uucaggcaacaaaaaacc

SEQ ID NO: 2613014 - RNA, 21 nt, Escherichia coli CFT073
uucaggccaaagccgccgagc

SEQ ID NO: 2613015 - RNA, 17 nt, Escherichia coli CFT073
uucaggccaauucacuu

SEQ ID NO: 2613016 - RNA, 17 nt, Escherichia coli CFT073
uucagggagguuucgac

SEQ ID NO: 2613017 - RNA, 20 nt, Escherichia coli CFT073
uucagggagguuucgaccac

SEQ ID NO: 2613018 - RNA, 20 nt, Escherichia coli CFT073
uucaggguuuacaggcucuc

SEQ ID NO: 2613019 - RNA, 13 nt, Escherichia coli CFT073
uucagguacagac

SEQ ID NO: 2613020 - RNA, 15 nt, Escherichia coli CFT073
uucagguacagacua

SEQ ID NO: 2613021 - RNA, 18 nt, Escherichia coli CFT073
uucaggucaucacucugu

SEQ ID NO: 2613022 - RNA, 21 nt, Escherichia coli CFT073
uuccagauguggugccagugc

SEQ ID NO: 2613023 - RNA, 19 nt, Escherichia coli CFT073
uuccagcaaacgcacuuuu

SEQ ID NO: 2613024 - RNA, 20 nt, Escherichia coli CFT073
uuccagcaaacgcacuuuua

SEQ ID NO: 2613025 - RNA, 14 nt, Escherichia coli CFT073
uuccagcaacgcug

SEQ ID NO: 2613026 - RNA, 17 nt, Escherichia coli CFT073
uuccagcaacucgacgc

SEQ ID NO: 2613027 - RNA, 23 nt, Escherichia coli CFT073
uuccagcaccacuuccggcaaca

SEQ ID NO: 2613028 - RNA, 20 nt, Escherichia coli CFT073
uuccagcagaccagcaauaa

SEQ ID NO: 2613029 - RNA, 22 nt, Escherichia coli CFT073
uuccagcagaccagcaauaacu

SEQ ID NO: 2613030 - RNA, 21 nt, Escherichia coli CFT073
uuccagcagcuugcgccgccc

SEQ ID NO: 2613031 - RNA, 14 nt, Escherichia coli CFT073
uuccagcaucagca

SEQ ID NO: 2613032 - RNA, 16 nt, Escherichia coli CFT073
uuccagcaucgaccag

SEQ ID NO: 2613033 - RNA, 22 nt, Escherichia coli CFT073
uuccagcaugaugcucucccaa

SEQ ID NO: 2613034 - RNA, 16 nt, Escherichia coli CFT073
uuccagcauuucuucc

SEQ ID NO: 2613035 - RNA, 14 nt, Escherichia coli CFT073
uuccagccagaaau

SEQ ID NO: 2613036 - RNA, 18 nt, Escherichia coli CFT073
uuccagccaugccacgcu

SEQ ID NO: 2613037 - RNA, 14 nt, Escherichia coli CFT073
uuccagcgacaccu

SEQ ID NO: 2613038 - RNA, 18 nt, Escherichia coli CFT073
uuccagcgcaucgccaaa

SEQ ID NO: 2613039 - RNA, 16 nt, Escherichia coli CFT073
uuccagcgccaguaau

SEQ ID NO: 2613040 - RNA, 22 nt, Escherichia coli CFT073
uuccagcgccgccagaagggaa

SEQ ID NO: 2613041 - RNA, 12 nt, Escherichia coli CFT073
uuccagcggcag

SEQ ID NO: 2613042 - RNA, 23 nt, Escherichia coli CFT073
uuccagcguagugaaggcaaacu

SEQ ID NO: 2613043 - RNA, 14 nt, Escherichia coli CFT073
uuccagcucaaaga

SEQ ID NO: 2613044 - RNA, 18 nt, Escherichia coli CFT073
uuccagcucaaccagauu

SEQ ID NO: 2613045 - RNA, 22 nt, Escherichia coli CFT073
uuccagcuccagccgcuccccu

SEQ ID NO: 2613046 - RNA, 17 nt, Escherichia coli CFT073
uuccagcugcacgccac

SEQ ID NO: 2613047 - RNA, 23 nt, Escherichia coli CFT073
uuccagcuucagauuagccgcag

SEQ ID NO: 2613048 - RNA, 18 nt, Escherichia coli CFT073
uuccagcuuccaggcaau

SEQ ID NO: 2613049 - RNA, 12 nt, Escherichia coli CFT073
uuccaggcagcc

SEQ ID NO: 2613050 - RNA, 13 nt, Escherichia coli CFT073
uuccaggcagcca

SEQ ID NO: 2613051 - RNA, 22 nt, Escherichia coli CFT073
uuccagggccucuccuuuacca

SEQ ID NO: 2613052 - RNA, 14 nt, Escherichia coli CFT073
uuccagguaagcaa

SEQ ID NO: 2613053 - RNA, 17 nt, Escherichia coli CFT073
uuccaggucaaucccag

SEQ ID NO: 2613054 - RNA, 18 nt, Escherichia coli CFT073
uuccagguuaacccacag

SEQ ID NO: 2613055 - RNA, 21 nt, Escherichia coli CFT073
uuccagguuaugguugaacac

SEQ ID NO: 2613056 - RNA, 17 nt, Escherichia coli CFT073
uuccaguaaccagccgu

SEQ ID NO: 2613057 - RNA, 16 nt, Escherichia coli CFT073
uuccaguaaugcgccc

SEQ ID NO: 2613058 - RNA, 17 nt, Escherichia coli CFT073
uuccaguaaugcgccca

SEQ ID NO: 2613059 - RNA, 23 nt, Escherichia coli CFT073
uuccaguggcauuuucugcccgu

SEQ ID NO: 2613060 - RNA, 22 nt, Escherichia coli CFT073
uuccaguguuuccggaauuaaa

SEQ ID NO: 2613061 - RNA, 18 nt, Escherichia coli CFT073
uuccaguuccggcauuaa

SEQ ID NO: 2613062 - RNA, 17 nt, Escherichia coli CFT073
uuccaguugaacaaucu

SEQ ID NO: 2613063 - RNA, 18 nt, Escherichia coli CFT073
uuccaguuugcucaaauc

SEQ ID NO: 2613064 - RNA, 19 nt, Escherichia coli CFT073
uuccaguuugcucaaaucc

SEQ ID NO: 2613065 - RNA, 23 nt, Escherichia coli CFT073
uuccauaaucgacucccgcgccg

SEQ ID NO: 2613066 - RNA, 16 nt, Escherichia coli CFT073
uuccauaaucgccuga

SEQ ID NO: 2613067 - RNA, 18 nt, Escherichia coli CFT073
uuccauaccaaccaugua

SEQ ID NO: 2613068 - RNA, 14 nt, Escherichia coli CFT073
uuccauaccggcug

SEQ ID NO: 2613069 - RNA, 14 nt, Escherichia coli CFT073
uuccauaucaagca

SEQ ID NO: 2613070 - RNA, 17 nt, Escherichia coli CFT073
uuccauaucgcuggcug

SEQ ID NO: 2613071 - RNA, 17 nt, Escherichia coli CFT073
uuccaucgcaucuucgc

SEQ ID NO: 2613072 - RNA, 14 nt, Escherichia coli CFT073
uuccaucuccagcu

SEQ ID NO: 2613073 - RNA, 14 nt, Escherichia coli CFT073
uuccauucaaggac

SEQ ID NO: 2613074 - RNA, 13 nt, Escherichia coli CFT073
uuccauucgcugc

SEQ ID NO: 2613075 - RNA, 18 nt, Escherichia coli CFT073
uuccauucuccgcucuuc

SEQ ID NO: 2613076 - RNA, 19 nt, Escherichia coli CFT073
uuccauucuccgcucuuca

SEQ ID NO: 2613077 - RNA, 19 nt, Escherichia coli CFT073
uuccauucuuucccagcag

SEQ ID NO: 2613078 - RNA, 13 nt, Escherichia coli CFT073
uuccauugagaaa

SEQ ID NO: 2613079 - RNA, 17 nt, Escherichia coli CFT073
uuccauugccugcaacg

SEQ ID NO: 2613080 - RNA, 14 nt, Escherichia coli CFT073
uuccauuguccacc

SEQ ID NO: 2613081 - RNA, 14 nt, Escherichia coli CFT073
uuccauuucaucgc

SEQ ID NO: 2613082 - RNA, 15 nt, Escherichia coli CFT073
uuccauuucaucgcc

SEQ ID NO: 2613083 - RNA, 23 nt, Escherichia coli CFT073
uucccaaagaucaacugccgccu

SEQ ID NO: 2613084 - RNA, 16 nt, Escherichia coli CFT073
uucccaaaucaaauca

SEQ ID NO: 2613085 - RNA, 14 nt, Escherichia coli CFT073
uucccaacaacagc

SEQ ID NO: 2613086 - RNA, 20 nt, Escherichia coli CFT073
uucccacuaacugcgcgcug

SEQ ID NO: 2613087 - RNA, 20 nt, Escherichia coli CFT073
uucccacugacgcucggcgc

SEQ ID NO: 2613088 - RNA, 19 nt, Escherichia coli CFT073
uucccagagcuuuugccau

SEQ ID NO: 2613089 - RNA, 11 nt, Escherichia coli CFT073
uucccagcaac

SEQ ID NO: 2613090 - RNA, 13 nt, Escherichia coli CFT073
uucccagcaacag

SEQ ID NO: 2613091 - RNA, 15 nt, Escherichia coli CFT073
uucccagcaagaacc

SEQ ID NO: 2613092 - RNA, 16 nt, Escherichia coli CFT073
uucccagcaccgcaga

SEQ ID NO: 2613093 - RNA, 18 nt, Escherichia coli CFT073
uucccagcaccgcagaga

SEQ ID NO: 2613094 - RNA, 18 nt, Escherichia coli CFT073
uucccagcaggaucaaua

SEQ ID NO: 2613095 - RNA, 15 nt, Escherichia coli CFT073
uucccagucaggcac

SEQ ID NO: 2613096 - RNA, 12 nt, Escherichia coli CFT073
uucccauaccuu

SEQ ID NO: 2613097 - RNA, 12 nt, Escherichia coli CFT073
uuccccaccuga

SEQ ID NO: 2613098 - RNA, 18 nt, Escherichia coli CFT073
uuccccauucugcgcuga

SEQ ID NO: 2613099 - RNA, 14 nt, Escherichia coli CFT073
uucccccaccgccg

SEQ ID NO: 2613100 - RNA, 17 nt, Escherichia coli CFT073
uucccccacugugcacc

SEQ ID NO: 2613101 - RNA, 14 nt, Escherichia coli CFT073
uucccccugccaga

SEQ ID NO: 2613102 - RNA, 19 nt, Escherichia coli CFT073
uuccccgcuucagcccgcg

SEQ ID NO: 2613103 - RNA, 17 nt, Escherichia coli CFT073
uuccccggaugaguaca

SEQ ID NO: 2613104 - RNA, 18 nt, Escherichia coli CFT073
uuccccggucagcagcac

SEQ ID NO: 2613105 - RNA, 14 nt, Escherichia coli CFT073
uuccccgucaucau

SEQ ID NO: 2613106 - RNA, 18 nt, Escherichia coli CFT073
uuccccuaacucuuucaa

SEQ ID NO: 2613107 - RNA, 19 nt, Escherichia coli CFT073
uucccgacacacugcgccg

SEQ ID NO: 2613108 - RNA, 12 nt, Escherichia coli CFT073
uucccgacguaa

SEQ ID NO: 2613109 - RNA, 20 nt, Escherichia coli CFT073
uucccgagacaucccuuuau

SEQ ID NO: 2613110 - RNA, 16 nt, Escherichia coli CFT073
uucccgagcggccaaa

SEQ ID NO: 2613111 - RNA, 23 nt, Escherichia coli CFT073
uucccgagcggccaaagggagca

SEQ ID NO: 2613112 - RNA, 23 nt, Escherichia coli CFT073
uucccgauaagggagcaggccag

SEQ ID NO: 2613113 - RNA, 21 nt, Escherichia coli CFT073
uucccgcaagcggcccggaga

SEQ ID NO: 2613114 - RNA, 21 nt, Escherichia coli CFT073
uucccgcagaccuucugccag

SEQ ID NO: 2613115 - RNA, 17 nt, Escherichia coli CFT073
uucccgcuccaaaauuu

SEQ ID NO: 2613116 - RNA, 14 nt, Escherichia coli CFT073
uucccggaauaauu

SEQ ID NO: 2613117 - RNA, 17 nt, Escherichia coli CFT073
uucccggauggcaacag

SEQ ID NO: 2613118 - RNA, 18 nt, Escherichia coli CFT073
uucccggauggcaacagc

SEQ ID NO: 2613119 - RNA, 20 nt, Escherichia coli CFT073
uucccguccacugcgagaaa

SEQ ID NO: 2613120 - RNA, 16 nt, Escherichia coli CFT073
uucccuccucaaauca

SEQ ID NO: 2613121 - RNA, 13 nt, Escherichia coli CFT073
uucccugcauaau

SEQ ID NO: 2613122 - RNA, 16 nt, Escherichia coli CFT073
uucccugccugacaga

SEQ ID NO: 2613123 - RNA, 19 nt, Escherichia coli CFT073
uucccugccugacagacca

SEQ ID NO: 2613124 - RNA, 18 nt, Escherichia coli CFT073
uucccuuccgccaucaau

SEQ ID NO: 2613125 - RNA, 17 nt, Escherichia coli CFT073
uucccuuuuucacauca

SEQ ID NO: 2613126 - RNA, 13 nt, Escherichia coli CFT073
uuccgacaccgcc

SEQ ID NO: 2613127 - RNA, 14 nt, Escherichia coli CFT073
uuccgacaccgccu

SEQ ID NO: 2613128 - RNA, 13 nt, Escherichia coli CFT073
uuccgagcagcuc

SEQ ID NO: 2613129 - RNA, 23 nt, Escherichia coli CFT073
uuccgcaaagcccaucaccgcca

SEQ ID NO: 2613130 - RNA, 14 nt, Escherichia coli CFT073
uucgccucgcuuuu

SEQ ID NO: 2613131 - RNA, 16 nt, Escherichia coli CFT073
uucgccuuucaguuca

SEQ ID NO: 2613132 - RNA, 18 nt, Escherichia coli CFT073
uucgccuuugauuuucag

SEQ ID NO: 2613133 - RNA, 15 nt, Escherichia coli CFT073
uucgcgacaucgccc

SEQ ID NO: 2613134 - RNA, 22 nt, Escherichia coli CFT073
uucgcgaucaaacgccagauca

SEQ ID NO: 2613135 - RNA, 16 nt, Escherichia coli CFT073
uucgcgccaauccaga

SEQ ID NO: 2613136 - RNA, 18 nt, Escherichia coli CFT073
uucgcgccgcauccggca

SEQ ID NO: 2613137 - RNA, 13 nt, Escherichia coli CFT073
uucgcgcuccggc

SEQ ID NO: 2613138 - RNA, 16 nt, Escherichia coli CFT073
uucgcggaauuucaga

SEQ ID NO: 2613139 - RNA, 12 nt, Escherichia coli CFT073
uucgcguaggug

SEQ ID NO: 2613140 - RNA, 20 nt, Escherichia coli CFT073
uucgcgucaaucacacugac

SEQ ID NO: 2613141 - RNA, 15 nt, Escherichia coli CFT073
uucgcguuguauaac

SEQ ID NO: 2613142 - RNA, 21 nt, Escherichia coli CFT073
uucgcguuuaaacucugcgcu

SEQ ID NO: 2613143 - RNA, 22 nt, Escherichia coli CFT073
uucgcuaaagacuuugcugccu

SEQ ID NO: 2613144 - RNA, 23 nt, Escherichia coli CFT073
uucgcuccagccugcgucagcua

SEQ ID NO: 2613145 - RNA, 17 nt, Escherichia coli CFT073
uucgcucuuucgcaucg

SEQ ID NO: 2613146 - RNA, 15 nt, Escherichia coli CFT073
uucgcugacaguacc

SEQ ID NO: 2613147 - RNA, 23 nt, Escherichia coli CFT073
uucgcugacgccugccagcucuu

SEQ ID NO: 2613148 - RNA, 14 nt, Escherichia coli CFT073
uucgcugccacacc

SEQ ID NO: 2613149 - RNA, 16 nt, Escherichia coli CFT073
uucgcugccacaccau

SEQ ID NO: 2613150 - RNA, 15 nt, Escherichia coli CFT073
uucgcugccgcucug

SEQ ID NO: 2613151 - RNA, 16 nt, Escherichia coli CFT073
uucgcuggaauaaucg

SEQ ID NO: 2613152 - RNA, 20 nt, Escherichia coli CFT073
uucgcuggcaaagccgucca

SEQ ID NO: 2613153 - RNA, 20 nt, Escherichia coli CFT073
uucgcuguguaaacccagcc

SEQ ID NO: 2613154 - RNA, 15 nt, Escherichia coli CFT073
uucgcuuaacucacc

SEQ ID NO: 2613155 - RNA, 23 nt, Escherichia coli CFT073
uucgcuuaccaugccaacgcgga

SEQ ID NO: 2613156 - RNA, 13 nt, Escherichia coli CFT073
uucgcuucaagca

SEQ ID NO: 2613157 - RNA, 21 nt, Escherichia coli CFT073
uucgcuuccuguauaucugac

SEQ ID NO: 2613158 - RNA, 21 nt, Escherichia coli CFT073
uucgcuucgauucccagcuuu

SEQ ID NO: 2613159 - RNA, 11 nt, Escherichia coli CFT073
uucgcuuuuau

SEQ ID NO: 2613160 - RNA, 17 nt, Escherichia coli CFT073
uucgcuuuucaccgccu

SEQ ID NO: 2613161 - RNA, 17 nt, Escherichia coli CFT073
uucggacguuugccaug

SEQ ID NO: 2613162 - RNA, 19 nt, Escherichia coli CFT073
uucggcaaccgcauccaga

SEQ ID NO: 2613163 - RNA, 13 nt, Escherichia coli CFT073
uucggcaaucaca

SEQ ID NO: 2613164 - RNA, 17 nt, Escherichia coli CFT073
uucggcagaaaauccac

SEQ ID NO: 2613165 - RNA, 16 nt, Escherichia coli CFT073
uucggcaggcuuugcu

SEQ ID NO: 2613166 - RNA, 18 nt, Escherichia coli CFT073
uucggcaguuuuaccgcc

SEQ ID NO: 2613167 - RNA, 20 nt, Escherichia coli CFT073
uucggcaucacgaauccgca

SEQ ID NO: 2613168 - RNA, 16 nt, Escherichia coli CFT073
uucggcauggggucag

SEQ ID NO: 2613169 - RNA, 17 nt, Escherichia coli CFT073
uucggcauuaauuagua

SEQ ID NO: 2613170 - RNA, 13 nt, Escherichia coli CFT073
uucggcccacaac

SEQ ID NO: 2613171 - RNA, 22 nt, Escherichia coli CFT073
uucggccuaccaugaucugcaa

SEQ ID NO: 2613172 - RNA, 16 nt, Escherichia coli CFT073
uucggcgucacauccg

SEQ ID NO: 2613173 - RNA, 22 nt, Escherichia coli CFT073
uucgggaucaucucaacaaacg

SEQ ID NO: 2613174 - RNA, 22 nt, Escherichia coli CFT073
uucgggcgcauauugccaucac

SEQ ID NO: 2613175 - RNA, 15 nt, Escherichia coli CFT073
uucggguuauugguu

SEQ ID NO: 2613176 - RNA, 15 nt, Escherichia coli CFT073
uucgguaaacggcac

SEQ ID NO: 2613177 - RNA, 22 nt, Escherichia coli CFT073
uucgguauuaauuugccagcgu

SEQ ID NO: 2613178 - RNA, 22 nt, Escherichia coli CFT073
uucgguauuuuuacgaaacaga

SEQ ID NO: 2613179 - RNA, 13 nt, Escherichia coli CFT073
uucggugacuuca

SEQ ID NO: 2613180 - RNA, 23 nt, Escherichia coli CFT073
uucggugauauacgccacuucau

SEQ ID NO: 2613181 - RNA, 17 nt, Escherichia coli CFT073
uucggugguaucaaaau

SEQ ID NO: 2613182 - RNA, 20 nt, Escherichia coli CFT073
uucgguguauuucgaaugcu

SEQ ID NO: 2613183 - RNA, 20 nt, Escherichia coli CFT073
uucgguuuugcgccaucaac

SEQ ID NO: 2613184 - RNA, 22 nt, Escherichia coli CFT073
uucguaacggccaggcgcuuuu

SEQ ID NO: 2613185 - RNA, 19 nt, Escherichia coli CFT073
uucguaccaacgagagugc

SEQ ID NO: 2613186 - RNA, 14 nt, Escherichia coli CFT073
uucguagcguuuuu

SEQ ID NO: 2613187 - RNA, 13 nt, Escherichia coli CFT073
uucgucacuuugc

SEQ ID NO: 2613188 - RNA, 16 nt, Escherichia coli CFT073
uucguccccaccagug

SEQ ID NO: 2613189 - RNA, 19 nt, Escherichia coli CFT073
uucguccccaguuuuccau

SEQ ID NO: 2613190 - RNA, 22 nt, Escherichia coli CFT073
uucguccccaguuuuccauccu

SEQ ID NO: 2613191 - RNA, 15 nt, Escherichia coli CFT073
uucgucgaacucauc

SEQ ID NO: 2613192 - RNA, 22 nt, Escherichia coli CFT073
uucgucgaguuuauagccuguc

SEQ ID NO: 2613193 - RNA, 16 nt, Escherichia coli CFT073
uucgucgccagcucuu

SEQ ID NO: 2613194 - RNA, 15 nt, Escherichia coli CFT073
uucgucgccaucaau

SEQ ID NO: 2613195 - RNA, 17 nt, Escherichia coli CFT073
uucgucguaaucauaaa

SEQ ID NO: 2613196 - RNA, 14 nt, Escherichia coli CFT073
uucgucgucuucgu

SEQ ID NO: 2613197 - RNA, 13 nt, Escherichia coli CFT073
uucgucuugcagg

SEQ ID NO: 2613198 - RNA, 14 nt, Escherichia coli CFT073
uucgucuuuggguu

SEQ ID NO: 2613199 - RNA, 16 nt, Escherichia coli CFT073
uucguuaaaaccaaug

SEQ ID NO: 2613200 - RNA, 14 nt, Escherichia coli CFT073
uucguuccaggacu

SEQ ID NO: 2613201 - RNA, 15 nt, Escherichia coli CFT073
uucguugaagucagg

SEQ ID NO: 2613202 - RNA, 13 nt, Escherichia coli CFT073
uucguugcaguaa

SEQ ID NO: 2613203 - RNA, 21 nt, Escherichia coli CFT073
uucguuuuacgcacuucuucc

SEQ ID NO: 2613204 - RNA, 14 nt, Escherichia coli CFT073
uucuacaagcagag

SEQ ID NO: 2613205 - RNA, 16 nt, Escherichia coli CFT073
uucuacacccagcccc

SEQ ID NO: 2613206 - RNA, 22 nt, Escherichia coli CFT073
uucuaccagguuucgcaauaac

SEQ ID NO: 2613207 - RNA, 21 nt, Escherichia coli CFT073
uucuaccauccgcugaaaaac

SEQ ID NO: 2613208 - RNA, 20 nt, Escherichia coli CFT073
uucuacgccaucaguuucag

SEQ ID NO: 2613209 - RNA, 17 nt, Escherichia coli CFT073
uucuacgcgaccuuuuu

SEQ ID NO: 2613210 - RNA, 14 nt, Escherichia coli CFT073
uucuaggcuguguu

SEQ ID NO: 2613211 - RNA, 20 nt, Escherichia coli CFT073
uucuaguucauguauuuuuu

SEQ ID NO: 2613212 - RNA, 12 nt, Escherichia coli CFT073
uucuauggaagu

SEQ ID NO: 2613213 - RNA, 20 nt, Escherichia coli CFT073
uucucaauauacgaaaauuu

SEQ ID NO: 2613214 - RNA, 16 nt, Escherichia coli CFT073
uucucaaucccuuucu

SEQ ID NO: 2613215 - RNA, 16 nt, Escherichia coli CFT073
uucucaaucugcuugc

SEQ ID NO: 2613216 - RNA, 16 nt, Escherichia coli CFT073
uucucaaugauggcgc

SEQ ID NO: 2613217 - RNA, 19 nt, Escherichia coli CFT073
uucucaccaugaccgauca

SEQ ID NO: 2613218 - RNA, 23 nt, Escherichia coli CFT073
uucucaccgauagucguugccac

SEQ ID NO: 2613219 - RNA, 22 nt, Escherichia coli CFT073
uucucacuaauugcaaacagag

SEQ ID NO: 2613220 - RNA, 16 nt, Escherichia coli CFT073
uucucacugauuaccc

SEQ ID NO: 2613221 - RNA, 21 nt, Escherichia coli CFT073
uucucacuggcgucacaggcc

SEQ ID NO: 2613222 - RNA, 17 nt, Escherichia coli CFT073
uucucauugaccgaccc

SEQ ID NO: 2613223 - RNA, 12 nt, Escherichia coli CFT073
uucucauuuuga

SEQ ID NO: 2613224 - RNA, 19 nt, Escherichia coli CFT073
uucuccacaccguugccgc

SEQ ID NO: 2613225 - RNA, 17 nt, Escherichia coli CFT073
uucuccauuucaaugcg

SEQ ID NO: 2613226 - RNA, 13 nt, Escherichia coli CFT073
uucucccgccugc

SEQ ID NO: 2613227 - RNA, 12 nt, Escherichia coli CFT073
uucucccggcac

SEQ ID NO: 2613228 - RNA, 15 nt, Escherichia coli CFT073
uucucccucccgaca

SEQ ID NO: 2613229 - RNA, 17 nt, Escherichia coli CFT073
uucuccgcguucaauac

SEQ ID NO: 2613230 - RNA, 22 nt, Escherichia coli CFT073
uucuccuacaccccagccgguc

SEQ ID NO: 2613231 - RNA, 14 nt, Escherichia coli CFT073
uucuccucaacgau

SEQ ID NO: 2613232 - RNA, 13 nt, Escherichia coli CFT073
uucuccugucaug

SEQ ID NO: 2613233 - RNA, 23 nt, Escherichia coli CFT073
uucucgaaacgcuuuuaacggug

SEQ ID NO: 2613234 - RNA, 16 nt, Escherichia coli CFT073
uucucgaauuaauggu

SEQ ID NO: 2613235 - RNA, 18 nt, Escherichia coli CFT073
uucucgccguggcuguug

SEQ ID NO: 2613236 - RNA, 18 nt, Escherichia coli CFT073
uucucguaaauuccccac

SEQ ID NO: 2613237 - RNA, 13 nt, Escherichia coli CFT073
uucucgucaauac

SEQ ID NO: 2613238 - RNA, 16 nt, Escherichia coli CFT073
uugaauuaacuccagu

SEQ ID NO: 2613239 - RNA, 18 nt, Escherichia coli CFT073
uugaauuccgaauuucau

SEQ ID NO: 2613240 - RNA, 14 nt, Escherichia coli CFT073
uugaauugguccau

SEQ ID NO: 2613241 - RNA, 15 nt, Escherichia coli CFT073
uugacagcucacgcg

SEQ ID NO: 2613242 - RNA, 22 nt, Escherichia coli CFT073
uugacauauaaccggcaacaga

SEQ ID NO: 2613243 - RNA, 12 nt, Escherichia coli CFT073
uugacauuuuuu

SEQ ID NO: 2613244 - RNA, 16 nt, Escherichia coli CFT073
uugacauuuuuucauc

SEQ ID NO: 2613245 - RNA, 17 nt, Escherichia coli CFT073
uugaccaagaacgucaa

SEQ ID NO: 2613246 - RNA, 14 nt, Escherichia coli CFT073
uugaccauauuaac

SEQ ID NO: 2613247 - RNA, 20 nt, Escherichia coli CFT073
uugaccgacaccggcagaga

SEQ ID NO: 2613248 - RNA, 19 nt, Escherichia coli CFT073
uugaccgacccuucaucgg

SEQ ID NO: 2613249 - RNA, 18 nt, Escherichia coli CFT073
uugaccgccagcgccauc

SEQ ID NO: 2613250 - RNA, 11 nt, Escherichia coli CFT073
uugaccgccua

SEQ ID NO: 2613251 - RNA, 19 nt, Escherichia coli CFT073
uugaccuguacaagcaacu

SEQ ID NO: 2613252 - RNA, 15 nt, Escherichia coli CFT073
uugacgccaucaacg

SEQ ID NO: 2613253 - RNA, 19 nt, Escherichia coli CFT073
uugacgcguaaauccagca

SEQ ID NO: 2613254 - RNA, 18 nt, Escherichia coli CFT073
uugacgcgucuuaucagg

SEQ ID NO: 2613255 - RNA, 19 nt, Escherichia coli CFT073
uugacgcgucuuaucaggc

SEQ ID NO: 2613256 - RNA, 13 nt, Escherichia coli CFT073
uugacugaaauuu

SEQ ID NO: 2613257 - RNA, 20 nt, Escherichia coli CFT073
uugacuuccagacggcgaua

SEQ ID NO: 2613258 - RNA, 14 nt, Escherichia coli CFT073
uugacuuuuaauuu

SEQ ID NO: 2613259 - RNA, 18 nt, Escherichia coli CFT073
uugagauaacguaauguc

SEQ ID NO: 2613260 - RNA, 18 nt, Escherichia coli CFT073
uugagauaagcaacaaac

SEQ ID NO: 2613261 - RNA, 22 nt, Escherichia coli CFT073
uugagauaagcaacaaacucau

SEQ ID NO: 2613262 - RNA, 14 nt, Escherichia coli CFT073
uugagauccugcca

SEQ ID NO: 2613263 - RNA, 11 nt, Escherichia coli CFT073
uugagcagcaa

SEQ ID NO: 2613264 - RNA, 15 nt, Escherichia coli CFT073
uugagcgugcgcgcu

SEQ ID NO: 2613265 - RNA, 16 nt, Escherichia coli CFT073
uugagcuugcugcagu

SEQ ID NO: 2613266 - RNA, 14 nt, Escherichia coli CFT073
uugagcuuuuuccg

SEQ ID NO: 2613267 - RNA, 18 nt, Escherichia coli CFT073
uugaggaacucaaaccau

SEQ ID NO: 2613268 - RNA, 22 nt, Escherichia coli CFT073
uugagggaagcggguucaguga

SEQ ID NO: 2613269 - RNA, 18 nt, Escherichia coli CFT073
uugaguacgcauccccag

SEQ ID NO: 2613270 - RNA, 17 nt, Escherichia coli CFT073
uugaguucaccgccauu

SEQ ID NO: 2613271 - RNA, 23 nt, Escherichia coli CFT073
uugaguuugauuccugccugauu

SEQ ID NO: 2613272 - RNA, 14 nt, Escherichia coli CFT073
uugauaaaaagacg

SEQ ID NO: 2613273 - RNA, 19 nt, Escherichia coli CFT073
uugauaaagcguugcggug

SEQ ID NO: 2613274 - RNA, 17 nt, Escherichia coli CFT073
uugauaaguacauuaaa

SEQ ID NO: 2613275 - RNA, 18 nt, Escherichia coli CFT073
uugauaaguacauuaaaa

SEQ ID NO: 2613276 - RNA, 19 nt, Escherichia coli CFT073
uugauaaguacauuaaaau

SEQ ID NO: 2613277 - RNA, 12 nt, Escherichia coli CFT073
uugauacguuau

SEQ ID NO: 2613278 - RNA, 15 nt, Escherichia coli CFT073
uugauacucaguccg

SEQ ID NO: 2613279 - RNA, 19 nt, Escherichia coli CFT073
uugauagauuucucuaaaa

SEQ ID NO: 2613280 - RNA, 18 nt, Escherichia coli CFT073
uugauauuuauuuccuuc

SEQ ID NO: 2613281 - RNA, 16 nt, Escherichia coli CFT073
uugaucacuuccagca

SEQ ID NO: 2613282 - RNA, 23 nt, Escherichia coli CFT073
uugaucagccaggcgaugaaauu

SEQ ID NO: 2613283 - RNA, 15 nt, Escherichia coli CFT073
uugauccacgggauc

SEQ ID NO: 2613284 - RNA, 11 nt, Escherichia coli CFT073
uugauccagcg

SEQ ID NO: 2613285 - RNA, 18 nt, Escherichia coli CFT073
uugaucccggcuuccugc

SEQ ID NO: 2613286 - RNA, 19 nt, Escherichia coli CFT073
uugaucccggcuuccugca

SEQ ID NO: 2613287 - RNA, 19 nt, Escherichia coli CFT073
uugaucccugcaccaauga

SEQ ID NO: 2613288 - RNA, 22 nt, Escherichia coli CFT073
uugaucgcuggcagccauaauc

SEQ ID NO: 2613289 - RNA, 18 nt, Escherichia coli CFT073
uugaugaguuggcuacuc

SEQ ID NO: 2613290 - RNA, 14 nt, Escherichia coli CFT073
uugaugcacaccau

SEQ ID NO: 2613291 - RNA, 14 nt, Escherichia coli CFT073
uugaugccguucca

SEQ ID NO: 2613292 - RNA, 22 nt, Escherichia coli CFT073
uugaugccuucaguuuccagca

SEQ ID NO: 2613293 - RNA, 22 nt, Escherichia coli CFT073
uugaugcgaguaaucaggcuau

SEQ ID NO: 2613294 - RNA, 13 nt, Escherichia coli CFT073
uugaugcggguaa

SEQ ID NO: 2613295 - RNA, 19 nt, Escherichia coli CFT073
uugaugcgucuuaucaggc

SEQ ID NO: 2613296 - RNA, 12 nt, Escherichia coli CFT073
uugaugcugcca

SEQ ID NO: 2613297 - RNA, 23 nt, Escherichia coli CFT073
uugauggauauaauucaucacgc

SEQ ID NO: 2613298 - RNA, 15 nt, Escherichia coli CFT073
uugauggcaaaaucc

SEQ ID NO: 2613299 - RNA, 20 nt, Escherichia coli CFT073
uugaugguaaaauaucacuc

SEQ ID NO: 2613300 - RNA, 18 nt, Escherichia coli CFT073
uugaugguggucgcauca

SEQ ID NO: 2613301 - RNA, 13 nt, Escherichia coli CFT073
uugauguacucaa

SEQ ID NO: 2613302 - RNA, 16 nt, Escherichia coli CFT073
uugauguccaguuccc

SEQ ID NO: 2613303 - RNA, 17 nt, Escherichia coli CFT073
uugauguccaguuccca

SEQ ID NO: 2613304 - RNA, 23 nt, Escherichia coli CFT073
uugaugugcuucagcuugagguu

SEQ ID NO: 2613305 - RNA, 19 nt, Escherichia coli CFT073
uugauguuaccaacacuga

SEQ ID NO: 2613306 - RNA, 18 nt, Escherichia coli CFT073
uugauuaaugaugugcuu

SEQ ID NO: 2613307 - RNA, 17 nt, Escherichia coli CFT073
uugauuacagcuggagu

SEQ ID NO: 2613308 - RNA, 20 nt, Escherichia coli CFT073
uugauucaucucuucuuccg

SEQ ID NO: 2613309 - RNA, 22 nt, Escherichia coli CFT073
uugauuccccacgggacgcugc

SEQ ID NO: 2613310 - RNA, 22 nt, Escherichia coli CFT073
uugauuccugccugauucagca

SEQ ID NO: 2613311 - RNA, 14 nt, Escherichia coli CFT073
uugauucuguucag

SEQ ID NO: 2613312 - RNA, 16 nt, Escherichia coli CFT073
uugauucuguucagua

SEQ ID NO: 2613313 - RNA, 11 nt, Escherichia coli CFT073
uugauugucau

SEQ ID NO: 2613314 - RNA, 19 nt, Escherichia coli CFT073
uugauuguuuuaaauauug

SEQ ID NO: 2613315 - RNA, 22 nt, Escherichia coli CFT073
uugauuuuaaaggauuuacuaa

SEQ ID NO: 2613316 - RNA, 16 nt, Escherichia coli CFT073
uugcaaacccacagag

SEQ ID NO: 2613317 - RNA, 16 nt, Escherichia coli CFT073
uugcaaauauuccauc

SEQ ID NO: 2613318 - RNA, 20 nt, Escherichia coli CFT073
uugcaaauauuccaucaaua

SEQ ID NO: 2613319 - RNA, 23 nt, Escherichia coli CFT073
uugcaacaucaaacuguucggua

SEQ ID NO: 2613320 - RNA, 21 nt, Escherichia coli CFT073
uugcaaucagcggugccgcga

SEQ ID NO: 2613321 - RNA, 23 nt, Escherichia coli CFT073
uugcacagguggcaaacgccacc

SEQ ID NO: 2613322 - RNA, 22 nt, Escherichia coli CFT073
uugcaccacuaucaaccacggc

SEQ ID NO: 2613323 - RNA, 19 nt, Escherichia coli CFT073
uugcaccagaucuuccagc

SEQ ID NO: 2613324 - RNA, 20 nt, Escherichia coli CFT073
uugcaccagaucuuccagcg

SEQ ID NO: 2613325 - RNA, 14 nt, Escherichia coli CFT073
uugcaccagcaauu

SEQ ID NO: 2613326 - RNA, 13 nt, Escherichia coli CFT073
uugcaccaggccg

SEQ ID NO: 2613327 - RNA, 17 nt, Escherichia coli CFT073
uugcaccgaggccaaaa

SEQ ID NO: 2613328 - RNA, 15 nt, Escherichia coli CFT073
uugcaccuaaagcgc

SEQ ID NO: 2613329 - RNA, 16 nt, Escherichia coli CFT073
uugcacgagauuguau

SEQ ID NO: 2613330 - RNA, 16 nt, Escherichia coli CFT073
uugcacuauugcguga

SEQ ID NO: 2613331 - RNA, 14 nt, Escherichia coli CFT073
uugcagaauuggcg

SEQ ID NO: 2613332 - RNA, 17 nt, Escherichia coli CFT073
uugcagacguagaaaau

SEQ ID NO: 2613333 - RNA, 22 nt, Escherichia coli CFT073
uugcagacguucuucugcuuca

SEQ ID NO: 2613334 - RNA, 16 nt, Escherichia coli CFT073
uugcagauaccacauc

SEQ ID NO: 2613335 - RNA, 13 nt, Escherichia coli CFT073
uugcagaugcucu

SEQ ID NO: 2613336 - RNA, 13 nt, Escherichia coli CFT073
uugcagauggaug

SEQ ID NO: 2613337 - RNA, 14 nt, Escherichia coli CFT073
uugcagcauucauc

SEQ ID NO: 2613338 - RNA, 23 nt, Escherichia coli CFT073
uugcagccgucgcccacagucug

SEQ ID NO: 2613339 - RNA, 22 nt, Escherichia coli CFT073
uugcagccguuuguucugcauc

SEQ ID NO: 2613340 - RNA, 12 nt, Escherichia coli CFT073
uugcagcucccc

SEQ ID NO: 2613341 - RNA, 20 nt, Escherichia coli CFT073
uugcagcuccccacaccacc

SEQ ID NO: 2613342 - RNA, 21 nt, Escherichia coli CFT073
uugcagcuccccacaccacca

SEQ ID NO: 2613343 - RNA, 18 nt, Escherichia coli CFT073
uugcaggaacaaugccuc

SEQ ID NO: 2613344 - RNA, 17 nt, Escherichia coli CFT073
uugcaggcaaaucgcuc

SEQ ID NO: 2613345 - RNA, 18 nt, Escherichia coli CFT073
uugcaggccauaugacac

SEQ ID NO: 2613346 - RNA, 16 nt, Escherichia coli CFT073
uugcgugcuggcugaa

SEQ ID NO: 2613347 - RNA, 18 nt, Escherichia coli CFT073
uugcguucaucaguucca

SEQ ID NO: 2613348 - RNA, 23 nt, Escherichia coli CFT073
uugcguucaucaguuccaguuca

SEQ ID NO: 2613349 - RNA, 21 nt, Escherichia coli CFT073
uugcguuccggcggcacagcc

SEQ ID NO: 2613350 - RNA, 21 nt, Escherichia coli CFT073
uugcguucuuccaucaccgcc

SEQ ID NO: 2613351 - RNA, 19 nt, Escherichia coli CFT073
uugcguuuuuugaucagua

SEQ ID NO: 2613352 - RNA, 22 nt, Escherichia coli CFT073
uugcuaaugcagguacgcaaua

SEQ ID NO: 2613353 - RNA, 23 nt, Escherichia coli CFT073
uugcuaccgucgccuuucacuuc

SEQ ID NO: 2613354 - RNA, 19 nt, Escherichia coli CFT073
uugcuauagcucauaaccu

SEQ ID NO: 2613355 - RNA, 13 nt, Escherichia coli CFT073
uugcuauaugcaa

SEQ ID NO: 2613356 - RNA, 16 nt, Escherichia coli CFT073
uugcuauaugcaaggc

SEQ ID NO: 2613357 - RNA, 15 nt, Escherichia coli CFT073
uugcuaucaacaaua

SEQ ID NO: 2613358 - RNA, 23 nt, Escherichia coli CFT073
uugcuaugguccguucucaccaa

SEQ ID NO: 2613359 - RNA, 14 nt, Escherichia coli CFT073
uugcuauugguuca

SEQ ID NO: 2613360 - RNA, 19 nt, Escherichia coli CFT073
uugcucagauugcugacaa

SEQ ID NO: 2613361 - RNA, 20 nt, Escherichia coli CFT073
uugcucagugucagguacug

SEQ ID NO: 2613362 - RNA, 20 nt, Escherichia coli CFT073
uugcucgaagaguuccagcg

SEQ ID NO: 2613363 - RNA, 21 nt, Escherichia coli CFT073
uugcucgacuagauacugacg

SEQ ID NO: 2613364 - RNA, 21 nt, Escherichia coli CFT073
uugcucgaucagacgaucgcg

SEQ ID NO: 2613365 - RNA, 21 nt, Escherichia coli CFT073
uugcucggcaaggccaauacc

SEQ ID NO: 2613366 - RNA, 22 nt, Escherichia coli CFT073
uugcucggcaaucucuuccagc

SEQ ID NO: 2613367 - RNA, 14 nt, Escherichia coli CFT073
uugcucguuuucaa

SEQ ID NO: 2613368 - RNA, 16 nt, Escherichia coli CFT073
uugcucucgggcagua

SEQ ID NO: 2613369 - RNA, 20 nt, Escherichia coli CFT073
uugcucugguuccccauucu

SEQ ID NO: 2613370 - RNA, 15 nt, Escherichia coli CFT073
uugcucuuucacuuu

SEQ ID NO: 2613371 - RNA, 14 nt, Escherichia coli CFT073
uugcugaaaaggcu

SEQ ID NO: 2613372 - RNA, 20 nt, Escherichia coli CFT073
uugcugaaaaggcuaaaauu

SEQ ID NO: 2613373 - RNA, 15 nt, Escherichia coli CFT073
uugcugaauuggguu

SEQ ID NO: 2613374 - RNA, 14 nt, Escherichia coli CFT073
uugcugacgaucgg

SEQ ID NO: 2613375 - RNA, 19 nt, Escherichia coli CFT073
uugcugcgcggaauuuguc

SEQ ID NO: 2613376 - RNA, 16 nt, Escherichia coli CFT073
uugcugcgcuucguug

SEQ ID NO: 2613377 - RNA, 14 nt, Escherichia coli CFT073
uugcugcucaaagg

SEQ ID NO: 2613378 - RNA, 15 nt, Escherichia coli CFT073
uugcugcugaagcaa

SEQ ID NO: 2613379 - RNA, 22 nt, Escherichia coli CFT073
uugcuggcaaucaccucuuugu

SEQ ID NO: 2613380 - RNA, 18 nt, Escherichia coli CFT073
uugcuggccuagaugaau

SEQ ID NO: 2613381 - RNA, 15 nt, Escherichia coli CFT073
uugcugucgacaaag

SEQ ID NO: 2613382 - RNA, 14 nt, Escherichia coli CFT073
uugcuguuccagca

SEQ ID NO: 2613383 - RNA, 13 nt, Escherichia coli CFT073
uugcuguuguucc

SEQ ID NO: 2613384 - RNA, 14 nt, Escherichia coli CFT073
uugcuuauaaccau

SEQ ID NO: 2613385 - RNA, 22 nt, Escherichia coli CFT073
uugcuuauuuaaacugaagacu

SEQ ID NO: 2613386 - RNA, 16 nt, Escherichia coli CFT073
uugcuuccaccaucac

SEQ ID NO: 2613387 - RNA, 18 nt, Escherichia coli CFT073
uugcuuccggcaagcaaa

SEQ ID NO: 2613388 - RNA, 13 nt, Escherichia coli CFT073
uugcuucgccagu

SEQ ID NO: 2613389 - RNA, 14 nt, Escherichia coli CFT073
uugcuucuuacuau

SEQ ID NO: 2613390 - RNA, 18 nt, Escherichia coli CFT073
uugcuucuuacuauauaa

SEQ ID NO: 2613391 - RNA, 12 nt, Escherichia coli CFT073
uugcuucuuugc

SEQ ID NO: 2613392 - RNA, 15 nt, Escherichia coli CFT073
uugcuuugcugugaa

SEQ ID NO: 2613393 - RNA, 16 nt, Escherichia coli CFT073
uuggacuguugugaau

SEQ ID NO: 2613394 - RNA, 19 nt, Escherichia coli CFT073
uuggacuguugugaauguu

SEQ ID NO: 2613395 - RNA, 20 nt, Escherichia coli CFT073
uuggagagauccgcauauuu

SEQ ID NO: 2613396 - RNA, 18 nt, Escherichia coli CFT073
uuggaucuguugcuggcu

SEQ ID NO: 2613397 - RNA, 16 nt, Escherichia coli CFT073
uuggcaaucacaucac

SEQ ID NO: 2613398 - RNA, 18 nt, Escherichia coli CFT073
uuggcaaucacaucacca

SEQ ID NO: 2613399 - RNA, 14 nt, Escherichia coli CFT073
uuggcaccaucccu

SEQ ID NO: 2613400 - RNA, 22 nt, Escherichia coli CFT073
uuggcagcacccaaaucugcgu

SEQ ID NO: 2613401 - RNA, 23 nt, Escherichia coli CFT073
uuggcauacacgucgucgccaau

SEQ ID NO: 2613402 - RNA, 21 nt, Escherichia coli CFT073
uuggcaucguauuucagaccu

SEQ ID NO: 2613403 - RNA, 20 nt, Escherichia coli CFT073
uuggcauucccggucaccgg

SEQ ID NO: 2613404 - RNA, 21 nt, Escherichia coli CFT073
uuggccagucgcaaaucagcg

SEQ ID NO: 2613405 - RNA, 23 nt, Escherichia coli CFT073
uuggccccauaaucaaugccagg

SEQ ID NO: 2613406 - RNA, 18 nt, Escherichia coli CFT073
uuggccugaauacacauc

SEQ ID NO: 2613407 - RNA, 20 nt, Escherichia coli CFT073
uuggcgauaaaguugaagcu

SEQ ID NO: 2613408 - RNA, 21 nt, Escherichia coli CFT073
uuggcgauaccccaacaaauu

SEQ ID NO: 2613409 - RNA, 23 nt, Escherichia coli CFT073
uuggcgcauaacucaccaucaag

SEQ ID NO: 2613410 - RNA, 20 nt, Escherichia coli CFT073
uuggcgcgaaccaucaccuc

SEQ ID NO: 2613411 - RNA, 23 nt, Escherichia coli CFT073
uuggcgcgaaccaucaccucuuc

SEQ ID NO: 2613412 - RNA, 21 nt, Escherichia coli CFT073
uuggcggcaacgaaucacugg

SEQ ID NO: 2613413 - RNA, 21 nt, Escherichia coli CFT073
uuggcggcagaugaugaacgg

SEQ ID NO: 2613414 - RNA, 21 nt, Escherichia coli CFT073
uuggcguaccauuaaggucau

SEQ ID NO: 2613415 - RNA, 19 nt, Escherichia coli CFT073
uuggcgucgauaucaacca

SEQ ID NO: 2613416 - RNA, 14 nt, Escherichia coli CFT073
uuggcguucacugc

SEQ ID NO: 2613417 - RNA, 20 nt, Escherichia coli CFT073
uuggcguucacugccguaca

SEQ ID NO: 2613418 - RNA, 12 nt, Escherichia coli CFT073
uuggcuggcccu

SEQ ID NO: 2613419 - RNA, 20 nt, Escherichia coli CFT073
uuggcugggguacgaggauu

SEQ ID NO: 2613420 - RNA, 22 nt, Escherichia coli CFT073
uuggcuucacugauuaacguca

SEQ ID NO: 2613421 - RNA, 15 nt, Escherichia coli CFT073
uuggcuuuauaaauu

SEQ ID NO: 2613422 - RNA, 19 nt, Escherichia coli CFT073
uuggcuuuaucuguacuua

SEQ ID NO: 2613423 - RNA, 17 nt, Escherichia coli CFT073
uugggcgaauuccugac

SEQ ID NO: 2613424 - RNA, 16 nt, Escherichia coli CFT073
uugggcgagaucuucu

SEQ ID NO: 2613425 - RNA, 17 nt, Escherichia coli CFT073
uugggcguuacagcugg

SEQ ID NO: 2613426 - RNA, 18 nt, Escherichia coli CFT073
uugggcucacccaucgau

SEQ ID NO: 2613427 - RNA, 13 nt, Escherichia coli CFT073
uuggggagacuaa

SEQ ID NO: 2613428 - RNA, 23 nt, Escherichia coli CFT073
uugggugcaaucaguacguuauc

SEQ ID NO: 2613429 - RNA, 18 nt, Escherichia coli CFT073
uugguaaaugcgaauagc

SEQ ID NO: 2613430 - RNA, 21 nt, Escherichia coli CFT073
uugguaauacuaaucucaccc

SEQ ID NO: 2613431 - RNA, 18 nt, Escherichia coli CFT073
uugguaccguaaaaauag

SEQ ID NO: 2613432 - RNA, 19 nt, Escherichia coli CFT073
uuggucggaaucccaucgc

SEQ ID NO: 2613433 - RNA, 16 nt, Escherichia coli CFT073
uuggugcauaacacaa

SEQ ID NO: 2613434 - RNA, 21 nt, Escherichia coli CFT073
uuggugcccugacaccaucac

SEQ ID NO: 2613435 - RNA, 20 nt, Escherichia coli CFT073
uugguuaacuccagcgaauc

SEQ ID NO: 2613436 - RNA, 16 nt, Escherichia coli CFT073
uugguuauccagcaac

SEQ ID NO: 2613437 - RNA, 23 nt, Escherichia coli CFT073
uugguucaacaaagcgcguguug

SEQ ID NO: 2613438 - RNA, 20 nt, Escherichia coli CFT073
uugguugcagcacgcuggac

SEQ ID NO: 2613439 - RNA, 15 nt, Escherichia coli CFT073
uugguuuuauccagu

SEQ ID NO: 2613440 - RNA, 19 nt, Escherichia coli CFT073
uuguaaagaccauugaugc

SEQ ID NO: 2613441 - RNA, 16 nt, Escherichia coli CFT073
uuguaaauaauugaau

SEQ ID NO: 2613442 - RNA, 19 nt, Escherichia coli CFT073
uuguaaaugcugcuccagc

SEQ ID NO: 2613443 - RNA, 15 nt, Escherichia coli CFT073
uuguaaauugcagua

SEQ ID NO: 2613444 - RNA, 23 nt, Escherichia coli CFT073
uuguaacaauccgauaaucccuu

SEQ ID NO: 2613445 - RNA, 21 nt, Escherichia coli CFT073
uuguaacucaggaacuuagua

SEQ ID NO: 2613446 - RNA, 11 nt, Escherichia coli CFT073
uuguaagcagg

SEQ ID NO: 2613447 - RNA, 16 nt, Escherichia coli CFT073
uuguaagcagggccaa

SEQ ID NO: 2613448 - RNA, 16 nt, Escherichia coli CFT073
uuguaagucagaaagc

SEQ ID NO: 2613449 - RNA, 14 nt, Escherichia coli CFT073
uuguacaaaccaua

SEQ ID NO: 2613450 - RNA, 16 nt, Escherichia coli CFT073
uuguaccaguuaaagc

SEQ ID NO: 2613451 - RNA, 19 nt, Escherichia coli CFT073
uuguacccaacgcgauacg

SEQ ID NO: 2613452 - RNA, 23 nt, Escherichia coli CFT073
uuguaccuggccguuacggacca

SEQ ID NO: 2613453 - RNA, 20 nt, Escherichia coli CFT073
uuuaccaccaaaugcagcaa

SEQ ID NO: 2613454 - RNA, 19 nt, Escherichia coli CFT073
uuuaccaccgucaauaaaa

SEQ ID NO: 2613455 - RNA, 20 nt, Escherichia coli CFT073
uuuaccaccgucaauaaaaa

SEQ ID NO: 2613456 - RNA, 22 nt, Escherichia coli CFT073
uuuaccaccgucaauaaaaacg

SEQ ID NO: 2613457 - RNA, 13 nt, Escherichia coli CFT073
uuuaccaggcggu

SEQ ID NO: 2613458 - RNA, 16 nt, Escherichia coli CFT073
uuuaccauauaaacau

SEQ ID NO: 2613459 - RNA, 22 nt, Escherichia coli CFT073
uuuacccguguuuugcaucaac

SEQ ID NO: 2613460 - RNA, 14 nt, Escherichia coli CFT073
uuuaccgaaaauca

SEQ ID NO: 2613461 - RNA, 12 nt, Escherichia coli CFT073
uuuaccgcaucc

SEQ ID NO: 2613462 - RNA, 18 nt, Escherichia coli CFT073
uuuaccgccacagcagcc

SEQ ID NO: 2613463 - RNA, 23 nt, Escherichia coli CFT073
uuuaccggucaggauuuccagcu

SEQ ID NO: 2613464 - RNA, 20 nt, Escherichia coli CFT073
uuuaccggucaugucggcau

SEQ ID NO: 2613465 - RNA, 14 nt, Escherichia coli CFT073
uuuaccgucuuucg

SEQ ID NO: 2613466 - RNA, 15 nt, Escherichia coli CFT073
uuuaccucgucacca

SEQ ID NO: 2613467 - RNA, 22 nt, Escherichia coli CFT073
uuuaccugaauugacuacaaaa

SEQ ID NO: 2613468 - RNA, 13 nt, Escherichia coli CFT073
uuuaccugccuga

SEQ ID NO: 2613469 - RNA, 17 nt, Escherichia coli CFT073
uuuaccuugcucaucca

SEQ ID NO: 2613470 - RNA, 18 nt, Escherichia coli CFT073
uuuaccuuuccagucucc

SEQ ID NO: 2613471 - RNA, 21 nt, Escherichia coli CFT073
uuuacgaagaaaucgacauug

SEQ ID NO: 2613472 - RNA, 18 nt, Escherichia coli CFT073
uuuacgaugcaauuauca

SEQ ID NO: 2613473 - RNA, 15 nt, Escherichia coli CFT073
uuuacgccgcaucag

SEQ ID NO: 2613474 - RNA, 14 nt, Escherichia coli CFT073
uuuacgccgcaucc

SEQ ID NO: 2613475 - RNA, 21 nt, Escherichia coli CFT073
uuuacgccgcauccgacauca

SEQ ID NO: 2613476 - RNA, 22 nt, Escherichia coli CFT073
uuuacgccgcauccgacaucaa

SEQ ID NO: 2613477 - RNA, 13 nt, Escherichia coli CFT073
uuuacgcgacaca

SEQ ID NO: 2613478 - RNA, 22 nt, Escherichia coli CFT073
uuuacgcgucaguuuuuccaga

SEQ ID NO: 2613479 - RNA, 20 nt, Escherichia coli CFT073
uuuacgcuguaagccgccgc

SEQ ID NO: 2613480 - RNA, 23 nt, Escherichia coli CFT073
uuuacggaacacggacaauacac

SEQ ID NO: 2613481 - RNA, 15 nt, Escherichia coli CFT073
uuuacuaaaaaguga

SEQ ID NO: 2613482 - RNA, 23 nt, Escherichia coli CFT073
uuuacuaaaaagugauaaaaguc

SEQ ID NO: 2613483 - RNA, 16 nt, Escherichia coli CFT073
uuuacuaaaacuucau

SEQ ID NO: 2613484 - RNA, 18 nt, Escherichia coli CFT073
uuuacucucguuccacuc

SEQ ID NO: 2613485 - RNA, 20 nt, Escherichia coli CFT073
uuuacucuucuuuaauuaau

SEQ ID NO: 2613486 - RNA, 16 nt, Escherichia coli CFT073
uuuacugcacucgcca

SEQ ID NO: 2613487 - RNA, 22 nt, Escherichia coli CFT073
uuuacugguugauuuuaaagga

SEQ ID NO: 2613488 - RNA, 15 nt, Escherichia coli CFT073
uuuacuuugcaauga

SEQ ID NO: 2613489 - RNA, 17 nt, Escherichia coli CFT073
uuuacuuuugaaggaau

SEQ ID NO: 2613490 - RNA, 16 nt, Escherichia coli CFT073
uuuagaaaagaguauu

SEQ ID NO: 2613491 - RNA, 11 nt, Escherichia coli CFT073
uuuagaagcac

SEQ ID NO: 2613492 - RNA, 12 nt, Escherichia coli CFT073
uuuagacagcuu

SEQ ID NO: 2613493 - RNA, 12 nt, Escherichia coli CFT073
uuuagacuuugu

SEQ ID NO: 2613494 - RNA, 18 nt, Escherichia coli CFT073
uuuagccgcuucugcagc

SEQ ID NO: 2613495 - RNA, 22 nt, Escherichia coli CFT073
uuuagggggggcucuuuccauc

SEQ ID NO: 2613496 - RNA, 13 nt, Escherichia coli CFT073
uuuauaaaguaaa

SEQ ID NO: 2613497 - RNA, 23 nt, Escherichia coli CFT073
uuuauaaauaucaaaaacaaauu

SEQ ID NO: 2613498 - RNA, 20 nt, Escherichia coli CFT073
uuuauaacggugcugcacau

SEQ ID NO: 2613499 - RNA, 19 nt, Escherichia coli CFT073
uuuauaccaacaaaaaacg

SEQ ID NO: 2613500 - RNA, 22 nt, Escherichia coli CFT073
uuuauacucacgaaucauaggc

SEQ ID NO: 2613501 - RNA, 19 nt, Escherichia coli CFT073
uuuauagcuuauucuuauu

SEQ ID NO: 2613502 - RNA, 12 nt, Escherichia coli CFT073
uuuauauucaug

SEQ ID NO: 2613503 - RNA, 13 nt, Escherichia coli CFT073
uuuaucacaucca

SEQ ID NO: 2613504 - RNA, 14 nt, Escherichia coli CFT073
uuuaucaccaauga

SEQ ID NO: 2613505 - RNA, 15 nt, Escherichia coli CFT073
uuuaucaccaaugau

SEQ ID NO: 2613506 - RNA, 12 nt, Escherichia coli CFT073
uuuauccagcac

SEQ ID NO: 2613507 - RNA, 22 nt, Escherichia coli CFT073
uuuauccauauuuuuugaaaaa

SEQ ID NO: 2613508 - RNA, 20 nt, Escherichia coli CFT073
uuuauccgaacacucgucca

SEQ ID NO: 2613509 - RNA, 20 nt, Escherichia coli CFT073
uuuauccgaguagcucacca

SEQ ID NO: 2613510 - RNA, 19 nt, Escherichia coli CFT073
uuuauccggccuacaauga

SEQ ID NO: 2613511 - RNA, 21 nt, Escherichia coli CFT073
uuuauccuaauccuggccaua

SEQ ID NO: 2613512 - RNA, 15 nt, Escherichia coli CFT073
uuuaucgacauaaau

SEQ ID NO: 2613513 - RNA, 23 nt, Escherichia coli CFT073
uuuaucgauaaauggcgcaucca

SEQ ID NO: 2613514 - RNA, 16 nt, Escherichia coli CFT073
uuuaucgcgggaaaaa

SEQ ID NO: 2613515 - RNA, 15 nt, Escherichia coli CFT073
uuuaucggcacccau

SEQ ID NO: 2613516 - RNA, 20 nt, Escherichia coli CFT073
uuuaucggcguuauuacugg

SEQ ID NO: 2613517 - RNA, 13 nt, Escherichia coli CFT073
uuuaucugccgga

SEQ ID NO: 2613518 - RNA, 13 nt, Escherichia coli CFT073
uuuaucuucccag

SEQ ID NO: 2613519 - RNA, 23 nt, Escherichia coli CFT073
uuuaugaaucaaaucaaccaggc

SEQ ID NO: 2613520 - RNA, 15 nt, Escherichia coli CFT073
uuuaugauccagcuu

SEQ ID NO: 2613521 - RNA, 22 nt, Escherichia coli CFT073
uuuaugauuuccggucaaccca

SEQ ID NO: 2613522 - RNA, 14 nt, Escherichia coli CFT073
uuuaugccggugag

SEQ ID NO: 2613523 - RNA, 24 nt, Escherichia coli CFT073
uuuauggcagaauacuucacauga

SEQ ID NO: 2613524 - RNA, 18 nt, Escherichia coli CFT073
uuuauguuagccgccugc

SEQ ID NO: 2613525 - RNA, 12 nt, Escherichia coli CFT073
uuuauuaaauau

SEQ ID NO: 2613526 - RNA, 14 nt, Escherichia coli CFT073
uuuauuaaauauua

SEQ ID NO: 2613527 - RNA, 23 nt, Escherichia coli CFT073
uuuauuaauccagggaucaacau

SEQ ID NO: 2613528 - RNA, 11 nt, Escherichia coli CFT073
uuuauuauucc

SEQ ID NO: 2613529 - RNA, 16 nt, Escherichia coli CFT073
uuuauuauuccgugac

SEQ ID NO: 2613530 - RNA, 14 nt, Escherichia coli CFT073
uuuauucaccagua

SEQ ID NO: 2613531 - RNA, 13 nt, Escherichia coli CFT073
uuuauucauaauc

SEQ ID NO: 2613532 - RNA, 18 nt, Escherichia coli CFT073
uuuauugaauuugcaaug

SEQ ID NO: 2613533 - RNA, 17 nt, Escherichia coli CFT073
uuuauuugacauuuuuu

SEQ ID NO: 2613534 - RNA, 22 nt, Escherichia coli CFT073
uuuauuuugcgagcagcauucc

SEQ ID NO: 2613535 - RNA, 14 nt, Escherichia coli CFT073
uuucaaacaggcug

SEQ ID NO: 2613536 - RNA, 17 nt, Escherichia coli CFT073
uuucaaauccagccagc

SEQ ID NO: 2613537 - RNA, 14 nt, Escherichia coli CFT073
uuucaaccagcagg

SEQ ID NO: 2613538 - RNA, 19 nt, Escherichia coli CFT073
uuucaacguacucugccac

SEQ ID NO: 2613539 - RNA, 15 nt, Escherichia coli CFT073
uuucaauccguccca

SEQ ID NO: 2613540 - RNA, 13 nt, Escherichia coli CFT073
uuucaaugccuuu

SEQ ID NO: 2613541 - RNA, 13 nt, Escherichia coli CFT073
uuucaaugcuuuu

SEQ ID NO: 2613542 - RNA, 19 nt, Escherichia coli CFT073
uuucaaugcuuuuugcauu

SEQ ID NO: 2613543 - RNA, 23 nt, Escherichia coli CFT073
uuucaauggcgcugcaaagcuga

SEQ ID NO: 2613544 - RNA, 18 nt, Escherichia coli CFT073
uuucaauuagcuuacgcc

SEQ ID NO: 2613545 - RNA, 12 nt, Escherichia coli CFT073
uuucaauuauca

SEQ ID NO: 2613546 - RNA, 18 nt, Escherichia coli CFT073
uuucaauuaucaccgcac

SEQ ID NO: 2613547 - RNA, 20 nt, Escherichia coli CFT073
uuucaccaacgaugaagaga

SEQ ID NO: 2613548 - RNA, 18 nt, Escherichia coli CFT073
uuucacgcaaggcacaaa

SEQ ID NO: 2613549 - RNA, 16 nt, Escherichia coli CFT073
uuucacgcaauaccug

SEQ ID NO: 2613550 - RNA, 15 nt, Escherichia coli CFT073
uuucacgcccagucc

SEQ ID NO: 2613551 - RNA, 22 nt, Escherichia coli CFT073
uuucacgccgggaaauuuuucc

SEQ ID NO: 2613552 - RNA, 15 nt, Escherichia coli CFT073
uuucacgcucaccca

SEQ ID NO: 2613553 - RNA, 22 nt, Escherichia coli CFT073
uuucacgcucagcaacauggcg

SEQ ID NO: 2613554 - RNA, 16 nt, Escherichia coli CFT073
uuucacggcaccagcc

SEQ ID NO: 2613555 - RNA, 18 nt, Escherichia coli CFT073
uuucacuucgucagaaau

SEQ ID NO: 2613556 - RNA, 17 nt, Escherichia coli CFT073
uuucacuuucagaugca

SEQ ID NO: 2613557 - RNA, 17 nt, Escherichia coli CFT073
uuucacuuucugaccau

SEQ ID NO: 2613558 - RNA, 19 nt, Escherichia coli CFT073
uuucagaaaacgguugaua

SEQ ID NO: 2613559 - RNA, 21 nt, Escherichia coli CFT073
uuucagaucaggcuuguguac

SEQ ID NO: 2613560 - RNA, 16 nt, Escherichia coli CFT073
uuucagauccagugcu

SEQ ID NO: 2613561 - RNA, 14 nt, Escherichia coli CFT073
uuucuacuuuuucu

SEQ ID NO: 2613562 - RNA, 15 nt, Escherichia coli CFT073
uuucuacuuuuucuu

SEQ ID NO: 2613563 - RNA, 14 nt, Escherichia coli CFT073
uuucuaucaucaua

SEQ ID NO: 2613564 - RNA, 15 nt, Escherichia coli CFT073
uuucuccaaccagcu

SEQ ID NO: 2613565 - RNA, 10 nt, Escherichia coli CFT073
uuucuccccu

SEQ ID NO: 2613566 - RNA, 19 nt, Escherichia coli CFT073
uuucucccgccugcugcgu

SEQ ID NO: 2613567 - RNA, 20 nt, Escherichia coli CFT073
uuucuccggcagcuuuaccg

SEQ ID NO: 2613568 - RNA, 14 nt, Escherichia coli CFT073
uuucuccugcgccu

SEQ ID NO: 2613569 - RNA, 22 nt, Escherichia coli CFT073
uuucucgccaccggcacaucca

SEQ ID NO: 2613570 - RNA, 20 nt, Escherichia coli CFT073
uuucucgccuggaugggaua

SEQ ID NO: 2613571 - RNA, 17 nt, Escherichia coli CFT073
uuucucguaaauucccc

SEQ ID NO: 2613572 - RNA, 21 nt, Escherichia coli CFT073
uuucucguuggguugccagcg

SEQ ID NO: 2613573 - RNA, 22 nt, Escherichia coli CFT073
uuucucugacgcucucaacgcc

SEQ ID NO: 2613574 - RNA, 13 nt, Escherichia coli CFT073
uuucucuucaucu

SEQ ID NO: 2613575 - RNA, 17 nt, Escherichia coli CFT073
uuucucuuuaaacagau

SEQ ID NO: 2613576 - RNA, 15 nt, Escherichia coli CFT073
uuucucuuucuucag

SEQ ID NO: 2613577 - RNA, 17 nt, Escherichia coli CFT073
uuucucuuucuucagca

SEQ ID NO: 2613578 - RNA, 20 nt, Escherichia coli CFT073
uuucugaccaugcauauaag

SEQ ID NO: 2613579 - RNA, 23 nt, Escherichia coli CFT073
uuucugacgaugguguuuauucc

SEQ ID NO: 2613580 - RNA, 14 nt, Escherichia coli CFT073
uuucugacuucccu

SEQ ID NO: 2613581 - RNA, 15 nt, Escherichia coli CFT073
uuucugcaugaaaua

SEQ ID NO: 2613582 - RNA, 14 nt, Escherichia coli CFT073
uuucugccacgcca

SEQ ID NO: 2613583 - RNA, 22 nt, Escherichia coli CFT073
uuucugccucgucccaaaagcu

SEQ ID NO: 2613584 - RNA, 22 nt, Escherichia coli CFT073
uuucugccugaucuuucugaua

SEQ ID NO: 2613585 - RNA, 17 nt, Escherichia coli CFT073
uuucugcuucgccaucu

SEQ ID NO: 2613586 - RNA, 20 nt, Escherichia coli CFT073
uuucuggaaauagauuuuca

SEQ ID NO: 2613587 - RNA, 21 nt, Escherichia coli CFT073
uuucuggauauacgcuuucag

SEQ ID NO: 2613588 - RNA, 18 nt, Escherichia coli CFT073
uuucuggaugccaucgca

SEQ ID NO: 2613589 - RNA, 21 nt, Escherichia coli CFT073
uuucuggcgguaguuccacca

SEQ ID NO: 2613590 - RNA, 13 nt, Escherichia coli CFT073
uuucuguugccag

SEQ ID NO: 2613591 - RNA, 12 nt, Escherichia coli CFT073
uuucuuauuuuu

SEQ ID NO: 2613592 - RNA, 23 nt, Escherichia coli CFT073
uuucuucaggccagccugaucca

SEQ ID NO: 2613593 - RNA, 16 nt, Escherichia coli CFT073
uuucuucaguucagcu

SEQ ID NO: 2613594 - RNA, 12 nt, Escherichia coli CFT073
uuucuucauucg

SEQ ID NO: 2613595 - RNA, 11 nt, Escherichia coli CFT073
uuucuucuucg

SEQ ID NO: 2613596 - RNA, 21 nt, Escherichia coli CFT073
uuucuugguagagauuuuucc

SEQ ID NO: 2613597 - RNA, 13 nt, Escherichia coli CFT073
uuucuuguugccu

SEQ ID NO: 2613598 - RNA, 16 nt, Escherichia coli CFT073
uuucuuucaccucuuc

SEQ ID NO: 2613599 - RNA, 13 nt, Escherichia coli CFT073
uuucuuuuaacaa

SEQ ID NO: 2613600 - RNA, 15 nt, Escherichia coli CFT073
uuucuuuuaacaaac

SEQ ID NO: 2613601 - RNA, 15 nt, Escherichia coli CFT073
uuucuuuuucagcaa

SEQ ID NO: 2613602 - RNA, 18 nt, Escherichia coli CFT073
uuugaaauugugauaaaa

SEQ ID NO: 2613603 - RNA, 14 nt, Escherichia coli CFT073
uuugaacuggaaaa

SEQ ID NO: 2613604 - RNA, 15 nt, Escherichia coli CFT073
uuugaacuuuuucuu

SEQ ID NO: 2613605 - RNA, 16 nt, Escherichia coli CFT073
uuugaagcccaguacc

SEQ ID NO: 2613606 - RNA, 22 nt, Escherichia coli CFT073
uuugaaggaaaaaucgcacugg

SEQ ID NO: 2613607 - RNA, 17 nt, Escherichia coli CFT073
uuugaaggaauuaaucc

SEQ ID NO: 2613608 - RNA, 13 nt, Escherichia coli CFT073
uuugaauuucaaa

SEQ ID NO: 2613609 - RNA, 19 nt, Escherichia coli CFT073
uuugacagccccugugcca

SEQ ID NO: 2613610 - RNA, 22 nt, Escherichia coli CFT073
uuugacagccccugugccagcu

SEQ ID NO: 2613611 - RNA, 19 nt, Escherichia coli CFT073
uuugacagcucacgcgcca

SEQ ID NO: 2613612 - RNA, 19 nt, Escherichia coli CFT073
uuugacccaucuugucauu

SEQ ID NO: 2613613 - RNA, 14 nt, Escherichia coli CFT073
uuugacgccugcag

SEQ ID NO: 2613614 - RNA, 18 nt, Escherichia coli CFT073
uuugacuccugacaggua

SEQ ID NO: 2613615 - RNA, 21 nt, Escherichia coli CFT073
uuugacugaagguaagcaaca

SEQ ID NO: 2613616 - RNA, 14 nt, Escherichia coli CFT073
uuugagaacauuca

SEQ ID NO: 2613617 - RNA, 22 nt, Escherichia coli CFT073
uuugagcgucaaacuuuuaaau

SEQ ID NO: 2613618 - RNA, 15 nt, Escherichia coli CFT073
uuugaggaagcugcc

SEQ ID NO: 2613619 - RNA, 15 nt, Escherichia coli CFT073
uuugaguggucgaca

SEQ ID NO: 2613620 - RNA, 14 nt, Escherichia coli CFT073
uuugaguucacugc

SEQ ID NO: 2613621 - RNA, 20 nt, Escherichia coli CFT073
uuugaguucacugccguaca

SEQ ID NO: 2613622 - RNA, 14 nt, Escherichia coli CFT073
uuugaucgccgcca

SEQ ID NO: 2613623 - RNA, 16 nt, Escherichia coli CFT073
uuugaucgcuuccauu

SEQ ID NO: 2613624 - RNA, 16 nt, Escherichia coli CFT073
uuugaugccuucaguu

SEQ ID NO: 2613625 - RNA, 21 nt, Escherichia coli CFT073
uuugaugguggucgcaucauc

SEQ ID NO: 2613626 - RNA, 23 nt, Escherichia coli CFT073
uuugauuccaguaaguuauguau

SEQ ID NO: 2613627 - RNA, 18 nt, Escherichia coli CFT073
uuugauugauuuuuccac

SEQ ID NO: 2613628 - RNA, 16 nt, Escherichia coli CFT073
uuugauuugcugcuca

SEQ ID NO: 2613629 - RNA, 17 nt, Escherichia coli CFT073
uuugcaaacaacgcuuc

SEQ ID NO: 2613630 - RNA, 18 nt, Escherichia coli CFT073
uuugcaacgcuuugcuga

SEQ ID NO: 2613631 - RNA, 17 nt, Escherichia coli CFT073
uuugcaagcguuccaua

SEQ ID NO: 2613632 - RNA, 15 nt, Escherichia coli CFT073
uuugcaauuugcagc

SEQ ID NO: 2613633 - RNA, 20 nt, Escherichia coli CFT073
uuugcacgcucuucacggcg

SEQ ID NO: 2613634 - RNA, 20 nt, Escherichia coli CFT073
uuugcagaaauagaaaguga

SEQ ID NO: 2613635 - RNA, 17 nt, Escherichia coli CFT073
uuugcagaggugcgacc

SEQ ID NO: 2613636 - RNA, 22 nt, Escherichia coli CFT073
uuugcagaggugcgaccagcaa

SEQ ID NO: 2613637 - RNA, 19 nt, Escherichia coli CFT073
uuugcagccguuuguucug

SEQ ID NO: 2613638 - RNA, 13 nt, Escherichia coli CFT073
uuugcaggccgga

SEQ ID NO: 2613639 - RNA, 17 nt, Escherichia coli CFT073
uuugcaggccugauaag

SEQ ID NO: 2613640 - RNA, 19 nt, Escherichia coli CFT073
uuugcaggucguccugcaa

SEQ ID NO: 2613641 - RNA, 15 nt, Escherichia coli CFT073
uuugcagguucugcu

SEQ ID NO: 2613642 - RNA, 21 nt, Escherichia coli CFT073
uuugcaugagugccagauuga

SEQ ID NO: 2613643 - RNA, 16 nt, Escherichia coli CFT073
uuugcauuacugcuau

SEQ ID NO: 2613644 - RNA, 15 nt, Escherichia coli CFT073
uuugccaaacgcguc

SEQ ID NO: 2613645 - RNA, 20 nt, Escherichia coli CFT073
uuugccaauagcguuuugcg

SEQ ID NO: 2613646 - RNA, 13 nt, Escherichia coli CFT073
uuugccagcagag

SEQ ID NO: 2613647 - RNA, 22 nt, Escherichia coli CFT073
uuugccaguaauaacccgucag

SEQ ID NO: 2613648 - RNA, 21 nt, Escherichia coli CFT073
uuugccaucaaucacuuugcg

SEQ ID NO: 2613649 - RNA, 15 nt, Escherichia coli CFT073
uuugccaucucacuu

SEQ ID NO: 2613650 - RNA, 16 nt, Escherichia coli CFT073
uuugccaucucugcaa

SEQ ID NO: 2613651 - RNA, 16 nt, Escherichia coli CFT073
uuugccaugcauaucc

SEQ ID NO: 2613652 - RNA, 14 nt, Escherichia coli CFT073
uuugcccuaaagcg

SEQ ID NO: 2613653 - RNA, 22 nt, Escherichia coli CFT073
uuugcccugaugaucuaaaagc

SEQ ID NO: 2613654 - RNA, 14 nt, Escherichia coli CFT073
uuugcccuuccaua

SEQ ID NO: 2613655 - RNA, 15 nt, Escherichia coli CFT073
uuugccgcauccuca

SEQ ID NO: 2613656 - RNA, 19 nt, Escherichia coli CFT073
uuugccgcuuuuaugugca

SEQ ID NO: 2613657 - RNA, 24 nt, Escherichia coli CFT073
uuugccggaugcgaugcuggcgca

SEQ ID NO: 2613658 - RNA, 14 nt, Escherichia coli CFT073
uuugccgugaacaa

SEQ ID NO: 2613659 - RNA, 14 nt, Escherichia coli CFT073
uuugccugccgccu

SEQ ID NO: 2613660 - RNA, 21 nt, Escherichia coli CFT073
uuugccugccgccuuuugccu

SEQ ID NO: 2613661 - RNA, 12 nt, Escherichia coli CFT073
uuugccugcuau

SEQ ID NO: 2613662 - RNA, 19 nt, Escherichia coli CFT073
uuugccuggcggcagauag

SEQ ID NO: 2613663 - RNA, 19 nt, Escherichia coli CFT073
uuugccugugcaaccuuuu

SEQ ID NO: 2613664 - RNA, 16 nt, Escherichia coli CFT073
uuugccuuacgcaccg

SEQ ID NO: 2613665 - RNA, 20 nt, Escherichia coli CFT073
uuugcgaguccgcuuccgcu

SEQ ID NO: 2613666 - RNA, 20 nt, Escherichia coli CFT073
uuugcgagucugcuccagaa

SEQ ID NO: 2613667 - RNA, 18 nt, Escherichia coli CFT073
uuugcgauauauuuugua

SEQ ID NO: 2613668 - RNA, 19 nt, Escherichia coli CFT073
uuugcgauauauuuuguac

SEQ ID NO: 2613669 - RNA, 13 nt, Escherichia coli CFT073
uuuucagcgugcc

SEQ ID NO: 2613670 - RNA, 17 nt, Escherichia coli CFT073
uuuucaggggagcuuug

SEQ ID NO: 2613671 - RNA, 11 nt, Escherichia coli CFT073
uuuuccagcac

SEQ ID NO: 2613672 - RNA, 22 nt, Escherichia coli CFT073
uuuuccagcgcgcuaugcaaca

SEQ ID NO: 2613673 - RNA, 20 nt, Escherichia coli CFT073
uuuuccaggggcuggugccu

SEQ ID NO: 2613674 - RNA, 18 nt, Escherichia coli CFT073
uuuuccaguucuagugcu

SEQ ID NO: 2613675 - RNA, 14 nt, Escherichia coli CFT073
uuuucccaauaauu

SEQ ID NO: 2613676 - RNA, 20 nt, Escherichia coli CFT073
uuuucccgauauaaccaucc

SEQ ID NO: 2613677 - RNA, 22 nt, Escherichia coli CFT073
uuuucccuuucagauaucccau

SEQ ID NO: 2613678 - RNA, 13 nt, Escherichia coli CFT073
uuuucccuuuuag

SEQ ID NO: 2613679 - RNA, 19 nt, Escherichia coli CFT073
uuuuccgggccaaaaaccg

SEQ ID NO: 2613680 - RNA, 23 nt, Escherichia coli CFT073
uuuuccggguucucgcaaaacgu

SEQ ID NO: 2613681 - RNA, 18 nt, Escherichia coli CFT073
uuuuccggugccaucucc

SEQ ID NO: 2613682 - RNA, 16 nt, Escherichia coli CFT073
uuuuccugguaucaau

SEQ ID NO: 2613683 - RNA, 17 nt, Escherichia coli CFT073
uuuuccuugaaaaagag

SEQ ID NO: 2613684 - RNA, 22 nt, Escherichia coli CFT073
uuuucgaugcguaccauuucuu

SEQ ID NO: 2613685 - RNA, 16 nt, Escherichia coli CFT073
uuuucgcaaucaccuu

SEQ ID NO: 2613686 - RNA, 16 nt, Escherichia coli CFT073
uuuucgccaucucaaa

SEQ ID NO: 2613687 - RNA, 18 nt, Escherichia coli CFT073
uuuucgcuggaauuucug

SEQ ID NO: 2613688 - RNA, 21 nt, Escherichia coli CFT073
uuuucgcuugaucuuccugau

SEQ ID NO: 2613689 - RNA, 10 nt, Escherichia coli CFT073
uuuucgucgc

SEQ ID NO: 2613690 - RNA, 13 nt, Escherichia coli CFT073
uuuucguuuuaau

SEQ ID NO: 2613691 - RNA, 14 nt, Escherichia coli CFT073
uuuucuacuuugua

SEQ ID NO: 2613692 - RNA, 19 nt, Escherichia coli CFT073
uuuucucgcgaaccgccug

SEQ ID NO: 2613693 - RNA, 20 nt, Escherichia coli CFT073
uuuucucgcgaaccgccugg

SEQ ID NO: 2613694 - RNA, 11 nt, Escherichia coli CFT073
uuuucugacca

SEQ ID NO: 2613695 - RNA, 14 nt, Escherichia coli CFT073
uuuucugccugguc

SEQ ID NO: 2613696 - RNA, 16 nt, Escherichia coli CFT073
uuuucuggaugccauc

SEQ ID NO: 2613697 - RNA, 13 nt, Escherichia coli CFT073
uuuucuucaauga

SEQ ID NO: 2613698 - RNA, 18 nt, Escherichia coli CFT073
uuuucuuccggcagcaaa

SEQ ID NO: 2613699 - RNA, 16 nt, Escherichia coli CFT073
uuuugaaauaaaauca

SEQ ID NO: 2613700 - RNA, 11 nt, Escherichia coli CFT073
uuuugaacaga

SEQ ID NO: 2613701 - RNA, 12 nt, Escherichia coli CFT073
uuuugaacagac

SEQ ID NO: 2613702 - RNA, 15 nt, Escherichia coli CFT073
uuuugaacuuuuucu

SEQ ID NO: 2613703 - RNA, 16 nt, Escherichia coli CFT073
uuuugaaggaaaaauc

SEQ ID NO: 2613704 - RNA, 19 nt, Escherichia coli CFT073
uuuugacguuuaauugcag

SEQ ID NO: 2613705 - RNA, 15 nt, Escherichia coli CFT073
uuuugagcgguacac

SEQ ID NO: 2613706 - RNA, 15 nt, Escherichia coli CFT073
uuuugauacucaguc

SEQ ID NO: 2613707 - RNA, 17 nt, Escherichia coli CFT073
uuuugcagcuguugcgc

SEQ ID NO: 2613708 - RNA, 14 nt, Escherichia coli CFT073
uuuugcauagugau

SEQ ID NO: 2613709 - RNA, 11 nt, Escherichia coli CFT073
uuuugccaggc

SEQ ID NO: 2613710 - RNA, 15 nt, Escherichia coli CFT073
uuuugcccuuucagc

SEQ ID NO: 2613711 - RNA, 13 nt, Escherichia coli CFT073
uuuugccugugca

SEQ ID NO: 2613712 - RNA, 12 nt, Escherichia coli CFT073
uuuugcgacccg

SEQ ID NO: 2613713 - RNA, 18 nt, Escherichia coli CFT073
uuuugcgagaacgucugc

SEQ ID NO: 2613714 - RNA, 20 nt, Escherichia coli CFT073
uuuugcgauuguaauuucac

SEQ ID NO: 2613715 - RNA, 13 nt, Escherichia coli CFT073
uuuugcgccauca

SEQ ID NO: 2613716 - RNA, 16 nt, Escherichia coli CFT073
uuuugcggaucugcuc

SEQ ID NO: 2613717 - RNA, 19 nt, Escherichia coli CFT073
uuuugcuaccaaaccucau

SEQ ID NO: 2613718 - RNA, 18 nt, Escherichia coli CFT073
uuuugcuauucaccugau

SEQ ID NO: 2613719 - RNA, 18 nt, Escherichia coli CFT073
uuuugcucggcaaucucu

SEQ ID NO: 2613720 - RNA, 16 nt, Escherichia coli CFT073
uuuugcuguuccagca

SEQ ID NO: 2613721 - RNA, 21 nt, Escherichia coli CFT073
uuuuggcgcguucccuuguug

SEQ ID NO: 2613722 - RNA, 12 nt, Escherichia coli CFT073
uuuuguagaccu

SEQ ID NO: 2613723 - RNA, 13 nt, Escherichia coli CFT073
uuuuguaggccug

SEQ ID NO: 2613724 - RNA, 13 nt, Escherichia coli CFT073
uuuugucucugca

SEQ ID NO: 2613725 - RNA, 12 nt, Escherichia coli CFT073
uuuuguuuuguc

SEQ ID NO: 2613726 - RNA, 16 nt, Escherichia coli CFT073
uuuuuaaccgucacgu

SEQ ID NO: 2613727 - RNA, 22 nt, Escherichia coli CFT073
uuuuuaacgccgcuauacgccu

SEQ ID NO: 2613728 - RNA, 23 nt, Escherichia coli CFT073
uuuuuaauaaaaaggugauuuau

SEQ ID NO: 2613729 - RNA, 19 nt, Escherichia coli CFT073
uuuuuacaucaucagaaau

SEQ ID NO: 2613730 - RNA, 13 nt, Escherichia coli CFT073
uuuuuacccagca

SEQ ID NO: 2613731 - RNA, 20 nt, Escherichia coli CFT073
uuuuuacgaugcaauuauca

SEQ ID NO: 2613732 - RNA, 18 nt, Escherichia coli CFT073
uuuuuagauuguuuucaa

SEQ ID NO: 2613733 - RNA, 17 nt, Escherichia coli CFT073
uuuuuauagcuuauucu

SEQ ID NO: 2613734 - RNA, 23 nt, Escherichia coli CFT073
uuuuuaucccggcaaaaaacacu

SEQ ID NO: 2613735 - RNA, 11 nt, Escherichia coli CFT073
uuuuuaugaug

SEQ ID NO: 2613736 - RNA, 17 nt, Escherichia coli CFT073
uuuuuaugaugcacuuc

SEQ ID NO: 2613737 - RNA, 14 nt, Escherichia coli CFT073
uuuuucaauuucca

SEQ ID NO: 2613738 - RNA, 21 nt, Escherichia coli CFT073
uuuuucaccgggauccaguua

SEQ ID NO: 2613739 - RNA, 19 nt, Escherichia coli CFT073
uuuuucacugcggcaagaa

SEQ ID NO: 2613740 - RNA, 14 nt, Escherichia coli CFT073
uuuuucaguuugcu

SEQ ID NO: 2613741 - RNA, 18 nt, Escherichia coli CFT073
uuuuucauagcaaauucc

SEQ ID NO: 2613742 - RNA, 14 nt, Escherichia coli CFT073
uuuuucauccagcg

SEQ ID NO: 2613743 - RNA, 14 nt, Escherichia coli CFT073
uuuuucauuucucc

SEQ ID NO: 2613744 - RNA, 15 nt, Escherichia coli CFT073
uuuuucauuucuccu

SEQ ID NO: 2613745 - RNA, 23 nt, Escherichia coli CFT073
uuuuuccagcauuucuuccagcg

SEQ ID NO: 2613746 - RNA, 11 nt, Escherichia coli CFT073
uuuuuccagcu

SEQ ID NO: 2613747 - RNA, 24 nt, Escherichia coli CFT073
uuuuuccaucgucagacgcucugg

SEQ ID NO: 2613748 - RNA, 15 nt, Escherichia coli CFT073
uuuuuccgcacauac

SEQ ID NO: 2613749 - RNA, 13 nt, Escherichia coli CFT073
uuuuucgaaccga

SEQ ID NO: 2613750 - RNA, 23 nt, Escherichia coli CFT073
uuuuucgacuuccaccagcggcu

SEQ ID NO: 2613751 - RNA, 14 nt, Escherichia coli CFT073
uuuuucgauaauca

SEQ ID NO: 2613752 - RNA, 18 nt, Escherichia coli CFT073
uuuuucuccgagcauuuu

SEQ ID NO: 2613753 - RNA, 23 nt, Escherichia coli CFT073
uuuuucuccgagcauuuucagcg

SEQ ID NO: 2613754 - RNA, 12 nt, Escherichia coli CFT073
uuuuucuucagu

SEQ ID NO: 2613755 - RNA, 17 nt, Escherichia coli CFT073
uuuuugaaacugguaac

SEQ ID NO: 2613756 - RNA, 11 nt, Escherichia coli CFT073
uuuuugaagcg

SEQ ID NO: 2613757 - RNA, 23 nt, Escherichia coli CFT073
uuuuugcauuuccgcugauucaa

SEQ ID NO: 2613758 - RNA, 16 nt, Escherichia coli CFT073
uuuuugccaauaaaac

SEQ ID NO: 2613759 - RNA, 22 nt, Escherichia coli CFT073
uuuuugccccagaauuuucccu

SEQ ID NO: 2613760 - RNA, 18 nt, Escherichia coli CFT073
uuuuugcgcccaugauga

SEQ ID NO: 2613761 - RNA, 14 nt, Escherichia coli CFT073
uuuuugcuccgaag

SEQ ID NO: 2613762 - RNA, 18 nt, Escherichia coli CFT073
uuuuuggguuaauucggc

SEQ ID NO: 2613763 - RNA, 20 nt, Escherichia coli CFT073
uuuuuggguuaauucggccu

SEQ ID NO: 2613764 - RNA, 14 nt, Escherichia coli CFT073
uuuuuguugccuga

SEQ ID NO: 2613765 - RNA, 14 nt, Escherichia coli CFT073
uuuuuuauuuguuu

SEQ ID NO: 2613766 - RNA, 21 nt, Escherichia coli CFT073
uuuuuugagaacauucaucau

SEQ ID NO: 2613767 - RNA, 17 nt, Escherichia coli CFT073
aaugcgaaugaaagaug

SEQ ID NO: 2613768 - RNA, 16 nt, Escherichia coli CFT073
aaugcgacccacgccc

SEQ ID NO: 2613769 - RNA, 20 nt, Escherichia coli CFT073
aaugcgauccugagccaguu

SEQ ID NO: 2613770 - RNA, 23 nt, Escherichia coli CFT073
aaugcgccaccacugacacggaa

SEQ ID NO: 2613771 - RNA, 19 nt, Escherichia coli CFT073
aaugcgccccgcaacgccg

SEQ ID NO: 2613772 - RNA, 15 nt, Escherichia coli CFT073
aaugcgccgccaaac

SEQ ID NO: 2613773 - RNA, 16 nt, Escherichia coli CFT073
aaugcgccgccaaacg

SEQ ID NO: 2613774 - RNA, 19 nt, Escherichia coli CFT073
aaugcgccgccaaacgcgg

SEQ ID NO: 2613775 - RNA, 18 nt, Escherichia coli CFT073
aaugcgcgcgaaaacauc

SEQ ID NO: 2613776 - RNA, 17 nt, Escherichia coli CFT073
aaugcgcgcuaugauga

SEQ ID NO: 2613777 - RNA, 22 nt, Escherichia coli CFT073
aaugcgcgcuaugaugaaaaag

SEQ ID NO: 2613778 - RNA, 17 nt, Escherichia coli CFT073
aaugcgcggucagaaaa

SEQ ID NO: 2613779 - RNA, 22 nt, Escherichia coli CFT073
aaugcgcucgcauccugccagg

SEQ ID NO: 2613780 - RNA, 16 nt, Escherichia coli CFT073
aaugcgcuuccggcag

SEQ ID NO: 2613781 - RNA, 20 nt, Escherichia coli CFT073
aaugcgcuuccggcagcuuc

SEQ ID NO: 2613782 - RNA, 23 nt, Escherichia coli CFT073
aaugcgcuuccggcagcuucacg

SEQ ID NO: 2613783 - RNA, 12 nt, Escherichia coli CFT073
aaugcgcuugca

SEQ ID NO: 2613784 - RNA, 18 nt, Escherichia coli CFT073
aaugcggaugagauacau

SEQ ID NO: 2613785 - RNA, 14 nt, Escherichia coli CFT073
aaugcguaaauugc

SEQ ID NO: 2613786 - RNA, 19 nt, Escherichia coli CFT073
aaugcgucgugauaaguaa

SEQ ID NO: 2613787 - RNA, 18 nt, Escherichia coli CFT073
aaugcucaagcaucauuu

SEQ ID NO: 2613788 - RNA, 14 nt, Escherichia coli CFT073
aaugcucacccgcg

SEQ ID NO: 2613789 - RNA, 22 nt, Escherichia coli CFT073
aaugcuccccagaccaauugcc

SEQ ID NO: 2613790 - RNA, 17 nt, Escherichia coli CFT073
aaugcuccccuuucuua

SEQ ID NO: 2613791 - RNA, 22 nt, Escherichia coli CFT073
aaugcucccgcaaggucgacuu

SEQ ID NO: 2613792 - RNA, 21 nt, Escherichia coli CFT073
aaugcugcaccccacaaacag

SEQ ID NO: 2613793 - RNA, 23 nt, Escherichia coli CFT073
aaugcuggcuuuuggaccgccaa

SEQ ID NO: 2613794 - RNA, 17 nt, Escherichia coli CFT073
aaugcugguaauggcuu

SEQ ID NO: 2613795 - RNA, 22 nt, Escherichia coli CFT073
aaugcugguuuugugcgccaca

SEQ ID NO: 2613796 - RNA, 22 nt, Escherichia coli CFT073
aaugcuugacucuguggcggga

SEQ ID NO: 2613797 - RNA, 22 nt, Escherichia coli CFT073
aaugcuuuauacgaugccugca

SEQ ID NO: 2613798 - RNA, 13 nt, Escherichia coli CFT073
aaugcuuucagua

SEQ ID NO: 2613799 - RNA, 16 nt, Escherichia coli CFT073
aaugcuuuccagagag

SEQ ID NO: 2613800 - RNA, 14 nt, Escherichia coli CFT073
aauggaaaaaguuu

SEQ ID NO: 2613801 - RNA, 17 nt, Escherichia coli CFT073
aauggaaacagcaccau

SEQ ID NO: 2613802 - RNA, 16 nt, Escherichia coli CFT073
aauggagagaaccagc

SEQ ID NO: 2613803 - RNA, 18 nt, Escherichia coli CFT073
aauggagagaaccagcgc

SEQ ID NO: 2613804 - RNA, 20 nt, Escherichia coli CFT073
aauggagauuguuaauacga

SEQ ID NO: 2613805 - RNA, 17 nt, Escherichia coli CFT073
aauggauaagaaagaua

SEQ ID NO: 2613806 - RNA, 21 nt, Escherichia coli CFT073
aauggauaagaaagauacaaa

SEQ ID NO: 2613807 - RNA, 19 nt, Escherichia coli CFT073
aauggaugcaucuucauua

SEQ ID NO: 2613808 - RNA, 21 nt, Escherichia coli CFT073
aauggcacguugcugcggcgu

SEQ ID NO: 2613809 - RNA, 18 nt, Escherichia coli CFT073
aauggcauauuccgccac

SEQ ID NO: 2613810 - RNA, 15 nt, Escherichia coli CFT073
aauggcauccgccac

SEQ ID NO: 2613811 - RNA, 21 nt, Escherichia coli CFT073
aauggcauccgccacuuuaug

SEQ ID NO: 2613812 - RNA, 14 nt, Escherichia coli CFT073
aauggcaucugaua

SEQ ID NO: 2613813 - RNA, 20 nt, Escherichia coli CFT073
aauggcaucugauaagccca

SEQ ID NO: 2613814 - RNA, 14 nt, Escherichia coli CFT073
aauggccaaugcgg

SEQ ID NO: 2613815 - RNA, 15 nt, Escherichia coli CFT073
aauggccagcacauu

SEQ ID NO: 2613816 - RNA, 20 nt, Escherichia coli CFT073
aauggccucuggugcaauuu

SEQ ID NO: 2613817 - RNA, 24 nt, Escherichia coli CFT073
aauggccugaugcgcuuaucagac

SEQ ID NO: 2613818 - RNA, 23 nt, Escherichia coli CFT073
aauggcgaccacugaccgcccgg

SEQ ID NO: 2613819 - RNA, 19 nt, Escherichia coli CFT073
aauggcgcauccagccaac

SEQ ID NO: 2613820 - RNA, 17 nt, Escherichia coli CFT073
aauggcgcgaaaacaac

SEQ ID NO: 2613821 - RNA, 17 nt, Escherichia coli CFT073
aauggcgucaacaacac

SEQ ID NO: 2613822 - RNA, 21 nt, Escherichia coli CFT073
aauggcgucaacaacacucuc

SEQ ID NO: 2613823 - RNA, 17 nt, Escherichia coli CFT073
aauggcguuaacaauaa

SEQ ID NO: 2613824 - RNA, 17 nt, Escherichia coli CFT073
aauggcguuaucacggu

SEQ ID NO: 2613825 - RNA, 15 nt, Escherichia coli CFT073
aauggcguugcuggc

SEQ ID NO: 2613826 - RNA, 18 nt, Escherichia coli CFT073
aauggcuaucgaaaucaa

SEQ ID NO: 2613827 - RNA, 19 nt, Escherichia coli CFT073
aauggcuaucgaaaucaaa

SEQ ID NO: 2613828 - RNA, 20 nt, Escherichia coli CFT073
aauggcugcgcgaaaacccu

SEQ ID NO: 2613829 - RNA, 15 nt, Escherichia coli CFT073
aauggcuggcagcag

SEQ ID NO: 2613830 - RNA, 13 nt, Escherichia coli CFT073
aauggcuggucag

SEQ ID NO: 2613831 - RNA, 21 nt, Escherichia coli CFT073
aauggcuguuaaacgccgguu

SEQ ID NO: 2613832 - RNA, 14 nt, Escherichia coli CFT073
aauggcuuccagua

SEQ ID NO: 2613833 - RNA, 13 nt, Escherichia coli CFT073
aauggcuuuugcc

SEQ ID NO: 2613834 - RNA, 14 nt, Escherichia coli CFT073
aaugggcgcgggca

SEQ ID NO: 2613835 - RNA, 18 nt, Escherichia coli CFT073
aaugggcgucuaaaucgu

SEQ ID NO: 2613836 - RNA, 13 nt, Escherichia coli CFT073
aauggggacauca

SEQ ID NO: 2613837 - RNA, 17 nt, Escherichia coli CFT073
aauggggauuuacgaug

SEQ ID NO: 2613838 - RNA, 18 nt, Escherichia coli CFT073
aaugggggagagccagca

SEQ ID NO: 2613839 - RNA, 17 nt, Escherichia coli CFT073
aaugguaacuuucugcc

SEQ ID NO: 2613840 - RNA, 15 nt, Escherichia coli CFT073
aaugguaaucagcga

SEQ ID NO: 2613841 - RNA, 16 nt, Escherichia coli CFT073
aaugguaucggcaucg

SEQ ID NO: 2613842 - RNA, 14 nt, Escherichia coli CFT073
aauggucacacaca

SEQ ID NO: 2613843 - RNA, 14 nt, Escherichia coli CFT073
aauggucaguuucg

SEQ ID NO: 2613844 - RNA, 18 nt, Escherichia coli CFT073
aaugguccgugacccgga

SEQ ID NO: 2613845 - RNA, 23 nt, Escherichia coli CFT073
aaugguccgugacccggaauaaa

SEQ ID NO: 2613846 - RNA, 16 nt, Escherichia coli CFT073
aauggucuggcgacgg

SEQ ID NO: 2613847 - RNA, 20 nt, Escherichia coli CFT073
aauggucuugacauccagcg

SEQ ID NO: 2613848 - RNA, 19 nt, Escherichia coli CFT073
aauggugguucagauaaau

SEQ ID NO: 2613849 - RNA, 22 nt, Escherichia coli CFT073
aauggugugcaugguguucaga

SEQ ID NO: 2613850 - RNA, 15 nt, Escherichia coli CFT073
aaugguuugccagca

SEQ ID NO: 2613851 - RNA, 22 nt, Escherichia coli CFT073
aaugguuuguuuggcuggcaaa

SEQ ID NO: 2613852 - RNA, 18 nt, Escherichia coli CFT073
aauguaaaaguugcaguc

SEQ ID NO: 2613853 - RNA, 21 nt, Escherichia coli CFT073
aauguaaaaguugcaguccgc

SEQ ID NO: 2613854 - RNA, 14 nt, Escherichia coli CFT073
aauguaaccacagg

SEQ ID NO: 2613855 - RNA, 23 nt, Escherichia coli CFT073
aauguagcgaacugguuucaaua

SEQ ID NO: 2613856 - RNA, 13 nt, Escherichia coli CFT073
aauguaucugaag

SEQ ID NO: 2613857 - RNA, 17 nt, Escherichia coli CFT073
aauguaugugcgaaaau

SEQ ID NO: 2613858 - RNA, 15 nt, Escherichia coli CFT073
aaugucaccagccgg

SEQ ID NO: 2613859 - RNA, 22 nt, Escherichia coli CFT073
aaugucaccuaauuuaaaauug

SEQ ID NO: 2613860 - RNA, 15 nt, Escherichia coli CFT073
aaugucagaaagaaa

SEQ ID NO: 2613861 - RNA, 19 nt, Escherichia coli CFT073
aaugucagggccaucgcgg

SEQ ID NO: 2613862 - RNA, 14 nt, Escherichia coli CFT073
aaugucagguauug

SEQ ID NO: 2613863 - RNA, 19 nt, Escherichia coli CFT073
aaugucauacuauugccau

SEQ ID NO: 2613864 - RNA, 16 nt, Escherichia coli CFT073
aaugucauggcagucu

SEQ ID NO: 2613865 - RNA, 14 nt, Escherichia coli CFT073
aauguccauauaua

SEQ ID NO: 2613866 - RNA, 19 nt, Escherichia coli CFT073
aauguccauauauaaaauc

SEQ ID NO: 2613867 - RNA, 18 nt, Escherichia coli CFT073
aauguccguaacauaaca

SEQ ID NO: 2613868 - RNA, 22 nt, Escherichia coli CFT073
aaugucgacguuuuucaggcug

SEQ ID NO: 2613869 - RNA, 20 nt, Escherichia coli CFT073
aaugucgcgaucauggucug

SEQ ID NO: 2613870 - RNA, 18 nt, Escherichia coli CFT073
aaugucggcccgcauuau

SEQ ID NO: 2613871 - RNA, 23 nt, Escherichia coli CFT073
aaugucggcggcgaucgccugcu

SEQ ID NO: 2613872 - RNA, 21 nt, Escherichia coli CFT073
aaugucucgguagagaaaacc

SEQ ID NO: 2613873 - RNA, 23 nt, Escherichia coli CFT073
aaugugaaaacccugcgcauggu

SEQ ID NO: 2613874 - RNA, 23 nt, Escherichia coli CFT073
ucguagaagccauuaaacaccag

SEQ ID NO: 2613875 - RNA, 18 nt, Escherichia coli CFT073
ucguagauuucauccggc

SEQ ID NO: 2613876 - RNA, 16 nt, Escherichia coli CFT073
ucguagccaccaucuu

SEQ ID NO: 2613877 - RNA, 18 nt, Escherichia coli CFT073
ucguagccaccaucuuuu

SEQ ID NO: 2613878 - RNA, 12 nt, Escherichia coli CFT073
ucguaggccuga

SEQ ID NO: 2613879 - RNA, 14 nt, Escherichia coli CFT073
ucguaggccugaua

SEQ ID NO: 2613880 - RNA, 21 nt, Escherichia coli CFT073
ucguaguuuuugcccaucaug

SEQ ID NO: 2613881 - RNA, 15 nt, Escherichia coli CFT073
ucguauacugcagcg

SEQ ID NO: 2613882 - RNA, 12 nt, Escherichia coli CFT073
ucguauccagcg

SEQ ID NO: 2613883 - RNA, 17 nt, Escherichia coli CFT073
ucgucaaaauucauaaa

SEQ ID NO: 2613884 - RNA, 14 nt, Escherichia coli CFT073
ucgucaaagauauu

SEQ ID NO: 2613885 - RNA, 20 nt, Escherichia coli CFT073
ucgucaaagauauuauuaaa

SEQ ID NO: 2613886 - RNA, 15 nt, Escherichia coli CFT073
ucgucaacuucuuua

SEQ ID NO: 2613887 - RNA, 17 nt, Escherichia coli CFT073
ucgucaauaaucaugca

SEQ ID NO: 2613888 - RNA, 14 nt, Escherichia coli CFT073
ucgucauaucauca

SEQ ID NO: 2613889 - RNA, 23 nt, Escherichia coli CFT073
ucgucaucaaacggcauaugcca

SEQ ID NO: 2613890 - RNA, 13 nt, Escherichia coli CFT073
ucgucauggccca

SEQ ID NO: 2613891 - RNA, 16 nt, Escherichia coli CFT073
ucguccaacaguucca

SEQ ID NO: 2613892 - RNA, 19 nt, Escherichia coli CFT073
ucguccagauguucuucaa

SEQ ID NO: 2613893 - RNA, 13 nt, Escherichia coli CFT073
ucguccagcauca

SEQ ID NO: 2613894 - RNA, 12 nt, Escherichia coli CFT073
ucgucccaggca

SEQ ID NO: 2613895 - RNA, 12 nt, Escherichia coli CFT073
ucgucccagucg

SEQ ID NO: 2613896 - RNA, 14 nt, Escherichia coli CFT073
ucguccuucacauu

SEQ ID NO: 2613897 - RNA, 22 nt, Escherichia coli CFT073
ucgucgauuguuauaccagucc

SEQ ID NO: 2613898 - RNA, 14 nt, Escherichia coli CFT073
ucgucgccagacca

SEQ ID NO: 2613899 - RNA, 16 nt, Escherichia coli CFT073
ucgucgcucacuucac

SEQ ID NO: 2613900 - RNA, 18 nt, Escherichia coli CFT073
ucgucgguguccacuucc

SEQ ID NO: 2613901 - RNA, 13 nt, Escherichia coli CFT073
ucgucuggcgcgu

SEQ ID NO: 2613902 - RNA, 23 nt, Escherichia coli CFT073
ucgucuggcuguaguuucagugc

SEQ ID NO: 2613903 - RNA, 23 nt, Escherichia coli CFT073
ucgucugguucgccaaaugucac

SEQ ID NO: 2613904 - RNA, 14 nt, Escherichia coli CFT073
ucgucuucaaccgc

SEQ ID NO: 2613905 - RNA, 17 nt, Escherichia coli CFT073
ucgucuucgucccaguc

SEQ ID NO: 2613906 - RNA, 15 nt, Escherichia coli CFT073
ucgucuuuauccugg

SEQ ID NO: 2613907 - RNA, 16 nt, Escherichia coli CFT073
ucgucuuuauccuggc

SEQ ID NO: 2613908 - RNA, 22 nt, Escherichia coli CFT073
ucgugaauuuuaggaugcugca

SEQ ID NO: 2613909 - RNA, 11 nt, Escherichia coli CFT073
ucgugauaaac

SEQ ID NO: 2613910 - RNA, 16 nt, Escherichia coli CFT073
aauuacgauccaccac

SEQ ID NO: 2613911 - RNA, 21 nt, Escherichia coli CFT073
aauuacgauguguggcaucgu

SEQ ID NO: 2613912 - RNA, 18 nt, Escherichia coli CFT073
aauuacgccgagcgccag

SEQ ID NO: 2613913 - RNA, 21 nt, Escherichia coli CFT073
aauuacgccgagcgccagcca

SEQ ID NO: 2613914 - RNA, 21 nt, Escherichia coli CFT073
aauuacgccggaaaguuaauu

SEQ ID NO: 2613915 - RNA, 16 nt, Escherichia coli CFT073
aauuacgcuauacaac

SEQ ID NO: 2613916 - RNA, 13 nt, Escherichia coli CFT073
aauuacucaguau

SEQ ID NO: 2613917 - RNA, 13 nt, Escherichia coli CFT073
aauuacugcugcg

SEQ ID NO: 2613918 - RNA, 23 nt, Escherichia coli CFT073
aauuacuuacaucugucugauaa

SEQ ID NO: 2613919 - RNA, 13 nt, Escherichia coli CFT073
aauuacuucucuu

SEQ ID NO: 2613920 - RNA, 18 nt, Escherichia coli CFT073
aauuagcacgauuuugua

SEQ ID NO: 2613921 - RNA, 15 nt, Escherichia coli CFT073
aauuagcggccagcg

SEQ ID NO: 2613922 - RNA, 17 nt, Escherichia coli CFT073
aauuagcgucaccaucc

SEQ ID NO: 2613923 - RNA, 16 nt, Escherichia coli CFT073
aauuagcuuacgcccg

SEQ ID NO: 2613924 - RNA, 16 nt, Escherichia coli CFT073
aauuauaauaaauauu

SEQ ID NO: 2613925 - RNA, 19 nt, Escherichia coli CFT073
aauuauaauacgcuugauu

SEQ ID NO: 2613926 - RNA, 14 nt, Escherichia coli CFT073
aauuaucgcagccu

SEQ ID NO: 2613927 - RNA, 22 nt, Escherichia coli CFT073
aauuaucggagaaauucugcau

SEQ ID NO: 2613928 - RNA, 23 nt, Escherichia coli CFT073
aauuaucuauacgacuggccaug

SEQ ID NO: 2613929 - RNA, 24 nt, Escherichia coli CFT073
aauuaucuauuaaagaguuguaau

SEQ ID NO: 2613930 - RNA, 12 nt, Escherichia coli CFT073
aauuaugcagcc

SEQ ID NO: 2613931 - RNA, 14 nt, Escherichia coli CFT073
aauuaugcccucag

SEQ ID NO: 2613932 - RNA, 13 nt, Escherichia coli CFT073
aauuauuaccauc

SEQ ID NO: 2613933 - RNA, 14 nt, Escherichia coli CFT073
aauuauuaccaucg

SEQ ID NO: 2613934 - RNA, 18 nt, Escherichia coli CFT073
aauuauuaccgucagaaa

SEQ ID NO: 2613935 - RNA, 19 nt, Escherichia coli CFT073
aauuauuacucaacagguu

SEQ ID NO: 2613936 - RNA, 15 nt, Escherichia coli CFT073
aauuauuagcaacga

SEQ ID NO: 2613937 - RNA, 23 nt, Escherichia coli CFT073
aauuauuagcaacgauauccaua

SEQ ID NO: 2613938 - RNA, 13 nt, Escherichia coli CFT073
aauuauucagagu

SEQ ID NO: 2613939 - RNA, 23 nt, Escherichia coli CFT073
aauuauugccuugaugaaaaaac

SEQ ID NO: 2613940 - RNA, 22 nt, Escherichia coli CFT073
aauuauuuuaccauauaaacau

SEQ ID NO: 2613941 - RNA, 21 nt, Escherichia coli CFT073
aauuauuuuacugguugauuu

SEQ ID NO: 2613942 - RNA, 21 nt, Escherichia coli CFT073
aauucaacagauuucgaaucu

SEQ ID NO: 2613943 - RNA, 17 nt, Escherichia coli CFT073
aauucaacuaacugacu

SEQ ID NO: 2613944 - RNA, 22 nt, Escherichia coli CFT073
aauucaaugacaguaucaccaa

SEQ ID NO: 2613945 - RNA, 18 nt, Escherichia coli CFT073
aauucacgccccagauug

SEQ ID NO: 2613946 - RNA, 14 nt, Escherichia coli CFT073
aauucacgccuucu

SEQ ID NO: 2613947 - RNA, 19 nt, Escherichia coli CFT073
aauucacguaucagcaugg

SEQ ID NO: 2613948 - RNA, 11 nt, Escherichia coli CFT073
aauucacuucu

SEQ ID NO: 2613949 - RNA, 15 nt, Escherichia coli CFT073
aauucagcguggcga

SEQ ID NO: 2613950 - RNA, 20 nt, Escherichia coli CFT073
aauucaggccgucguuaauc

SEQ ID NO: 2613951 - RNA, 13 nt, Escherichia coli CFT073
aauucaguaccag

SEQ ID NO: 2613952 - RNA, 15 nt, Escherichia coli CFT073
aauucaguaccagca

SEQ ID NO: 2613953 - RNA, 22 nt, Escherichia coli CFT073
aauucaguaccagcaccugaau

SEQ ID NO: 2613954 - RNA, 18 nt, Escherichia coli CFT073
aauucaguacguucacgc

SEQ ID NO: 2613955 - RNA, 12 nt, Escherichia coli CFT073
aauucagugugc

SEQ ID NO: 2613956 - RNA, 20 nt, Escherichia coli CFT073
aauucaucuuucaucuguuu

SEQ ID NO: 2613957 - RNA, 20 nt, Escherichia coli CFT073
aauucauuacgaaguuuaau

SEQ ID NO: 2613958 - RNA, 15 nt, Escherichia coli CFT073
aauuccaucuuuaac

SEQ ID NO: 2613959 - RNA, 16 nt, Escherichia coli CFT073
aauuccccugccagaa

SEQ ID NO: 2613960 - RNA, 19 nt, Escherichia coli CFT073
aauuccccugccagaagca

SEQ ID NO: 2613961 - RNA, 22 nt, Escherichia coli CFT073
aauuccccugccagaagcagaa

SEQ ID NO: 2613962 - RNA, 20 nt, Escherichia coli CFT073
aauucccugugccagcggca

SEQ ID NO: 2613963 - RNA, 23 nt, Escherichia coli CFT073
aauuccgcgcgaacagucagcac

SEQ ID NO: 2613964 - RNA, 19 nt, Escherichia coli CFT073
aauuccggcuucuucugcc

SEQ ID NO: 2613965 - RNA, 18 nt, Escherichia coli CFT073
aauuccgugccagcacca

SEQ ID NO: 2613966 - RNA, 19 nt, Escherichia coli CFT073
aauuccgugccagcaccaa

SEQ ID NO: 2613967 - RNA, 23 nt, Escherichia coli CFT073
aauuccuuugcugcucuauugcc

SEQ ID NO: 2613968 - RNA, 16 nt, Escherichia coli CFT073
aauucgacuuucucug

SEQ ID NO: 2613969 - RNA, 21 nt, Escherichia coli CFT073
aauucgcagaccgggaaucga

SEQ ID NO: 2613970 - RNA, 21 nt, Escherichia coli CFT073
aauucgccacugcgacaccag

SEQ ID NO: 2613971 - RNA, 23 nt, Escherichia coli CFT073
aauucgcccuucggcaucacgaa

SEQ ID NO: 2613972 - RNA, 12 nt, Escherichia coli CFT073
aauucggcaucg

SEQ ID NO: 2613973 - RNA, 20 nt, Escherichia coli CFT073
aauucggccugguaaucgcg

SEQ ID NO: 2613974 - RNA, 22 nt, Escherichia coli CFT073
aauucgggcgcugauucuuccc

SEQ ID NO: 2613975 - RNA, 21 nt, Escherichia coli CFT073
aauucucccugcgacguucuc

SEQ ID NO: 2613976 - RNA, 15 nt, Escherichia coli CFT073
aauucuguuucauua

SEQ ID NO: 2613977 - RNA, 22 nt, Escherichia coli CFT073
acaaaaccaacgcauagacagc

SEQ ID NO: 2613978 - RNA, 12 nt, Escherichia coli CFT073
acaaaaccugcc

SEQ ID NO: 2613979 - RNA, 21 nt, Escherichia coli CFT073
acaaaagaauggcuguagggu

SEQ ID NO: 2613980 - RNA, 12 nt, Escherichia coli CFT073
acaaaagcaaag

SEQ ID NO: 2613981 - RNA, 12 nt, Escherichia coli CFT073
acaaaagcaccg

SEQ ID NO: 2613982 - RNA, 16 nt, Escherichia coli CFT073
acaaaagcgaagcgaa

SEQ ID NO: 2613983 - RNA, 15 nt, Escherichia coli CFT073
acaaaaucuucguua

SEQ ID NO: 2613984 - RNA, 22 nt, Escherichia coli CFT073
acaaaaugccguacagcagaau

SEQ ID NO: 2613985 - RNA, 19 nt, Escherichia coli CFT073
acaaaauggggacaucaaa

SEQ ID NO: 2613986 - RNA, 23 nt, Escherichia coli CFT073
acaaaauggggacaucaaagaaa

SEQ ID NO: 2613987 - RNA, 12 nt, Escherichia coli CFT073
acaaaauugccg

SEQ ID NO: 2613988 - RNA, 19 nt, Escherichia coli CFT073
acaaaauuuauccagcgca

SEQ ID NO: 2613989 - RNA, 20 nt, Escherichia coli CFT073
acaaacaaugccagaaacau

SEQ ID NO: 2613990 - RNA, 22 nt, Escherichia coli CFT073
acaaacagcucgacaccaaaca

SEQ ID NO: 2613991 - RNA, 19 nt, Escherichia coli CFT073
acaaacagucucaagcacc

SEQ ID NO: 2613992 - RNA, 16 nt, Escherichia coli CFT073
acaaacauaaagccug

SEQ ID NO: 2613993 - RNA, 16 nt, Escherichia coli CFT073
acaaacaucauccagu

SEQ ID NO: 2613994 - RNA, 11 nt, Escherichia coli CFT073
acaaaccaccg

SEQ ID NO: 2613995 - RNA, 18 nt, Escherichia coli CFT073
acaaacgcaaaacugccu

SEQ ID NO: 2613996 - RNA, 18 nt, Escherichia coli CFT073
acaaacgcaaacaccagc

SEQ ID NO: 2613997 - RNA, 14 nt, Escherichia coli CFT073
acaaacgcaaucca

SEQ ID NO: 2613998 - RNA, 17 nt, Escherichia coli CFT073
acaaacgcaauccagug

SEQ ID NO: 2613999 - RNA, 12 nt, Escherichia coli CFT073
acaaacgccacc

SEQ ID NO: 2614000 - RNA, 15 nt, Escherichia coli CFT073
acaaacgcugacaua

SEQ ID NO: 2614001 - RNA, 19 nt, Escherichia coli CFT073
acaaacgcuguaauuacca

SEQ ID NO: 2614002 - RNA, 21 nt, Escherichia coli CFT073
acaaacgcuuuacucaacucc

SEQ ID NO: 2614003 - RNA, 19 nt, Escherichia coli CFT073
acaaacggugagacgccag

SEQ ID NO: 2614004 - RNA, 18 nt, Escherichia coli CFT073
acaaacguucauacgcaa

SEQ ID NO: 2614005 - RNA, 18 nt, Escherichia coli CFT073
acaaacucacugccagca

SEQ ID NO: 2614006 - RNA, 20 nt, Escherichia coli CFT073
acaaacuuccagaauauguu

SEQ ID NO: 2614007 - RNA, 21 nt, Escherichia coli CFT073
acaaagcaaauaauguccaua

SEQ ID NO: 2614008 - RNA, 17 nt, Escherichia coli CFT073
acaaagcaauauuaugg

SEQ ID NO: 2614009 - RNA, 14 nt, Escherichia coli CFT073
acaaagccaacagc

SEQ ID NO: 2614010 - RNA, 15 nt, Escherichia coli CFT073
acaaagccaacagca

SEQ ID NO: 2614011 - RNA, 22 nt, Escherichia coli CFT073
acaaaggcggacucauaauccg

SEQ ID NO: 2614012 - RNA, 18 nt, Escherichia coli CFT073
acaaaggguaaagcacca

SEQ ID NO: 2614013 - RNA, 15 nt, Escherichia coli CFT073
acaaagguuuguaac

SEQ ID NO: 2614014 - RNA, 21 nt, Escherichia coli CFT073
acaaaguaauucccaguuacu

SEQ ID NO: 2614015 - RNA, 13 nt, Escherichia coli CFT073
acaaauaacccgc

SEQ ID NO: 2614016 - RNA, 14 nt, Escherichia coli CFT073
acaaauacaugaug

SEQ ID NO: 2614017 - RNA, 17 nt, Escherichia coli CFT073
acaaauagaucgccaga

SEQ ID NO: 2614018 - RNA, 19 nt, Escherichia coli CFT073
acaaauagccaauucccag

SEQ ID NO: 2614019 - RNA, 14 nt, Escherichia coli CFT073
acaaauagccagca

SEQ ID NO: 2614020 - RNA, 16 nt, Escherichia coli CFT073
acaaauagccagcaga

SEQ ID NO: 2614021 - RNA, 17 nt, Escherichia coli CFT073
acaaauagccagcagag

SEQ ID NO: 2614022 - RNA, 18 nt, Escherichia coli CFT073
acaaauaucuuucuacca

SEQ ID NO: 2614023 - RNA, 15 nt, Escherichia coli CFT073
acaaaucgugacagc

SEQ ID NO: 2614024 - RNA, 15 nt, Escherichia coli CFT073
acaaaucucccuugc

SEQ ID NO: 2614025 - RNA, 20 nt, Escherichia coli CFT073
acaaaugaaagcagcagcug

SEQ ID NO: 2614026 - RNA, 14 nt, Escherichia coli CFT073
acaaaugugccauu

SEQ ID NO: 2614027 - RNA, 19 nt, Escherichia coli CFT073
acaaauguguucagcgaca

SEQ ID NO: 2614028 - RNA, 21 nt, Escherichia coli CFT073
acaaauguguucagcgacaga

SEQ ID NO: 2614029 - RNA, 16 nt, Escherichia coli CFT073
acaaauuugugcucug

SEQ ID NO: 2614030 - RNA, 15 nt, Escherichia coli CFT073
acaacaaacgcaaac

SEQ ID NO: 2614031 - RNA, 14 nt, Escherichia coli CFT073
acaacaacaucaca

SEQ ID NO: 2614032 - RNA, 20 nt, Escherichia coli CFT073
acaacaauaccguaccaugu

SEQ ID NO: 2614033 - RNA, 14 nt, Escherichia coli CFT073
acaacacaccacca

SEQ ID NO: 2614034 - RNA, 19 nt, Escherichia coli CFT073
acaacaccgauagaaccaa

SEQ ID NO: 2614035 - RNA, 21 nt, Escherichia coli CFT073
acaacaccgauagaaccaaag

SEQ ID NO: 2614036 - RNA, 20 nt, Escherichia coli CFT073
acaacaccgguacuaacagg

SEQ ID NO: 2614037 - RNA, 16 nt, Escherichia coli CFT073
acaacacucucugcag

SEQ ID NO: 2614038 - RNA, 18 nt, Escherichia coli CFT073
acaacauagcuuggcaga

SEQ ID NO: 2614039 - RNA, 17 nt, Escherichia coli CFT073
acaacaucacaccugcu

SEQ ID NO: 2614040 - RNA, 18 nt, Escherichia coli CFT073
acaacaugagaacaguuc

SEQ ID NO: 2614041 - RNA, 23 nt, Escherichia coli CFT073
acaacaugccgaauccgggaagg

SEQ ID NO: 2614042 - RNA, 18 nt, Escherichia coli CFT073
acaacaugcuauuacgcc

SEQ ID NO: 2614043 - RNA, 23 nt, Escherichia coli CFT073
acaacaugcuauuacgccagccu

SEQ ID NO: 2614044 - RNA, 17 nt, Escherichia coli CFT073
acaacauugauaagcaa

SEQ ID NO: 2614045 - RNA, 17 nt, Escherichia coli CFT073
acaacauuuugcggcua

SEQ ID NO: 2614046 - RNA, 14 nt, Escherichia coli CFT073
acaaccaaaucuga

SEQ ID NO: 2614047 - RNA, 15 nt, Escherichia coli CFT073
acaacccaagcgcgc

SEQ ID NO: 2614048 - RNA, 18 nt, Escherichia coli CFT073
acaacccagacaaauaac

SEQ ID NO: 2614049 - RNA, 21 nt, Escherichia coli CFT073
acaacccagcggaugacccag

SEQ ID NO: 2614050 - RNA, 15 nt, Escherichia coli CFT073
acaaccgaggcucaa

SEQ ID NO: 2614051 - RNA, 20 nt, Escherichia coli CFT073
acaaccgccagaugcggcgu

SEQ ID NO: 2614052 - RNA, 18 nt, Escherichia coli CFT073
acaaccgccauccaggua

SEQ ID NO: 2614053 - RNA, 20 nt, Escherichia coli CFT073
acaaccgccggaugcggcgu

SEQ ID NO: 2614054 - RNA, 18 nt, Escherichia coli CFT073
acaaccgucagccacugg

SEQ ID NO: 2614055 - RNA, 21 nt, Escherichia coli CFT073
acaaccguucacgcauuugca

SEQ ID NO: 2614056 - RNA, 15 nt, Escherichia coli CFT073
acaaccucagcaguu

SEQ ID NO: 2614057 - RNA, 16 nt, Escherichia coli CFT073
acaaccuccuccggca

SEQ ID NO: 2614058 - RNA, 16 nt, Escherichia coli CFT073
acaacgauaauccagc

SEQ ID NO: 2614059 - RNA, 16 nt, Escherichia coli CFT073
acaacgccgauuaaua

SEQ ID NO: 2614060 - RNA, 13 nt, Escherichia coli CFT073
acaacggcaaaca

SEQ ID NO: 2614061 - RNA, 18 nt, Escherichia coli CFT073
acaacgggcaccgccgcc

SEQ ID NO: 2614062 - RNA, 19 nt, Escherichia coli CFT073
acaacgggcaccgccgcca

SEQ ID NO: 2614063 - RNA, 21 nt, Escherichia coli CFT073
acaacgggcaccgccgccacu

SEQ ID NO: 2614064 - RNA, 16 nt, Escherichia coli CFT073
acaacgucgccagucc

SEQ ID NO: 2614065 - RNA, 17 nt, Escherichia coli CFT073
acaacgucgccaguccu

SEQ ID NO: 2614066 - RNA, 21 nt, Escherichia coli CFT073
acaacucauuacuguaggcca

SEQ ID NO: 2614067 - RNA, 23 nt, Escherichia coli CFT073
acaacucgcuuaagccaucauca

SEQ ID NO: 2614068 - RNA, 20 nt, Escherichia coli CFT073
acaacuucuaauuuuuccag

SEQ ID NO: 2614069 - RNA, 18 nt, Escherichia coli CFT073
acaacuuuugcaggaagc

SEQ ID NO: 2614070 - RNA, 17 nt, Escherichia coli CFT073
acaagaaauaugaauau

SEQ ID NO: 2614071 - RNA, 13 nt, Escherichia coli CFT073
acaagaauauugc

SEQ ID NO: 2614072 - RNA, 16 nt, Escherichia coli CFT073
acaagaaucaugccaa

SEQ ID NO: 2614073 - RNA, 13 nt, Escherichia coli CFT073
acaagacaucacu

SEQ ID NO: 2614074 - RNA, 16 nt, Escherichia coli CFT073
acaagacugacaauca

SEQ ID NO: 2614075 - RNA, 17 nt, Escherichia coli CFT073
acaagacugacaaucaa

SEQ ID NO: 2614076 - RNA, 13 nt, Escherichia coli CFT073
acaagcacagggc

SEQ ID NO: 2614077 - RNA, 12 nt, Escherichia coli CFT073
acaagcagcugc

SEQ ID NO: 2614078 - RNA, 13 nt, Escherichia coli CFT073
acaagcagcugcc

SEQ ID NO: 2614079 - RNA, 14 nt, Escherichia coli CFT073
acaagccaaaucca

SEQ ID NO: 2614080 - RNA, 18 nt, Escherichia coli CFT073
acaagccacaucgccaua

SEQ ID NO: 2614081 - RNA, 19 nt, Escherichia coli CFT073
acaagcccaggccaucgcc

SEQ ID NO: 2614082 - RNA, 17 nt, Escherichia coli CFT073
acaagcccgccagacca

SEQ ID NO: 2614083 - RNA, 13 nt, Escherichia coli CFT073
acaagcggcaguu

SEQ ID NO: 2614084 - RNA, 13 nt, Escherichia coli CFT073
acaagcgucauau

SEQ ID NO: 2614085 - RNA, 21 nt, Escherichia coli CFT073
acaagcgucauauccgacacu

SEQ ID NO: 2614086 - RNA, 19 nt, Escherichia coli CFT073
acacauaacgccaauucau

SEQ ID NO: 2614087 - RNA, 14 nt, Escherichia coli CFT073
acacauacauguau

SEQ ID NO: 2614088 - RNA, 19 nt, Escherichia coli CFT073
acacauaccuggucugaac

SEQ ID NO: 2614089 - RNA, 19 nt, Escherichia coli CFT073
acacaucaacccagaaaca

SEQ ID NO: 2614090 - RNA, 19 nt, Escherichia coli CFT073
acacaucagaaacgcgaca

SEQ ID NO: 2614091 - RNA, 19 nt, Escherichia coli CFT073
acacaucagcaacgcugac

SEQ ID NO: 2614092 - RNA, 17 nt, Escherichia coli CFT073
acacauguguucccugu

SEQ ID NO: 2614093 - RNA, 20 nt, Escherichia coli CFT073
acacauuaucucaacacacg

SEQ ID NO: 2614094 - RNA, 15 nt, Escherichia coli CFT073
acaccaaaauaacga

SEQ ID NO: 2614095 - RNA, 15 nt, Escherichia coli CFT073
acaccaacaucacgu

SEQ ID NO: 2614096 - RNA, 14 nt, Escherichia coli CFT073
acaccaagcaccau

SEQ ID NO: 2614097 - RNA, 20 nt, Escherichia coli CFT073
acaccaagcaccauaaacac

SEQ ID NO: 2614098 - RNA, 17 nt, Escherichia coli CFT073
acaccaaggaacugugc

SEQ ID NO: 2614099 - RNA, 16 nt, Escherichia coli CFT073
acaccaauugugguac

SEQ ID NO: 2614100 - RNA, 14 nt, Escherichia coli CFT073
acaccacaaaucgg

SEQ ID NO: 2614101 - RNA, 18 nt, Escherichia coli CFT073
acaccaccacaagccacc

SEQ ID NO: 2614102 - RNA, 20 nt, Escherichia coli CFT073
acaccaccagcgccaccacg

SEQ ID NO: 2614103 - RNA, 14 nt, Escherichia coli CFT073
acaccacuugcugg

SEQ ID NO: 2614104 - RNA, 15 nt, Escherichia coli CFT073
acaccagaaccagca

SEQ ID NO: 2614105 - RNA, 16 nt, Escherichia coli CFT073
acaccagaaccagcaa

SEQ ID NO: 2614106 - RNA, 15 nt, Escherichia coli CFT073
acaccagaccagaca

SEQ ID NO: 2614107 - RNA, 17 nt, Escherichia coli CFT073
acaccagaccagacaau

SEQ ID NO: 2614108 - RNA, 17 nt, Escherichia coli CFT073
acaccagauccugccau

SEQ ID NO: 2614109 - RNA, 16 nt, Escherichia coli CFT073
acaccagcaauagcgc

SEQ ID NO: 2614110 - RNA, 17 nt, Escherichia coli CFT073
acaccagcacaucauca

SEQ ID NO: 2614111 - RNA, 12 nt, Escherichia coli CFT073
acaccagcagca

SEQ ID NO: 2614112 - RNA, 18 nt, Escherichia coli CFT073
acaccagcaguaaaccac

SEQ ID NO: 2614113 - RNA, 22 nt, Escherichia coli CFT073
acaccagcaguaaaccacccac

SEQ ID NO: 2614114 - RNA, 20 nt, Escherichia coli CFT073
acaccagccagacucagcaa

SEQ ID NO: 2614115 - RNA, 16 nt, Escherichia coli CFT073
acaccagugacgcagc

SEQ ID NO: 2614116 - RNA, 19 nt, Escherichia coli CFT073
acaccagugacgcagcgau

SEQ ID NO: 2614117 - RNA, 13 nt, Escherichia coli CFT073
acaccaguuucca

SEQ ID NO: 2614118 - RNA, 12 nt, Escherichia coli CFT073
acaccaucaaca

SEQ ID NO: 2614119 - RNA, 14 nt, Escherichia coli CFT073
acaccaucaacaaa

SEQ ID NO: 2614120 - RNA, 14 nt, Escherichia coli CFT073
acaccauccagcaa

SEQ ID NO: 2614121 - RNA, 20 nt, Escherichia coli CFT073
acaccauccagcaacaacag

SEQ ID NO: 2614122 - RNA, 20 nt, Escherichia coli CFT073
acaccaucgauuuacugcca

SEQ ID NO: 2614123 - RNA, 16 nt, Escherichia coli CFT073
acaccaucgcauacgg

SEQ ID NO: 2614124 - RNA, 13 nt, Escherichia coli CFT073
acaccaucuucaa

SEQ ID NO: 2614125 - RNA, 13 nt, Escherichia coli CFT073
acaccaugccaga

SEQ ID NO: 2614126 - RNA, 16 nt, Escherichia coli CFT073
acacccacagccaugg

SEQ ID NO: 2614127 - RNA, 12 nt, Escherichia coli CFT073
acacccacauca

SEQ ID NO: 2614128 - RNA, 21 nt, Escherichia coli CFT073
acaccccgcgccgcugagaaa

SEQ ID NO: 2614129 - RNA, 18 nt, Escherichia coli CFT073
acacccgacacggcucgc

SEQ ID NO: 2614130 - RNA, 14 nt, Escherichia coli CFT073
acacccgcaagacg

SEQ ID NO: 2614131 - RNA, 20 nt, Escherichia coli CFT073
acacccugauggcugauuac

SEQ ID NO: 2614132 - RNA, 17 nt, Escherichia coli CFT073
acaccgaaccgaaaugg

SEQ ID NO: 2614133 - RNA, 15 nt, Escherichia coli CFT073
acaccgauagaacca

SEQ ID NO: 2614134 - RNA, 18 nt, Escherichia coli CFT073
acaccgcaaacugcuguu

SEQ ID NO: 2614135 - RNA, 20 nt, Escherichia coli CFT073
acaccgcccagcgagcuggc

SEQ ID NO: 2614136 - RNA, 17 nt, Escherichia coli CFT073
acaccgccguugauuuc

SEQ ID NO: 2614137 - RNA, 20 nt, Escherichia coli CFT073
acaccgccguugauuucaca

SEQ ID NO: 2614138 - RNA, 18 nt, Escherichia coli CFT073
acaccgccuaccgccagu

SEQ ID NO: 2614139 - RNA, 18 nt, Escherichia coli CFT073
acaccgcgaagcagcucc

SEQ ID NO: 2614140 - RNA, 14 nt, Escherichia coli CFT073
acaccgcuuuaauc

SEQ ID NO: 2614141 - RNA, 16 nt, Escherichia coli CFT073
acaccggcaauaauua

SEQ ID NO: 2614142 - RNA, 14 nt, Escherichia coli CFT073
acaccggcagagau

SEQ ID NO: 2614143 - RNA, 17 nt, Escherichia coli CFT073
acaccgguauucuccug

SEQ ID NO: 2614144 - RNA, 15 nt, Escherichia coli CFT073
acaccguaauugcca

SEQ ID NO: 2614145 - RNA, 18 nt, Escherichia coli CFT073
acaccguaauugccagac

SEQ ID NO: 2614146 - RNA, 14 nt, Escherichia coli CFT073
acaccgucagccag

SEQ ID NO: 2614147 - RNA, 17 nt, Escherichia coli CFT073
acaccguccggcgggca

SEQ ID NO: 2614148 - RNA, 16 nt, Escherichia coli CFT073
acaccgucgcaauacc

SEQ ID NO: 2614149 - RNA, 20 nt, Escherichia coli CFT073
acaccucaacccgguugcuu

SEQ ID NO: 2614150 - RNA, 15 nt, Escherichia coli CFT073
acaccucguauucca

SEQ ID NO: 2614151 - RNA, 15 nt, Escherichia coli CFT073
acaccugacaauccg

SEQ ID NO: 2614152 - RNA, 17 nt, Escherichia coli CFT073
acaccugcuccgccaga

SEQ ID NO: 2614153 - RNA, 13 nt, Escherichia coli CFT073
acaccugggcaau

SEQ ID NO: 2614154 - RNA, 22 nt, Escherichia coli CFT073
acaccugggcaauggugaacug

SEQ ID NO: 2614155 - RNA, 13 nt, Escherichia coli CFT073
acaccuuaaggcu

SEQ ID NO: 2614156 - RNA, 19 nt, Escherichia coli CFT073
acaccuucagcgaagccca

SEQ ID NO: 2614157 - RNA, 20 nt, Escherichia coli CFT073
acaccuucagcgaagcccac

SEQ ID NO: 2614158 - RNA, 19 nt, Escherichia coli CFT073
acaccuucguccagcauca

SEQ ID NO: 2614159 - RNA, 24 nt, Escherichia coli CFT073
acaccuucuccggccuacaaaaca

SEQ ID NO: 2614160 - RNA, 15 nt, Escherichia coli CFT073
acaccuuucacgccg

SEQ ID NO: 2614161 - RNA, 20 nt, Escherichia coli CFT073
acaccuuuccccggcagcau

SEQ ID NO: 2614162 - RNA, 23 nt, Escherichia coli CFT073
acaccuuuccccggcagcaucag

SEQ ID NO: 2614163 - RNA, 23 nt, Escherichia coli CFT073
acacgaaucaggcggcucaccug

SEQ ID NO: 2614164 - RNA, 12 nt, Escherichia coli CFT073
acacgacgccag

SEQ ID NO: 2614165 - RNA, 13 nt, Escherichia coli CFT073
acacgacgccagc

SEQ ID NO: 2614166 - RNA, 14 nt, Escherichia coli CFT073
acacgacgccagcc

SEQ ID NO: 2614167 - RNA, 19 nt, Escherichia coli CFT073
acacgacgcgccagcagcg

SEQ ID NO: 2614168 - RNA, 23 nt, Escherichia coli CFT073
acacgacgcgccagcagcgcaaa

SEQ ID NO: 2614169 - RNA, 13 nt, Escherichia coli CFT073
acacgaucagcca

SEQ ID NO: 2614170 - RNA, 17 nt, Escherichia coli CFT073
acacgcagaccaaccgu

SEQ ID NO: 2614171 - RNA, 17 nt, Escherichia coli CFT073
acacgcaucacgcgcau

SEQ ID NO: 2614172 - RNA, 13 nt, Escherichia coli CFT073
acacgccagcguu

SEQ ID NO: 2614173 - RNA, 20 nt, Escherichia coli CFT073
acacgccgccagaccaauag

SEQ ID NO: 2614174 - RNA, 14 nt, Escherichia coli CFT073
acacgcgcccagcc

SEQ ID NO: 2614175 - RNA, 16 nt, Escherichia coli CFT073
acacgcggagccaguu

SEQ ID NO: 2614176 - RNA, 14 nt, Escherichia coli CFT073
acacgcucuggcag

SEQ ID NO: 2614177 - RNA, 20 nt, Escherichia coli CFT073
acacgcucuggcaggcuuca

SEQ ID NO: 2614178 - RNA, 21 nt, Escherichia coli CFT073
acacgcugaagaucuucaguc

SEQ ID NO: 2614179 - RNA, 20 nt, Escherichia coli CFT073
acacgcugcaaggcaacgca

SEQ ID NO: 2614180 - RNA, 17 nt, Escherichia coli CFT073
acacggcgaacauuccc

SEQ ID NO: 2614181 - RNA, 12 nt, Escherichia coli CFT073
acacggcucgcc

SEQ ID NO: 2614182 - RNA, 17 nt, Escherichia coli CFT073
acacgggaaaccaacuc

SEQ ID NO: 2614183 - RNA, 22 nt, Escherichia coli CFT073
acacggugcgaugcaaaaucag

SEQ ID NO: 2614184 - RNA, 14 nt, Escherichia coli CFT073
acacuaauccguaa

SEQ ID NO: 2614185 - RNA, 14 nt, Escherichia coli CFT073
acacuacaaauuua

SEQ ID NO: 2614186 - RNA, 21 nt, Escherichia coli CFT073
acacuacaccccagcguaaua

SEQ ID NO: 2614187 - RNA, 17 nt, Escherichia coli CFT073
acacuacccgcgccaau

SEQ ID NO: 2614188 - RNA, 18 nt, Escherichia coli CFT073
acacuacucguaauaauu

SEQ ID NO: 2614189 - RNA, 19 nt, Escherichia coli CFT073
acacuacucguaauaauua

SEQ ID NO: 2614190 - RNA, 22 nt, Escherichia coli CFT073
acacuauaucucaaucaaaaga

SEQ ID NO: 2614191 - RNA, 14 nt, Escherichia coli CFT073
acacucacgcauac

SEQ ID NO: 2614192 - RNA, 19 nt, Escherichia coli CFT073
acacucgugcgucgcaucc

SEQ ID NO: 2614193 - RNA, 16 nt, Escherichia coli CFT073
acacucguuucaaauu

SEQ ID NO: 2614194 - RNA, 17 nt, Escherichia coli CFT073
acacucguuucaaauuu

SEQ ID NO: 2614195 - RNA, 12 nt, Escherichia coli CFT073
acagacaaacag

SEQ ID NO: 2614196 - RNA, 14 nt, Escherichia coli CFT073
acagacaaacagcu

SEQ ID NO: 2614197 - RNA, 19 nt, Escherichia coli CFT073
acagaccacauuccaggcc

SEQ ID NO: 2614198 - RNA, 17 nt, Escherichia coli CFT073
acagaccagcaaagugc

SEQ ID NO: 2614199 - RNA, 22 nt, Escherichia coli CFT073
acagacgcuggggauuuucugc

SEQ ID NO: 2614200 - RNA, 15 nt, Escherichia coli CFT073
acagacucaaaccaa

SEQ ID NO: 2614201 - RNA, 17 nt, Escherichia coli CFT073
acagagaacacccagaa

SEQ ID NO: 2614202 - RNA, 20 nt, Escherichia coli CFT073
acagagaacaucaauccaaa

SEQ ID NO: 2614203 - RNA, 22 nt, Escherichia coli CFT073
acagaguauuuccagcucaacc

SEQ ID NO: 2614204 - RNA, 22 nt, Escherichia coli CFT073
acagagugaauggugaaguuau

SEQ ID NO: 2614205 - RNA, 13 nt, Escherichia coli CFT073
acagagugguggg

SEQ ID NO: 2614206 - RNA, 15 nt, Escherichia coli CFT073
acagauaaaucaaua

SEQ ID NO: 2614207 - RNA, 15 nt, Escherichia coli CFT073
acagauaauaaaaaa

SEQ ID NO: 2614208 - RNA, 20 nt, Escherichia coli CFT073
acagauaggcaucagcaauu

SEQ ID NO: 2614209 - RNA, 12 nt, Escherichia coli CFT073
acagaugacgau

SEQ ID NO: 2614210 - RNA, 22 nt, Escherichia coli CFT073
acagaugcgacggcaccacauu

SEQ ID NO: 2614211 - RNA, 19 nt, Escherichia coli CFT073
acagauuagcuggccugcu

SEQ ID NO: 2614212 - RNA, 21 nt, Escherichia coli CFT073
acagauucaauacuucagcga

SEQ ID NO: 2614213 - RNA, 20 nt, Escherichia coli CFT073
acagauucagcgcacuuuca

SEQ ID NO: 2614214 - RNA, 17 nt, Escherichia coli CFT073
acagauugagaauaaug

SEQ ID NO: 2614215 - RNA, 23 nt, Escherichia coli CFT073
acagauuuugcaggccugauaag

SEQ ID NO: 2614216 - RNA, 12 nt, Escherichia coli CFT073
acagcaaaacgc

SEQ ID NO: 2614217 - RNA, 15 nt, Escherichia coli CFT073
acagcaacucagcca

SEQ ID NO: 2614218 - RNA, 14 nt, Escherichia coli CFT073
acagcaagcagccg

SEQ ID NO: 2614219 - RNA, 21 nt, Escherichia coli CFT073
acagcaagcagccgauaauau

SEQ ID NO: 2614220 - RNA, 15 nt, Escherichia coli CFT073
acagcaauaauaaua

SEQ ID NO: 2614221 - RNA, 18 nt, Escherichia coli CFT073
acagcaauacguuucaua

SEQ ID NO: 2614222 - RNA, 16 nt, Escherichia coli CFT073
acagcaauggaaaaag

SEQ ID NO: 2614223 - RNA, 23 nt, Escherichia coli CFT073
acagcaccauccgcccacaccag

SEQ ID NO: 2614224 - RNA, 14 nt, Escherichia coli CFT073
acagcaccgcccgu

SEQ ID NO: 2614225 - RNA, 20 nt, Escherichia coli CFT073
acagcaccguuaauccacgc

SEQ ID NO: 2614226 - RNA, 21 nt, Escherichia coli CFT073
acagcaccguuaauccacgcu

SEQ ID NO: 2614227 - RNA, 18 nt, Escherichia coli CFT073
acagcacggcagcaacag

SEQ ID NO: 2614228 - RNA, 19 nt, Escherichia coli CFT073
acagcacguuacccgccgu

SEQ ID NO: 2614229 - RNA, 16 nt, Escherichia coli CFT073
acagcagaacgaccag

SEQ ID NO: 2614230 - RNA, 19 nt, Escherichia coli CFT073
acagcagaacgaccagcgc

SEQ ID NO: 2614231 - RNA, 23 nt, Escherichia coli CFT073
acagcagaacgaccagcgccgca

SEQ ID NO: 2614232 - RNA, 14 nt, Escherichia coli CFT073
acagcagagcaugg

SEQ ID NO: 2614233 - RNA, 14 nt, Escherichia coli CFT073
acagcagauggcag

SEQ ID NO: 2614234 - RNA, 19 nt, Escherichia coli CFT073
acagcagccacaccaauca

SEQ ID NO: 2614235 - RNA, 13 nt, Escherichia coli CFT073
acagcaggaaaau

SEQ ID NO: 2614236 - RNA, 14 nt, Escherichia coli CFT073
acagcauacggcug

SEQ ID NO: 2614237 - RNA, 19 nt, Escherichia coli CFT073
acagccaaaucaucaguac

SEQ ID NO: 2614238 - RNA, 19 nt, Escherichia coli CFT073
acagccaaucauaaacgcc

SEQ ID NO: 2614239 - RNA, 22 nt, Escherichia coli CFT073
acagccacacaccgcaaacugc

SEQ ID NO: 2614240 - RNA, 22 nt, Escherichia coli CFT073
acagccacaccuucuugcguca

SEQ ID NO: 2614241 - RNA, 18 nt, Escherichia coli CFT073
acagccagaagcccggau

SEQ ID NO: 2614242 - RNA, 17 nt, Escherichia coli CFT073
acagccagaaucaaggu

SEQ ID NO: 2614243 - RNA, 23 nt, Escherichia coli CFT073
acagccagaaugaggcaucauua

SEQ ID NO: 2614244 - RNA, 17 nt, Escherichia coli CFT073
acagccagccagcacca

SEQ ID NO: 2614245 - RNA, 15 nt, Escherichia coli CFT073
acagccagccuccaa

SEQ ID NO: 2614246 - RNA, 14 nt, Escherichia coli CFT073
acagccagcgcagg

SEQ ID NO: 2614247 - RNA, 19 nt, Escherichia coli CFT073
acagccauaaagaaaucac

SEQ ID NO: 2614248 - RNA, 15 nt, Escherichia coli CFT073
acagccccaccagca

SEQ ID NO: 2614249 - RNA, 16 nt, Escherichia coli CFT073
acagccccaccagcaa

SEQ ID NO: 2614250 - RNA, 20 nt, Escherichia coli CFT073
acagcccgccaaugccgcgc

SEQ ID NO: 2614251 - RNA, 18 nt, Escherichia coli CFT073
acagcccgccggaaagca

SEQ ID NO: 2614252 - RNA, 23 nt, Escherichia coli CFT073
acagccgaagccguuggucauca

SEQ ID NO: 2614253 - RNA, 15 nt, Escherichia coli CFT073
acagucgcucggcga

SEQ ID NO: 2614254 - RNA, 21 nt, Escherichia coli CFT073
acagucuggcguuuucuuuuu

SEQ ID NO: 2614255 - RNA, 18 nt, Escherichia coli CFT073
acagugaccaucuuccag

SEQ ID NO: 2614256 - RNA, 15 nt, Escherichia coli CFT073
acagugacccgcagc

SEQ ID NO: 2614257 - RNA, 19 nt, Escherichia coli CFT073
acagugacccgcagccagc

SEQ ID NO: 2614258 - RNA, 15 nt, Escherichia coli CFT073
acagugccgaugccg

SEQ ID NO: 2614259 - RNA, 22 nt, Escherichia coli CFT073
acagugccgcgcauagcaccac

SEQ ID NO: 2614260 - RNA, 20 nt, Escherichia coli CFT073
acagugccuggcgaaaggag

SEQ ID NO: 2614261 - RNA, 19 nt, Escherichia coli CFT073
acaguggcgacaagcauaa

SEQ ID NO: 2614262 - RNA, 21 nt, Escherichia coli CFT073
acaguggcgacaagcauaaca

SEQ ID NO: 2614263 - RNA, 23 nt, Escherichia coli CFT073
acaguguuuguugaaacuuucca

SEQ ID NO: 2614264 - RNA, 12 nt, Escherichia coli CFT073
acaguuaucaaa

SEQ ID NO: 2614265 - RNA, 21 nt, Escherichia coli CFT073
acaguuccgcaaagcccauca

SEQ ID NO: 2614266 - RNA, 16 nt, Escherichia coli CFT073
acaguucuucaaaaau

SEQ ID NO: 2614267 - RNA, 17 nt, Escherichia coli CFT073
acaguucuucaaaaaua

SEQ ID NO: 2614268 - RNA, 19 nt, Escherichia coli CFT073
acaguucuucaaaaauaau

SEQ ID NO: 2614269 - RNA, 18 nt, Escherichia coli CFT073
acaguugcaguuauuaua

SEQ ID NO: 2614270 - RNA, 14 nt, Escherichia coli CFT073
acaguugcugauaa

SEQ ID NO: 2614271 - RNA, 22 nt, Escherichia coli CFT073
acaguugcugcgugaccgccag

SEQ ID NO: 2614272 - RNA, 13 nt, Escherichia coli CFT073
acaguuguaaagu

SEQ ID NO: 2614273 - RNA, 16 nt, Escherichia coli CFT073
acaguuugaucaguuc

SEQ ID NO: 2614274 - RNA, 20 nt, Escherichia coli CFT073
acaguuuuacugcagccagc

SEQ ID NO: 2614275 - RNA, 21 nt, Escherichia coli CFT073
acaguuuucgcaccgcguuua

SEQ ID NO: 2614276 - RNA, 21 nt, Escherichia coli CFT073
acaguuuugagugauuccguu

SEQ ID NO: 2614277 - RNA, 23 nt, Escherichia coli CFT073
acauaaaaaagccgggguaauuc

SEQ ID NO: 2614278 - RNA, 20 nt, Escherichia coli CFT073
acauaaauggguuuuuuguu

SEQ ID NO: 2614279 - RNA, 13 nt, Escherichia coli CFT073
acauaacagccau

SEQ ID NO: 2614280 - RNA, 15 nt, Escherichia coli CFT073
acauaaccaaucauc

SEQ ID NO: 2614281 - RNA, 15 nt, Escherichia coli CFT073
acauaacccagcgau

SEQ ID NO: 2614282 - RNA, 21 nt, Escherichia coli CFT073
acauaagcaccgaacaagaaa

SEQ ID NO: 2614283 - RNA, 20 nt, Escherichia coli CFT073
acauaaucaaccauuaaacg

SEQ ID NO: 2614284 - RNA, 20 nt, Escherichia coli CFT073
acauaaucgaaaacaucaug

SEQ ID NO: 2614285 - RNA, 23 nt, Escherichia coli CFT073
acauaaugccgacaucaaacagg

SEQ ID NO: 2614286 - RNA, 22 nt, Escherichia coli CFT073
acauaauugaccagaucuucau

SEQ ID NO: 2614287 - RNA, 21 nt, Escherichia coli CFT073
acauaauuuuucuuuaacauc

SEQ ID NO: 2614288 - RNA, 20 nt, Escherichia coli CFT073
acauacagcguuuugccauc

SEQ ID NO: 2614289 - RNA, 20 nt, Escherichia coli CFT073
acauacaggggaucgacgcc

SEQ ID NO: 2614290 - RNA, 15 nt, Escherichia coli CFT073
acauacauaauaauc

SEQ ID NO: 2614291 - RNA, 23 nt, Escherichia coli CFT073
acauacauguauaaaaagaagau

SEQ ID NO: 2614292 - RNA, 19 nt, Escherichia coli CFT073
acauaccacggcauuuccg

SEQ ID NO: 2614293 - RNA, 13 nt, Escherichia coli CFT073
acauaccagcagg

SEQ ID NO: 2614294 - RNA, 21 nt, Escherichia coli CFT073
acauacccacgaaaucuucca

SEQ ID NO: 2614295 - RNA, 23 nt, Escherichia coli CFT073
acauaccuaaaagcacgccagac

SEQ ID NO: 2614296 - RNA, 22 nt, Escherichia coli CFT073
acauacggcauaauaccgcgag

SEQ ID NO: 2614297 - RNA, 16 nt, Escherichia coli CFT073
acauacggcauuuucc

SEQ ID NO: 2614298 - RNA, 18 nt, Escherichia coli CFT073
acauacggcgguucuuuc

SEQ ID NO: 2614299 - RNA, 21 nt, Escherichia coli CFT073
acauacuuaaauaaugcuucu

SEQ ID NO: 2614300 - RNA, 22 nt, Escherichia coli CFT073
acauagcaaccggaucgauaaa

SEQ ID NO: 2614301 - RNA, 13 nt, Escherichia coli CFT073
acauagccacuca

SEQ ID NO: 2614302 - RNA, 19 nt, Escherichia coli CFT073
acauagccacucaccgccg

SEQ ID NO: 2614303 - RNA, 14 nt, Escherichia coli CFT073
acauagccaucccu

SEQ ID NO: 2614304 - RNA, 16 nt, Escherichia coli CFT073
acauagccgaaaaugc

SEQ ID NO: 2614305 - RNA, 16 nt, Escherichia coli CFT073
acauagcgugacacca

SEQ ID NO: 2614306 - RNA, 21 nt, Escherichia coli CFT073
acauagcgugacaccagcaca

SEQ ID NO: 2614307 - RNA, 14 nt, Escherichia coli CFT073
acauaggcgcucac

SEQ ID NO: 2614308 - RNA, 19 nt, Escherichia coli CFT073
acauagggaaacuccagcc

SEQ ID NO: 2614309 - RNA, 14 nt, Escherichia coli CFT073
acauauaucgaaaa

SEQ ID NO: 2614310 - RNA, 13 nt, Escherichia coli CFT073
acauaucaugaaa

SEQ ID NO: 2614311 - RNA, 18 nt, Escherichia coli CFT073
acauauccaucguugaau

SEQ ID NO: 2614312 - RNA, 17 nt, Escherichia coli CFT073
acauaucccaccagcgc

SEQ ID NO: 2614313 - RNA, 20 nt, Escherichia coli CFT073
acauauguuuaaccggcagc

SEQ ID NO: 2614314 - RNA, 13 nt, Escherichia coli CFT073
acauauucauccc

SEQ ID NO: 2614315 - RNA, 16 nt, Escherichia coli CFT073
acauauucauuacuua

SEQ ID NO: 2614316 - RNA, 22 nt, Escherichia coli CFT073
acauauugcaccagaucuucca

SEQ ID NO: 2614317 - RNA, 14 nt, Escherichia coli CFT073
acauauugcagcuu

SEQ ID NO: 2614318 - RNA, 18 nt, Escherichia coli CFT073
acauauugcagcuucuuc

SEQ ID NO: 2614319 - RNA, 19 nt, Escherichia coli CFT073
acauauuuuuguugaaaua

SEQ ID NO: 2614320 - RNA, 18 nt, Escherichia coli CFT073
acaucaaaaggugccaug

SEQ ID NO: 2614321 - RNA, 14 nt, Escherichia coli CFT073
acaucaaaauuacc

SEQ ID NO: 2614322 - RNA, 13 nt, Escherichia coli CFT073
acaucaaacaggc

SEQ ID NO: 2614323 - RNA, 18 nt, Escherichia coli CFT073
acaucaaauacagcuuaa

SEQ ID NO: 2614324 - RNA, 13 nt, Escherichia coli CFT073
acaucaacagacc

SEQ ID NO: 2614325 - RNA, 13 nt, Escherichia coli CFT073
acaucaacccaga

SEQ ID NO: 2614326 - RNA, 14 nt, Escherichia coli CFT073
acaucaacccgccc

SEQ ID NO: 2614327 - RNA, 18 nt, Escherichia coli CFT073
acaucaacgaugccuuau

SEQ ID NO: 2614328 - RNA, 15 nt, Escherichia coli CFT073
acaucaagucagaug

SEQ ID NO: 2614329 - RNA, 18 nt, Escherichia coli CFT073
acaucaauuacaccauca

SEQ ID NO: 2614330 - RNA, 22 nt, Escherichia coli CFT073
acaucaauuacaccaucacgcc

SEQ ID NO: 2614331 - RNA, 23 nt, Escherichia coli CFT073
acaucaauucagaaauaaucacc

SEQ ID NO: 2614332 - RNA, 12 nt, Escherichia coli CFT073
acaucacaccau

SEQ ID NO: 2614333 - RNA, 19 nt, Escherichia coli CFT073
acaucacaccauccagcaa

SEQ ID NO: 2614334 - RNA, 22 nt, Escherichia coli CFT073
acaucacaccauccagcaacaa

SEQ ID NO: 2614335 - RNA, 19 nt, Escherichia coli CFT073
acaucacauauucgccgcc

SEQ ID NO: 2614336 - RNA, 13 nt, Escherichia coli CFT073
acaucacaugcug

SEQ ID NO: 2614337 - RNA, 13 nt, Escherichia coli CFT073
acaucaccaacac

SEQ ID NO: 2614338 - RNA, 15 nt, Escherichia coli CFT073
acaucaccaaugaca

SEQ ID NO: 2614339 - RNA, 21 nt, Escherichia coli CFT073
acaucaccaaugacagcccca

SEQ ID NO: 2614340 - RNA, 21 nt, Escherichia coli CFT073
acaucaccguucagcuugcgu

SEQ ID NO: 2614341 - RNA, 19 nt, Escherichia coli CFT073
acaucaccuuguuucagcg

SEQ ID NO: 2614342 - RNA, 19 nt, Escherichia coli CFT073
acaucacgacgaccaccga

SEQ ID NO: 2614343 - RNA, 14 nt, Escherichia coli CFT073
acaucacgcagcug

SEQ ID NO: 2614344 - RNA, 19 nt, Escherichia coli CFT073
acaucacucacgacacaua

SEQ ID NO: 2614345 - RNA, 18 nt, Escherichia coli CFT073
acaucagauaaucgccau

SEQ ID NO: 2614346 - RNA, 19 nt, Escherichia coli CFT073
acaucagcggcaaaacggu

SEQ ID NO: 2614347 - RNA, 12 nt, Escherichia coli CFT073
acaucaggcuga

SEQ ID NO: 2614348 - RNA, 17 nt, Escherichia coli CFT073
acaucaucacgcagagc

SEQ ID NO: 2614349 - RNA, 13 nt, Escherichia coli CFT073
acaucaucagaaa

SEQ ID NO: 2614350 - RNA, 14 nt, Escherichia coli CFT073
acaucaucaucgcg

SEQ ID NO: 2614351 - RNA, 13 nt, Escherichia coli CFT073
acaucaucgcccc

SEQ ID NO: 2614352 - RNA, 21 nt, Escherichia coli CFT073
acaucaugccggccagcgcca

SEQ ID NO: 2614353 - RNA, 21 nt, Escherichia coli CFT073
acaucauuaacgccucaagua

SEQ ID NO: 2614354 - RNA, 20 nt, Escherichia coli CFT073
acaucauucaaugcucaccc

SEQ ID NO: 2614355 - RNA, 22 nt, Escherichia coli CFT073
acaucauugagacguuugagac

SEQ ID NO: 2614356 - RNA, 16 nt, Escherichia coli CFT073
acaucauugccgccug

SEQ ID NO: 2614357 - RNA, 23 nt, Escherichia coli CFT073
acauccaccagcgccucuuccag

SEQ ID NO: 2614358 - RNA, 13 nt, Escherichia coli CFT073
acauccagaucac

SEQ ID NO: 2614359 - RNA, 12 nt, Escherichia coli CFT073
acauccagcggc

SEQ ID NO: 2614360 - RNA, 22 nt, Escherichia coli CFT073
acauccagcguaauaggcgcga

SEQ ID NO: 2614361 - RNA, 14 nt, Escherichia coli CFT073
acauucaucauuuc

SEQ ID NO: 2614362 - RNA, 19 nt, Escherichia coli CFT073
acauuccagaugcgccagu

SEQ ID NO: 2614363 - RNA, 23 nt, Escherichia coli CFT073
acauuccaggcccgcguggauaa

SEQ ID NO: 2614364 - RNA, 12 nt, Escherichia coli CFT073
acauucccauca

SEQ ID NO: 2614365 - RNA, 14 nt, Escherichia coli CFT073
acauucccugcagu

SEQ ID NO: 2614366 - RNA, 18 nt, Escherichia coli CFT073
acauucggcguuaacaau

SEQ ID NO: 2614367 - RNA, 11 nt, Escherichia coli CFT073
acauucguugc

SEQ ID NO: 2614368 - RNA, 23 nt, Escherichia coli CFT073
acauugaccagugcagacucacc

SEQ ID NO: 2614369 - RNA, 14 nt, Escherichia coli CFT073
acauugagcaaaga

SEQ ID NO: 2614370 - RNA, 16 nt, Escherichia coli CFT073
acauugaugcgccaua

SEQ ID NO: 2614371 - RNA, 19 nt, Escherichia coli CFT073
acauugccaccaccagcgu

SEQ ID NO: 2614372 - RNA, 20 nt, Escherichia coli CFT073
acauugccaccaccagcgua

SEQ ID NO: 2614373 - RNA, 19 nt, Escherichia coli CFT073
acauugccaguuuuaaauu

SEQ ID NO: 2614374 - RNA, 19 nt, Escherichia coli CFT073
acauugccgaauggcugca

SEQ ID NO: 2614375 - RNA, 22 nt, Escherichia coli CFT073
acauugccgaauggcugcacuu

SEQ ID NO: 2614376 - RNA, 23 nt, Escherichia coli CFT073
acauugccggaagcgccaccagc

SEQ ID NO: 2614377 - RNA, 20 nt, Escherichia coli CFT073
acauugcgccucaccggaua

SEQ ID NO: 2614378 - RNA, 21 nt, Escherichia coli CFT073
acauugcgccucaccggauaa

SEQ ID NO: 2614379 - RNA, 15 nt, Escherichia coli CFT073
acauugcugcacauc

SEQ ID NO: 2614380 - RNA, 12 nt, Escherichia coli CFT073
acauugcugcug

SEQ ID NO: 2614381 - RNA, 13 nt, Escherichia coli CFT073
acauugcugcuga

SEQ ID NO: 2614382 - RNA, 19 nt, Escherichia coli CFT073
acauugugguucguugaua

SEQ ID NO: 2614383 - RNA, 22 nt, Escherichia coli CFT073
acauuguuaaagcccugcucgc

SEQ ID NO: 2614384 - RNA, 19 nt, Escherichia coli CFT073
acauuuaacccuucaagaa

SEQ ID NO: 2614385 - RNA, 22 nt, Escherichia coli CFT073
acauuuauuucaacgacauaug

SEQ ID NO: 2614386 - RNA, 19 nt, Escherichia coli CFT073
acauuucacguucacguaa

SEQ ID NO: 2614387 - RNA, 15 nt, Escherichia coli CFT073
acauuucccccuucc

SEQ ID NO: 2614388 - RNA, 11 nt, Escherichia coli CFT073
acauuucucug

SEQ ID NO: 2614389 - RNA, 14 nt, Escherichia coli CFT073
acauuucugcugcc

SEQ ID NO: 2614390 - RNA, 14 nt, Escherichia coli CFT073
acauuucuucuuuc

SEQ ID NO: 2614391 - RNA, 20 nt, Escherichia coli CFT073
acauuucuucuuucagguga

SEQ ID NO: 2614392 - RNA, 17 nt, Escherichia coli CFT073
acauuugcguggcgcgc

SEQ ID NO: 2614393 - RNA, 21 nt, Escherichia coli CFT073
acauuuuaaacaucaggcaaa

SEQ ID NO: 2614394 - RNA, 15 nt, Escherichia coli CFT073
acauuuuccaucacg

SEQ ID NO: 2614395 - RNA, 15 nt, Escherichia coli CFT073
accaaaacagcgaca

SEQ ID NO: 2614396 - RNA, 17 nt, Escherichia coli CFT073
accaaaacagcgacacc

SEQ ID NO: 2614397 - RNA, 12 nt, Escherichia coli CFT073
accaaaacggac

SEQ ID NO: 2614398 - RNA, 19 nt, Escherichia coli CFT073
accaaaauaacgaucauca

SEQ ID NO: 2614399 - RNA, 12 nt, Escherichia coli CFT073
accaaaauacca

SEQ ID NO: 2614400 - RNA, 12 nt, Escherichia coli CFT073
accaaaaucauc

SEQ ID NO: 2614401 - RNA, 16 nt, Escherichia coli CFT073
accaaaaucaucaauu

SEQ ID NO: 2614402 - RNA, 14 nt, Escherichia coli CFT073
accaaacagcgcca

SEQ ID NO: 2614403 - RNA, 16 nt, Escherichia coli CFT073
accaaacagcgccaga

SEQ ID NO: 2614404 - RNA, 11 nt, Escherichia coli CFT073
accaaaccuca

SEQ ID NO: 2614405 - RNA, 14 nt, Escherichia coli CFT073
accaaacugauuua

SEQ ID NO: 2614406 - RNA, 12 nt, Escherichia coli CFT073
accaaacugcuc

SEQ ID NO: 2614407 - RNA, 17 nt, Escherichia coli CFT073
accaaagaaguucucca

SEQ ID NO: 2614408 - RNA, 15 nt, Escherichia coli CFT073
accaaagaaugacac

SEQ ID NO: 2614409 - RNA, 21 nt, Escherichia coli CFT073
accaaagcgguaguuaagauu

SEQ ID NO: 2614410 - RNA, 13 nt, Escherichia coli CFT073
accaaaguagaua

SEQ ID NO: 2614411 - RNA, 19 nt, Escherichia coli CFT073
accaaaguuaaucagcgcc

SEQ ID NO: 2614412 - RNA, 19 nt, Escherichia coli CFT073
accaaauaaacgaaucugc

SEQ ID NO: 2614413 - RNA, 13 nt, Escherichia coli CFT073
accaaauacacgc

SEQ ID NO: 2614414 - RNA, 15 nt, Escherichia coli CFT073
accaaaucgaaauga

SEQ ID NO: 2614415 - RNA, 16 nt, Escherichia coli CFT073
accaaaucgaaaugau

SEQ ID NO: 2614416 - RNA, 21 nt, Escherichia coli CFT073
accaaaucugauuaauauuga

SEQ ID NO: 2614417 - RNA, 20 nt, Escherichia coli CFT073
accaaaugacucguuauugu

SEQ ID NO: 2614418 - RNA, 14 nt, Escherichia coli CFT073
accaaaugcagcaa

SEQ ID NO: 2614419 - RNA, 15 nt, Escherichia coli CFT073
accaaaugcagcaac

SEQ ID NO: 2614420 - RNA, 11 nt, Escherichia coli CFT073
accaaaugccg

SEQ ID NO: 2614421 - RNA, 14 nt, Escherichia coli CFT073
accaacaagcaccg

SEQ ID NO: 2614422 - RNA, 16 nt, Escherichia coli CFT073
accaacaauacaaaau

SEQ ID NO: 2614423 - RNA, 18 nt, Escherichia coli CFT073
accaacaccuaccggcug

SEQ ID NO: 2614424 - RNA, 19 nt, Escherichia coli CFT073
accaacaccuaccggcugg

SEQ ID NO: 2614425 - RNA, 14 nt, Escherichia coli CFT073
accaacauauugcu

SEQ ID NO: 2614426 - RNA, 13 nt, Escherichia coli CFT073
accaaccacugcu

SEQ ID NO: 2614427 - RNA, 14 nt, Escherichia coli CFT073
accaaccaucaucc

SEQ ID NO: 2614428 - RNA, 15 nt, Escherichia coli CFT073
accaaccaucauccc

SEQ ID NO: 2614429 - RNA, 20 nt, Escherichia coli CFT073
accaacccaacuuauuguuu

SEQ ID NO: 2614430 - RNA, 20 nt, Escherichia coli CFT073
accaacgaugaagagauaaa

SEQ ID NO: 2614431 - RNA, 12 nt, Escherichia coli CFT073
accaacgcaccc

SEQ ID NO: 2614432 - RNA, 13 nt, Escherichia coli CFT073
accaacgcacccg

SEQ ID NO: 2614433 - RNA, 13 nt, Escherichia coli CFT073
accaacgcagaaa

SEQ ID NO: 2614434 - RNA, 18 nt, Escherichia coli CFT073
accaacgccccguaaauc

SEQ ID NO: 2614435 - RNA, 16 nt, Escherichia coli CFT073
accaacgcuaaauacu

SEQ ID NO: 2614436 - RNA, 18 nt, Escherichia coli CFT073
accaacugauccugacaa

SEQ ID NO: 2614437 - RNA, 19 nt, Escherichia coli CFT073
accaacugugccgcgacca

SEQ ID NO: 2614438 - RNA, 22 nt, Escherichia coli CFT073
accaacugugccgcgaccaccu

SEQ ID NO: 2614439 - RNA, 21 nt, Escherichia coli CFT073
accaacuuucacgcgcugacc

SEQ ID NO: 2614440 - RNA, 14 nt, Escherichia coli CFT073
accaagaccaaucc

SEQ ID NO: 2614441 - RNA, 14 nt, Escherichia coli CFT073
accaagacuauuaa

SEQ ID NO: 2614442 - RNA, 22 nt, Escherichia coli CFT073
accaagcacggcgcgacucagc

SEQ ID NO: 2614443 - RNA, 14 nt, Escherichia coli CFT073
accaagccaagcca

SEQ ID NO: 2614444 - RNA, 16 nt, Escherichia coli CFT073
accaagccaagccaga

SEQ ID NO: 2614445 - RNA, 20 nt, Escherichia coli CFT073
accaagccaagccagagcag

SEQ ID NO: 2614446 - RNA, 16 nt, Escherichia coli CFT073
accaauaaacgccagg

SEQ ID NO: 2614447 - RNA, 18 nt, Escherichia coli CFT073
accaauaaguaagcauua

SEQ ID NO: 2614448 - RNA, 13 nt, Escherichia coli CFT073
accaauaaucaau

SEQ ID NO: 2614449 - RNA, 12 nt, Escherichia coli CFT073
accaauaauccc

SEQ ID NO: 2614450 - RNA, 16 nt, Escherichia coli CFT073
accaauaucaaucuuc

SEQ ID NO: 2614451 - RNA, 22 nt, Escherichia coli CFT073
accaaucacacaaccaugcagg

SEQ ID NO: 2614452 - RNA, 20 nt, Escherichia coli CFT073
accaaucagauugaucauca

SEQ ID NO: 2614453 - RNA, 17 nt, Escherichia coli CFT073
accaaucggcagaacgg

SEQ ID NO: 2614454 - RNA, 17 nt, Escherichia coli CFT073
accaaucucccagccgg

SEQ ID NO: 2614455 - RNA, 17 nt, Escherichia coli CFT073
accaaucuucaacacuu

SEQ ID NO: 2614456 - RNA, 12 nt, Escherichia coli CFT073
accaaugaauuu

SEQ ID NO: 2614457 - RNA, 14 nt, Escherichia coli CFT073
accaaugacagccc

SEQ ID NO: 2614458 - RNA, 21 nt, Escherichia coli CFT073
accaaugacagccccaccagc

SEQ ID NO: 2614459 - RNA, 15 nt, Escherichia coli CFT073
accaaugacggccag

SEQ ID NO: 2614460 - RNA, 12 nt, Escherichia coli CFT073
accaaugacuau

SEQ ID NO: 2614461 - RNA, 13 nt, Escherichia coli CFT073
accaaugccaccc

SEQ ID NO: 2614462 - RNA, 14 nt, Escherichia coli CFT073
accaaugccaccca

SEQ ID NO: 2614463 - RNA, 12 nt, Escherichia coli CFT073
accaaugcccaa

SEQ ID NO: 2614464 - RNA, 22 nt, Escherichia coli CFT073
accaauggcgaggaacgccccc

SEQ ID NO: 2614465 - RNA, 19 nt, Escherichia coli CFT073
accaauggucgugguaaug

SEQ ID NO: 2614466 - RNA, 21 nt, Escherichia coli CFT073
accaauggugagaguuuguuu

SEQ ID NO: 2614467 - RNA, 23 nt, Escherichia coli CFT073
accaaugucagggccaucgcggu

SEQ ID NO: 2614468 - RNA, 15 nt, Escherichia coli CFT073
accaauuaaauaucc

SEQ ID NO: 2614469 - RNA, 17 nt, Escherichia coli CFT073
accaauuacacacaaca

SEQ ID NO: 2614470 - RNA, 23 nt, Escherichia coli CFT073
accagaccggcaaucgcgccaga

SEQ ID NO: 2614471 - RNA, 16 nt, Escherichia coli CFT073
accagacgauggcucc

SEQ ID NO: 2614472 - RNA, 15 nt, Escherichia coli CFT073
accagacgauuuucc

SEQ ID NO: 2614473 - RNA, 16 nt, Escherichia coli CFT073
accagacgauuuuccc

SEQ ID NO: 2614474 - RNA, 18 nt, Escherichia coli CFT073
accagacgccccaguaaa

SEQ ID NO: 2614475 - RNA, 13 nt, Escherichia coli CFT073
accagacgcgcgu

SEQ ID NO: 2614476 - RNA, 18 nt, Escherichia coli CFT073
accagacgcgcugaguca

SEQ ID NO: 2614477 - RNA, 14 nt, Escherichia coli CFT073
accagacgcgggca

SEQ ID NO: 2614478 - RNA, 13 nt, Escherichia coli CFT073
accagagauagcg

SEQ ID NO: 2614479 - RNA, 13 nt, Escherichia coli CFT073
accagagugacca

SEQ ID NO: 2614480 - RNA, 14 nt, Escherichia coli CFT073
accagauaaacauc

SEQ ID NO: 2614481 - RNA, 12 nt, Escherichia coli CFT073
accagauaagaa

SEQ ID NO: 2614482 - RNA, 13 nt, Escherichia coli CFT073
accagauccaaca

SEQ ID NO: 2614483 - RNA, 17 nt, Escherichia coli CFT073
accagauccagcaaggg

SEQ ID NO: 2614484 - RNA, 20 nt, Escherichia coli CFT073
accagaucgccuaauuucac

SEQ ID NO: 2614485 - RNA, 22 nt, Escherichia coli CFT073
accagaucuaucuggcgcgcua

SEQ ID NO: 2614486 - RNA, 21 nt, Escherichia coli CFT073
accagaucugacgauuauuuu

SEQ ID NO: 2614487 - RNA, 20 nt, Escherichia coli CFT073
accagaucuucaucaccgau

SEQ ID NO: 2614488 - RNA, 16 nt, Escherichia coli CFT073
accagauuaauuauug

SEQ ID NO: 2614489 - RNA, 15 nt, Escherichia coli CFT073
accagauuaccgccu

SEQ ID NO: 2614490 - RNA, 18 nt, Escherichia coli CFT073
accagauucggcgcaaug

SEQ ID NO: 2614491 - RNA, 20 nt, Escherichia coli CFT073
accagauucggcgcaaugau

SEQ ID NO: 2614492 - RNA, 23 nt, Escherichia coli CFT073
accagcaacgcuucaaccagugc

SEQ ID NO: 2614493 - RNA, 23 nt, Escherichia coli CFT073
accagcaacgcuucguagaagcc

SEQ ID NO: 2614494 - RNA, 16 nt, Escherichia coli CFT073
accagcaauaaaaaac

SEQ ID NO: 2614495 - RNA, 13 nt, Escherichia coli CFT073
accagcaaugcca

SEQ ID NO: 2614496 - RNA, 15 nt, Escherichia coli CFT073
accagcacaaagugg

SEQ ID NO: 2614497 - RNA, 16 nt, Escherichia coli CFT073
accagcacaaaguggc

SEQ ID NO: 2614498 - RNA, 16 nt, Escherichia coli CFT073
accagcacaucaucaa

SEQ ID NO: 2614499 - RNA, 22 nt, Escherichia coli CFT073
accagcacaucaucaaagccaa

SEQ ID NO: 2614500 - RNA, 12 nt, Escherichia coli CFT073
accagcacaucu

SEQ ID NO: 2614501 - RNA, 16 nt, Escherichia coli CFT073
accagcaccgccagca

SEQ ID NO: 2614502 - RNA, 22 nt, Escherichia coli CFT073
accagcaccgcgacaaucaggu

SEQ ID NO: 2614503 - RNA, 13 nt, Escherichia coli CFT073
accagcagcauca

SEQ ID NO: 2614504 - RNA, 15 nt, Escherichia coli CFT073
accagcagcaucacc

SEQ ID NO: 2614505 - RNA, 16 nt, Escherichia coli CFT073
accagcagcaucacca

SEQ ID NO: 2614506 - RNA, 17 nt, Escherichia coli CFT073
accagcagcaucaccac

SEQ ID NO: 2614507 - RNA, 13 nt, Escherichia coli CFT073
accagcagccauc

SEQ ID NO: 2614508 - RNA, 16 nt, Escherichia coli CFT073
accagcagcgccggau

SEQ ID NO: 2614509 - RNA, 20 nt, Escherichia coli CFT073
accagcagcgucagcacuuc

SEQ ID NO: 2614510 - RNA, 13 nt, Escherichia coli CFT073
accagcagcugcu

SEQ ID NO: 2614511 - RNA, 17 nt, Escherichia coli CFT073
accagcaggaaucccau

SEQ ID NO: 2614512 - RNA, 19 nt, Escherichia coli CFT073
accagcaggaaucccauca

SEQ ID NO: 2614513 - RNA, 23 nt, Escherichia coli CFT073
accagcaggaaucccaucagacg

SEQ ID NO: 2614514 - RNA, 15 nt, Escherichia coli CFT073
accagcaggucgaua

SEQ ID NO: 2614515 - RNA, 14 nt, Escherichia coli CFT073
accagcaguacagu

SEQ ID NO: 2614516 - RNA, 17 nt, Escherichia coli CFT073
accagcagucgaccaaa

SEQ ID NO: 2614517 - RNA, 17 nt, Escherichia coli CFT073
accagcaucaacaacaa

SEQ ID NO: 2614518 - RNA, 23 nt, Escherichia coli CFT073
accagcaucaacaacaauuucac

SEQ ID NO: 2614519 - RNA, 12 nt, Escherichia coli CFT073
accagcaucacc

SEQ ID NO: 2614520 - RNA, 16 nt, Escherichia coli CFT073
accagcaucaggauga

SEQ ID NO: 2614521 - RNA, 14 nt, Escherichia coli CFT073
accagcaucgccgg

SEQ ID NO: 2614522 - RNA, 16 nt, Escherichia coli CFT073
accagcauuagcauua

SEQ ID NO: 2614523 - RNA, 17 nt, Escherichia coli CFT073
accagcauuagcauuaa

SEQ ID NO: 2614524 - RNA, 19 nt, Escherichia coli CFT073
accagcauuccuaaaccau

SEQ ID NO: 2614525 - RNA, 18 nt, Escherichia coli CFT073
accagccaaauaaaaucc

SEQ ID NO: 2614526 - RNA, 12 nt, Escherichia coli CFT073
accagccaacaa

SEQ ID NO: 2614527 - RNA, 20 nt, Escherichia coli CFT073
accagccacggcgcaugacc

SEQ ID NO: 2614528 - RNA, 14 nt, Escherichia coli CFT073
accagccagacuca

SEQ ID NO: 2614529 - RNA, 16 nt, Escherichia coli CFT073
accagccaggccgcca

SEQ ID NO: 2614530 - RNA, 17 nt, Escherichia coli CFT073
accagccauuaaccagc

SEQ ID NO: 2614531 - RNA, 19 nt, Escherichia coli CFT073
accagccauuaaccagcca

SEQ ID NO: 2614532 - RNA, 23 nt, Escherichia coli CFT073
accagccccuggaaaaaaugccc

SEQ ID NO: 2614533 - RNA, 21 nt, Escherichia coli CFT073
accagccgccaacuccaccaa

SEQ ID NO: 2614534 - RNA, 19 nt, Escherichia coli CFT073
accagccguaaacgugcgc

SEQ ID NO: 2614535 - RNA, 23 nt, Escherichia coli CFT073
accagccgugcggugguuucucc

SEQ ID NO: 2614536 - RNA, 18 nt, Escherichia coli CFT073
accagccguuauguugau

SEQ ID NO: 2614537 - RNA, 20 nt, Escherichia coli CFT073
accagccguugucagucauc

SEQ ID NO: 2614538 - RNA, 23 nt, Escherichia coli CFT073
accagccguugucagucaucacu

SEQ ID NO: 2614539 - RNA, 14 nt, Escherichia coli CFT073
accagccuugugcc

SEQ ID NO: 2614540 - RNA, 15 nt, Escherichia coli CFT073
accagccuugugccu

SEQ ID NO: 2614541 - RNA, 22 nt, Escherichia coli CFT073
accagcgaaaaaugguuugccc

SEQ ID NO: 2614542 - RNA, 14 nt, Escherichia coli CFT073
accagcgaaaccug

SEQ ID NO: 2614543 - RNA, 15 nt, Escherichia coli CFT073
accagcgacagccag

SEQ ID NO: 2614544 - RNA, 17 nt, Escherichia coli CFT073
accagcgacagccagcc

SEQ ID NO: 2614545 - RNA, 14 nt, Escherichia coli CFT073
accagcgcaauaug

SEQ ID NO: 2614546 - RNA, 16 nt, Escherichia coli CFT073
accagcgcagacacca

SEQ ID NO: 2614547 - RNA, 13 nt, Escherichia coli CFT073
accagcgccauua

SEQ ID NO: 2614548 - RNA, 14 nt, Escherichia coli CFT073
accagcgccucuuc

SEQ ID NO: 2614549 - RNA, 13 nt, Escherichia coli CFT073
accagcgccuggc

SEQ ID NO: 2614550 - RNA, 14 nt, Escherichia coli CFT073
accagcgcugcggc

SEQ ID NO: 2614551 - RNA, 15 nt, Escherichia coli CFT073
accagcggacggcug

SEQ ID NO: 2614552 - RNA, 16 nt, Escherichia coli CFT073
accagcggcaacauca

SEQ ID NO: 2614553 - RNA, 17 nt, Escherichia coli CFT073
accagcggcaacaucau

SEQ ID NO: 2614554 - RNA, 20 nt, Escherichia coli CFT073
accagcggcaacaucaucac

SEQ ID NO: 2614555 - RNA, 18 nt, Escherichia coli CFT073
accagcggccagacgcgc

SEQ ID NO: 2614556 - RNA, 23 nt, Escherichia coli CFT073
accagcggccagacgcgccgcca

SEQ ID NO: 2614557 - RNA, 20 nt, Escherichia coli CFT073
accagcggguuaucuuccag

SEQ ID NO: 2614558 - RNA, 16 nt, Escherichia coli CFT073
accagcgucagaaaca

SEQ ID NO: 2614559 - RNA, 23 nt, Escherichia coli CFT073
accagcgucauaaaaauccgguu

SEQ ID NO: 2614560 - RNA, 18 nt, Escherichia coli CFT073
accagcgucgcaucaggc

SEQ ID NO: 2614561 - RNA, 17 nt, Escherichia coli CFT073
accagcguuuccagcac

SEQ ID NO: 2614562 - RNA, 15 nt, Escherichia coli CFT073
accagcuccagcagu

SEQ ID NO: 2614563 - RNA, 17 nt, Escherichia coli CFT073
accagcuccggcacuuc

SEQ ID NO: 2614564 - RNA, 16 nt, Escherichia coli CFT073
accagcugaaaucacc

SEQ ID NO: 2614565 - RNA, 23 nt, Escherichia coli CFT073
accagcugaaaucaccgccacca

SEQ ID NO: 2614566 - RNA, 19 nt, Escherichia coli CFT073
accagcuguuuugguaaac

SEQ ID NO: 2614567 - RNA, 18 nt, Escherichia coli CFT073
accaggaaaaagaucagc

SEQ ID NO: 2614568 - RNA, 19 nt, Escherichia coli CFT073
accaggaaacccaacgcaa

SEQ ID NO: 2614569 - RNA, 23 nt, Escherichia coli CFT073
accaggaaacccaacgcaaagag

SEQ ID NO: 2614570 - RNA, 12 nt, Escherichia coli CFT073
accaggaucagc

SEQ ID NO: 2614571 - RNA, 16 nt, Escherichia coli CFT073
accaggcaagaauccg

SEQ ID NO: 2614572 - RNA, 14 nt, Escherichia coli CFT073
accaggcaauaaac

SEQ ID NO: 2614573 - RNA, 19 nt, Escherichia coli CFT073
accaggcaauaaacauccu

SEQ ID NO: 2614574 - RNA, 15 nt, Escherichia coli CFT073
accaggcauauucac

SEQ ID NO: 2614575 - RNA, 15 nt, Escherichia coli CFT073
accaggccaucagca

SEQ ID NO: 2614576 - RNA, 19 nt, Escherichia coli CFT073
accaggcgaccguuuucac

SEQ ID NO: 2614577 - RNA, 23 nt, Escherichia coli CFT073
accaggcgaccguuuucaccagu

SEQ ID NO: 2614578 - RNA, 22 nt, Escherichia coli CFT073
accaggcguggauacaggcggg

SEQ ID NO: 2614579 - RNA, 19 nt, Escherichia coli CFT073
accauuuacccgauccacu

SEQ ID NO: 2614580 - RNA, 15 nt, Escherichia coli CFT073
acccaaaaaauagca

SEQ ID NO: 2614581 - RNA, 19 nt, Escherichia coli CFT073
acccaaaaaauagcaaagu

SEQ ID NO: 2614582 - RNA, 22 nt, Escherichia coli CFT073
acccaacacucgaacaaggcaa

SEQ ID NO: 2614583 - RNA, 17 nt, Escherichia coli CFT073
acccaacgcaaagagag

SEQ ID NO: 2614584 - RNA, 21 nt, Escherichia coli CFT073
acccaacgcaaagagagaagc

SEQ ID NO: 2614585 - RNA, 17 nt, Escherichia coli CFT073
acccaacggcaaacauc

SEQ ID NO: 2614586 - RNA, 21 nt, Escherichia coli CFT073
acccaagcgggaauagcucag

SEQ ID NO: 2614587 - RNA, 11 nt, Escherichia coli CFT073
acccaauccag

SEQ ID NO: 2614588 - RNA, 14 nt, Escherichia coli CFT073
acccaaucccccac

SEQ ID NO: 2614589 - RNA, 15 nt, Escherichia coli CFT073
acccacagcgcacca

SEQ ID NO: 2614590 - RNA, 20 nt, Escherichia coli CFT073
acccaccaauuaaucccgga

SEQ ID NO: 2614591 - RNA, 13 nt, Escherichia coli CFT073
acccaccgcagcc

SEQ ID NO: 2614592 - RNA, 21 nt, Escherichia coli CFT073
acccaccgguccuaacaacca

SEQ ID NO: 2614593 - RNA, 17 nt, Escherichia coli CFT073
acccacgaaaucuucca

SEQ ID NO: 2614594 - RNA, 20 nt, Escherichia coli CFT073
acccacgguacucaucacgu

SEQ ID NO: 2614595 - RNA, 13 nt, Escherichia coli CFT073
acccacuuccccu

SEQ ID NO: 2614596 - RNA, 16 nt, Escherichia coli CFT073
acccagaacacgccgu

SEQ ID NO: 2614597 - RNA, 19 nt, Escherichia coli CFT073
acccagaaucucuuuuguu

SEQ ID NO: 2614598 - RNA, 16 nt, Escherichia coli CFT073
acccagcaauccugca

SEQ ID NO: 2614599 - RNA, 14 nt, Escherichia coli CFT073
acccagcaaugcca

SEQ ID NO: 2614600 - RNA, 21 nt, Escherichia coli CFT073
acccagcaaugccaggcucca

SEQ ID NO: 2614601 - RNA, 14 nt, Escherichia coli CFT073
acccagcaccagua

SEQ ID NO: 2614602 - RNA, 11 nt, Escherichia coli CFT073
acccagcagca

SEQ ID NO: 2614603 - RNA, 13 nt, Escherichia coli CFT073
acccagcagcagc

SEQ ID NO: 2614604 - RNA, 15 nt, Escherichia coli CFT073
acccagcagcagcgg

SEQ ID NO: 2614605 - RNA, 14 nt, Escherichia coli CFT073
acccagcagcgcca

SEQ ID NO: 2614606 - RNA, 15 nt, Escherichia coli CFT073
acccagcagcgccac

SEQ ID NO: 2614607 - RNA, 13 nt, Escherichia coli CFT073
acccagcgccaug

SEQ ID NO: 2614608 - RNA, 19 nt, Escherichia coli CFT073
acccagcgcgauacgcagu

SEQ ID NO: 2614609 - RNA, 18 nt, Escherichia coli CFT073
acccagcggaugacccag

SEQ ID NO: 2614610 - RNA, 17 nt, Escherichia coli CFT073
acccagcgguaaaaugg

SEQ ID NO: 2614611 - RNA, 20 nt, Escherichia coli CFT073
acccagcgguaaaaugguca

SEQ ID NO: 2614612 - RNA, 22 nt, Escherichia coli CFT073
acccagguuugacgccugcagc

SEQ ID NO: 2614613 - RNA, 16 nt, Escherichia coli CFT073
acccaguacgggcagc

SEQ ID NO: 2614614 - RNA, 14 nt, Escherichia coli CFT073
acccagucccacca

SEQ ID NO: 2614615 - RNA, 13 nt, Escherichia coli CFT073
acccagucgcgcg

SEQ ID NO: 2614616 - RNA, 17 nt, Escherichia coli CFT073
acccagugaauccagca

SEQ ID NO: 2614617 - RNA, 20 nt, Escherichia coli CFT073
acccaguuuaccgaaaauca

SEQ ID NO: 2614618 - RNA, 18 nt, Escherichia coli CFT073
acccaucaacaacuggcg

SEQ ID NO: 2614619 - RNA, 20 nt, Escherichia coli CFT073
acccaucaaccuugaaccga

SEQ ID NO: 2614620 - RNA, 17 nt, Escherichia coli CFT073
acccaucacuaccugau

SEQ ID NO: 2614621 - RNA, 15 nt, Escherichia coli CFT073
acccauccagcagag

SEQ ID NO: 2614622 - RNA, 23 nt, Escherichia coli CFT073
acccaucgccguaccuuuguaac

SEQ ID NO: 2614623 - RNA, 16 nt, Escherichia coli CFT073
acccauuuaaaaauca

SEQ ID NO: 2614624 - RNA, 22 nt, Escherichia coli CFT073
acccauuuucagccggcaggau

SEQ ID NO: 2614625 - RNA, 23 nt, Escherichia coli CFT073
accccaaaaccuggacaguuuca

SEQ ID NO: 2614626 - RNA, 12 nt, Escherichia coli CFT073
accccaaccacu

SEQ ID NO: 2614627 - RNA, 19 nt, Escherichia coli CFT073
accccaaguuuaugcaaua

SEQ ID NO: 2614628 - RNA, 20 nt, Escherichia coli CFT073
accccacaaacagaauggug

SEQ ID NO: 2614629 - RNA, 12 nt, Escherichia coli CFT073
accccagaugga

SEQ ID NO: 2614630 - RNA, 15 nt, Escherichia coli CFT073
accccagcggcaacc

SEQ ID NO: 2614631 - RNA, 16 nt, Escherichia coli CFT073
accccauauucgaacc

SEQ ID NO: 2614632 - RNA, 12 nt, Escherichia coli CFT073
accccauuaaua

SEQ ID NO: 2614633 - RNA, 22 nt, Escherichia coli CFT073
acccccauaauccaugccaacg

SEQ ID NO: 2614634 - RNA, 16 nt, Escherichia coli CFT073
acccccauccacgcau

SEQ ID NO: 2614635 - RNA, 22 nt, Escherichia coli CFT073
accccccaggcgcaccagcaca

SEQ ID NO: 2614636 - RNA, 13 nt, Escherichia coli CFT073
acccccgaacugg

SEQ ID NO: 2614637 - RNA, 17 nt, Escherichia coli CFT073
accccgagaugcccgcu

SEQ ID NO: 2614638 - RNA, 17 nt, Escherichia coli CFT073
accccgagcgaauaaac

SEQ ID NO: 2614639 - RNA, 22 nt, Escherichia coli CFT073
accccgagcgaauaaaccacac

SEQ ID NO: 2614640 - RNA, 14 nt, Escherichia coli CFT073
accccgccagcaga

SEQ ID NO: 2614641 - RNA, 17 nt, Escherichia coli CFT073
accccgccagcagaaug

SEQ ID NO: 2614642 - RNA, 22 nt, Escherichia coli CFT073
accccgcgcgguguaccgcauc

SEQ ID NO: 2614643 - RNA, 23 nt, Escherichia coli CFT073
accccgcgcucacaccacaacag

SEQ ID NO: 2614644 - RNA, 18 nt, Escherichia coli CFT073
accccgguaguacgugaa

SEQ ID NO: 2614645 - RNA, 19 nt, Escherichia coli CFT073
accccguaauaaccaccac

SEQ ID NO: 2614646 - RNA, 21 nt, Escherichia coli CFT073
accccugacgcuuaucuuccg

SEQ ID NO: 2614647 - RNA, 12 nt, Escherichia coli CFT073
accccugcggcc

SEQ ID NO: 2614648 - RNA, 14 nt, Escherichia coli CFT073
acccgaauaccuuu

SEQ ID NO: 2614649 - RNA, 17 nt, Escherichia coli CFT073
acccgacacggcucgcc

SEQ ID NO: 2614650 - RNA, 19 nt, Escherichia coli CFT073
acccgacagauaaaucauc

SEQ ID NO: 2614651 - RNA, 18 nt, Escherichia coli CFT073
acccgaccgagcugguga

SEQ ID NO: 2614652 - RNA, 15 nt, Escherichia coli CFT073
acccgacgcgccagg

SEQ ID NO: 2614653 - RNA, 16 nt, Escherichia coli CFT073
acccgagcgccagcga

SEQ ID NO: 2614654 - RNA, 15 nt, Escherichia coli CFT073
acccgauacuccacg

SEQ ID NO: 2614655 - RNA, 18 nt, Escherichia coli CFT073
acccgauccacugaaaca

SEQ ID NO: 2614656 - RNA, 20 nt, Escherichia coli CFT073
acccgcacaaauagccagca

SEQ ID NO: 2614657 - RNA, 18 nt, Escherichia coli CFT073
acccgcagcaagcguuug

SEQ ID NO: 2614658 - RNA, 14 nt, Escherichia coli CFT073
acccgcagccagca

SEQ ID NO: 2614659 - RNA, 18 nt, Escherichia coli CFT073
acccgcagccaucaccac

SEQ ID NO: 2614660 - RNA, 17 nt, Escherichia coli CFT073
acccgcaguccugcagg

SEQ ID NO: 2614661 - RNA, 20 nt, Escherichia coli CFT073
acccgcagugauugccgcga

SEQ ID NO: 2614662 - RNA, 15 nt, Escherichia coli CFT073
acccgccaccgggaa

SEQ ID NO: 2614663 - RNA, 20 nt, Escherichia coli CFT073
acccgccagaaaaggugcca

SEQ ID NO: 2614664 - RNA, 17 nt, Escherichia coli CFT073
acccgccagaaucaccg

SEQ ID NO: 2614665 - RNA, 15 nt, Escherichia coli CFT073
acccgccagaauccc

SEQ ID NO: 2614666 - RNA, 17 nt, Escherichia coli CFT073
acccgccaucgcccgca

SEQ ID NO: 2614667 - RNA, 14 nt, Escherichia coli CFT073
acccgcgacgcgcu

SEQ ID NO: 2614668 - RNA, 14 nt, Escherichia coli CFT073
acccgcugguaaac

SEQ ID NO: 2614669 - RNA, 22 nt, Escherichia coli CFT073
acccggacaaauaacccgccau

SEQ ID NO: 2614670 - RNA, 15 nt, Escherichia coli CFT073
acccggcaucaacca

SEQ ID NO: 2614671 - RNA, 19 nt, Escherichia coli CFT073
acccggccacagcgccaga

SEQ ID NO: 2614672 - RNA, 22 nt, Escherichia coli CFT073
acccggcgcuaauucaacgccu

SEQ ID NO: 2614673 - RNA, 15 nt, Escherichia coli CFT073
acccggcguuuucag

SEQ ID NO: 2614674 - RNA, 16 nt, Escherichia coli CFT073
acccggcguuuucaga

SEQ ID NO: 2614675 - RNA, 19 nt, Escherichia coli CFT073
acccgguccgcgaaucucu

SEQ ID NO: 2614676 - RNA, 17 nt, Escherichia coli CFT073
acccggugccgccguca

SEQ ID NO: 2614677 - RNA, 17 nt, Escherichia coli CFT073
acccgucagcagaucca

SEQ ID NO: 2614678 - RNA, 22 nt, Escherichia coli CFT073
acccguugaucuucucuuauau

SEQ ID NO: 2614679 - RNA, 14 nt, Escherichia coli CFT073
acccguugcuucac

SEQ ID NO: 2614680 - RNA, 19 nt, Escherichia coli CFT073
acccguuguaaaugcugcu

SEQ ID NO: 2614681 - RNA, 22 nt, Escherichia coli CFT073
acccguuuacauaaauggguuu

SEQ ID NO: 2614682 - RNA, 13 nt, Escherichia coli CFT073
acccguuuuaaau

SEQ ID NO: 2614683 - RNA, 13 nt, Escherichia coli CFT073
acccuaaagcacc

SEQ ID NO: 2614684 - RNA, 15 nt, Escherichia coli CFT073
acccuauuuaaagca

SEQ ID NO: 2614685 - RNA, 18 nt, Escherichia coli CFT073
acccuauuuaaagcacaa

SEQ ID NO: 2614686 - RNA, 18 nt, Escherichia coli CFT073
acccucaaaauuucucuu

SEQ ID NO: 2614687 - RNA, 19 nt, Escherichia coli CFT073
acccucaaacgccagcaug

SEQ ID NO: 2614688 - RNA, 22 nt, Escherichia coli CFT073
accgccaauuaauugugcuccu

SEQ ID NO: 2614689 - RNA, 16 nt, Escherichia coli CFT073
accgccacagcagccu

SEQ ID NO: 2614690 - RNA, 13 nt, Escherichia coli CFT073
accgccacuacca

SEQ ID NO: 2614691 - RNA, 14 nt, Escherichia coli CFT073
accgccagaagaac

SEQ ID NO: 2614692 - RNA, 20 nt, Escherichia coli CFT073
accgccagcacagccagccu

SEQ ID NO: 2614693 - RNA, 15 nt, Escherichia coli CFT073
accgccaggcacuuc

SEQ ID NO: 2614694 - RNA, 22 nt, Escherichia coli CFT073
accgccaggccuaacaccauca

SEQ ID NO: 2614695 - RNA, 23 nt, Escherichia coli CFT073
accgccaggccuaacaccaucag

SEQ ID NO: 2614696 - RNA, 17 nt, Escherichia coli CFT073
accgccagucacugcca

SEQ ID NO: 2614697 - RNA, 15 nt, Escherichia coli CFT073
accgccagugcagcg

SEQ ID NO: 2614698 - RNA, 17 nt, Escherichia coli CFT073
accgccagugcagcgaa

SEQ ID NO: 2614699 - RNA, 20 nt, Escherichia coli CFT073
accgccauuaaacgcaguaa

SEQ ID NO: 2614700 - RNA, 14 nt, Escherichia coli CFT073
accgcccacuacca

SEQ ID NO: 2614701 - RNA, 18 nt, Escherichia coli CFT073
accgccccggguuuccug

SEQ ID NO: 2614702 - RNA, 19 nt, Escherichia coli CFT073
accgcccgguuuuuuuacc

SEQ ID NO: 2614703 - RNA, 18 nt, Escherichia coli CFT073
accgcccugcaucaugcg

SEQ ID NO: 2614704 - RNA, 22 nt, Escherichia coli CFT073
accgcccugcuguacaguaauc

SEQ ID NO: 2614705 - RNA, 15 nt, Escherichia coli CFT073
accgccgagcacaaa

SEQ ID NO: 2614706 - RNA, 20 nt, Escherichia coli CFT073
accgccgagucgguuuuauu

SEQ ID NO: 2614707 - RNA, 14 nt, Escherichia coli CFT073
accgccgcacaaua

SEQ ID NO: 2614708 - RNA, 10 nt, Escherichia coli CFT073
accgccgccg

SEQ ID NO: 2614709 - RNA, 17 nt, Escherichia coli CFT073
accgccgccgccacugc

SEQ ID NO: 2614710 - RNA, 20 nt, Escherichia coli CFT073
accgccguacgucagcgccu

SEQ ID NO: 2614711 - RNA, 20 nt, Escherichia coli CFT073
accgccgucguaacaggaaa

SEQ ID NO: 2614712 - RNA, 20 nt, Escherichia coli CFT073
accgccugcauaaaggcaaa

SEQ ID NO: 2614713 - RNA, 16 nt, Escherichia coli CFT073
accgccuggcgcugcu

SEQ ID NO: 2614714 - RNA, 18 nt, Escherichia coli CFT073
accgccuggcgcugcuca

SEQ ID NO: 2614715 - RNA, 16 nt, Escherichia coli CFT073
accgcgaauauaagcg

SEQ ID NO: 2614716 - RNA, 17 nt, Escherichia coli CFT073
accgcgagauauccaca

SEQ ID NO: 2614717 - RNA, 16 nt, Escherichia coli CFT073
accgcgagcaaaaucg

SEQ ID NO: 2614718 - RNA, 18 nt, Escherichia coli CFT073
accgcgcaguaccacuuc

SEQ ID NO: 2614719 - RNA, 16 nt, Escherichia coli CFT073
accgcgccaagccuga

SEQ ID NO: 2614720 - RNA, 17 nt, Escherichia coli CFT073
accgcgccauguugccu

SEQ ID NO: 2614721 - RNA, 22 nt, Escherichia coli CFT073
accgcgcggcugguaacagucc

SEQ ID NO: 2614722 - RNA, 21 nt, Escherichia coli CFT073
accgcgcuggcugaaucccug

SEQ ID NO: 2614723 - RNA, 14 nt, Escherichia coli CFT073
accgcggaacgcac

SEQ ID NO: 2614724 - RNA, 19 nt, Escherichia coli CFT073
accgcgggcaaucgccaga

SEQ ID NO: 2614725 - RNA, 22 nt, Escherichia coli CFT073
accgcgguucccagcgucggaa

SEQ ID NO: 2614726 - RNA, 15 nt, Escherichia coli CFT073
accgcguaugcccag

SEQ ID NO: 2614727 - RNA, 22 nt, Escherichia coli CFT073
accgcgugagaacacgaccugc

SEQ ID NO: 2614728 - RNA, 13 nt, Escherichia coli CFT073
accgcguuuucca

SEQ ID NO: 2614729 - RNA, 14 nt, Escherichia coli CFT073
accgcuaacugcug

SEQ ID NO: 2614730 - RNA, 15 nt, Escherichia coli CFT073
accgcuaacugcugc

SEQ ID NO: 2614731 - RNA, 19 nt, Escherichia coli CFT073
accgcuaauagcgcagcgg

SEQ ID NO: 2614732 - RNA, 14 nt, Escherichia coli CFT073
accgcuaccgcccu

SEQ ID NO: 2614733 - RNA, 22 nt, Escherichia coli CFT073
accgcuacuggcaauccugcuu

SEQ ID NO: 2614734 - RNA, 20 nt, Escherichia coli CFT073
accgcuauagccgcaacugc

SEQ ID NO: 2614735 - RNA, 17 nt, Escherichia coli CFT073
accgcuccgccaucuuc

SEQ ID NO: 2614736 - RNA, 13 nt, Escherichia coli CFT073
accgcucgcgcuu

SEQ ID NO: 2614737 - RNA, 16 nt, Escherichia coli CFT073
accgcucgucacauca

SEQ ID NO: 2614738 - RNA, 19 nt, Escherichia coli CFT073
accgcucgucacaucacca

SEQ ID NO: 2614739 - RNA, 15 nt, Escherichia coli CFT073
accgcucucauccau

SEQ ID NO: 2614740 - RNA, 15 nt, Escherichia coli CFT073
accgcugauugcugg

SEQ ID NO: 2614741 - RNA, 21 nt, Escherichia coli CFT073
accgcugcgccauaaccgcca

SEQ ID NO: 2614742 - RNA, 13 nt, Escherichia coli CFT073
accgcugcuggcg

SEQ ID NO: 2614743 - RNA, 22 nt, Escherichia coli CFT073
accgcuguuaugcacacgcgga

SEQ ID NO: 2614744 - RNA, 23 nt, Escherichia coli CFT073
accgcuguugccagcagcaacca

SEQ ID NO: 2614745 - RNA, 23 nt, Escherichia coli CFT073
accgcuguugcuuccaccaucac

SEQ ID NO: 2614746 - RNA, 20 nt, Escherichia coli CFT073
accgcuucaacagcggcauu

SEQ ID NO: 2614747 - RNA, 16 nt, Escherichia coli CFT073
accgcuucaucugcac

SEQ ID NO: 2614748 - RNA, 15 nt, Escherichia coli CFT073
accgcuucccaaaga

SEQ ID NO: 2614749 - RNA, 21 nt, Escherichia coli CFT073
accgcuucgcguaaaauugca

SEQ ID NO: 2614750 - RNA, 22 nt, Escherichia coli CFT073
accgcuucgcguaaaauugcag

SEQ ID NO: 2614751 - RNA, 14 nt, Escherichia coli CFT073
accgcuuuccucau

SEQ ID NO: 2614752 - RNA, 17 nt, Escherichia coli CFT073
accgcuuuccucaucag

SEQ ID NO: 2614753 - RNA, 17 nt, Escherichia coli CFT073
accgcuuuugccagcag

SEQ ID NO: 2614754 - RNA, 23 nt, Escherichia coli CFT073
gacaaucaccaggucaccagaca

SEQ ID NO: 2614755 - RNA, 20 nt, Escherichia coli CFT073
gacaaucagguaagcgauaa

SEQ ID NO: 2614756 - RNA, 17 nt, Escherichia coli CFT073
gacaaucaucacgauca

SEQ ID NO: 2614757 - RNA, 13 nt, Escherichia coli CFT073
gacaaucaucgcc

SEQ ID NO: 2614758 - RNA, 22 nt, Escherichia coli CFT073
gacaauccagcgaaauaaaagu

SEQ ID NO: 2614759 - RNA, 20 nt, Escherichia coli CFT073
gacaaucgccagugauugcu

SEQ ID NO: 2614760 - RNA, 16 nt, Escherichia coli CFT073
gacaaucgcccccauc

SEQ ID NO: 2614761 - RNA, 23 nt, Escherichia coli CFT073
gacaaucugugugggcacucgaa

SEQ ID NO: 2614762 - RNA, 17 nt, Escherichia coli CFT073
gacaauguaucuuucau

SEQ ID NO: 2614763 - RNA, 22 nt, Escherichia coli CFT073
gacaaugugaaaacccugcgca

SEQ ID NO: 2614764 - RNA, 22 nt, Escherichia coli CFT073
gacaauguggccuuaauuggcc

SEQ ID NO: 2614765 - RNA, 15 nt, Escherichia coli CFT073
gacaauuaaacuuua

SEQ ID NO: 2614766 - RNA, 13 nt, Escherichia coli CFT073
gacaauuaacacg

SEQ ID NO: 2614767 - RNA, 15 nt, Escherichia coli CFT073
gacacaacuggcgca

SEQ ID NO: 2614768 - RNA, 15 nt, Escherichia coli CFT073
gacacaaucaaaucc

SEQ ID NO: 2614769 - RNA, 17 nt, Escherichia coli CFT073
gacacaauccaugccaa

SEQ ID NO: 2614770 - RNA, 13 nt, Escherichia coli CFT073
gacacaaugccau

SEQ ID NO: 2614771 - RNA, 14 nt, Escherichia coli CFT073
gacacaggcagcaa

SEQ ID NO: 2614772 - RNA, 16 nt, Escherichia coli CFT073
gacacaggcagcaauc

SEQ ID NO: 2614773 - RNA, 19 nt, Escherichia coli CFT073
gacacaggcagcaaucacu

SEQ ID NO: 2614774 - RNA, 16 nt, Escherichia coli CFT073
gacacagguaucgaca

SEQ ID NO: 2614775 - RNA, 15 nt, Escherichia coli CFT073
gacacaucuaaugcu

SEQ ID NO: 2614776 - RNA, 14 nt, Escherichia coli CFT073
gacacaugcugacu

SEQ ID NO: 2614777 - RNA, 14 nt, Escherichia coli CFT073
gacacauucagaau

SEQ ID NO: 2614778 - RNA, 16 nt, Escherichia coli CFT073
gacaccacccaacaga

SEQ ID NO: 2614779 - RNA, 16 nt, Escherichia coli CFT073
gacaccagcacaucau

SEQ ID NO: 2614780 - RNA, 11 nt, Escherichia coli CFT073
gacaccagcau

SEQ ID NO: 2614781 - RNA, 13 nt, Escherichia coli CFT073
gacaccagccaga

SEQ ID NO: 2614782 - RNA, 22 nt, Escherichia coli CFT073
gacaccagccagacucagcaac

SEQ ID NO: 2614783 - RNA, 18 nt, Escherichia coli CFT073
gacaccaguucagugacc

SEQ ID NO: 2614784 - RNA, 19 nt, Escherichia coli CFT073
gacaccaucacccaacaau

SEQ ID NO: 2614785 - RNA, 18 nt, Escherichia coli CFT073
gacaccccgguaaagcgc

SEQ ID NO: 2614786 - RNA, 19 nt, Escherichia coli CFT073
gacaccgcuguugcuucca

SEQ ID NO: 2614787 - RNA, 20 nt, Escherichia coli CFT073
gacacgaucuugauguggac

SEQ ID NO: 2614788 - RNA, 14 nt, Escherichia coli CFT073
gacacgcaacggcu

SEQ ID NO: 2614789 - RNA, 13 nt, Escherichia coli CFT073
gacacgcaucacg

SEQ ID NO: 2614790 - RNA, 14 nt, Escherichia coli CFT073
gacacggcucgccu

SEQ ID NO: 2614791 - RNA, 18 nt, Escherichia coli CFT073
gacacucacgcauacagu

SEQ ID NO: 2614792 - RNA, 22 nt, Escherichia coli CFT073
gacacugacgcgucuuaucugg

SEQ ID NO: 2614793 - RNA, 22 nt, Escherichia coli CFT073
gacacugccacuuuuucccugu

SEQ ID NO: 2614794 - RNA, 15 nt, Escherichia coli CFT073
gacacugucaccuuu

SEQ ID NO: 2614795 - RNA, 15 nt, Escherichia coli CFT073
gacacuuucagcgca

SEQ ID NO: 2614796 - RNA, 21 nt, Escherichia coli CFT073
gacagaaaaccaaaaccggcu

SEQ ID NO: 2614797 - RNA, 19 nt, Escherichia coli CFT073
gacagaccaaaacgugcag

SEQ ID NO: 2614798 - RNA, 20 nt, Escherichia coli CFT073
gacagaccacucucuggcaa

SEQ ID NO: 2614799 - RNA, 14 nt, Escherichia coli CFT073
gacagaccgccagu

SEQ ID NO: 2614800 - RNA, 15 nt, Escherichia coli CFT073
gacagacgccagcgc

SEQ ID NO: 2614801 - RNA, 20 nt, Escherichia coli CFT073
gacagacggcgacgcgcgcg

SEQ ID NO: 2614802 - RNA, 23 nt, Escherichia coli CFT073
gacagacggcgacgcgcgcgggu

SEQ ID NO: 2614803 - RNA, 18 nt, Escherichia coli CFT073
gacagagaacaucaaucc

SEQ ID NO: 2614804 - RNA, 18 nt, Escherichia coli CFT073
gacagaguguucgccauu

SEQ ID NO: 2614805 - RNA, 22 nt, Escherichia coli CFT073
gacagauuuauaaaauccaacu

SEQ ID NO: 2614806 - RNA, 15 nt, Escherichia coli CFT073
gacagcaggaaaaug

SEQ ID NO: 2614807 - RNA, 17 nt, Escherichia coli CFT073
gacagcaucgaccaugc

SEQ ID NO: 2614808 - RNA, 21 nt, Escherichia coli CFT073
gacagccauaaagaaaucacc

SEQ ID NO: 2614809 - RNA, 15 nt, Escherichia coli CFT073
gacagccauccccac

SEQ ID NO: 2614810 - RNA, 20 nt, Escherichia coli CFT073
gacagccccaccagcaaaua

SEQ ID NO: 2614811 - RNA, 21 nt, Escherichia coli CFT073
gacagccccaccagcaaauau

SEQ ID NO: 2614812 - RNA, 17 nt, Escherichia coli CFT073
gacagccccugugccag

SEQ ID NO: 2614813 - RNA, 20 nt, Escherichia coli CFT073
gacagcccggcauguuucaa

SEQ ID NO: 2614814 - RNA, 21 nt, Escherichia coli CFT073
gacagcgaaaacgacgagcca

SEQ ID NO: 2614815 - RNA, 19 nt, Escherichia coli CFT073
gacagcgauuaccauuuca

SEQ ID NO: 2614816 - RNA, 15 nt, Escherichia coli CFT073
gacagcgauuccagu

SEQ ID NO: 2614817 - RNA, 14 nt, Escherichia coli CFT073
gacagcgccaggcu

SEQ ID NO: 2614818 - RNA, 20 nt, Escherichia coli CFT073
gacagcgugagcagggugaa

SEQ ID NO: 2614819 - RNA, 16 nt, Escherichia coli CFT073
gacagcucacgcgcca

SEQ ID NO: 2614820 - RNA, 21 nt, Escherichia coli CFT073
gacagcuuagacaacgccgcu

SEQ ID NO: 2614821 - RNA, 17 nt, Escherichia coli CFT073
gacagcuuuuacaaaau

SEQ ID NO: 2614822 - RNA, 16 nt, Escherichia coli CFT073
gacaggagccgcagua

SEQ ID NO: 2614823 - RNA, 13 nt, Escherichia coli CFT073
gacaggccugauu

SEQ ID NO: 2614824 - RNA, 19 nt, Escherichia coli CFT073
gacaggcgaaaccagcagc

SEQ ID NO: 2614825 - RNA, 21 nt, Escherichia coli CFT073
gacaggcuuacguuacccagc

SEQ ID NO: 2614826 - RNA, 15 nt, Escherichia coli CFT073
gacaggucaaaguaa

SEQ ID NO: 2614827 - RNA, 14 nt, Escherichia coli CFT073
gacaggucaucgca

SEQ ID NO: 2614828 - RNA, 16 nt, Escherichia coli CFT073
gacagguggugugcaa

SEQ ID NO: 2614829 - RNA, 15 nt, Escherichia coli CFT073
gacaguaccagcagu

SEQ ID NO: 2614830 - RNA, 16 nt, Escherichia coli CFT073
gacaguacccagauuc

SEQ ID NO: 2614831 - RNA, 17 nt, Escherichia coli CFT073
gacaguacccagauuca

SEQ ID NO: 2614832 - RNA, 15 nt, Escherichia coli CFT073
gacaguaucaccaac

SEQ ID NO: 2614833 - RNA, 16 nt, Escherichia coli CFT073
gacaguaucaccaacu

SEQ ID NO: 2614834 - RNA, 17 nt, Escherichia coli CFT073
gacagugaaacacaugg

SEQ ID NO: 2614835 - RNA, 18 nt, Escherichia coli CFT073
gacagugaugacgccagc

SEQ ID NO: 2614836 - RNA, 17 nt, Escherichia coli CFT073
gacagugcgcgguaguu

SEQ ID NO: 2614837 - RNA, 14 nt, Escherichia coli CFT073
gacagugucuggcg

SEQ ID NO: 2614838 - RNA, 17 nt, Escherichia coli CFT073
gacaguguuauucccaa

SEQ ID NO: 2614839 - RNA, 17 nt, Escherichia coli CFT073
gacaguuaucaaauuca

SEQ ID NO: 2614840 - RNA, 22 nt, Escherichia coli CFT073
gacaguugcugcgugaccgcca

SEQ ID NO: 2614841 - RNA, 14 nt, Escherichia coli CFT073
gacauaaacaccag

SEQ ID NO: 2614842 - RNA, 21 nt, Escherichia coli CFT073
gacauaaccgagaauuuccag

SEQ ID NO: 2614843 - RNA, 19 nt, Escherichia coli CFT073
gacauacagcaccgcccgu

SEQ ID NO: 2614844 - RNA, 13 nt, Escherichia coli CFT073
gacauacuuaaau

SEQ ID NO: 2614845 - RNA, 23 nt, Escherichia coli CFT073
gacauaguacuggaagaaaacau

SEQ ID NO: 2614846 - RNA, 14 nt, Escherichia coli CFT073
gacauauaaccggc

SEQ ID NO: 2614847 - RNA, 16 nt, Escherichia coli CFT073
gacaucaaacaggcug

SEQ ID NO: 2614848 - RNA, 22 nt, Escherichia coli CFT073
gacaucaacagaagagcggcuc

SEQ ID NO: 2614849 - RNA, 17 nt, Escherichia coli CFT073
gacaucaacgaugccuu

SEQ ID NO: 2614850 - RNA, 16 nt, Escherichia coli CFT073
gacaucaacgccugau

SEQ ID NO: 2614851 - RNA, 20 nt, Escherichia coli CFT073
gacaucaacgccugaugcga

SEQ ID NO: 2614852 - RNA, 16 nt, Escherichia coli CFT073
gacaucaagaaaugca

SEQ ID NO: 2614853 - RNA, 17 nt, Escherichia coli CFT073
gacaucaccaguaccgc

SEQ ID NO: 2614854 - RNA, 18 nt, Escherichia coli CFT073
gacaucacucacgacaca

SEQ ID NO: 2614855 - RNA, 23 nt, Escherichia coli CFT073
gacauccagaucacgcagcaagc

SEQ ID NO: 2614856 - RNA, 14 nt, Escherichia coli CFT073
gacauccaugcacu

SEQ ID NO: 2614857 - RNA, 15 nt, Escherichia coli CFT073
gacauccgccagcgc

SEQ ID NO: 2614858 - RNA, 16 nt, Escherichia coli CFT073
gacauccgccagcgcc

SEQ ID NO: 2614859 - RNA, 22 nt, Escherichia coli CFT073
gacauccugaguuaaucgccgc

SEQ ID NO: 2614860 - RNA, 15 nt, Escherichia coli CFT073
gacaucgacguggug

SEQ ID NO: 2614861 - RNA, 20 nt, Escherichia coli CFT073
gacaucgccacggcaugaaa

SEQ ID NO: 2614862 - RNA, 21 nt, Escherichia coli CFT073
gaccugcgucugaugaaagca

SEQ ID NO: 2614863 - RNA, 14 nt, Escherichia coli CFT073
gaccuggucgcugg

SEQ ID NO: 2614864 - RNA, 18 nt, Escherichia coli CFT073
gaccuguugcccaugcuu

SEQ ID NO: 2614865 - RNA, 19 nt, Escherichia coli CFT073
gaccuucauagguaaacau

SEQ ID NO: 2614866 - RNA, 14 nt, Escherichia coli CFT073
gaccuuccagcgcu

SEQ ID NO: 2614867 - RNA, 14 nt, Escherichia coli CFT073
gaccuucugccaga

SEQ ID NO: 2614868 - RNA, 14 nt, Escherichia coli CFT073
gaccuugccaaggu

SEQ ID NO: 2614869 - RNA, 21 nt, Escherichia coli CFT073
gacgaaaacucgcuaaccacu

SEQ ID NO: 2614870 - RNA, 23 nt, Escherichia coli CFT073
gacgaaaacucgcuaaccacugu

SEQ ID NO: 2614871 - RNA, 18 nt, Escherichia coli CFT073
gacgaaagcgcaguaagc

SEQ ID NO: 2614872 - RNA, 13 nt, Escherichia coli CFT073
gacgaaccggcac

SEQ ID NO: 2614873 - RNA, 18 nt, Escherichia coli CFT073
gacgaauuucaucgcuac

SEQ ID NO: 2614874 - RNA, 13 nt, Escherichia coli CFT073
gacgacaggcaag

SEQ ID NO: 2614875 - RNA, 15 nt, Escherichia coli CFT073
gacgacaggcaagca

SEQ ID NO: 2614876 - RNA, 18 nt, Escherichia coli CFT073
gacgacaucgacucacca

SEQ ID NO: 2614877 - RNA, 20 nt, Escherichia coli CFT073
gacgacaugguagauaaccu

SEQ ID NO: 2614878 - RNA, 13 nt, Escherichia coli CFT073
gacgaccaguccg

SEQ ID NO: 2614879 - RNA, 17 nt, Escherichia coli CFT073
gacgaccgccgcucacc

SEQ ID NO: 2614880 - RNA, 15 nt, Escherichia coli CFT073
gacgaccuuuuccau

SEQ ID NO: 2614881 - RNA, 15 nt, Escherichia coli CFT073
gacgacgguuuccac

SEQ ID NO: 2614882 - RNA, 14 nt, Escherichia coli CFT073
gacgagagugacga

SEQ ID NO: 2614883 - RNA, 14 nt, Escherichia coli CFT073
gacgauacaacgcu

SEQ ID NO: 2614884 - RNA, 15 nt, Escherichia coli CFT073
gacgaucaacagaau

SEQ ID NO: 2614885 - RNA, 15 nt, Escherichia coli CFT073
gacgaucaacccagu

SEQ ID NO: 2614886 - RNA, 14 nt, Escherichia coli CFT073
gacgaucgccacuu

SEQ ID NO: 2614887 - RNA, 13 nt, Escherichia coli CFT073
gacgaucgcgcag

SEQ ID NO: 2614888 - RNA, 16 nt, Escherichia coli CFT073
gacgaucgcugaugaa

SEQ ID NO: 2614889 - RNA, 15 nt, Escherichia coli CFT073
gacgaugauuguccc

SEQ ID NO: 2614890 - RNA, 20 nt, Escherichia coli CFT073
gacgaugauugucccugcca

SEQ ID NO: 2614891 - RNA, 23 nt, Escherichia coli CFT073
gacgaugccgucgccauugcagc

SEQ ID NO: 2614892 - RNA, 16 nt, Escherichia coli CFT073
gacgauguuaccguuu

SEQ ID NO: 2614893 - RNA, 14 nt, Escherichia coli CFT073
gacgauuguagaaa

SEQ ID NO: 2614894 - RNA, 22 nt, Escherichia coli CFT073
gacgauuguagaaaaucucaau

SEQ ID NO: 2614895 - RNA, 17 nt, Escherichia coli CFT073
gacgauuuucccugagu

SEQ ID NO: 2614896 - RNA, 12 nt, Escherichia coli CFT073
gacgcaaacaac

SEQ ID NO: 2614897 - RNA, 18 nt, Escherichia coli CFT073
gacgcaacagaaacgcca

SEQ ID NO: 2614898 - RNA, 22 nt, Escherichia coli CFT073
gacgcaacugcgcuucaauacg

SEQ ID NO: 2614899 - RNA, 15 nt, Escherichia coli CFT073
gacgcagaucccacu

SEQ ID NO: 2614900 - RNA, 21 nt, Escherichia coli CFT073
gacgcaggcgcgcuguggugu

SEQ ID NO: 2614901 - RNA, 21 nt, Escherichia coli CFT073
gacgcauaauccaggcaucag

SEQ ID NO: 2614902 - RNA, 13 nt, Escherichia coli CFT073
gacgcauccggca

SEQ ID NO: 2614903 - RNA, 17 nt, Escherichia coli CFT073
gacgcaucgcccagcca

SEQ ID NO: 2614904 - RNA, 19 nt, Escherichia coli CFT073
gacgcaucuguaugucagu

SEQ ID NO: 2614905 - RNA, 16 nt, Escherichia coli CFT073
gacgccaauaccgauc

SEQ ID NO: 2614906 - RNA, 21 nt, Escherichia coli CFT073
gacgccaauaccgaucaguac

SEQ ID NO: 2614907 - RNA, 20 nt, Escherichia coli CFT073
gacgccacaacgauaaucca

SEQ ID NO: 2614908 - RNA, 12 nt, Escherichia coli CFT073
gacgccagaacc

SEQ ID NO: 2614909 - RNA, 12 nt, Escherichia coli CFT073
gacgccagcgcu

SEQ ID NO: 2614910 - RNA, 22 nt, Escherichia coli CFT073
gacgccagcguucaaacaccag

SEQ ID NO: 2614911 - RNA, 13 nt, Escherichia coli CFT073
gacgccaucaauu

SEQ ID NO: 2614912 - RNA, 18 nt, Escherichia coli CFT073
gacgccauugcuaucaac

SEQ ID NO: 2614913 - RNA, 12 nt, Escherichia coli CFT073
gacgcccagcgc

SEQ ID NO: 2614914 - RNA, 13 nt, Escherichia coli CFT073
gacgcccgcgccc

SEQ ID NO: 2614915 - RNA, 13 nt, Escherichia coli CFT073
gacgcccgggcuu

SEQ ID NO: 2614916 - RNA, 12 nt, Escherichia coli CFT073
gacgcccugcgc

SEQ ID NO: 2614917 - RNA, 19 nt, Escherichia coli CFT073
gacgcccugcgcgggugaa

SEQ ID NO: 2614918 - RNA, 14 nt, Escherichia coli CFT073
gacgcccugugcgc

SEQ ID NO: 2614919 - RNA, 16 nt, Escherichia coli CFT073
gacgcccugugcgccc

SEQ ID NO: 2614920 - RNA, 21 nt, Escherichia coli CFT073
gacgccgcuggugucgcaccu

SEQ ID NO: 2614921 - RNA, 18 nt, Escherichia coli CFT073
gacgccggauaucccccu

SEQ ID NO: 2614922 - RNA, 21 nt, Escherichia coli CFT073
gacgccguuccagauuccugc

SEQ ID NO: 2614923 - RNA, 15 nt, Escherichia coli CFT073
gacgccugcagcauc

SEQ ID NO: 2614924 - RNA, 17 nt, Escherichia coli CFT073
gacgccugcagcaucgg

SEQ ID NO: 2614925 - RNA, 19 nt, Escherichia coli CFT073
gacgccugcuccaucaucc

SEQ ID NO: 2614926 - RNA, 14 nt, Escherichia coli CFT073
gacgcgauccgccg

SEQ ID NO: 2614927 - RNA, 14 nt, Escherichia coli CFT073
gacgcgccagcgcc

SEQ ID NO: 2614928 - RNA, 14 nt, Escherichia coli CFT073
gacgcgcugaguca

SEQ ID NO: 2614929 - RNA, 15 nt, Escherichia coli CFT073
gacgcgcuuguccug

SEQ ID NO: 2614930 - RNA, 17 nt, Escherichia coli CFT073
gacgcggcacuccgcca

SEQ ID NO: 2614931 - RNA, 19 nt, Escherichia coli CFT073
gacgcggcagcgucgcauc

SEQ ID NO: 2614932 - RNA, 19 nt, Escherichia coli CFT073
gacgcggcaggcgucgcau

SEQ ID NO: 2614933 - RNA, 16 nt, Escherichia coli CFT073
gacgcgguaaaagccc

SEQ ID NO: 2614934 - RNA, 17 nt, Escherichia coli CFT073
gacgcgguauuggugaa

SEQ ID NO: 2614935 - RNA, 22 nt, Escherichia coli CFT073
gacgcguaaauccagcaccgcu

SEQ ID NO: 2614936 - RNA, 20 nt, Escherichia coli CFT073
gacgcguagugucgcaucag

SEQ ID NO: 2614937 - RNA, 12 nt, Escherichia coli CFT073
gacgcgucagug

SEQ ID NO: 2614938 - RNA, 18 nt, Escherichia coli CFT073
gacgcgucagugucuuau

SEQ ID NO: 2614939 - RNA, 18 nt, Escherichia coli CFT073
gacgcgucugcgucgcau

SEQ ID NO: 2614940 - RNA, 21 nt, Escherichia coli CFT073
gacgcgucugcgucgcaucug

SEQ ID NO: 2614941 - RNA, 18 nt, Escherichia coli CFT073
gacgcgucuuauccggcc

SEQ ID NO: 2614942 - RNA, 16 nt, Escherichia coli CFT073
gacgcgugcagaguca

SEQ ID NO: 2614943 - RNA, 17 nt, Escherichia coli CFT073
gacgcguggcgucgcau

SEQ ID NO: 2614944 - RNA, 13 nt, Escherichia coli CFT073
gacgcguuaagcg

SEQ ID NO: 2614945 - RNA, 22 nt, Escherichia coli CFT073
gacgcguuaagcgucgcaucag

SEQ ID NO: 2614946 - RNA, 22 nt, Escherichia coli CFT073
gacgcugaagucagcacaucca

SEQ ID NO: 2614947 - RNA, 18 nt, Escherichia coli CFT073
gacgcugaauaaucccca

SEQ ID NO: 2614948 - RNA, 13 nt, Escherichia coli CFT073
gacgcugaauacg

SEQ ID NO: 2614949 - RNA, 16 nt, Escherichia coli CFT073
gacgcugacgauugua

SEQ ID NO: 2614950 - RNA, 14 nt, Escherichia coli CFT073
gacgcuggcagcag

SEQ ID NO: 2614951 - RNA, 15 nt, Escherichia coli CFT073
gacgcuguccggcgc

SEQ ID NO: 2614952 - RNA, 17 nt, Escherichia coli CFT073
gacgcuguccggcgcac

SEQ ID NO: 2614953 - RNA, 17 nt, Escherichia coli CFT073
gacgcuuacucuuucaa

SEQ ID NO: 2614954 - RNA, 15 nt, Escherichia coli CFT073
gacgcuuaucuuccg

SEQ ID NO: 2614955 - RNA, 16 nt, Escherichia coli CFT073
gacggaaaagacuaua

SEQ ID NO: 2614956 - RNA, 17 nt, Escherichia coli CFT073
gacggaacaucugcccc

SEQ ID NO: 2614957 - RNA, 16 nt, Escherichia coli CFT073
gacggaauaaacccac

SEQ ID NO: 2614958 - RNA, 13 nt, Escherichia coli CFT073
gacggaauuauca

SEQ ID NO: 2614959 - RNA, 20 nt, Escherichia coli CFT073
gacggaucuuccagcgcauc

SEQ ID NO: 2614960 - RNA, 22 nt, Escherichia coli CFT073
gacggccaguuugacaucguca

SEQ ID NO: 2614961 - RNA, 15 nt, Escherichia coli CFT073
gacggccaucccagu

SEQ ID NO: 2614962 - RNA, 21 nt, Escherichia coli CFT073
gacggccccgcgccagcgggc

SEQ ID NO: 2614963 - RNA, 14 nt, Escherichia coli CFT073
gacggcgacgcgcg

SEQ ID NO: 2614964 - RNA, 12 nt, Escherichia coli CFT073
gacggcgagcgu

SEQ ID NO: 2614965 - RNA, 17 nt, Escherichia coli CFT073
gacggcgcacaggcaau

SEQ ID NO: 2614966 - RNA, 13 nt, Escherichia coli CFT073
gacggcguucuuu

SEQ ID NO: 2614967 - RNA, 15 nt, Escherichia coli CFT073
gacggcuccccgccc

SEQ ID NO: 2614968 - RNA, 14 nt, Escherichia coli CFT073
gacggcugauaugc

SEQ ID NO: 2614969 - RNA, 15 nt, Escherichia coli CFT073
gacggcuggcaaaaa

SEQ ID NO: 2614970 - RNA, 20 nt, Escherichia coli CFT073
gacggcugucauccagcagu

SEQ ID NO: 2614971 - RNA, 22 nt, Escherichia coli CFT073
gacuuuacuaauagcaaaauau

SEQ ID NO: 2614972 - RNA, 21 nt, Escherichia coli CFT073
gacuuuauagaucaggaaaaa

SEQ ID NO: 2614973 - RNA, 21 nt, Escherichia coli CFT073
gacuuucaaacgccacagcaa

SEQ ID NO: 2614974 - RNA, 20 nt, Escherichia coli CFT073
gacuuucuccgcauccggcg

SEQ ID NO: 2614975 - RNA, 18 nt, Escherichia coli CFT073
gacuuugccuggcggcag

SEQ ID NO: 2614976 - RNA, 19 nt, Escherichia coli CFT073
gacuuugccuggcggcaga

SEQ ID NO: 2614977 - RNA, 23 nt, Escherichia coli CFT073
gacuuuuacugucugcucggaaa

SEQ ID NO: 2614978 - RNA, 12 nt, Escherichia coli CFT073
gacuuuucagau

SEQ ID NO: 2614979 - RNA, 15 nt, Escherichia coli CFT073
gacuuuugcccggca

SEQ ID NO: 2614980 - RNA, 10 nt, Escherichia coli CFT073
gagaaaaagc

SEQ ID NO: 2614981 - RNA, 14 nt, Escherichia coli CFT073
gagaaaaagcgaag

SEQ ID NO: 2614982 - RNA, 18 nt, Escherichia coli CFT073
gagaaaaucggccagaga

SEQ ID NO: 2614983 - RNA, 19 nt, Escherichia coli CFT073
gagaaaaugccgcacauca

SEQ ID NO: 2614984 - RNA, 22 nt, Escherichia coli CFT073
gagaaaauguauuucaucauca

SEQ ID NO: 2614985 - RNA, 13 nt, Escherichia coli CFT073
gagaaaccacauc

SEQ ID NO: 2614986 - RNA, 22 nt, Escherichia coli CFT073
gagaaagccaauuugcgccgcc

SEQ ID NO: 2614987 - RNA, 23 nt, Escherichia coli CFT073
gagaaaguuucaaaggugccaau

SEQ ID NO: 2614988 - RNA, 15 nt, Escherichia coli CFT073
gagaaauagagaaau

SEQ ID NO: 2614989 - RNA, 21 nt, Escherichia coli CFT073
gagaaauauaaagaaugaaau

SEQ ID NO: 2614990 - RNA, 15 nt, Escherichia coli CFT073
gagaaauaucagcag

SEQ ID NO: 2614991 - RNA, 16 nt, Escherichia coli CFT073
gagaaauaucagcagc

SEQ ID NO: 2614992 - RNA, 17 nt, Escherichia coli CFT073
gagaaauaucagcagca

SEQ ID NO: 2614993 - RNA, 19 nt, Escherichia coli CFT073
gagaacaagauugccugau

SEQ ID NO: 2614994 - RNA, 23 nt, Escherichia coli CFT073
gagaacaccgaaccaaaguagau

SEQ ID NO: 2614995 - RNA, 16 nt, Escherichia coli CFT073
gagaacacgaccugcc

SEQ ID NO: 2614996 - RNA, 11 nt, Escherichia coli CFT073
gagaacagaua

SEQ ID NO: 2614997 - RNA, 18 nt, Escherichia coli CFT073
gagaacaucauccccaca

SEQ ID NO: 2614998 - RNA, 12 nt, Escherichia coli CFT073
gagaacgaugcu

SEQ ID NO: 2614999 - RNA, 17 nt, Escherichia coli CFT073
gagaacggaucaggcag

SEQ ID NO: 2615000 - RNA, 18 nt, Escherichia coli CFT073
gagaacgucgcagggaga

SEQ ID NO: 2615001 - RNA, 12 nt, Escherichia coli CFT073
gagaacugcugc

SEQ ID NO: 2615002 - RNA, 13 nt, Escherichia coli CFT073
gagaagauccaug

SEQ ID NO: 2615003 - RNA, 13 nt, Escherichia coli CFT073
gagaagcaccgcc

SEQ ID NO: 2615004 - RNA, 13 nt, Escherichia coli CFT073
gagaagccaggua

SEQ ID NO: 2615005 - RNA, 15 nt, Escherichia coli CFT073
gagaagccagguaga

SEQ ID NO: 2615006 - RNA, 17 nt, Escherichia coli CFT073
gagaagcugcugccgcu

SEQ ID NO: 2615007 - RNA, 16 nt, Escherichia coli CFT073
gagaaggcguucacgc

SEQ ID NO: 2615008 - RNA, 15 nt, Escherichia coli CFT073
gagaauaaaacaagc

SEQ ID NO: 2615009 - RNA, 22 nt, Escherichia coli CFT073
gagaauaaaacaagcagcugcc

SEQ ID NO: 2615010 - RNA, 22 nt, Escherichia coli CFT073
gagaauaaagcuuuaauauccg

SEQ ID NO: 2615011 - RNA, 14 nt, Escherichia coli CFT073
gagaauagcgccau

SEQ ID NO: 2615012 - RNA, 19 nt, Escherichia coli CFT073
gagaauagcgccaucgcga

SEQ ID NO: 2615013 - RNA, 21 nt, Escherichia coli CFT073
gagaauagcgccaucgcgacg

SEQ ID NO: 2615014 - RNA, 22 nt, Escherichia coli CFT073
gagaauauguuuuuaaaccaac

SEQ ID NO: 2615015 - RNA, 15 nt, Escherichia coli CFT073
gagaauauugccggg

SEQ ID NO: 2615016 - RNA, 18 nt, Escherichia coli CFT073
gagaaucaacacaccgcc

SEQ ID NO: 2615017 - RNA, 23 nt, Escherichia coli CFT073
gagaauccagccccaccagcaaa

SEQ ID NO: 2615018 - RNA, 21 nt, Escherichia coli CFT073
gagaaugacgacaaagaccug

SEQ ID NO: 2615019 - RNA, 12 nt, Escherichia coli CFT073
gagaaugccagc

SEQ ID NO: 2615020 - RNA, 14 nt, Escherichia coli CFT073
gagaaugccagcag

SEQ ID NO: 2615021 - RNA, 16 nt, Escherichia coli CFT073
gagaaugccagcagca

SEQ ID NO: 2615022 - RNA, 18 nt, Escherichia coli CFT073
gagaaugccagcagcacc

SEQ ID NO: 2615023 - RNA, 16 nt, Escherichia coli CFT073
gagaauguagauauua

SEQ ID NO: 2615024 - RNA, 14 nt, Escherichia coli CFT073
gagaauuaaccaga

SEQ ID NO: 2615025 - RNA, 14 nt, Escherichia coli CFT073
gagacaacccgcca

SEQ ID NO: 2615026 - RNA, 14 nt, Escherichia coli CFT073
gagacaccagcguc

SEQ ID NO: 2615027 - RNA, 19 nt, Escherichia coli CFT073
gagacacugcgaucgcccg

SEQ ID NO: 2615028 - RNA, 13 nt, Escherichia coli CFT073
gagacagauuuau

SEQ ID NO: 2615029 - RNA, 19 nt, Escherichia coli CFT073
gagacauuacguccaucac

SEQ ID NO: 2615030 - RNA, 19 nt, Escherichia coli CFT073
gagacauuggcaaaaccaa

SEQ ID NO: 2615031 - RNA, 19 nt, Escherichia coli CFT073
gagacgaggauuucgccgc

SEQ ID NO: 2615032 - RNA, 14 nt, Escherichia coli CFT073
gagacggggauacu

SEQ ID NO: 2615033 - RNA, 15 nt, Escherichia coli CFT073
gagacggggauacuc

SEQ ID NO: 2615034 - RNA, 19 nt, Escherichia coli CFT073
gagacgguauuacccggcc

SEQ ID NO: 2615035 - RNA, 20 nt, Escherichia coli CFT073
gagacgguauuacccggccc

SEQ ID NO: 2615036 - RNA, 19 nt, Escherichia coli CFT073
gagacucaccaaucggcag

SEQ ID NO: 2615037 - RNA, 13 nt, Escherichia coli CFT073
gagagaacugcug

SEQ ID NO: 2615038 - RNA, 13 nt, Escherichia coli CFT073
gagagaagccagg

SEQ ID NO: 2615039 - RNA, 20 nt, Escherichia coli CFT073
gagagaagcgcguucauccc

SEQ ID NO: 2615040 - RNA, 23 nt, Escherichia coli CFT073
gagagcaaacaccgcuucaacag

SEQ ID NO: 2615041 - RNA, 17 nt, Escherichia coli CFT073
gagagcaaccagcaaug

SEQ ID NO: 2615042 - RNA, 11 nt, Escherichia coli CFT073
gagagccuucg

SEQ ID NO: 2615043 - RNA, 12 nt, Escherichia coli CFT073
gagagcggaggu

SEQ ID NO: 2615044 - RNA, 22 nt, Escherichia coli CFT073
gagaggcugaaggcgcuccccu

SEQ ID NO: 2615045 - RNA, 18 nt, Escherichia coli CFT073
gagagucauuaugcugga

SEQ ID NO: 2615046 - RNA, 18 nt, Escherichia coli CFT073
gagaguguuuuaucugug

SEQ ID NO: 2615047 - RNA, 18 nt, Escherichia coli CFT073
gagaguuagcguccggcu

SEQ ID NO: 2615048 - RNA, 15 nt, Escherichia coli CFT073
gagaguugcaccagc

SEQ ID NO: 2615049 - RNA, 20 nt, Escherichia coli CFT073
gagauaaaaacucaaaaaaa

SEQ ID NO: 2615050 - RNA, 20 nt, Escherichia coli CFT073
gagauaaaugccaaagaaug

SEQ ID NO: 2615051 - RNA, 22 nt, Escherichia coli CFT073
gagauaaccacguucauuucgu

SEQ ID NO: 2615052 - RNA, 15 nt, Escherichia coli CFT073
gagauaagcaacaaa

SEQ ID NO: 2615053 - RNA, 17 nt, Escherichia coli CFT073
gagauaagcaacaaacu

SEQ ID NO: 2615054 - RNA, 22 nt, Escherichia coli CFT073
gagauaaucgcgguuacucugu

SEQ ID NO: 2615055 - RNA, 15 nt, Escherichia coli CFT073
gagauaaugcgccag

SEQ ID NO: 2615056 - RNA, 18 nt, Escherichia coli CFT073
gagauacaggccaccgcc

SEQ ID NO: 2615057 - RNA, 21 nt, Escherichia coli CFT073
gagauacucaagcaaccaggu

SEQ ID NO: 2615058 - RNA, 15 nt, Escherichia coli CFT073
gagauauuccccaga

SEQ ID NO: 2615059 - RNA, 16 nt, Escherichia coli CFT073
gagauauuccccagac

SEQ ID NO: 2615060 - RNA, 16 nt, Escherichia coli CFT073
gagauauuucaccagc

SEQ ID NO: 2615061 - RNA, 16 nt, Escherichia coli CFT073
gagaucaaugcgccaa

SEQ ID NO: 2615062 - RNA, 18 nt, Escherichia coli CFT073
gagaucaccacauacugc

SEQ ID NO: 2615063 - RNA, 16 nt, Escherichia coli CFT073
gagaucaccuugcagu

SEQ ID NO: 2615064 - RNA, 21 nt, Escherichia coli CFT073
gagaucaccuugcaguuguaa

SEQ ID NO: 2615065 - RNA, 18 nt, Escherichia coli CFT073
gagauccagcuucgccag

SEQ ID NO: 2615066 - RNA, 12 nt, Escherichia coli CFT073
gagauccaggcc

SEQ ID NO: 2615067 - RNA, 16 nt, Escherichia coli CFT073
gagaucccccgcacac

SEQ ID NO: 2615068 - RNA, 16 nt, Escherichia coli CFT073
gagaucccuuccggug

SEQ ID NO: 2615069 - RNA, 22 nt, Escherichia coli CFT073
gagaucgaccggauuagucugg

SEQ ID NO: 2615070 - RNA, 15 nt, Escherichia coli CFT073
gagaucgagcgccgu

SEQ ID NO: 2615071 - RNA, 23 nt, Escherichia coli CFT073
gagaucguuaugcaaaugagaau

SEQ ID NO: 2615072 - RNA, 17 nt, Escherichia coli CFT073
gagaucuuucacgccca

SEQ ID NO: 2615073 - RNA, 15 nt, Escherichia coli CFT073
gagaugaauuuauaa

SEQ ID NO: 2615074 - RNA, 18 nt, Escherichia coli CFT073
gagaugacgccacuggcu

SEQ ID NO: 2615075 - RNA, 18 nt, Escherichia coli CFT073
gagaugggugugcugacc

SEQ ID NO: 2615076 - RNA, 14 nt, Escherichia coli CFT073
gagauguugcugcu

SEQ ID NO: 2615077 - RNA, 15 nt, Escherichia coli CFT073
gagauguugcugcuc

SEQ ID NO: 2615078 - RNA, 14 nt, Escherichia coli CFT073
gagauuaaacgcau

SEQ ID NO: 2615079 - RNA, 20 nt, Escherichia coli CFT073
gagauucauccaguuccagu

SEQ ID NO: 2615080 - RNA, 18 nt, Escherichia coli CFT073
gagggacuccggauucaa

SEQ ID NO: 2615081 - RNA, 22 nt, Escherichia coli CFT073
gagggagcagauacggcgcauc

SEQ ID NO: 2615082 - RNA, 17 nt, Escherichia coli CFT073
gagggcauagcgcagcg

SEQ ID NO: 2615083 - RNA, 19 nt, Escherichia coli CFT073
gagggcgauuauccgccag

SEQ ID NO: 2615084 - RNA, 12 nt, Escherichia coli CFT073
gaggggaacacg

SEQ ID NO: 2615085 - RNA, 23 nt, Escherichia coli CFT073
gaggggaacacggcuuucugcaa

SEQ ID NO: 2615086 - RNA, 20 nt, Escherichia coli CFT073
gaggggaacccguuggcaca

SEQ ID NO: 2615087 - RNA, 19 nt, Escherichia coli CFT073
gagggugacaucaaucagc

SEQ ID NO: 2615088 - RNA, 11 nt, Escherichia coli CFT073
gaggguggcac

SEQ ID NO: 2615089 - RNA, 15 nt, Escherichia coli CFT073
gaggguuucuggcua

SEQ ID NO: 2615090 - RNA, 23 nt, Escherichia coli CFT073
gaggguuucuucaaacugcagca

SEQ ID NO: 2615091 - RNA, 23 nt, Escherichia coli CFT073
gagguaaauuugccaucucugca

SEQ ID NO: 2615092 - RNA, 19 nt, Escherichia coli CFT073
gagguagcgauagaaauca

SEQ ID NO: 2615093 - RNA, 22 nt, Escherichia coli CFT073
gagguauacgcuguggcgcugg

SEQ ID NO: 2615094 - RNA, 18 nt, Escherichia coli CFT073
gaggucgguauuguccgu

SEQ ID NO: 2615095 - RNA, 21 nt, Escherichia coli CFT073
gaggugcugaagggcaucagc

SEQ ID NO: 2615096 - RNA, 21 nt, Escherichia coli CFT073
gaggugugaaaccuuuaugca

SEQ ID NO: 2615097 - RNA, 18 nt, Escherichia coli CFT073
gagguucagccgagcacg

SEQ ID NO: 2615098 - RNA, 16 nt, Escherichia coli CFT073
gaguaaaaaaacauca

SEQ ID NO: 2615099 - RNA, 15 nt, Escherichia coli CFT073
gaguaaacggcagag

SEQ ID NO: 2615100 - RNA, 14 nt, Escherichia coli CFT073
gaguaaagcccgcc

SEQ ID NO: 2615101 - RNA, 23 nt, Escherichia coli CFT073
gaguaaagcccgccaucgcccau

SEQ ID NO: 2615102 - RNA, 13 nt, Escherichia coli CFT073
gaguaaauauagc

SEQ ID NO: 2615103 - RNA, 14 nt, Escherichia coli CFT073
gaguaaaucagagg

SEQ ID NO: 2615104 - RNA, 14 nt, Escherichia coli CFT073
gaguaacagauugu

SEQ ID NO: 2615105 - RNA, 15 nt, Escherichia coli CFT073
gaguaaggcaaggau

SEQ ID NO: 2615106 - RNA, 15 nt, Escherichia coli CFT073
gaguaaugcaugacu

SEQ ID NO: 2615107 - RNA, 17 nt, Escherichia coli CFT073
gaguacgccauuucggg

SEQ ID NO: 2615108 - RNA, 23 nt, Escherichia coli CFT073
gaguacgugaguaguggaaaccg

SEQ ID NO: 2615109 - RNA, 12 nt, Escherichia coli CFT073
gaguagcccuuc

SEQ ID NO: 2615110 - RNA, 21 nt, Escherichia coli CFT073
gaguagcucaccagcaggcac

SEQ ID NO: 2615111 - RNA, 17 nt, Escherichia coli CFT073
gaguaguggaaaccggc

SEQ ID NO: 2615112 - RNA, 22 nt, Escherichia coli CFT073
gaguaugugacuggaaaucaaa

SEQ ID NO: 2615113 - RNA, 21 nt, Escherichia coli CFT073
gaguauugcuuugcugugaag

SEQ ID NO: 2615114 - RNA, 12 nt, Escherichia coli CFT073
gagucagcagcg

SEQ ID NO: 2615115 - RNA, 13 nt, Escherichia coli CFT073
gagucagucccug

SEQ ID NO: 2615116 - RNA, 15 nt, Escherichia coli CFT073
gagucauuguaaauu

SEQ ID NO: 2615117 - RNA, 18 nt, Escherichia coli CFT073
gaguccgguagcgagggu

SEQ ID NO: 2615118 - RNA, 17 nt, Escherichia coli CFT073
gagucuuucagacugag

SEQ ID NO: 2615119 - RNA, 11 nt, Escherichia coli CFT073
gagugaacacg

SEQ ID NO: 2615120 - RNA, 13 nt, Escherichia coli CFT073
gagugaacccccu

SEQ ID NO: 2615121 - RNA, 19 nt, Escherichia coli CFT073
gagugacaguucaaucucc

SEQ ID NO: 2615122 - RNA, 14 nt, Escherichia coli CFT073
gagugcaauaacgu

SEQ ID NO: 2615123 - RNA, 20 nt, Escherichia coli CFT073
gagugcagcacucgauucca

SEQ ID NO: 2615124 - RNA, 21 nt, Escherichia coli CFT073
gagugccagauugaagcagau

SEQ ID NO: 2615125 - RNA, 23 nt, Escherichia coli CFT073
gagugcgaaacagaaauagagaa

SEQ ID NO: 2615126 - RNA, 19 nt, Escherichia coli CFT073
gagugcgguuuugucggca

SEQ ID NO: 2615127 - RNA, 15 nt, Escherichia coli CFT073
gaguggaagcccaaa

SEQ ID NO: 2615128 - RNA, 18 nt, Escherichia coli CFT073
gaguggauuaucuucacc

SEQ ID NO: 2615129 - RNA, 15 nt, Escherichia coli CFT073
gaguggcccagguua

SEQ ID NO: 2615130 - RNA, 18 nt, Escherichia coli CFT073
gagugguuagagcacaga

SEQ ID NO: 2615131 - RNA, 15 nt, Escherichia coli CFT073
gaguguauucaugcc

SEQ ID NO: 2615132 - RNA, 21 nt, Escherichia coli CFT073
gagugugauuacagccaggcg

SEQ ID NO: 2615133 - RNA, 20 nt, Escherichia coli CFT073
gaguguuacgccugccgcau

SEQ ID NO: 2615134 - RNA, 13 nt, Escherichia coli CFT073
gaguguuccucug

SEQ ID NO: 2615135 - RNA, 19 nt, Escherichia coli CFT073
gaguuaccagcggccagac

SEQ ID NO: 2615136 - RNA, 18 nt, Escherichia coli CFT073
gaguuagaagccaguaca

SEQ ID NO: 2615137 - RNA, 14 nt, Escherichia coli CFT073
gaguucacugccgu

SEQ ID NO: 2615138 - RNA, 19 nt, Escherichia coli CFT073
gaguucgcgcgcugccaga

SEQ ID NO: 2615139 - RNA, 15 nt, Escherichia coli CFT073
gaguugaucgccaga

SEQ ID NO: 2615140 - RNA, 13 nt, Escherichia coli CFT073
gaguugcaccagc

SEQ ID NO: 2615141 - RNA, 12 nt, Escherichia coli CFT073
gaguugcagauu

SEQ ID NO: 2615142 - RNA, 18 nt, Escherichia coli CFT073
gaguugccauccggcuga

SEQ ID NO: 2615143 - RNA, 20 nt, Escherichia coli CFT073
gaguugguuauucaaagcga

SEQ ID NO: 2615144 - RNA, 17 nt, Escherichia coli CFT073
gaguuguaauuuaaauc

SEQ ID NO: 2615145 - RNA, 18 nt, Escherichia coli CFT073
gaguuguaauuuaaauca

SEQ ID NO: 2615146 - RNA, 15 nt, Escherichia coli CFT073
gaguuuacgcagcag

SEQ ID NO: 2615147 - RNA, 13 nt, Escherichia coli CFT073
gaguuugaugacc

SEQ ID NO: 2615148 - RNA, 21 nt, Escherichia coli CFT073
gaguuugccaccaacaguaau

SEQ ID NO: 2615149 - RNA, 15 nt, Escherichia coli CFT073
gaguuuuaaacgcag

SEQ ID NO: 2615150 - RNA, 16 nt, Escherichia coli CFT073
gaguuuucaguaccgc

SEQ ID NO: 2615151 - RNA, 14 nt, Escherichia coli CFT073
gaguuuuuccuuuc

SEQ ID NO: 2615152 - RNA, 12 nt, Escherichia coli CFT073
gauaaaaacgaa

SEQ ID NO: 2615153 - RNA, 23 nt, Escherichia coli CFT073
gauaaaaacucaaaaaaaauuuu

SEQ ID NO: 2615154 - RNA, 13 nt, Escherichia coli CFT073
gauaaaacauuac

SEQ ID NO: 2615155 - RNA, 15 nt, Escherichia coli CFT073
gauaaaacugccaga

SEQ ID NO: 2615156 - RNA, 18 nt, Escherichia coli CFT073
gauaaaagaccacaauca

SEQ ID NO: 2615157 - RNA, 20 nt, Escherichia coli CFT073
gauaaacaucgggacaugau

SEQ ID NO: 2615158 - RNA, 19 nt, Escherichia coli CFT073
gauaaaccgaucgccguua

SEQ ID NO: 2615159 - RNA, 19 nt, Escherichia coli CFT073
gauaaaccuccagcaucag

SEQ ID NO: 2615160 - RNA, 14 nt, Escherichia coli CFT073
gauaaacuccugca

SEQ ID NO: 2615161 - RNA, 19 nt, Escherichia coli CFT073
gauaaagcccccacaacau

SEQ ID NO: 2615162 - RNA, 20 nt, Escherichia coli CFT073
gauaaagcccccacaacauu

SEQ ID NO: 2615163 - RNA, 19 nt, Escherichia coli CFT073
gauaaagcgaccaaccauc

SEQ ID NO: 2615164 - RNA, 23 nt, Escherichia coli CFT073
gauaaagcgaccaaccaucaucc

SEQ ID NO: 2615165 - RNA, 15 nt, Escherichia coli CFT073
gauaaagcgauccag

SEQ ID NO: 2615166 - RNA, 16 nt, Escherichia coli CFT073
gauaaagcgauccagu

SEQ ID NO: 2615167 - RNA, 13 nt, Escherichia coli CFT073
gauaaagcugggu

SEQ ID NO: 2615168 - RNA, 21 nt, Escherichia coli CFT073
gauaaagcugucaccucugca

SEQ ID NO: 2615169 - RNA, 16 nt, Escherichia coli CFT073
gauaaaggucaucaca

SEQ ID NO: 2615170 - RNA, 14 nt, Escherichia coli CFT073
gauaaauaaaauaa

SEQ ID NO: 2615171 - RNA, 12 nt, Escherichia coli CFT073
gauaaauauuau

SEQ ID NO: 2615172 - RNA, 14 nt, Escherichia coli CFT073
gauaaauauuauug

SEQ ID NO: 2615173 - RNA, 22 nt, Escherichia coli CFT073
gauaaaucgauaacgcgcugcc

SEQ ID NO: 2615174 - RNA, 19 nt, Escherichia coli CFT073
gauaaaucgcacguugcca

SEQ ID NO: 2615175 - RNA, 20 nt, Escherichia coli CFT073
gauaaauggcguaugccgga

SEQ ID NO: 2615176 - RNA, 20 nt, Escherichia coli CFT073
gauaaauucguuuucgcgcu

SEQ ID NO: 2615177 - RNA, 15 nt, Escherichia coli CFT073
gauaacaaucaccaa

SEQ ID NO: 2615178 - RNA, 16 nt, Escherichia coli CFT073
gauaacaaucaccaaa

SEQ ID NO: 2615179 - RNA, 21 nt, Escherichia coli CFT073
gauaacaaucaucaacccgcg

SEQ ID NO: 2615180 - RNA, 15 nt, Escherichia coli CFT073
gauaacacagcggca

SEQ ID NO: 2615181 - RNA, 13 nt, Escherichia coli CFT073
gauaaccacguuc

SEQ ID NO: 2615182 - RNA, 17 nt, Escherichia coli CFT073
gauaaccacuaccguag

SEQ ID NO: 2615183 - RNA, 20 nt, Escherichia coli CFT073
gauaaccgccgccaaacugu

SEQ ID NO: 2615184 - RNA, 22 nt, Escherichia coli CFT073
gauaaccgguuacggauuuccc

SEQ ID NO: 2615185 - RNA, 17 nt, Escherichia coli CFT073
gauaacgaauugcugcg

SEQ ID NO: 2615186 - RNA, 20 nt, Escherichia coli CFT073
gauaacgcccucuaaaauaa

SEQ ID NO: 2615187 - RNA, 19 nt, Escherichia coli CFT073
gauaacgccuggcaguggu

SEQ ID NO: 2615188 - RNA, 16 nt, Escherichia coli CFT073
gauaggugguauagaa

SEQ ID NO: 2615189 - RNA, 17 nt, Escherichia coli CFT073
gauagucguugccacac

SEQ ID NO: 2615190 - RNA, 18 nt, Escherichia coli CFT073
gauagugcccggcaauac

SEQ ID NO: 2615191 - RNA, 20 nt, Escherichia coli CFT073
gauagugcugccaucuucuu

SEQ ID NO: 2615192 - RNA, 20 nt, Escherichia coli CFT073
gauaguuucacggcaccagc

SEQ ID NO: 2615193 - RNA, 22 nt, Escherichia coli CFT073
gauauaaacggucuacauugcu

SEQ ID NO: 2615194 - RNA, 14 nt, Escherichia coli CFT073
gauauaaauuccac

SEQ ID NO: 2615195 - RNA, 15 nt, Escherichia coli CFT073
gauauaaccauggcu

SEQ ID NO: 2615196 - RNA, 22 nt, Escherichia coli CFT073
gauauacaccggcaucaacggg

SEQ ID NO: 2615197 - RNA, 16 nt, Escherichia coli CFT073
gauauacaccugauaa

SEQ ID NO: 2615198 - RNA, 21 nt, Escherichia coli CFT073
gauauacgccacuucaucguc

SEQ ID NO: 2615199 - RNA, 20 nt, Escherichia coli CFT073
gauauacgcuuucagcacuu

SEQ ID NO: 2615200 - RNA, 17 nt, Escherichia coli CFT073
gauauagaccaucggcg

SEQ ID NO: 2615201 - RNA, 22 nt, Escherichia coli CFT073
gauauagaccaucggcgcuggc

SEQ ID NO: 2615202 - RNA, 18 nt, Escherichia coli CFT073
gauauaugucaccagcau

SEQ ID NO: 2615203 - RNA, 21 nt, Escherichia coli CFT073
gauauaugucaccagcauuag

SEQ ID NO: 2615204 - RNA, 22 nt, Escherichia coli CFT073
gauaucaauguauuguucgugc

SEQ ID NO: 2615205 - RNA, 19 nt, Escherichia coli CFT073
gauauccacccgcagccau

SEQ ID NO: 2615206 - RNA, 22 nt, Escherichia coli CFT073
gauauccacccgcagccaucac

SEQ ID NO: 2615207 - RNA, 19 nt, Escherichia coli CFT073
gauauccaccgucaaaucc

SEQ ID NO: 2615208 - RNA, 21 nt, Escherichia coli CFT073
gauauccagaccgcgcuugcc

SEQ ID NO: 2615209 - RNA, 22 nt, Escherichia coli CFT073
gauaucccaggcaaaauccuuc

SEQ ID NO: 2615210 - RNA, 15 nt, Escherichia coli CFT073
gauaucccauuuacu

SEQ ID NO: 2615211 - RNA, 16 nt, Escherichia coli CFT073
gauaucccgccagcac

SEQ ID NO: 2615212 - RNA, 23 nt, Escherichia coli CFT073
gauaucccgccagcaccagcaac

SEQ ID NO: 2615213 - RNA, 17 nt, Escherichia coli CFT073
gauauccugaaacgcgg

SEQ ID NO: 2615214 - RNA, 20 nt, Escherichia coli CFT073
gauauccugaaacgcggcgu

SEQ ID NO: 2615215 - RNA, 14 nt, Escherichia coli CFT073
gauauccuggucaa

SEQ ID NO: 2615216 - RNA, 23 nt, Escherichia coli CFT073
gauaucgcggauaugcagcagcc

SEQ ID NO: 2615217 - RNA, 19 nt, Escherichia coli CFT073
gauaucgugcgggaccagc

SEQ ID NO: 2615218 - RNA, 20 nt, Escherichia coli CFT073
gauaucgugcgggaccagca

SEQ ID NO: 2615219 - RNA, 13 nt, Escherichia coli CFT073
gauaucguugauu

SEQ ID NO: 2615220 - RNA, 14 nt, Escherichia coli CFT073
gauaucugaaaguu

SEQ ID NO: 2615221 - RNA, 15 nt, Escherichia coli CFT073
gauaucuuucacaaa

SEQ ID NO: 2615222 - RNA, 15 nt, Escherichia coli CFT073
gauaugaaugauaug

SEQ ID NO: 2615223 - RNA, 21 nt, Escherichia coli CFT073
gauaugagacaccuguaaguu

SEQ ID NO: 2615224 - RNA, 22 nt, Escherichia coli CFT073
gauaugaucaucaccuuacugg

SEQ ID NO: 2615225 - RNA, 17 nt, Escherichia coli CFT073
gauaugauguaacaguu

SEQ ID NO: 2615226 - RNA, 14 nt, Escherichia coli CFT073
gauaugcagcagcc

SEQ ID NO: 2615227 - RNA, 21 nt, Escherichia coli CFT073
gauaugccccagcccgccaau

SEQ ID NO: 2615228 - RNA, 17 nt, Escherichia coli CFT073
gauaugccggcaucaaa

SEQ ID NO: 2615229 - RNA, 17 nt, Escherichia coli CFT073
gauaugggcagcucuau

SEQ ID NO: 2615230 - RNA, 15 nt, Escherichia coli CFT073
gauauguauuauaag

SEQ ID NO: 2615231 - RNA, 20 nt, Escherichia coli CFT073
gauaugugcagaagcccagu

SEQ ID NO: 2615232 - RNA, 23 nt, Escherichia coli CFT073
gauauguucaggauauuuauauu

SEQ ID NO: 2615233 - RNA, 18 nt, Escherichia coli CFT073
gauauuaauuuguauggu

SEQ ID NO: 2615234 - RNA, 18 nt, Escherichia coli CFT073
gauauuacauaccagcag

SEQ ID NO: 2615235 - RNA, 17 nt, Escherichia coli CFT073
gauauuaucgaaaccaa

SEQ ID NO: 2615236 - RNA, 15 nt, Escherichia coli CFT073
gauauucauagagaa

SEQ ID NO: 2615237 - RNA, 17 nt, Escherichia coli CFT073
gauauuccccagacgag

SEQ ID NO: 2615238 - RNA, 23 nt, Escherichia coli CFT073
gauauuccccagacgagagugac

SEQ ID NO: 2615239 - RNA, 20 nt, Escherichia coli CFT073
gauauugauucaucucuucu

SEQ ID NO: 2615240 - RNA, 21 nt, Escherichia coli CFT073
gauauugcccguuauucccac

SEQ ID NO: 2615241 - RNA, 19 nt, Escherichia coli CFT073
gauauugcccuucacuuca

SEQ ID NO: 2615242 - RNA, 18 nt, Escherichia coli CFT073
gauauugcuccagacguu

SEQ ID NO: 2615243 - RNA, 20 nt, Escherichia coli CFT073
gauauuggucaccacggcca

SEQ ID NO: 2615244 - RNA, 20 nt, Escherichia coli CFT073
gauauugucgcccuguaauu

SEQ ID NO: 2615245 - RNA, 18 nt, Escherichia coli CFT073
gauauuguuugcuggcaa

SEQ ID NO: 2615246 - RNA, 16 nt, Escherichia coli CFT073
gauauuuauuuccuuc

SEQ ID NO: 2615247 - RNA, 13 nt, Escherichia coli CFT073
gauauuugccgcg

SEQ ID NO: 2615248 - RNA, 21 nt, Escherichia coli CFT073
gauauuuuucccugaagguug

SEQ ID NO: 2615249 - RNA, 17 nt, Escherichia coli CFT073
gauauuuuuuuccuaaa

SEQ ID NO: 2615250 - RNA, 19 nt, Escherichia coli CFT073
gaucaaaccucaccucaau

SEQ ID NO: 2615251 - RNA, 14 nt, Escherichia coli CFT073
gaucaaauaaccgg

SEQ ID NO: 2615252 - RNA, 17 nt, Escherichia coli CFT073
gaucaaauaaccgguau

SEQ ID NO: 2615253 - RNA, 16 nt, Escherichia coli CFT073
gaucaaauacuucaau

SEQ ID NO: 2615254 - RNA, 13 nt, Escherichia coli CFT073
gaucaaauccaau

SEQ ID NO: 2615255 - RNA, 15 nt, Escherichia coli CFT073
gaucaacagaaugau

SEQ ID NO: 2615256 - RNA, 21 nt, Escherichia coli CFT073
gaucaaccaccgucgucccuu

SEQ ID NO: 2615257 - RNA, 23 nt, Escherichia coli CFT073
gaucaaccgcgacauacuuaaau

SEQ ID NO: 2615258 - RNA, 12 nt, Escherichia coli CFT073
gaucaagcgaac

SEQ ID NO: 2615259 - RNA, 19 nt, Escherichia coli CFT073
gaucaaggcauauaccaca

SEQ ID NO: 2615260 - RNA, 20 nt, Escherichia coli CFT073
gaucaaggcauauaccacac

SEQ ID NO: 2615261 - RNA, 18 nt, Escherichia coli CFT073
gaucaagugaacuuucuc

SEQ ID NO: 2615262 - RNA, 22 nt, Escherichia coli CFT073
gaucaauaaucucuuuacccag

SEQ ID NO: 2615263 - RNA, 13 nt, Escherichia coli CFT073
gaucaauccccag

SEQ ID NO: 2615264 - RNA, 15 nt, Escherichia coli CFT073
gaucaaucugcucuu

SEQ ID NO: 2615265 - RNA, 14 nt, Escherichia coli CFT073
gaucaaugugguga

SEQ ID NO: 2615266 - RNA, 18 nt, Escherichia coli CFT073
gaucaauucgagcaucau

SEQ ID NO: 2615267 - RNA, 16 nt, Escherichia coli CFT073
gaucacaauguaaauc

SEQ ID NO: 2615268 - RNA, 18 nt, Escherichia coli CFT073
gaucacaauguaaaucau

SEQ ID NO: 2615269 - RNA, 13 nt, Escherichia coli CFT073
gaucacacggcca

SEQ ID NO: 2615270 - RNA, 16 nt, Escherichia coli CFT073
gaucacacggccauca

SEQ ID NO: 2615271 - RNA, 12 nt, Escherichia coli CFT073
gaucacagagcc

SEQ ID NO: 2615272 - RNA, 21 nt, Escherichia coli CFT073
gaucacauaauacguuuaugu

SEQ ID NO: 2615273 - RNA, 21 nt, Escherichia coli CFT073
gaucacauccaguacgccuuc

SEQ ID NO: 2615274 - RNA, 17 nt, Escherichia coli CFT073
gaucaccaauaccagca

SEQ ID NO: 2615275 - RNA, 19 nt, Escherichia coli CFT073
gaucaccaguccaucggca

SEQ ID NO: 2615276 - RNA, 20 nt, Escherichia coli CFT073
gaucacccacaccaccgcaa

SEQ ID NO: 2615277 - RNA, 17 nt, Escherichia coli CFT073
gaucaccgcagaagcga

SEQ ID NO: 2615278 - RNA, 19 nt, Escherichia coli CFT073
gaucaccguagaaggcgac

SEQ ID NO: 2615279 - RNA, 19 nt, Escherichia coli CFT073
gaucaccugcgauaaaccg

SEQ ID NO: 2615280 - RNA, 19 nt, Escherichia coli CFT073
gaucacgcggucaaugguc

SEQ ID NO: 2615281 - RNA, 23 nt, Escherichia coli CFT073
gaucacucacccgccagcgcgcg

SEQ ID NO: 2615282 - RNA, 14 nt, Escherichia coli CFT073
gaucacugaaauug

SEQ ID NO: 2615283 - RNA, 14 nt, Escherichia coli CFT073
gaucacuuccagca

SEQ ID NO: 2615284 - RNA, 17 nt, Escherichia coli CFT073
gaucacuuuuucuuucg

SEQ ID NO: 2615285 - RNA, 20 nt, Escherichia coli CFT073
gaucagaagcauaaccgagc

SEQ ID NO: 2615286 - RNA, 16 nt, Escherichia coli CFT073
gaucagacccagaacc

SEQ ID NO: 2615287 - RNA, 17 nt, Escherichia coli CFT073
gaucagaccgccaauca

SEQ ID NO: 2615288 - RNA, 20 nt, Escherichia coli CFT073
gaucagaguacgcaguugcu

SEQ ID NO: 2615289 - RNA, 15 nt, Escherichia coli CFT073
gaucagcaaaauggc

SEQ ID NO: 2615290 - RNA, 13 nt, Escherichia coli CFT073
gaucagcaaauaa

SEQ ID NO: 2615291 - RNA, 23 nt, Escherichia coli CFT073
gaucagcaacgccgguuccagua

SEQ ID NO: 2615292 - RNA, 12 nt, Escherichia coli CFT073
gaucagcauuuc

SEQ ID NO: 2615293 - RNA, 21 nt, Escherichia coli CFT073
gaucagcgaagcgcaucaggc

SEQ ID NO: 2615294 - RNA, 14 nt, Escherichia coli CFT073
gaucagcggccagu

SEQ ID NO: 2615295 - RNA, 23 nt, Escherichia coli CFT073
cuucaucccuuucgcuucaagca

SEQ ID NO: 2615296 - RNA, 18 nt, Escherichia coli CFT073
cuucauccggauacagcc

SEQ ID NO: 2615297 - RNA, 17 nt, Escherichia coli CFT073
cuucaucgaugcugcuc

SEQ ID NO: 2615298 - RNA, 15 nt, Escherichia coli CFT073
cuucaucguccagcg

SEQ ID NO: 2615299 - RNA, 21 nt, Escherichia coli CFT073
cuucaucgugcucgcuuucca

SEQ ID NO: 2615300 - RNA, 19 nt, Escherichia coli CFT073
cuucaucguucaucuguaa

SEQ ID NO: 2615301 - RNA, 12 nt, Escherichia coli CFT073
cuucaucuucca

SEQ ID NO: 2615302 - RNA, 15 nt, Escherichia coli CFT073
cuucaucuuuaucaa

SEQ ID NO: 2615303 - RNA, 14 nt, Escherichia coli CFT073
cuucaugcuccagc

SEQ ID NO: 2615304 - RNA, 18 nt, Escherichia coli CFT073
cuucauguugcagaugcu

SEQ ID NO: 2615305 - RNA, 13 nt, Escherichia coli CFT073
cuucauuaccuuc

SEQ ID NO: 2615306 - RNA, 16 nt, Escherichia coli CFT073
cuucauuaccuucaau

SEQ ID NO: 2615307 - RNA, 21 nt, Escherichia coli CFT073
cuucauuaucgauccuuacca

SEQ ID NO: 2615308 - RNA, 14 nt, Escherichia coli CFT073
cuucauuaucuucu

SEQ ID NO: 2615309 - RNA, 15 nt, Escherichia coli CFT073
cuucauucaccaguu

SEQ ID NO: 2615310 - RNA, 20 nt, Escherichia coli CFT073
cuucauucagaaaaacuaca

SEQ ID NO: 2615311 - RNA, 19 nt, Escherichia coli CFT073
cuucauucagguauugugu

SEQ ID NO: 2615312 - RNA, 13 nt, Escherichia coli CFT073
cuucauucauccg

SEQ ID NO: 2615313 - RNA, 12 nt, Escherichia coli CFT073
cuucauugcucu

SEQ ID NO: 2615314 - RNA, 13 nt, Escherichia coli CFT073
cuucauugcucuc

SEQ ID NO: 2615315 - RNA, 21 nt, Escherichia coli CFT073
cuucauugcucucuucuccuu

SEQ ID NO: 2615316 - RNA, 16 nt, Escherichia coli CFT073
cuucauuugcggguuc

SEQ ID NO: 2615317 - RNA, 20 nt, Escherichia coli CFT073
cuucauuugucucaaaacug

SEQ ID NO: 2615318 - RNA, 13 nt, Escherichia coli CFT073
cuuccaccacuuc

SEQ ID NO: 2615319 - RNA, 16 nt, Escherichia coli CFT073
cuuccaccacuuccug

SEQ ID NO: 2615320 - RNA, 17 nt, Escherichia coli CFT073
cuuccaccacuuccugc

SEQ ID NO: 2615321 - RNA, 21 nt, Escherichia coli CFT073
cuuccaccagauggcuuucca

SEQ ID NO: 2615322 - RNA, 23 nt, Escherichia coli CFT073
cuuccacggcguggucguuggug

SEQ ID NO: 2615323 - RNA, 14 nt, Escherichia coli CFT073
cuuccacuucauca

SEQ ID NO: 2615324 - RNA, 18 nt, Escherichia coli CFT073
cuuccacuucaucaagca

SEQ ID NO: 2615325 - RNA, 12 nt, Escherichia coli CFT073
cuuccacuuccu

SEQ ID NO: 2615326 - RNA, 16 nt, Escherichia coli CFT073
cuuccacuuccugcgg

SEQ ID NO: 2615327 - RNA, 16 nt, Escherichia coli CFT073
cuuccagacucaucuu

SEQ ID NO: 2615328 - RNA, 16 nt, Escherichia coli CFT073
cuuccagauucaguuu

SEQ ID NO: 2615329 - RNA, 17 nt, Escherichia coli CFT073
cuuccagcaaauccauc

SEQ ID NO: 2615330 - RNA, 19 nt, Escherichia coli CFT073
cuuccagcagaccagcaau

SEQ ID NO: 2615331 - RNA, 22 nt, Escherichia coli CFT073
cuuccagcagaccagcaauaac

SEQ ID NO: 2615332 - RNA, 22 nt, Escherichia coli CFT073
cuuccagcagcuugcgccgccc

SEQ ID NO: 2615333 - RNA, 20 nt, Escherichia coli CFT073
cuuccagcaguucgcccgcu

SEQ ID NO: 2615334 - RNA, 14 nt, Escherichia coli CFT073
cuuccagcaucagc

SEQ ID NO: 2615335 - RNA, 16 nt, Escherichia coli CFT073
cuuccagcauuuccac

SEQ ID NO: 2615336 - RNA, 15 nt, Escherichia coli CFT073
cuuccagccaugcca

SEQ ID NO: 2615337 - RNA, 21 nt, Escherichia coli CFT073
cuuccagcgcguucuguucaa

SEQ ID NO: 2615338 - RNA, 15 nt, Escherichia coli CFT073
cuuccagcggcaggc

SEQ ID NO: 2615339 - RNA, 17 nt, Escherichia coli CFT073
cuuccagcggcaggccg

SEQ ID NO: 2615340 - RNA, 21 nt, Escherichia coli CFT073
cuuccagcguagugaaggcaa

SEQ ID NO: 2615341 - RNA, 13 nt, Escherichia coli CFT073
cuuccagcuccag

SEQ ID NO: 2615342 - RNA, 15 nt, Escherichia coli CFT073
cuuccagcuccagcc

SEQ ID NO: 2615343 - RNA, 18 nt, Escherichia coli CFT073
cuuccagcuccagccgcu

SEQ ID NO: 2615344 - RNA, 17 nt, Escherichia coli CFT073
cuuccagcugcacgcca

SEQ ID NO: 2615345 - RNA, 23 nt, Escherichia coli CFT073
cuuccagcuucgcuaccugaguc

SEQ ID NO: 2615346 - RNA, 22 nt, Escherichia coli CFT073
cuuccaggcucauaccuuccac

SEQ ID NO: 2615347 - RNA, 12 nt, Escherichia coli CFT073
cuucguugauca

SEQ ID NO: 2615348 - RNA, 17 nt, Escherichia coli CFT073
cuucguuuuccgcuucg

SEQ ID NO: 2615349 - RNA, 23 nt, Escherichia coli CFT073
cuucguuuugcuguuccagcauc

SEQ ID NO: 2615350 - RNA, 18 nt, Escherichia coli CFT073
cuucuaaaucguaccagc

SEQ ID NO: 2615351 - RNA, 15 nt, Escherichia coli CFT073
cuucuaacaucauga

SEQ ID NO: 2615352 - RNA, 17 nt, Escherichia coli CFT073
cuucuaauugugcugca

SEQ ID NO: 2615353 - RNA, 18 nt, Escherichia coli CFT073
cuucuaauuuuuccagca

SEQ ID NO: 2615354 - RNA, 13 nt, Escherichia coli CFT073
cuucuacauuucu

SEQ ID NO: 2615355 - RNA, 18 nt, Escherichia coli CFT073
cuucuacauuucuguagu

SEQ ID NO: 2615356 - RNA, 23 nt, Escherichia coli CFT073
cuucuaccuuaacgguaucuuuc

SEQ ID NO: 2615357 - RNA, 17 nt, Escherichia coli CFT073
cuucuacugcaugauua

SEQ ID NO: 2615358 - RNA, 20 nt, Escherichia coli CFT073
cuucuaguucauguauuuuu

SEQ ID NO: 2615359 - RNA, 14 nt, Escherichia coli CFT073
cuucuauaucuccc

SEQ ID NO: 2615360 - RNA, 14 nt, Escherichia coli CFT073
cuucuaucuucauc

SEQ ID NO: 2615361 - RNA, 23 nt, Escherichia coli CFT073
cuucucaagauuggagcgugaua

SEQ ID NO: 2615362 - RNA, 15 nt, Escherichia coli CFT073
cuucucaaucccuuu

SEQ ID NO: 2615363 - RNA, 17 nt, Escherichia coli CFT073
cuucucaaucccuuucu

SEQ ID NO: 2615364 - RNA, 19 nt, Escherichia coli CFT073
cuucucaaucccuuucucc

SEQ ID NO: 2615365 - RNA, 18 nt, Escherichia coli CFT073
cuucucacggauccagaa

SEQ ID NO: 2615366 - RNA, 20 nt, Escherichia coli CFT073
cuucucacggauccagaacu

SEQ ID NO: 2615367 - RNA, 21 nt, Escherichia coli CFT073
cuucucacggauccagaacug

SEQ ID NO: 2615368 - RNA, 13 nt, Escherichia coli CFT073
cuucucacugccc

SEQ ID NO: 2615369 - RNA, 13 nt, Escherichia coli CFT073
cuucucagccaaa

SEQ ID NO: 2615370 - RNA, 17 nt, Escherichia coli CFT073
cuucucaucuuucagaa

SEQ ID NO: 2615371 - RNA, 12 nt, Escherichia coli CFT073
cuucuccacgcc

SEQ ID NO: 2615372 - RNA, 14 nt, Escherichia coli CFT073
cuucuccggccuac

SEQ ID NO: 2615373 - RNA, 22 nt, Escherichia coli CFT073
cuucucgcucgagagagaaaau

SEQ ID NO: 2615374 - RNA, 22 nt, Escherichia coli CFT073
cuucucggacaauaguuucaau

SEQ ID NO: 2615375 - RNA, 22 nt, Escherichia coli CFT073
cuucucucccgcauuccauugu

SEQ ID NO: 2615376 - RNA, 21 nt, Escherichia coli CFT073
cuucucuggcugcuucaguaa

SEQ ID NO: 2615377 - RNA, 12 nt, Escherichia coli CFT073
cuucucugugac

SEQ ID NO: 2615378 - RNA, 15 nt, Escherichia coli CFT073
cuucucuucuuccgc

SEQ ID NO: 2615379 - RNA, 21 nt, Escherichia coli CFT073
cuucucuugcuggauuucccu

SEQ ID NO: 2615380 - RNA, 16 nt, Escherichia coli CFT073
cuucugaagcaaacuu

SEQ ID NO: 2615381 - RNA, 18 nt, Escherichia coli CFT073
cuucugaaucagaucaag

SEQ ID NO: 2615382 - RNA, 21 nt, Escherichia coli CFT073
cuucugacauagccacucacc

SEQ ID NO: 2615383 - RNA, 23 nt, Escherichia coli CFT073
cuucugaccgggauuuucaacau

SEQ ID NO: 2615384 - RNA, 18 nt, Escherichia coli CFT073
cuucugauaaaugaagaa

SEQ ID NO: 2615385 - RNA, 17 nt, Escherichia coli CFT073
cuucugaucuacagccu

SEQ ID NO: 2615386 - RNA, 14 nt, Escherichia coli CFT073
cuucugcaaucaac

SEQ ID NO: 2615387 - RNA, 23 nt, Escherichia coli CFT073
cuucugcaaucaacacuucuuug

SEQ ID NO: 2615388 - RNA, 22 nt, Escherichia coli CFT073
cuucugcacgguuuuuccagcu

SEQ ID NO: 2615389 - RNA, 22 nt, Escherichia coli CFT073
cuucugccaauuuuucgcucuu

SEQ ID NO: 2615390 - RNA, 20 nt, Escherichia coli CFT073
cuucugccaggugcagccca

SEQ ID NO: 2615391 - RNA, 13 nt, Escherichia coli CFT073
cuucugccgcuuc

SEQ ID NO: 2615392 - RNA, 14 nt, Escherichia coli CFT073
cuucugccgcuucc

SEQ ID NO: 2615393 - RNA, 16 nt, Escherichia coli CFT073
cuucugccgcuuuaga

SEQ ID NO: 2615394 - RNA, 22 nt, Escherichia coli CFT073
cuucugcguucucuucacgcca

SEQ ID NO: 2615395 - RNA, 14 nt, Escherichia coli CFT073
cuucugcugugacu

SEQ ID NO: 2615396 - RNA, 17 nt, Escherichia coli CFT073
cuucugcugugacuuca

SEQ ID NO: 2615397 - RNA, 15 nt, Escherichia coli CFT073
cuucuggcaccagua

SEQ ID NO: 2615398 - RNA, 16 nt, Escherichia coli CFT073
cuucuggccucgcuuu

SEQ ID NO: 2615399 - RNA, 22 nt, Escherichia coli CFT073
cuucuggcgacccguuuuucuu

SEQ ID NO: 2615400 - RNA, 23 nt, Escherichia coli CFT073
cuucuggcggcggcaacgucacc

SEQ ID NO: 2615401 - RNA, 14 nt, Escherichia coli CFT073
cuucuggcuggcgc

SEQ ID NO: 2615402 - RNA, 15 nt, Escherichia coli CFT073
cuucugguaacagcg

SEQ ID NO: 2615403 - RNA, 20 nt, Escherichia coli CFT073
cuucugguaacagcggacgg

SEQ ID NO: 2615404 - RNA, 14 nt, Escherichia coli CFT073
cuucuggugaugca

SEQ ID NO: 2615405 - RNA, 13 nt, Escherichia coli CFT073
cuucugucgcuuc

SEQ ID NO: 2615406 - RNA, 22 nt, Escherichia coli CFT073
cuucugucgcuucacgcagguu

SEQ ID NO: 2615407 - RNA, 14 nt, Escherichia coli CFT073
cuucuguuaaauca

SEQ ID NO: 2615408 - RNA, 22 nt, Escherichia coli CFT073
cuucuguuauauauuacccuuu

SEQ ID NO: 2615409 - RNA, 16 nt, Escherichia coli CFT073
cuucuuaggcauugcc

SEQ ID NO: 2615410 - RNA, 19 nt, Escherichia coli CFT073
cuucuucacaucaauauuc

SEQ ID NO: 2615411 - RNA, 12 nt, Escherichia coli CFT073
cuucuucaguuu

SEQ ID NO: 2615412 - RNA, 15 nt, Escherichia coli CFT073
cuucuucauccagcg

SEQ ID NO: 2615413 - RNA, 14 nt, Escherichia coli CFT073
cuucuucaucgcgc

SEQ ID NO: 2615414 - RNA, 12 nt, Escherichia coli CFT073
cuucuuccagca

SEQ ID NO: 2615415 - RNA, 16 nt, Escherichia coli CFT073
cuucuuccagcggcag

SEQ ID NO: 2615416 - RNA, 16 nt, Escherichia coli CFT073
cuucuuccugcgccag

SEQ ID NO: 2615417 - RNA, 19 nt, Escherichia coli CFT073
cuucuucgucgucuucguc

SEQ ID NO: 2615418 - RNA, 14 nt, Escherichia coli CFT073
cuucuucuaugcca

SEQ ID NO: 2615419 - RNA, 16 nt, Escherichia coli CFT073
cuucuucuggcugcca

SEQ ID NO: 2615420 - RNA, 14 nt, Escherichia coli CFT073
cuucuucuuaugca

SEQ ID NO: 2615421 - RNA, 18 nt, Escherichia coli CFT073
cuucuugcagcuuaauca

SEQ ID NO: 2615422 - RNA, 16 nt, Escherichia coli CFT073
cuucuugcguuuuuug

SEQ ID NO: 2615423 - RNA, 20 nt, Escherichia coli CFT073
cuucuuuaguugagcuuuuu

SEQ ID NO: 2615424 - RNA, 15 nt, Escherichia coli CFT073
cuucuuucgcccagc

SEQ ID NO: 2615425 - RNA, 16 nt, Escherichia coli CFT073
cuucuuucucuuucuu

SEQ ID NO: 2615426 - RNA, 23 nt, Escherichia coli CFT073
cuucuuuuuccgggccaaaaacc

SEQ ID NO: 2615427 - RNA, 22 nt, Escherichia coli CFT073
cuugaacgacaaaaacgccgcu

SEQ ID NO: 2615428 - RNA, 16 nt, Escherichia coli CFT073
cuugaacuuaucauca

SEQ ID NO: 2615429 - RNA, 15 nt, Escherichia coli CFT073
cuugaagccuucgcc

SEQ ID NO: 2615430 - RNA, 18 nt, Escherichia coli CFT073
cuugaaggguuuaauaau

SEQ ID NO: 2615431 - RNA, 20 nt, Escherichia coli CFT073
cuugaaggguuuaauaaucg

SEQ ID NO: 2615432 - RNA, 20 nt, Escherichia coli CFT073
cuugaauuuaucuucaccaa

SEQ ID NO: 2615433 - RNA, 19 nt, Escherichia coli CFT073
cuugacccguuuuaaaucg

SEQ ID NO: 2615434 - RNA, 21 nt, Escherichia coli CFT073
cuugacccguuuuaaaucgcc

SEQ ID NO: 2615435 - RNA, 21 nt, Escherichia coli CFT073
cuugacgcgucuuaucaggcc

SEQ ID NO: 2615436 - RNA, 23 nt, Escherichia coli CFT073
cuugacgcgucuuaucaggccua

SEQ ID NO: 2615437 - RNA, 19 nt, Escherichia coli CFT073
cuugacucuguagcgggaa

SEQ ID NO: 2615438 - RNA, 11 nt, Escherichia coli CFT073
cuugagaaaau

SEQ ID NO: 2615439 - RNA, 15 nt, Escherichia coli CFT073
cuugagccgccacca

SEQ ID NO: 2615440 - RNA, 17 nt, Escherichia coli CFT073
cuugagccgccaccaga

SEQ ID NO: 2615441 - RNA, 20 nt, Escherichia coli CFT073
cuugaggccauccgcaucac

SEQ ID NO: 2615442 - RNA, 23 nt, Escherichia coli CFT073
cuugagggauucgacgcaaacaa

SEQ ID NO: 2615443 - RNA, 19 nt, Escherichia coli CFT073
cuugaguaccgagaaaauc

SEQ ID NO: 2615444 - RNA, 23 nt, Escherichia coli CFT073
cuugaucaggaaaucgucgaggg

SEQ ID NO: 2615445 - RNA, 17 nt, Escherichia coli CFT073
cuugauucuguucagua

SEQ ID NO: 2615446 - RNA, 14 nt, Escherichia coli CFT073
cuugcaaaggcugu

SEQ ID NO: 2615447 - RNA, 23 nt, Escherichia coli CFT073
cuugcaacuccggcgaaaauccc

SEQ ID NO: 2615448 - RNA, 22 nt, Escherichia coli CFT073
cuugcaaucucugacauaaaaa

SEQ ID NO: 2615449 - RNA, 22 nt, Escherichia coli CFT073
cuugcaccuuucgguagcaggg

SEQ ID NO: 2615450 - RNA, 23 nt, Escherichia coli CFT073
cuugcagauaauuuugcaguccc

SEQ ID NO: 2615451 - RNA, 23 nt, Escherichia coli CFT073
cuugcagccagaacucaucuucu

SEQ ID NO: 2615452 - RNA, 18 nt, Escherichia coli CFT073
cuugcaggaucagcuccg

SEQ ID NO: 2615453 - RNA, 18 nt, Escherichia coli CFT073
cuugcagucggcuuucuc

SEQ ID NO: 2615454 - RNA, 17 nt, Escherichia coli CFT073
cuugcauuguguaauua

SEQ ID NO: 2615455 - RNA, 13 nt, Escherichia coli CFT073
cuuucaccagauc

SEQ ID NO: 2615456 - RNA, 17 nt, Escherichia coli CFT073
cuuucaccagugggaaa

SEQ ID NO: 2615457 - RNA, 20 nt, Escherichia coli CFT073
cuuucacccggcgcuaauuc

SEQ ID NO: 2615458 - RNA, 22 nt, Escherichia coli CFT073
cuuucaccgccugaucauuucc

SEQ ID NO: 2615459 - RNA, 14 nt, Escherichia coli CFT073
cuuucaccucuuca

SEQ ID NO: 2615460 - RNA, 17 nt, Escherichia coli CFT073
cuuucaccucuucauua

SEQ ID NO: 2615461 - RNA, 16 nt, Escherichia coli CFT073
cuuucacgcccagucc

SEQ ID NO: 2615462 - RNA, 16 nt, Escherichia coli CFT073
cuuucacgcccgcguu

SEQ ID NO: 2615463 - RNA, 14 nt, Escherichia coli CFT073
cuuucacgccgcca

SEQ ID NO: 2615464 - RNA, 20 nt, Escherichia coli CFT073
cuuucacgccgccaaaacgg

SEQ ID NO: 2615465 - RNA, 22 nt, Escherichia coli CFT073
cuuucacgcgcugaccuucuuc

SEQ ID NO: 2615466 - RNA, 18 nt, Escherichia coli CFT073
cuuucacuacaaucaggc

SEQ ID NO: 2615467 - RNA, 13 nt, Escherichia coli CFT073
cuuucacuccauu

SEQ ID NO: 2615468 - RNA, 14 nt, Escherichia coli CFT073
cuuucacuccauug

SEQ ID NO: 2615469 - RNA, 21 nt, Escherichia coli CFT073
cuuucacuucagcaacgugcu

SEQ ID NO: 2615470 - RNA, 15 nt, Escherichia coli CFT073
cuuucacuucaguaa

SEQ ID NO: 2615471 - RNA, 13 nt, Escherichia coli CFT073
cuuucacuuccgu

SEQ ID NO: 2615472 - RNA, 23 nt, Escherichia coli CFT073
cuuucacuugacuaagcguuuuc

SEQ ID NO: 2615473 - RNA, 16 nt, Escherichia coli CFT073
cuuucacuuuugccag

SEQ ID NO: 2615474 - RNA, 20 nt, Escherichia coli CFT073
cuuucacuuuugccagacga

SEQ ID NO: 2615475 - RNA, 19 nt, Escherichia coli CFT073
cuuucagagaagcaccgcc

SEQ ID NO: 2615476 - RNA, 19 nt, Escherichia coli CFT073
cuuucagaguuguaccacc

SEQ ID NO: 2615477 - RNA, 15 nt, Escherichia coli CFT073
cuuucagcaccagcc

SEQ ID NO: 2615478 - RNA, 23 nt, Escherichia coli CFT073
cuuucagcaccagcccgacgaua

SEQ ID NO: 2615479 - RNA, 18 nt, Escherichia coli CFT073
cuuucagcacuucggcau

SEQ ID NO: 2615480 - RNA, 22 nt, Escherichia coli CFT073
cuuucagccccagcgcaauagu

SEQ ID NO: 2615481 - RNA, 16 nt, Escherichia coli CFT073
cuuucagcguuaauuc

SEQ ID NO: 2615482 - RNA, 17 nt, Escherichia coli CFT073
cuuucagcguuaauuca

SEQ ID NO: 2615483 - RNA, 22 nt, Escherichia coli CFT073
cuuucaggaacagcgacagauu

SEQ ID NO: 2615484 - RNA, 16 nt, Escherichia coli CFT073
cuuucaggccgcgcag

SEQ ID NO: 2615485 - RNA, 20 nt, Escherichia coli CFT073
cuuucagggcgucaauuugc

SEQ ID NO: 2615486 - RNA, 21 nt, Escherichia coli CFT073
cuuucauacugccgaccaucu

SEQ ID NO: 2615487 - RNA, 19 nt, Escherichia coli CFT073
cuuucauauaagcguccca

SEQ ID NO: 2615488 - RNA, 20 nt, Escherichia coli CFT073
cuuucauaugauaggcuuca

SEQ ID NO: 2615489 - RNA, 16 nt, Escherichia coli CFT073
cuuucauauuccagcc

SEQ ID NO: 2615490 - RNA, 17 nt, Escherichia coli CFT073
cuuucaucuguuuucaa

SEQ ID NO: 2615491 - RNA, 18 nt, Escherichia coli CFT073
cuuucaucuguuuucaau

SEQ ID NO: 2615492 - RNA, 22 nt, Escherichia coli CFT073
cuuucaucuguuuucaaugucu

SEQ ID NO: 2615493 - RNA, 17 nt, Escherichia coli CFT073
cuuucaugguacuggcg

SEQ ID NO: 2615494 - RNA, 15 nt, Escherichia coli CFT073
cuuucauuucagcgu

SEQ ID NO: 2615495 - RNA, 23 nt, Escherichia coli CFT073
cuuuccagacccuuauuuaacau

SEQ ID NO: 2615496 - RNA, 17 nt, Escherichia coli CFT073
cuuuccagccacaguuc

SEQ ID NO: 2615497 - RNA, 20 nt, Escherichia coli CFT073
cuuuccagcuguaccagcaa

SEQ ID NO: 2615498 - RNA, 20 nt, Escherichia coli CFT073
cuuuccaggcgugcuccuuc

SEQ ID NO: 2615499 - RNA, 17 nt, Escherichia coli CFT073
cuuuccagucuccuugc

SEQ ID NO: 2615500 - RNA, 12 nt, Escherichia coli CFT073
cuuuccaguuca

SEQ ID NO: 2615501 - RNA, 15 nt, Escherichia coli CFT073
cuuuccauucuuucc

SEQ ID NO: 2615502 - RNA, 21 nt, Escherichia coli CFT073
cuuucccagcaggaucaauac

SEQ ID NO: 2615503 - RNA, 20 nt, Escherichia coli CFT073
cuuucccgcgcccgugcauc

SEQ ID NO: 2615504 - RNA, 17 nt, Escherichia coli CFT073
cuuucccggcaaucacc

SEQ ID NO: 2615505 - RNA, 16 nt, Escherichia coli CFT073
cuuuccggcagaagca

SEQ ID NO: 2615506 - RNA, 21 nt, Escherichia coli CFT073
cuuuccgggguaaauuucuuc

SEQ ID NO: 2615507 - RNA, 21 nt, Escherichia coli CFT073
cuuuccguuuucacccucgcc

SEQ ID NO: 2615508 - RNA, 18 nt, Escherichia coli CFT073
cuuuccuaaacuccucgc

SEQ ID NO: 2615509 - RNA, 20 nt, Escherichia coli CFT073
cuuuccuaaacuccucgccu

SEQ ID NO: 2615510 - RNA, 18 nt, Escherichia coli CFT073
cuuuccugcacaaugccu

SEQ ID NO: 2615511 - RNA, 18 nt, Escherichia coli CFT073
cuuuccugcucggcaaac

SEQ ID NO: 2615512 - RNA, 23 nt, Escherichia coli CFT073
cuuucgacggcauaagaaacaca

SEQ ID NO: 2615513 - RNA, 21 nt, Escherichia coli CFT073
cuuucgagcaauuuuccuuga

SEQ ID NO: 2615514 - RNA, 23 nt, Escherichia coli CFT073
cuuucgauugcacaaagguuucg

SEQ ID NO: 2615515 - RNA, 16 nt, Escherichia coli CFT073
cuuucgcaauaaucau

SEQ ID NO: 2615516 - RNA, 13 nt, Escherichia coli CFT073
cuuucgcaucagc

SEQ ID NO: 2615517 - RNA, 20 nt, Escherichia coli CFT073
cuuucgccggaugcgacguu

SEQ ID NO: 2615518 - RNA, 15 nt, Escherichia coli CFT073
cuuucgcuucaagca

SEQ ID NO: 2615519 - RNA, 13 nt, Escherichia coli CFT073
cuuucgcuugaca

SEQ ID NO: 2615520 - RNA, 16 nt, Escherichia coli CFT073
cuuucgcuuucucuuc

SEQ ID NO: 2615521 - RNA, 20 nt, Escherichia coli CFT073
cuuucgcuuucucuucggcu

SEQ ID NO: 2615522 - RNA, 23 nt, Escherichia coli CFT073
cuuucgcuuucucuucggcuucu

SEQ ID NO: 2615523 - RNA, 16 nt, Escherichia coli CFT073
cuuucggcaguuuuac

SEQ ID NO: 2615524 - RNA, 19 nt, Escherichia coli CFT073
cuuucgggcgcaaaaacau

SEQ ID NO: 2615525 - RNA, 19 nt, Escherichia coli CFT073
cuuucggguggccagcaac

SEQ ID NO: 2615526 - RNA, 15 nt, Escherichia coli CFT073
cuuucggugacuuca

SEQ ID NO: 2615527 - RNA, 23 nt, Escherichia coli CFT073
cuuucgguucauaaacacucaca

SEQ ID NO: 2615528 - RNA, 19 nt, Escherichia coli CFT073
cuuucguggugagggcaaa

SEQ ID NO: 2615529 - RNA, 16 nt, Escherichia coli CFT073
cuuucguuauuacagc

SEQ ID NO: 2615530 - RNA, 14 nt, Escherichia coli CFT073
cuuucuccgcaucc

SEQ ID NO: 2615531 - RNA, 20 nt, Escherichia coli CFT073
cuuucucgcgcccaaccagc

SEQ ID NO: 2615532 - RNA, 17 nt, Escherichia coli CFT073
cuuucucuggcuguuuc

SEQ ID NO: 2615533 - RNA, 14 nt, Escherichia coli CFT073
cuuucucuucaucu

SEQ ID NO: 2615534 - RNA, 14 nt, Escherichia coli CFT073
cuuucucuucuagu

SEQ ID NO: 2615535 - RNA, 21 nt, Escherichia coli CFT073
cuuucucuucuaguucaugua

SEQ ID NO: 2615536 - RNA, 14 nt, Escherichia coli CFT073
cuuucugaaggauu

SEQ ID NO: 2615537 - RNA, 16 nt, Escherichia coli CFT073
cuuucugauuguuauu

SEQ ID NO: 2615538 - RNA, 17 nt, Escherichia coli CFT073
cuuucugcaaccagaaa

SEQ ID NO: 2615539 - RNA, 18 nt, Escherichia coli CFT073
cuuucugcauccguucuu

SEQ ID NO: 2615540 - RNA, 23 nt, Escherichia coli CFT073
cuuucugcccgcguuuccacgcu

SEQ ID NO: 2615541 - RNA, 13 nt, Escherichia coli CFT073
cuuucugcugcuu

SEQ ID NO: 2615542 - RNA, 18 nt, Escherichia coli CFT073
cuuucugcugcuuuauca

SEQ ID NO: 2615543 - RNA, 19 nt, Escherichia coli CFT073
cuuucugcuucgccaucuc

SEQ ID NO: 2615544 - RNA, 14 nt, Escherichia coli CFT073
cuuucugugcaauc

SEQ ID NO: 2615545 - RNA, 12 nt, Escherichia coli CFT073
cuuucuguuucg

SEQ ID NO: 2615546 - RNA, 18 nt, Escherichia coli CFT073
cuuucuuaauauuucccg

SEQ ID NO: 2615547 - RNA, 17 nt, Escherichia coli CFT073
cuuucuuauucgcugcu

SEQ ID NO: 2615548 - RNA, 16 nt, Escherichia coli CFT073
cuuucuuauuuuucuc

SEQ ID NO: 2615549 - RNA, 14 nt, Escherichia coli CFT073
cuuucuucagcuuu

SEQ ID NO: 2615550 - RNA, 21 nt, Escherichia coli CFT073
cuuucuucgcagcaaaucuca

SEQ ID NO: 2615551 - RNA, 18 nt, Escherichia coli CFT073
cuuucuugccacuggccu

SEQ ID NO: 2615552 - RNA, 17 nt, Escherichia coli CFT073
cuuucuuugcuuuguaa

SEQ ID NO: 2615553 - RNA, 13 nt, Escherichia coli CFT073
cuuucuuuucccu

SEQ ID NO: 2615554 - RNA, 15 nt, Escherichia coli CFT073
cuuucuuuucccugu

SEQ ID NO: 2615555 - RNA, 19 nt, Escherichia coli CFT073
cuuucuuuuuuucacuuuc

SEQ ID NO: 2615556 - RNA, 15 nt, Escherichia coli CFT073
cuuugaacagccaga

SEQ ID NO: 2615557 - RNA, 23 nt, Escherichia coli CFT073
cuuugacguugguuucgcauuuc

SEQ ID NO: 2615558 - RNA, 16 nt, Escherichia coli CFT073
cuuugacugaaauuua

SEQ ID NO: 2615559 - RNA, 23 nt, Escherichia coli CFT073
cuuugagcaucaaacuuuuaaau

SEQ ID NO: 2615560 - RNA, 23 nt, Escherichia coli CFT073
cuuugagcgucaaacuuuuaaau

SEQ ID NO: 2615561 - RNA, 21 nt, Escherichia coli CFT073
cuuugagucaacauauuaaaa

SEQ ID NO: 2615562 - RNA, 13 nt, Escherichia coli CFT073
cuuugauauucau

SEQ ID NO: 2615563 - RNA, 22 nt, Escherichia coli CFT073
gaaaaaccguauucaucgccau

SEQ ID NO: 2615564 - RNA, 19 nt, Escherichia coli CFT073
gaaaaaccguguuuaugaa

SEQ ID NO: 2615565 - RNA, 15 nt, Escherichia coli CFT073
gaaaaaccuaauacu

SEQ ID NO: 2615566 - RNA, 20 nt, Escherichia coli CFT073
gaaaaaccuuaaagcgaaac

SEQ ID NO: 2615567 - RNA, 22 nt, Escherichia coli CFT073
gaaaaaccuuaaagcgaaacag

SEQ ID NO: 2615568 - RNA, 17 nt, Escherichia coli CFT073
gaaaaacggaaagcaac

SEQ ID NO: 2615569 - RNA, 23 nt, Escherichia coli CFT073
gaaaaacguuucaaacaggcugc

SEQ ID NO: 2615570 - RNA, 22 nt, Escherichia coli CFT073
gaaaaagauauguugcgggagg

SEQ ID NO: 2615571 - RNA, 17 nt, Escherichia coli CFT073
gaaaaagcgcucccgca

SEQ ID NO: 2615572 - RNA, 23 nt, Escherichia coli CFT073
gaaaaauaaaagcgugaaacaaa

SEQ ID NO: 2615573 - RNA, 22 nt, Escherichia coli CFT073
gaaaaauaaugccaccagugcc

SEQ ID NO: 2615574 - RNA, 17 nt, Escherichia coli CFT073
gaaaaaucaaaaacucu

SEQ ID NO: 2615575 - RNA, 13 nt, Escherichia coli CFT073
gaaaaaucccucu

SEQ ID NO: 2615576 - RNA, 23 nt, Escherichia coli CFT073
gaaaaaugaauaccaagucucaa

SEQ ID NO: 2615577 - RNA, 14 nt, Escherichia coli CFT073
gaaaaauucaaccu

SEQ ID NO: 2615578 - RNA, 13 nt, Escherichia coli CFT073
gaaaaauucaggg

SEQ ID NO: 2615579 - RNA, 22 nt, Escherichia coli CFT073
gaaaaauucaggggaagccaga

SEQ ID NO: 2615580 - RNA, 16 nt, Escherichia coli CFT073
gaaaaauugccugaug

SEQ ID NO: 2615581 - RNA, 15 nt, Escherichia coli CFT073
gaaaacaacuggcaa

SEQ ID NO: 2615582 - RNA, 15 nt, Escherichia coli CFT073
gaaaaccacccgcaa

SEQ ID NO: 2615583 - RNA, 12 nt, Escherichia coli CFT073
gaaaaccauaau

SEQ ID NO: 2615584 - RNA, 14 nt, Escherichia coli CFT073
gaaaaccauaauga

SEQ ID NO: 2615585 - RNA, 16 nt, Escherichia coli CFT073
gaaaaccauaaugaug

SEQ ID NO: 2615586 - RNA, 14 nt, Escherichia coli CFT073
gaaaacccugcgca

SEQ ID NO: 2615587 - RNA, 16 nt, Escherichia coli CFT073
gaaaaccgauaaacgc

SEQ ID NO: 2615588 - RNA, 15 nt, Escherichia coli CFT073
gaaaacgaaagcgcc

SEQ ID NO: 2615589 - RNA, 15 nt, Escherichia coli CFT073
gaaaacgaauugucc

SEQ ID NO: 2615590 - RNA, 19 nt, Escherichia coli CFT073
gaaaacgcauaucuucuga

SEQ ID NO: 2615591 - RNA, 15 nt, Escherichia coli CFT073
gaaaacgccaccaga

SEQ ID NO: 2615592 - RNA, 14 nt, Escherichia coli CFT073
gaaaacgcccggca

SEQ ID NO: 2615593 - RNA, 11 nt, Escherichia coli CFT073
gaaaacgccuu

SEQ ID NO: 2615594 - RNA, 21 nt, Escherichia coli CFT073
gaaaacgcuccaacgacaaca

SEQ ID NO: 2615595 - RNA, 13 nt, Escherichia coli CFT073
gaaaacuaucuga

SEQ ID NO: 2615596 - RNA, 17 nt, Escherichia coli CFT073
gaaaacuauuacugacc

SEQ ID NO: 2615597 - RNA, 20 nt, Escherichia coli CFT073
gaaaacucgcuaaccacugu

SEQ ID NO: 2615598 - RNA, 24 nt, Escherichia coli CFT073
gaaaacucgcuaaccacuguucug

SEQ ID NO: 2615599 - RNA, 23 nt, Escherichia coli CFT073
gaaaacucgucugauuucuuauu

SEQ ID NO: 2615600 - RNA, 19 nt, Escherichia coli CFT073
gaaaacugcgcccgcuuuu

SEQ ID NO: 2615601 - RNA, 20 nt, Escherichia coli CFT073
gaaaacuuaucuuauuccca

SEQ ID NO: 2615602 - RNA, 16 nt, Escherichia coli CFT073
gaaaagaaacugugau

SEQ ID NO: 2615603 - RNA, 15 nt, Escherichia coli CFT073
gaaaagagaugaaug

SEQ ID NO: 2615604 - RNA, 22 nt, Escherichia coli CFT073
gaaaagaguauuacaucacuua

SEQ ID NO: 2615605 - RNA, 14 nt, Escherichia coli CFT073
gaaaagauguguca

SEQ ID NO: 2615606 - RNA, 23 nt, Escherichia coli CFT073
gaaaagccuguaccaaaaucauc

SEQ ID NO: 2615607 - RNA, 22 nt, Escherichia coli CFT073
gaaaagcuguaaggugaaagca

SEQ ID NO: 2615608 - RNA, 22 nt, Escherichia coli CFT073
gaaaaggaguuuuuccuuucug

SEQ ID NO: 2615609 - RNA, 19 nt, Escherichia coli CFT073
gaaaagguaaggauaaaaa

SEQ ID NO: 2615610 - RNA, 21 nt, Escherichia coli CFT073
gaaaagguaaggauaaaaaag

SEQ ID NO: 2615611 - RNA, 22 nt, Escherichia coli CFT073
gaaaagguuaaaccgccaguca

SEQ ID NO: 2615612 - RNA, 23 nt, Escherichia coli CFT073
gaaaaguuagccacagccuggga

SEQ ID NO: 2615613 - RNA, 22 nt, Escherichia coli CFT073
gaaaaguuuauuacucagcgca

SEQ ID NO: 2615614 - RNA, 22 nt, Escherichia coli CFT073
gaaaauaacguaguguaaaugc

SEQ ID NO: 2615615 - RNA, 13 nt, Escherichia coli CFT073
gaaaauacagcaa

SEQ ID NO: 2615616 - RNA, 14 nt, Escherichia coli CFT073
gaaaauacucagca

SEQ ID NO: 2615617 - RNA, 20 nt, Escherichia coli CFT073
gaaaauagacguucuucuuc

SEQ ID NO: 2615618 - RNA, 17 nt, Escherichia coli CFT073
gaaaauaugcccauguu

SEQ ID NO: 2615619 - RNA, 17 nt, Escherichia coli CFT073
gaaaauauugcuguaaa

SEQ ID NO: 2615620 - RNA, 16 nt, Escherichia coli CFT073
gaaaaucaccucauca

SEQ ID NO: 2615621 - RNA, 14 nt, Escherichia coli CFT073
gaaaaucagcauca

SEQ ID NO: 2615622 - RNA, 15 nt, Escherichia coli CFT073
gaaaaucagcaucaa

SEQ ID NO: 2615623 - RNA, 22 nt, Escherichia coli CFT073
gaaaaucaugaauuuugaagga

SEQ ID NO: 2615624 - RNA, 23 nt, Escherichia coli CFT073
gaaaaucgccggaugcggcaggc

SEQ ID NO: 2615625 - RNA, 17 nt, Escherichia coli CFT073
gaaaaucucacgcagga

SEQ ID NO: 2615626 - RNA, 14 nt, Escherichia coli CFT073
gaaaaucugcggga

SEQ ID NO: 2615627 - RNA, 14 nt, Escherichia coli CFT073
gaaaaucuucucuc

SEQ ID NO: 2615628 - RNA, 22 nt, Escherichia coli CFT073
gaaaaucuucucucauccgcca

SEQ ID NO: 2615629 - RNA, 14 nt, Escherichia coli CFT073
gaaaaugaaauaaa

SEQ ID NO: 2615630 - RNA, 22 nt, Escherichia coli CFT073
gaaaaugaaauaaaacaaauau

SEQ ID NO: 2615631 - RNA, 21 nt, Escherichia coli CFT073
gaaaaugcccgguccuggcga

SEQ ID NO: 2615632 - RNA, 17 nt, Escherichia coli CFT073
gaaaaugccgcacauca

SEQ ID NO: 2615633 - RNA, 21 nt, Escherichia coli CFT073
gaaaaugccgcacaucaccgc

SEQ ID NO: 2615634 - RNA, 19 nt, Escherichia coli CFT073
gaaaaugcucgccuugcug

SEQ ID NO: 2615635 - RNA, 21 nt, Escherichia coli CFT073
gaaaaugcucgccuugcugcc

SEQ ID NO: 2615636 - RNA, 24 nt, Escherichia coli CFT073
gaaaaugcuuuccagagagacauu

SEQ ID NO: 2615637 - RNA, 13 nt, Escherichia coli CFT073
gaaaauggcgcuc

SEQ ID NO: 2615638 - RNA, 16 nt, Escherichia coli CFT073
gaaaauggcgcucagg

SEQ ID NO: 2615639 - RNA, 16 nt, Escherichia coli CFT073
gaaaauuacgaaagca

SEQ ID NO: 2615640 - RNA, 19 nt, Escherichia coli CFT073
gaaaauuacgaaagcaaaa

SEQ ID NO: 2615641 - RNA, 20 nt, Escherichia coli CFT073
gaaaauuacgaaagcaaaau

SEQ ID NO: 2615642 - RNA, 15 nt, Escherichia coli CFT073
gaaaauuauuuuaaa

SEQ ID NO: 2615643 - RNA, 14 nt, Escherichia coli CFT073
gaaaauucaguucg

SEQ ID NO: 2615644 - RNA, 22 nt, Escherichia coli CFT073
gaaaauuuuuucagauaaaagc

SEQ ID NO: 2615645 - RNA, 13 nt, Escherichia coli CFT073
gaaacaaccucuu

SEQ ID NO: 2615646 - RNA, 15 nt, Escherichia coli CFT073
gaaacaaccucuuuu

SEQ ID NO: 2615647 - RNA, 15 nt, Escherichia coli CFT073
gaaacacacuuucca

SEQ ID NO: 2615648 - RNA, 12 nt, Escherichia coli CFT073
gaaacaccagaa

SEQ ID NO: 2615649 - RNA, 20 nt, Escherichia coli CFT073
gaaacaccagaaugccccau

SEQ ID NO: 2615650 - RNA, 22 nt, Escherichia coli CFT073
gaaacaccggugaccaucagca

SEQ ID NO: 2615651 - RNA, 22 nt, Escherichia coli CFT073
gaaacaccugcauuuacggcca

SEQ ID NO: 2615652 - RNA, 22 nt, Escherichia coli CFT073
gaaacacuacgaucagaaugau

SEQ ID NO: 2615653 - RNA, 19 nt, Escherichia coli CFT073
gaaacagauaaaaguuaca

SEQ ID NO: 2615654 - RNA, 19 nt, Escherichia coli CFT073
gaaacagcaccauccgccc

SEQ ID NO: 2615655 - RNA, 20 nt, Escherichia coli CFT073
gaaacagccaaucauaaacg

SEQ ID NO: 2615656 - RNA, 13 nt, Escherichia coli CFT073
gaaacagccaccc

SEQ ID NO: 2615657 - RNA, 14 nt, Escherichia coli CFT073
gaaacaggcggcgc

SEQ ID NO: 2615658 - RNA, 23 nt, Escherichia coli CFT073
gaaacagguggcguuugccaccu

SEQ ID NO: 2615659 - RNA, 22 nt, Escherichia coli CFT073
gaaacaucauccccaucgccgc

SEQ ID NO: 2615660 - RNA, 19 nt, Escherichia coli CFT073
gaaacauccccagcgucag

SEQ ID NO: 2615661 - RNA, 12 nt, Escherichia coli CFT073
gaaacaugaaca

SEQ ID NO: 2615662 - RNA, 15 nt, Escherichia coli CFT073
gaaacaugaacauca

SEQ ID NO: 2615663 - RNA, 16 nt, Escherichia coli CFT073
gaaaccaaacuuaugc

SEQ ID NO: 2615664 - RNA, 21 nt, Escherichia coli CFT073
gaaaccaagaccaauccgcca

SEQ ID NO: 2615665 - RNA, 22 nt, Escherichia coli CFT073
gaaaccaagaccaauccgccag

SEQ ID NO: 2615666 - RNA, 19 nt, Escherichia coli CFT073
gaaaccacggugauucccg

SEQ ID NO: 2615667 - RNA, 17 nt, Escherichia coli CFT073
gaaaccauccagcagac

SEQ ID NO: 2615668 - RNA, 13 nt, Escherichia coli CFT073
gaaacccaacgca

SEQ ID NO: 2615669 - RNA, 14 nt, Escherichia coli CFT073
gaaacccacgacca

SEQ ID NO: 2615670 - RNA, 21 nt, Escherichia coli CFT073
gaaaugagauauuucagagcu

SEQ ID NO: 2615671 - RNA, 22 nt, Escherichia coli CFT073
gaaaugauguuugcgacaaacu

SEQ ID NO: 2615672 - RNA, 18 nt, Escherichia coli CFT073
gaaaugccaaauauuucu

SEQ ID NO: 2615673 - RNA, 21 nt, Escherichia coli CFT073
gaaaugccaaauguauccauc

SEQ ID NO: 2615674 - RNA, 18 nt, Escherichia coli CFT073
gaaaugccaguaacucau

SEQ ID NO: 2615675 - RNA, 11 nt, Escherichia coli CFT073
gaaaugcggcg

SEQ ID NO: 2615676 - RNA, 12 nt, Escherichia coli CFT073
gaaauggcuggu

SEQ ID NO: 2615677 - RNA, 16 nt, Escherichia coli CFT073
gaaauggcuggucagg

SEQ ID NO: 2615678 - RNA, 15 nt, Escherichia coli CFT073
gaaauggucacacac

SEQ ID NO: 2615679 - RNA, 21 nt, Escherichia coli CFT073
gaaauggugugcaugguguuc

SEQ ID NO: 2615680 - RNA, 14 nt, Escherichia coli CFT073
gaaauguaaaaguu

SEQ ID NO: 2615681 - RNA, 20 nt, Escherichia coli CFT073
gaaauguaaaaguugcaguc

SEQ ID NO: 2615682 - RNA, 21 nt, Escherichia coli CFT073
gaaaugugccggaugcaucac

SEQ ID NO: 2615683 - RNA, 15 nt, Escherichia coli CFT073
gaaauguuccagugc

SEQ ID NO: 2615684 - RNA, 20 nt, Escherichia coli CFT073
gaaauguugaauugcagggu

SEQ ID NO: 2615685 - RNA, 22 nt, Escherichia coli CFT073
gaaauguugccggauggcacgc

SEQ ID NO: 2615686 - RNA, 20 nt, Escherichia coli CFT073
gaaauuaagaucagaagcau

SEQ ID NO: 2615687 - RNA, 14 nt, Escherichia coli CFT073
gaaauuaagcggca

SEQ ID NO: 2615688 - RNA, 18 nt, Escherichia coli CFT073
gaaauuaccgcaccacca

SEQ ID NO: 2615689 - RNA, 20 nt, Escherichia coli CFT073
gaaauuauucuacgcgaccu

SEQ ID NO: 2615690 - RNA, 17 nt, Escherichia coli CFT073
gaaauucaccaccgcaa

SEQ ID NO: 2615691 - RNA, 21 nt, Escherichia coli CFT073
gaaauucacuuccgucaugua

SEQ ID NO: 2615692 - RNA, 13 nt, Escherichia coli CFT073
gaaauuccugaga

SEQ ID NO: 2615693 - RNA, 21 nt, Escherichia coli CFT073
gaaauugcaaacgcguuaagc

SEQ ID NO: 2615694 - RNA, 15 nt, Escherichia coli CFT073
gaaauugcugccgcu

SEQ ID NO: 2615695 - RNA, 17 nt, Escherichia coli CFT073
gaaauugugauaaaaau

SEQ ID NO: 2615696 - RNA, 22 nt, Escherichia coli CFT073
gaaauugugauaaaaaucggca

SEQ ID NO: 2615697 - RNA, 12 nt, Escherichia coli CFT073
gaacaaaacagc

SEQ ID NO: 2615698 - RNA, 16 nt, Escherichia coli CFT073
gaacaaagcaaauaau

SEQ ID NO: 2615699 - RNA, 17 nt, Escherichia coli CFT073
gaacaaagcaaauaaug

SEQ ID NO: 2615700 - RNA, 20 nt, Escherichia coli CFT073
gaacaaaucgcacguuguca

SEQ ID NO: 2615701 - RNA, 14 nt, Escherichia coli CFT073
gaacaagaaacaga

SEQ ID NO: 2615702 - RNA, 18 nt, Escherichia coli CFT073
gaacaagauugccugaug

SEQ ID NO: 2615703 - RNA, 20 nt, Escherichia coli CFT073
gaacaagccaaauccagcac

SEQ ID NO: 2615704 - RNA, 19 nt, Escherichia coli CFT073
gaacaaggcaauuaaaaau

SEQ ID NO: 2615705 - RNA, 19 nt, Escherichia coli CFT073
gaacaaguucgcuccagcc

SEQ ID NO: 2615706 - RNA, 21 nt, Escherichia coli CFT073
gaacaauuucagcaauaauca

SEQ ID NO: 2615707 - RNA, 16 nt, Escherichia coli CFT073
gaacacauuugucgga

SEQ ID NO: 2615708 - RNA, 19 nt, Escherichia coli CFT073
gaacaccaacggacggguc

SEQ ID NO: 2615709 - RNA, 19 nt, Escherichia coli CFT073
gaacaccaaucuucaacac

SEQ ID NO: 2615710 - RNA, 14 nt, Escherichia coli CFT073
gaacaccagcaccg

SEQ ID NO: 2615711 - RNA, 17 nt, Escherichia coli CFT073
gaacacgcaacaccagc

SEQ ID NO: 2615712 - RNA, 18 nt, Escherichia coli CFT073
gaacacgcaacaccagca

SEQ ID NO: 2615713 - RNA, 15 nt, Escherichia coli CFT073
gaacacgcucccagc

SEQ ID NO: 2615714 - RNA, 18 nt, Escherichia coli CFT073
gaacacgcucccagcagu

SEQ ID NO: 2615715 - RNA, 15 nt, Escherichia coli CFT073
gaacacggacaauac

SEQ ID NO: 2615716 - RNA, 14 nt, Escherichia coli CFT073
gaacagaaaucuga

SEQ ID NO: 2615717 - RNA, 21 nt, Escherichia coli CFT073
gaacagaccacauuccaggcc

SEQ ID NO: 2615718 - RNA, 23 nt, Escherichia coli CFT073
gaacagaccacauuccaggcccg

SEQ ID NO: 2615719 - RNA, 17 nt, Escherichia coli CFT073
gaacagagucugaccac

SEQ ID NO: 2615720 - RNA, 13 nt, Escherichia coli CFT073
gaacagcaacuca

SEQ ID NO: 2615721 - RNA, 16 nt, Escherichia coli CFT073
gaacagcaacucagcc

SEQ ID NO: 2615722 - RNA, 22 nt, Escherichia coli CFT073
gaacagccagaaugaggcauca

SEQ ID NO: 2615723 - RNA, 24 nt, Escherichia coli CFT073
gaacagccagaaugaggcaucauu

SEQ ID NO: 2615724 - RNA, 14 nt, Escherichia coli CFT073
gaacagcccgccaa

SEQ ID NO: 2615725 - RNA, 13 nt, Escherichia coli CFT073
gaacagcggagca

SEQ ID NO: 2615726 - RNA, 18 nt, Escherichia coli CFT073
gaacagcuuuuuccugcg

SEQ ID NO: 2615727 - RNA, 21 nt, Escherichia coli CFT073
gaacaggcaucacuuuaccgg

SEQ ID NO: 2615728 - RNA, 22 nt, Escherichia coli CFT073
gaacaggcuggccguauuuuug

SEQ ID NO: 2615729 - RNA, 18 nt, Escherichia coli CFT073
gaacagggguuauaucuu

SEQ ID NO: 2615730 - RNA, 15 nt, Escherichia coli CFT073
gaacaguaaagcgca

SEQ ID NO: 2615731 - RNA, 16 nt, Escherichia coli CFT073
gaacagugccagacaa

SEQ ID NO: 2615732 - RNA, 17 nt, Escherichia coli CFT073
gaacagugccagacaaa

SEQ ID NO: 2615733 - RNA, 12 nt, Escherichia coli CFT073
gaacauaaacag

SEQ ID NO: 2615734 - RNA, 17 nt, Escherichia coli CFT073
gaacauaugcacaugau

SEQ ID NO: 2615735 - RNA, 16 nt, Escherichia coli CFT073
gaacauccccugcgcg

SEQ ID NO: 2615736 - RNA, 18 nt, Escherichia coli CFT073
gaacauccggcacuuucg

SEQ ID NO: 2615737 - RNA, 23 nt, Escherichia coli CFT073
gaacaucgaugccgccuggugca

SEQ ID NO: 2615738 - RNA, 12 nt, Escherichia coli CFT073
gaacaucgccau

SEQ ID NO: 2615739 - RNA, 17 nt, Escherichia coli CFT073
gaacauuaagaggcauu

SEQ ID NO: 2615740 - RNA, 16 nt, Escherichia coli CFT073
gaacauucggcaaugg

SEQ ID NO: 2615741 - RNA, 15 nt, Escherichia coli CFT073
gaacauugcugcuga

SEQ ID NO: 2615742 - RNA, 21 nt, Escherichia coli CFT073
gaacauuucccgcauaaagag

SEQ ID NO: 2615743 - RNA, 18 nt, Escherichia coli CFT073
gaaccaaacagcgccaga

SEQ ID NO: 2615744 - RNA, 15 nt, Escherichia coli CFT073
gaaccaaaguagaua

SEQ ID NO: 2615745 - RNA, 18 nt, Escherichia coli CFT073
gaaccaaaguagauaauc

SEQ ID NO: 2615746 - RNA, 19 nt, Escherichia coli CFT073
gaaccaaaguuugcaaacc

SEQ ID NO: 2615747 - RNA, 15 nt, Escherichia coli CFT073
gaaccaaaugccgga

SEQ ID NO: 2615748 - RNA, 13 nt, Escherichia coli CFT073
gaaccaaucacua

SEQ ID NO: 2615749 - RNA, 21 nt, Escherichia coli CFT073
gaaccaaucagccgagcuuca

SEQ ID NO: 2615750 - RNA, 13 nt, Escherichia coli CFT073
gaaccacagcccg

SEQ ID NO: 2615751 - RNA, 13 nt, Escherichia coli CFT073
gaaccacagcgcc

SEQ ID NO: 2615752 - RNA, 14 nt, Escherichia coli CFT073
gaaccacagcgccg

SEQ ID NO: 2615753 - RNA, 16 nt, Escherichia coli CFT073
gaaccagaauuuccag

SEQ ID NO: 2615754 - RNA, 23 nt, Escherichia coli CFT073
gaaccagaccgccuuugaucucu

SEQ ID NO: 2615755 - RNA, 12 nt, Escherichia coli CFT073
gaaccagcugcc

SEQ ID NO: 2615756 - RNA, 19 nt, Escherichia coli CFT073
gaaccagggaaaaaagccc

SEQ ID NO: 2615757 - RNA, 14 nt, Escherichia coli CFT073
gaaccaguauccgc

SEQ ID NO: 2615758 - RNA, 16 nt, Escherichia coli CFT073
gaaccaguauccgcua

SEQ ID NO: 2615759 - RNA, 16 nt, Escherichia coli CFT073
gaaccagugaauacug

SEQ ID NO: 2615760 - RNA, 18 nt, Escherichia coli CFT073
gaaccaucaccucuucac

SEQ ID NO: 2615761 - RNA, 22 nt, Escherichia coli CFT073
gaaccaugcaaucacugccacc

SEQ ID NO: 2615762 - RNA, 19 nt, Escherichia coli CFT073
gaacccccugaaagcgaca

SEQ ID NO: 2615763 - RNA, 17 nt, Escherichia coli CFT073
gaacccgcaguccugca

SEQ ID NO: 2615764 - RNA, 13 nt, Escherichia coli CFT073
gaaccgcaggugg

SEQ ID NO: 2615765 - RNA, 22 nt, Escherichia coli CFT073
gaaccgccgcugucugaaugau

SEQ ID NO: 2615766 - RNA, 23 nt, Escherichia coli CFT073
gaaccgccgcugucugaaugaua

SEQ ID NO: 2615767 - RNA, 22 nt, Escherichia coli CFT073
gaaccgccuggcgcugcucagg

SEQ ID NO: 2615768 - RNA, 17 nt, Escherichia coli CFT073
gaaccgcguaacuuuug

SEQ ID NO: 2615769 - RNA, 14 nt, Escherichia coli CFT073
gaaccggaaaucca

SEQ ID NO: 2615770 - RNA, 23 nt, Escherichia coli CFT073
gaaccgggcggacuuucacuuca

SEQ ID NO: 2615771 - RNA, 23 nt, Escherichia coli CFT073
gaaccgguugccgguagcuucca

SEQ ID NO: 2615772 - RNA, 15 nt, Escherichia coli CFT073
gaaccguaaacagau

SEQ ID NO: 2615773 - RNA, 20 nt, Escherichia coli CFT073
gaaccguauagcauggcuuc

SEQ ID NO: 2615774 - RNA, 15 nt, Escherichia coli CFT073
gaaccgucacuguug

SEQ ID NO: 2615775 - RNA, 14 nt, Escherichia coli CFT073
gaaccuaagcaauu

SEQ ID NO: 2615776 - RNA, 23 nt, Escherichia coli CFT073
gaaccucacagaggucuuuucuc

SEQ ID NO: 2615777 - RNA, 19 nt, Escherichia coli CFT073
gaaccugaggcaauaaaua

SEQ ID NO: 2615778 - RNA, 15 nt, Escherichia coli CFT073
gaagcccacaccgcc

SEQ ID NO: 2615779 - RNA, 23 nt, Escherichia coli CFT073
gaagcccacaccgcccagcgagc

SEQ ID NO: 2615780 - RNA, 22 nt, Escherichia coli CFT073
gaagcccauuucaguauugagc

SEQ ID NO: 2615781 - RNA, 12 nt, Escherichia coli CFT073
gaagccccagcu

SEQ ID NO: 2615782 - RNA, 17 nt, Escherichia coli CFT073
gaagccgaacagucgcu

SEQ ID NO: 2615783 - RNA, 20 nt, Escherichia coli CFT073
gaagccgaccagcaccgcca

SEQ ID NO: 2615784 - RNA, 19 nt, Escherichia coli CFT073
gaagccgcuccggcagcag

SEQ ID NO: 2615785 - RNA, 16 nt, Escherichia coli CFT073
gaagccgggcagguga

SEQ ID NO: 2615786 - RNA, 14 nt, Escherichia coli CFT073
gaagccggucauau

SEQ ID NO: 2615787 - RNA, 21 nt, Escherichia coli CFT073
gaagccguuggucaucaucag

SEQ ID NO: 2615788 - RNA, 21 nt, Escherichia coli CFT073
gaagccuuccgcaaacaggcg

SEQ ID NO: 2615789 - RNA, 15 nt, Escherichia coli CFT073
gaagcgaacaucgag

SEQ ID NO: 2615790 - RNA, 17 nt, Escherichia coli CFT073
gaagcgacugacgucac

SEQ ID NO: 2615791 - RNA, 19 nt, Escherichia coli CFT073
gaagcgcaacagcgcgccc

SEQ ID NO: 2615792 - RNA, 20 nt, Escherichia coli CFT073
gaagcgcagcgcaucaggca

SEQ ID NO: 2615793 - RNA, 22 nt, Escherichia coli CFT073
gaagcgccggaugcgacgcauc

SEQ ID NO: 2615794 - RNA, 18 nt, Escherichia coli CFT073
gaagcgccguccaguaau

SEQ ID NO: 2615795 - RNA, 19 nt, Escherichia coli CFT073
gaagcgcgccguaugcgaa

SEQ ID NO: 2615796 - RNA, 13 nt, Escherichia coli CFT073
gaagcggcagagg

SEQ ID NO: 2615797 - RNA, 12 nt, Escherichia coli CFT073
gaagcguacugu

SEQ ID NO: 2615798 - RNA, 16 nt, Escherichia coli CFT073
gaagcguacugucugc

SEQ ID NO: 2615799 - RNA, 14 nt, Escherichia coli CFT073
gaagcguauggcgu

SEQ ID NO: 2615800 - RNA, 12 nt, Escherichia coli CFT073
gaagcgugcauc

SEQ ID NO: 2615801 - RNA, 14 nt, Escherichia coli CFT073
gaagcguugaucca

SEQ ID NO: 2615802 - RNA, 15 nt, Escherichia coli CFT073
gaagcucauaugcag

SEQ ID NO: 2615803 - RNA, 21 nt, Escherichia coli CFT073
gaagcucguuguuuacgccgg

SEQ ID NO: 2615804 - RNA, 13 nt, Escherichia coli CFT073
gaagcugaacagu

SEQ ID NO: 2615805 - RNA, 17 nt, Escherichia coli CFT073
gaagcugaacagucgcu

SEQ ID NO: 2615806 - RNA, 21 nt, Escherichia coli CFT073
gaagcugguguaacugcgcca

SEQ ID NO: 2615807 - RNA, 22 nt, Escherichia coli CFT073
gaagcugguguaacugcgccag

SEQ ID NO: 2615808 - RNA, 14 nt, Escherichia coli CFT073
gaagcuugcuucuu

SEQ ID NO: 2615809 - RNA, 13 nt, Escherichia coli CFT073
gaagcuuuucggg

SEQ ID NO: 2615810 - RNA, 17 nt, Escherichia coli CFT073
gaaggaaaauacagcaa

SEQ ID NO: 2615811 - RNA, 19 nt, Escherichia coli CFT073
gaaggaaccuguucaacaa

SEQ ID NO: 2615812 - RNA, 16 nt, Escherichia coli CFT073
gaaggaagacguagca

SEQ ID NO: 2615813 - RNA, 16 nt, Escherichia coli CFT073
gaaggcgcauugcugg

SEQ ID NO: 2615814 - RNA, 17 nt, Escherichia coli CFT073
gaaggcgcuuggcuucc

SEQ ID NO: 2615815 - RNA, 21 nt, Escherichia coli CFT073
gaagggaucuuccaguucuuc

SEQ ID NO: 2615816 - RNA, 13 nt, Escherichia coli CFT073
gaagggcuggcca

SEQ ID NO: 2615817 - RNA, 22 nt, Escherichia coli CFT073
gaagguaaaaguagggcgcugc

SEQ ID NO: 2615818 - RNA, 14 nt, Escherichia coli CFT073
gaagguaccgcaau

SEQ ID NO: 2615819 - RNA, 15 nt, Escherichia coli CFT073
gaagguaccgcaaug

SEQ ID NO: 2615820 - RNA, 21 nt, Escherichia coli CFT073
gaaggugaacgccaccaacgc

SEQ ID NO: 2615821 - RNA, 16 nt, Escherichia coli CFT073
gaaggugccugcccag

SEQ ID NO: 2615822 - RNA, 14 nt, Escherichia coli CFT073
gaagguucgaaucc

SEQ ID NO: 2615823 - RNA, 19 nt, Escherichia coli CFT073
gaagguugccauaucuucc

SEQ ID NO: 2615824 - RNA, 14 nt, Escherichia coli CFT073
gaagguugccgggg

SEQ ID NO: 2615825 - RNA, 20 nt, Escherichia coli CFT073
gaagguuuuuucuguauuca

SEQ ID NO: 2615826 - RNA, 17 nt, Escherichia coli CFT073
gaaguaacagagugaau

SEQ ID NO: 2615827 - RNA, 21 nt, Escherichia coli CFT073
gaaguaaccgcauccggcgca

SEQ ID NO: 2615828 - RNA, 17 nt, Escherichia coli CFT073
gaaguaauaaucaacgc

SEQ ID NO: 2615829 - RNA, 23 nt, Escherichia coli CFT073
gaaguaauaaucaacgcgccgac

SEQ ID NO: 2615830 - RNA, 17 nt, Escherichia coli CFT073
gaaguacgcaguaaaua

SEQ ID NO: 2615831 - RNA, 14 nt, Escherichia coli CFT073
gaaguaguugcugu

SEQ ID NO: 2615832 - RNA, 21 nt, Escherichia coli CFT073
gaaguaugacgaguauauucu

SEQ ID NO: 2615833 - RNA, 21 nt, Escherichia coli CFT073
gaaguauggaaaucacccagc

SEQ ID NO: 2615834 - RNA, 17 nt, Escherichia coli CFT073
gaagucgaacuucucuu

SEQ ID NO: 2615835 - RNA, 17 nt, Escherichia coli CFT073
gaagucgcugcugccug

SEQ ID NO: 2615836 - RNA, 22 nt, Escherichia coli CFT073
gaagucuuaagugggcaacaag

SEQ ID NO: 2615837 - RNA, 20 nt, Escherichia coli CFT073
gaagugagggccagcguuuu

SEQ ID NO: 2615838 - RNA, 16 nt, Escherichia coli CFT073
gaagugauccgccgug

SEQ ID NO: 2615839 - RNA, 21 nt, Escherichia coli CFT073
gaagugaucuuucagcguuuu

SEQ ID NO: 2615840 - RNA, 15 nt, Escherichia coli CFT073
gaagugaugaaaaac

SEQ ID NO: 2615841 - RNA, 13 nt, Escherichia coli CFT073
gaaguggcugacc

SEQ ID NO: 2615842 - RNA, 14 nt, Escherichia coli CFT073
gaaguggugauuga

SEQ ID NO: 2615843 - RNA, 23 nt, Escherichia coli CFT073
gaagugguugagugugcacagca

SEQ ID NO: 2615844 - RNA, 16 nt, Escherichia coli CFT073
gaaguuagagccgaua

SEQ ID NO: 2615845 - RNA, 16 nt, Escherichia coli CFT073
gaaguucgguaggccg

SEQ ID NO: 2615846 - RNA, 16 nt, Escherichia coli CFT073
gaaguuuaauucuuug

SEQ ID NO: 2615847 - RNA, 19 nt, Escherichia coli CFT073
gaaguuuugucgcugauuc

SEQ ID NO: 2615848 - RNA, 21 nt, Escherichia coli CFT073
gaaguuuuucgucaccuggua

SEQ ID NO: 2615849 - RNA, 17 nt, Escherichia coli CFT073
gaauaaaacgccugaua

SEQ ID NO: 2615850 - RNA, 21 nt, Escherichia coli CFT073
gaauaaacagcagauggcagc

SEQ ID NO: 2615851 - RNA, 13 nt, Escherichia coli CFT073
gaauaaacgccau

SEQ ID NO: 2615852 - RNA, 23 nt, Escherichia coli CFT073
gaauaaaguuuuaguugccguuc

SEQ ID NO: 2615853 - RNA, 16 nt, Escherichia coli CFT073
gaauaaauuggcuggg

SEQ ID NO: 2615854 - RNA, 23 nt, Escherichia coli CFT073
gaauaacucccuauaaugcgcca

SEQ ID NO: 2615855 - RNA, 15 nt, Escherichia coli CFT073
gaauaagaauaugaa

SEQ ID NO: 2615856 - RNA, 14 nt, Escherichia coli CFT073
gaauaaggcgguua

SEQ ID NO: 2615857 - RNA, 13 nt, Escherichia coli CFT073
gaauaaggcguuu

SEQ ID NO: 2615858 - RNA, 20 nt, Escherichia coli CFT073
gaauaaguuucagcaucagg

SEQ ID NO: 2615859 - RNA, 13 nt, Escherichia coli CFT073
gaauaaucagaug

SEQ ID NO: 2615860 - RNA, 15 nt, Escherichia coli CFT073
gaauaaucagcagug

SEQ ID NO: 2615861 - RNA, 18 nt, Escherichia coli CFT073
gaauaauccccacaucag

SEQ ID NO: 2615862 - RNA, 19 nt, Escherichia coli CFT073
gaauaaucccggcaccaau

SEQ ID NO: 2615863 - RNA, 15 nt, Escherichia coli CFT073
gaauaauccgcccgg

SEQ ID NO: 2615864 - RNA, 17 nt, Escherichia coli CFT073
gaauaaucguaaucagc

SEQ ID NO: 2615865 - RNA, 19 nt, Escherichia coli CFT073
gaauaaucugaaaaccagg

SEQ ID NO: 2615866 - RNA, 15 nt, Escherichia coli CFT073
gaauaaugcaaaaag

SEQ ID NO: 2615867 - RNA, 16 nt, Escherichia coli CFT073
gaauaaugucgacguu

SEQ ID NO: 2615868 - RNA, 19 nt, Escherichia coli CFT073
gaauacacugcugauaauc

SEQ ID NO: 2615869 - RNA, 12 nt, Escherichia coli CFT073
gaauacauucau

SEQ ID NO: 2615870 - RNA, 19 nt, Escherichia coli CFT073
gaauaccccagcggcaacc

SEQ ID NO: 2615871 - RNA, 23 nt, Escherichia coli CFT073
gaauaccccagcggcaaccagca

SEQ ID NO: 2615872 - RNA, 14 nt, Escherichia coli CFT073
gaauacccgccaga

SEQ ID NO: 2615873 - RNA, 13 nt, Escherichia coli CFT073
gaauaccgacauc

SEQ ID NO: 2615874 - RNA, 16 nt, Escherichia coli CFT073
gaauaccugagacaaa

SEQ ID NO: 2615875 - RNA, 13 nt, Escherichia coli CFT073
gaauaccuucuuc

SEQ ID NO: 2615876 - RNA, 16 nt, Escherichia coli CFT073
gaauaccuucuuccug

SEQ ID NO: 2615877 - RNA, 18 nt, Escherichia coli CFT073
gaauaccuugcugcucca

SEQ ID NO: 2615878 - RNA, 21 nt, Escherichia coli CFT073
gaauaccuuucuccgcgaccu

SEQ ID NO: 2615879 - RNA, 13 nt, Escherichia coli CFT073
gaauacgccgaua

SEQ ID NO: 2615880 - RNA, 21 nt, Escherichia coli CFT073
gaauacguugcaaauauucca

SEQ ID NO: 2615881 - RNA, 14 nt, Escherichia coli CFT073
gaauagaacauaau

SEQ ID NO: 2615882 - RNA, 21 nt, Escherichia coli CFT073
gaauagaaccuaagaaccaga

SEQ ID NO: 2615883 - RNA, 17 nt, Escherichia coli CFT073
gaauagauuaugaaauu

SEQ ID NO: 2615884 - RNA, 14 nt, Escherichia coli CFT073
gaauagccgcagcu

SEQ ID NO: 2615885 - RNA, 19 nt, Escherichia coli CFT073
gaauagccgcagcuaucag

SEQ ID NO: 2615886 - RNA, 14 nt, Escherichia coli CFT073
gaauggcauacugu

SEQ ID NO: 2615887 - RNA, 13 nt, Escherichia coli CFT073
gaauggcaucuga

SEQ ID NO: 2615888 - RNA, 15 nt, Escherichia coli CFT073
gaauggcgaacgcua

SEQ ID NO: 2615889 - RNA, 14 nt, Escherichia coli CFT073
gaauggcugcacuu

SEQ ID NO: 2615890 - RNA, 18 nt, Escherichia coli CFT073
gaauggcugcacuuucag

SEQ ID NO: 2615891 - RNA, 17 nt, Escherichia coli CFT073
gaauggguaaacccgcg

SEQ ID NO: 2615892 - RNA, 18 nt, Escherichia coli CFT073
gaauggguucgauuucau

SEQ ID NO: 2615893 - RNA, 21 nt, Escherichia coli CFT073
gaaugguaaucagcgacugcu

SEQ ID NO: 2615894 - RNA, 14 nt, Escherichia coli CFT073
gaauggugaccugc

SEQ ID NO: 2615895 - RNA, 22 nt, Escherichia coli CFT073
gaauggugccgacagguggugu

SEQ ID NO: 2615896 - RNA, 12 nt, Escherichia coli CFT073
gaaugguuaacg

SEQ ID NO: 2615897 - RNA, 17 nt, Escherichia coli CFT073
gaaugguuuugucagcc

SEQ ID NO: 2615898 - RNA, 14 nt, Escherichia coli CFT073
gaauguaaugcaug

SEQ ID NO: 2615899 - RNA, 23 nt, Escherichia coli CFT073
gaauuaaaaacaguaugcaacaa

SEQ ID NO: 2615900 - RNA, 23 nt, Escherichia coli CFT073
gaauuaaaauguguacuucucug

SEQ ID NO: 2615901 - RNA, 15 nt, Escherichia coli CFT073
gaauuaacaccacca

SEQ ID NO: 2615902 - RNA, 22 nt, Escherichia coli CFT073
gaauuaacuuaucaagaaagcu

SEQ ID NO: 2615903 - RNA, 14 nt, Escherichia coli CFT073
gaauuaaugccucu

SEQ ID NO: 2615904 - RNA, 14 nt, Escherichia coli CFT073
gaauuauccccgau

SEQ ID NO: 2615905 - RNA, 13 nt, Escherichia coli CFT073
gaauuaugcagcc

SEQ ID NO: 2615906 - RNA, 16 nt, Escherichia coli CFT073
gaauuaugcagccuuc

SEQ ID NO: 2615907 - RNA, 17 nt, Escherichia coli CFT073
gaauuauuagcaacgau

SEQ ID NO: 2615908 - RNA, 20 nt, Escherichia coli CFT073
gaauuauucagaguauauau

SEQ ID NO: 2615909 - RNA, 21 nt, Escherichia coli CFT073
gaauuauucagaguauauauu

SEQ ID NO: 2615910 - RNA, 23 nt, Escherichia coli CFT073
gaauucaacuaacugacuuucuu

SEQ ID NO: 2615911 - RNA, 16 nt, Escherichia coli CFT073
gaauucaguaccagca

SEQ ID NO: 2615912 - RNA, 17 nt, Escherichia coli CFT073
gaauucaguaccagcac

SEQ ID NO: 2615913 - RNA, 21 nt, Escherichia coli CFT073
gaauucaguaccagcaccuga

SEQ ID NO: 2615914 - RNA, 16 nt, Escherichia coli CFT073
gaauuccgaauuucau

SEQ ID NO: 2615915 - RNA, 22 nt, Escherichia coli CFT073
gaauuccggcagagaaagcaaa

SEQ ID NO: 2615916 - RNA, 22 nt, Escherichia coli CFT073
gaauuccggcuucuucugccgc

SEQ ID NO: 2615917 - RNA, 18 nt, Escherichia coli CFT073
gaauuccgugccagcacc

SEQ ID NO: 2615918 - RNA, 21 nt, Escherichia coli CFT073
gaauucgguagucauuaacua

SEQ ID NO: 2615919 - RNA, 23 nt, Escherichia coli CFT073
gaauucguucaaacgauucggca

SEQ ID NO: 2615920 - RNA, 17 nt, Escherichia coli CFT073
gaauugaagcuguauca

SEQ ID NO: 2615921 - RNA, 20 nt, Escherichia coli CFT073
gaauugcaucuacgcucucu

SEQ ID NO: 2615922 - RNA, 20 nt, Escherichia coli CFT073
gaauugcugcgcccgcagcg

SEQ ID NO: 2615923 - RNA, 14 nt, Escherichia coli CFT073
gaauugcuuccagu

SEQ ID NO: 2615924 - RNA, 20 nt, Escherichia coli CFT073
gaauugcuuccaguaacacu

SEQ ID NO: 2615925 - RNA, 17 nt, Escherichia coli CFT073
gaauuggguucuuuccu

SEQ ID NO: 2615926 - RNA, 22 nt, Escherichia coli CFT073
gaauuguccagaucuuucgcca

SEQ ID NO: 2615927 - RNA, 21 nt, Escherichia coli CFT073
gaauugucccauuugccagcg

SEQ ID NO: 2615928 - RNA, 14 nt, Escherichia coli CFT073
gaauugugaugguu

SEQ ID NO: 2615929 - RNA, 18 nt, Escherichia coli CFT073
gaauugugcuuucaguuc

SEQ ID NO: 2615930 - RNA, 19 nt, Escherichia coli CFT073
gaauuuaucuuucagcacu

SEQ ID NO: 2615931 - RNA, 16 nt, Escherichia coli CFT073
gaauuucaauaauucc

SEQ ID NO: 2615932 - RNA, 13 nt, Escherichia coli CFT073
gaauuucacuuuc

SEQ ID NO: 2615933 - RNA, 19 nt, Escherichia coli CFT073
gaauuucacuuucugacca

SEQ ID NO: 2615934 - RNA, 23 nt, Escherichia coli CFT073
gaauuucagguucugaccagcca

SEQ ID NO: 2615935 - RNA, 17 nt, Escherichia coli CFT073
gaauuucaucaccagcu

SEQ ID NO: 2615936 - RNA, 20 nt, Escherichia coli CFT073
gaauuucaucaucacgaaau

SEQ ID NO: 2615937 - RNA, 16 nt, Escherichia coli CFT073
gaauuuccagaaagug

SEQ ID NO: 2615938 - RNA, 18 nt, Escherichia coli CFT073
gaauuuccagauguggug

SEQ ID NO: 2615939 - RNA, 22 nt, Escherichia coli CFT073
gaauuuccgguuguuuugguua

SEQ ID NO: 2615940 - RNA, 15 nt, Escherichia coli CFT073
gaauuuccugcgcuu

SEQ ID NO: 2615941 - RNA, 19 nt, Escherichia coli CFT073
gaauuuccugcgcuuucug

SEQ ID NO: 2615942 - RNA, 14 nt, Escherichia coli CFT073
gaauuugaggaagc

SEQ ID NO: 2615943 - RNA, 21 nt, Escherichia coli CFT073
gaauuugucgauuuccaucuc

SEQ ID NO: 2615944 - RNA, 15 nt, Escherichia coli CFT073
gaauuuuaauauguu

SEQ ID NO: 2615945 - RNA, 23 nt, Escherichia coli CFT073
gaauuuugcuggcuucgcgcgcu

SEQ ID NO: 2615946 - RNA, 13 nt, Escherichia coli CFT073
gacaaaagugaau

SEQ ID NO: 2615947 - RNA, 21 nt, Escherichia coli CFT073
gacaaaagugaaugucggcgg

SEQ ID NO: 2615948 - RNA, 22 nt, Escherichia coli CFT073
gacaaaaucaauauaaacagcc

SEQ ID NO: 2615949 - RNA, 23 nt, Escherichia coli CFT073
gacaaaaucaauauaaacagccc

SEQ ID NO: 2615950 - RNA, 24 nt, Escherichia coli CFT073
gacaaaauccccuucauuaagaau

SEQ ID NO: 2615951 - RNA, 21 nt, Escherichia coli CFT073
gacaaacaccgaaccagagau

SEQ ID NO: 2615952 - RNA, 21 nt, Escherichia coli CFT073
gacaaacagcucgacaccaaa

SEQ ID NO: 2615953 - RNA, 17 nt, Escherichia coli CFT073
gacaaacuaaccagacg

SEQ ID NO: 2615954 - RNA, 20 nt, Escherichia coli CFT073
gacaaacucaccuggcugau

SEQ ID NO: 2615955 - RNA, 17 nt, Escherichia coli CFT073
gacaaacugccgacaau

SEQ ID NO: 2615956 - RNA, 13 nt, Escherichia coli CFT073
gacaaacugcgug

SEQ ID NO: 2615957 - RNA, 15 nt, Escherichia coli CFT073
gacaaaguugaagcc

SEQ ID NO: 2615958 - RNA, 23 nt, Escherichia coli CFT073
gacaaaguuugucccuugucugg

SEQ ID NO: 2615959 - RNA, 18 nt, Escherichia coli CFT073
gacaaauaacccgccaug

SEQ ID NO: 2615960 - RNA, 20 nt, Escherichia coli CFT073
gccggauaucccccuuucug

SEQ ID NO: 2615961 - RNA, 22 nt, Escherichia coli CFT073
gccggauaucccccuuucugca

SEQ ID NO: 2615962 - RNA, 23 nt, Escherichia coli CFT073
gccggauauuccugaauggugac

SEQ ID NO: 2615963 - RNA, 16 nt, Escherichia coli CFT073
gccggaucgaccgguu

SEQ ID NO: 2615964 - RNA, 18 nt, Escherichia coli CFT073
gccggaucuuucaggaac

SEQ ID NO: 2615965 - RNA, 23 nt, Escherichia coli CFT073
gccggaugaguauuucauccggc

SEQ ID NO: 2615966 - RNA, 18 nt, Escherichia coli CFT073
gccggaugaucauccggc

SEQ ID NO: 2615967 - RNA, 10 nt, Escherichia coli CFT073
gccggaugcg

SEQ ID NO: 2615968 - RNA, 20 nt, Escherichia coli CFT073
gccggaugcgaacauccggc

SEQ ID NO: 2615969 - RNA, 15 nt, Escherichia coli CFT073
gccggaugcggcagg

SEQ ID NO: 2615970 - RNA, 19 nt, Escherichia coli CFT073
gccggaugcggcaggcgua

SEQ ID NO: 2615971 - RNA, 23 nt, Escherichia coli CFT073
gccggaugcggcgcgagcgccuu

SEQ ID NO: 2615972 - RNA, 14 nt, Escherichia coli CFT073
gccggaugcggcgu

SEQ ID NO: 2615973 - RNA, 15 nt, Escherichia coli CFT073
gccggaugcggcgua

SEQ ID NO: 2615974 - RNA, 16 nt, Escherichia coli CFT073
gccggaugcggcguaa

SEQ ID NO: 2615975 - RNA, 23 nt, Escherichia coli CFT073
gccggaugcggcgugaacaccuu

SEQ ID NO: 2615976 - RNA, 20 nt, Escherichia coli CFT073
gccggauggaaacauccggc

SEQ ID NO: 2615977 - RNA, 22 nt, Escherichia coli CFT073
gccggauguggcguaaacgccu

SEQ ID NO: 2615978 - RNA, 19 nt, Escherichia coli CFT073
gccggauguguugcauccg

SEQ ID NO: 2615979 - RNA, 20 nt, Escherichia coli CFT073
gccggauuugagaucggaaa

SEQ ID NO: 2615980 - RNA, 14 nt, Escherichia coli CFT073
gccgggcaggugac

SEQ ID NO: 2615981 - RNA, 15 nt, Escherichia coli CFT073
gccgggcgaugcagc

SEQ ID NO: 2615982 - RNA, 18 nt, Escherichia coli CFT073
gccgggcgaugcagcgca

SEQ ID NO: 2615983 - RNA, 16 nt, Escherichia coli CFT073
gccgggcuaaccgcuu

SEQ ID NO: 2615984 - RNA, 21 nt, Escherichia coli CFT073
gccggggagauauuccccaga

SEQ ID NO: 2615985 - RNA, 19 nt, Escherichia coli CFT073
gccggggucaaaccuggcg

SEQ ID NO: 2615986 - RNA, 15 nt, Escherichia coli CFT073
gccggguaaucagcu

SEQ ID NO: 2615987 - RNA, 19 nt, Escherichia coli CFT073
gccggguaguaucgcucaa

SEQ ID NO: 2615988 - RNA, 17 nt, Escherichia coli CFT073
gccgggugccucccggu

SEQ ID NO: 2615989 - RNA, 20 nt, Escherichia coli CFT073
gccgguaacugcuugaauuu

SEQ ID NO: 2615990 - RNA, 22 nt, Escherichia coli CFT073
gccggugagcacaucagcgccc

SEQ ID NO: 2615991 - RNA, 22 nt, Escherichia coli CFT073
gccggugggaugaagcaacugg

SEQ ID NO: 2615992 - RNA, 14 nt, Escherichia coli CFT073
gccgguuaauacgc

SEQ ID NO: 2615993 - RNA, 14 nt, Escherichia coli CFT073
gccgguuaucccgc

SEQ ID NO: 2615994 - RNA, 14 nt, Escherichia coli CFT073
gccgguuccagcuu

SEQ ID NO: 2615995 - RNA, 14 nt, Escherichia coli CFT073
gccgguuggcgacu

SEQ ID NO: 2615996 - RNA, 16 nt, Escherichia coli CFT073
gccgguugugugcugg

SEQ ID NO: 2615997 - RNA, 13 nt, Escherichia coli CFT073
gccgguuugccau

SEQ ID NO: 2615998 - RNA, 17 nt, Escherichia coli CFT073
gccgguuuugcaggaaa

SEQ ID NO: 2615999 - RNA, 18 nt, Escherichia coli CFT073
gccguaaacaucauccag

SEQ ID NO: 2616000 - RNA, 19 nt, Escherichia coli CFT073
gccguaaacaucauccaga

SEQ ID NO: 2616001 - RNA, 14 nt, Escherichia coli CFT073
gccguaaccagcgc

SEQ ID NO: 2616002 - RNA, 19 nt, Escherichia coli CFT073
gccguaaccagcgcagaca

SEQ ID NO: 2616003 - RNA, 20 nt, Escherichia coli CFT073
gccguaacugugccaaaucu

SEQ ID NO: 2616004 - RNA, 21 nt, Escherichia coli CFT073
gccguaauguugcgccaguuc

SEQ ID NO: 2616005 - RNA, 16 nt, Escherichia coli CFT073
gccguaccaucgccag

SEQ ID NO: 2616006 - RNA, 20 nt, Escherichia coli CFT073
gccguaccugacgguaaaua

SEQ ID NO: 2616007 - RNA, 13 nt, Escherichia coli CFT073
gccguacgucagc

SEQ ID NO: 2616008 - RNA, 16 nt, Escherichia coli CFT073
gccguacgucagcgcc

SEQ ID NO: 2616009 - RNA, 14 nt, Escherichia coli CFT073
gccguagccauuac

SEQ ID NO: 2616010 - RNA, 18 nt, Escherichia coli CFT073
gccguaguuccacauaaa

SEQ ID NO: 2616011 - RNA, 13 nt, Escherichia coli CFT073
gccguauccaggc

SEQ ID NO: 2616012 - RNA, 17 nt, Escherichia coli CFT073
gccgucaacaauccauu

SEQ ID NO: 2616013 - RNA, 17 nt, Escherichia coli CFT073
gccgucaauuuuaagca

SEQ ID NO: 2616014 - RNA, 20 nt, Escherichia coli CFT073
gccgucaccagcaucaacaa

SEQ ID NO: 2616015 - RNA, 18 nt, Escherichia coli CFT073
gccgucaucaucggcugc

SEQ ID NO: 2616016 - RNA, 16 nt, Escherichia coli CFT073
gccgucaucgacuucg

SEQ ID NO: 2616017 - RNA, 13 nt, Escherichia coli CFT073
gccguccagcgcc

SEQ ID NO: 2616018 - RNA, 20 nt, Escherichia coli CFT073
gccguccaguaaugcaacac

SEQ ID NO: 2616019 - RNA, 23 nt, Escherichia coli CFT073
gccgucgaccagcacguuaauca

SEQ ID NO: 2616020 - RNA, 18 nt, Escherichia coli CFT073
gccgucgagaaucaacac

SEQ ID NO: 2616021 - RNA, 22 nt, Escherichia coli CFT073
gccgucgaugucuggcugagca

SEQ ID NO: 2616022 - RNA, 18 nt, Escherichia coli CFT073
gccgucgccacaaucagc

SEQ ID NO: 2616023 - RNA, 12 nt, Escherichia coli CFT073
gccgucugccac

SEQ ID NO: 2616024 - RNA, 14 nt, Escherichia coli CFT073
gccgugcaguuugu

SEQ ID NO: 2616025 - RNA, 16 nt, Escherichia coli CFT073
gccgugccggaaaugg

SEQ ID NO: 2616026 - RNA, 19 nt, Escherichia coli CFT073
gccgugcugugugccgcga

SEQ ID NO: 2616027 - RNA, 16 nt, Escherichia coli CFT073
gccguggagauuggcc

SEQ ID NO: 2616028 - RNA, 13 nt, Escherichia coli CFT073
gccguggccgaga

SEQ ID NO: 2616029 - RNA, 14 nt, Escherichia coli CFT073
gccguggcgcucgc

SEQ ID NO: 2616030 - RNA, 17 nt, Escherichia coli CFT073
gccgugucggugcucau

SEQ ID NO: 2616031 - RNA, 16 nt, Escherichia coli CFT073
gccguguuauccgccg

SEQ ID NO: 2616032 - RNA, 21 nt, Escherichia coli CFT073
gccguuaaagauaaugccagc

SEQ ID NO: 2616033 - RNA, 16 nt, Escherichia coli CFT073
gccguuaacacggugc

SEQ ID NO: 2616034 - RNA, 16 nt, Escherichia coli CFT073
gccguuaacuaacggu

SEQ ID NO: 2616035 - RNA, 22 nt, Escherichia coli CFT073
gccguuaccuuaccaaccgcaa

SEQ ID NO: 2616036 - RNA, 14 nt, Escherichia coli CFT073
gccguuaccuucgg

SEQ ID NO: 2616037 - RNA, 20 nt, Escherichia coli CFT073
gccguuaccuucggccccau

SEQ ID NO: 2616038 - RNA, 17 nt, Escherichia coli CFT073
gccguuaggaccgguuu

SEQ ID NO: 2616039 - RNA, 14 nt, Escherichia coli CFT073
gccguuccagauuc

SEQ ID NO: 2616040 - RNA, 14 nt, Escherichia coli CFT073
gccguuccuggcac

SEQ ID NO: 2616041 - RNA, 18 nt, Escherichia coli CFT073
gccguucuggugggcgaa

SEQ ID NO: 2616042 - RNA, 23 nt, Escherichia coli CFT073
gccguucuucagcguccgggaaa

SEQ ID NO: 2616043 - RNA, 13 nt, Escherichia coli CFT073
gccguucuucccg

SEQ ID NO: 2616044 - RNA, 19 nt, Escherichia coli CFT073
gccguugacgaugucgaca

SEQ ID NO: 2616045 - RNA, 22 nt, Escherichia coli CFT073
gccguugaguucaaauuccaca

SEQ ID NO: 2616046 - RNA, 16 nt, Escherichia coli CFT073
gccguugaucagcgca

SEQ ID NO: 2616047 - RNA, 17 nt, Escherichia coli CFT073
gccguugauuucacagu

SEQ ID NO: 2616048 - RNA, 14 nt, Escherichia coli CFT073
gccguugccuuuac

SEQ ID NO: 2616049 - RNA, 20 nt, Escherichia coli CFT073
gccguugcgcccaucaucau

SEQ ID NO: 2616050 - RNA, 22 nt, Escherichia coli CFT073
gccguugcuggcaaucaccucu

SEQ ID NO: 2616051 - RNA, 20 nt, Escherichia coli CFT073
gccguuuuuacccagcagca

SEQ ID NO: 2616052 - RNA, 17 nt, Escherichia coli CFT073
gccguuuuuuucuucuc

SEQ ID NO: 2616053 - RNA, 13 nt, Escherichia coli CFT073
gccuaaauggaaa

SEQ ID NO: 2616054 - RNA, 17 nt, Escherichia coli CFT073
gccuaacaacugcugga

SEQ ID NO: 2616055 - RNA, 14 nt, Escherichia coli CFT073
gccuaacaccauca

SEQ ID NO: 2616056 - RNA, 15 nt, Escherichia coli CFT073
gccuaacaccaucag

SEQ ID NO: 2616057 - RNA, 17 nt, Escherichia coli CFT073
gccuaagccauuuaacu

SEQ ID NO: 2616058 - RNA, 17 nt, Escherichia coli CFT073
gccuaauaccagaacug

SEQ ID NO: 2616059 - RNA, 16 nt, Escherichia coli CFT073
gccuacaaaggcacgc

SEQ ID NO: 2616060 - RNA, 20 nt, Escherichia coli CFT073
gccuacaaguccguugaaau

SEQ ID NO: 2616061 - RNA, 14 nt, Escherichia coli CFT073
gccuacaggugauu

SEQ ID NO: 2616062 - RNA, 12 nt, Escherichia coli CFT073
gccuacaguuca

SEQ ID NO: 2616063 - RNA, 16 nt, Escherichia coli CFT073
gccuacauauccgcgc

SEQ ID NO: 2616064 - RNA, 19 nt, Escherichia coli CFT073
gccuacauauucauccccg

SEQ ID NO: 2616065 - RNA, 20 nt, Escherichia coli CFT073
gccuacauuaguccgguugu

SEQ ID NO: 2616066 - RNA, 18 nt, Escherichia coli CFT073
gccuacauuggugccgga

SEQ ID NO: 2616067 - RNA, 20 nt, Escherichia coli CFT073
gccuaccaugaucugcaaau

SEQ ID NO: 2616068 - RNA, 23 nt, Escherichia coli CFT073
gccugcuaccgggaucuccucca

SEQ ID NO: 2616069 - RNA, 13 nt, Escherichia coli CFT073
gccugcucaaccg

SEQ ID NO: 2616070 - RNA, 17 nt, Escherichia coli CFT073
gccugcucaaccgccag

SEQ ID NO: 2616071 - RNA, 18 nt, Escherichia coli CFT073
gccugcuccaucauccgc

SEQ ID NO: 2616072 - RNA, 18 nt, Escherichia coli CFT073
gccugcugaauauugcca

SEQ ID NO: 2616073 - RNA, 17 nt, Escherichia coli CFT073
gccugcugcacagagcu

SEQ ID NO: 2616074 - RNA, 18 nt, Escherichia coli CFT073
gccugcugcgucgcggcc

SEQ ID NO: 2616075 - RNA, 11 nt, Escherichia coli CFT073
gccugcuggca

SEQ ID NO: 2616076 - RNA, 13 nt, Escherichia coli CFT073
gccugcuggcagc

SEQ ID NO: 2616077 - RNA, 22 nt, Escherichia coli CFT073
gccugcuggcuagccucccugc

SEQ ID NO: 2616078 - RNA, 13 nt, Escherichia coli CFT073
gccugcugguugc

SEQ ID NO: 2616079 - RNA, 21 nt, Escherichia coli CFT073
gccugcuucagugagcugucu

SEQ ID NO: 2616080 - RNA, 18 nt, Escherichia coli CFT073
gccugcuucuacgcaggu

SEQ ID NO: 2616081 - RNA, 21 nt, Escherichia coli CFT073
gccugcuuuuaccaucgcgau

SEQ ID NO: 2616082 - RNA, 17 nt, Escherichia coli CFT073
gccugcuuuugccagcg

SEQ ID NO: 2616083 - RNA, 23 nt, Escherichia coli CFT073
gccuggaaguugaugguguagaa

SEQ ID NO: 2616084 - RNA, 17 nt, Escherichia coli CFT073
gccuggaauuucuucgg

SEQ ID NO: 2616085 - RNA, 18 nt, Escherichia coli CFT073
gccuggcacucuuuuaau

SEQ ID NO: 2616086 - RNA, 17 nt, Escherichia coli CFT073
gccuggcagcaugcugc

SEQ ID NO: 2616087 - RNA, 18 nt, Escherichia coli CFT073
gccuggcccauagacagg

SEQ ID NO: 2616088 - RNA, 23 nt, Escherichia coli CFT073
gccuggcgaaaggaggcauugaa

SEQ ID NO: 2616089 - RNA, 21 nt, Escherichia coli CFT073
gccuggcgcgacaauauucac

SEQ ID NO: 2616090 - RNA, 13 nt, Escherichia coli CFT073
gccuggcggcaga

SEQ ID NO: 2616091 - RNA, 18 nt, Escherichia coli CFT073
gccugggggggaaaccca

SEQ ID NO: 2616092 - RNA, 15 nt, Escherichia coli CFT073
gccuggguuuucaca

SEQ ID NO: 2616093 - RNA, 20 nt, Escherichia coli CFT073
gccuggguuuucacagaagu

SEQ ID NO: 2616094 - RNA, 18 nt, Escherichia coli CFT073
gccugguuuugccaugca

SEQ ID NO: 2616095 - RNA, 16 nt, Escherichia coli CFT073
gccuguaccagcggcu

SEQ ID NO: 2616096 - RNA, 20 nt, Escherichia coli CFT073
gccugucaccgccuccaccu

SEQ ID NO: 2616097 - RNA, 16 nt, Escherichia coli CFT073
gccuguccacauccag

SEQ ID NO: 2616098 - RNA, 16 nt, Escherichia coli CFT073
gccugugccacggcuu

SEQ ID NO: 2616099 - RNA, 15 nt, Escherichia coli CFT073
gccugugccugagcc

SEQ ID NO: 2616100 - RNA, 16 nt, Escherichia coli CFT073
gccugugccugagccg

SEQ ID NO: 2616101 - RNA, 15 nt, Escherichia coli CFT073
gccuguguuuaugcc

SEQ ID NO: 2616102 - RNA, 17 nt, Escherichia coli CFT073
gccuguuaaucagcuaa

SEQ ID NO: 2616103 - RNA, 20 nt, Escherichia coli CFT073
gccuguuaaugcuacccggc

SEQ ID NO: 2616104 - RNA, 16 nt, Escherichia coli CFT073
gccuguucaaccucaa

SEQ ID NO: 2616105 - RNA, 16 nt, Escherichia coli CFT073
gccuguucgccgccgc

SEQ ID NO: 2616106 - RNA, 14 nt, Escherichia coli CFT073
gccuguuucauagu

SEQ ID NO: 2616107 - RNA, 14 nt, Escherichia coli CFT073
gccuguuuuuuuaa

SEQ ID NO: 2616108 - RNA, 13 nt, Escherichia coli CFT073
gccuuaaaaacca

SEQ ID NO: 2616109 - RNA, 19 nt, Escherichia coli CFT073
gccuuaacaagauauuccg

SEQ ID NO: 2616110 - RNA, 16 nt, Escherichia coli CFT073
gccuuacccugaccgu

SEQ ID NO: 2616111 - RNA, 17 nt, Escherichia coli CFT073
gccuuacgcaccggaaa

SEQ ID NO: 2616112 - RNA, 14 nt, Escherichia coli CFT073
gccuuauccgaccu

SEQ ID NO: 2616113 - RNA, 16 nt, Escherichia coli CFT073
gccuuauccgaccuac

SEQ ID NO: 2616114 - RNA, 17 nt, Escherichia coli CFT073
gccuuauccgaccuaca

SEQ ID NO: 2616115 - RNA, 17 nt, Escherichia coli CFT073
gccuuauccgaccuacg

SEQ ID NO: 2616116 - RNA, 17 nt, Escherichia coli CFT073
gccuuauccgccugaca

SEQ ID NO: 2616117 - RNA, 14 nt, Escherichia coli CFT073
gccuuauccggccu

SEQ ID NO: 2616118 - RNA, 18 nt, Escherichia coli CFT073
gccuuauccggccuacga

SEQ ID NO: 2616119 - RNA, 14 nt, Escherichia coli CFT073
gccuuauccggucu

SEQ ID NO: 2616120 - RNA, 17 nt, Escherichia coli CFT073
gccuucacaggccgcca

SEQ ID NO: 2616121 - RNA, 19 nt, Escherichia coli CFT073
gccuucacaggccgccagg

SEQ ID NO: 2616122 - RNA, 17 nt, Escherichia coli CFT073
gccuucagguuuuucag

SEQ ID NO: 2616123 - RNA, 13 nt, Escherichia coli CFT073
gccuucauaauga

SEQ ID NO: 2616124 - RNA, 16 nt, Escherichia coli CFT073
gccuucauaaugaaug

SEQ ID NO: 2616125 - RNA, 19 nt, Escherichia coli CFT073
gccuucauacgacgacggu

SEQ ID NO: 2616126 - RNA, 13 nt, Escherichia coli CFT073
gccuuccagcagc

SEQ ID NO: 2616127 - RNA, 13 nt, Escherichia coli CFT073
gccuuccaucccu

SEQ ID NO: 2616128 - RNA, 15 nt, Escherichia coli CFT073
gccuucccuuucagc

SEQ ID NO: 2616129 - RNA, 21 nt, Escherichia coli CFT073
gccuuccgcaaacaggcgcag

SEQ ID NO: 2616130 - RNA, 19 nt, Escherichia coli CFT073
gccuuccggguuuucucca

SEQ ID NO: 2616131 - RNA, 20 nt, Escherichia coli CFT073
gccuuccggguuuucuccaa

SEQ ID NO: 2616132 - RNA, 15 nt, Escherichia coli CFT073
gccuuccgucagcaa

SEQ ID NO: 2616133 - RNA, 16 nt, Escherichia coli CFT073
gccuuccgucagcaaa

SEQ ID NO: 2616134 - RNA, 17 nt, Escherichia coli CFT073
gccuuccgucagcaaag

SEQ ID NO: 2616135 - RNA, 21 nt, Escherichia coli CFT073
gccuuccugauaacacagcgg

SEQ ID NO: 2616136 - RNA, 21 nt, Escherichia coli CFT073
gccuucgcaaaaaaccauccc

SEQ ID NO: 2616137 - RNA, 18 nt, Escherichia coli CFT073
gccuucgcaguggugaua

SEQ ID NO: 2616138 - RNA, 13 nt, Escherichia coli CFT073
gccuucgccuuuc

SEQ ID NO: 2616139 - RNA, 20 nt, Escherichia coli CFT073
gccuucggacguuugccaug

SEQ ID NO: 2616140 - RNA, 14 nt, Escherichia coli CFT073
gccuucuccggccu

SEQ ID NO: 2616141 - RNA, 21 nt, Escherichia coli CFT073
gccuucuccgggagaaggccu

SEQ ID NO: 2616142 - RNA, 12 nt, Escherichia coli CFT073
gccuucugcggu

SEQ ID NO: 2616143 - RNA, 19 nt, Escherichia coli CFT073
gccuucuguaaccuuuucc

SEQ ID NO: 2616144 - RNA, 14 nt, Escherichia coli CFT073
gccuucuucaucca

SEQ ID NO: 2616145 - RNA, 21 nt, Escherichia coli CFT073
gccuucuucauccagcgcacg

SEQ ID NO: 2616146 - RNA, 15 nt, Escherichia coli CFT073
gccuucuucuuucag

SEQ ID NO: 2616147 - RNA, 18 nt, Escherichia coli CFT073
gccuucuucuuucagagu

SEQ ID NO: 2616148 - RNA, 19 nt, Escherichia coli CFT073
gccuucuugcuguccggua

SEQ ID NO: 2616149 - RNA, 20 nt, Escherichia coli CFT073
gccuugaguaccgagaaaau

SEQ ID NO: 2616150 - RNA, 22 nt, Escherichia coli CFT073
gccuugaguuuuucaucccucu

SEQ ID NO: 2616151 - RNA, 14 nt, Escherichia coli CFT073
gccuugaugaaaaa

SEQ ID NO: 2616152 - RNA, 15 nt, Escherichia coli CFT073
gccuugauuauuucc

SEQ ID NO: 2616153 - RNA, 17 nt, Escherichia coli CFT073
gccuugcagccagaacu

SEQ ID NO: 2616154 - RNA, 20 nt, Escherichia coli CFT073
gccuugcgauuacguucggc

SEQ ID NO: 2616155 - RNA, 18 nt, Escherichia coli CFT073
gccuugcguaccggcguu

SEQ ID NO: 2616156 - RNA, 18 nt, Escherichia coli CFT073
gccuugcgugacgccugc

SEQ ID NO: 2616157 - RNA, 16 nt, Escherichia coli CFT073
gccuuguucggucagc

SEQ ID NO: 2616158 - RNA, 16 nt, Escherichia coli CFT073
gccuuuaccgccacag

SEQ ID NO: 2616159 - RNA, 17 nt, Escherichia coli CFT073
gccuuuaccgccacagc

SEQ ID NO: 2616160 - RNA, 21 nt, Escherichia coli CFT073
gccuuuaccgcgcucgaagcg

SEQ ID NO: 2616161 - RNA, 19 nt, Escherichia coli CFT073
gccuuuaucaacaauaaaa

SEQ ID NO: 2616162 - RNA, 18 nt, Escherichia coli CFT073
gccuuuaucuuucaguau

SEQ ID NO: 2616163 - RNA, 16 nt, Escherichia coli CFT073
gccuuucagaucaaaa

SEQ ID NO: 2616164 - RNA, 19 nt, Escherichia coli CFT073
gccuuucagccccagcgca

SEQ ID NO: 2616165 - RNA, 15 nt, Escherichia coli CFT073
gccuuuccagcaauc

SEQ ID NO: 2616166 - RNA, 15 nt, Escherichia coli CFT073
gccuuucccuuucuu

SEQ ID NO: 2616167 - RNA, 22 nt, Escherichia coli CFT073
gccuuucggcuccguuauucaa

SEQ ID NO: 2616168 - RNA, 19 nt, Escherichia coli CFT073
gccuuucucgcgguucagu

SEQ ID NO: 2616169 - RNA, 16 nt, Escherichia coli CFT073
gccuuucuuaccgauu

SEQ ID NO: 2616170 - RNA, 17 nt, Escherichia coli CFT073
gccuuugacuauuucau

SEQ ID NO: 2616171 - RNA, 14 nt, Escherichia coli CFT073
gccuuugaucucua

SEQ ID NO: 2616172 - RNA, 14 nt, Escherichia coli CFT073
gccuuugaugccac

SEQ ID NO: 2616173 - RNA, 15 nt, Escherichia coli CFT073
gccuuuggcaccguu

SEQ ID NO: 2616174 - RNA, 18 nt, Escherichia coli CFT073
gccuuuuuaauuugccag

SEQ ID NO: 2616175 - RNA, 21 nt, Escherichia coli CFT073
gccuuuuucagccgcaaacuc

SEQ ID NO: 2616176 - RNA, 22 nt, Escherichia coli CFT073
gccuuuuucaguuugcugacaa

SEQ ID NO: 2616177 - RNA, 21 nt, Escherichia coli CFT073
gcgacgcuggccgcgucuuau

SEQ ID NO: 2616178 - RNA, 14 nt, Escherichia coli CFT073
gcgacgcuggcgcg

SEQ ID NO: 2616179 - RNA, 15 nt, Escherichia coli CFT073
gcgacgcuggcgcgu

SEQ ID NO: 2616180 - RNA, 20 nt, Escherichia coli CFT073
gcgacgcuggcgcgucuuau

SEQ ID NO: 2616181 - RNA, 21 nt, Escherichia coli CFT073
gcgacgcugguugcgucuuau

SEQ ID NO: 2616182 - RNA, 21 nt, Escherichia coli CFT073
gcgacgcuguucgcgucuuau

SEQ ID NO: 2616183 - RNA, 21 nt, Escherichia coli CFT073
gcgacgcuugacgcgucuuau

SEQ ID NO: 2616184 - RNA, 15 nt, Escherichia coli CFT073
gcgacggacgcccgc

SEQ ID NO: 2616185 - RNA, 18 nt, Escherichia coli CFT073
gcgacgggcgacaaacgc

SEQ ID NO: 2616186 - RNA, 15 nt, Escherichia coli CFT073
gcgacguugcuucuc

SEQ ID NO: 2616187 - RNA, 15 nt, Escherichia coli CFT073
gcgacguuuaccgca

SEQ ID NO: 2616188 - RNA, 21 nt, Escherichia coli CFT073
gcgacguuugaugcgucuuau

SEQ ID NO: 2616189 - RNA, 17 nt, Escherichia coli CFT073
gcgacugaaccagcgcc

SEQ ID NO: 2616190 - RNA, 14 nt, Escherichia coli CFT073
gcgacugccagcca

SEQ ID NO: 2616191 - RNA, 16 nt, Escherichia coli CFT073
gcgacugccagccaca

SEQ ID NO: 2616192 - RNA, 12 nt, Escherichia coli CFT073
gcgacuggcuga

SEQ ID NO: 2616193 - RNA, 15 nt, Escherichia coli CFT073
gcgacuuuaaucacc

SEQ ID NO: 2616194 - RNA, 18 nt, Escherichia coli CFT073
gcgagaaauacgcccuga

SEQ ID NO: 2616195 - RNA, 15 nt, Escherichia coli CFT073
gcgagaacaccgaac

SEQ ID NO: 2616196 - RNA, 20 nt, Escherichia coli CFT073
gcgagauauucccccaccgc

SEQ ID NO: 2616197 - RNA, 15 nt, Escherichia coli CFT073
gcgagaugaccgaca

SEQ ID NO: 2616198 - RNA, 23 nt, Escherichia coli CFT073
gcgagcaaaaucguaagcaggag

SEQ ID NO: 2616199 - RNA, 12 nt, Escherichia coli CFT073
gcgagcaacgca

SEQ ID NO: 2616200 - RNA, 14 nt, Escherichia coli CFT073
gcgagcaucgcgag

SEQ ID NO: 2616201 - RNA, 22 nt, Escherichia coli CFT073
gcgagccgccgcauuaugguga

SEQ ID NO: 2616202 - RNA, 21 nt, Escherichia coli CFT073
gcgagccgucgcuaucgaugc

SEQ ID NO: 2616203 - RNA, 21 nt, Escherichia coli CFT073
gcgagcgccuuauccggccua

SEQ ID NO: 2616204 - RNA, 22 nt, Escherichia coli CFT073
gcgagcugccaguugcgcuuca

SEQ ID NO: 2616205 - RNA, 17 nt, Escherichia coli CFT073
gcgagcuguaucacuga

SEQ ID NO: 2616206 - RNA, 15 nt, Escherichia coli CFT073
gcgaggaaugacgga

SEQ ID NO: 2616207 - RNA, 20 nt, Escherichia coli CFT073
gcgaggaauucagcguggcg

SEQ ID NO: 2616208 - RNA, 22 nt, Escherichia coli CFT073
gcgaggaauucagcguggcgaa

SEQ ID NO: 2616209 - RNA, 14 nt, Escherichia coli CFT073
gcgaggaucaucgg

SEQ ID NO: 2616210 - RNA, 21 nt, Escherichia coli CFT073
gcgaggggaccgaucgcgcuc

SEQ ID NO: 2616211 - RNA, 21 nt, Escherichia coli CFT073
gcgaggggacgguccgugcgc

SEQ ID NO: 2616212 - RNA, 15 nt, Escherichia coli CFT073
gcgaggggacuggcc

SEQ ID NO: 2616213 - RNA, 17 nt, Escherichia coli CFT073
gcgaggggacuggccgg

SEQ ID NO: 2616214 - RNA, 15 nt, Escherichia coli CFT073
gcgagguccagcucc

SEQ ID NO: 2616215 - RNA, 15 nt, Escherichia coli CFT073
gcgagucaggccagg

SEQ ID NO: 2616216 - RNA, 17 nt, Escherichia coli CFT073
gcgagugaauccccagg

SEQ ID NO: 2616217 - RNA, 21 nt, Escherichia coli CFT073
gcgagugcauccagugccgga

SEQ ID NO: 2616218 - RNA, 23 nt, Escherichia coli CFT073
gcgagugugauuacagccaggcg

SEQ ID NO: 2616219 - RNA, 16 nt, Escherichia coli CFT073
gcgaguucgagucucg

SEQ ID NO: 2616220 - RNA, 21 nt, Escherichia coli CFT073
gcgaguucgguacguacaaug

SEQ ID NO: 2616221 - RNA, 14 nt, Escherichia coli CFT073
gcgauaaacagcac

SEQ ID NO: 2616222 - RNA, 12 nt, Escherichia coli CFT073
gcgauaaccagg

SEQ ID NO: 2616223 - RNA, 13 nt, Escherichia coli CFT073
gcgauaaccgcac

SEQ ID NO: 2616224 - RNA, 22 nt, Escherichia coli CFT073
gcgauaaccuucaccgugaaug

SEQ ID NO: 2616225 - RNA, 20 nt, Escherichia coli CFT073
gcgauaagucgcccaaacgc

SEQ ID NO: 2616226 - RNA, 17 nt, Escherichia coli CFT073
gcgauaauacccagcaa

SEQ ID NO: 2616227 - RNA, 22 nt, Escherichia coli CFT073
gcgauaauauugaugcacacca

SEQ ID NO: 2616228 - RNA, 23 nt, Escherichia coli CFT073
gcgauaauauugaugcacaccau

SEQ ID NO: 2616229 - RNA, 22 nt, Escherichia coli CFT073
gcgauaaugaaccaaucagccg

SEQ ID NO: 2616230 - RNA, 12 nt, Escherichia coli CFT073
gcgauacgcagu

SEQ ID NO: 2616231 - RNA, 13 nt, Escherichia coli CFT073
gcgauacgccaga

SEQ ID NO: 2616232 - RNA, 23 nt, Escherichia coli CFT073
gcgauacgccagacucucgccag

SEQ ID NO: 2616233 - RNA, 21 nt, Escherichia coli CFT073
gcgauacgcuucaaccaguuu

SEQ ID NO: 2616234 - RNA, 21 nt, Escherichia coli CFT073
gcgauagcuucugcguucucu

SEQ ID NO: 2616235 - RNA, 16 nt, Escherichia coli CFT073
gcgauaguaaucaccg

SEQ ID NO: 2616236 - RNA, 22 nt, Escherichia coli CFT073
gcgauaucaauauuaagagaac

SEQ ID NO: 2616237 - RNA, 23 nt, Escherichia coli CFT073
gcgauaucaguuauugacgccgu

SEQ ID NO: 2616238 - RNA, 14 nt, Escherichia coli CFT073
gcgauauccgggca

SEQ ID NO: 2616239 - RNA, 13 nt, Escherichia coli CFT073
gcgauauguugug

SEQ ID NO: 2616240 - RNA, 16 nt, Escherichia coli CFT073
gcgauauuccagaccu

SEQ ID NO: 2616241 - RNA, 19 nt, Escherichia coli CFT073
gcgauauuccagaccuacg

SEQ ID NO: 2616242 - RNA, 16 nt, Escherichia coli CFT073
gcgauauugccgcgau

SEQ ID NO: 2616243 - RNA, 14 nt, Escherichia coli CFT073
gcgauauugcugca

SEQ ID NO: 2616244 - RNA, 17 nt, Escherichia coli CFT073
gcgaucaguugcucggc

SEQ ID NO: 2616245 - RNA, 19 nt, Escherichia coli CFT073
gcgaucaucaguacgccuu

SEQ ID NO: 2616246 - RNA, 13 nt, Escherichia coli CFT073
gcgaucauuagcc

SEQ ID NO: 2616247 - RNA, 18 nt, Escherichia coli CFT073
gcgauccacgcucgcugg

SEQ ID NO: 2616248 - RNA, 19 nt, Escherichia coli CFT073
gcgauccacgcucgcuggc

SEQ ID NO: 2616249 - RNA, 22 nt, Escherichia coli CFT073
gcgauccagcgcaauaccgaua

SEQ ID NO: 2616250 - RNA, 18 nt, Escherichia coli CFT073
gcgaucccagagcgggca

SEQ ID NO: 2616251 - RNA, 20 nt, Escherichia coli CFT073
gcgaucccggcucauccccu

SEQ ID NO: 2616252 - RNA, 15 nt, Escherichia coli CFT073
gcgaucgcuuucgcu

SEQ ID NO: 2616253 - RNA, 20 nt, Escherichia coli CFT073
gcgaucgucaaaacgcgcgc

SEQ ID NO: 2616254 - RNA, 12 nt, Escherichia coli CFT073
gcgaucuucccg

SEQ ID NO: 2616255 - RNA, 17 nt, Escherichia coli CFT073
gcgaucuuugcccauac

SEQ ID NO: 2616256 - RNA, 22 nt, Escherichia coli CFT073
gcgaugaaaaucgccggaugcg

SEQ ID NO: 2616257 - RNA, 23 nt, Escherichia coli CFT073
gcgaugaaaaucgccggaugcgg

SEQ ID NO: 2616258 - RNA, 13 nt, Escherichia coli CFT073
gcgaugaccgcca

SEQ ID NO: 2616259 - RNA, 15 nt, Escherichia coli CFT073
gcgaugauagggcug

SEQ ID NO: 2616260 - RNA, 20 nt, Escherichia coli CFT073
gcgaugcacaugcuucagca

SEQ ID NO: 2616261 - RNA, 18 nt, Escherichia coli CFT073
gcgaugcugacacaucuu

SEQ ID NO: 2616262 - RNA, 17 nt, Escherichia coli CFT073
gcgaugcuuuccagcug

SEQ ID NO: 2616263 - RNA, 18 nt, Escherichia coli CFT073
gcgaugcuuuccagcugu

SEQ ID NO: 2616264 - RNA, 24 nt, Escherichia coli CFT073
gcgauggaagagguguaauacguu

SEQ ID NO: 2616265 - RNA, 22 nt, Escherichia coli CFT073
gcgauggcaggccccgucagca

SEQ ID NO: 2616266 - RNA, 14 nt, Escherichia coli CFT073
gcgauggcccgcuu

SEQ ID NO: 2616267 - RNA, 16 nt, Escherichia coli CFT073
gcgauggcggcagccu

SEQ ID NO: 2616268 - RNA, 24 nt, Escherichia coli CFT073
gcgauggcuggaaucaucaagcac

SEQ ID NO: 2616269 - RNA, 22 nt, Escherichia coli CFT073
gcgauggucaguuuaaacagaa

SEQ ID NO: 2616270 - RNA, 20 nt, Escherichia coli CFT073
gcgauuaaacgccauccggc

SEQ ID NO: 2616271 - RNA, 21 nt, Escherichia coli CFT073
gcgauuaaacgccauccggca

SEQ ID NO: 2616272 - RNA, 13 nt, Escherichia coli CFT073
gcgauuaauaaaa

SEQ ID NO: 2616273 - RNA, 13 nt, Escherichia coli CFT073
gcgauuaaucuca

SEQ ID NO: 2616274 - RNA, 19 nt, Escherichia coli CFT073
gcgauuacguucgacugcg

SEQ ID NO: 2616275 - RNA, 22 nt, Escherichia coli CFT073
gcgauuauuuauucccgccaga

SEQ ID NO: 2616276 - RNA, 17 nt, Escherichia coli CFT073
gcgauucagcaacauca

SEQ ID NO: 2616277 - RNA, 15 nt, Escherichia coli CFT073
gcgauucauaugcgc

SEQ ID NO: 2616278 - RNA, 18 nt, Escherichia coli CFT073
gcgauucauaugcgccag

SEQ ID NO: 2616279 - RNA, 21 nt, Escherichia coli CFT073
gcgauugaguauuaaauguca

SEQ ID NO: 2616280 - RNA, 17 nt, Escherichia coli CFT073
gcgauugaucucguuga

SEQ ID NO: 2616281 - RNA, 19 nt, Escherichia coli CFT073
gcgauuguaauuucacgcu

SEQ ID NO: 2616282 - RNA, 23 nt, Escherichia coli CFT073
gcgauuucacaagacuguaaaua

SEQ ID NO: 2616283 - RNA, 20 nt, Escherichia coli CFT073
gcgcaaaaacauugccggaa

SEQ ID NO: 2616284 - RNA, 14 nt, Escherichia coli CFT073
gcgccaaucggcaa

SEQ ID NO: 2616285 - RNA, 13 nt, Escherichia coli CFT073
gcgccaccagcgc

SEQ ID NO: 2616286 - RNA, 15 nt, Escherichia coli CFT073
gcgccaccagcgcca

SEQ ID NO: 2616287 - RNA, 19 nt, Escherichia coli CFT073
gcgccaccucuuucaccaa

SEQ ID NO: 2616288 - RNA, 14 nt, Escherichia coli CFT073
gcgccagaaaggua

SEQ ID NO: 2616289 - RNA, 22 nt, Escherichia coli CFT073
gcgccagaaaguuuuucaacac

SEQ ID NO: 2616290 - RNA, 17 nt, Escherichia coli CFT073
gcgccagaaugucuucg

SEQ ID NO: 2616291 - RNA, 11 nt, Escherichia coli CFT073
gcgccagacgu

SEQ ID NO: 2616292 - RNA, 20 nt, Escherichia coli CFT073
gcgccagacgugcacgcagc

SEQ ID NO: 2616293 - RNA, 17 nt, Escherichia coli CFT073
gcgccagacugacaauc

SEQ ID NO: 2616294 - RNA, 23 nt, Escherichia coli CFT073
gcgccagacugaucaucgcccag

SEQ ID NO: 2616295 - RNA, 14 nt, Escherichia coli CFT073
gcgccagagcgcgg

SEQ ID NO: 2616296 - RNA, 19 nt, Escherichia coli CFT073
gcgccagagcgcggcguga

SEQ ID NO: 2616297 - RNA, 22 nt, Escherichia coli CFT073
gcgccagauaagaggcgcgcgg

SEQ ID NO: 2616298 - RNA, 18 nt, Escherichia coli CFT073
gcgccagcaaaucagcca

SEQ ID NO: 2616299 - RNA, 23 nt, Escherichia coli CFT073
gcgccagcaaaucagccauugcu

SEQ ID NO: 2616300 - RNA, 12 nt, Escherichia coli CFT073
gcgccagcaaga

SEQ ID NO: 2616301 - RNA, 12 nt, Escherichia coli CFT073
gcgccagcagcg

SEQ ID NO: 2616302 - RNA, 22 nt, Escherichia coli CFT073
gcgccagcaucgcauccggcaa

SEQ ID NO: 2616303 - RNA, 13 nt, Escherichia coli CFT073
gcgccagccagcc

SEQ ID NO: 2616304 - RNA, 14 nt, Escherichia coli CFT073
gcgccagccagcca

SEQ ID NO: 2616305 - RNA, 12 nt, Escherichia coli CFT073
gcgccagcgauu

SEQ ID NO: 2616306 - RNA, 15 nt, Escherichia coli CFT073
gcgccagcgcaucau

SEQ ID NO: 2616307 - RNA, 21 nt, Escherichia coli CFT073
gcgccagcgucgcauccgaca

SEQ ID NO: 2616308 - RNA, 21 nt, Escherichia coli CFT073
gcgccagcgucgcauccggca

SEQ ID NO: 2616309 - RNA, 17 nt, Escherichia coli CFT073
gcgccagcugcauuuca

SEQ ID NO: 2616310 - RNA, 18 nt, Escherichia coli CFT073
gcgccaggaaucuggucc

SEQ ID NO: 2616311 - RNA, 20 nt, Escherichia coli CFT073
gcgccaggcacaccagcaau

SEQ ID NO: 2616312 - RNA, 15 nt, Escherichia coli CFT073
gcgccaggcgcugaa

SEQ ID NO: 2616313 - RNA, 21 nt, Escherichia coli CFT073
gcgccagguguuuaaccaaca

SEQ ID NO: 2616314 - RNA, 21 nt, Escherichia coli CFT073
gcgccaguaaucagcgcggaa

SEQ ID NO: 2616315 - RNA, 17 nt, Escherichia coli CFT073
gcgccaguaccgccgca

SEQ ID NO: 2616316 - RNA, 22 nt, Escherichia coli CFT073
gcgccaguugcuuauccagcac

SEQ ID NO: 2616317 - RNA, 20 nt, Escherichia coli CFT073
gcgccauaaaacucgauggc

SEQ ID NO: 2616318 - RNA, 15 nt, Escherichia coli CFT073
gcgccauaaucagcg

SEQ ID NO: 2616319 - RNA, 18 nt, Escherichia coli CFT073
gcgccauaccaugcacca

SEQ ID NO: 2616320 - RNA, 14 nt, Escherichia coli CFT073
gcgccauaucggca

SEQ ID NO: 2616321 - RNA, 18 nt, Escherichia coli CFT073
gcgccaucaaaucugccg

SEQ ID NO: 2616322 - RNA, 22 nt, Escherichia coli CFT073
gcgccaucaaaucugccguaac

SEQ ID NO: 2616323 - RNA, 17 nt, Escherichia coli CFT073
gcgccaucaaugugcug

SEQ ID NO: 2616324 - RNA, 23 nt, Escherichia coli CFT073
gcgccaucaguguuggcggcaga

SEQ ID NO: 2616325 - RNA, 13 nt, Escherichia coli CFT073
gcgccaucgccag

SEQ ID NO: 2616326 - RNA, 16 nt, Escherichia coli CFT073
gcgccaucgccaggaa

SEQ ID NO: 2616327 - RNA, 17 nt, Escherichia coli CFT073
gcgccaucgguagcacc

SEQ ID NO: 2616328 - RNA, 23 nt, Escherichia coli CFT073
gcgccauuacccggugccgccgu

SEQ ID NO: 2616329 - RNA, 14 nt, Escherichia coli CFT073
gcgccauuggccug

SEQ ID NO: 2616330 - RNA, 14 nt, Escherichia coli CFT073
gcgcccaaccagca

SEQ ID NO: 2616331 - RNA, 16 nt, Escherichia coli CFT073
gcgcccaaccagcagg

SEQ ID NO: 2616332 - RNA, 13 nt, Escherichia coli CFT073
gcgcccagcaacg

SEQ ID NO: 2616333 - RNA, 18 nt, Escherichia coli CFT073
gcgcccaguuucuucagg

SEQ ID NO: 2616334 - RNA, 12 nt, Escherichia coli CFT073
gcgccccacgga

SEQ ID NO: 2616335 - RNA, 16 nt, Escherichia coli CFT073
gcgccccuggcgcagc

SEQ ID NO: 2616336 - RNA, 22 nt, Escherichia coli CFT073
gcgccccuggucauaggcugcc

SEQ ID NO: 2616337 - RNA, 19 nt, Escherichia coli CFT073
gcgcccgacaauaugcagc

SEQ ID NO: 2616338 - RNA, 21 nt, Escherichia coli CFT073
gcgcccgacaauaugcagcag

SEQ ID NO: 2616339 - RNA, 12 nt, Escherichia coli CFT073
gcgcccgccagc

SEQ ID NO: 2616340 - RNA, 13 nt, Escherichia coli CFT073
gcgcccgccagca

SEQ ID NO: 2616341 - RNA, 15 nt, Escherichia coli CFT073
gcgcccgcguuccug

SEQ ID NO: 2616342 - RNA, 22 nt, Escherichia coli CFT073
gcgcccugggcuucauccagca

SEQ ID NO: 2616343 - RNA, 12 nt, Escherichia coli CFT073
gcgcccuguucu

SEQ ID NO: 2616344 - RNA, 17 nt, Escherichia coli CFT073
gcgcccuugcagacgau

SEQ ID NO: 2616345 - RNA, 16 nt, Escherichia coli CFT073
gcgccgaagcugacca

SEQ ID NO: 2616346 - RNA, 18 nt, Escherichia coli CFT073
gcgccgaagcugaccaga

SEQ ID NO: 2616347 - RNA, 20 nt, Escherichia coli CFT073
gcgccgauuccaauauuaaa

SEQ ID NO: 2616348 - RNA, 20 nt, Escherichia coli CFT073
gcgccgcaacuaccagcagu

SEQ ID NO: 2616349 - RNA, 13 nt, Escherichia coli CFT073
gcgccgcauccga

SEQ ID NO: 2616350 - RNA, 22 nt, Escherichia coli CFT073
gcgccgcaucgccgguuuugcc

SEQ ID NO: 2616351 - RNA, 18 nt, Escherichia coli CFT073
gcgccgccagccacaggc

SEQ ID NO: 2616352 - RNA, 13 nt, Escherichia coli CFT073
gcgccgccucagc

SEQ ID NO: 2616353 - RNA, 16 nt, Escherichia coli CFT073
gcgccgccucagccag

SEQ ID NO: 2616354 - RNA, 18 nt, Escherichia coli CFT073
gcgccgcgauuaaccguu

SEQ ID NO: 2616355 - RNA, 14 nt, Escherichia coli CFT073
gcgccgcgcggagc

SEQ ID NO: 2616356 - RNA, 14 nt, Escherichia coli CFT073
gcgccgcucggugc

SEQ ID NO: 2616357 - RNA, 18 nt, Escherichia coli CFT073
gcgccggaaaccagcggc

SEQ ID NO: 2616358 - RNA, 17 nt, Escherichia coli CFT073
gcgccggaauauauuca

SEQ ID NO: 2616359 - RNA, 16 nt, Escherichia coli CFT073
gcgccggcgcaccggu

SEQ ID NO: 2616360 - RNA, 16 nt, Escherichia coli CFT073
gcgccgggaaugccac

SEQ ID NO: 2616361 - RNA, 20 nt, Escherichia coli CFT073
gcgccguagccauuaccagg

SEQ ID NO: 2616362 - RNA, 23 nt, Escherichia coli CFT073
gcgccuauaaggcucucuuacca

SEQ ID NO: 2616363 - RNA, 21 nt, Escherichia coli CFT073
gcgccucaaaauaaggcugcc

SEQ ID NO: 2616364 - RNA, 21 nt, Escherichia coli CFT073
gcgccucaacgccuaaugcca

SEQ ID NO: 2616365 - RNA, 19 nt, Escherichia coli CFT073
gcgccugcacaaagcgcca

SEQ ID NO: 2616366 - RNA, 21 nt, Escherichia coli CFT073
gcgccugcagcggccaguagc

SEQ ID NO: 2616367 - RNA, 18 nt, Escherichia coli CFT073
gcgccugcagucagccag

SEQ ID NO: 2616368 - RNA, 12 nt, Escherichia coli CFT073
gcgccugccagg

SEQ ID NO: 2616369 - RNA, 18 nt, Escherichia coli CFT073
gcgccugcggccagcagc

SEQ ID NO: 2616370 - RNA, 22 nt, Escherichia coli CFT073
gcgccugcggccagcagcugua

SEQ ID NO: 2616371 - RNA, 13 nt, Escherichia coli CFT073
gcgccuggcagca

SEQ ID NO: 2616372 - RNA, 18 nt, Escherichia coli CFT073
gcgccuggcgaaucgccu

SEQ ID NO: 2616373 - RNA, 20 nt, Escherichia coli CFT073
gcgccuuaucccaccugcgg

SEQ ID NO: 2616374 - RNA, 24 nt, Escherichia coli CFT073
gcgccuuugaugccaccaggcagc

SEQ ID NO: 2616375 - RNA, 19 nt, Escherichia coli CFT073
gcgccuuuuucgcuuguua

SEQ ID NO: 2616376 - RNA, 22 nt, Escherichia coli CFT073
gcgcgaaaacccucgaccaucu

SEQ ID NO: 2616377 - RNA, 18 nt, Escherichia coli CFT073
gcgcgaaauagcccgguu

SEQ ID NO: 2616378 - RNA, 17 nt, Escherichia coli CFT073
gcgcgaaauuauccaua

SEQ ID NO: 2616379 - RNA, 22 nt, Escherichia coli CFT073
gcgcgaaauuauccauauucag

SEQ ID NO: 2616380 - RNA, 14 nt, Escherichia coli CFT073
gcgcgaaccagaga

SEQ ID NO: 2616381 - RNA, 23 nt, Escherichia coli CFT073
gcgcgaaccaucaccucuucacc

SEQ ID NO: 2616382 - RNA, 19 nt, Escherichia coli CFT073
gcgcgaccaaugucagggc

SEQ ID NO: 2616383 - RNA, 16 nt, Escherichia coli CFT073
gcgcgacggugcggcu

SEQ ID NO: 2616384 - RNA, 18 nt, Escherichia coli CFT073
gcgcgagccauaaaccga

SEQ ID NO: 2616385 - RNA, 14 nt, Escherichia coli CFT073
gcgcgaggaauaug

SEQ ID NO: 2616386 - RNA, 13 nt, Escherichia coli CFT073
gcgcgaggccagc

SEQ ID NO: 2616387 - RNA, 15 nt, Escherichia coli CFT073
gcgcgaggguaaaca

SEQ ID NO: 2616388 - RNA, 15 nt, Escherichia coli CFT073
gcgcgauauccaguu

SEQ ID NO: 2616389 - RNA, 19 nt, Escherichia coli CFT073
gcgcgauauccaguucaug

SEQ ID NO: 2616390 - RNA, 13 nt, Escherichia coli CFT073
gcgcgauauuccg

SEQ ID NO: 2616391 - RNA, 16 nt, Escherichia coli CFT073
gcgcgaucuuccucua

SEQ ID NO: 2616392 - RNA, 16 nt, Escherichia coli CFT073
gcggacuucuggcaga

SEQ ID NO: 2616393 - RNA, 13 nt, Escherichia coli CFT073
gcggaggggagga

SEQ ID NO: 2616394 - RNA, 14 nt, Escherichia coli CFT073
gcggaguaagaaua

SEQ ID NO: 2616395 - RNA, 13 nt, Escherichia coli CFT073
gcggauaaagcag

SEQ ID NO: 2616396 - RNA, 23 nt, Escherichia coli CFT073
gcggauaaccgggguuucaccca

SEQ ID NO: 2616397 - RNA, 19 nt, Escherichia coli CFT073
gcggauagccauccccgcc

SEQ ID NO: 2616398 - RNA, 17 nt, Escherichia coli CFT073
gcggauaugcagcagcc

SEQ ID NO: 2616399 - RNA, 15 nt, Escherichia coli CFT073
gcggauauguucgcg

SEQ ID NO: 2616400 - RNA, 14 nt, Escherichia coli CFT073
gcggaucggcuggc

SEQ ID NO: 2616401 - RNA, 20 nt, Escherichia coli CFT073
gcggaucucuucguuuucaa

SEQ ID NO: 2616402 - RNA, 13 nt, Escherichia coli CFT073
gcggaugacccag

SEQ ID NO: 2616403 - RNA, 15 nt, Escherichia coli CFT073
gcggaugacccagcg

SEQ ID NO: 2616404 - RNA, 21 nt, Escherichia coli CFT073
gcggaugaggcguuaacagcg

SEQ ID NO: 2616405 - RNA, 19 nt, Escherichia coli CFT073
gcggauggccucugccagc

SEQ ID NO: 2616406 - RNA, 21 nt, Escherichia coli CFT073
gcggauggccucugccagcug

SEQ ID NO: 2616407 - RNA, 18 nt, Escherichia coli CFT073
gcggauucgaugcccagc

SEQ ID NO: 2616408 - RNA, 19 nt, Escherichia coli CFT073
gcggauucgaugcccagcu

SEQ ID NO: 2616409 - RNA, 13 nt, Escherichia coli CFT073
gcggcaaaacccu

SEQ ID NO: 2616410 - RNA, 17 nt, Escherichia coli CFT073
gcggcaaaccuuucgcc

SEQ ID NO: 2616411 - RNA, 18 nt, Escherichia coli CFT073
gcggcaaagcgcaucagc

SEQ ID NO: 2616412 - RNA, 13 nt, Escherichia coli CFT073
gcggcaacaucau

SEQ ID NO: 2616413 - RNA, 20 nt, Escherichia coli CFT073
gcggcaacaucaucacgcag

SEQ ID NO: 2616414 - RNA, 14 nt, Escherichia coli CFT073
gcggcaacguugcg

SEQ ID NO: 2616415 - RNA, 14 nt, Escherichia coli CFT073
gcggcaacuuuauu

SEQ ID NO: 2616416 - RNA, 22 nt, Escherichia coli CFT073
gcggcaagcgucgcaucaggca

SEQ ID NO: 2616417 - RNA, 17 nt, Escherichia coli CFT073
gcggcaaucacauccac

SEQ ID NO: 2616418 - RNA, 19 nt, Escherichia coli CFT073
gcggcaaucacauccacca

SEQ ID NO: 2616419 - RNA, 17 nt, Escherichia coli CFT073
gcggcaaucaucaucgg

SEQ ID NO: 2616420 - RNA, 19 nt, Escherichia coli CFT073
gcggcaauccccgccagca

SEQ ID NO: 2616421 - RNA, 14 nt, Escherichia coli CFT073
gcggcaaucgccag

SEQ ID NO: 2616422 - RNA, 17 nt, Escherichia coli CFT073
gcggcaaucgccagaau

SEQ ID NO: 2616423 - RNA, 15 nt, Escherichia coli CFT073
gcggcaaucgcugcu

SEQ ID NO: 2616424 - RNA, 13 nt, Escherichia coli CFT073
gcggcaauguucg

SEQ ID NO: 2616425 - RNA, 16 nt, Escherichia coli CFT073
gcggcacagaaacgcc

SEQ ID NO: 2616426 - RNA, 14 nt, Escherichia coli CFT073
gcggcacagccagc

SEQ ID NO: 2616427 - RNA, 16 nt, Escherichia coli CFT073
gcggcaccacgagcgg

SEQ ID NO: 2616428 - RNA, 20 nt, Escherichia coli CFT073
gcggcacccauuuauccagc

SEQ ID NO: 2616429 - RNA, 16 nt, Escherichia coli CFT073
gcggcacuguuucgcc

SEQ ID NO: 2616430 - RNA, 20 nt, Escherichia coli CFT073
gcggcacuguuucgccaggu

SEQ ID NO: 2616431 - RNA, 17 nt, Escherichia coli CFT073
gcggcagacgcucgcca

SEQ ID NO: 2616432 - RNA, 16 nt, Escherichia coli CFT073
gcggcagagcaaacag

SEQ ID NO: 2616433 - RNA, 15 nt, Escherichia coli CFT073
gcggcagauccacca

SEQ ID NO: 2616434 - RNA, 18 nt, Escherichia coli CFT073
gcggcagauugagcguca

SEQ ID NO: 2616435 - RNA, 21 nt, Escherichia coli CFT073
gcggcagcaaccgcuuccggu

SEQ ID NO: 2616436 - RNA, 12 nt, Escherichia coli CFT073
gcggcagcaggu

SEQ ID NO: 2616437 - RNA, 16 nt, Escherichia coli CFT073
gcggcagcgugccagg

SEQ ID NO: 2616438 - RNA, 14 nt, Escherichia coli CFT073
gcggcagcuccagc

SEQ ID NO: 2616439 - RNA, 15 nt, Escherichia coli CFT073
gcggcagcuccagca

SEQ ID NO: 2616440 - RNA, 21 nt, Escherichia coli CFT073
gcggcagcuuguacugcucgc

SEQ ID NO: 2616441 - RNA, 17 nt, Escherichia coli CFT073
gcggcaggguuugcgcc

SEQ ID NO: 2616442 - RNA, 20 nt, Escherichia coli CFT073
gcggcagguugaaguugaug

SEQ ID NO: 2616443 - RNA, 14 nt, Escherichia coli CFT073
gcggcagguugaug

SEQ ID NO: 2616444 - RNA, 15 nt, Escherichia coli CFT073
gcggcaguaaauauu

SEQ ID NO: 2616445 - RNA, 15 nt, Escherichia coli CFT073
gcggcaguggcuaag

SEQ ID NO: 2616446 - RNA, 18 nt, Escherichia coli CFT073
gcggcaguggcuaagcag

SEQ ID NO: 2616447 - RNA, 12 nt, Escherichia coli CFT073
gcggcaguucgu

SEQ ID NO: 2616448 - RNA, 22 nt, Escherichia coli CFT073
gcggcaguugcccgguuucgcc

SEQ ID NO: 2616449 - RNA, 15 nt, Escherichia coli CFT073
gcggcaguuucagcc

SEQ ID NO: 2616450 - RNA, 18 nt, Escherichia coli CFT073
gcggcauaaacgccuuau

SEQ ID NO: 2616451 - RNA, 16 nt, Escherichia coli CFT073
gcggcauccgguaacc

SEQ ID NO: 2616452 - RNA, 13 nt, Escherichia coli CFT073
gcggcaugugaug

SEQ ID NO: 2616453 - RNA, 20 nt, Escherichia coli CFT073
gcggcaugugaugccgcauc

SEQ ID NO: 2616454 - RNA, 16 nt, Escherichia coli CFT073
gcggcauuacgcccga

SEQ ID NO: 2616455 - RNA, 19 nt, Escherichia coli CFT073
gcggcauugacaucaggau

SEQ ID NO: 2616456 - RNA, 13 nt, Escherichia coli CFT073
gcggcauuucgcc

SEQ ID NO: 2616457 - RNA, 13 nt, Escherichia coli CFT073
gcggccaaaggga

SEQ ID NO: 2616458 - RNA, 21 nt, Escherichia coli CFT073
gcggccagacgcgccgccacc

SEQ ID NO: 2616459 - RNA, 15 nt, Escherichia coli CFT073
gcggccagcgcaccu

SEQ ID NO: 2616460 - RNA, 23 nt, Escherichia coli CFT073
gcggccauuuuuuuacccagcgu

SEQ ID NO: 2616461 - RNA, 14 nt, Escherichia coli CFT073
gcggccuucuucca

SEQ ID NO: 2616462 - RNA, 16 nt, Escherichia coli CFT073
gcggcgaaaacgccuc

SEQ ID NO: 2616463 - RNA, 23 nt, Escherichia coli CFT073
gcggcgaaaacgccucauccggc

SEQ ID NO: 2616464 - RNA, 16 nt, Escherichia coli CFT073
gcggcgaaccagccgu

SEQ ID NO: 2616465 - RNA, 20 nt, Escherichia coli CFT073
gcggcgaguguguggaaaac

SEQ ID NO: 2616466 - RNA, 15 nt, Escherichia coli CFT073
gcggcgauaaacagc

SEQ ID NO: 2616467 - RNA, 21 nt, Escherichia coli CFT073
gcggcgauaauauugaugcac

SEQ ID NO: 2616468 - RNA, 20 nt, Escherichia coli CFT073
gcggcgauauccagcgcggc

SEQ ID NO: 2616469 - RNA, 20 nt, Escherichia coli CFT073
gcggcgaucuucaaacuggc

SEQ ID NO: 2616470 - RNA, 18 nt, Escherichia coli CFT073
gcggcgaucuuuuaauaa

SEQ ID NO: 2616471 - RNA, 16 nt, Escherichia coli CFT073
gcggcgaugaccgcca

SEQ ID NO: 2616472 - RNA, 18 nt, Escherichia coli CFT073
gcggcgaugaccgccacg

SEQ ID NO: 2616473 - RNA, 14 nt, Escherichia coli CFT073
gcggcgauuaagaa

SEQ ID NO: 2616474 - RNA, 17 nt, Escherichia coli CFT073
gcggcgcaaccaucagu

SEQ ID NO: 2616475 - RNA, 18 nt, Escherichia coli CFT073
gcggcgcaggcgcuuauc

SEQ ID NO: 2616476 - RNA, 17 nt, Escherichia coli CFT073
gcggcgcauccgccagc

SEQ ID NO: 2616477 - RNA, 17 nt, Escherichia coli CFT073
gcggcgcauucaccagc

SEQ ID NO: 2616478 - RNA, 15 nt, Escherichia coli CFT073
gcggcggcgcaacca

SEQ ID NO: 2616479 - RNA, 15 nt, Escherichia coli CFT073
gcggcggguuaacca

SEQ ID NO: 2616480 - RNA, 19 nt, Escherichia coli CFT073
gcggcggguuaaccagcac

SEQ ID NO: 2616481 - RNA, 20 nt, Escherichia coli CFT073
gcggcgguaaaaucauccug

SEQ ID NO: 2616482 - RNA, 18 nt, Escherichia coli CFT073
gcggcggugagaagaccg

SEQ ID NO: 2616483 - RNA, 17 nt, Escherichia coli CFT073
gcggcguaaacgccuua

SEQ ID NO: 2616484 - RNA, 13 nt, Escherichia coli CFT073
gcggcguaaccac

SEQ ID NO: 2616485 - RNA, 15 nt, Escherichia coli CFT073
gcggcguagggcagg

SEQ ID NO: 2616486 - RNA, 16 nt, Escherichia coli CFT073
gcggcguagggcaggc

SEQ ID NO: 2616487 - RNA, 17 nt, Escherichia coli CFT073
gcggcguaucuuccagg

SEQ ID NO: 2616488 - RNA, 17 nt, Escherichia coli CFT073
gcggcgugaacgccuua

SEQ ID NO: 2616489 - RNA, 15 nt, Escherichia coli CFT073
gcggcgugauaaaag

SEQ ID NO: 2616490 - RNA, 19 nt, Escherichia coli CFT073
gcggcguuaacgccuuauc

SEQ ID NO: 2616491 - RNA, 14 nt, Escherichia coli CFT073
gcggcguuccugcc

SEQ ID NO: 2616492 - RNA, 16 nt, Escherichia coli CFT073
gcggcguugccgaucg

SEQ ID NO: 2616493 - RNA, 18 nt, Escherichia coli CFT073
gcggcguuuugcuuuuua

SEQ ID NO: 2616494 - RNA, 14 nt, Escherichia coli CFT073
gcggcuaucccaaa

SEQ ID NO: 2616495 - RNA, 15 nt, Escherichia coli CFT073
gcggcuauucaccac

SEQ ID NO: 2616496 - RNA, 19 nt, Escherichia coli CFT073
gcggcucaggcgcacgcca

SEQ ID NO: 2616497 - RNA, 11 nt, Escherichia coli CFT073
gcggcuccaga

SEQ ID NO: 2616498 - RNA, 13 nt, Escherichia coli CFT073
gcggcuccagaau

SEQ ID NO: 2616499 - RNA, 22 nt, Escherichia coli CFT073
gcggcuccagacgcccgcgccc

SEQ ID NO: 2616500 - RNA, 16 nt, Escherichia coli CFT073
gcggcucucuuucucc

SEQ ID NO: 2616501 - RNA, 16 nt, Escherichia coli CFT073
gcguacccgccugaua

SEQ ID NO: 2616502 - RNA, 17 nt, Escherichia coli CFT073
gcguaccuugcggcggu

SEQ ID NO: 2616503 - RNA, 15 nt, Escherichia coli CFT073
gcguacgauuacagg

SEQ ID NO: 2616504 - RNA, 16 nt, Escherichia coli CFT073
gcguagauucgaaaug

SEQ ID NO: 2616505 - RNA, 24 nt, Escherichia coli CFT073
gcguagcaccacgguacgccagag

SEQ ID NO: 2616506 - RNA, 13 nt, Escherichia coli CFT073
gcguagccaggcg

SEQ ID NO: 2616507 - RNA, 14 nt, Escherichia coli CFT073
gcguagccaggcuu

SEQ ID NO: 2616508 - RNA, 15 nt, Escherichia coli CFT073
gcguagccgggaagg

SEQ ID NO: 2616509 - RNA, 17 nt, Escherichia coli CFT073
gcguagcggcguuaaug

SEQ ID NO: 2616510 - RNA, 15 nt, Escherichia coli CFT073
gcguagggcaggcgu

SEQ ID NO: 2616511 - RNA, 21 nt, Escherichia coli CFT073
gcguagguguauugcccgccg

SEQ ID NO: 2616512 - RNA, 14 nt, Escherichia coli CFT073
gcguaguugcugcg

SEQ ID NO: 2616513 - RNA, 16 nt, Escherichia coli CFT073
gcguauaaaccauauc

SEQ ID NO: 2616514 - RNA, 23 nt, Escherichia coli CFT073
gcguaucguucgccagcuccagc

SEQ ID NO: 2616515 - RNA, 19 nt, Escherichia coli CFT073
gcguaugcagccaggccau

SEQ ID NO: 2616516 - RNA, 17 nt, Escherichia coli CFT073
gcguaugcaucgguggc

SEQ ID NO: 2616517 - RNA, 14 nt, Escherichia coli CFT073
gcguaugcccagcg

SEQ ID NO: 2616518 - RNA, 16 nt, Escherichia coli CFT073
gcgucaaacuuuuaaa

SEQ ID NO: 2616519 - RNA, 16 nt, Escherichia coli CFT073
gcgucaaauaaagaag

SEQ ID NO: 2616520 - RNA, 14 nt, Escherichia coli CFT073
gcgucaacagggca

SEQ ID NO: 2616521 - RNA, 16 nt, Escherichia coli CFT073
gcgucaacagggcaga

SEQ ID NO: 2616522 - RNA, 15 nt, Escherichia coli CFT073
gcgucaagauggcuc

SEQ ID NO: 2616523 - RNA, 16 nt, Escherichia coli CFT073
gcgucaaguuaagcau

SEQ ID NO: 2616524 - RNA, 22 nt, Escherichia coli CFT073
gcgucaaucacuuucugcgcca

SEQ ID NO: 2616525 - RNA, 22 nt, Escherichia coli CFT073
gcgucaaugccgcuucgagcug

SEQ ID NO: 2616526 - RNA, 17 nt, Escherichia coli CFT073
gcgucaauuugcuccgc

SEQ ID NO: 2616527 - RNA, 12 nt, Escherichia coli CFT073
gcgucaccaucc

SEQ ID NO: 2616528 - RNA, 20 nt, Escherichia coli CFT073
gcgucacgguuucaaagaaa

SEQ ID NO: 2616529 - RNA, 13 nt, Escherichia coli CFT073
gcgucagaaacag

SEQ ID NO: 2616530 - RNA, 20 nt, Escherichia coli CFT073
gcgucagaccggcaaccagc

SEQ ID NO: 2616531 - RNA, 12 nt, Escherichia coli CFT073
gcgucagcagca

SEQ ID NO: 2616532 - RNA, 13 nt, Escherichia coli CFT073
gcgucagccacaa

SEQ ID NO: 2616533 - RNA, 12 nt, Escherichia coli CFT073
gcgucagcuuca

SEQ ID NO: 2616534 - RNA, 15 nt, Escherichia coli CFT073
gcgucagcuuucaga

SEQ ID NO: 2616535 - RNA, 17 nt, Escherichia coli CFT073
gcgucagcuuucagaga

SEQ ID NO: 2616536 - RNA, 21 nt, Escherichia coli CFT073
gcgucaguaaaugcuggcgca

SEQ ID NO: 2616537 - RNA, 18 nt, Escherichia coli CFT073
gcgucagugucuuaucug

SEQ ID NO: 2616538 - RNA, 13 nt, Escherichia coli CFT073
gcgucaucggcag

SEQ ID NO: 2616539 - RNA, 15 nt, Escherichia coli CFT073
gcgucaucggcagca

SEQ ID NO: 2616540 - RNA, 17 nt, Escherichia coli CFT073
gcgucaucuuacugcaa

SEQ ID NO: 2616541 - RNA, 22 nt, Escherichia coli CFT073
gcgucaucuuacugcaacugug

SEQ ID NO: 2616542 - RNA, 13 nt, Escherichia coli CFT073
gcgucaugcucgc

SEQ ID NO: 2616543 - RNA, 18 nt, Escherichia coli CFT073
gcgucauugacgcuggcu

SEQ ID NO: 2616544 - RNA, 17 nt, Escherichia coli CFT073
gcgucauuuccagacgc

SEQ ID NO: 2616545 - RNA, 23 nt, Escherichia coli CFT073
gcguccaccugcgucgcgccgua

SEQ ID NO: 2616546 - RNA, 13 nt, Escherichia coli CFT073
gcgucccaucggc

SEQ ID NO: 2616547 - RNA, 21 nt, Escherichia coli CFT073
gcguccgcucggucacugaca

SEQ ID NO: 2616548 - RNA, 18 nt, Escherichia coli CFT073
gcguccgggaaauccuca

SEQ ID NO: 2616549 - RNA, 18 nt, Escherichia coli CFT073
gcguccuuguaacgcgcu

SEQ ID NO: 2616550 - RNA, 21 nt, Escherichia coli CFT073
gcgucgaaaauaucgagcagc

SEQ ID NO: 2616551 - RNA, 14 nt, Escherichia coli CFT073
gcgucgaucucuuc

SEQ ID NO: 2616552 - RNA, 14 nt, Escherichia coli CFT073
gcgucgauugcuca

SEQ ID NO: 2616553 - RNA, 14 nt, Escherichia coli CFT073
gcgucgcauccggc

SEQ ID NO: 2616554 - RNA, 16 nt, Escherichia coli CFT073
gcgucgcauccggcau

SEQ ID NO: 2616555 - RNA, 15 nt, Escherichia coli CFT073
gcgucgcaucuggca

SEQ ID NO: 2616556 - RNA, 14 nt, Escherichia coli CFT073
gcgucgccagcagc

SEQ ID NO: 2616557 - RNA, 16 nt, Escherichia coli CFT073
gcgucgcccguggagu

SEQ ID NO: 2616558 - RNA, 21 nt, Escherichia coli CFT073
gcgucgcugcucuucuguggu

SEQ ID NO: 2616559 - RNA, 20 nt, Escherichia coli CFT073
gcgucggaaucccuuccgcu

SEQ ID NO: 2616560 - RNA, 13 nt, Escherichia coli CFT073
gcgucgguaaaga

SEQ ID NO: 2616561 - RNA, 12 nt, Escherichia coli CFT073
gcgucgguuucg

SEQ ID NO: 2616562 - RNA, 17 nt, Escherichia coli CFT073
gcgucguauccagcguu

SEQ ID NO: 2616563 - RNA, 18 nt, Escherichia coli CFT073
gcgucgugguaucgccac

SEQ ID NO: 2616564 - RNA, 17 nt, Escherichia coli CFT073
gcgucguuaaucgccug

SEQ ID NO: 2616565 - RNA, 17 nt, Escherichia coli CFT073
gcgucguucaucgcaaa

SEQ ID NO: 2616566 - RNA, 14 nt, Escherichia coli CFT073
gcgucguucgccag

SEQ ID NO: 2616567 - RNA, 17 nt, Escherichia coli CFT073
gcgucguucgcgccaac

SEQ ID NO: 2616568 - RNA, 17 nt, Escherichia coli CFT073
gcgucuaucagugcaaa

SEQ ID NO: 2616569 - RNA, 17 nt, Escherichia coli CFT073
gcgucucacuaucgccg

SEQ ID NO: 2616570 - RNA, 20 nt, Escherichia coli CFT073
gcgucucauaacggauugca

SEQ ID NO: 2616571 - RNA, 15 nt, Escherichia coli CFT073
gcgucugaauaucau

SEQ ID NO: 2616572 - RNA, 16 nt, Escherichia coli CFT073
gcgucugaugaaagca

SEQ ID NO: 2616573 - RNA, 18 nt, Escherichia coli CFT073
gcgucuggcccaugccag

SEQ ID NO: 2616574 - RNA, 15 nt, Escherichia coli CFT073
gcgucuggcgaaaac

SEQ ID NO: 2616575 - RNA, 15 nt, Escherichia coli CFT073
gcgucuuaucaggcc

SEQ ID NO: 2616576 - RNA, 19 nt, Escherichia coli CFT073
gcgucuuaucaggccuaca

SEQ ID NO: 2616577 - RNA, 20 nt, Escherichia coli CFT073
gcgucuuaucaggccuacga

SEQ ID NO: 2616578 - RNA, 20 nt, Escherichia coli CFT073
gcgucuuaucaggccuacgu

SEQ ID NO: 2616579 - RNA, 16 nt, Escherichia coli CFT073
gcgucuuauccggccu

SEQ ID NO: 2616580 - RNA, 20 nt, Escherichia coli CFT073
gcgucuuauccggccuacua

SEQ ID NO: 2616581 - RNA, 19 nt, Escherichia coli CFT073
gcgucuuaucuggccuaca

SEQ ID NO: 2616582 - RNA, 16 nt, Escherichia coli CFT073
gcgucuuccgugccug

SEQ ID NO: 2616583 - RNA, 15 nt, Escherichia coli CFT073
gcgugaaacgcguuu

SEQ ID NO: 2616584 - RNA, 15 nt, Escherichia coli CFT073
gcgugaaagaaaaug

SEQ ID NO: 2616585 - RNA, 18 nt, Escherichia coli CFT073
gcgugaacgccuucuccg

SEQ ID NO: 2616586 - RNA, 14 nt, Escherichia coli CFT073
gcgugacacuaaca

SEQ ID NO: 2616587 - RNA, 22 nt, Escherichia coli CFT073
gcgugacgccugcuccaucauc

SEQ ID NO: 2616588 - RNA, 18 nt, Escherichia coli CFT073
gcgugagaaccgcaccga

SEQ ID NO: 2616589 - RNA, 15 nt, Escherichia coli CFT073
gcgugaguggcgcgc

SEQ ID NO: 2616590 - RNA, 17 nt, Escherichia coli CFT073
gcgugauaacaguuggu

SEQ ID NO: 2616591 - RNA, 23 nt, Escherichia coli CFT073
gcgugauauuacauaccagcagc

SEQ ID NO: 2616592 - RNA, 20 nt, Escherichia coli CFT073
gcgugauuuuguaggucgga

SEQ ID NO: 2616593 - RNA, 21 nt, Escherichia coli CFT073
gcgugauuuuuguaggucgga

SEQ ID NO: 2616594 - RNA, 17 nt, Escherichia coli CFT073
gcgugccaccauucccu

SEQ ID NO: 2616595 - RNA, 21 nt, Escherichia coli CFT073
gcgugcccacguucaugccga

SEQ ID NO: 2616596 - RNA, 23 nt, Escherichia coli CFT073
gcgugcccccguaccgguugucg

SEQ ID NO: 2616597 - RNA, 19 nt, Escherichia coli CFT073
gcgugcgccaccgcuuccg

SEQ ID NO: 2616598 - RNA, 18 nt, Escherichia coli CFT073
gcgugcgcccaucauugc

SEQ ID NO: 2616599 - RNA, 21 nt, Escherichia coli CFT073
gcgugcgcccaucauugcgcc

SEQ ID NO: 2616600 - RNA, 16 nt, Escherichia coli CFT073
gcgugcggcauccggu

SEQ ID NO: 2616601 - RNA, 18 nt, Escherichia coli CFT073
gcgugcuccagucgcgug

SEQ ID NO: 2616602 - RNA, 14 nt, Escherichia coli CFT073
gcguggaggggcga

SEQ ID NO: 2616603 - RNA, 23 nt, Escherichia coli CFT073
gcguggcgauaaucagcgccagc

SEQ ID NO: 2616604 - RNA, 21 nt, Escherichia coli CFT073
gcguggcguugcggcugccca

SEQ ID NO: 2616605 - RNA, 21 nt, Escherichia coli CFT073
gcgugguaucacguagccacg

SEQ ID NO: 2616606 - RNA, 20 nt, Escherichia coli CFT073
gcguggucguuggugaagug

SEQ ID NO: 2616607 - RNA, 14 nt, Escherichia coli CFT073
gcguguaagcauac

SEQ ID NO: 2616608 - RNA, 19 nt, Escherichia coli CFT073
gcgugugacaaaagugaau

SEQ ID NO: 2616609 - RNA, 19 nt, Escherichia coli CFT073
gcgugugccgguaaagcaa

SEQ ID NO: 2616610 - RNA, 21 nt, Escherichia coli CFT073
gcuaccgcccugagcaucaau

SEQ ID NO: 2616611 - RNA, 22 nt, Escherichia coli CFT073
gcuaccggcaggaaauuaagau

SEQ ID NO: 2616612 - RNA, 17 nt, Escherichia coli CFT073
gcuaccgggaucuccuc

SEQ ID NO: 2616613 - RNA, 20 nt, Escherichia coli CFT073
gcuaccguugcggcgucaua

SEQ ID NO: 2616614 - RNA, 19 nt, Escherichia coli CFT073
gcuacgccacagccgagcg

SEQ ID NO: 2616615 - RNA, 17 nt, Escherichia coli CFT073
gcuacgccuuccgucag

SEQ ID NO: 2616616 - RNA, 21 nt, Escherichia coli CFT073
gcuacgcgagugugauuacag

SEQ ID NO: 2616617 - RNA, 22 nt, Escherichia coli CFT073
gcuacgcuuaucaggccugcaa

SEQ ID NO: 2616618 - RNA, 17 nt, Escherichia coli CFT073
gcuacgguugucuuggc

SEQ ID NO: 2616619 - RNA, 19 nt, Escherichia coli CFT073
gcuacguagcucaucuuca

SEQ ID NO: 2616620 - RNA, 13 nt, Escherichia coli CFT073
gcuacgugccggg

SEQ ID NO: 2616621 - RNA, 17 nt, Escherichia coli CFT073
gcuacgugccgggcaaa

SEQ ID NO: 2616622 - RNA, 15 nt, Escherichia coli CFT073
gcuacucgccugcca

SEQ ID NO: 2616623 - RNA, 18 nt, Escherichia coli CFT073
gcuacugauguucgccag

SEQ ID NO: 2616624 - RNA, 19 nt, Escherichia coli CFT073
gcuacugauguucgccaga

SEQ ID NO: 2616625 - RNA, 19 nt, Escherichia coli CFT073
gcuacuggcaauccugcuu

SEQ ID NO: 2616626 - RNA, 11 nt, Escherichia coli CFT073
gcuagcagcag

SEQ ID NO: 2616627 - RNA, 21 nt, Escherichia coli CFT073
gcuagccgcgucuuauccggc

SEQ ID NO: 2616628 - RNA, 18 nt, Escherichia coli CFT073
gcuagcgucgcauccggc

SEQ ID NO: 2616629 - RNA, 17 nt, Escherichia coli CFT073
gcuauaaaaaaacggcg

SEQ ID NO: 2616630 - RNA, 16 nt, Escherichia coli CFT073
gcuauacagcagccau

SEQ ID NO: 2616631 - RNA, 21 nt, Escherichia coli CFT073
gcuauagacaccuugcaacuc

SEQ ID NO: 2616632 - RNA, 14 nt, Escherichia coli CFT073
gcuauaucgcugau

SEQ ID NO: 2616633 - RNA, 20 nt, Escherichia coli CFT073
gcuauaucgcugauaucaaa

SEQ ID NO: 2616634 - RNA, 16 nt, Escherichia coli CFT073
gcuaucaguccauggc

SEQ ID NO: 2616635 - RNA, 21 nt, Escherichia coli CFT073
gcuaucgaaaucaaaguaccg

SEQ ID NO: 2616636 - RNA, 18 nt, Escherichia coli CFT073
gcuaucgaugccgcuuau

SEQ ID NO: 2616637 - RNA, 19 nt, Escherichia coli CFT073
gcuaucggcaaaaauaauc

SEQ ID NO: 2616638 - RNA, 17 nt, Escherichia coli CFT073
gcuaucuauugcugaau

SEQ ID NO: 2616639 - RNA, 20 nt, Escherichia coli CFT073
gcuaucucugguaggccuga

SEQ ID NO: 2616640 - RNA, 18 nt, Escherichia coli CFT073
gcuaugcaacaacuggcg

SEQ ID NO: 2616641 - RNA, 19 nt, Escherichia coli CFT073
gcuaugcaacaacuggcgg

SEQ ID NO: 2616642 - RNA, 15 nt, Escherichia coli CFT073
gcuaugcgcaucaag

SEQ ID NO: 2616643 - RNA, 16 nt, Escherichia coli CFT073
gcuaugugccauugca

SEQ ID NO: 2616644 - RNA, 13 nt, Escherichia coli CFT073
gcuauguguaaga

SEQ ID NO: 2616645 - RNA, 13 nt, Escherichia coli CFT073
gcuauuaacccgc

SEQ ID NO: 2616646 - RNA, 18 nt, Escherichia coli CFT073
gcuauuaacccgcaacag

SEQ ID NO: 2616647 - RNA, 18 nt, Escherichia coli CFT073
gcuauuacuuuaagccuu

SEQ ID NO: 2616648 - RNA, 16 nt, Escherichia coli CFT073
gcuauugaccagcgcc

SEQ ID NO: 2616649 - RNA, 20 nt, Escherichia coli CFT073
gcuauugcuuuagacagcuu

SEQ ID NO: 2616650 - RNA, 12 nt, Escherichia coli CFT073
gcuauuuaccag

SEQ ID NO: 2616651 - RNA, 21 nt, Escherichia coli CFT073
gcuauuuaccgcuacugcguc

SEQ ID NO: 2616652 - RNA, 22 nt, Escherichia coli CFT073
gcuauuuacgguauaacccagu

SEQ ID NO: 2616653 - RNA, 23 nt, Escherichia coli CFT073
gcuauuucccccucccccuuuac

SEQ ID NO: 2616654 - RNA, 13 nt, Escherichia coli CFT073
gcucaaagauauu

SEQ ID NO: 2616655 - RNA, 10 nt, Escherichia coli CFT073
gcucaaaucc

SEQ ID NO: 2616656 - RNA, 18 nt, Escherichia coli CFT073
gcucaacaucgcgcuggc

SEQ ID NO: 2616657 - RNA, 23 nt, Escherichia coli CFT073
gcucaaccgccaguucccccugc

SEQ ID NO: 2616658 - RNA, 22 nt, Escherichia coli CFT073
gcucaaccgccguaacgcggcu

SEQ ID NO: 2616659 - RNA, 13 nt, Escherichia coli CFT073
gcucaacuuccug

SEQ ID NO: 2616660 - RNA, 17 nt, Escherichia coli CFT073
gcucaagaaucucuucu

SEQ ID NO: 2616661 - RNA, 18 nt, Escherichia coli CFT073
gcucaagcguuucaucuu

SEQ ID NO: 2616662 - RNA, 16 nt, Escherichia coli CFT073
gcucaaucgcauggcu

SEQ ID NO: 2616663 - RNA, 18 nt, Escherichia coli CFT073
gcucaaucgccucgccga

SEQ ID NO: 2616664 - RNA, 12 nt, Escherichia coli CFT073
gcucaaucugcg

SEQ ID NO: 2616665 - RNA, 15 nt, Escherichia coli CFT073
gcucacacaaacggc

SEQ ID NO: 2616666 - RNA, 13 nt, Escherichia coli CFT073
gcucaccagcagg

SEQ ID NO: 2616667 - RNA, 16 nt, Escherichia coli CFT073
gcucaccagcaggcac

SEQ ID NO: 2616668 - RNA, 13 nt, Escherichia coli CFT073
gcucacccccauc

SEQ ID NO: 2616669 - RNA, 16 nt, Escherichia coli CFT073
gcucacccccaucagc

SEQ ID NO: 2616670 - RNA, 15 nt, Escherichia coli CFT073
gcucaccugauacgc

SEQ ID NO: 2616671 - RNA, 13 nt, Escherichia coli CFT073
gcucaccugcaca

SEQ ID NO: 2616672 - RNA, 17 nt, Escherichia coli CFT073
gcucacgcagcggcggc

SEQ ID NO: 2616673 - RNA, 15 nt, Escherichia coli CFT073
gcucacgcagcuucu

SEQ ID NO: 2616674 - RNA, 17 nt, Escherichia coli CFT073
gcucacggcggcaguau

SEQ ID NO: 2616675 - RNA, 16 nt, Escherichia coli CFT073
gcucacucaucacucc

SEQ ID NO: 2616676 - RNA, 13 nt, Escherichia coli CFT073
gcucacugauaau

SEQ ID NO: 2616677 - RNA, 17 nt, Escherichia coli CFT073
gcucacuucacgcugcc

SEQ ID NO: 2616678 - RNA, 21 nt, Escherichia coli CFT073
gcucacuucacgcugccagcc

SEQ ID NO: 2616679 - RNA, 18 nt, Escherichia coli CFT073
gcucacuuuguaggccug

SEQ ID NO: 2616680 - RNA, 19 nt, Escherichia coli CFT073
gcucacuuuguaggccuga

SEQ ID NO: 2616681 - RNA, 21 nt, Escherichia coli CFT073
gcucacuuuguaggccugaua

SEQ ID NO: 2616682 - RNA, 19 nt, Escherichia coli CFT073
gcucagaauucugggauga

SEQ ID NO: 2616683 - RNA, 15 nt, Escherichia coli CFT073
gcucagcaaucgcau

SEQ ID NO: 2616684 - RNA, 11 nt, Escherichia coli CFT073
gcucaggcgag

SEQ ID NO: 2616685 - RNA, 11 nt, Escherichia coli CFT073
gcucaggcggu

SEQ ID NO: 2616686 - RNA, 19 nt, Escherichia coli CFT073
gcucaguugguagagcacg

SEQ ID NO: 2616687 - RNA, 21 nt, Escherichia coli CFT073
gcucaguugguagagcacgac

SEQ ID NO: 2616688 - RNA, 22 nt, Escherichia coli CFT073
gcucaguugguagagcacgacc

SEQ ID NO: 2616689 - RNA, 15 nt, Escherichia coli CFT073
gcucaguugguuaga

SEQ ID NO: 2616690 - RNA, 14 nt, Escherichia coli CFT073
gcucaguuucgcgu

SEQ ID NO: 2616691 - RNA, 20 nt, Escherichia coli CFT073
gcucauaaaaucacgcgccu

SEQ ID NO: 2616692 - RNA, 21 nt, Escherichia coli CFT073
gcucauaaaaucacgcgccug

SEQ ID NO: 2616693 - RNA, 15 nt, Escherichia coli CFT073
gcucauaaccgucca

SEQ ID NO: 2616694 - RNA, 17 nt, Escherichia coli CFT073
gcucauagaccauugca

SEQ ID NO: 2616695 - RNA, 13 nt, Escherichia coli CFT073
gcucauaggccug

SEQ ID NO: 2616696 - RNA, 15 nt, Escherichia coli CFT073
gcucauauuccugca

SEQ ID NO: 2616697 - RNA, 12 nt, Escherichia coli CFT073
gcucaucagcgg

SEQ ID NO: 2616698 - RNA, 21 nt, Escherichia coli CFT073
gcucaucagcggcgaagccua

SEQ ID NO: 2616699 - RNA, 13 nt, Escherichia coli CFT073
gcucauccuucag

SEQ ID NO: 2616700 - RNA, 23 nt, Escherichia coli CFT073
gcucaucgaaaauacacgcugca

SEQ ID NO: 2616701 - RNA, 23 nt, Escherichia coli CFT073
gcucaucggcauacagcgacaga

SEQ ID NO: 2616702 - RNA, 17 nt, Escherichia coli CFT073
gcucaucugcugcguuu

SEQ ID NO: 2616703 - RNA, 20 nt, Escherichia coli CFT073
gcucaugccguagaacagca

SEQ ID NO: 2616704 - RNA, 14 nt, Escherichia coli CFT073
gcucauuccgccgc

SEQ ID NO: 2616705 - RNA, 17 nt, Escherichia coli CFT073
gcucauuccgccgccca

SEQ ID NO: 2616706 - RNA, 19 nt, Escherichia coli CFT073
gcuccacacgcucuuccag

SEQ ID NO: 2616707 - RNA, 13 nt, Escherichia coli CFT073
gcuccacgccagc

SEQ ID NO: 2616708 - RNA, 17 nt, Escherichia coli CFT073
gcuccagaauuccgugc

SEQ ID NO: 2616709 - RNA, 22 nt, Escherichia coli CFT073
gcuccagauagagccgguuuug

SEQ ID NO: 2616710 - RNA, 22 nt, Escherichia coli CFT073
gcuccagauuacuuaaguuaua

SEQ ID NO: 2616711 - RNA, 12 nt, Escherichia coli CFT073
gcuccagcagcu

SEQ ID NO: 2616712 - RNA, 16 nt, Escherichia coli CFT073
gcuccagcagcucaau

SEQ ID NO: 2616713 - RNA, 22 nt, Escherichia coli CFT073
gcuccagcccgcgucguucauc

SEQ ID NO: 2616714 - RNA, 21 nt, Escherichia coli CFT073
gcuccagcgggcgaaucaacu

SEQ ID NO: 2616715 - RNA, 20 nt, Escherichia coli CFT073
gcuccagcguaccugccgcg

SEQ ID NO: 2616716 - RNA, 20 nt, Escherichia coli CFT073
gcuccaguaccugcaaaccg

SEQ ID NO: 2616717 - RNA, 22 nt, Escherichia coli CFT073
gcuccaguaccuucguccaucc

SEQ ID NO: 2616718 - RNA, 14 nt, Escherichia coli CFT073
gcucuuaucaccaa

SEQ ID NO: 2616719 - RNA, 15 nt, Escherichia coli CFT073
gcucuuaucaccaaa

SEQ ID NO: 2616720 - RNA, 17 nt, Escherichia coli CFT073
gcucuucaucuuccagu

SEQ ID NO: 2616721 - RNA, 17 nt, Escherichia coli CFT073
gcucuucuggcaccagu

SEQ ID NO: 2616722 - RNA, 19 nt, Escherichia coli CFT073
gcucuugcuuacgcagaca

SEQ ID NO: 2616723 - RNA, 20 nt, Escherichia coli CFT073
gcucuugcuuacgcagacaa

SEQ ID NO: 2616724 - RNA, 15 nt, Escherichia coli CFT073
gcucuuuauccagca

SEQ ID NO: 2616725 - RNA, 18 nt, Escherichia coli CFT073
gcucuuuauccagcagcc

SEQ ID NO: 2616726 - RNA, 21 nt, Escherichia coli CFT073
gcucuuuauccagcagccaga

SEQ ID NO: 2616727 - RNA, 18 nt, Escherichia coli CFT073
gcucuuucgacagcgauu

SEQ ID NO: 2616728 - RNA, 19 nt, Escherichia coli CFT073
gcucuuucucgcucaguuu

SEQ ID NO: 2616729 - RNA, 18 nt, Escherichia coli CFT073
gcucuuucucuucuaguu

SEQ ID NO: 2616730 - RNA, 15 nt, Escherichia coli CFT073
gcucuuuuucggggc

SEQ ID NO: 2616731 - RNA, 18 nt, Escherichia coli CFT073
gcugaaaaggcuaaaauu

SEQ ID NO: 2616732 - RNA, 20 nt, Escherichia coli CFT073
gcugaaaauauucccgucau

SEQ ID NO: 2616733 - RNA, 13 nt, Escherichia coli CFT073
gcugaaauaucau

SEQ ID NO: 2616734 - RNA, 11 nt, Escherichia coli CFT073
gcugaaaucac

SEQ ID NO: 2616735 - RNA, 17 nt, Escherichia coli CFT073
gcugaaaucaccgccac

SEQ ID NO: 2616736 - RNA, 21 nt, Escherichia coli CFT073
gcugaaaucaccgccaccagc

SEQ ID NO: 2616737 - RNA, 22 nt, Escherichia coli CFT073
gcugaaaucaccgccaccagcg

SEQ ID NO: 2616738 - RNA, 19 nt, Escherichia coli CFT073
gcugaacacauuugucgga

SEQ ID NO: 2616739 - RNA, 13 nt, Escherichia coli CFT073
gcugaacagucgc

SEQ ID NO: 2616740 - RNA, 14 nt, Escherichia coli CFT073
gcugaacaucgucu

SEQ ID NO: 2616741 - RNA, 17 nt, Escherichia coli CFT073
gcugaacgcaggccgcc

SEQ ID NO: 2616742 - RNA, 18 nt, Escherichia coli CFT073
gcugaagcaacaguaaua

SEQ ID NO: 2616743 - RNA, 16 nt, Escherichia coli CFT073
gcugaagggcaucagc

SEQ ID NO: 2616744 - RNA, 20 nt, Escherichia coli CFT073
gcugaauaauccccacauca

SEQ ID NO: 2616745 - RNA, 15 nt, Escherichia coli CFT073
gcugaauacgcacca

SEQ ID NO: 2616746 - RNA, 21 nt, Escherichia coli CFT073
gcugaauaucuuucucgcggc

SEQ ID NO: 2616747 - RNA, 13 nt, Escherichia coli CFT073
gcugaaucccugu

SEQ ID NO: 2616748 - RNA, 23 nt, Escherichia coli CFT073
gcugaauggauucagucuuaaaa

SEQ ID NO: 2616749 - RNA, 19 nt, Escherichia coli CFT073
gcugaauggcgauuucaca

SEQ ID NO: 2616750 - RNA, 12 nt, Escherichia coli CFT073
gcugaauguucu

SEQ ID NO: 2616751 - RNA, 20 nt, Escherichia coli CFT073
gcugaauuggguucuuuccu

SEQ ID NO: 2616752 - RNA, 23 nt, Escherichia coli CFT073
gcugaauuggguucuuuccugcg

SEQ ID NO: 2616753 - RNA, 21 nt, Escherichia coli CFT073
gcugaauuuuuuucucgcggc

SEQ ID NO: 2616754 - RNA, 14 nt, Escherichia coli CFT073
gcugacaaacugcg

SEQ ID NO: 2616755 - RNA, 16 nt, Escherichia coli CFT073
gcugacaaagugcacu

SEQ ID NO: 2616756 - RNA, 23 nt, Escherichia coli CFT073
gcugacacaucuuuuccggccuu

SEQ ID NO: 2616757 - RNA, 22 nt, Escherichia coli CFT073
gcugacacgggaaaccaacucc

SEQ ID NO: 2616758 - RNA, 17 nt, Escherichia coli CFT073
gcugacaggcgcugaug

SEQ ID NO: 2616759 - RNA, 17 nt, Escherichia coli CFT073
gcugacauaaacaccag

SEQ ID NO: 2616760 - RNA, 18 nt, Escherichia coli CFT073
gcugacauaaacaccagc

SEQ ID NO: 2616761 - RNA, 21 nt, Escherichia coli CFT073
gcugacauaaacaccagcaau

SEQ ID NO: 2616762 - RNA, 16 nt, Escherichia coli CFT073
gcugacaucaacagaa

SEQ ID NO: 2616763 - RNA, 18 nt, Escherichia coli CFT073
gcugacauggcaauagcu

SEQ ID NO: 2616764 - RNA, 14 nt, Escherichia coli CFT073
gcugacaugugauu

SEQ ID NO: 2616765 - RNA, 13 nt, Escherichia coli CFT073
gcugaccaccagc

SEQ ID NO: 2616766 - RNA, 16 nt, Escherichia coli CFT073
gcugaccaccagcacg

SEQ ID NO: 2616767 - RNA, 16 nt, Escherichia coli CFT073
gcugaccagacuggag

SEQ ID NO: 2616768 - RNA, 14 nt, Escherichia coli CFT073
gcugaccgaaauaa

SEQ ID NO: 2616769 - RNA, 12 nt, Escherichia coli CFT073
gcugaccgcuug

SEQ ID NO: 2616770 - RNA, 20 nt, Escherichia coli CFT073
gcugaccgucaaagcgccag

SEQ ID NO: 2616771 - RNA, 21 nt, Escherichia coli CFT073
gcugaccgucaaagcgccagc

SEQ ID NO: 2616772 - RNA, 14 nt, Escherichia coli CFT073
gcugaccuggaagu

SEQ ID NO: 2616773 - RNA, 17 nt, Escherichia coli CFT073
gcugacgaucauuccgc

SEQ ID NO: 2616774 - RNA, 20 nt, Escherichia coli CFT073
gcugacgcaucuuauccagc

SEQ ID NO: 2616775 - RNA, 15 nt, Escherichia coli CFT073
gcugacgccugccag

SEQ ID NO: 2616776 - RNA, 21 nt, Escherichia coli CFT073
gcugacggugauaaucauccc

SEQ ID NO: 2616777 - RNA, 21 nt, Escherichia coli CFT073
gcugacggugccagguaaaca

SEQ ID NO: 2616778 - RNA, 18 nt, Escherichia coli CFT073
gcugacguuaagaaaacg

SEQ ID NO: 2616779 - RNA, 18 nt, Escherichia coli CFT073
gcugacugacuucaacag

SEQ ID NO: 2616780 - RNA, 18 nt, Escherichia coli CFT073
gcugacugcgcucugacu

SEQ ID NO: 2616781 - RNA, 20 nt, Escherichia coli CFT073
gcugagaacauaaacaccca

SEQ ID NO: 2616782 - RNA, 15 nt, Escherichia coli CFT073
gcugagauccgucag

SEQ ID NO: 2616783 - RNA, 17 nt, Escherichia coli CFT073
gcugagcaggugugaug

SEQ ID NO: 2616784 - RNA, 21 nt, Escherichia coli CFT073
gcugagcuucuucaaaaaagu

SEQ ID NO: 2616785 - RNA, 15 nt, Escherichia coli CFT073
gcugagguauuucgu

SEQ ID NO: 2616786 - RNA, 20 nt, Escherichia coli CFT073
gcugaguauuaaccgguugu

SEQ ID NO: 2616787 - RNA, 14 nt, Escherichia coli CFT073
gcugauaaaucccg

SEQ ID NO: 2616788 - RNA, 13 nt, Escherichia coli CFT073
gcugauaacgcca

SEQ ID NO: 2616789 - RNA, 16 nt, Escherichia coli CFT073
gcugauacuauucauu

SEQ ID NO: 2616790 - RNA, 19 nt, Escherichia coli CFT073
gcugauacuccaugaguaa

SEQ ID NO: 2616791 - RNA, 17 nt, Escherichia coli CFT073
gcugauauuucggcacu

SEQ ID NO: 2616792 - RNA, 13 nt, Escherichia coli CFT073
gcugaucaccgua

SEQ ID NO: 2616793 - RNA, 15 nt, Escherichia coli CFT073
gcugaucgucagcac

SEQ ID NO: 2616794 - RNA, 22 nt, Escherichia coli CFT073
gcugaugaaggugcuaugcaua

SEQ ID NO: 2616795 - RNA, 22 nt, Escherichia coli CFT073
gcugaugaaguugaaaucaccg

SEQ ID NO: 2616796 - RNA, 16 nt, Escherichia coli CFT073
gcugaugcagcgauga

SEQ ID NO: 2616797 - RNA, 19 nt, Escherichia coli CFT073
gcugaugcagcgucaguga

SEQ ID NO: 2616798 - RNA, 21 nt, Escherichia coli CFT073
gcugauggagauuuuccgggu

SEQ ID NO: 2616799 - RNA, 23 nt, Escherichia coli CFT073
gcugauggcgccaguuauucauu

SEQ ID NO: 2616800 - RNA, 22 nt, Escherichia coli CFT073
gcugauggucagugccugcgcc

SEQ ID NO: 2616801 - RNA, 15 nt, Escherichia coli CFT073
gcugauugcggucag

SEQ ID NO: 2616802 - RNA, 12 nt, Escherichia coli CFT073
gcugauugcugg

SEQ ID NO: 2616803 - RNA, 16 nt, Escherichia coli CFT073
gcugauuuuauuucaa

SEQ ID NO: 2616804 - RNA, 15 nt, Escherichia coli CFT073
gcugcaaaaagccuu

SEQ ID NO: 2616805 - RNA, 22 nt, Escherichia coli CFT073
gcugcaaauauugccccagcgu

SEQ ID NO: 2616806 - RNA, 21 nt, Escherichia coli CFT073
gcugcaacagcgcgguauucg

SEQ ID NO: 2616807 - RNA, 18 nt, Escherichia coli CFT073
gcugcaacuggcggcggc

SEQ ID NO: 2616808 - RNA, 19 nt, Escherichia coli CFT073
gcugcaacuggcggcggcg

SEQ ID NO: 2616809 - RNA, 21 nt, Escherichia coli CFT073
gcugcaaggcucuauacgcau

SEQ ID NO: 2616810 - RNA, 14 nt, Escherichia coli CFT073
gcugcaaugccauu

SEQ ID NO: 2616811 - RNA, 22 nt, Escherichia coli CFT073
gcugcaauugcggcaggucauc

SEQ ID NO: 2616812 - RNA, 18 nt, Escherichia coli CFT073
gcugcaccaacaucaugc

SEQ ID NO: 2616813 - RNA, 11 nt, Escherichia coli CFT073
gcugcaccagc

SEQ ID NO: 2616814 - RNA, 18 nt, Escherichia coli CFT073
gcugcaccccacaaacag

SEQ ID NO: 2616815 - RNA, 21 nt, Escherichia coli CFT073
gcugcaccccacaaacagaau

SEQ ID NO: 2616816 - RNA, 18 nt, Escherichia coli CFT073
gcugcacguuuucaaccg

SEQ ID NO: 2616817 - RNA, 16 nt, Escherichia coli CFT073
gcugcagccaguugcu

SEQ ID NO: 2616818 - RNA, 15 nt, Escherichia coli CFT073
gcugcaguuguuccu

SEQ ID NO: 2616819 - RNA, 12 nt, Escherichia coli CFT073
gcugcauccaga

SEQ ID NO: 2616820 - RNA, 23 nt, Escherichia coli CFT073
gcugcaucucuuugcuguugauu

SEQ ID NO: 2616821 - RNA, 22 nt, Escherichia coli CFT073
gcugcaugaugucgaauuucuc

SEQ ID NO: 2616822 - RNA, 21 nt, Escherichia coli CFT073
gcugcauguuuuuuaaguuca

SEQ ID NO: 2616823 - RNA, 16 nt, Escherichia coli CFT073
gcugcauuauccacgc

SEQ ID NO: 2616824 - RNA, 16 nt, Escherichia coli CFT073
gcugcauuucuggaau

SEQ ID NO: 2616825 - RNA, 18 nt, Escherichia coli CFT073
gcugccacauuucucugu

SEQ ID NO: 2616826 - RNA, 17 nt, Escherichia coli CFT073
gcuggcguacccaucaa

SEQ ID NO: 2616827 - RNA, 16 nt, Escherichia coli CFT073
gcuggcguagagaucc

SEQ ID NO: 2616828 - RNA, 18 nt, Escherichia coli CFT073
gcuggcgucacgccgacc

SEQ ID NO: 2616829 - RNA, 14 nt, Escherichia coli CFT073
gcuggcugcagugg

SEQ ID NO: 2616830 - RNA, 22 nt, Escherichia coli CFT073
gcuggcugcgcuugcggccagc

SEQ ID NO: 2616831 - RNA, 21 nt, Escherichia coli CFT073
gcuggcuuuacccuggcgcga

SEQ ID NO: 2616832 - RNA, 20 nt, Escherichia coli CFT073
gcugggaaaucaccaccagc

SEQ ID NO: 2616833 - RNA, 21 nt, Escherichia coli CFT073
gcugggauuuggcagcaccca

SEQ ID NO: 2616834 - RNA, 18 nt, Escherichia coli CFT073
gcugggccaucaggcgac

SEQ ID NO: 2616835 - RNA, 14 nt, Escherichia coli CFT073
gcugggcgauuucg

SEQ ID NO: 2616836 - RNA, 19 nt, Escherichia coli CFT073
gcugggcgguaauguuuug

SEQ ID NO: 2616837 - RNA, 17 nt, Escherichia coli CFT073
gcuggguuucgccugcc

SEQ ID NO: 2616838 - RNA, 20 nt, Escherichia coli CFT073
gcugguaacaucaauaacaa

SEQ ID NO: 2616839 - RNA, 15 nt, Escherichia coli CFT073
gcugguaaucaccac

SEQ ID NO: 2616840 - RNA, 19 nt, Escherichia coli CFT073
gcugguaaucaccacccac

SEQ ID NO: 2616841 - RNA, 20 nt, Escherichia coli CFT073
gcugguaccugucgcuuuug

SEQ ID NO: 2616842 - RNA, 19 nt, Escherichia coli CFT073
gcuggucacugacgacuuc

SEQ ID NO: 2616843 - RNA, 18 nt, Escherichia coli CFT073
gcuggucagcaucgucaa

SEQ ID NO: 2616844 - RNA, 13 nt, Escherichia coli CFT073
gcuggucgcccgg

SEQ ID NO: 2616845 - RNA, 13 nt, Escherichia coli CFT073
gcuggugauucag

SEQ ID NO: 2616846 - RNA, 18 nt, Escherichia coli CFT073
gcuggugauugcaaagag

SEQ ID NO: 2616847 - RNA, 22 nt, Escherichia coli CFT073
gcugguggaacagcugcaacag

SEQ ID NO: 2616848 - RNA, 18 nt, Escherichia coli CFT073
gcugguggaguaaacacc

SEQ ID NO: 2616849 - RNA, 20 nt, Escherichia coli CFT073
gcugguggauguuugcagua

SEQ ID NO: 2616850 - RNA, 22 nt, Escherichia coli CFT073
gcugguguaaaaacugccaggc

SEQ ID NO: 2616851 - RNA, 14 nt, Escherichia coli CFT073
gcugguugaugcgc

SEQ ID NO: 2616852 - RNA, 16 nt, Escherichia coli CFT073
gcugguuucuggcggu

SEQ ID NO: 2616853 - RNA, 19 nt, Escherichia coli CFT073
gcugguuuucagcgaaaca

SEQ ID NO: 2616854 - RNA, 20 nt, Escherichia coli CFT073
gcugguuuugugcgccacau

SEQ ID NO: 2616855 - RNA, 21 nt, Escherichia coli CFT073
gcuguaagccaaaccgaaaca

SEQ ID NO: 2616856 - RNA, 15 nt, Escherichia coli CFT073
gcuguaagccgccgc

SEQ ID NO: 2616857 - RNA, 18 nt, Escherichia coli CFT073
gcuguaaggugaaagcaa

SEQ ID NO: 2616858 - RNA, 15 nt, Escherichia coli CFT073
gcuguaauagacugc

SEQ ID NO: 2616859 - RNA, 20 nt, Escherichia coli CFT073
gcuguaauagacugcacuga

SEQ ID NO: 2616860 - RNA, 20 nt, Escherichia coli CFT073
gcuguaauuucacaccauca

SEQ ID NO: 2616861 - RNA, 15 nt, Escherichia coli CFT073
gcuguacacuuccca

SEQ ID NO: 2616862 - RNA, 22 nt, Escherichia coli CFT073
gcuguacacuucccagccccgc

SEQ ID NO: 2616863 - RNA, 18 nt, Escherichia coli CFT073
gcuguaccuggccccugg

SEQ ID NO: 2616864 - RNA, 23 nt, Escherichia coli CFT073
gcuguaccuggccccuggcuggu

SEQ ID NO: 2616865 - RNA, 14 nt, Escherichia coli CFT073
gcuguacucaccaa

SEQ ID NO: 2616866 - RNA, 19 nt, Escherichia coli CFT073
gcuguacucaccaacgcag

SEQ ID NO: 2616867 - RNA, 20 nt, Escherichia coli CFT073
gcuguagcaguuccagcauc

SEQ ID NO: 2616868 - RNA, 15 nt, Escherichia coli CFT073
gcuguagccagcucg

SEQ ID NO: 2616869 - RNA, 22 nt, Escherichia coli CFT073
gcuguaggguggggaaaaaaca

SEQ ID NO: 2616870 - RNA, 18 nt, Escherichia coli CFT073
gcuguaguccaggccuga

SEQ ID NO: 2616871 - RNA, 13 nt, Escherichia coli CFT073
gcuguaguucaga

SEQ ID NO: 2616872 - RNA, 16 nt, Escherichia coli CFT073
gcuguauguuccccuc

SEQ ID NO: 2616873 - RNA, 19 nt, Escherichia coli CFT073
gcugucaacugcgccacuc

SEQ ID NO: 2616874 - RNA, 21 nt, Escherichia coli CFT073
gcugucaccucugcaacgucu

SEQ ID NO: 2616875 - RNA, 15 nt, Escherichia coli CFT073
gcugucaguagcaaa

SEQ ID NO: 2616876 - RNA, 16 nt, Escherichia coli CFT073
gcugucauccagcagu

SEQ ID NO: 2616877 - RNA, 14 nt, Escherichia coli CFT073
gcugucauggcuga

SEQ ID NO: 2616878 - RNA, 15 nt, Escherichia coli CFT073
gcugucauucauuca

SEQ ID NO: 2616879 - RNA, 12 nt, Escherichia coli CFT073
gcuguccauacc

SEQ ID NO: 2616880 - RNA, 14 nt, Escherichia coli CFT073
gcugucgaaaagau

SEQ ID NO: 2616881 - RNA, 15 nt, Escherichia coli CFT073
gcugucgaucagaga

SEQ ID NO: 2616882 - RNA, 16 nt, Escherichia coli CFT073
gcugucgaucuccggc

SEQ ID NO: 2616883 - RNA, 16 nt, Escherichia coli CFT073
gcugucgcgcagcacu

SEQ ID NO: 2616884 - RNA, 20 nt, Escherichia coli CFT073
gcugucggcaagauacugca

SEQ ID NO: 2616885 - RNA, 12 nt, Escherichia coli CFT073
gcugucggcacu

SEQ ID NO: 2616886 - RNA, 14 nt, Escherichia coli CFT073
gcugucggcacuga

SEQ ID NO: 2616887 - RNA, 21 nt, Escherichia coli CFT073
gcugucggcacugaccaccac

SEQ ID NO: 2616888 - RNA, 17 nt, Escherichia coli CFT073
gcugucggucaaauuca

SEQ ID NO: 2616889 - RNA, 16 nt, Escherichia coli CFT073
gcugucuaccagcacc

SEQ ID NO: 2616890 - RNA, 15 nt, Escherichia coli CFT073
gcugucuuucaacag

SEQ ID NO: 2616891 - RNA, 17 nt, Escherichia coli CFT073
gcugugaaacaccugca

SEQ ID NO: 2616892 - RNA, 16 nt, Escherichia coli CFT073
gcugugaagcaccugc

SEQ ID NO: 2616893 - RNA, 22 nt, Escherichia coli CFT073
gcugugagguggagucagggga

SEQ ID NO: 2616894 - RNA, 14 nt, Escherichia coli CFT073
gcugugccaggacu

SEQ ID NO: 2616895 - RNA, 17 nt, Escherichia coli CFT073
gcugugcgacuucauuc

SEQ ID NO: 2616896 - RNA, 21 nt, Escherichia coli CFT073
gcugugcuccuucucugagcu

SEQ ID NO: 2616897 - RNA, 22 nt, Escherichia coli CFT073
gcugugcuccuucucugagcug

SEQ ID NO: 2616898 - RNA, 12 nt, Escherichia coli CFT073
gcugugggguau

SEQ ID NO: 2616899 - RNA, 22 nt, Escherichia coli CFT073
gcuguggugcaauccacaagca

SEQ ID NO: 2616900 - RNA, 14 nt, Escherichia coli CFT073
gcuguuaccagaca

SEQ ID NO: 2616901 - RNA, 24 nt, Escherichia coli CFT073
gcuguuacuuucacaaugcccgga

SEQ ID NO: 2616902 - RNA, 16 nt, Escherichia coli CFT073
gcuguucaucccgacc

SEQ ID NO: 2616903 - RNA, 17 nt, Escherichia coli CFT073
gcuguuccagcaucaca

SEQ ID NO: 2616904 - RNA, 20 nt, Escherichia coli CFT073
gcuguuccggcacaccuuca

SEQ ID NO: 2616905 - RNA, 17 nt, Escherichia coli CFT073
gcuguuccggcggcagg

SEQ ID NO: 2616906 - RNA, 19 nt, Escherichia coli CFT073
gcuguuccucaacuuuguu

SEQ ID NO: 2616907 - RNA, 15 nt, Escherichia coli CFT073
gcuguugccaccauu

SEQ ID NO: 2616908 - RNA, 16 nt, Escherichia coli CFT073
gcuguugccagcagca

SEQ ID NO: 2616909 - RNA, 21 nt, Escherichia coli CFT073
gcuguugccgccgcgugcaau

SEQ ID NO: 2616910 - RNA, 17 nt, Escherichia coli CFT073
gcuguuguucagugcau

SEQ ID NO: 2616911 - RNA, 15 nt, Escherichia coli CFT073
gcuguuguuccagcu

SEQ ID NO: 2616912 - RNA, 18 nt, Escherichia coli CFT073
gcuguuucuggcaccagg

SEQ ID NO: 2616913 - RNA, 18 nt, Escherichia coli CFT073
gcuguuuucagcaccaga

SEQ ID NO: 2616914 - RNA, 14 nt, Escherichia coli CFT073
gcuguuuuccagca

SEQ ID NO: 2616915 - RNA, 13 nt, Escherichia coli CFT073
gcuuaaaguguuc

SEQ ID NO: 2616916 - RNA, 12 nt, Escherichia coli CFT073
gcuuaacaacgg

SEQ ID NO: 2616917 - RNA, 23 nt, Escherichia coli CFT073
gcuuaacagauugagaauaaugc

SEQ ID NO: 2616918 - RNA, 16 nt, Escherichia coli CFT073
gcuuaacguacugcug

SEQ ID NO: 2616919 - RNA, 15 nt, Escherichia coli CFT073
gcuuaagaagaacgg

SEQ ID NO: 2616920 - RNA, 18 nt, Escherichia coli CFT073
gcuuaagaucaacuucgc

SEQ ID NO: 2616921 - RNA, 18 nt, Escherichia coli CFT073
gcuuaagcgaccaguugu

SEQ ID NO: 2616922 - RNA, 15 nt, Escherichia coli CFT073
gcuuaaucaauugca

SEQ ID NO: 2616923 - RNA, 17 nt, Escherichia coli CFT073
gcuuaaucaccagcgca

SEQ ID NO: 2616924 - RNA, 19 nt, Escherichia coli CFT073
gcuuaauccgcgcccuuuu

SEQ ID NO: 2616925 - RNA, 17 nt, Escherichia coli CFT073
gcuuaaugagauaauca

SEQ ID NO: 2616926 - RNA, 18 nt, Escherichia coli CFT073
gcuuaaugagauaaucaa

SEQ ID NO: 2616927 - RNA, 17 nt, Escherichia coli CFT073
gcuuaauugcgcagcgg

SEQ ID NO: 2616928 - RNA, 13 nt, Escherichia coli CFT073
gcuuacaucuuua

SEQ ID NO: 2616929 - RNA, 15 nt, Escherichia coli CFT073
gcuuacgcaacucau

SEQ ID NO: 2616930 - RNA, 16 nt, Escherichia coli CFT073
gcuuacgcccgccugc

SEQ ID NO: 2616931 - RNA, 21 nt, Escherichia coli CFT073
gcuuacguccgccguugcgcc

SEQ ID NO: 2616932 - RNA, 19 nt, Escherichia coli CFT073
gcuuacguuacccagcacg

SEQ ID NO: 2616933 - RNA, 21 nt, Escherichia coli CFT073
gcuuacucuuucaauuugcag

SEQ ID NO: 2616934 - RNA, 17 nt, Escherichia coli CFT073
gccagaauagccgcagc

SEQ ID NO: 2616935 - RNA, 18 nt, Escherichia coli CFT073
gccagaauagccgcagcu

SEQ ID NO: 2616936 - RNA, 13 nt, Escherichia coli CFT073
gccagaaucaaac

SEQ ID NO: 2616937 - RNA, 17 nt, Escherichia coli CFT073
gccagaaucaaacugcc

SEQ ID NO: 2616938 - RNA, 13 nt, Escherichia coli CFT073
gccagaaucccca

SEQ ID NO: 2616939 - RNA, 17 nt, Escherichia coli CFT073
gccagaauccccacugc

SEQ ID NO: 2616940 - RNA, 19 nt, Escherichia coli CFT073
gccagaaucgcaaccagcc

SEQ ID NO: 2616941 - RNA, 17 nt, Escherichia coli CFT073
gccagaaugucuucgac

SEQ ID NO: 2616942 - RNA, 17 nt, Escherichia coli CFT073
gccagacaaaccacgcc

SEQ ID NO: 2616943 - RNA, 17 nt, Escherichia coli CFT073
gccagacaauccagcga

SEQ ID NO: 2616944 - RNA, 19 nt, Escherichia coli CFT073
gccagacaauggcccgccg

SEQ ID NO: 2616945 - RNA, 20 nt, Escherichia coli CFT073
gccagacaauggcccgccgc

SEQ ID NO: 2616946 - RNA, 17 nt, Escherichia coli CFT073
gccagaccgaacagcau

SEQ ID NO: 2616947 - RNA, 18 nt, Escherichia coli CFT073
gccagaccgaacagcaua

SEQ ID NO: 2616948 - RNA, 14 nt, Escherichia coli CFT073
gccagaccugcgca

SEQ ID NO: 2616949 - RNA, 17 nt, Escherichia coli CFT073
gccagaccuuaucacaa

SEQ ID NO: 2616950 - RNA, 22 nt, Escherichia coli CFT073
gccagacgaaugaagcagaagc

SEQ ID NO: 2616951 - RNA, 16 nt, Escherichia coli CFT073
gccagacgcgccgcca

SEQ ID NO: 2616952 - RNA, 13 nt, Escherichia coli CFT073
gccagacgcguca

SEQ ID NO: 2616953 - RNA, 19 nt, Escherichia coli CFT073
gccagacguccaaucggcc

SEQ ID NO: 2616954 - RNA, 21 nt, Escherichia coli CFT073
gccagacguccaaucggccau

SEQ ID NO: 2616955 - RNA, 15 nt, Escherichia coli CFT073
gccagacucagcaac

SEQ ID NO: 2616956 - RNA, 17 nt, Escherichia coli CFT073
gccagacucucgccaga

SEQ ID NO: 2616957 - RNA, 23 nt, Escherichia coli CFT073
gccagacugacaaucaucgccgu

SEQ ID NO: 2616958 - RNA, 19 nt, Escherichia coli CFT073
gccagacugaucaucgccc

SEQ ID NO: 2616959 - RNA, 14 nt, Escherichia coli CFT073
gccagagaauaccg

SEQ ID NO: 2616960 - RNA, 12 nt, Escherichia coli CFT073
gccagagagcga

SEQ ID NO: 2616961 - RNA, 19 nt, Escherichia coli CFT073
gccagagcagcaacaagcc

SEQ ID NO: 2616962 - RNA, 14 nt, Escherichia coli CFT073
gccagaggcgacaa

SEQ ID NO: 2616963 - RNA, 21 nt, Escherichia coli CFT073
gccagagucagcaaugccaga

SEQ ID NO: 2616964 - RNA, 14 nt, Escherichia coli CFT073
gccagagucagcac

SEQ ID NO: 2616965 - RNA, 22 nt, Escherichia coli CFT073
gccagaguggauuaucuucacc

SEQ ID NO: 2616966 - RNA, 20 nt, Escherichia coli CFT073
gccagauaagacgcgucagc

SEQ ID NO: 2616967 - RNA, 20 nt, Escherichia coli CFT073
gccagauaagacgcgucagu

SEQ ID NO: 2616968 - RNA, 23 nt, Escherichia coli CFT073
gccagauaaggcguucacgccgc

SEQ ID NO: 2616969 - RNA, 17 nt, Escherichia coli CFT073
gccagauaauggcuguu

SEQ ID NO: 2616970 - RNA, 22 nt, Escherichia coli CFT073
gccagauacugccgaccagagc

SEQ ID NO: 2616971 - RNA, 23 nt, Escherichia coli CFT073
gccagauauugauucaucucuuc

SEQ ID NO: 2616972 - RNA, 14 nt, Escherichia coli CFT073
gccagauccgccau

SEQ ID NO: 2616973 - RNA, 23 nt, Escherichia coli CFT073
gccagaugcggcgugaacgccuu

SEQ ID NO: 2616974 - RNA, 16 nt, Escherichia coli CFT073
gccagauggcauccag

SEQ ID NO: 2616975 - RNA, 18 nt, Escherichia coli CFT073
gccagauggcuuugcccu

SEQ ID NO: 2616976 - RNA, 17 nt, Escherichia coli CFT073
gccagauguuccgccau

SEQ ID NO: 2616977 - RNA, 18 nt, Escherichia coli CFT073
gccagauguuuaaacugg

SEQ ID NO: 2616978 - RNA, 14 nt, Escherichia coli CFT073
gccagauucuccag

SEQ ID NO: 2616979 - RNA, 17 nt, Escherichia coli CFT073
gccagauugaagcagau

SEQ ID NO: 2616980 - RNA, 19 nt, Escherichia coli CFT073
gccagauugugugacacuu

SEQ ID NO: 2616981 - RNA, 18 nt, Escherichia coli CFT073
gccagauuguuauccagc

SEQ ID NO: 2616982 - RNA, 19 nt, Escherichia coli CFT073
gccagauuguuauccagcu

SEQ ID NO: 2616983 - RNA, 20 nt, Escherichia coli CFT073
gccagauuguuauccagcug

SEQ ID NO: 2616984 - RNA, 16 nt, Escherichia coli CFT073
gccagcaaaucagcca

SEQ ID NO: 2616985 - RNA, 20 nt, Escherichia coli CFT073
gccagcaacagcgcgucagc

SEQ ID NO: 2616986 - RNA, 22 nt, Escherichia coli CFT073
gccagcaaccaacgcuagcagc

SEQ ID NO: 2616987 - RNA, 24 nt, Escherichia coli CFT073
gccagcaaccaacgcuagcagcag

SEQ ID NO: 2616988 - RNA, 22 nt, Escherichia coli CFT073
gccagcaacggccaaauauccg

SEQ ID NO: 2616989 - RNA, 17 nt, Escherichia coli CFT073
gccagcaacugauacac

SEQ ID NO: 2616990 - RNA, 14 nt, Escherichia coli CFT073
gccagcaacuggcg

SEQ ID NO: 2616991 - RNA, 23 nt, Escherichia coli CFT073
gccagcacauagccgaaaaugcu

SEQ ID NO: 2616992 - RNA, 21 nt, Escherichia coli CFT073
gccagcaccacuuuacgggca

SEQ ID NO: 2616993 - RNA, 16 nt, Escherichia coli CFT073
gccagcaccaucgcga

SEQ ID NO: 2616994 - RNA, 16 nt, Escherichia coli CFT073
gccagcaccaucgcgc

SEQ ID NO: 2616995 - RNA, 20 nt, Escherichia coli CFT073
gccagcacuuuguaaccagu

SEQ ID NO: 2616996 - RNA, 19 nt, Escherichia coli CFT073
gccagcagcagcgaauaau

SEQ ID NO: 2616997 - RNA, 22 nt, Escherichia coli CFT073
gccagcagccacgacguuuggu

SEQ ID NO: 2616998 - RNA, 14 nt, Escherichia coli CFT073
gccagcagccauuc

SEQ ID NO: 2616999 - RNA, 18 nt, Escherichia coli CFT073
gccagcagcgaaucagcc

SEQ ID NO: 2617000 - RNA, 19 nt, Escherichia coli CFT073
gccagcagcgaaucagccc

SEQ ID NO: 2617001 - RNA, 22 nt, Escherichia coli CFT073
gccagcagcgaaucagcccagc

SEQ ID NO: 2617002 - RNA, 18 nt, Escherichia coli CFT073
gccagcagcgcaaagccc

SEQ ID NO: 2617003 - RNA, 17 nt, Escherichia coli CFT073
gccagcagcugacugac

SEQ ID NO: 2617004 - RNA, 13 nt, Escherichia coli CFT073
gccagcagcuuca

SEQ ID NO: 2617005 - RNA, 15 nt, Escherichia coli CFT073
gccagcagggcaaac

SEQ ID NO: 2617006 - RNA, 20 nt, Escherichia coli CFT073
gccagcagggcaaacagcac

SEQ ID NO: 2617007 - RNA, 13 nt, Escherichia coli CFT073
gccagcaguucaa

SEQ ID NO: 2617008 - RNA, 19 nt, Escherichia coli CFT073
gccagcauaaucaccauca

SEQ ID NO: 2617009 - RNA, 22 nt, Escherichia coli CFT073
gccagcauaaucaccaucagca

SEQ ID NO: 2617010 - RNA, 23 nt, Escherichia coli CFT073
gccagcauaaucaccaucagcag

SEQ ID NO: 2617011 - RNA, 15 nt, Escherichia coli CFT073
gccagcaucagaccc

SEQ ID NO: 2617012 - RNA, 19 nt, Escherichia coli CFT073
gccagcaucagacccaccc

SEQ ID NO: 2617013 - RNA, 11 nt, Escherichia coli CFT073
gccagcaucgc

SEQ ID NO: 2617014 - RNA, 21 nt, Escherichia coli CFT073
gccagcaucggcaacgccagc

SEQ ID NO: 2617015 - RNA, 22 nt, Escherichia coli CFT073
gccagcaucgggaugagcaucg

SEQ ID NO: 2617016 - RNA, 23 nt, Escherichia coli CFT073
gccagcaugccuguggcgcgacc

SEQ ID NO: 2617017 - RNA, 14 nt, Escherichia coli CFT073
gccagcauugcgcc

SEQ ID NO: 2617018 - RNA, 21 nt, Escherichia coli CFT073
gccagcauugcgccagcgaga

SEQ ID NO: 2617019 - RNA, 15 nt, Escherichia coli CFT073
gccagccaagcaugu

SEQ ID NO: 2617020 - RNA, 16 nt, Escherichia coli CFT073
gccagccaauugccau

SEQ ID NO: 2617021 - RNA, 15 nt, Escherichia coli CFT073
gccagccacaggccg

SEQ ID NO: 2617022 - RNA, 17 nt, Escherichia coli CFT073
gccagccacaggccggu

SEQ ID NO: 2617023 - RNA, 16 nt, Escherichia coli CFT073
gccagccaucgccugc

SEQ ID NO: 2617024 - RNA, 17 nt, Escherichia coli CFT073
gccagccaucgccugcu

SEQ ID NO: 2617025 - RNA, 15 nt, Escherichia coli CFT073
gccagccaugcggca

SEQ ID NO: 2617026 - RNA, 22 nt, Escherichia coli CFT073
gccagcccgaucggcuggcauu

SEQ ID NO: 2617027 - RNA, 20 nt, Escherichia coli CFT073
gccagcccuuucagcccacc

SEQ ID NO: 2617028 - RNA, 18 nt, Escherichia coli CFT073
gccagccgauaucuuucc

SEQ ID NO: 2617029 - RNA, 15 nt, Escherichia coli CFT073
gccagccgauccgga

SEQ ID NO: 2617030 - RNA, 13 nt, Escherichia coli CFT073
gccagccgcagcu

SEQ ID NO: 2617031 - RNA, 15 nt, Escherichia coli CFT073
gccagccgccagcau

SEQ ID NO: 2617032 - RNA, 12 nt, Escherichia coli CFT073
gccagccgcuaa

SEQ ID NO: 2617033 - RNA, 12 nt, Escherichia coli CFT073
gccagccgucgu

SEQ ID NO: 2617034 - RNA, 10 nt, Escherichia coli CFT073
gccagccuca

SEQ ID NO: 2617035 - RNA, 14 nt, Escherichia coli CFT073
gccagccucaucca

SEQ ID NO: 2617036 - RNA, 17 nt, Escherichia coli CFT073
gccagccuccaacccac

SEQ ID NO: 2617037 - RNA, 12 nt, Escherichia coli CFT073
gccagccugauc

SEQ ID NO: 2617038 - RNA, 20 nt, Escherichia coli CFT073
gccagccugcgcuaccagaa

SEQ ID NO: 2617039 - RNA, 16 nt, Escherichia coli CFT073
gccagcgaagccagcu

SEQ ID NO: 2617040 - RNA, 20 nt, Escherichia coli CFT073
gccagcgaagguaacaccag

SEQ ID NO: 2617041 - RNA, 16 nt, Escherichia coli CFT073
gccagcgacagaaauc

SEQ ID NO: 2617042 - RNA, 18 nt, Escherichia coli CFT073
gccagcgagaaauacgcc

SEQ ID NO: 2617043 - RNA, 14 nt, Escherichia coli CFT073
gccagcgagaaguc

SEQ ID NO: 2617044 - RNA, 18 nt, Escherichia coli CFT073
gccagcgauuugucggca

SEQ ID NO: 2617045 - RNA, 18 nt, Escherichia coli CFT073
gccagcgauuuugccagc

SEQ ID NO: 2617046 - RNA, 21 nt, Escherichia coli CFT073
gccagcgauuuugccagccgc

SEQ ID NO: 2617047 - RNA, 14 nt, Escherichia coli CFT073
gccagcgcaggcag

SEQ ID NO: 2617048 - RNA, 15 nt, Escherichia coli CFT073
gccagcgccaaagcc

SEQ ID NO: 2617049 - RNA, 19 nt, Escherichia coli CFT073
gccagcgccaaagccaguu

SEQ ID NO: 2617050 - RNA, 15 nt, Escherichia coli CFT073
gccagcgccaccacc

SEQ ID NO: 2617051 - RNA, 13 nt, Escherichia coli CFT073
gccagcgccaucg

SEQ ID NO: 2617052 - RNA, 13 nt, Escherichia coli CFT073
gccagcgccgcgc

SEQ ID NO: 2617053 - RNA, 16 nt, Escherichia coli CFT073
gccagcgcgaccgcca

SEQ ID NO: 2617054 - RNA, 14 nt, Escherichia coli CFT073
gccagcgcgcggcu

SEQ ID NO: 2617055 - RNA, 16 nt, Escherichia coli CFT073
gccagcgcgcggcugg

SEQ ID NO: 2617056 - RNA, 19 nt, Escherichia coli CFT073
gccagcgcgcggcuggcac

SEQ ID NO: 2617057 - RNA, 14 nt, Escherichia coli CFT073
gccagcgcugccca

SEQ ID NO: 2617058 - RNA, 10 nt, Escherichia coli CFT073
gccagcggcg

SEQ ID NO: 2617059 - RNA, 12 nt, Escherichia coli CFT073
gccagcggcggc

SEQ ID NO: 2617060 - RNA, 18 nt, Escherichia coli CFT073
gccagcgguagcucgacc

SEQ ID NO: 2617061 - RNA, 18 nt, Escherichia coli CFT073
gccagcguaccuugcggc

SEQ ID NO: 2617062 - RNA, 20 nt, Escherichia coli CFT073
gccagcgucaguucucuggc

SEQ ID NO: 2617063 - RNA, 19 nt, Escherichia coli CFT073
gccagcgucgcauccgaca

SEQ ID NO: 2617064 - RNA, 16 nt, Escherichia coli CFT073
gccagcgugucgagca

SEQ ID NO: 2617065 - RNA, 23 nt, Escherichia coli CFT073
gccagcguuaucccauuccacuc

SEQ ID NO: 2617066 - RNA, 14 nt, Escherichia coli CFT073
gccagcuaccagaa

SEQ ID NO: 2617067 - RNA, 21 nt, Escherichia coli CFT073
gccagcucaucguuacgccca

SEQ ID NO: 2617068 - RNA, 13 nt, Escherichia coli CFT073
gccagcuccagcg

SEQ ID NO: 2617069 - RNA, 16 nt, Escherichia coli CFT073
gccagcuccagcgcuu

SEQ ID NO: 2617070 - RNA, 19 nt, Escherichia coli CFT073
gccagcucccacaguuuca

SEQ ID NO: 2617071 - RNA, 18 nt, Escherichia coli CFT073
gccagcuccgggcugguu

SEQ ID NO: 2617072 - RNA, 14 nt, Escherichia coli CFT073
gccagcucgugcag

SEQ ID NO: 2617073 - RNA, 12 nt, Escherichia coli CFT073
gccagcucugcg

SEQ ID NO: 2617074 - RNA, 22 nt, Escherichia coli CFT073
gccagcucugcgcccugcauca

SEQ ID NO: 2617075 - RNA, 14 nt, Escherichia coli CFT073
gccagcuucacgcg

SEQ ID NO: 2617076 - RNA, 16 nt, Escherichia coli CFT073
gccagcuugcagccgu

SEQ ID NO: 2617077 - RNA, 22 nt, Escherichia coli CFT073
gccagcuugcuuuccagcuuca

SEQ ID NO: 2617078 - RNA, 15 nt, Escherichia coli CFT073
gccagcuuugacguu

SEQ ID NO: 2617079 - RNA, 22 nt, Escherichia coli CFT073
gccaggaaccugugacagcagc

SEQ ID NO: 2617080 - RNA, 15 nt, Escherichia coli CFT073
gccaggacaucagcg

SEQ ID NO: 2617081 - RNA, 14 nt, Escherichia coli CFT073
gccaggaccauuca

SEQ ID NO: 2617082 - RNA, 13 nt, Escherichia coli CFT073
gccaggaccgcug

SEQ ID NO: 2617083 - RNA, 14 nt, Escherichia coli CFT073
gccaggaccgcuga

SEQ ID NO: 2617084 - RNA, 21 nt, Escherichia coli CFT073
gccaggcaacagauaauaaaa

SEQ ID NO: 2617085 - RNA, 16 nt, Escherichia coli CFT073
gccaggcacgccgcgc

SEQ ID NO: 2617086 - RNA, 15 nt, Escherichia coli CFT073
gccaggcacuuccca

SEQ ID NO: 2617087 - RNA, 13 nt, Escherichia coli CFT073
gccaggcccaaua

SEQ ID NO: 2617088 - RNA, 20 nt, Escherichia coli CFT073
gccaggcgcgagaagaucca

SEQ ID NO: 2617089 - RNA, 14 nt, Escherichia coli CFT073
gccaggcgcugcug

SEQ ID NO: 2617090 - RNA, 19 nt, Escherichia coli CFT073
gccaggcgcugcuggagca

SEQ ID NO: 2617091 - RNA, 14 nt, Escherichia coli CFT073
gccaggcuccagau

SEQ ID NO: 2617092 - RNA, 15 nt, Escherichia coli CFT073
gccaggcuccagaua

SEQ ID NO: 2617093 - RNA, 18 nt, Escherichia coli CFT073
gccaggcuuuaaauuccg

SEQ ID NO: 2617094 - RNA, 20 nt, Escherichia coli CFT073
gccaggcuuuccgucagcgg

SEQ ID NO: 2617095 - RNA, 21 nt, Escherichia coli CFT073
gccagggauaagccagaccac

SEQ ID NO: 2617096 - RNA, 16 nt, Escherichia coli CFT073
gccagggucaguuuca

SEQ ID NO: 2617097 - RNA, 20 nt, Escherichia coli CFT073
gccagguagcguuucaccuc

SEQ ID NO: 2617098 - RNA, 18 nt, Escherichia coli CFT073
gccagguauuugcguagc

SEQ ID NO: 2617099 - RNA, 19 nt, Escherichia coli CFT073
gccaggucagagagccagc

SEQ ID NO: 2617100 - RNA, 20 nt, Escherichia coli CFT073
gccaggucagagagccagcc

SEQ ID NO: 2617101 - RNA, 18 nt, Escherichia coli CFT073
gccaggucgcuugccgcc

SEQ ID NO: 2617102 - RNA, 21 nt, Escherichia coli CFT073
gccaggugaucccccugggcc

SEQ ID NO: 2617103 - RNA, 22 nt, Escherichia coli CFT073
gccaggugcuuuuguuauagca

SEQ ID NO: 2617104 - RNA, 20 nt, Escherichia coli CFT073
gccagguuuuagaucccacg

SEQ ID NO: 2617105 - RNA, 20 nt, Escherichia coli CFT073
gccagguuuucuuucaccuc

SEQ ID NO: 2617106 - RNA, 20 nt, Escherichia coli CFT073
gccaguaaauggcgcuaaaa

SEQ ID NO: 2617107 - RNA, 20 nt, Escherichia coli CFT073
gccaguaagcaguccagcgc

SEQ ID NO: 2617108 - RNA, 21 nt, Escherichia coli CFT073
gccaguaagcaguccagcgcc

SEQ ID NO: 2617109 - RNA, 23 nt, Escherichia coli CFT073
gccaguaauaacccgucagcaga

SEQ ID NO: 2617110 - RNA, 14 nt, Escherichia coli CFT073
gccaguaaugcgca

SEQ ID NO: 2617111 - RNA, 22 nt, Escherichia coli CFT073
gccaguacacguucuaccguau

SEQ ID NO: 2617112 - RNA, 15 nt, Escherichia coli CFT073
gccaguaccagcagc

SEQ ID NO: 2617113 - RNA, 18 nt, Escherichia coli CFT073
gccaguaccagcagcgcc

SEQ ID NO: 2617114 - RNA, 21 nt, Escherichia coli CFT073
gccaguaccaucaaucuucac

SEQ ID NO: 2617115 - RNA, 14 nt, Escherichia coli CFT073
gccaguaccgccgc

SEQ ID NO: 2617116 - RNA, 14 nt, Escherichia coli CFT073
gccaguacgcgccc

SEQ ID NO: 2617117 - RNA, 16 nt, Escherichia coli CFT073
gccaguacgcgcccgu

SEQ ID NO: 2617118 - RNA, 13 nt, Escherichia coli CFT073
gccaguacugcag

SEQ ID NO: 2617119 - RNA, 14 nt, Escherichia coli CFT073
gccaguagcaccuc

SEQ ID NO: 2617120 - RNA, 16 nt, Escherichia coli CFT073
gccagucacaaugggc

SEQ ID NO: 2617121 - RNA, 22 nt, Escherichia coli CFT073
gccagucacaaugggcgugaaa

SEQ ID NO: 2617122 - RNA, 15 nt, Escherichia coli CFT073
gccagucauaauuca

SEQ ID NO: 2617123 - RNA, 13 nt, Escherichia coli CFT073
gccaguccagguu

SEQ ID NO: 2617124 - RNA, 21 nt, Escherichia coli CFT073
gccagucccgcgacaaucgcc

SEQ ID NO: 2617125 - RNA, 23 nt, Escherichia coli CFT073
gccagucgcaaaucagcggcaga

SEQ ID NO: 2617126 - RNA, 17 nt, Escherichia coli CFT073
gccagucgcgaugcagc

SEQ ID NO: 2617127 - RNA, 23 nt, Escherichia coli CFT073
gccagucguaaugaaucagcaga

SEQ ID NO: 2617128 - RNA, 16 nt, Escherichia coli CFT073
gccagucguuguccgu

SEQ ID NO: 2617129 - RNA, 15 nt, Escherichia coli CFT073
gccagucuccaggca

SEQ ID NO: 2617130 - RNA, 16 nt, Escherichia coli CFT073
gccagucuuccgccgg

SEQ ID NO: 2617131 - RNA, 23 nt, Escherichia coli CFT073
gccagucuuccggcuguagcccu

SEQ ID NO: 2617132 - RNA, 19 nt, Escherichia coli CFT073
gccagugcacuaccguaaa

SEQ ID NO: 2617133 - RNA, 12 nt, Escherichia coli CFT073
gccagugccgga

SEQ ID NO: 2617134 - RNA, 19 nt, Escherichia coli CFT073
gccagugccugacgaaugg

SEQ ID NO: 2617135 - RNA, 16 nt, Escherichia coli CFT073
gccagugcgccccagg

SEQ ID NO: 2617136 - RNA, 22 nt, Escherichia coli CFT073
gccagugcuacccccagacgac

SEQ ID NO: 2617137 - RNA, 19 nt, Escherichia coli CFT073
gccaguguagcgauuucac

SEQ ID NO: 2617138 - RNA, 17 nt, Escherichia coli CFT073
gccagugucgcaucagg

SEQ ID NO: 2617139 - RNA, 23 nt, Escherichia coli CFT073
gccagugugaauaauugugcaau

SEQ ID NO: 2617140 - RNA, 18 nt, Escherichia coli CFT073
gccaguguuggcgucaga

SEQ ID NO: 2617141 - RNA, 18 nt, Escherichia coli CFT073
gccaguguuuaucaucuc

SEQ ID NO: 2617142 - RNA, 20 nt, Escherichia coli CFT073
gccaguguuucgacaauaau

SEQ ID NO: 2617143 - RNA, 21 nt, Escherichia coli CFT073
gccaguguuucgacaauaauc

SEQ ID NO: 2617144 - RNA, 16 nt, Escherichia coli CFT073
gccaguuaaccugcgc

SEQ ID NO: 2617145 - RNA, 14 nt, Escherichia coli CFT073
gccaguuauagcgc

SEQ ID NO: 2617146 - RNA, 16 nt, Escherichia coli CFT073
gccaguuaucgcaggu

SEQ ID NO: 2617147 - RNA, 14 nt, Escherichia coli CFT073
gccaguucaguaaa

SEQ ID NO: 2617148 - RNA, 15 nt, Escherichia coli CFT073
gccaguucauccaga

SEQ ID NO: 2617149 - RNA, 21 nt, Escherichia coli CFT073
gccaguucaugacgcaggcgu

SEQ ID NO: 2617150 - RNA, 14 nt, Escherichia coli CFT073
gccaguuccaggca

SEQ ID NO: 2617151 - RNA, 22 nt, Escherichia coli CFT073
gccaguucggaugugaaccuca

SEQ ID NO: 2617152 - RNA, 21 nt, Escherichia coli CFT073
gccaguucggcagccugcguc

SEQ ID NO: 2617153 - RNA, 23 nt, Escherichia coli CFT073
gccaguucguuauaguguuccug

SEQ ID NO: 2617154 - RNA, 19 nt, Escherichia coli CFT073
gccaguucguugaucagca

SEQ ID NO: 2617155 - RNA, 23 nt, Escherichia coli CFT073
gccaguucuuccgcagaguaaug

SEQ ID NO: 2617156 - RNA, 14 nt, Escherichia coli CFT073
gccaguucuucggu

SEQ ID NO: 2617157 - RNA, 17 nt, Escherichia coli CFT073
gccaguugacuuugaca

SEQ ID NO: 2617158 - RNA, 16 nt, Escherichia coli CFT073
gccaguugcgcaacgu

SEQ ID NO: 2617159 - RNA, 15 nt, Escherichia coli CFT073
gccaguugcgcuuca

SEQ ID NO: 2617160 - RNA, 18 nt, Escherichia coli CFT073
gccaguugcgcuucacga

SEQ ID NO: 2617161 - RNA, 16 nt, Escherichia coli CFT073
gccaguuggcguacca

SEQ ID NO: 2617162 - RNA, 23 nt, Escherichia coli CFT073
gccaguuguugauaagccccagu

SEQ ID NO: 2617163 - RNA, 20 nt, Escherichia coli CFT073
gccaguuuacccagugaauc

SEQ ID NO: 2617164 - RNA, 17 nt, Escherichia coli CFT073
gccaguuucgggaucau

SEQ ID NO: 2617165 - RNA, 16 nt, Escherichia coli CFT073
gccaguuucugcccaa

SEQ ID NO: 2617166 - RNA, 20 nt, Escherichia coli CFT073
gccaguuugcaggccaaaca

SEQ ID NO: 2617167 - RNA, 23 nt, Escherichia coli CFT073
gccaguuuggucuggcaaaaaua

SEQ ID NO: 2617168 - RNA, 20 nt, Escherichia coli CFT073
gccauaaaaacgauaaauaa

SEQ ID NO: 2617169 - RNA, 11 nt, Escherichia coli CFT073
gccauaaaagu

SEQ ID NO: 2617170 - RNA, 16 nt, Escherichia coli CFT073
gccauaaaaucacagg

SEQ ID NO: 2617171 - RNA, 19 nt, Escherichia coli CFT073
gccauaaacaccagcagca

SEQ ID NO: 2617172 - RNA, 20 nt, Escherichia coli CFT073
gccauaaacaccagcagcag

SEQ ID NO: 2617173 - RNA, 14 nt, Escherichia coli CFT073
gccauaaacagcag

SEQ ID NO: 2617174 - RNA, 16 nt, Escherichia coli CFT073
gccauaaacagcaggc

SEQ ID NO: 2617175 - RNA, 19 nt, Escherichia coli CFT073
gccauaaacagcaggcaga

SEQ ID NO: 2617176 - RNA, 23 nt, Escherichia coli CFT073
gccauaaccaugcagcgccgcgu

SEQ ID NO: 2617177 - RNA, 13 nt, Escherichia coli CFT073
gccauaaucagcg

SEQ ID NO: 2617178 - RNA, 19 nt, Escherichia coli CFT073
gccauaaucagcgcaccgu

SEQ ID NO: 2617179 - RNA, 15 nt, Escherichia coli CFT073
gccauaaucugcggg

SEQ ID NO: 2617180 - RNA, 18 nt, Escherichia coli CFT073
gccauacccgccagugcc

SEQ ID NO: 2617181 - RNA, 18 nt, Escherichia coli CFT073
gccauagaaaggaccaaa

SEQ ID NO: 2617182 - RNA, 23 nt, Escherichia coli CFT073
gccauagacgagugguucaccag

SEQ ID NO: 2617183 - RNA, 19 nt, Escherichia coli CFT073
gccauagcgggcaaucagc

SEQ ID NO: 2617184 - RNA, 19 nt, Escherichia coli CFT073
gccauauaacgggcuuccc

SEQ ID NO: 2617185 - RNA, 21 nt, Escherichia coli CFT073
gccauauaacguccaguugaa

SEQ ID NO: 2617186 - RNA, 22 nt, Escherichia coli CFT073
gccauauaacguccaguugaag

SEQ ID NO: 2617187 - RNA, 14 nt, Escherichia coli CFT073
gccauauaccgcgg

SEQ ID NO: 2617188 - RNA, 20 nt, Escherichia coli CFT073
gccauauaugccaucgccag

SEQ ID NO: 2617189 - RNA, 21 nt, Escherichia coli CFT073
gccauaucaccaccgucauca

SEQ ID NO: 2617190 - RNA, 12 nt, Escherichia coli CFT073
gccauauccagc

SEQ ID NO: 2617191 - RNA, 19 nt, Escherichia coli CFT073
gccauaucuauuacagcgc

SEQ ID NO: 2617192 - RNA, 20 nt, Escherichia coli CFT073
gccauaucuauuacagcgca

SEQ ID NO: 2617193 - RNA, 13 nt, Escherichia coli CFT073
gccauaugacacc

SEQ ID NO: 2617194 - RNA, 22 nt, Escherichia coli CFT073
gccaucaacaauucccagcuca

SEQ ID NO: 2617195 - RNA, 14 nt, Escherichia coli CFT073
gccaucaacacuuu

SEQ ID NO: 2617196 - RNA, 16 nt, Escherichia coli CFT073
gccaucaagcgaaaau

SEQ ID NO: 2617197 - RNA, 15 nt, Escherichia coli CFT073
gccaucaaugugcug

SEQ ID NO: 2617198 - RNA, 16 nt, Escherichia coli CFT073
gccaucaauuuccggc

SEQ ID NO: 2617199 - RNA, 13 nt, Escherichia coli CFT073
gccaucacacccu

SEQ ID NO: 2617200 - RNA, 13 nt, Escherichia coli CFT073
gccaucaccaacg

SEQ ID NO: 2617201 - RNA, 22 nt, Escherichia coli CFT073
gccaucaccaguugugaugcca

SEQ ID NO: 2617202 - RNA, 15 nt, Escherichia coli CFT073
gccaucacuauucag

SEQ ID NO: 2617203 - RNA, 22 nt, Escherichia coli CFT073
gccaucacuauucagaucuugc

SEQ ID NO: 2617204 - RNA, 13 nt, Escherichia coli CFT073
gccaucagcagcg

SEQ ID NO: 2617205 - RNA, 23 nt, Escherichia coli CFT073
gccaucagccacuucaaccagcg

SEQ ID NO: 2617206 - RNA, 16 nt, Escherichia coli CFT073
gccaucagcgccugau

SEQ ID NO: 2617207 - RNA, 18 nt, Escherichia coli CFT073
gccaucaguguuggcggc

SEQ ID NO: 2617208 - RNA, 17 nt, Escherichia coli CFT073
gccaucauacagccagc

SEQ ID NO: 2617209 - RNA, 18 nt, Escherichia coli CFT073
gccaucauccugaugguc

SEQ ID NO: 2617210 - RNA, 21 nt, Escherichia coli CFT073
gccaucauuucgauauguucc

SEQ ID NO: 2617211 - RNA, 12 nt, Escherichia coli CFT073
gccauccacauu

SEQ ID NO: 2617212 - RNA, 17 nt, Escherichia coli CFT073
gccauccaccagugacu

SEQ ID NO: 2617213 - RNA, 15 nt, Escherichia coli CFT073
gccauccagcucaag

SEQ ID NO: 2617214 - RNA, 12 nt, Escherichia coli CFT073
gccauccaguga

SEQ ID NO: 2617215 - RNA, 15 nt, Escherichia coli CFT073
gccauccaucaacgc

SEQ ID NO: 2617216 - RNA, 14 nt, Escherichia coli CFT073
gccaucccaggggc

SEQ ID NO: 2617217 - RNA, 14 nt, Escherichia coli CFT073
gccauccccacggc

SEQ ID NO: 2617218 - RNA, 22 nt, Escherichia coli CFT073
gccauccccgaagcuuguucag

SEQ ID NO: 2617219 - RNA, 20 nt, Escherichia coli CFT073
gccauccccgccgguggcau

SEQ ID NO: 2617220 - RNA, 13 nt, Escherichia coli CFT073
gccauccgcguga

SEQ ID NO: 2617221 - RNA, 18 nt, Escherichia coli CFT073
gccauccgcgugacgcug

SEQ ID NO: 2617222 - RNA, 21 nt, Escherichia coli CFT073
gccauccgcgugacgcuggca

SEQ ID NO: 2617223 - RNA, 23 nt, Escherichia coli CFT073
gccauccgcgugacgcuggcaga

SEQ ID NO: 2617224 - RNA, 11 nt, Escherichia coli CFT073
gccauccggcu

SEQ ID NO: 2617225 - RNA, 15 nt, Escherichia coli CFT073
gccauccggcugauu

SEQ ID NO: 2617226 - RNA, 23 nt, Escherichia coli CFT073
gccauccguuucagcuuauucau

SEQ ID NO: 2617227 - RNA, 15 nt, Escherichia coli CFT073
gccaucgccagcagc

SEQ ID NO: 2617228 - RNA, 14 nt, Escherichia coli CFT073
gccaucgccaggaa

SEQ ID NO: 2617229 - RNA, 16 nt, Escherichia coli CFT073
gccaucgcccgcaggu

SEQ ID NO: 2617230 - RNA, 18 nt, Escherichia coli CFT073
gccaucgccgccuggcua

SEQ ID NO: 2617231 - RNA, 15 nt, Escherichia coli CFT073
gccaucgccugcugg

SEQ ID NO: 2617232 - RNA, 21 nt, Escherichia coli CFT073
gccaucgcgguuaaucggcag

SEQ ID NO: 2617233 - RNA, 19 nt, Escherichia coli CFT073
gccaucggcagacagcgcc

SEQ ID NO: 2617234 - RNA, 21 nt, Escherichia coli CFT073
gccaucggcagacagcgccag

SEQ ID NO: 2617235 - RNA, 17 nt, Escherichia coli CFT073
gccaucguugaugcaua

SEQ ID NO: 2617236 - RNA, 17 nt, Escherichia coli CFT073
gccaucucacuuugaga

SEQ ID NO: 2617237 - RNA, 21 nt, Escherichia coli CFT073
gccaucucaguggugaguuua

SEQ ID NO: 2617238 - RNA, 22 nt, Escherichia coli CFT073
gccaucugaauaaacggcucau

SEQ ID NO: 2617239 - RNA, 20 nt, Escherichia coli CFT073
gccaucugccagcaagcgca

SEQ ID NO: 2617240 - RNA, 17 nt, Escherichia coli CFT073
gccaucuuccggguuau

SEQ ID NO: 2617241 - RNA, 18 nt, Escherichia coli CFT073
gccaucuuuuggcugaua

SEQ ID NO: 2617242 - RNA, 16 nt, Escherichia coli CFT073
gccaugaccaccgcag

SEQ ID NO: 2617243 - RNA, 17 nt, Escherichia coli CFT073
gccaugagacaaaacga

SEQ ID NO: 2617244 - RNA, 21 nt, Escherichia coli CFT073
gccaugauaagagagcaacag

SEQ ID NO: 2617245 - RNA, 19 nt, Escherichia coli CFT073
gccaugaucguuaaaucca

SEQ ID NO: 2617246 - RNA, 17 nt, Escherichia coli CFT073
gccaugauuaccagcau

SEQ ID NO: 2617247 - RNA, 15 nt, Escherichia coli CFT073
gccaugcacgcaaaa

SEQ ID NO: 2617248 - RNA, 22 nt, Escherichia coli CFT073
gccaugcauuuuuguccucacc

SEQ ID NO: 2617249 - RNA, 13 nt, Escherichia coli CFT073
gccaugccaacgc

SEQ ID NO: 2617250 - RNA, 13 nt, Escherichia coli CFT073
gccaugccacgcu

SEQ ID NO: 2617251 - RNA, 20 nt, Escherichia coli CFT073
gccaugccgaugccgacgau

SEQ ID NO: 2617252 - RNA, 19 nt, Escherichia coli CFT073
gccaugcgauggcggcagc

SEQ ID NO: 2617253 - RNA, 16 nt, Escherichia coli CFT073
gccaugcgguaacaga

SEQ ID NO: 2617254 - RNA, 14 nt, Escherichia coli CFT073
gccaugcugguuac

SEQ ID NO: 2617255 - RNA, 18 nt, Escherichia coli CFT073
gccauggcauccaagcug

SEQ ID NO: 2617256 - RNA, 21 nt, Escherichia coli CFT073
gccauggcugcgauaguggaa

SEQ ID NO: 2617257 - RNA, 14 nt, Escherichia coli CFT073
gccaugucugcaua

SEQ ID NO: 2617258 - RNA, 18 nt, Escherichia coli CFT073
gccaugugcuuuuccuca

SEQ ID NO: 2617259 - RNA, 22 nt, Escherichia coli CFT073
gccaugugcuuuuccucauuua

SEQ ID NO: 2617260 - RNA, 15 nt, Escherichia coli CFT073
gccauguuuuccuuu

SEQ ID NO: 2617261 - RNA, 12 nt, Escherichia coli CFT073
gccauuaaacaa

SEQ ID NO: 2617262 - RNA, 13 nt, Escherichia coli CFT073
gccauuaaacaac

SEQ ID NO: 2617263 - RNA, 13 nt, Escherichia coli CFT073
gccauuaaacgca

SEQ ID NO: 2617264 - RNA, 16 nt, Escherichia coli CFT073
gccauuaacuccacca

SEQ ID NO: 2617265 - RNA, 19 nt, Escherichia coli CFT073
gccauuaaugccgcaacuu

SEQ ID NO: 2617266 - RNA, 22 nt, Escherichia coli CFT073
gccauuaccgauaucaauaaca

SEQ ID NO: 2617267 - RNA, 14 nt, Escherichia coli CFT073
gccauuaucgauaa

SEQ ID NO: 2617268 - RNA, 20 nt, Escherichia coli CFT073
gccauuauuaccgaugaagu

SEQ ID NO: 2617269 - RNA, 19 nt, Escherichia coli CFT073
gccauucaguuugcauggg

SEQ ID NO: 2617270 - RNA, 13 nt, Escherichia coli CFT073
gccauuccagcca

SEQ ID NO: 2617271 - RNA, 17 nt, Escherichia coli CFT073
gccauuccagccagaaa

SEQ ID NO: 2617272 - RNA, 14 nt, Escherichia coli CFT073
gccauucuggcgca

SEQ ID NO: 2617273 - RNA, 22 nt, Escherichia coli CFT073
gccauucuugucagaugcggcg

SEQ ID NO: 2617274 - RNA, 15 nt, Escherichia coli CFT073
gccauugaauuaaaa

SEQ ID NO: 2617275 - RNA, 18 nt, Escherichia coli CFT073
gccauugacguucccuuc

SEQ ID NO: 2617276 - RNA, 16 nt, Escherichia coli CFT073
gccauugcccgaggau

SEQ ID NO: 2617277 - RNA, 13 nt, Escherichia coli CFT073
gccauugcuuuaa

SEQ ID NO: 2617278 - RNA, 23 nt, Escherichia coli CFT073
gccauuggcaggcucugacugau

SEQ ID NO: 2617279 - RNA, 16 nt, Escherichia coli CFT073
gccauuggccugaaua

SEQ ID NO: 2617280 - RNA, 20 nt, Escherichia coli CFT073
gccauugggaauuugcuccg

SEQ ID NO: 2617281 - RNA, 13 nt, Escherichia coli CFT073
gccauuuccagcg

SEQ ID NO: 2617282 - RNA, 20 nt, Escherichia coli CFT073
gccauuuccccaaucuucuc

SEQ ID NO: 2617283 - RNA, 17 nt, Escherichia coli CFT073
gccauuucguuagcaaa

SEQ ID NO: 2617284 - RNA, 14 nt, Escherichia coli CFT073
gccauuugaugaau

SEQ ID NO: 2617285 - RNA, 20 nt, Escherichia coli CFT073
gccauuuucauuuaagccac

SEQ ID NO: 2617286 - RNA, 17 nt, Escherichia coli CFT073
gccauuuugcaacgcuu

SEQ ID NO: 2617287 - RNA, 20 nt, Escherichia coli CFT073
gccauuuuucacugcggcaa

SEQ ID NO: 2617288 - RNA, 15 nt, Escherichia coli CFT073
gccauuuuucagacg

SEQ ID NO: 2617289 - RNA, 20 nt, Escherichia coli CFT073
gccauuuuuucgauaaucaa

SEQ ID NO: 2617290 - RNA, 21 nt, Escherichia coli CFT073
gccauuuuuucgauaaucaaa

SEQ ID NO: 2617291 - RNA, 20 nt, Escherichia coli CFT073
gccauuuuuuuacccagcgu

SEQ ID NO: 2617292 - RNA, 20 nt, Escherichia coli CFT073
gccauuuuuuuaugcuucag

SEQ ID NO: 2617293 - RNA, 12 nt, Escherichia coli CFT073
gcccaaacgccc

SEQ ID NO: 2617294 - RNA, 21 nt, Escherichia coli CFT073
gcccaaagagcaagaacccca

SEQ ID NO: 2617295 - RNA, 18 nt, Escherichia coli CFT073
gcccaaagccaaucugug

SEQ ID NO: 2617296 - RNA, 17 nt, Escherichia coli CFT073
gcccaaaguguaaaaaa

SEQ ID NO: 2617297 - RNA, 16 nt, Escherichia coli CFT073
gcccaacacuuccccg

SEQ ID NO: 2617298 - RNA, 23 nt, Escherichia coli CFT073
gcccaaccacggaguugaccagc

SEQ ID NO: 2617299 - RNA, 13 nt, Escherichia coli CFT073
gcccaaccagcag

SEQ ID NO: 2617300 - RNA, 15 nt, Escherichia coli CFT073
gcccaaccagcaggu

SEQ ID NO: 2617301 - RNA, 22 nt, Escherichia coli CFT073
gcccaauaaugaugagauccgc

SEQ ID NO: 2617302 - RNA, 14 nt, Escherichia coli CFT073
gcccaauacugcgc

SEQ ID NO: 2617303 - RNA, 22 nt, Escherichia coli CFT073
gcccaauauccauagugaagug

SEQ ID NO: 2617304 - RNA, 13 nt, Escherichia coli CFT073
gcccaaucaaacu

SEQ ID NO: 2617305 - RNA, 20 nt, Escherichia coli CFT073
gcccaaucaaacuuccggca

SEQ ID NO: 2617306 - RNA, 21 nt, Escherichia coli CFT073
gcccacaaucuuaggggacau

SEQ ID NO: 2617307 - RNA, 20 nt, Escherichia coli CFT073
gcccacaccgcccagcgagc

SEQ ID NO: 2617308 - RNA, 14 nt, Escherichia coli CFT073
gcccaccagccgca

SEQ ID NO: 2617309 - RNA, 15 nt, Escherichia coli CFT073
gcccaccauaaucag

SEQ ID NO: 2617310 - RNA, 21 nt, Escherichia coli CFT073
gcccaccccaauguuuuucuc

SEQ ID NO: 2617311 - RNA, 14 nt, Escherichia coli CFT073
gcccacgccagccc

SEQ ID NO: 2617312 - RNA, 15 nt, Escherichia coli CFT073
gcccacgguaaaaua

SEQ ID NO: 2617313 - RNA, 14 nt, Escherichia coli CFT073
gcccacuaccagcu

SEQ ID NO: 2617314 - RNA, 22 nt, Escherichia coli CFT073
gcccacuguuugaucugcugcc

SEQ ID NO: 2617315 - RNA, 15 nt, Escherichia coli CFT073
gcccagaaaccaguu

SEQ ID NO: 2617316 - RNA, 19 nt, Escherichia coli CFT073
gcccagaccgugcgcagca

SEQ ID NO: 2617317 - RNA, 20 nt, Escherichia coli CFT073
gcccagaguggcgauauucu

SEQ ID NO: 2617318 - RNA, 12 nt, Escherichia coli CFT073
gcccagaucacu

SEQ ID NO: 2617319 - RNA, 20 nt, Escherichia coli CFT073
gcccagccaucgacaccagc

SEQ ID NO: 2617320 - RNA, 22 nt, Escherichia coli CFT073
gcccagccgaagggaaagagcg

SEQ ID NO: 2617321 - RNA, 15 nt, Escherichia coli CFT073
gcccagccgugaaug

SEQ ID NO: 2617322 - RNA, 17 nt, Escherichia coli CFT073
gcccagccuuuccagca

SEQ ID NO: 2617323 - RNA, 19 nt, Escherichia coli CFT073
gcccagcgagcuggcggca

SEQ ID NO: 2617324 - RNA, 13 nt, Escherichia coli CFT073
gcccagcgccugg

SEQ ID NO: 2617325 - RNA, 21 nt, Escherichia coli CFT073
gcccagcuuaguaagcccagg

SEQ ID NO: 2617326 - RNA, 22 nt, Escherichia coli CFT073
gcccagcuuaguaagcccaggg

SEQ ID NO: 2617327 - RNA, 20 nt, Escherichia coli CFT073
gcccaggcgaccaggccggu

SEQ ID NO: 2617328 - RNA, 19 nt, Escherichia coli CFT073
gcccagggaaacagccacc

SEQ ID NO: 2617329 - RNA, 15 nt, Escherichia coli CFT073
gcccaggucucccag

SEQ ID NO: 2617330 - RNA, 16 nt, Escherichia coli CFT073
gcccaguaccgccagu

SEQ ID NO: 2617331 - RNA, 13 nt, Escherichia coli CFT073
gcccagucuuccg

SEQ ID NO: 2617332 - RNA, 15 nt, Escherichia coli CFT073
gcccagugccagcac

SEQ ID NO: 2617333 - RNA, 19 nt, Escherichia coli CFT073
gcccagugccagcaccacu

SEQ ID NO: 2617334 - RNA, 19 nt, Escherichia coli CFT073
gcccagugcugagaguaac

SEQ ID NO: 2617335 - RNA, 19 nt, Escherichia coli CFT073
gcccaguggaugcgccaua

SEQ ID NO: 2617336 - RNA, 15 nt, Escherichia coli CFT073
gcccaguucagcggc

SEQ ID NO: 2617337 - RNA, 18 nt, Escherichia coli CFT073
gcccaguuucgacaucac

SEQ ID NO: 2617338 - RNA, 19 nt, Escherichia coli CFT073
gcccaguuucgacaucaca

SEQ ID NO: 2617339 - RNA, 15 nt, Escherichia coli CFT073
gcccaguuucuucag

SEQ ID NO: 2617340 - RNA, 16 nt, Escherichia coli CFT073
gcccaguuuuucagga

SEQ ID NO: 2617341 - RNA, 20 nt, Escherichia coli CFT073
gcccauaaacaucgucagga

SEQ ID NO: 2617342 - RNA, 23 nt, Escherichia coli CFT073
gcccauaaacaucgucaggaaga

SEQ ID NO: 2617343 - RNA, 14 nt, Escherichia coli CFT073
gcccauaccacagc

SEQ ID NO: 2617344 - RNA, 19 nt, Escherichia coli CFT073
gcccauacucaucuuccau

SEQ ID NO: 2617345 - RNA, 17 nt, Escherichia coli CFT073
gcccauacuuaaugcca

SEQ ID NO: 2617346 - RNA, 17 nt, Escherichia coli CFT073
gcccaucaccgccaggc

SEQ ID NO: 2617347 - RNA, 21 nt, Escherichia coli CFT073
gcccaucaguguccagaugcu

SEQ ID NO: 2617348 - RNA, 22 nt, Escherichia coli CFT073
gcccaucaguguccagaugcug

SEQ ID NO: 2617349 - RNA, 15 nt, Escherichia coli CFT073
gcccaucaucuggcu

SEQ ID NO: 2617350 - RNA, 17 nt, Escherichia coli CFT073
gcccaucaucuggcugu

SEQ ID NO: 2617351 - RNA, 17 nt, Escherichia coli CFT073
gcccaucauugacagac

SEQ ID NO: 2617352 - RNA, 19 nt, Escherichia coli CFT073
gcccaucauugacagaccg

SEQ ID NO: 2617353 - RNA, 19 nt, Escherichia coli CFT073
gcccaucgauaugggcagc

SEQ ID NO: 2617354 - RNA, 18 nt, Escherichia coli CFT073
gcccaucgcgcccgccgc

SEQ ID NO: 2617355 - RNA, 20 nt, Escherichia coli CFT073
gcccaucgcgcccgccgcca

SEQ ID NO: 2617356 - RNA, 16 nt, Escherichia coli CFT073
gcccaugacaggcaga

SEQ ID NO: 2617357 - RNA, 17 nt, Escherichia coli CFT073
gcccaugacaggcagac

SEQ ID NO: 2617358 - RNA, 20 nt, Escherichia coli CFT073
gcccaugacaggcagacgau

SEQ ID NO: 2617359 - RNA, 17 nt, Escherichia coli CFT073
gcccaugacauccccau

SEQ ID NO: 2617360 - RNA, 17 nt, Escherichia coli CFT073
gcccaugccaauuaaau

SEQ ID NO: 2617361 - RNA, 19 nt, Escherichia coli CFT073
gcccaugcgggcaacuuuc

SEQ ID NO: 2617362 - RNA, 14 nt, Escherichia coli CFT073
gcccauucagcaug

SEQ ID NO: 2617363 - RNA, 21 nt, Escherichia coli CFT073
gcccauuccccagccgaucag

SEQ ID NO: 2617364 - RNA, 12 nt, Escherichia coli CFT073
gccccaacguau

SEQ ID NO: 2617365 - RNA, 22 nt, Escherichia coli CFT073
gccccaaugcguuccagcaugu

SEQ ID NO: 2617366 - RNA, 15 nt, Escherichia coli CFT073
gccccacaagcccgc

SEQ ID NO: 2617367 - RNA, 16 nt, Escherichia coli CFT073
gccccacagaguggug

SEQ ID NO: 2617368 - RNA, 16 nt, Escherichia coli CFT073
gccccaccagcaaaua

SEQ ID NO: 2617369 - RNA, 21 nt, Escherichia coli CFT073
gccccacuucuuccuauggcu

SEQ ID NO: 2617370 - RNA, 17 nt, Escherichia coli CFT073
gccccagaacucacgca

SEQ ID NO: 2617371 - RNA, 22 nt, Escherichia coli CFT073
gccccagaauaacgcggcagga

SEQ ID NO: 2617372 - RNA, 20 nt, Escherichia coli CFT073
gccccagacguuucgccagc

SEQ ID NO: 2617373 - RNA, 16 nt, Escherichia coli CFT073
gccccagauugccgau

SEQ ID NO: 2617374 - RNA, 14 nt, Escherichia coli CFT073
gccccagcguucgg

SEQ ID NO: 2617375 - RNA, 20 nt, Escherichia coli CFT073
gccccagcguucgguggugc

SEQ ID NO: 2617376 - RNA, 15 nt, Escherichia coli CFT073
gccccaggcauagaa

SEQ ID NO: 2617377 - RNA, 18 nt, Escherichia coli CFT073
gccccaggcauagaaaaa

SEQ ID NO: 2617378 - RNA, 12 nt, Escherichia coli CFT073
gccccaguuccg

SEQ ID NO: 2617379 - RNA, 20 nt, Escherichia coli CFT073
gccccaucgaaucaaacaug

SEQ ID NO: 2617380 - RNA, 23 nt, Escherichia coli CFT073
gccccauguugacuucaaucuga

SEQ ID NO: 2617381 - RNA, 23 nt, Escherichia coli CFT073
gccccauugcugaugcaccuuca

SEQ ID NO: 2617382 - RNA, 21 nt, Escherichia coli CFT073
gccccauuuugauguacucgc

SEQ ID NO: 2617383 - RNA, 17 nt, Escherichia coli CFT073
gcccccaggagcgcggc

SEQ ID NO: 2617384 - RNA, 14 nt, Escherichia coli CFT073
gcccccgccagcgc

SEQ ID NO: 2617385 - RNA, 19 nt, Escherichia coli CFT073
gcccccugaagcaguuuca

SEQ ID NO: 2617386 - RNA, 22 nt, Escherichia coli CFT073
gcccccugaagcaguuucacca

SEQ ID NO: 2617387 - RNA, 13 nt, Escherichia coli CFT073
gccccgcagccga

SEQ ID NO: 2617388 - RNA, 18 nt, Escherichia coli CFT073
gccccgccaacagugccg

SEQ ID NO: 2617389 - RNA, 17 nt, Escherichia coli CFT073
gccccgcgccagcgggc

SEQ ID NO: 2617390 - RNA, 20 nt, Escherichia coli CFT073
gccccgcgcggcgcaggcgc

SEQ ID NO: 2617391 - RNA, 21 nt, Escherichia coli CFT073
gccccgcgcggcgcaggcgcu

SEQ ID NO: 2617392 - RNA, 22 nt, Escherichia coli CFT073
gccccgcucacgcagcggcggc

SEQ ID NO: 2617393 - RNA, 12 nt, Escherichia coli CFT073
gccccggccagu

SEQ ID NO: 2617394 - RNA, 20 nt, Escherichia coli CFT073
gccccggcgaucccagagcg

SEQ ID NO: 2617395 - RNA, 19 nt, Escherichia coli CFT073
gccccggcugcgcgacggc

SEQ ID NO: 2617396 - RNA, 17 nt, Escherichia coli CFT073
gccccggguuuccugga

SEQ ID NO: 2617397 - RNA, 15 nt, Escherichia coli CFT073
gccccgguuucucuu

SEQ ID NO: 2617398 - RNA, 15 nt, Escherichia coli CFT073
gccccgugaugaacu

SEQ ID NO: 2617399 - RNA, 23 nt, Escherichia coli CFT073
gccccuaaauaaacaccagcagu

SEQ ID NO: 2617400 - RNA, 17 nt, Escherichia coli CFT073
gccccuccggagagggg

SEQ ID NO: 2617401 - RNA, 15 nt, Escherichia coli CFT073
gccccugaauaaucg

SEQ ID NO: 2617402 - RNA, 22 nt, Escherichia coli CFT073
gccccugagcgaauaccccagc

SEQ ID NO: 2617403 - RNA, 13 nt, Escherichia coli CFT073
gccccuggcgcag

SEQ ID NO: 2617404 - RNA, 18 nt, Escherichia coli CFT073
gccccuggucgcgcggca

SEQ ID NO: 2617405 - RNA, 21 nt, Escherichia coli CFT073
gccccugugccagcucgugca

SEQ ID NO: 2617406 - RNA, 14 nt, Escherichia coli CFT073
gcccgacaaagccc

SEQ ID NO: 2617407 - RNA, 24 nt, Escherichia coli CFT073
gcccgacaaagcccgaugcgcgac

SEQ ID NO: 2617408 - RNA, 20 nt, Escherichia coli CFT073
gcccgacaauaugcagcagu

SEQ ID NO: 2617409 - RNA, 19 nt, Escherichia coli CFT073
gcccgacgaggcgcuggcg

SEQ ID NO: 2617410 - RNA, 21 nt, Escherichia coli CFT073
gcccgacgauaccgccgcaca

SEQ ID NO: 2617411 - RNA, 17 nt, Escherichia coli CFT073
gcccgagccgguugccu

SEQ ID NO: 2617412 - RNA, 18 nt, Escherichia coli CFT073
gcccgauaagcuugcgca

SEQ ID NO: 2617413 - RNA, 20 nt, Escherichia coli CFT073
gcccgauggcaucaccaucg

SEQ ID NO: 2617414 - RNA, 20 nt, Escherichia coli CFT073
gcccgcaacuuuaccgcaau

SEQ ID NO: 2617415 - RNA, 19 nt, Escherichia coli CFT073
gcccgcaaucaacauaaug

SEQ ID NO: 2617416 - RNA, 14 nt, Escherichia coli CFT073
gcccgcacaaagca

SEQ ID NO: 2617417 - RNA, 19 nt, Escherichia coli CFT073
gcccgcagcguccagcgcc

SEQ ID NO: 2617418 - RNA, 19 nt, Escherichia coli CFT073
gcccgcauagcccagcgcc

SEQ ID NO: 2617419 - RNA, 22 nt, Escherichia coli CFT073
gcccgccacaauugcaguauga

SEQ ID NO: 2617420 - RNA, 15 nt, Escherichia coli CFT073
gcccgccagcaugcc

SEQ ID NO: 2617421 - RNA, 18 nt, Escherichia coli CFT073
gcccgccagugcaucagc

SEQ ID NO: 2617422 - RNA, 16 nt, Escherichia coli CFT073
gcccgccaucgcccau

SEQ ID NO: 2617423 - RNA, 22 nt, Escherichia coli CFT073
gcccgccgagaaauaucagcag

SEQ ID NO: 2617424 - RNA, 13 nt, Escherichia coli CFT073
gcccgccgccauc

SEQ ID NO: 2617425 - RNA, 13 nt, Escherichia coli CFT073
gcccgccgccauu

SEQ ID NO: 2617426 - RNA, 12 nt, Escherichia coli CFT073
gcccgcgaagcu

SEQ ID NO: 2617427 - RNA, 20 nt, Escherichia coli CFT073
gcccgcgauuuguuucaauu

SEQ ID NO: 2617428 - RNA, 14 nt, Escherichia coli CFT073
gcccgcgcccaggc

SEQ ID NO: 2617429 - RNA, 18 nt, Escherichia coli CFT073
gcccgcgccucaacgccu

SEQ ID NO: 2617430 - RNA, 13 nt, Escherichia coli CFT073
gcccgcgcguuaa

SEQ ID NO: 2617431 - RNA, 16 nt, Escherichia coli CFT073
gcccgcguagagaaaa

SEQ ID NO: 2617432 - RNA, 20 nt, Escherichia coli CFT073
gcccgcgucguucaucgcaa

SEQ ID NO: 2617433 - RNA, 12 nt, Escherichia coli CFT073
gcccgcuccagc

SEQ ID NO: 2617434 - RNA, 23 nt, Escherichia coli CFT073
gcccgcuucaaacgcugacggug

SEQ ID NO: 2617435 - RNA, 15 nt, Escherichia coli CFT073
gcccgcuucaucgug

SEQ ID NO: 2617436 - RNA, 19 nt, Escherichia coli CFT073
gcccgcuugaaagcgggcu

SEQ ID NO: 2617437 - RNA, 15 nt, Escherichia coli CFT073
gcccggacuagcgcu

SEQ ID NO: 2617438 - RNA, 17 nt, Escherichia coli CFT073
gcccggagccaucccug

SEQ ID NO: 2617439 - RNA, 13 nt, Escherichia coli CFT073
gcccggaggaugc

SEQ ID NO: 2617440 - RNA, 16 nt, Escherichia coli CFT073
gcccggauuaagucua

SEQ ID NO: 2617441 - RNA, 14 nt, Escherichia coli CFT073
gcccggcaaaacgu

SEQ ID NO: 2617442 - RNA, 15 nt, Escherichia coli CFT073
gcccggcaacguugc

SEQ ID NO: 2617443 - RNA, 18 nt, Escherichia coli CFT073
gcccggcaagugucgccu

SEQ ID NO: 2617444 - RNA, 21 nt, Escherichia coli CFT073
gcccggcaauacacgccgggc

SEQ ID NO: 2617445 - RNA, 23 nt, Escherichia coli CFT073
gcccggcaauacacgccgggcag

SEQ ID NO: 2617446 - RNA, 15 nt, Escherichia coli CFT073
gcccggcaccagcac

SEQ ID NO: 2617447 - RNA, 19 nt, Escherichia coli CFT073
gcccggcaugacgccgggc

SEQ ID NO: 2617448 - RNA, 16 nt, Escherichia coli CFT073
gcccggcauucaccuc

SEQ ID NO: 2617449 - RNA, 17 nt, Escherichia coli CFT073
gcccggcguggugcagc

SEQ ID NO: 2617450 - RNA, 20 nt, Escherichia coli CFT073
gcccggcguggugcagccgc

SEQ ID NO: 2617451 - RNA, 15 nt, Escherichia coli CFT073
gcccgguauccauca

SEQ ID NO: 2617452 - RNA, 15 nt, Escherichia coli CFT073
gcccggugccgcguu

SEQ ID NO: 2617453 - RNA, 17 nt, Escherichia coli CFT073
gcccgguugcuuuucac

SEQ ID NO: 2617454 - RNA, 19 nt, Escherichia coli CFT073
gcccgguuucgccgcggcg

SEQ ID NO: 2617455 - RNA, 17 nt, Escherichia coli CFT073
gcccgguuuguuaucaa

SEQ ID NO: 2617456 - RNA, 17 nt, Escherichia coli CFT073
gcccguagcuucccaua

SEQ ID NO: 2617457 - RNA, 22 nt, Escherichia coli CFT073
gcccguagcuucccauauguuc

SEQ ID NO: 2617458 - RNA, 13 nt, Escherichia coli CFT073
gcccgucauaccg

SEQ ID NO: 2617459 - RNA, 14 nt, Escherichia coli CFT073
gcccgugacgggug

SEQ ID NO: 2617460 - RNA, 12 nt, Escherichia coli CFT073
gcccguguuucu

SEQ ID NO: 2617461 - RNA, 15 nt, Escherichia coli CFT073
gcccguuaagcguuc

SEQ ID NO: 2617462 - RNA, 22 nt, Escherichia coli CFT073
gcccguuucucuuaaaugcaca

SEQ ID NO: 2617463 - RNA, 21 nt, Escherichia coli CFT073
gcccguuuucaccuuacuucc

SEQ ID NO: 2617464 - RNA, 18 nt, Escherichia coli CFT073
gcccguuuucuccagcgc

SEQ ID NO: 2617465 - RNA, 18 nt, Escherichia coli CFT073
gcccuauaaucaccguga

SEQ ID NO: 2617466 - RNA, 13 nt, Escherichia coli CFT073
gcccuaucaucgc

SEQ ID NO: 2617467 - RNA, 12 nt, Escherichia coli CFT073
gcccucacccgu

SEQ ID NO: 2617468 - RNA, 22 nt, Escherichia coli CFT073
gcccucagccuucuguaaccuu

SEQ ID NO: 2617469 - RNA, 21 nt, Escherichia coli CFT073
gcccugaaccaucgacgucca

SEQ ID NO: 2617470 - RNA, 14 nt, Escherichia coli CFT073
gcccugaccgucaa

SEQ ID NO: 2617471 - RNA, 17 nt, Escherichia coli CFT073
gcccugaugcaucaaca

SEQ ID NO: 2617472 - RNA, 16 nt, Escherichia coli CFT073
gcccugauggcgcgcc

SEQ ID NO: 2617473 - RNA, 12 nt, Escherichia coli CFT073
gcccugcaggga

SEQ ID NO: 2617474 - RNA, 14 nt, Escherichia coli CFT073
gcccugccagcgau

SEQ ID NO: 2617475 - RNA, 15 nt, Escherichia coli CFT073
gcccugccagcgaua

SEQ ID NO: 2617476 - RNA, 12 nt, Escherichia coli CFT073
gcccugcgucgc

SEQ ID NO: 2617477 - RNA, 13 nt, Escherichia coli CFT073
gcccugcuccagc

SEQ ID NO: 2617478 - RNA, 19 nt, Escherichia coli CFT073
gcccugcuccagcagcuca

SEQ ID NO: 2617479 - RNA, 15 nt, Escherichia coli CFT073
gcccugcucgucggc

SEQ ID NO: 2617480 - RNA, 17 nt, Escherichia coli CFT073
gcccuggacaacauucc

SEQ ID NO: 2617481 - RNA, 19 nt, Escherichia coli CFT073
gcccuggacaacauuccug

SEQ ID NO: 2617482 - RNA, 17 nt, Escherichia coli CFT073
gcccuggaucguggcug

SEQ ID NO: 2617483 - RNA, 22 nt, Escherichia coli CFT073
gcccuggcccauugccagcgcu

SEQ ID NO: 2617484 - RNA, 23 nt, Escherichia coli CFT073
gcccugggcuucauccagcagcg

SEQ ID NO: 2617485 - RNA, 21 nt, Escherichia coli CFT073
gcccugucaccgggcaaacgc

SEQ ID NO: 2617486 - RNA, 22 nt, Escherichia coli CFT073
gcccugucaccgggcaaacgcu

SEQ ID NO: 2617487 - RNA, 16 nt, Escherichia coli CFT073
gcccuuaccauuccca

SEQ ID NO: 2617488 - RNA, 23 nt, Escherichia coli CFT073
gcccuuccauacgaauugccgcg

SEQ ID NO: 2617489 - RNA, 16 nt, Escherichia coli CFT073
gcccuugcgcaaugag

SEQ ID NO: 2617490 - RNA, 20 nt, Escherichia coli CFT073
gcccuuucgacgcgugcaga

SEQ ID NO: 2617491 - RNA, 20 nt, Escherichia coli CFT073
gcccuuugcuggcaugaaug

SEQ ID NO: 2617492 - RNA, 21 nt, Escherichia coli CFT073
gcccuuuuuuugucuguuugc

SEQ ID NO: 2617493 - RNA, 18 nt, Escherichia coli CFT073
gccgaaacgcaguuuaau

SEQ ID NO: 2617494 - RNA, 15 nt, Escherichia coli CFT073
gccgaaacucuccca

SEQ ID NO: 2617495 - RNA, 20 nt, Escherichia coli CFT073
gccgaaacuugguuacgcac

SEQ ID NO: 2617496 - RNA, 12 nt, Escherichia coli CFT073
gccgaaaucaag

SEQ ID NO: 2617497 - RNA, 12 nt, Escherichia coli CFT073
gccgaacagguu

SEQ ID NO: 2617498 - RNA, 19 nt, Escherichia coli CFT073
gccgaaccagugcuccacc

SEQ ID NO: 2617499 - RNA, 20 nt, Escherichia coli CFT073
gccgaagaacauaaacagcg

SEQ ID NO: 2617500 - RNA, 14 nt, Escherichia coli CFT073
gccgaagcagcugc

SEQ ID NO: 2617501 - RNA, 17 nt, Escherichia coli CFT073
gcaaaucggcgugguaa

SEQ ID NO: 2617502 - RNA, 17 nt, Escherichia coli CFT073
gcaaaucggucggugca

SEQ ID NO: 2617503 - RNA, 22 nt, Escherichia coli CFT073
gcaaaucucacuacaacaaccu

SEQ ID NO: 2617504 - RNA, 13 nt, Escherichia coli CFT073
gcaaaugacccau

SEQ ID NO: 2617505 - RNA, 15 nt, Escherichia coli CFT073
gcaaaugacgaugca

SEQ ID NO: 2617506 - RNA, 22 nt, Escherichia coli CFT073
gcaaauuaauuacacaaugcaa

SEQ ID NO: 2617507 - RNA, 20 nt, Escherichia coli CFT073
gcaaauuauuaauuaaacaa

SEQ ID NO: 2617508 - RNA, 22 nt, Escherichia coli CFT073
gcaaauuauuaauuaaacaaau

SEQ ID NO: 2617509 - RNA, 19 nt, Escherichia coli CFT073
gcaaauugcggguaggcac

SEQ ID NO: 2617510 - RNA, 15 nt, Escherichia coli CFT073
gcaaauuuauuaucu

SEQ ID NO: 2617511 - RNA, 15 nt, Escherichia coli CFT073
gcaaauuucgucgua

SEQ ID NO: 2617512 - RNA, 18 nt, Escherichia coli CFT073
gcaaauuuuccccagaug

SEQ ID NO: 2617513 - RNA, 15 nt, Escherichia coli CFT073
gcaacaaaaaaacca

SEQ ID NO: 2617514 - RNA, 22 nt, Escherichia coli CFT073
gcaacaaaaaacccaucaaccu

SEQ ID NO: 2617515 - RNA, 15 nt, Escherichia coli CFT073
gcaacaacaacacgc

SEQ ID NO: 2617516 - RNA, 13 nt, Escherichia coli CFT073
gcaacaacaccag

SEQ ID NO: 2617517 - RNA, 16 nt, Escherichia coli CFT073
gcaacaaccaccacac

SEQ ID NO: 2617518 - RNA, 21 nt, Escherichia coli CFT073
gcaacaaccaccacaccugcc

SEQ ID NO: 2617519 - RNA, 21 nt, Escherichia coli CFT073
gcaacaaggcuacgccacagc

SEQ ID NO: 2617520 - RNA, 21 nt, Escherichia coli CFT073
gcaacaaguucgaaccaacaa

SEQ ID NO: 2617521 - RNA, 22 nt, Escherichia coli CFT073
gcaacaauaacccccugcccca

SEQ ID NO: 2617522 - RNA, 23 nt, Escherichia coli CFT073
gcaacaauuuccgcagcuccagc

SEQ ID NO: 2617523 - RNA, 15 nt, Escherichia coli CFT073
gcaacaauuugcggu

SEQ ID NO: 2617524 - RNA, 12 nt, Escherichia coli CFT073
gcaacacauuac

SEQ ID NO: 2617525 - RNA, 20 nt, Escherichia coli CFT073
gcaacaccgcuuuaaucacc

SEQ ID NO: 2617526 - RNA, 13 nt, Escherichia coli CFT073
gcaacacgccagc

SEQ ID NO: 2617527 - RNA, 15 nt, Escherichia coli CFT073
gcaacacguugccau

SEQ ID NO: 2617528 - RNA, 16 nt, Escherichia coli CFT073
gcaacacuuuaucugc

SEQ ID NO: 2617529 - RNA, 20 nt, Escherichia coli CFT073
gcaacagaaacgccauccag

SEQ ID NO: 2617530 - RNA, 22 nt, Escherichia coli CFT073
gcaacagaaacgccauccagcc

SEQ ID NO: 2617531 - RNA, 17 nt, Escherichia coli CFT073
gcaacagaacgcgccuu

SEQ ID NO: 2617532 - RNA, 12 nt, Escherichia coli CFT073
gcaacagcagcc

SEQ ID NO: 2617533 - RNA, 13 nt, Escherichia coli CFT073
gcaacagcgcggu

SEQ ID NO: 2617534 - RNA, 16 nt, Escherichia coli CFT073
gcaacagcgcgucagc

SEQ ID NO: 2617535 - RNA, 16 nt, Escherichia coli CFT073
gcaacagguaacccag

SEQ ID NO: 2617536 - RNA, 17 nt, Escherichia coli CFT073
gcaacagguuacgcugg

SEQ ID NO: 2617537 - RNA, 13 nt, Escherichia coli CFT073
gcaacauauuccg

SEQ ID NO: 2617538 - RNA, 20 nt, Escherichia coli CFT073
gcaacaucaaauacagcuua

SEQ ID NO: 2617539 - RNA, 23 nt, Escherichia coli CFT073
gcaacaucaaaucacagcaccuu

SEQ ID NO: 2617540 - RNA, 13 nt, Escherichia coli CFT073
gcaacaucaacag

SEQ ID NO: 2617541 - RNA, 16 nt, Escherichia coli CFT073
gcaacaucaacagacc

SEQ ID NO: 2617542 - RNA, 12 nt, Escherichia coli CFT073
gcaacaucacgc

SEQ ID NO: 2617543 - RNA, 15 nt, Escherichia coli CFT073
gcaacaucaucacgc

SEQ ID NO: 2617544 - RNA, 22 nt, Escherichia coli CFT073
gcaacaugcggugauuuugccu

SEQ ID NO: 2617545 - RNA, 16 nt, Escherichia coli CFT073
gcaacauggcgcggca

SEQ ID NO: 2617546 - RNA, 16 nt, Escherichia coli CFT073
gcaacaugucagcaau

SEQ ID NO: 2617547 - RNA, 19 nt, Escherichia coli CFT073
gcaacauuaucugaugcgc

SEQ ID NO: 2617548 - RNA, 16 nt, Escherichia coli CFT073
gcaaccacaaccucag

SEQ ID NO: 2617549 - RNA, 19 nt, Escherichia coli CFT073
gcaaccacacccacaucaa

SEQ ID NO: 2617550 - RNA, 21 nt, Escherichia coli CFT073
gcaaccaccugaagaaaaucc

SEQ ID NO: 2617551 - RNA, 17 nt, Escherichia coli CFT073
gcaaccacuugcagcuc

SEQ ID NO: 2617552 - RNA, 23 nt, Escherichia coli CFT073
gcaaccagagccggugccauuuc

SEQ ID NO: 2617553 - RNA, 14 nt, Escherichia coli CFT073
gcaaccagcacgcc

SEQ ID NO: 2617554 - RNA, 16 nt, Escherichia coli CFT073
gcaaccagcagcauca

SEQ ID NO: 2617555 - RNA, 11 nt, Escherichia coli CFT073
gcaaccaggua

SEQ ID NO: 2617556 - RNA, 13 nt, Escherichia coli CFT073
gcaaccaucagua

SEQ ID NO: 2617557 - RNA, 17 nt, Escherichia coli CFT073
gcaacccagaagaaagc

SEQ ID NO: 2617558 - RNA, 13 nt, Escherichia coli CFT073
gcaacccccacac

SEQ ID NO: 2617559 - RNA, 23 nt, Escherichia coli CFT073
gcaaccgacgacgaccagcggca

SEQ ID NO: 2617560 - RNA, 14 nt, Escherichia coli CFT073
gcaaccgagcgccc

SEQ ID NO: 2617561 - RNA, 17 nt, Escherichia coli CFT073
gcaaccgccaacagcag

SEQ ID NO: 2617562 - RNA, 21 nt, Escherichia coli CFT073
gcaaccgcgccaagccugaug

SEQ ID NO: 2617563 - RNA, 14 nt, Escherichia coli CFT073
gcaaccgcuggcca

SEQ ID NO: 2617564 - RNA, 21 nt, Escherichia coli CFT073
gcaaccggaauguuccauacc

SEQ ID NO: 2617565 - RNA, 22 nt, Escherichia coli CFT073
gcaaccggggcauucaugaaca

SEQ ID NO: 2617566 - RNA, 14 nt, Escherichia coli CFT073
gcaaccuucgccag

SEQ ID NO: 2617567 - RNA, 18 nt, Escherichia coli CFT073
gcaaccuugcugcgggcg

SEQ ID NO: 2617568 - RNA, 19 nt, Escherichia coli CFT073
gcaacgaaauagccaggca

SEQ ID NO: 2617569 - RNA, 15 nt, Escherichia coli CFT073
gcaacgacagaacgc

SEQ ID NO: 2617570 - RNA, 20 nt, Escherichia coli CFT073
gcaacgacgguaaaccacgc

SEQ ID NO: 2617571 - RNA, 23 nt, Escherichia coli CFT073
gcaacgacgguaaaccacgccag

SEQ ID NO: 2617572 - RNA, 15 nt, Escherichia coli CFT073
gcaacgacuacgcca

SEQ ID NO: 2617573 - RNA, 17 nt, Escherichia coli CFT073
gcaacgauaacaaucac

SEQ ID NO: 2617574 - RNA, 19 nt, Escherichia coli CFT073
gcaacgauaacaaucacca

SEQ ID NO: 2617575 - RNA, 15 nt, Escherichia coli CFT073
gcaacgcaaacugcu

SEQ ID NO: 2617576 - RNA, 13 nt, Escherichia coli CFT073
gcaacgcaucaaa

SEQ ID NO: 2617577 - RNA, 13 nt, Escherichia coli CFT073
gcaacgccagcga

SEQ ID NO: 2617578 - RNA, 14 nt, Escherichia coli CFT073
gcaacgccagcgaa

SEQ ID NO: 2617579 - RNA, 21 nt, Escherichia coli CFT073
gcaacgccagcgaagccagcu

SEQ ID NO: 2617580 - RNA, 23 nt, Escherichia coli CFT073
gcaacgccuaaacugaucgacag

SEQ ID NO: 2617581 - RNA, 23 nt, Escherichia coli CFT073
gcaacgccuuugucgggcaggcu

SEQ ID NO: 2617582 - RNA, 12 nt, Escherichia coli CFT073
gcaacgcgcuuu

SEQ ID NO: 2617583 - RNA, 13 nt, Escherichia coli CFT073
gcaacgcugauuu

SEQ ID NO: 2617584 - RNA, 14 nt, Escherichia coli CFT073
gcaacggaaaagca

SEQ ID NO: 2617585 - RNA, 16 nt, Escherichia coli CFT073
gcaacggccaaaagca

SEQ ID NO: 2617586 - RNA, 12 nt, Escherichia coli CFT073
gcaacgucaguc

SEQ ID NO: 2617587 - RNA, 17 nt, Escherichia coli CFT073
gcaacgucagucccaac

SEQ ID NO: 2617588 - RNA, 16 nt, Escherichia coli CFT073
gcaacgucagugacug

SEQ ID NO: 2617589 - RNA, 15 nt, Escherichia coli CFT073
gcaacgucuucccga

SEQ ID NO: 2617590 - RNA, 19 nt, Escherichia coli CFT073
gcaacgugcuucgcgcugu

SEQ ID NO: 2617591 - RNA, 18 nt, Escherichia coli CFT073
gcaacgugguuugcggca

SEQ ID NO: 2617592 - RNA, 14 nt, Escherichia coli CFT073
gcaacguuccagca

SEQ ID NO: 2617593 - RNA, 17 nt, Escherichia coli CFT073
gcaacuacagcauuuug

SEQ ID NO: 2617594 - RNA, 19 nt, Escherichia coli CFT073
gcaacucaccuuuaaacag

SEQ ID NO: 2617595 - RNA, 23 nt, Escherichia coli CFT073
gcaacucauaagguguaccggua

SEQ ID NO: 2617596 - RNA, 17 nt, Escherichia coli CFT073
gcaacuccaccagcacc

SEQ ID NO: 2617597 - RNA, 20 nt, Escherichia coli CFT073
gcaacuccaccagcaccagc

SEQ ID NO: 2617598 - RNA, 13 nt, Escherichia coli CFT073
gcaacuccagcuu

SEQ ID NO: 2617599 - RNA, 16 nt, Escherichia coli CFT073
gcaacugauauuuaaa

SEQ ID NO: 2617600 - RNA, 16 nt, Escherichia coli CFT073
gcaacugccaguaaag

SEQ ID NO: 2617601 - RNA, 15 nt, Escherichia coli CFT073
gcaacugcccaggca

SEQ ID NO: 2617602 - RNA, 17 nt, Escherichia coli CFT073
gcaacugcgccgcgagc

SEQ ID NO: 2617603 - RNA, 18 nt, Escherichia coli CFT073
gcaacugcgccgcgagca

SEQ ID NO: 2617604 - RNA, 16 nt, Escherichia coli CFT073
gcaacuggaaaugauc

SEQ ID NO: 2617605 - RNA, 13 nt, Escherichia coli CFT073
gcaacuggcugcc

SEQ ID NO: 2617606 - RNA, 18 nt, Escherichia coli CFT073
gcaacuggcuugccagca

SEQ ID NO: 2617607 - RNA, 17 nt, Escherichia coli CFT073
gcaacugucccauucca

SEQ ID NO: 2617608 - RNA, 21 nt, Escherichia coli CFT073
gcaacugucccauuccagcca

SEQ ID NO: 2617609 - RNA, 17 nt, Escherichia coli CFT073
gcaacuucggccagcgu

SEQ ID NO: 2617610 - RNA, 20 nt, Escherichia coli CFT073
gcaaucgaccaggccaucag

SEQ ID NO: 2617611 - RNA, 22 nt, Escherichia coli CFT073
gcaaucgaccaggccaucagca

SEQ ID NO: 2617612 - RNA, 23 nt, Escherichia coli CFT073
gcaaucgaccaggccaucagcag

SEQ ID NO: 2617613 - RNA, 17 nt, Escherichia coli CFT073
gcaaucgauuugaaucg

SEQ ID NO: 2617614 - RNA, 11 nt, Escherichia coli CFT073
gcaaucgccag

SEQ ID NO: 2617615 - RNA, 20 nt, Escherichia coli CFT073
gcaaucgccagacucaccag

SEQ ID NO: 2617616 - RNA, 17 nt, Escherichia coli CFT073
gcaaucgccagcggcag

SEQ ID NO: 2617617 - RNA, 18 nt, Escherichia coli CFT073
gcaaucgccagcggcagc

SEQ ID NO: 2617618 - RNA, 13 nt, Escherichia coli CFT073
gcaaucgccucca

SEQ ID NO: 2617619 - RNA, 21 nt, Escherichia coli CFT073
gcaaucgcgccagaacacgcu

SEQ ID NO: 2617620 - RNA, 15 nt, Escherichia coli CFT073
gcaaucgcggcagcg

SEQ ID NO: 2617621 - RNA, 17 nt, Escherichia coli CFT073
gcaaucgcugcuaauuu

SEQ ID NO: 2617622 - RNA, 20 nt, Escherichia coli CFT073
gcaaucgcuuugacuaaaga

SEQ ID NO: 2617623 - RNA, 21 nt, Escherichia coli CFT073
gcaaucgggaucccuuuguaa

SEQ ID NO: 2617624 - RNA, 22 nt, Escherichia coli CFT073
gcaaucuccuguugugaugcaa

SEQ ID NO: 2617625 - RNA, 17 nt, Escherichia coli CFT073
gcaaucucuucaagcug

SEQ ID NO: 2617626 - RNA, 15 nt, Escherichia coli CFT073
gcaaucugcuggcaa

SEQ ID NO: 2617627 - RNA, 12 nt, Escherichia coli CFT073
gcaaucugcuuc

SEQ ID NO: 2617628 - RNA, 18 nt, Escherichia coli CFT073
gcaaucugcuucuuacca

SEQ ID NO: 2617629 - RNA, 23 nt, Escherichia coli CFT073
gcaaucugcuucuuaccaccuuc

SEQ ID NO: 2617630 - RNA, 18 nt, Escherichia coli CFT073
gcaaucuuccucgccagc

SEQ ID NO: 2617631 - RNA, 15 nt, Escherichia coli CFT073
gcaaugaaacucaag

SEQ ID NO: 2617632 - RNA, 22 nt, Escherichia coli CFT073
gcaaugacauacagcaccgccc

SEQ ID NO: 2617633 - RNA, 22 nt, Escherichia coli CFT073
gcaaugagacgguuaaaaacag

SEQ ID NO: 2617634 - RNA, 23 nt, Escherichia coli CFT073
gcaaugagacgguuaaaaacagc

SEQ ID NO: 2617635 - RNA, 17 nt, Escherichia coli CFT073
gcaaugauauuaauguu

SEQ ID NO: 2617636 - RNA, 14 nt, Escherichia coli CFT073
gcaaugaucucaau

SEQ ID NO: 2617637 - RNA, 14 nt, Escherichia coli CFT073
gcaaugcaaucaaa

SEQ ID NO: 2617638 - RNA, 12 nt, Escherichia coli CFT073
gcaaugccagcg

SEQ ID NO: 2617639 - RNA, 16 nt, Escherichia coli CFT073
gcaaugccaucaccaa

SEQ ID NO: 2617640 - RNA, 17 nt, Escherichia coli CFT073
gcaaugccaucaccaac

SEQ ID NO: 2617641 - RNA, 18 nt, Escherichia coli CFT073
gcaaugccaucaccaacg

SEQ ID NO: 2617642 - RNA, 16 nt, Escherichia coli CFT073
gcaaugccauccagcu

SEQ ID NO: 2617643 - RNA, 17 nt, Escherichia coli CFT073
gcaaugccauccagcuu

SEQ ID NO: 2617644 - RNA, 15 nt, Escherichia coli CFT073
gcaaugcccgcagua

SEQ ID NO: 2617645 - RNA, 16 nt, Escherichia coli CFT073
gcaaugcguuccagca

SEQ ID NO: 2617646 - RNA, 23 nt, Escherichia coli CFT073
gcaaugcguuuggagccgcuggc

SEQ ID NO: 2617647 - RNA, 14 nt, Escherichia coli CFT073
gcaauggacaccag

SEQ ID NO: 2617648 - RNA, 16 nt, Escherichia coli CFT073
gcaauggaccagaacg

SEQ ID NO: 2617649 - RNA, 20 nt, Escherichia coli CFT073
gcaauggccguuccggcaac

SEQ ID NO: 2617650 - RNA, 18 nt, Escherichia coli CFT073
gcaauggucccuugcugg

SEQ ID NO: 2617651 - RNA, 22 nt, Escherichia coli CFT073
gcaauggucgcgcucaucaggu

SEQ ID NO: 2617652 - RNA, 20 nt, Escherichia coli CFT073
gcaauggucuugacauccag

SEQ ID NO: 2617653 - RNA, 23 nt, Escherichia coli CFT073
gcaauggucuugacauccagcgu

SEQ ID NO: 2617654 - RNA, 21 nt, Escherichia coli CFT073
gcaaugguguccaaaugcagc

SEQ ID NO: 2617655 - RNA, 19 nt, Escherichia coli CFT073
gcaaugugcucuaacccuu

SEQ ID NO: 2617656 - RNA, 15 nt, Escherichia coli CFT073
gcaauguuaccgauc

SEQ ID NO: 2617657 - RNA, 20 nt, Escherichia coli CFT073
gcaauguugcuggcgagugc

SEQ ID NO: 2617658 - RNA, 22 nt, Escherichia coli CFT073
gcaauguuuuucucugccgccg

SEQ ID NO: 2617659 - RNA, 13 nt, Escherichia coli CFT073
gcaauuaaaaauu

SEQ ID NO: 2617660 - RNA, 13 nt, Escherichia coli CFT073
gcaauucaauuaa

SEQ ID NO: 2617661 - RNA, 16 nt, Escherichia coli CFT073
gcaauuccagcgccag

SEQ ID NO: 2617662 - RNA, 17 nt, Escherichia coli CFT073
gcaauuccagcgccagu

SEQ ID NO: 2617663 - RNA, 22 nt, Escherichia coli CFT073
gcaauucgcccuucggcaucac

SEQ ID NO: 2617664 - RNA, 12 nt, Escherichia coli CFT073
gcaauucuucau

SEQ ID NO: 2617665 - RNA, 17 nt, Escherichia coli CFT073
gcaauucuucauuccag

SEQ ID NO: 2617666 - RNA, 20 nt, Escherichia coli CFT073
gcaauucuucauuccaguca

SEQ ID NO: 2617667 - RNA, 21 nt, Escherichia coli CFT073
gcaauucuuuccguuuucacc

SEQ ID NO: 2617668 - RNA, 17 nt, Escherichia coli CFT073
gcaauugccagacaaca

SEQ ID NO: 2617669 - RNA, 17 nt, Escherichia coli CFT073
gcaauugccauaaaaac

SEQ ID NO: 2617670 - RNA, 14 nt, Escherichia coli CFT073
gcaauugcggcagg

SEQ ID NO: 2617671 - RNA, 19 nt, Escherichia coli CFT073
gcaauugcugccccucaac

SEQ ID NO: 2617672 - RNA, 14 nt, Escherichia coli CFT073
gcaauuucacgcuc

SEQ ID NO: 2617673 - RNA, 16 nt, Escherichia coli CFT073
gcaauuuugcccagcc

SEQ ID NO: 2617674 - RNA, 13 nt, Escherichia coli CFT073
gcaauuuuuugcg

SEQ ID NO: 2617675 - RNA, 15 nt, Escherichia coli CFT073
gcacaaaaacccgcu

SEQ ID NO: 2617676 - RNA, 14 nt, Escherichia coli CFT073
gcacaaaaccugcc

SEQ ID NO: 2617677 - RNA, 14 nt, Escherichia coli CFT073
gcacaaaacuguau

SEQ ID NO: 2617678 - RNA, 17 nt, Escherichia coli CFT073
gcacaaacgcaauccag

SEQ ID NO: 2617679 - RNA, 13 nt, Escherichia coli CFT073
gcacaaacgccac

SEQ ID NO: 2617680 - RNA, 14 nt, Escherichia coli CFT073
gcacaaagccgugc

SEQ ID NO: 2617681 - RNA, 19 nt, Escherichia coli CFT073
gcacaaagccgugccagau

SEQ ID NO: 2617682 - RNA, 15 nt, Escherichia coli CFT073
gcacaaagcgccaga

SEQ ID NO: 2617683 - RNA, 22 nt, Escherichia coli CFT073
gcacaaagcgccagaaugcgga

SEQ ID NO: 2617684 - RNA, 15 nt, Escherichia coli CFT073
gcacaaaguggcggc

SEQ ID NO: 2617685 - RNA, 18 nt, Escherichia coli CFT073
gcacaaauagccagcaga

SEQ ID NO: 2617686 - RNA, 15 nt, Escherichia coli CFT073
gcacaaauuugccgu

SEQ ID NO: 2617687 - RNA, 18 nt, Escherichia coli CFT073
gcacaaauuugccgucga

SEQ ID NO: 2617688 - RNA, 16 nt, Escherichia coli CFT073
gcacaaccaccugaua

SEQ ID NO: 2617689 - RNA, 13 nt, Escherichia coli CFT073
gcacaaccaucag

SEQ ID NO: 2617690 - RNA, 14 nt, Escherichia coli CFT073
gcacaaccgccaga

SEQ ID NO: 2617691 - RNA, 15 nt, Escherichia coli CFT073
gcacaaccgccagau

SEQ ID NO: 2617692 - RNA, 21 nt, Escherichia coli CFT073
gcacaaccgccagaugcggcg

SEQ ID NO: 2617693 - RNA, 20 nt, Escherichia coli CFT073
gcacaaccggaaccagcgcc

SEQ ID NO: 2617694 - RNA, 19 nt, Escherichia coli CFT073
gcacaacgcuuaucaggcu

SEQ ID NO: 2617695 - RNA, 12 nt, Escherichia coli CFT073
gcacaagacuga

SEQ ID NO: 2617696 - RNA, 15 nt, Escherichia coli CFT073
gcacaauaaucagcc

SEQ ID NO: 2617697 - RNA, 23 nt, Escherichia coli CFT073
gcacaaucaaaucgacggccagu

SEQ ID NO: 2617698 - RNA, 14 nt, Escherichia coli CFT073
gcacaauccgccag

SEQ ID NO: 2617699 - RNA, 15 nt, Escherichia coli CFT073
gcacaauccgccagg

SEQ ID NO: 2617700 - RNA, 22 nt, Escherichia coli CFT073
gcacaaugccguaaccagcgca

SEQ ID NO: 2617701 - RNA, 15 nt, Escherichia coli CFT073
gcacaaugccugaug

SEQ ID NO: 2617702 - RNA, 18 nt, Escherichia coli CFT073
gcacaaugccugaugcga

SEQ ID NO: 2617703 - RNA, 15 nt, Escherichia coli CFT073
gcacacaaaauugcc

SEQ ID NO: 2617704 - RNA, 20 nt, Escherichia coli CFT073
gcacacaaauaauucagccc

SEQ ID NO: 2617705 - RNA, 18 nt, Escherichia coli CFT073
gcacacaagcguaagaga

SEQ ID NO: 2617706 - RNA, 14 nt, Escherichia coli CFT073
gcacacauaacagc

SEQ ID NO: 2617707 - RNA, 17 nt, Escherichia coli CFT073
gcacaccaaccgcuucc

SEQ ID NO: 2617708 - RNA, 11 nt, Escherichia coli CFT073
gcacaccaacu

SEQ ID NO: 2617709 - RNA, 15 nt, Escherichia coli CFT073
gcacaccaacuucau

SEQ ID NO: 2617710 - RNA, 21 nt, Escherichia coli CFT073
gcacaccagccaguagcaccu

SEQ ID NO: 2617711 - RNA, 14 nt, Escherichia coli CFT073
gcacaccauacugu

SEQ ID NO: 2617712 - RNA, 17 nt, Escherichia coli CFT073
gcacaccgucagccagc

SEQ ID NO: 2617713 - RNA, 20 nt, Escherichia coli CFT073
gcacaccuucaagaacggcu

SEQ ID NO: 2617714 - RNA, 23 nt, Escherichia coli CFT073
gcacacucaagccguuaauucuu

SEQ ID NO: 2617715 - RNA, 19 nt, Escherichia coli CFT073
gcacacugccagugucgga

SEQ ID NO: 2617716 - RNA, 23 nt, Escherichia coli CFT073
gcacacugccagugucggaugcg

SEQ ID NO: 2617717 - RNA, 17 nt, Escherichia coli CFT073
gcacagaaaagcagagu

SEQ ID NO: 2617718 - RNA, 13 nt, Escherichia coli CFT073
gcaccgcgcccac

SEQ ID NO: 2617719 - RNA, 22 nt, Escherichia coli CFT073
gcaccgcgugaugcggcaucug

SEQ ID NO: 2617720 - RNA, 18 nt, Escherichia coli CFT073
gcaccggaaauugcugcc

SEQ ID NO: 2617721 - RNA, 20 nt, Escherichia coli CFT073
gcaccggcguaacgccgcga

SEQ ID NO: 2617722 - RNA, 21 nt, Escherichia coli CFT073
gcaccgggggguugccgccac

SEQ ID NO: 2617723 - RNA, 17 nt, Escherichia coli CFT073
gcaccggguagggcgaa

SEQ ID NO: 2617724 - RNA, 22 nt, Escherichia coli CFT073
gcaccgguacacaaccgccgga

SEQ ID NO: 2617725 - RNA, 15 nt, Escherichia coli CFT073
gcaccgguuccgggc

SEQ ID NO: 2617726 - RNA, 18 nt, Escherichia coli CFT073
gcaccgugaccacccaug

SEQ ID NO: 2617727 - RNA, 22 nt, Escherichia coli CFT073
gcaccgugcauuuuucgcuuuu

SEQ ID NO: 2617728 - RNA, 19 nt, Escherichia coli CFT073
gcaccguguuccugaacgu

SEQ ID NO: 2617729 - RNA, 22 nt, Escherichia coli CFT073
gcaccguuuugcguccagugac

SEQ ID NO: 2617730 - RNA, 14 nt, Escherichia coli CFT073
gcaccuacagccau

SEQ ID NO: 2617731 - RNA, 19 nt, Escherichia coli CFT073
gcaccucuccacgcaucug

SEQ ID NO: 2617732 - RNA, 17 nt, Escherichia coli CFT073
gcaccugaaccagaccg

SEQ ID NO: 2617733 - RNA, 13 nt, Escherichia coli CFT073
gcaccugccagcg

SEQ ID NO: 2617734 - RNA, 14 nt, Escherichia coli CFT073
gcaccugccagcgc

SEQ ID NO: 2617735 - RNA, 22 nt, Escherichia coli CFT073
gcaccugcggaaucaccggcaa

SEQ ID NO: 2617736 - RNA, 23 nt, Escherichia coli CFT073
gcaccugcggaaucaccggcaaa

SEQ ID NO: 2617737 - RNA, 22 nt, Escherichia coli CFT073
gcaccugcucaggcagaagaga

SEQ ID NO: 2617738 - RNA, 20 nt, Escherichia coli CFT073
gcaccuuguucaucggccuu

SEQ ID NO: 2617739 - RNA, 16 nt, Escherichia coli CFT073
gcaccuuuaaccccag

SEQ ID NO: 2617740 - RNA, 14 nt, Escherichia coli CFT073
gcacgaaucgauaa

SEQ ID NO: 2617741 - RNA, 20 nt, Escherichia coli CFT073
gcacgaaucgauaaccccag

SEQ ID NO: 2617742 - RNA, 17 nt, Escherichia coli CFT073
gcacgaauugcuuccag

SEQ ID NO: 2617743 - RNA, 15 nt, Escherichia coli CFT073
gcacgacacaaugcc

SEQ ID NO: 2617744 - RNA, 14 nt, Escherichia coli CFT073
gcacgaccaggaac

SEQ ID NO: 2617745 - RNA, 19 nt, Escherichia coli CFT073
gcacgaccaggaacgccau

SEQ ID NO: 2617746 - RNA, 16 nt, Escherichia coli CFT073
gcacgaccggguuuuc

SEQ ID NO: 2617747 - RNA, 13 nt, Escherichia coli CFT073
gcacgaccuugcc

SEQ ID NO: 2617748 - RNA, 22 nt, Escherichia coli CFT073
gcacgaccuugccaaggucggg

SEQ ID NO: 2617749 - RNA, 22 nt, Escherichia coli CFT073
gcacgacgaaucugauucgccu

SEQ ID NO: 2617750 - RNA, 19 nt, Escherichia coli CFT073
gcacgacguuucuuucgau

SEQ ID NO: 2617751 - RNA, 23 nt, Escherichia coli CFT073
gcacgaguguuacgccugccgca

SEQ ID NO: 2617752 - RNA, 22 nt, Escherichia coli CFT073
gcacgauaacgguauaaaucga

SEQ ID NO: 2617753 - RNA, 19 nt, Escherichia coli CFT073
  misc_feature (10)..(10): n is a, c, g or u
gcacgauaangcuugcgca

SEQ ID NO: 2617754 - RNA, 18 nt, Escherichia coli CFT073
gcacgauauaccgugcug

SEQ ID NO: 2617755 - RNA, 17 nt, Escherichia coli CFT073
gcacgccaauuacgccu

SEQ ID NO: 2617756 - RNA, 20 nt, Escherichia coli CFT073
gcacgcccauacauaccagc

SEQ ID NO: 2617757 - RNA, 14 nt, Escherichia coli CFT073
gcacgcccaucagc

SEQ ID NO: 2617758 - RNA, 18 nt, Escherichia coli CFT073
gcacgcccaucgcgcccg

SEQ ID NO: 2617759 - RNA, 22 nt, Escherichia coli CFT073
gcacgcccgcgccauuaucccg

SEQ ID NO: 2617760 - RNA, 14 nt, Escherichia coli CFT073
gcacgcgcaucauu

SEQ ID NO: 2617761 - RNA, 18 nt, Escherichia coli CFT073
gcacgcguaauauccagc

SEQ ID NO: 2617762 - RNA, 21 nt, Escherichia coli CFT073
gcacgcguaauauccagcgua

SEQ ID NO: 2617763 - RNA, 16 nt, Escherichia coli CFT073
gcacgcucaaagacgc

SEQ ID NO: 2617764 - RNA, 17 nt, Escherichia coli CFT073
gcacgcugaccgcuuca

SEQ ID NO: 2617765 - RNA, 13 nt, Escherichia coli CFT073
gcacgcugcggca

SEQ ID NO: 2617766 - RNA, 16 nt, Escherichia coli CFT073
gcacggaaagcagcau

SEQ ID NO: 2617767 - RNA, 22 nt, Escherichia coli CFT073
gcacggaaagcagcauacccac

SEQ ID NO: 2617768 - RNA, 16 nt, Escherichia coli CFT073
gcacggaguaacaaau

SEQ ID NO: 2617769 - RNA, 18 nt, Escherichia coli CFT073
gcacggauaccgcacgcu

SEQ ID NO: 2617770 - RNA, 22 nt, Escherichia coli CFT073
gcacggauucacaauuggcgca

SEQ ID NO: 2617771 - RNA, 13 nt, Escherichia coli CFT073
gcacggcacacuu

SEQ ID NO: 2617772 - RNA, 22 nt, Escherichia coli CFT073
gcacggcgaaaauuacuuuccg

SEQ ID NO: 2617773 - RNA, 14 nt, Escherichia coli CFT073
gcacggcguuuauu

SEQ ID NO: 2617774 - RNA, 18 nt, Escherichia coli CFT073
gcacggucacaucgcuga

SEQ ID NO: 2617775 - RNA, 15 nt, Escherichia coli CFT073
gcacggucacuacac

SEQ ID NO: 2617776 - RNA, 14 nt, Escherichia coli CFT073
gcacgguggcuggc

SEQ ID NO: 2617777 - RNA, 15 nt, Escherichia coli CFT073
gcacgguggcuggcg

SEQ ID NO: 2617778 - RNA, 18 nt, Escherichia coli CFT073
gcacgguuuuuccagcuc

SEQ ID NO: 2617779 - RNA, 19 nt, Escherichia coli CFT073
gcacguaggcgaucccagc

SEQ ID NO: 2617780 - RNA, 21 nt, Escherichia coli CFT073
gcacgucuuugccgcgcucuu

SEQ ID NO: 2617781 - RNA, 13 nt, Escherichia coli CFT073
gcacguuaaucaa

SEQ ID NO: 2617782 - RNA, 22 nt, Escherichia coli CFT073
gcacguuaucagacaccagcca

SEQ ID NO: 2617783 - RNA, 19 nt, Escherichia coli CFT073
gcacguucugucgcucugc

SEQ ID NO: 2617784 - RNA, 16 nt, Escherichia coli CFT073
gcacguugccagcaac

SEQ ID NO: 2617785 - RNA, 21 nt, Escherichia coli CFT073
gcacguugcuuauugccggau

SEQ ID NO: 2617786 - RNA, 14 nt, Escherichia coli CFT073
gcacuaccgcccga

SEQ ID NO: 2617787 - RNA, 20 nt, Escherichia coli CFT073
gcacuaccuugcuucuuacu

SEQ ID NO: 2617788 - RNA, 16 nt, Escherichia coli CFT073
gcacuauaucccucac

SEQ ID NO: 2617789 - RNA, 16 nt, Escherichia coli CFT073
gcacucacgccaggca

SEQ ID NO: 2617790 - RNA, 18 nt, Escherichia coli CFT073
gcacucauagccucugcc

SEQ ID NO: 2617791 - RNA, 16 nt, Escherichia coli CFT073
gcacucauuuucucuu

SEQ ID NO: 2617792 - RNA, 12 nt, Escherichia coli CFT073
gcacuccgccgc

SEQ ID NO: 2617793 - RNA, 13 nt, Escherichia coli CFT073
gcacucgccagga

SEQ ID NO: 2617794 - RNA, 22 nt, Escherichia coli CFT073
gcacucugugcgucugcuuuua

SEQ ID NO: 2617795 - RNA, 19 nt, Escherichia coli CFT073
gcacugaaagagucgccag

SEQ ID NO: 2617796 - RNA, 14 nt, Escherichia coli CFT073
gcacugacugacag

SEQ ID NO: 2617797 - RNA, 20 nt, Escherichia coli CFT073
gcacugauaaucccggcggc

SEQ ID NO: 2617798 - RNA, 23 nt, Escherichia coli CFT073
gcacugauuuuuuccaacaggcg

SEQ ID NO: 2617799 - RNA, 22 nt, Escherichia coli CFT073
gcacugcauucggcgaccagcg

SEQ ID NO: 2617800 - RNA, 13 nt, Escherichia coli CFT073
gcacugccagcca

SEQ ID NO: 2617801 - RNA, 16 nt, Escherichia coli CFT073
gcacugcgcccgccag

SEQ ID NO: 2617802 - RNA, 17 nt, Escherichia coli CFT073
gcacugcgcccgccagc

SEQ ID NO: 2617803 - RNA, 18 nt, Escherichia coli CFT073
gcacugcgcccgccagca

SEQ ID NO: 2617804 - RNA, 20 nt, Escherichia coli CFT073
gcacugcgcccgccagcauc

SEQ ID NO: 2617805 - RNA, 22 nt, Escherichia coli CFT073
gcacugcgcccgccagcaucgg

SEQ ID NO: 2617806 - RNA, 21 nt, Escherichia coli CFT073
gcacugcgcgauaaucccaac

SEQ ID NO: 2617807 - RNA, 15 nt, Escherichia coli CFT073
gcacugcucuuuaac

SEQ ID NO: 2617808 - RNA, 19 nt, Escherichia coli CFT073
gcacugcuuaaauuucuua

SEQ ID NO: 2617809 - RNA, 22 nt, Escherichia coli CFT073
gcacuggcaagaaacgcuccac

SEQ ID NO: 2617810 - RNA, 17 nt, Escherichia coli CFT073
gcacuggcgaauucugc

SEQ ID NO: 2617811 - RNA, 14 nt, Escherichia coli CFT073
gcacuggcgcgccu

SEQ ID NO: 2617812 - RNA, 18 nt, Escherichia coli CFT073
gcacuggcggcagcaggu

SEQ ID NO: 2617813 - RNA, 22 nt, Escherichia coli CFT073
gcacuggcggcagcaggugcgc

SEQ ID NO: 2617814 - RNA, 18 nt, Escherichia coli CFT073
gcacuggguucaucuucc

SEQ ID NO: 2617815 - RNA, 20 nt, Escherichia coli CFT073
gcacuggguucaucuuccag

SEQ ID NO: 2617816 - RNA, 15 nt, Escherichia coli CFT073
gcacugguacucaac

SEQ ID NO: 2617817 - RNA, 18 nt, Escherichia coli CFT073
gcacuguucgccgcagcc

SEQ ID NO: 2617818 - RNA, 15 nt, Escherichia coli CFT073
gcacuguuucgccag

SEQ ID NO: 2617819 - RNA, 17 nt, Escherichia coli CFT073
gcacuuaccuucacgaa

SEQ ID NO: 2617820 - RNA, 16 nt, Escherichia coli CFT073
gcacuuauaugccgga

SEQ ID NO: 2617821 - RNA, 15 nt, Escherichia coli CFT073
gcacuucaaauuuca

SEQ ID NO: 2617822 - RNA, 12 nt, Escherichia coli CFT073
gcacuucaacuu

SEQ ID NO: 2617823 - RNA, 19 nt, Escherichia coli CFT073
gcacuucacccaucgccag

SEQ ID NO: 2617824 - RNA, 20 nt, Escherichia coli CFT073
gcacuucacccaucgccaga

SEQ ID NO: 2617825 - RNA, 22 nt, Escherichia coli CFT073
gcacuucacccaucgccagaua

SEQ ID NO: 2617826 - RNA, 17 nt, Escherichia coli CFT073
gcagcaaucgaccaggc

SEQ ID NO: 2617827 - RNA, 16 nt, Escherichia coli CFT073
gcagcaauggcacugu

SEQ ID NO: 2617828 - RNA, 17 nt, Escherichia coli CFT073
gcagcacacgauuccaa

SEQ ID NO: 2617829 - RNA, 19 nt, Escherichia coli CFT073
gcagcacccagaacgccga

SEQ ID NO: 2617830 - RNA, 16 nt, Escherichia coli CFT073
gcagcacccugaguuu

SEQ ID NO: 2617831 - RNA, 19 nt, Escherichia coli CFT073
gcagcacccugaguuuuca

SEQ ID NO: 2617832 - RNA, 20 nt, Escherichia coli CFT073
gcagcacccugaguuuucag

SEQ ID NO: 2617833 - RNA, 13 nt, Escherichia coli CFT073
gcagcacgcugga

SEQ ID NO: 2617834 - RNA, 17 nt, Escherichia coli CFT073
gcagcacggugcgggcu

SEQ ID NO: 2617835 - RNA, 17 nt, Escherichia coli CFT073
gcagcacucgauuccaa

SEQ ID NO: 2617836 - RNA, 14 nt, Escherichia coli CFT073
gcagcacugauaau

SEQ ID NO: 2617837 - RNA, 22 nt, Escherichia coli CFT073
gcagcagacgcaucgcccagcc

SEQ ID NO: 2617838 - RNA, 22 nt, Escherichia coli CFT073
gcagcagauuaaccgcuucgcu

SEQ ID NO: 2617839 - RNA, 16 nt, Escherichia coli CFT073
gcagcagcgaauaauu

SEQ ID NO: 2617840 - RNA, 15 nt, Escherichia coli CFT073
gcagcagcgccaggc

SEQ ID NO: 2617841 - RNA, 16 nt, Escherichia coli CFT073
gcagcagcgccaggca

SEQ ID NO: 2617842 - RNA, 17 nt, Escherichia coli CFT073
gcagcagcgccaggcac

SEQ ID NO: 2617843 - RNA, 18 nt, Escherichia coli CFT073
gcagcagcgccaggcaca

SEQ ID NO: 2617844 - RNA, 20 nt, Escherichia coli CFT073
gcagcagcgccaggcacacc

SEQ ID NO: 2617845 - RNA, 19 nt, Escherichia coli CFT073
gcagcagcuguuuggccug

SEQ ID NO: 2617846 - RNA, 17 nt, Escherichia coli CFT073
gcagcaggaucagaccg

SEQ ID NO: 2617847 - RNA, 17 nt, Escherichia coli CFT073
gcagcaggaucuccagu

SEQ ID NO: 2617848 - RNA, 19 nt, Escherichia coli CFT073
gcagcaggugcgccagcga

SEQ ID NO: 2617849 - RNA, 17 nt, Escherichia coli CFT073
gcagcaguccuggcgcu

SEQ ID NO: 2617850 - RNA, 12 nt, Escherichia coli CFT073
gcagcaucacca

SEQ ID NO: 2617851 - RNA, 13 nt, Escherichia coli CFT073
gcagcaucaccac

SEQ ID NO: 2617852 - RNA, 12 nt, Escherichia coli CFT073
gcagcaucacgc

SEQ ID NO: 2617853 - RNA, 13 nt, Escherichia coli CFT073
gcagcaucagcaa

SEQ ID NO: 2617854 - RNA, 17 nt, Escherichia coli CFT073
gcagcaucgcucaccca

SEQ ID NO: 2617855 - RNA, 18 nt, Escherichia coli CFT073
gcagcaugauacaaaaca

SEQ ID NO: 2617856 - RNA, 14 nt, Escherichia coli CFT073
gcagcaugauuuca

SEQ ID NO: 2617857 - RNA, 13 nt, Escherichia coli CFT073
gcagcauggguaa

SEQ ID NO: 2617858 - RNA, 16 nt, Escherichia coli CFT073
gcagcauggguaaagc

SEQ ID NO: 2617859 - RNA, 19 nt, Escherichia coli CFT073
gcagcauggucgcagcggc

SEQ ID NO: 2617860 - RNA, 20 nt, Escherichia coli CFT073
gcagcauggucgcagcggcu

SEQ ID NO: 2617861 - RNA, 21 nt, Escherichia coli CFT073
gcagcauuucaaaacggucac

SEQ ID NO: 2617862 - RNA, 13 nt, Escherichia coli CFT073
gcagcauuuccuc

SEQ ID NO: 2617863 - RNA, 12 nt, Escherichia coli CFT073
gcagccaaaaau

SEQ ID NO: 2617864 - RNA, 19 nt, Escherichia coli CFT073
gcagccaaaaaugacgccc

SEQ ID NO: 2617865 - RNA, 13 nt, Escherichia coli CFT073
gcagccacaccaa

SEQ ID NO: 2617866 - RNA, 16 nt, Escherichia coli CFT073
gcagccacggcagcaa

SEQ ID NO: 2617867 - RNA, 15 nt, Escherichia coli CFT073
gcagccacgucaccu

SEQ ID NO: 2617868 - RNA, 16 nt, Escherichia coli CFT073
gcagccagaacucauc

SEQ ID NO: 2617869 - RNA, 18 nt, Escherichia coli CFT073
gcagccagcacugccgca

SEQ ID NO: 2617870 - RNA, 12 nt, Escherichia coli CFT073
gcagccagcgca

SEQ ID NO: 2617871 - RNA, 20 nt, Escherichia coli CFT073
gcagccagcguuacccagac

SEQ ID NO: 2617872 - RNA, 17 nt, Escherichia coli CFT073
gcagccaguuguugaua

SEQ ID NO: 2617873 - RNA, 14 nt, Escherichia coli CFT073
gcagccaugaugaa

SEQ ID NO: 2617874 - RNA, 23 nt, Escherichia coli CFT073
gcagccauuuguuggcgcugcug

SEQ ID NO: 2617875 - RNA, 13 nt, Escherichia coli CFT073
gcagccccagcgc

SEQ ID NO: 2617876 - RNA, 14 nt, Escherichia coli CFT073
gcagccccagcgca

SEQ ID NO: 2617877 - RNA, 16 nt, Escherichia coli CFT073
gcagcccgagcaacag

SEQ ID NO: 2617878 - RNA, 18 nt, Escherichia coli CFT073
gcagccggaaaaccauca

SEQ ID NO: 2617879 - RNA, 23 nt, Escherichia coli CFT073
gcagccggagcuucacccgcagc

SEQ ID NO: 2617880 - RNA, 14 nt, Escherichia coli CFT073
gcagccgucgccag

SEQ ID NO: 2617881 - RNA, 23 nt, Escherichia coli CFT073
gcagccgucgccaguaccagcag

SEQ ID NO: 2617882 - RNA, 14 nt, Escherichia coli CFT073
gcagccuccccagc

SEQ ID NO: 2617883 - RNA, 19 nt, Escherichia coli CFT073
gcagccuuucacaucagaa

SEQ ID NO: 2617884 - RNA, 14 nt, Escherichia coli CFT073
gcagcgacucacga

SEQ ID NO: 2617885 - RNA, 19 nt, Escherichia coli CFT073
gcagcgauggauaaccgca

SEQ ID NO: 2617886 - RNA, 18 nt, Escherichia coli CFT073
gcagcgauuaacugcgcg

SEQ ID NO: 2617887 - RNA, 17 nt, Escherichia coli CFT073
gcagcgcaaucgccucc

SEQ ID NO: 2617888 - RNA, 24 nt, Escherichia coli CFT073
gcagcgccacacgagucauuccug

SEQ ID NO: 2617889 - RNA, 15 nt, Escherichia coli CFT073
gcagcgccgguuuuc

SEQ ID NO: 2617890 - RNA, 15 nt, Escherichia coli CFT073
gcagcgcgugcgcca

SEQ ID NO: 2617891 - RNA, 17 nt, Escherichia coli CFT073
gcagcgcgugcgccacc

SEQ ID NO: 2617892 - RNA, 23 nt, Escherichia coli CFT073
gcagcgcuggagagcgccgggca

SEQ ID NO: 2617893 - RNA, 15 nt, Escherichia coli CFT073
gcagcggaccgcuuu

SEQ ID NO: 2617894 - RNA, 23 nt, Escherichia coli CFT073
gcagcggagaaauguugguuucg

SEQ ID NO: 2617895 - RNA, 23 nt, Escherichia coli CFT073
gcagcggcagcuuaacgguuuua

SEQ ID NO: 2617896 - RNA, 15 nt, Escherichia coli CFT073
gcagcggcggcacug

SEQ ID NO: 2617897 - RNA, 15 nt, Escherichia coli CFT073
gcagcgggauuuccg

SEQ ID NO: 2617898 - RNA, 19 nt, Escherichia coli CFT073
gcagcggucgcugacauua

SEQ ID NO: 2617899 - RNA, 17 nt, Escherichia coli CFT073
gcagcggugagccagga

SEQ ID NO: 2617900 - RNA, 20 nt, Escherichia coli CFT073
gcagcgguuaugguuucccu

SEQ ID NO: 2617901 - RNA, 18 nt, Escherichia coli CFT073
gcagcgguugagagaaga

SEQ ID NO: 2617902 - RNA, 15 nt, Escherichia coli CFT073
gcagcguaacggcuc

SEQ ID NO: 2617903 - RNA, 12 nt, Escherichia coli CFT073
gcagcgucgcau

SEQ ID NO: 2617904 - RNA, 15 nt, Escherichia coli CFT073
gcagcgucgcaucag

SEQ ID NO: 2617905 - RNA, 17 nt, Escherichia coli CFT073
gcagcgucgcaucaggc

SEQ ID NO: 2617906 - RNA, 23 nt, Escherichia coli CFT073
gcagcgucgcauccaacaauaaa

SEQ ID NO: 2617907 - RNA, 23 nt, Escherichia coli CFT073
gcagcgucucauaacggauugca

SEQ ID NO: 2617908 - RNA, 19 nt, Escherichia coli CFT073
gcagcguggugcugauacg

SEQ ID NO: 2617909 - RNA, 22 nt, Escherichia coli CFT073
gcagcguggugcugauacgcgc

SEQ ID NO: 2617910 - RNA, 20 nt, Escherichia coli CFT073
gcagcguuucgcgcgcgccu

SEQ ID NO: 2617911 - RNA, 17 nt, Escherichia coli CFT073
gcagcuaauugauugua

SEQ ID NO: 2617912 - RNA, 20 nt, Escherichia coli CFT073
gcagcucacuucgauccagu

SEQ ID NO: 2617913 - RNA, 12 nt, Escherichia coli CFT073
gcagcuccagcc

SEQ ID NO: 2617914 - RNA, 19 nt, Escherichia coli CFT073
gcagcuccccacaccacca

SEQ ID NO: 2617915 - RNA, 21 nt, Escherichia coli CFT073
gcagcuccccacaccaccaug

SEQ ID NO: 2617916 - RNA, 23 nt, Escherichia coli CFT073
gcagcuccccacaccaccaugcu

SEQ ID NO: 2617917 - RNA, 13 nt, Escherichia coli CFT073
gcagcuccgccag

SEQ ID NO: 2617918 - RNA, 12 nt, Escherichia coli CFT073
gcagcuccugcu

SEQ ID NO: 2617919 - RNA, 15 nt, Escherichia coli CFT073
gcagcuccugcucug

SEQ ID NO: 2617920 - RNA, 19 nt, Escherichia coli CFT073
gcagcucuuuauccagcag

SEQ ID NO: 2617921 - RNA, 20 nt, Escherichia coli CFT073
gcagcucuuuauccagcagc

SEQ ID NO: 2617922 - RNA, 20 nt, Escherichia coli CFT073
gcagcucuuucucgcucagu

SEQ ID NO: 2617923 - RNA, 17 nt, Escherichia coli CFT073
gcagcuguagcgugcga

SEQ ID NO: 2617924 - RNA, 12 nt, Escherichia coli CFT073
gcagcugugccg

SEQ ID NO: 2617925 - RNA, 17 nt, Escherichia coli CFT073
gcagcuguugcgccagc

SEQ ID NO: 2617926 - RNA, 16 nt, Escherichia coli CFT073
gcagcuguuucaucuc

SEQ ID NO: 2617927 - RNA, 17 nt, Escherichia coli CFT073
gcagcuguuucaucuca

SEQ ID NO: 2617928 - RNA, 16 nt, Escherichia coli CFT073
gcagcuguuuggccug

SEQ ID NO: 2617929 - RNA, 20 nt, Escherichia coli CFT073
gcagcuuaaucauaauguug

SEQ ID NO: 2617930 - RNA, 22 nt, Escherichia coli CFT073
gcagcuuacgcgccagagcugg

SEQ ID NO: 2617931 - RNA, 13 nt, Escherichia coli CFT073
gcagcuucacaaa

SEQ ID NO: 2617932 - RNA, 18 nt, Escherichia coli CFT073
gcagcuucacaaaggcuu

SEQ ID NO: 2617933 - RNA, 23 nt, Escherichia coli CFT073
gcagcuucacaaaggcuugcugc

SEQ ID NO: 2617934 - RNA, 19 nt, Escherichia coli CFT073
gcaguggauagacgcaggu

SEQ ID NO: 2617935 - RNA, 14 nt, Escherichia coli CFT073
gcaguggugcggcu

SEQ ID NO: 2617936 - RNA, 14 nt, Escherichia coli CFT073
gcagugucagcacc

SEQ ID NO: 2617937 - RNA, 19 nt, Escherichia coli CFT073
gcaguguucuggcuugcug

SEQ ID NO: 2617938 - RNA, 19 nt, Escherichia coli CFT073
gcaguuacugcccgcacac

SEQ ID NO: 2617939 - RNA, 16 nt, Escherichia coli CFT073
gcaguuagcuuuucuc

SEQ ID NO: 2617940 - RNA, 13 nt, Escherichia coli CFT073
gcaguuauuauaa

SEQ ID NO: 2617941 - RNA, 17 nt, Escherichia coli CFT073
gcaguuccagcaucugu

SEQ ID NO: 2617942 - RNA, 21 nt, Escherichia coli CFT073
gcaguucugccaggcuggcag

SEQ ID NO: 2617943 - RNA, 16 nt, Escherichia coli CFT073
gcaguugccggaugcg

SEQ ID NO: 2617944 - RNA, 14 nt, Escherichia coli CFT073
gcaguugcgcgcgu

SEQ ID NO: 2617945 - RNA, 13 nt, Escherichia coli CFT073
gcaguugcugacu

SEQ ID NO: 2617946 - RNA, 16 nt, Escherichia coli CFT073
gcaguuuauccagcca

SEQ ID NO: 2617947 - RNA, 22 nt, Escherichia coli CFT073
gcaguuuaugaaucaaaucaac

SEQ ID NO: 2617948 - RNA, 19 nt, Escherichia coli CFT073
gcaguuucaccagcaguaa

SEQ ID NO: 2617949 - RNA, 15 nt, Escherichia coli CFT073
gcaguuucagccagu

SEQ ID NO: 2617950 - RNA, 17 nt, Escherichia coli CFT073
gcaguuuuuccccugcc

SEQ ID NO: 2617951 - RNA, 23 nt, Escherichia coli CFT073
gcauaaaaaaagcgggccaguaa

SEQ ID NO: 2617952 - RNA, 19 nt, Escherichia coli CFT073
gcauaaaagggcagcagga

SEQ ID NO: 2617953 - RNA, 15 nt, Escherichia coli CFT073
gcauaaacaucuucc

SEQ ID NO: 2617954 - RNA, 14 nt, Escherichia coli CFT073
gcauaacaaaaugc

SEQ ID NO: 2617955 - RNA, 17 nt, Escherichia coli CFT073
gcauaacgcuggggaau

SEQ ID NO: 2617956 - RNA, 22 nt, Escherichia coli CFT073
gcauaacgcuggggaaugccau

SEQ ID NO: 2617957 - RNA, 15 nt, Escherichia coli CFT073
gcauaacucaccauc

SEQ ID NO: 2617958 - RNA, 20 nt, Escherichia coli CFT073
gcauaagcgcguuucugcgc

SEQ ID NO: 2617959 - RNA, 19 nt, Escherichia coli CFT073
gcauaagucccgaccacac

SEQ ID NO: 2617960 - RNA, 16 nt, Escherichia coli CFT073
gcauaauaagcccggc

SEQ ID NO: 2617961 - RNA, 19 nt, Escherichia coli CFT073
gcauaaucaccaguaccgc

SEQ ID NO: 2617962 - RNA, 17 nt, Escherichia coli CFT073
gcauaaucaccaucagc

SEQ ID NO: 2617963 - RNA, 15 nt, Escherichia coli CFT073
gcauaauccaggcau

SEQ ID NO: 2617964 - RNA, 13 nt, Escherichia coli CFT073
gcauaaucggcug

SEQ ID NO: 2617965 - RNA, 17 nt, Escherichia coli CFT073
gcauaaugucgcuggcc

SEQ ID NO: 2617966 - RNA, 22 nt, Escherichia coli CFT073
gcauaauugcgccagagcugcg

SEQ ID NO: 2617967 - RNA, 15 nt, Escherichia coli CFT073
gcauaauuuccagca

SEQ ID NO: 2617968 - RNA, 20 nt, Escherichia coli CFT073
gcauaauuucuucguucgcc

SEQ ID NO: 2617969 - RNA, 17 nt, Escherichia coli CFT073
gcauacaacgccaugaa

SEQ ID NO: 2617970 - RNA, 19 nt, Escherichia coli CFT073
gcauacaacgccaugaaga

SEQ ID NO: 2617971 - RNA, 17 nt, Escherichia coli CFT073
gcauacaccaccacauu

SEQ ID NO: 2617972 - RNA, 23 nt, Escherichia coli CFT073
gcauacacgucgucgccaaugcg

SEQ ID NO: 2617973 - RNA, 23 nt, Escherichia coli CFT073
gcauacagcuuuuacagccaaug

SEQ ID NO: 2617974 - RNA, 17 nt, Escherichia coli CFT073
gcauacaguaucgccug

SEQ ID NO: 2617975 - RNA, 17 nt, Escherichia coli CFT073
gcauacauugccgcagu

SEQ ID NO: 2617976 - RNA, 21 nt, Escherichia coli CFT073
gcauacauuuauuucaacgac

SEQ ID NO: 2617977 - RNA, 22 nt, Escherichia coli CFT073
gcauacauuuauuucaacgaca

SEQ ID NO: 2617978 - RNA, 15 nt, Escherichia coli CFT073
gcauaccauccggca

SEQ ID NO: 2617979 - RNA, 19 nt, Escherichia coli CFT073
gcauaccauccggcauaaa

SEQ ID NO: 2617980 - RNA, 22 nt, Escherichia coli CFT073
gcauaccauccggcauaaacgc

SEQ ID NO: 2617981 - RNA, 20 nt, Escherichia coli CFT073
gcauaccgaucgcgguaaca

SEQ ID NO: 2617982 - RNA, 13 nt, Escherichia coli CFT073
gcauaccuucaca

SEQ ID NO: 2617983 - RNA, 23 nt, Escherichia coli CFT073
gcauaccuucacaaaaugccagc

SEQ ID NO: 2617984 - RNA, 15 nt, Escherichia coli CFT073
gcauacgccacaucc

SEQ ID NO: 2617985 - RNA, 22 nt, Escherichia coli CFT073
gcauacgggauuuuacuuccca

SEQ ID NO: 2617986 - RNA, 17 nt, Escherichia coli CFT073
gcauacuccggcggcag

SEQ ID NO: 2617987 - RNA, 18 nt, Escherichia coli CFT073
gcauacuccggcggcagc

SEQ ID NO: 2617988 - RNA, 15 nt, Escherichia coli CFT073
gcauacucgcgucug

SEQ ID NO: 2617989 - RNA, 15 nt, Escherichia coli CFT073
gcauacucuccucca

SEQ ID NO: 2617990 - RNA, 20 nt, Escherichia coli CFT073
gcauacucuccuccagguua

SEQ ID NO: 2617991 - RNA, 14 nt, Escherichia coli CFT073
gcauacugauuacc

SEQ ID NO: 2617992 - RNA, 13 nt, Escherichia coli CFT073
gcauagcaccacc

SEQ ID NO: 2617993 - RNA, 22 nt, Escherichia coli CFT073
gcauagccaccuggcugcguuu

SEQ ID NO: 2617994 - RNA, 15 nt, Escherichia coli CFT073
gcauagccccagcgc

SEQ ID NO: 2617995 - RNA, 16 nt, Escherichia coli CFT073
gcauagccccagcgca

SEQ ID NO: 2617996 - RNA, 16 nt, Escherichia coli CFT073
gcauagcgguaaauga

SEQ ID NO: 2617997 - RNA, 16 nt, Escherichia coli CFT073
gcauagcguucuucca

SEQ ID NO: 2617998 - RNA, 22 nt, Escherichia coli CFT073
gcauagcguucuuccacuuuaa

SEQ ID NO: 2617999 - RNA, 19 nt, Escherichia coli CFT073
gcauagcuggcguagccag

SEQ ID NO: 2618000 - RNA, 20 nt, Escherichia coli CFT073
gcauagcuggcguagccagu

SEQ ID NO: 2618001 - RNA, 16 nt, Escherichia coli CFT073
gcauagugaucagccu

SEQ ID NO: 2618002 - RNA, 13 nt, Escherichia coli CFT073
gcauauccaggcu

SEQ ID NO: 2618003 - RNA, 13 nt, Escherichia coli CFT073
gcauauccggugc

SEQ ID NO: 2618004 - RNA, 12 nt, Escherichia coli CFT073
gcauauccucau

SEQ ID NO: 2618005 - RNA, 23 nt, Escherichia coli CFT073
gcauauccucauuucauuguccg

SEQ ID NO: 2618006 - RNA, 14 nt, Escherichia coli CFT073
gcauaucuucugaa

SEQ ID NO: 2618007 - RNA, 22 nt, Escherichia coli CFT073
gcauaugcugcuuuuacgcugg

SEQ ID NO: 2618008 - RNA, 16 nt, Escherichia coli CFT073
gcauaugcuucuuccu

SEQ ID NO: 2618009 - RNA, 19 nt, Escherichia coli CFT073
gcauauguuuacgcuggcg

SEQ ID NO: 2618010 - RNA, 22 nt, Escherichia coli CFT073
gcauauguuuacgcuggcggaa

SEQ ID NO: 2618011 - RNA, 19 nt, Escherichia coli CFT073
gcauauuguguaugcacac

SEQ ID NO: 2618012 - RNA, 14 nt, Escherichia coli CFT073
gcauauuuaaaaac

SEQ ID NO: 2618013 - RNA, 19 nt, Escherichia coli CFT073
gcaucaaacgguugauaaa

SEQ ID NO: 2618014 - RNA, 16 nt, Escherichia coli CFT073
gcaucaaagaacucac

SEQ ID NO: 2618015 - RNA, 19 nt, Escherichia coli CFT073
gcaucaaagaacucacgcg

SEQ ID NO: 2618016 - RNA, 14 nt, Escherichia coli CFT073
gcaucaacagcacg

SEQ ID NO: 2618017 - RNA, 13 nt, Escherichia coli CFT073
gcaucaaccagca

SEQ ID NO: 2618018 - RNA, 21 nt, Escherichia coli CFT073
gcaucaagaaugcucgcuggc

SEQ ID NO: 2618019 - RNA, 22 nt, Escherichia coli CFT073
gcaucaagaaugcucgcuggca

SEQ ID NO: 2618020 - RNA, 17 nt, Escherichia coli CFT073
gcaucaaguugauuuuu

SEQ ID NO: 2618021 - RNA, 20 nt, Escherichia coli CFT073
gcaucaaguugauuuuucgu

SEQ ID NO: 2618022 - RNA, 13 nt, Escherichia coli CFT073
gcaucacagacca

SEQ ID NO: 2618023 - RNA, 22 nt, Escherichia coli CFT073
gcaucacauugcguaaaucuuc

SEQ ID NO: 2618024 - RNA, 16 nt, Escherichia coli CFT073
gcaucacccgcugcaa

SEQ ID NO: 2618025 - RNA, 20 nt, Escherichia coli CFT073
gcaucacgaccgcuucagga

SEQ ID NO: 2618026 - RNA, 12 nt, Escherichia coli CFT073
gcaucacuccag

SEQ ID NO: 2618027 - RNA, 15 nt, Escherichia coli CFT073
gcaucacuuccagua

SEQ ID NO: 2618028 - RNA, 12 nt, Escherichia coli CFT073
gcaucagauggg

SEQ ID NO: 2618029 - RNA, 22 nt, Escherichia coli CFT073
gcaucagcagauaccaacccug

SEQ ID NO: 2618030 - RNA, 21 nt, Escherichia coli CFT073
gcaucagccaggguucccggc

SEQ ID NO: 2618031 - RNA, 15 nt, Escherichia coli CFT073
gcaucagccucgaua

SEQ ID NO: 2618032 - RNA, 12 nt, Escherichia coli CFT073
gcaucagcgauu

SEQ ID NO: 2618033 - RNA, 22 nt, Escherichia coli CFT073
gcaucagcgccuuaccaauacc

SEQ ID NO: 2618034 - RNA, 18 nt, Escherichia coli CFT073
gcaucagcgcuaccagag

SEQ ID NO: 2618035 - RNA, 16 nt, Escherichia coli CFT073
gcaucagcuacaccga

SEQ ID NO: 2618036 - RNA, 18 nt, Escherichia coli CFT073
gcaucagcuacaccgauc

SEQ ID NO: 2618037 - RNA, 15 nt, Escherichia coli CFT073
gcaucagcuccggua

SEQ ID NO: 2618038 - RNA, 15 nt, Escherichia coli CFT073
gcaucaggcaaaaga

SEQ ID NO: 2618039 - RNA, 20 nt, Escherichia coli CFT073
gcaucaggcaacaucgccag

SEQ ID NO: 2618040 - RNA, 18 nt, Escherichia coli CFT073
gcaucaggcaacccagaa

SEQ ID NO: 2618041 - RNA, 18 nt, Escherichia coli CFT073
gcaucaggcaugauacgc

SEQ ID NO: 2618042 - RNA, 16 nt, Escherichia coli CFT073
gcaugaacaaagcuca

SEQ ID NO: 2618043 - RNA, 16 nt, Escherichia coli CFT073
gcaugaacauugcugc

SEQ ID NO: 2618044 - RNA, 13 nt, Escherichia coli CFT073
gcaugaacgccug

SEQ ID NO: 2618045 - RNA, 14 nt, Escherichia coli CFT073
gcaugaacgccuga

SEQ ID NO: 2618046 - RNA, 19 nt, Escherichia coli CFT073
gcaugaauaucaaguuuau

SEQ ID NO: 2618047 - RNA, 23 nt, Escherichia coli CFT073
gcaugacacacucugaccugucg

SEQ ID NO: 2618048 - RNA, 14 nt, Escherichia coli CFT073
gcaugacaggcaac

SEQ ID NO: 2618049 - RNA, 19 nt, Escherichia coli CFT073
gcaugauaccgauuacuca

SEQ ID NO: 2618050 - RNA, 15 nt, Escherichia coli CFT073
gcaugauacgccaau

SEQ ID NO: 2618051 - RNA, 12 nt, Escherichia coli CFT073
gcaugaucgaag

SEQ ID NO: 2618052 - RNA, 22 nt, Escherichia coli CFT073
gcaugaugacuugccuccagcg

SEQ ID NO: 2618053 - RNA, 20 nt, Escherichia coli CFT073
gcaugauguaagaugaaaua

SEQ ID NO: 2618054 - RNA, 18 nt, Escherichia coli CFT073
gcaugauuucaucaucag

SEQ ID NO: 2618055 - RNA, 12 nt, Escherichia coli CFT073
gcaugauuuuca

SEQ ID NO: 2618056 - RNA, 18 nt, Escherichia coli CFT073
gcaugcaggcaugcaaua

SEQ ID NO: 2618057 - RNA, 21 nt, Escherichia coli CFT073
gcaugcauuuucaauaacugg

SEQ ID NO: 2618058 - RNA, 15 nt, Escherichia coli CFT073
gcauggaagcgcagg

SEQ ID NO: 2618059 - RNA, 16 nt, Escherichia coli CFT073
gcauggaagcgcaggu

SEQ ID NO: 2618060 - RNA, 16 nt, Escherichia coli CFT073
gcauggaucgccgcgg

SEQ ID NO: 2618061 - RNA, 23 nt, Escherichia coli CFT073
gcaugggaacugcugaccagcga

SEQ ID NO: 2618062 - RNA, 14 nt, Escherichia coli CFT073
gcauggggagaccc

SEQ ID NO: 2618063 - RNA, 22 nt, Escherichia coli CFT073
gcauggguaaagcccaucgcca

SEQ ID NO: 2618064 - RNA, 15 nt, Escherichia coli CFT073
gcaugguagaaaucu

SEQ ID NO: 2618065 - RNA, 17 nt, Escherichia coli CFT073
gcauggucgcagcggcu

SEQ ID NO: 2618066 - RNA, 15 nt, Escherichia coli CFT073
gcauggugagcgcac

SEQ ID NO: 2618067 - RNA, 20 nt, Escherichia coli CFT073
gcauggugcuggcuuauuaa

SEQ ID NO: 2618068 - RNA, 16 nt, Escherichia coli CFT073
gcauggugucaccacc

SEQ ID NO: 2618069 - RNA, 22 nt, Escherichia coli CFT073
gcauguaacccuuugcggugca

SEQ ID NO: 2618070 - RNA, 22 nt, Escherichia coli CFT073
gcaugucaggcaguguucuggc

SEQ ID NO: 2618071 - RNA, 18 nt, Escherichia coli CFT073
gcauguuaugaauaucau

SEQ ID NO: 2618072 - RNA, 22 nt, Escherichia coli CFT073
gcauguucauaucaaaaccuaa

SEQ ID NO: 2618073 - RNA, 15 nt, Escherichia coli CFT073
gcauguucuuucggu

SEQ ID NO: 2618074 - RNA, 17 nt, Escherichia coli CFT073
gcauguuguuuucaacu

SEQ ID NO: 2618075 - RNA, 16 nt, Escherichia coli CFT073
gcauguuuaaccaagu

SEQ ID NO: 2618076 - RNA, 22 nt, Escherichia coli CFT073
gcauuaaaaagcccugcaggga

SEQ ID NO: 2618077 - RNA, 18 nt, Escherichia coli CFT073
gcauuaaauucagcaaau

SEQ ID NO: 2618078 - RNA, 22 nt, Escherichia coli CFT073
gcauuaacgaaacccgaaccac

SEQ ID NO: 2618079 - RNA, 14 nt, Escherichia coli CFT073
gcauuaacgcgaaa

SEQ ID NO: 2618080 - RNA, 21 nt, Escherichia coli CFT073
gcauuaacgcgaaauaaucaa

SEQ ID NO: 2618081 - RNA, 22 nt, Escherichia coli CFT073
gcauuaacucacuggcgcgcgc

SEQ ID NO: 2618082 - RNA, 22 nt, Escherichia coli CFT073
gcauuaacuccccuuuaaauua

SEQ ID NO: 2618083 - RNA, 19 nt, Escherichia coli CFT073
gcauuaaguguaaucagcc

SEQ ID NO: 2618084 - RNA, 17 nt, Escherichia coli CFT073
gcauuaauaugcucaac

SEQ ID NO: 2618085 - RNA, 18 nt, Escherichia coli CFT073
gcauuaauuaguaggccg

SEQ ID NO: 2618086 - RNA, 20 nt, Escherichia coli CFT073
gcauuaauuaguaggccgga

SEQ ID NO: 2618087 - RNA, 14 nt, Escherichia coli CFT073
gcauuaccucaaua

SEQ ID NO: 2618088 - RNA, 13 nt, Escherichia coli CFT073
gcauuacgcccga

SEQ ID NO: 2618089 - RNA, 21 nt, Escherichia coli CFT073
gcauuacgcucgcugcaaaac

SEQ ID NO: 2618090 - RNA, 17 nt, Escherichia coli CFT073
gcauuacggaacugcuc

SEQ ID NO: 2618091 - RNA, 24 nt, Escherichia coli CFT073
gcauuacggaacugcuccagggca

SEQ ID NO: 2618092 - RNA, 13 nt, Escherichia coli CFT073
gcauuacugcuau

SEQ ID NO: 2618093 - RNA, 18 nt, Escherichia coli CFT073
gcauuacuggcuguauau

SEQ ID NO: 2618094 - RNA, 15 nt, Escherichia coli CFT073
gcauuagcaguuacu

SEQ ID NO: 2618095 - RNA, 14 nt, Escherichia coli CFT073
gcauuagccaggca

SEQ ID NO: 2618096 - RNA, 15 nt, Escherichia coli CFT073
gcauuagugcgcagu

SEQ ID NO: 2618097 - RNA, 17 nt, Escherichia coli CFT073
gcauuauccucaaugaa

SEQ ID NO: 2618098 - RNA, 19 nt, Escherichia coli CFT073
gcauuauccucaaugaauc

SEQ ID NO: 2618099 - RNA, 14 nt, Escherichia coli CFT073
gcauuaucgagcug

SEQ ID NO: 2618100 - RNA, 15 nt, Escherichia coli CFT073
gcauuaucgagcugc

SEQ ID NO: 2618101 - RNA, 15 nt, Escherichia coli CFT073
gcauuauggcgcagu

SEQ ID NO: 2618102 - RNA, 14 nt, Escherichia coli CFT073
gcauuauggugaag

SEQ ID NO: 2618103 - RNA, 22 nt, Escherichia coli CFT073
gcauuauucaggcacuuucgcg

SEQ ID NO: 2618104 - RNA, 16 nt, Escherichia coli CFT073
gcauucacgggcggcg

SEQ ID NO: 2618105 - RNA, 14 nt, Escherichia coli CFT073
gcauucaugaacac

SEQ ID NO: 2618106 - RNA, 18 nt, Escherichia coli CFT073
gcauucaugcgaauacag

SEQ ID NO: 2618107 - RNA, 13 nt, Escherichia coli CFT073
gcauuccagucca

SEQ ID NO: 2618108 - RNA, 14 nt, Escherichia coli CFT073
gcauucccgccacc

SEQ ID NO: 2618109 - RNA, 21 nt, Escherichia coli CFT073
gcauucgccguuaccagcacc

SEQ ID NO: 2618110 - RNA, 16 nt, Escherichia coli CFT073
gcauucggcauugaau

SEQ ID NO: 2618111 - RNA, 22 nt, Escherichia coli CFT073
gcauucucccgccugcggggag

SEQ ID NO: 2618112 - RNA, 19 nt, Escherichia coli CFT073
gcauucucuuuucacgcaa

SEQ ID NO: 2618113 - RNA, 22 nt, Escherichia coli CFT073
gcauugacgauaucgauaaaga

SEQ ID NO: 2618114 - RNA, 20 nt, Escherichia coli CFT073
gcauugaggguauccaggcc

SEQ ID NO: 2618115 - RNA, 17 nt, Escherichia coli CFT073
gcauugauggaguaguu

SEQ ID NO: 2618116 - RNA, 18 nt, Escherichia coli CFT073
gcauugauuuuaauaaau

SEQ ID NO: 2618117 - RNA, 12 nt, Escherichia coli CFT073
gcauugccagca

SEQ ID NO: 2618118 - RNA, 15 nt, Escherichia coli CFT073
gcauugcgccagcga

SEQ ID NO: 2618119 - RNA, 17 nt, Escherichia coli CFT073
gcauugcucccugcggc

SEQ ID NO: 2618120 - RNA, 22 nt, Escherichia coli CFT073
gcauugcuuuuguggucaccau

SEQ ID NO: 2618121 - RNA, 13 nt, Escherichia coli CFT073
gcauuggcaauca

SEQ ID NO: 2618122 - RNA, 20 nt, Escherichia coli CFT073
gcauugucaggaucaccaau

SEQ ID NO: 2618123 - RNA, 22 nt, Escherichia coli CFT073
gcauugucaggaucaccaauac

SEQ ID NO: 2618124 - RNA, 19 nt, Escherichia coli CFT073
gcauugucugaacguucug

SEQ ID NO: 2618125 - RNA, 20 nt, Escherichia coli CFT073
gcauugucugaacguucugc

SEQ ID NO: 2618126 - RNA, 15 nt, Escherichia coli CFT073
gcauuuaaacgagaa

SEQ ID NO: 2618127 - RNA, 17 nt, Escherichia coli CFT073
gcauuuaaccgccgagc

SEQ ID NO: 2618128 - RNA, 21 nt, Escherichia coli CFT073
gcauuuacgccgcauccggca

SEQ ID NO: 2618129 - RNA, 13 nt, Escherichia coli CFT073
gcauuuccaccga

SEQ ID NO: 2618130 - RNA, 17 nt, Escherichia coli CFT073
gcauuucccagcaagaa

SEQ ID NO: 2618131 - RNA, 18 nt, Escherichia coli CFT073
gcauuuccgcugauucaa

SEQ ID NO: 2618132 - RNA, 17 nt, Escherichia coli CFT073
gcauuuccucaacaucu

SEQ ID NO: 2618133 - RNA, 13 nt, Escherichia coli CFT073
gcauuucggcuuu

SEQ ID NO: 2618134 - RNA, 22 nt, Escherichia coli CFT073
gcauuucgugcggguaaccagc

SEQ ID NO: 2618135 - RNA, 21 nt, Escherichia coli CFT073
gcauuucuccgcguucaauac

SEQ ID NO: 2618136 - RNA, 20 nt, Escherichia coli CFT073
gcauuucuggaaugcggaga

SEQ ID NO: 2618137 - RNA, 23 nt, Escherichia coli CFT073
gcauuucuuuuauggucaucguu

SEQ ID NO: 2618138 - RNA, 21 nt, Escherichia coli CFT073
gcauuugccgcugggccauca

SEQ ID NO: 2618139 - RNA, 15 nt, Escherichia coli CFT073
gcauuugcggcagag

SEQ ID NO: 2618140 - RNA, 16 nt, Escherichia coli CFT073
gcauuugucuguuucu

SEQ ID NO: 2618141 - RNA, 14 nt, Escherichia coli CFT073
gcauuuucagcguu

SEQ ID NO: 2618142 - RNA, 21 nt, Escherichia coli CFT073
gcauuuucuaugcugccacac

SEQ ID NO: 2618143 - RNA, 16 nt, Escherichia coli CFT073
gcauuuucucacuggc

SEQ ID NO: 2618144 - RNA, 23 nt, Escherichia coli CFT073
gcauuuucucgugccgccaguac

SEQ ID NO: 2618145 - RNA, 15 nt, Escherichia coli CFT073
gcauuuucugcgcau

SEQ ID NO: 2618146 - RNA, 12 nt, Escherichia coli CFT073
gcauuuucuucc

SEQ ID NO: 2618147 - RNA, 20 nt, Escherichia coli CFT073
gcauuuuuuauggagaaaac

SEQ ID NO: 2618148 - RNA, 21 nt, Escherichia coli CFT073
gcauuuuuuauggagaaaaca

SEQ ID NO: 2618149 - RNA, 22 nt, Escherichia coli CFT073
gcauuuuuuauggagaaaacau

SEQ ID NO: 2618150 - RNA, 14 nt, Escherichia coli CFT073
gccacauccagcgg

SEQ ID NO: 2618151 - RNA, 15 nt, Escherichia coli CFT073
gccacauccagcggc

SEQ ID NO: 2618152 - RNA, 22 nt, Escherichia coli CFT073
gccacauccccuccccggcggc

SEQ ID NO: 2618153 - RNA, 13 nt, Escherichia coli CFT073
gccacauccggca

SEQ ID NO: 2618154 - RNA, 15 nt, Escherichia coli CFT073
gccacauggcgugca

SEQ ID NO: 2618155 - RNA, 17 nt, Escherichia coli CFT073
gccacauuucucuguca

SEQ ID NO: 2618156 - RNA, 19 nt, Escherichia coli CFT073
gccacauuucucugucagg

SEQ ID NO: 2618157 - RNA, 16 nt, Escherichia coli CFT073
gccaccaacaguaauu

SEQ ID NO: 2618158 - RNA, 14 nt, Escherichia coli CFT073
gccaccacaaaagc

SEQ ID NO: 2618159 - RNA, 13 nt, Escherichia coli CFT073
gccaccacaacau

SEQ ID NO: 2618160 - RNA, 23 nt, Escherichia coli CFT073
gccaccacaacauucccaucagu

SEQ ID NO: 2618161 - RNA, 13 nt, Escherichia coli CFT073
gccaccaccagcg

SEQ ID NO: 2618162 - RNA, 16 nt, Escherichia coli CFT073
gccaccaccucuucca

SEQ ID NO: 2618163 - RNA, 20 nt, Escherichia coli CFT073
gccaccaccucuuccagcga

SEQ ID NO: 2618164 - RNA, 14 nt, Escherichia coli CFT073
gccaccacgcccag

SEQ ID NO: 2618165 - RNA, 15 nt, Escherichia coli CFT073
gccaccacguucagg

SEQ ID NO: 2618166 - RNA, 18 nt, Escherichia coli CFT073
ucaccaaucugaaaccag

SEQ ID NO: 2618167 - RNA, 14 nt, Escherichia coli CFT073
ucaccaaugacagc

SEQ ID NO: 2618168 - RNA, 22 nt, Escherichia coli CFT073
ucaccaaugacagccccaccag

SEQ ID NO: 2618169 - RNA, 23 nt, Escherichia coli CFT073
ucaccaaugacagccccaccagc

SEQ ID NO: 2618170 - RNA, 21 nt, Escherichia coli CFT073
ucaccaauguugucgcagacg

SEQ ID NO: 2618171 - RNA, 16 nt, Escherichia coli CFT073
ucaccaauuuuaaaac

SEQ ID NO: 2618172 - RNA, 17 nt, Escherichia coli CFT073
ucaccacagacaaacag

SEQ ID NO: 2618173 - RNA, 18 nt, Escherichia coli CFT073
ucaccacauucagcagcc

SEQ ID NO: 2618174 - RNA, 19 nt, Escherichia coli CFT073
ucaccacauucagcagccc

SEQ ID NO: 2618175 - RNA, 15 nt, Escherichia coli CFT073
ucaccaccagcaccg

SEQ ID NO: 2618176 - RNA, 19 nt, Escherichia coli CFT073
ucaccacccagcgguaaaa

SEQ ID NO: 2618177 - RNA, 20 nt, Escherichia coli CFT073
ucaccacccagcgguaaaau

SEQ ID NO: 2618178 - RNA, 16 nt, Escherichia coli CFT073
ucaccaccgcaaucgc

SEQ ID NO: 2618179 - RNA, 21 nt, Escherichia coli CFT073
ucaccaccgcaaucgcggcag

SEQ ID NO: 2618180 - RNA, 17 nt, Escherichia coli CFT073
ucaccaccuggcggcgu

SEQ ID NO: 2618181 - RNA, 15 nt, Escherichia coli CFT073
ucaccaccuggguga

SEQ ID NO: 2618182 - RNA, 23 nt, Escherichia coli CFT073
ucaccacgccccacgccauaacc

SEQ ID NO: 2618183 - RNA, 19 nt, Escherichia coli CFT073
ucaccacgccgagagaagc

SEQ ID NO: 2618184 - RNA, 18 nt, Escherichia coli CFT073
ucaccacguuagcaaaug

SEQ ID NO: 2618185 - RNA, 16 nt, Escherichia coli CFT073
ucaccacuaccguguc

SEQ ID NO: 2618186 - RNA, 18 nt, Escherichia coli CFT073
ucaccacuaccgugucug

SEQ ID NO: 2618187 - RNA, 22 nt, Escherichia coli CFT073
ucaccacuucggcaaaaaaguc

SEQ ID NO: 2618188 - RNA, 18 nt, Escherichia coli CFT073
ucaccacuuuauagcuuu

SEQ ID NO: 2618189 - RNA, 21 nt, Escherichia coli CFT073
ucaccagaauagcggcuucau

SEQ ID NO: 2618190 - RNA, 14 nt, Escherichia coli CFT073
ucaccagacaucaa

SEQ ID NO: 2618191 - RNA, 20 nt, Escherichia coli CFT073
ucaccagacaucaaguaacc

SEQ ID NO: 2618192 - RNA, 11 nt, Escherichia coli CFT073
ucaccagaccc

SEQ ID NO: 2618193 - RNA, 18 nt, Escherichia coli CFT073
ucaccagaggaugcaggu

SEQ ID NO: 2618194 - RNA, 20 nt, Escherichia coli CFT073
ucaccagcaaauccagcggu

SEQ ID NO: 2618195 - RNA, 18 nt, Escherichia coli CFT073
ucaccagcaucgcuucca

SEQ ID NO: 2618196 - RNA, 15 nt, Escherichia coli CFT073
ucaccagcauuagca

SEQ ID NO: 2618197 - RNA, 18 nt, Escherichia coli CFT073
ucaccagcauuagcauua

SEQ ID NO: 2618198 - RNA, 19 nt, Escherichia coli CFT073
ucaccagcgcauugacgau

SEQ ID NO: 2618199 - RNA, 19 nt, Escherichia coli CFT073
ucaccagcgcgaggaucac

SEQ ID NO: 2618200 - RNA, 22 nt, Escherichia coli CFT073
ucaccagcgcgaggaucacgca

SEQ ID NO: 2618201 - RNA, 12 nt, Escherichia coli CFT073
ucaccagcguca

SEQ ID NO: 2618202 - RNA, 16 nt, Escherichia coli CFT073
ucaccaggucaccaga

SEQ ID NO: 2618203 - RNA, 15 nt, Escherichia coli CFT073
ucaccagguucgcca

SEQ ID NO: 2618204 - RNA, 22 nt, Escherichia coli CFT073
ucaccaguaacuuccccuuuca

SEQ ID NO: 2618205 - RNA, 16 nt, Escherichia coli CFT073
ucaccaguaaggcauc

SEQ ID NO: 2618206 - RNA, 20 nt, Escherichia coli CFT073
ucaccaguaaggcaucuucu

SEQ ID NO: 2618207 - RNA, 23 nt, Escherichia coli CFT073
ucaccaguaaggcaucuucuuca

SEQ ID NO: 2618208 - RNA, 23 nt, Escherichia coli CFT073
ucaccaguaccgccaccaccaga

SEQ ID NO: 2618209 - RNA, 22 nt, Escherichia coli CFT073
ucaccaguaccgccgccauaaa

SEQ ID NO: 2618210 - RNA, 14 nt, Escherichia coli CFT073
ucaccagugaucug

SEQ ID NO: 2618211 - RNA, 17 nt, Escherichia coli CFT073
ucaccaguugugaugcc

SEQ ID NO: 2618212 - RNA, 20 nt, Escherichia coli CFT073
ucaccaguugugaugccacu

SEQ ID NO: 2618213 - RNA, 22 nt, Escherichia coli CFT073
ucaccaguuguugcgugaaagu

SEQ ID NO: 2618214 - RNA, 16 nt, Escherichia coli CFT073
ucaccauauucagcag

SEQ ID NO: 2618215 - RNA, 17 nt, Escherichia coli CFT073
ucaccauauucagcagc

SEQ ID NO: 2618216 - RNA, 18 nt, Escherichia coli CFT073
ucaccauauucagcagca

SEQ ID NO: 2618217 - RNA, 17 nt, Escherichia coli CFT073
ucaccaucaaguagcag

SEQ ID NO: 2618218 - RNA, 20 nt, Escherichia coli CFT073
ucaccauccugaucgccauc

SEQ ID NO: 2618219 - RNA, 21 nt, Escherichia coli CFT073
ucaccaucgcaaacagcacau

SEQ ID NO: 2618220 - RNA, 22 nt, Escherichia coli CFT073
ucaccaucgcaaacagcacauc

SEQ ID NO: 2618221 - RNA, 14 nt, Escherichia coli CFT073
ucaccaucuucacu

SEQ ID NO: 2618222 - RNA, 20 nt, Escherichia coli CFT073
ucaccaucuucacuguccgc

SEQ ID NO: 2618223 - RNA, 23 nt, Escherichia coli CFT073
ucaccaugauuucguauacugca

SEQ ID NO: 2618224 - RNA, 14 nt, Escherichia coli CFT073
ucaccauuggcauu

SEQ ID NO: 2618225 - RNA, 12 nt, Escherichia coli CFT073
ucacccaacaau

SEQ ID NO: 2618226 - RNA, 13 nt, Escherichia coli CFT073
ucacccacacuuc

SEQ ID NO: 2618227 - RNA, 18 nt, Escherichia coli CFT073
ucacccacgguuacgcua

SEQ ID NO: 2618228 - RNA, 20 nt, Escherichia coli CFT073
ucacccagcguuugcugcuu

SEQ ID NO: 2618229 - RNA, 17 nt, Escherichia coli CFT073
ucacccagucccaccau

SEQ ID NO: 2618230 - RNA, 20 nt, Escherichia coli CFT073
ucaccccguugcuucgccgc

SEQ ID NO: 2618231 - RNA, 20 nt, Escherichia coli CFT073
ucacccgagagaacugcugc

SEQ ID NO: 2618232 - RNA, 16 nt, Escherichia coli CFT073
ucacccgauaaauaau

SEQ ID NO: 2618233 - RNA, 20 nt, Escherichia coli CFT073
ucagauuauucaaaaacaga

SEQ ID NO: 2618234 - RNA, 13 nt, Escherichia coli CFT073
ucagauucaaauc

SEQ ID NO: 2618235 - RNA, 18 nt, Escherichia coli CFT073
ucagauucggauccagca

SEQ ID NO: 2618236 - RNA, 17 nt, Escherichia coli CFT073
ucagauugaugcgagua

SEQ ID NO: 2618237 - RNA, 22 nt, Escherichia coli CFT073
ucagauuguagugauccugcau

SEQ ID NO: 2618238 - RNA, 15 nt, Escherichia coli CFT073
ucagauuuacggugu

SEQ ID NO: 2618239 - RNA, 18 nt, Escherichia coli CFT073
ucagcaaaauaacaggga

SEQ ID NO: 2618240 - RNA, 18 nt, Escherichia coli CFT073
ucagcaaaauacugaaca

SEQ ID NO: 2618241 - RNA, 14 nt, Escherichia coli CFT073
ucagcaacgcugac

SEQ ID NO: 2618242 - RNA, 15 nt, Escherichia coli CFT073
ucagcaagagguaaa

SEQ ID NO: 2618243 - RNA, 18 nt, Escherichia coli CFT073
ucagcaagaguuuuaaaa

SEQ ID NO: 2618244 - RNA, 17 nt, Escherichia coli CFT073
ucagcaaggcuuuccag

SEQ ID NO: 2618245 - RNA, 16 nt, Escherichia coli CFT073
ucagcaauaaaaaaau

SEQ ID NO: 2618246 - RNA, 14 nt, Escherichia coli CFT073
ucagcaauaaucag

SEQ ID NO: 2618247 - RNA, 14 nt, Escherichia coli CFT073
ucagcaauacgcuu

SEQ ID NO: 2618248 - RNA, 21 nt, Escherichia coli CFT073
ucagcaauauaggccgccgau

SEQ ID NO: 2618249 - RNA, 14 nt, Escherichia coli CFT073
ucagcaaugccaga

SEQ ID NO: 2618250 - RNA, 15 nt, Escherichia coli CFT073
ucagcaauuucuccg

SEQ ID NO: 2618251 - RNA, 21 nt, Escherichia coli CFT073
ucagcacacauaacagcggga

SEQ ID NO: 2618252 - RNA, 14 nt, Escherichia coli CFT073
ucagcacagagaua

SEQ ID NO: 2618253 - RNA, 12 nt, Escherichia coli CFT073
ucagcaccagau

SEQ ID NO: 2618254 - RNA, 17 nt, Escherichia coli CFT073
ucagcacgacauaagcg

SEQ ID NO: 2618255 - RNA, 16 nt, Escherichia coli CFT073
ucagcacgccacucac

SEQ ID NO: 2618256 - RNA, 19 nt, Escherichia coli CFT073
ucagcacgguguuaccgua

SEQ ID NO: 2618257 - RNA, 22 nt, Escherichia coli CFT073
ucagcacguuuaacacgcucug

SEQ ID NO: 2618258 - RNA, 14 nt, Escherichia coli CFT073
ucagcacuacugcc

SEQ ID NO: 2618259 - RNA, 21 nt, Escherichia coli CFT073
ucagcacuacugccagauucu

SEQ ID NO: 2618260 - RNA, 18 nt, Escherichia coli CFT073
ucagcacucacgccaggc

SEQ ID NO: 2618261 - RNA, 14 nt, Escherichia coli CFT073
ucagcacuggcggc

SEQ ID NO: 2618262 - RNA, 21 nt, Escherichia coli CFT073
ucagcacuggcggcagcaggu

SEQ ID NO: 2618263 - RNA, 20 nt, Escherichia coli CFT073
ucagcagauaucccgccagc

SEQ ID NO: 2618264 - RNA, 15 nt, Escherichia coli CFT073
ucagcagauggcaga

SEQ ID NO: 2618265 - RNA, 16 nt, Escherichia coli CFT073
ucagcagauggcagac

SEQ ID NO: 2618266 - RNA, 16 nt, Escherichia coli CFT073
ucagcagcaauauguu

SEQ ID NO: 2618267 - RNA, 18 nt, Escherichia coli CFT073
ucagcagcagaauuggca

SEQ ID NO: 2618268 - RNA, 17 nt, Escherichia coli CFT073
ucagcagcagacagccu

SEQ ID NO: 2618269 - RNA, 13 nt, Escherichia coli CFT073
ucagcagcggcac

SEQ ID NO: 2618270 - RNA, 20 nt, Escherichia coli CFT073
ucagcagcggcacguucgau

SEQ ID NO: 2618271 - RNA, 16 nt, Escherichia coli CFT073
ucagcagcguucccag

SEQ ID NO: 2618272 - RNA, 18 nt, Escherichia coli CFT073
ucagcagcguucccagcc

SEQ ID NO: 2618273 - RNA, 12 nt, Escherichia coli CFT073
ucagcaggcugc

SEQ ID NO: 2618274 - RNA, 17 nt, Escherichia coli CFT073
ucagcaggcugcgcgcu

SEQ ID NO: 2618275 - RNA, 16 nt, Escherichia coli CFT073
ucagcaguucugccag

SEQ ID NO: 2618276 - RNA, 16 nt, Escherichia coli CFT073
ucagcauacuccagcc

SEQ ID NO: 2618277 - RNA, 18 nt, Escherichia coli CFT073
ucagcauaugcuucuucc

SEQ ID NO: 2618278 - RNA, 20 nt, Escherichia coli CFT073
ucagcauauuuggcgcuggc

SEQ ID NO: 2618279 - RNA, 17 nt, Escherichia coli CFT073
ucagcaucaaugaccug

SEQ ID NO: 2618280 - RNA, 14 nt, Escherichia coli CFT073
ucagcaucagggag

SEQ ID NO: 2618281 - RNA, 17 nt, Escherichia coli CFT073
ucagcaucccaccugaa

SEQ ID NO: 2618282 - RNA, 12 nt, Escherichia coli CFT073
ucagcaugacaa

SEQ ID NO: 2618283 - RNA, 16 nt, Escherichia coli CFT073
ucagcaugacaaaaaa

SEQ ID NO: 2618284 - RNA, 15 nt, Escherichia coli CFT073
ucagcaugucuugcc

SEQ ID NO: 2618285 - RNA, 19 nt, Escherichia coli CFT073
ucagcaugucuugccuccc

SEQ ID NO: 2618286 - RNA, 20 nt, Escherichia coli CFT073
ucagcauuucgcgauauugc

SEQ ID NO: 2618287 - RNA, 21 nt, Escherichia coli CFT073
ucagccaaagcgacacaauca

SEQ ID NO: 2618288 - RNA, 16 nt, Escherichia coli CFT073
ucagccaaauccagcg

SEQ ID NO: 2618289 - RNA, 19 nt, Escherichia coli CFT073
ucagccacacuuaauaacg

SEQ ID NO: 2618290 - RNA, 21 nt, Escherichia coli CFT073
ucagccacuucaaccagcggc

SEQ ID NO: 2618291 - RNA, 20 nt, Escherichia coli CFT073
ucagccacuucauuuaugga

SEQ ID NO: 2618292 - RNA, 22 nt, Escherichia coli CFT073
ucagccagggauaagccagacc

SEQ ID NO: 2618293 - RNA, 19 nt, Escherichia coli CFT073
ucagccaguaaaccaauca

SEQ ID NO: 2618294 - RNA, 20 nt, Escherichia coli CFT073
ucagccagugcuucgcggac

SEQ ID NO: 2618295 - RNA, 19 nt, Escherichia coli CFT073
ucagccaucgccaccgcuu

SEQ ID NO: 2618296 - RNA, 23 nt, Escherichia coli CFT073
ucagcccaaaaauugcccccagu

SEQ ID NO: 2618297 - RNA, 13 nt, Escherichia coli CFT073
ucagcccaaccac

SEQ ID NO: 2618298 - RNA, 23 nt, Escherichia coli CFT073
ucagccccagacguuucgccagc

SEQ ID NO: 2618299 - RNA, 17 nt, Escherichia coli CFT073
ucagccccuucgccagu

SEQ ID NO: 2618300 - RNA, 22 nt, Escherichia coli CFT073
ucagcccggcaacguugccagu

SEQ ID NO: 2618301 - RNA, 15 nt, Escherichia coli CFT073
ucagcccugcccaga

SEQ ID NO: 2618302 - RNA, 22 nt, Escherichia coli CFT073
ucagcccuucccggugcgcaga

SEQ ID NO: 2618303 - RNA, 16 nt, Escherichia coli CFT073
ucagcccuucuuuaug

SEQ ID NO: 2618304 - RNA, 17 nt, Escherichia coli CFT073
ucagcccuuuuggcaca

SEQ ID NO: 2618305 - RNA, 16 nt, Escherichia coli CFT073
ucagccgagcuucaau

SEQ ID NO: 2618306 - RNA, 14 nt, Escherichia coli CFT073
ucagccgcaaacuc

SEQ ID NO: 2618307 - RNA, 14 nt, Escherichia coli CFT073
ucagccgcaaacuu

SEQ ID NO: 2618308 - RNA, 18 nt, Escherichia coli CFT073
ucagccguauccaggccc

SEQ ID NO: 2618309 - RNA, 15 nt, Escherichia coli CFT073
ucagccuuaaucuuc

SEQ ID NO: 2618310 - RNA, 21 nt, Escherichia coli CFT073
ucagccuucuguaaccuuuuc

SEQ ID NO: 2618311 - RNA, 15 nt, Escherichia coli CFT073
ucagccuucuugcug

SEQ ID NO: 2618312 - RNA, 14 nt, Escherichia coli CFT073
ucagcgaacaccag

SEQ ID NO: 2618313 - RNA, 20 nt, Escherichia coli CFT073
ucagcgaacgacauccgcca

SEQ ID NO: 2618314 - RNA, 14 nt, Escherichia coli CFT073
ucagcgaagucaca

SEQ ID NO: 2618315 - RNA, 16 nt, Escherichia coli CFT073
ucagcgaagucacaaa

SEQ ID NO: 2618316 - RNA, 22 nt, Escherichia coli CFT073
ucagcgagacgugcguaccauu

SEQ ID NO: 2618317 - RNA, 23 nt, Escherichia coli CFT073
ucagcgagggcuaugcgcaucaa

SEQ ID NO: 2618318 - RNA, 16 nt, Escherichia coli CFT073
ucagcgaucagcauuu

SEQ ID NO: 2618319 - RNA, 14 nt, Escherichia coli CFT073
ucagcgcaaagagu

SEQ ID NO: 2618320 - RNA, 16 nt, Escherichia coli CFT073
ucagcgcaaucugcuu

SEQ ID NO: 2618321 - RNA, 13 nt, Escherichia coli CFT073
ucagcgcaccaca

SEQ ID NO: 2618322 - RNA, 13 nt, Escherichia coli CFT073
ucagcgcaccaua

SEQ ID NO: 2618323 - RNA, 23 nt, Escherichia coli CFT073
ucagcgcacuuucacccugacug

SEQ ID NO: 2618324 - RNA, 13 nt, Escherichia coli CFT073
ucagcgcagcacc

SEQ ID NO: 2618325 - RNA, 14 nt, Escherichia coli CFT073
ucagcgcagcgcga

SEQ ID NO: 2618326 - RNA, 13 nt, Escherichia coli CFT073
ucagcgcaugauu

SEQ ID NO: 2618327 - RNA, 13 nt, Escherichia coli CFT073
ucagcgccaccac

SEQ ID NO: 2618328 - RNA, 14 nt, Escherichia coli CFT073
ucagcgccacggaa

SEQ ID NO: 2618329 - RNA, 16 nt, Escherichia coli CFT073
ucagcgccacggaaac

SEQ ID NO: 2618330 - RNA, 23 nt, Escherichia coli CFT073
ucagcgccagcuucgaggccgga

SEQ ID NO: 2618331 - RNA, 16 nt, Escherichia coli CFT073
ucagcgccauccccac

SEQ ID NO: 2618332 - RNA, 17 nt, Escherichia coli CFT073
ucagcgccaucgccagg

SEQ ID NO: 2618333 - RNA, 19 nt, Escherichia coli CFT073
ucagcgccaucgccaggaa

SEQ ID NO: 2618334 - RNA, 21 nt, Escherichia coli CFT073
ucagcgccguagccauuacca

SEQ ID NO: 2618335 - RNA, 22 nt, Escherichia coli CFT073
ucagcgccugcugcacaccaua

SEQ ID NO: 2618336 - RNA, 20 nt, Escherichia coli CFT073
ucagcgcggaacaagucggc

SEQ ID NO: 2618337 - RNA, 19 nt, Escherichia coli CFT073
ucagcgcggggaucacugg

SEQ ID NO: 2618338 - RNA, 17 nt, Escherichia coli CFT073
ucagcgcuaccagagcc

SEQ ID NO: 2618339 - RNA, 19 nt, Escherichia coli CFT073
ucagcgcuaccagagccgc

SEQ ID NO: 2618340 - RNA, 20 nt, Escherichia coli CFT073
ucagcggcguaucuuccagg

SEQ ID NO: 2618341 - RNA, 15 nt, Escherichia coli CFT073
ucagcgggcagggca

SEQ ID NO: 2618342 - RNA, 17 nt, Escherichia coli CFT073
ucagcgggcagggcauc

SEQ ID NO: 2618343 - RNA, 17 nt, Escherichia coli CFT073
ucagcggucaccggaac

SEQ ID NO: 2618344 - RNA, 19 nt, Escherichia coli CFT073
ucagcggugccgcgauacc

SEQ ID NO: 2618345 - RNA, 16 nt, Escherichia coli CFT073
ucagcgguggugaaaa

SEQ ID NO: 2618346 - RNA, 19 nt, Escherichia coli CFT073
ucagcgguggugaaaagag

SEQ ID NO: 2618347 - RNA, 20 nt, Escherichia coli CFT073
ucagcgguuuugccagcgag

SEQ ID NO: 2618348 - RNA, 21 nt, Escherichia coli CFT073
ucagcgucgccagcagcucac

SEQ ID NO: 2618349 - RNA, 16 nt, Escherichia coli CFT073
ucagcgucgcguuuuu

SEQ ID NO: 2618350 - RNA, 17 nt, Escherichia coli CFT073
ucagcgucucaacaaac

SEQ ID NO: 2618351 - RNA, 12 nt, Escherichia coli CFT073
ucagcgugccca

SEQ ID NO: 2618352 - RNA, 13 nt, Escherichia coli CFT073
ucagcgugcccac

SEQ ID NO: 2618353 - RNA, 16 nt, Escherichia coli CFT073
ucagcguuaauucaaa

SEQ ID NO: 2618354 - RNA, 14 nt, Escherichia coli CFT073
ucagcguuccccag

SEQ ID NO: 2618355 - RNA, 15 nt, Escherichia coli CFT073
ucagcguuccccaga

SEQ ID NO: 2618356 - RNA, 18 nt, Escherichia coli CFT073
ucagcguuucuuccagcc

SEQ ID NO: 2618357 - RNA, 17 nt, Escherichia coli CFT073
ucagcuaacaaaaauau

SEQ ID NO: 2618358 - RNA, 20 nt, Escherichia coli CFT073
ucagcucauaggccugcuga

SEQ ID NO: 2618359 - RNA, 15 nt, Escherichia coli CFT073
ucagcucauccagcg

SEQ ID NO: 2618360 - RNA, 19 nt, Escherichia coli CFT073
ucagcuccacaagaaugcc

SEQ ID NO: 2618361 - RNA, 14 nt, Escherichia coli CFT073
ucagcuccggcagc

SEQ ID NO: 2618362 - RNA, 15 nt, Escherichia coli CFT073
ucagcuccgguauac

SEQ ID NO: 2618363 - RNA, 13 nt, Escherichia coli CFT073
ucagcugccaggg

SEQ ID NO: 2618364 - RNA, 15 nt, Escherichia coli CFT073
ucagcuuauccagca

SEQ ID NO: 2618365 - RNA, 20 nt, Escherichia coli CFT073
ucagcuuccuugcugauuuu

SEQ ID NO: 2618366 - RNA, 22 nt, Escherichia coli CFT073
ucagcuuccuugcugauuuuau

SEQ ID NO: 2618367 - RNA, 22 nt, Escherichia coli CFT073
ucagcuucggcgacuauuucaa

SEQ ID NO: 2618368 - RNA, 15 nt, Escherichia coli CFT073
ucagcuuucaccaga

SEQ ID NO: 2618369 - RNA, 18 nt, Escherichia coli CFT073
ucaggaaaaacggaauga

SEQ ID NO: 2618370 - RNA, 12 nt, Escherichia coli CFT073
ucaggaaauaaa

SEQ ID NO: 2618371 - RNA, 21 nt, Escherichia coli CFT073
ucaggaacauccccugcgcgc

SEQ ID NO: 2618372 - RNA, 17 nt, Escherichia coli CFT073
ucaggaagaagcccauc

SEQ ID NO: 2618373 - RNA, 15 nt, Escherichia coli CFT073
ucaggaaggcgauau

SEQ ID NO: 2618374 - RNA, 15 nt, Escherichia coli CFT073
ucaggaauaagacag

SEQ ID NO: 2618375 - RNA, 12 nt, Escherichia coli CFT073
ucaggacccuca

SEQ ID NO: 2618376 - RNA, 14 nt, Escherichia coli CFT073
ucaggaucaagcug

SEQ ID NO: 2618377 - RNA, 13 nt, Escherichia coli CFT073
ucaggaucaccaa

SEQ ID NO: 2618378 - RNA, 14 nt, Escherichia coli CFT073
ucaggaucaccaau

SEQ ID NO: 2618379 - RNA, 21 nt, Escherichia coli CFT073
ucaggaucagccauuuugcac

SEQ ID NO: 2618380 - RNA, 21 nt, Escherichia coli CFT073
ucaggaucaucauuguugguu

SEQ ID NO: 2618381 - RNA, 18 nt, Escherichia coli CFT073
ucaggaugugagcuggcg

SEQ ID NO: 2618382 - RNA, 18 nt, Escherichia coli CFT073
ucaggauuuccagcucaa

SEQ ID NO: 2618383 - RNA, 22 nt, Escherichia coli CFT073
ucaggcaaagcuguuucagugu

SEQ ID NO: 2618384 - RNA, 12 nt, Escherichia coli CFT073
ucaggcaacaaa

SEQ ID NO: 2618385 - RNA, 17 nt, Escherichia coli CFT073
ucaggcaacccagaaga

SEQ ID NO: 2618386 - RNA, 17 nt, Escherichia coli CFT073
ucaggcaacggcaucaa

SEQ ID NO: 2618387 - RNA, 12 nt, Escherichia coli CFT073
ucaggcaauggg

SEQ ID NO: 2618388 - RNA, 13 nt, Escherichia coli CFT073
ucaggcagaacac

SEQ ID NO: 2618389 - RNA, 22 nt, Escherichia coli CFT073
ucaggcagaacaccggcagcgg

SEQ ID NO: 2618390 - RNA, 20 nt, Escherichia coli CFT073
ucaggcagaacgccaugcca

SEQ ID NO: 2618391 - RNA, 21 nt, Escherichia coli CFT073
ucaggcagaacgccaugccaa

SEQ ID NO: 2618392 - RNA, 18 nt, Escherichia coli CFT073
ucaggcagaagagaagaa

SEQ ID NO: 2618393 - RNA, 17 nt, Escherichia coli CFT073
ucaggcagucgugccca

SEQ ID NO: 2618394 - RNA, 12 nt, Escherichia coli CFT073
ucaggcagucug

SEQ ID NO: 2618395 - RNA, 17 nt, Escherichia coli CFT073
ucaggcaguuuugcguu

SEQ ID NO: 2618396 - RNA, 20 nt, Escherichia coli CFT073
ucaggcaucgugcaccaauu

SEQ ID NO: 2618397 - RNA, 21 nt, Escherichia coli CFT073
ucaggcauuguguagggcagc

SEQ ID NO: 2618398 - RNA, 20 nt, Escherichia coli CFT073
ucaggccaaacuacgcugcg

SEQ ID NO: 2618399 - RNA, 21 nt, Escherichia coli CFT073
ucaggccaaagccgccgagca

SEQ ID NO: 2618400 - RNA, 21 nt, Escherichia coli CFT073
ucaggccaacauccaucagcg

SEQ ID NO: 2618401 - RNA, 13 nt, Escherichia coli CFT073
ucaggccaaggcc

SEQ ID NO: 2618402 - RNA, 18 nt, Escherichia coli CFT073
ucaggccaaucaaaccca

SEQ ID NO: 2618403 - RNA, 19 nt, Escherichia coli CFT073
ucaggccaaucaaacccac

SEQ ID NO: 2618404 - RNA, 20 nt, Escherichia coli CFT073
ucaggccaggcgugaaucac

SEQ ID NO: 2618405 - RNA, 20 nt, Escherichia coli CFT073
ucaggcccgcguagagaaaa

SEQ ID NO: 2618406 - RNA, 15 nt, Escherichia coli CFT073
ucaggccgauuucau

SEQ ID NO: 2618407 - RNA, 18 nt, Escherichia coli CFT073
ucaggccuacaugccauc

SEQ ID NO: 2618408 - RNA, 18 nt, Escherichia coli CFT073
ucaggccuacgccagaca

SEQ ID NO: 2618409 - RNA, 18 nt, Escherichia coli CFT073
ucaggccuacgucagaca

SEQ ID NO: 2618410 - RNA, 19 nt, Escherichia coli CFT073
ucaggccuacgugauuccu

SEQ ID NO: 2618411 - RNA, 21 nt, Escherichia coli CFT073
ucaggccuacgugauuccugc

SEQ ID NO: 2618412 - RNA, 16 nt, Escherichia coli CFT073
ucaggccuccggugau

SEQ ID NO: 2618413 - RNA, 13 nt, Escherichia coli CFT073
ucaggccugcaua

SEQ ID NO: 2618414 - RNA, 23 nt, Escherichia coli CFT073
ucaggcgagucgagaucccuucc

SEQ ID NO: 2618415 - RNA, 19 nt, Escherichia coli CFT073
ucaggcgagugguaugacu

SEQ ID NO: 2618416 - RNA, 21 nt, Escherichia coli CFT073
ucaggcgcgugaaugccugag

SEQ ID NO: 2618417 - RNA, 15 nt, Escherichia coli CFT073
ucaggcggcucaccu

SEQ ID NO: 2618418 - RNA, 16 nt, Escherichia coli CFT073
ucaggcggcucaccug

SEQ ID NO: 2618419 - RNA, 17 nt, Escherichia coli CFT073
ucaggcggcucaccugc

SEQ ID NO: 2618420 - RNA, 20 nt, Escherichia coli CFT073
ucaggcguuucuucacccuu

SEQ ID NO: 2618421 - RNA, 16 nt, Escherichia coli CFT073
ucaggcucucauuuuu

SEQ ID NO: 2618422 - RNA, 18 nt, Escherichia coli CFT073
ucaggcugaaaaucuucu

SEQ ID NO: 2618423 - RNA, 17 nt, Escherichia coli CFT073
ucagggagaacucaucu

SEQ ID NO: 2618424 - RNA, 13 nt, Escherichia coli CFT073
ucagggccaucau

SEQ ID NO: 2618425 - RNA, 19 nt, Escherichia coli CFT073
ucagggccaucauuuugcu

SEQ ID NO: 2618426 - RNA, 13 nt, Escherichia coli CFT073
ucagggccugcgu

SEQ ID NO: 2618427 - RNA, 16 nt, Escherichia coli CFT073
ucagggccugcgugug

SEQ ID NO: 2618428 - RNA, 20 nt, Escherichia coli CFT073
ucagggcgcacgcacggcgu

SEQ ID NO: 2618429 - RNA, 22 nt, Escherichia coli CFT073
ucagggcggcuaucccaaagcu

SEQ ID NO: 2618430 - RNA, 22 nt, Escherichia coli CFT073
ucagggucgugcggcacggcgu

SEQ ID NO: 2618431 - RNA, 20 nt, Escherichia coli CFT073
ucagguaagcgauaaaaaua

SEQ ID NO: 2618432 - RNA, 22 nt, Escherichia coli CFT073
ucagguaagcgauaaaaauacc

SEQ ID NO: 2618433 - RNA, 23 nt, Escherichia coli CFT073
ucagguaauuuugcuuauuuaaa

SEQ ID NO: 2618434 - RNA, 20 nt, Escherichia coli CFT073
ucagguauucguuaaaacca

SEQ ID NO: 2618435 - RNA, 13 nt, Escherichia coli CFT073
ucaggucaucacu

SEQ ID NO: 2618436 - RNA, 23 nt, Escherichia coli CFT073
ucagguccacgccaucguaaguc

SEQ ID NO: 2618437 - RNA, 23 nt, Escherichia coli CFT073
ucaggucggugugaaugaccagg

SEQ ID NO: 2618438 - RNA, 15 nt, Escherichia coli CFT073
ucaggucuuucugaa

SEQ ID NO: 2618439 - RNA, 23 nt, Escherichia coli CFT073
ucaggucuuucugaaaugggcca

SEQ ID NO: 2618440 - RNA, 17 nt, Escherichia coli CFT073
ucaggugauggcagcca

SEQ ID NO: 2618441 - RNA, 14 nt, Escherichia coli CFT073
ucagguguaauaaa

SEQ ID NO: 2618442 - RNA, 18 nt, Escherichia coli CFT073
ucagguuacgcccuuccc

SEQ ID NO: 2618443 - RNA, 20 nt, Escherichia coli CFT073
ucagguugaggaacuuccag

SEQ ID NO: 2618444 - RNA, 15 nt, Escherichia coli CFT073
ucagguugccggaug

SEQ ID NO: 2618445 - RNA, 20 nt, Escherichia coli CFT073
ucagguuguuuucuggcuga

SEQ ID NO: 2618446 - RNA, 21 nt, Escherichia coli CFT073
ucagguuuaaugguuugcccu

SEQ ID NO: 2618447 - RNA, 13 nt, Escherichia coli CFT073
ucaguaaaaccau

SEQ ID NO: 2618448 - RNA, 22 nt, Escherichia coli CFT073
ucaguaaaguaucaaacagaaa

SEQ ID NO: 2618449 - RNA, 13 nt, Escherichia coli CFT073
ucaucaugaacug

SEQ ID NO: 2618450 - RNA, 16 nt, Escherichia coli CFT073
ucaucaugcuuaaaua

SEQ ID NO: 2618451 - RNA, 18 nt, Escherichia coli CFT073
ucaucaugggcaagguau

SEQ ID NO: 2618452 - RNA, 12 nt, Escherichia coli CFT073
ucauccagcagc

SEQ ID NO: 2618453 - RNA, 15 nt, Escherichia coli CFT073
ucauccagccuggaa

SEQ ID NO: 2618454 - RNA, 18 nt, Escherichia coli CFT073
ucauccauaccacagguc

SEQ ID NO: 2618455 - RNA, 12 nt, Escherichia coli CFT073
ucauccaucaaa

SEQ ID NO: 2618456 - RNA, 17 nt, Escherichia coli CFT073
ucauccaucaaauuacc

SEQ ID NO: 2618457 - RNA, 16 nt, Escherichia coli CFT073
ucauccaucggcgcuu

SEQ ID NO: 2618458 - RNA, 20 nt, Escherichia coli CFT073
ucauccaucggcgcuucaau

SEQ ID NO: 2618459 - RNA, 14 nt, Escherichia coli CFT073
ucauccccucuucc

SEQ ID NO: 2618460 - RNA, 15 nt, Escherichia coli CFT073
ucauccccucuucca

SEQ ID NO: 2618461 - RNA, 20 nt, Escherichia coli CFT073
ucaucccgguuauuaaaacg

SEQ ID NO: 2618462 - RNA, 13 nt, Escherichia coli CFT073
ucauccgacacca

SEQ ID NO: 2618463 - RNA, 14 nt, Escherichia coli CFT073
ucauccgaugguuu

SEQ ID NO: 2618464 - RNA, 16 nt, Escherichia coli CFT073
ucauccggcacgcuac

SEQ ID NO: 2618465 - RNA, 18 nt, Escherichia coli CFT073
ucauccggcacgcuacca

SEQ ID NO: 2618466 - RNA, 19 nt, Escherichia coli CFT073
ucauccggcacuuuuucau

SEQ ID NO: 2618467 - RNA, 21 nt, Escherichia coli CFT073
ucauccggcuuuuuuacauca

SEQ ID NO: 2618468 - RNA, 20 nt, Escherichia coli CFT073
ucauccgguaacggaccgca

SEQ ID NO: 2618469 - RNA, 18 nt, Escherichia coli CFT073
ucauccgguuauacguca

SEQ ID NO: 2618470 - RNA, 14 nt, Escherichia coli CFT073
ucauccucuucacc

SEQ ID NO: 2618471 - RNA, 17 nt, Escherichia coli CFT073
ucauccugcugcacgcc

SEQ ID NO: 2618472 - RNA, 19 nt, Escherichia coli CFT073
ucauccuguaugacaaaag

SEQ ID NO: 2618473 - RNA, 15 nt, Escherichia coli CFT073
ucauccuucagugcc

SEQ ID NO: 2618474 - RNA, 20 nt, Escherichia coli CFT073
ucaucgaacgggugauuucc

SEQ ID NO: 2618475 - RNA, 14 nt, Escherichia coli CFT073
ucaucgaauaaauu

SEQ ID NO: 2618476 - RNA, 22 nt, Escherichia coli CFT073
ucaucgacauugaccagugcag

SEQ ID NO: 2618477 - RNA, 14 nt, Escherichia coli CFT073
ucaucgagaucgac

SEQ ID NO: 2618478 - RNA, 17 nt, Escherichia coli CFT073
ucaucgagcagcauaau

SEQ ID NO: 2618479 - RNA, 15 nt, Escherichia coli CFT073
ucaucgaugcugcuc

SEQ ID NO: 2618480 - RNA, 14 nt, Escherichia coli CFT073
ucaucgauuuucug

SEQ ID NO: 2618481 - RNA, 12 nt, Escherichia coli CFT073
ucaucgcaaaug

SEQ ID NO: 2618482 - RNA, 15 nt, Escherichia coli CFT073
ucaucgccagcgaau

SEQ ID NO: 2618483 - RNA, 19 nt, Escherichia coli CFT073
ucaucgcccuguuccuguu

SEQ ID NO: 2618484 - RNA, 15 nt, Escherichia coli CFT073
ucaucgccuucaucu

SEQ ID NO: 2618485 - RNA, 16 nt, Escherichia coli CFT073
ucaucgcgauccccca

SEQ ID NO: 2618486 - RNA, 22 nt, Escherichia coli CFT073
ucaucgcgcaaaauuucuauca

SEQ ID NO: 2618487 - RNA, 17 nt, Escherichia coli CFT073
ucaucgcggcacacagc

SEQ ID NO: 2618488 - RNA, 23 nt, Escherichia coli CFT073
ucaucgcggucaaccaucgcaua

SEQ ID NO: 2618489 - RNA, 19 nt, Escherichia coli CFT073
ucaucgcugacaugugauu

SEQ ID NO: 2618490 - RNA, 20 nt, Escherichia coli CFT073
ucaucgcuguggcagucacu

SEQ ID NO: 2618491 - RNA, 14 nt, Escherichia coli CFT073
ucaucggcaaaggc

SEQ ID NO: 2618492 - RNA, 20 nt, Escherichia coli CFT073
ucaucggcagcaucgcucac

SEQ ID NO: 2618493 - RNA, 15 nt, Escherichia coli CFT073
ucaucggcaucuucu

SEQ ID NO: 2618494 - RNA, 23 nt, Escherichia coli CFT073
ucaucggcggugacuagcagcau

SEQ ID NO: 2618495 - RNA, 17 nt, Escherichia coli CFT073
ucaucggcgucgguuuc

SEQ ID NO: 2618496 - RNA, 18 nt, Escherichia coli CFT073
ucaucggcuuuugguccg

SEQ ID NO: 2618497 - RNA, 16 nt, Escherichia coli CFT073
ucaucgggcguuuucu

SEQ ID NO: 2618498 - RNA, 16 nt, Escherichia coli CFT073
ucaucgguauaaccaa

SEQ ID NO: 2618499 - RNA, 23 nt, Escherichia coli CFT073
ucaucggucagcgcagugacauu

SEQ ID NO: 2618500 - RNA, 18 nt, Escherichia coli CFT073
ucaucggucaguuugccc

SEQ ID NO: 2618501 - RNA, 20 nt, Escherichia coli CFT073
ucaucggucaguuugcccca

SEQ ID NO: 2618502 - RNA, 22 nt, Escherichia coli CFT073
ucaucggugguguaaccuucac

SEQ ID NO: 2618503 - RNA, 14 nt, Escherichia coli CFT073
ucaucgguuaaccc

SEQ ID NO: 2618504 - RNA, 22 nt, Escherichia coli CFT073
ucaucguaaccgacgaugguuu

SEQ ID NO: 2618505 - RNA, 13 nt, Escherichia coli CFT073
ucaucgucaaaau

SEQ ID NO: 2618506 - RNA, 21 nt, Escherichia coli CFT073
ucaucgugaccaaagcagacg

SEQ ID NO: 2618507 - RNA, 18 nt, Escherichia coli CFT073
ucaucuaccagcauuacg

SEQ ID NO: 2618508 - RNA, 13 nt, Escherichia coli CFT073
ucaucucaacaaa

SEQ ID NO: 2618509 - RNA, 15 nt, Escherichia coli CFT073
ucaucucagucagau

SEQ ID NO: 2618510 - RNA, 13 nt, Escherichia coli CFT073
ucaucucuccuuu

SEQ ID NO: 2618511 - RNA, 15 nt, Escherichia coli CFT073
ucaucucugccuuga

SEQ ID NO: 2618512 - RNA, 12 nt, Escherichia coli CFT073
ucaucucuucaa

SEQ ID NO: 2618513 - RNA, 14 nt, Escherichia coli CFT073
ucaucucuucaaua

SEQ ID NO: 2618514 - RNA, 16 nt, Escherichia coli CFT073
ucaucugaccacggcc

SEQ ID NO: 2618515 - RNA, 20 nt, Escherichia coli CFT073
ucaucugcgccacgaaaacc

SEQ ID NO: 2618516 - RNA, 19 nt, Escherichia coli CFT073
ucaucugguuccuaaauaa

SEQ ID NO: 2618517 - RNA, 21 nt, Escherichia coli CFT073
ucaucugguuccuaaauaacc

SEQ ID NO: 2618518 - RNA, 14 nt, Escherichia coli CFT073
ucaucuguuuucaa

SEQ ID NO: 2618519 - RNA, 21 nt, Escherichia coli CFT073
ucaucuuacugcaacugugcg

SEQ ID NO: 2618520 - RNA, 16 nt, Escherichia coli CFT073
ucaucuucauaacuuu

SEQ ID NO: 2618521 - RNA, 19 nt, Escherichia coli CFT073
ucaucuucauaacuuugau

SEQ ID NO: 2618522 - RNA, 15 nt, Escherichia coli CFT073
ucaucuucaucaucu

SEQ ID NO: 2618523 - RNA, 19 nt, Escherichia coli CFT073
ucaucuuccgggcaacaau

SEQ ID NO: 2618524 - RNA, 13 nt, Escherichia coli CFT073
ucaucuuuauuca

SEQ ID NO: 2618525 - RNA, 20 nt, Escherichia coli CFT073
ucaucuuuugcgauauauuu

SEQ ID NO: 2618526 - RNA, 21 nt, Escherichia coli CFT073
ucaucuuuugcgauauauuuu

SEQ ID NO: 2618527 - RNA, 17 nt, Escherichia coli CFT073
ucaugaacacacccgga

SEQ ID NO: 2618528 - RNA, 15 nt, Escherichia coli CFT073
ucaugaacugggcua

SEQ ID NO: 2618529 - RNA, 12 nt, Escherichia coli CFT073
ucaugaauaaaa

SEQ ID NO: 2618530 - RNA, 19 nt, Escherichia coli CFT073
ucaugauacuccacaucau

SEQ ID NO: 2618531 - RNA, 21 nt, Escherichia coli CFT073
ucaugauauguuuuaaagcga

SEQ ID NO: 2618532 - RNA, 16 nt, Escherichia coli CFT073
ucaugauggcgauacu

SEQ ID NO: 2618533 - RNA, 18 nt, Escherichia coli CFT073
ucaugcaucgguuuugcg

SEQ ID NO: 2618534 - RNA, 13 nt, Escherichia coli CFT073
ucaugccagugau

SEQ ID NO: 2618535 - RNA, 12 nt, Escherichia coli CFT073
ucaugccauccg

SEQ ID NO: 2618536 - RNA, 18 nt, Escherichia coli CFT073
ucaugcccgccgaccgua

SEQ ID NO: 2618537 - RNA, 23 nt, Escherichia coli CFT073
ucaugcccugcccgcugccagga

SEQ ID NO: 2618538 - RNA, 17 nt, Escherichia coli CFT073
ucaugcccuuuuuucuu

SEQ ID NO: 2618539 - RNA, 22 nt, Escherichia coli CFT073
ucaugccggccagcgccaccac

SEQ ID NO: 2618540 - RNA, 20 nt, Escherichia coli CFT073
ucaugccgggcaaaagucac

SEQ ID NO: 2618541 - RNA, 22 nt, Escherichia coli CFT073
ucaugccuacgaguucgaugcu

SEQ ID NO: 2618542 - RNA, 17 nt, Escherichia coli CFT073
ucaugcggcgcgcccca

SEQ ID NO: 2618543 - RNA, 19 nt, Escherichia coli CFT073
ucaugcgggcgaggggaga

SEQ ID NO: 2618544 - RNA, 20 nt, Escherichia coli CFT073
ucaugcgucaaaugcagggc

SEQ ID NO: 2618545 - RNA, 14 nt, Escherichia coli CFT073
ucaugcucaccaau

SEQ ID NO: 2618546 - RNA, 22 nt, Escherichia coli CFT073
ucaugcuucaucgugacaaucu

SEQ ID NO: 2618547 - RNA, 16 nt, Escherichia coli CFT073
ucauggcagucuuaau

SEQ ID NO: 2618548 - RNA, 16 nt, Escherichia coli CFT073
ucauggcguuuuuccc

SEQ ID NO: 2618549 - RNA, 19 nt, Escherichia coli CFT073
ucaugggcuaacgagcagu

SEQ ID NO: 2618550 - RNA, 16 nt, Escherichia coli CFT073
ucaugguacuggcgac

SEQ ID NO: 2618551 - RNA, 21 nt, Escherichia coli CFT073
ucaugguacuggcgacugcca

SEQ ID NO: 2618552 - RNA, 15 nt, Escherichia coli CFT073
ucauguauuuuuucc

SEQ ID NO: 2618553 - RNA, 13 nt, Escherichia coli CFT073
ucaugucagagcu

SEQ ID NO: 2618554 - RNA, 15 nt, Escherichia coli CFT073
ucaugucagagcugu

SEQ ID NO: 2618555 - RNA, 19 nt, Escherichia coli CFT073
ucaugucagaugcggcaug

SEQ ID NO: 2618556 - RNA, 13 nt, Escherichia coli CFT073
ucaugucucucag

SEQ ID NO: 2618557 - RNA, 20 nt, Escherichia coli CFT073
ucauguugauuugcuggaag

SEQ ID NO: 2618558 - RNA, 23 nt, Escherichia coli CFT073
uccacgcuaugugcuucaucagg

SEQ ID NO: 2618559 - RNA, 13 nt, Escherichia coli CFT073
uccacggcaucuu

SEQ ID NO: 2618560 - RNA, 16 nt, Escherichia coli CFT073
uccacgguucuccacu

SEQ ID NO: 2618561 - RNA, 17 nt, Escherichia coli CFT073
uccacguuucuucuaau

SEQ ID NO: 2618562 - RNA, 14 nt, Escherichia coli CFT073
uccacuaacuguuu

SEQ ID NO: 2618563 - RNA, 21 nt, Escherichia coli CFT073
uccacuacgcuguagccgcca

SEQ ID NO: 2618564 - RNA, 22 nt, Escherichia coli CFT073
uccacucacacagcuuucucaa

SEQ ID NO: 2618565 - RNA, 22 nt, Escherichia coli CFT073
uccacucuuucagcaccagccc

SEQ ID NO: 2618566 - RNA, 22 nt, Escherichia coli CFT073
uccacugaaacaugaacaucaa

SEQ ID NO: 2618567 - RNA, 18 nt, Escherichia coli CFT073
uccacugaauagugccgc

SEQ ID NO: 2618568 - RNA, 21 nt, Escherichia coli CFT073
uccacugauggcgaaaucgcu

SEQ ID NO: 2618569 - RNA, 14 nt, Escherichia coli CFT073
uccacugcaucagu

SEQ ID NO: 2618570 - RNA, 13 nt, Escherichia coli CFT073
uccacugcgcaua

SEQ ID NO: 2618571 - RNA, 18 nt, Escherichia coli CFT073
uccacugcgcauaaucca

SEQ ID NO: 2618572 - RNA, 13 nt, Escherichia coli CFT073
uccacuggcaccc

SEQ ID NO: 2618573 - RNA, 19 nt, Escherichia coli CFT073
uccacugguuaacgcgcca

SEQ ID NO: 2618574 - RNA, 13 nt, Escherichia coli CFT073
uccacuucaucaa

SEQ ID NO: 2618575 - RNA, 21 nt, Escherichia coli CFT073
uccacuuccaccacuuccugc

SEQ ID NO: 2618576 - RNA, 14 nt, Escherichia coli CFT073
uccacuuccugcca

SEQ ID NO: 2618577 - RNA, 14 nt, Escherichia coli CFT073
uccacuuccugcgg

SEQ ID NO: 2618578 - RNA, 21 nt, Escherichia coli CFT073
uccacuucugcacgguuuuuc

SEQ ID NO: 2618579 - RNA, 18 nt, Escherichia coli CFT073
uccacuuugcuuucagau

SEQ ID NO: 2618580 - RNA, 15 nt, Escherichia coli CFT073
uccagaaaaaaagca

SEQ ID NO: 2618581 - RNA, 16 nt, Escherichia coli CFT073
uccagaauuccgugcc

SEQ ID NO: 2618582 - RNA, 23 nt, Escherichia coli CFT073
uccagaauuccgugccagcacca

SEQ ID NO: 2618583 - RNA, 19 nt, Escherichia coli CFT073
uccagaccgcgcuugccgc

SEQ ID NO: 2618584 - RNA, 20 nt, Escherichia coli CFT073
uccagaccgcgcuugccgcc

SEQ ID NO: 2618585 - RNA, 23 nt, Escherichia coli CFT073
uccagaccgcgcuugccgccgga

SEQ ID NO: 2618586 - RNA, 19 nt, Escherichia coli CFT073
uccagauaauuaugccgau

SEQ ID NO: 2618587 - RNA, 13 nt, Escherichia coli CFT073
uccagauauugcu

SEQ ID NO: 2618588 - RNA, 22 nt, Escherichia coli CFT073
uccagaucacgcagcaagccgu

SEQ ID NO: 2618589 - RNA, 18 nt, Escherichia coli CFT073
uccagaugucuuuacccg

SEQ ID NO: 2618590 - RNA, 22 nt, Escherichia coli CFT073
uccagauucucauauaucccuu

SEQ ID NO: 2618591 - RNA, 16 nt, Escherichia coli CFT073
uccagauucuccaccu

SEQ ID NO: 2618592 - RNA, 19 nt, Escherichia coli CFT073
uccagcaacaacagcgcga

SEQ ID NO: 2618593 - RNA, 12 nt, Escherichia coli CFT073
uccagcaacgcu

SEQ ID NO: 2618594 - RNA, 17 nt, Escherichia coli CFT073
uccagcaaugucauaaa

SEQ ID NO: 2618595 - RNA, 17 nt, Escherichia coli CFT073
uccagcacacuguaagc

SEQ ID NO: 2618596 - RNA, 13 nt, Escherichia coli CFT073
uccagcaccaguu

SEQ ID NO: 2618597 - RNA, 17 nt, Escherichia coli CFT073
uccagcaccaguucgcc

SEQ ID NO: 2618598 - RNA, 23 nt, Escherichia coli CFT073
uccagcaccaguucgccuucauu

SEQ ID NO: 2618599 - RNA, 18 nt, Escherichia coli CFT073
uccagcagacgcuccauu

SEQ ID NO: 2618600 - RNA, 18 nt, Escherichia coli CFT073
uccagcagaugcugugcc

SEQ ID NO: 2618601 - RNA, 16 nt, Escherichia coli CFT073
uccagcagauggcagu

SEQ ID NO: 2618602 - RNA, 17 nt, Escherichia coli CFT073
uccagcagauucaacau

SEQ ID NO: 2618603 - RNA, 13 nt, Escherichia coli CFT073
uccagcagcaaug

SEQ ID NO: 2618604 - RNA, 14 nt, Escherichia coli CFT073
uccagcagcaaugc

SEQ ID NO: 2618605 - RNA, 13 nt, Escherichia coli CFT073
uccagcagccaga

SEQ ID NO: 2618606 - RNA, 17 nt, Escherichia coli CFT073
uccagcagcuccggcuc

SEQ ID NO: 2618607 - RNA, 23 nt, Escherichia coli CFT073
uccagcagcuuaagcgaccaguu

SEQ ID NO: 2618608 - RNA, 20 nt, Escherichia coli CFT073
uccagcagcuugcgccgccc

SEQ ID NO: 2618609 - RNA, 13 nt, Escherichia coli CFT073
uccagcaggaagc

SEQ ID NO: 2618610 - RNA, 15 nt, Escherichia coli CFT073
uccagcagugcugca

SEQ ID NO: 2618611 - RNA, 23 nt, Escherichia coli CFT073
uccagcauaacuaauuccgcuga

SEQ ID NO: 2618612 - RNA, 17 nt, Escherichia coli CFT073
uccagcauaaugacucu

SEQ ID NO: 2618613 - RNA, 20 nt, Escherichia coli CFT073
uccagcauaccuuccagcgc

SEQ ID NO: 2618614 - RNA, 22 nt, Escherichia coli CFT073
uccagcauaccuuccagcgcgu

SEQ ID NO: 2618615 - RNA, 18 nt, Escherichia coli CFT073
uccagcauaguacgggca

SEQ ID NO: 2618616 - RNA, 19 nt, Escherichia coli CFT073
uccagcauauguuuacgcu

SEQ ID NO: 2618617 - RNA, 14 nt, Escherichia coli CFT073
uccagcaucgaaaa

SEQ ID NO: 2618618 - RNA, 18 nt, Escherichia coli CFT073
uccagcaucgaccaggau

SEQ ID NO: 2618619 - RNA, 22 nt, Escherichia coli CFT073
uccagcaucgcccccaucgcca

SEQ ID NO: 2618620 - RNA, 16 nt, Escherichia coli CFT073
uccagcaucuccugca

SEQ ID NO: 2618621 - RNA, 15 nt, Escherichia coli CFT073
uccagcaugcucacu

SEQ ID NO: 2618622 - RNA, 17 nt, Escherichia coli CFT073
uccagcauucccgccac

SEQ ID NO: 2618623 - RNA, 20 nt, Escherichia coli CFT073
uccagccaccgcguggcaga

SEQ ID NO: 2618624 - RNA, 21 nt, Escherichia coli CFT073
uccagccaccgcguggcagac

SEQ ID NO: 2618625 - RNA, 22 nt, Escherichia coli CFT073
uccagccacggcuccagcaaug

SEQ ID NO: 2618626 - RNA, 12 nt, Escherichia coli CFT073
uccagccacugc

SEQ ID NO: 2618627 - RNA, 16 nt, Escherichia coli CFT073
uccagccccaccagca

SEQ ID NO: 2618628 - RNA, 22 nt, Escherichia coli CFT073
uccagccccaccagcaaaaacg

SEQ ID NO: 2618629 - RNA, 12 nt, Escherichia coli CFT073
uccagccgguaa

SEQ ID NO: 2618630 - RNA, 14 nt, Escherichia coli CFT073
uccagccucugucu

SEQ ID NO: 2618631 - RNA, 21 nt, Escherichia coli CFT073
uccagccuggaauuucuucgg

SEQ ID NO: 2618632 - RNA, 17 nt, Escherichia coli CFT073
uccagcgaaauaaaagu

SEQ ID NO: 2618633 - RNA, 14 nt, Escherichia coli CFT073
uccagcgauaauga

SEQ ID NO: 2618634 - RNA, 20 nt, Escherichia coli CFT073
uccagcgcaaaguagcugaa

SEQ ID NO: 2618635 - RNA, 16 nt, Escherichia coli CFT073
uccagcgcaucgaucu

SEQ ID NO: 2618636 - RNA, 13 nt, Escherichia coli CFT073
uccagcgcaucgc

SEQ ID NO: 2618637 - RNA, 18 nt, Escherichia coli CFT073
uccagcgccugaauaauc

SEQ ID NO: 2618638 - RNA, 23 nt, Escherichia coli CFT073
uccagcgccugacggaucggcuc

SEQ ID NO: 2618639 - RNA, 16 nt, Escherichia coli CFT073
uccagcgccuggcgaa

SEQ ID NO: 2618640 - RNA, 20 nt, Escherichia coli CFT073
uccagcgcggcgaaggugcc

SEQ ID NO: 2618641 - RNA, 16 nt, Escherichia coli CFT073
uccagcgcguuuguca

SEQ ID NO: 2618642 - RNA, 21 nt, Escherichia coli CFT073
uccagcgcguuugucagcaaa

SEQ ID NO: 2618643 - RNA, 15 nt, Escherichia coli CFT073
uccagcggcaacggc

SEQ ID NO: 2618644 - RNA, 14 nt, Escherichia coli CFT073
uccagcggcaggcc

SEQ ID NO: 2618645 - RNA, 17 nt, Escherichia coli CFT073
uccagcggccagacacc

SEQ ID NO: 2618646 - RNA, 19 nt, Escherichia coli CFT073
uccagcggccagacaccgg

SEQ ID NO: 2618647 - RNA, 22 nt, Escherichia coli CFT073
uccagcggccagacaccggcuu

SEQ ID NO: 2618648 - RNA, 23 nt, Escherichia coli CFT073
uccagcgguaacuuaucuguaau

SEQ ID NO: 2618649 - RNA, 20 nt, Escherichia coli CFT073
uccagcgguugggcauuggc

SEQ ID NO: 2618650 - RNA, 18 nt, Escherichia coli CFT073
uccagcgguuguagccac

SEQ ID NO: 2618651 - RNA, 21 nt, Escherichia coli CFT073
uccagcguuaauuuccucuuc

SEQ ID NO: 2618652 - RNA, 16 nt, Escherichia coli CFT073
uccagcguuaccggcu

SEQ ID NO: 2618653 - RNA, 19 nt, Escherichia coli CFT073
uccagcucaaccagauucg

SEQ ID NO: 2618654 - RNA, 15 nt, Escherichia coli CFT073
uccagcuccguccag

SEQ ID NO: 2618655 - RNA, 17 nt, Escherichia coli CFT073
uccagcuccguccagcc

SEQ ID NO: 2618656 - RNA, 13 nt, Escherichia coli CFT073
uccagcucggcgc

SEQ ID NO: 2618657 - RNA, 18 nt, Escherichia coli CFT073
uccagcuguaccagcaac

SEQ ID NO: 2618658 - RNA, 19 nt, Escherichia coli CFT073
uccagcuguaccagcaacu

SEQ ID NO: 2618659 - RNA, 19 nt, Escherichia coli CFT073
uccagcuuaacauccccau

SEQ ID NO: 2618660 - RNA, 20 nt, Escherichia coli CFT073
uccagcuuaauucuguccuc

SEQ ID NO: 2618661 - RNA, 17 nt, Escherichia coli CFT073
uccagcuuagcggcgcg

SEQ ID NO: 2618662 - RNA, 23 nt, Escherichia coli CFT073
uccagcuuuucgauaacccugcg

SEQ ID NO: 2618663 - RNA, 23 nt, Escherichia coli CFT073
uccaggaaccguccgcauucuuc

SEQ ID NO: 2618664 - RNA, 23 nt, Escherichia coli CFT073
uccaggacuggcgauaucaauau

SEQ ID NO: 2618665 - RNA, 19 nt, Escherichia coli CFT073
uccaggagauauugcugcg

SEQ ID NO: 2618666 - RNA, 18 nt, Escherichia coli CFT073
ucccacguuccuugcugc

SEQ ID NO: 2618667 - RNA, 14 nt, Escherichia coli CFT073
ucccacucaucaag

SEQ ID NO: 2618668 - RNA, 17 nt, Escherichia coli CFT073
ucccacuuuuauuucac

SEQ ID NO: 2618669 - RNA, 22 nt, Escherichia coli CFT073
ucccagaagaugcguucaccua

SEQ ID NO: 2618670 - RNA, 22 nt, Escherichia coli CFT073
ucccagaagguuucgccgcugc

SEQ ID NO: 2618671 - RNA, 14 nt, Escherichia coli CFT073
ucccagaccuucau

SEQ ID NO: 2618672 - RNA, 15 nt, Escherichia coli CFT073
ucccagagaaugaau

SEQ ID NO: 2618673 - RNA, 20 nt, Escherichia coli CFT073
ucccagagaaugaauuucac

SEQ ID NO: 2618674 - RNA, 19 nt, Escherichia coli CFT073
ucccagcaacagcaaagag

SEQ ID NO: 2618675 - RNA, 18 nt, Escherichia coli CFT073
ucccagcaccgcagagau

SEQ ID NO: 2618676 - RNA, 20 nt, Escherichia coli CFT073
ucccagccaaugcaggcauc

SEQ ID NO: 2618677 - RNA, 12 nt, Escherichia coli CFT073
ucccagccaguc

SEQ ID NO: 2618678 - RNA, 14 nt, Escherichia coli CFT073
ucccagccaguccu

SEQ ID NO: 2618679 - RNA, 16 nt, Escherichia coli CFT073
ucccagccaguccugu

SEQ ID NO: 2618680 - RNA, 19 nt, Escherichia coli CFT073
ucccagccaguccuguuca

SEQ ID NO: 2618681 - RNA, 13 nt, Escherichia coli CFT073
ucccagcccagcg

SEQ ID NO: 2618682 - RNA, 20 nt, Escherichia coli CFT073
ucccagcccccuguguugau

SEQ ID NO: 2618683 - RNA, 23 nt, Escherichia coli CFT073
ucccagccgggaaguaccauuga

SEQ ID NO: 2618684 - RNA, 19 nt, Escherichia coli CFT073
ucccagcgaugcugacgaa

SEQ ID NO: 2618685 - RNA, 16 nt, Escherichia coli CFT073
ucccagcgccugcagu

SEQ ID NO: 2618686 - RNA, 17 nt, Escherichia coli CFT073
ucccagcgcgaaagaua

SEQ ID NO: 2618687 - RNA, 22 nt, Escherichia coli CFT073
ucccagcgucggaaucccuucc

SEQ ID NO: 2618688 - RNA, 22 nt, Escherichia coli CFT073
ucccagcguuuaucaauaucca

SEQ ID NO: 2618689 - RNA, 16 nt, Escherichia coli CFT073
ucccagcucaaagcag

SEQ ID NO: 2618690 - RNA, 19 nt, Escherichia coli CFT073
ucccaggucgacaauccag

SEQ ID NO: 2618691 - RNA, 20 nt, Escherichia coli CFT073
ucccaguacuguacaacaca

SEQ ID NO: 2618692 - RNA, 22 nt, Escherichia coli CFT073
ucccaguacuguacaacacagu

SEQ ID NO: 2618693 - RNA, 14 nt, Escherichia coli CFT073
ucccaguagugcuu

SEQ ID NO: 2618694 - RNA, 14 nt, Escherichia coli CFT073
ucccagucgaagau

SEQ ID NO: 2618695 - RNA, 14 nt, Escherichia coli CFT073
ucccagucuuucca

SEQ ID NO: 2618696 - RNA, 13 nt, Escherichia coli CFT073
ucccagugcagca

SEQ ID NO: 2618697 - RNA, 21 nt, Escherichia coli CFT073
ucccaguuacugccaucuucc

SEQ ID NO: 2618698 - RNA, 16 nt, Escherichia coli CFT073
ucccauaagugcguca

SEQ ID NO: 2618699 - RNA, 13 nt, Escherichia coli CFT073
ucccaucagacgg

SEQ ID NO: 2618700 - RNA, 18 nt, Escherichia coli CFT073
ucccauuuacuggcauca

SEQ ID NO: 2618701 - RNA, 23 nt, Escherichia coli CFT073
uccccaaaaaaucaacgacaaaa

SEQ ID NO: 2618702 - RNA, 22 nt, Escherichia coli CFT073
uccccaagaaucgucgcccgau

SEQ ID NO: 2618703 - RNA, 11 nt, Escherichia coli CFT073
uccccaauacg

SEQ ID NO: 2618704 - RNA, 14 nt, Escherichia coli CFT073
uccccacaccacca

SEQ ID NO: 2618705 - RNA, 14 nt, Escherichia coli CFT073
uccccacaccugac

SEQ ID NO: 2618706 - RNA, 20 nt, Escherichia coli CFT073
uccccacaggcgaugcacau

SEQ ID NO: 2618707 - RNA, 13 nt, Escherichia coli CFT073
uccccaccaguga

SEQ ID NO: 2618708 - RNA, 18 nt, Escherichia coli CFT073
uccccaccuguccagacg

SEQ ID NO: 2618709 - RNA, 19 nt, Escherichia coli CFT073
uccccacuauuggaugaca

SEQ ID NO: 2618710 - RNA, 21 nt, Escherichia coli CFT073
uccccacugcauggcggcguc

SEQ ID NO: 2618711 - RNA, 16 nt, Escherichia coli CFT073
uccccacuucauccga

SEQ ID NO: 2618712 - RNA, 18 nt, Escherichia coli CFT073
uccccagacgagagugac

SEQ ID NO: 2618713 - RNA, 18 nt, Escherichia coli CFT073
uccccagcggaaaauauc

SEQ ID NO: 2618714 - RNA, 17 nt, Escherichia coli CFT073
uccccagcgucagcagc

SEQ ID NO: 2618715 - RNA, 18 nt, Escherichia coli CFT073
uccccagcgucagcagca

SEQ ID NO: 2618716 - RNA, 21 nt, Escherichia coli CFT073
uccccagcgucagcagcaaua

SEQ ID NO: 2618717 - RNA, 23 nt, Escherichia coli CFT073
uccccagggaagauguuggcagc

SEQ ID NO: 2618718 - RNA, 16 nt, Escherichia coli CFT073
uccccaguuuuccauc

SEQ ID NO: 2618719 - RNA, 11 nt, Escherichia coli CFT073
uccccaucagg

SEQ ID NO: 2618720 - RNA, 13 nt, Escherichia coli CFT073
uccccauucugcg

SEQ ID NO: 2618721 - RNA, 12 nt, Escherichia coli CFT073
ucccccacagcu

SEQ ID NO: 2618722 - RNA, 20 nt, Escherichia coli CFT073
ucccccacagcucugcuguc

SEQ ID NO: 2618723 - RNA, 23 nt, Escherichia coli CFT073
ucccccacugugcaccgcgcugg

SEQ ID NO: 2618724 - RNA, 19 nt, Escherichia coli CFT073
ucccccgcacacuccauga

SEQ ID NO: 2618725 - RNA, 13 nt, Escherichia coli CFT073
ucccccgguuuua

SEQ ID NO: 2618726 - RNA, 13 nt, Escherichia coli CFT073
ucccccucuuccg

SEQ ID NO: 2618727 - RNA, 16 nt, Escherichia coli CFT073
ucccccugccagacca

SEQ ID NO: 2618728 - RNA, 21 nt, Escherichia coli CFT073
uccccgaagcuuguucagccg

SEQ ID NO: 2618729 - RNA, 14 nt, Escherichia coli CFT073
uccccgcaaaccag

SEQ ID NO: 2618730 - RNA, 18 nt, Escherichia coli CFT073
uccccgcaggucggauaa

SEQ ID NO: 2618731 - RNA, 22 nt, Escherichia coli CFT073
uccccgcaucagugaacccaua

SEQ ID NO: 2618732 - RNA, 23 nt, Escherichia coli CFT073
uccccgccagcguugccaguccg

SEQ ID NO: 2618733 - RNA, 20 nt, Escherichia coli CFT073
uccccgcgccaaccaugccg

SEQ ID NO: 2618734 - RNA, 14 nt, Escherichia coli CFT073
uccccggagcccua

SEQ ID NO: 2618735 - RNA, 17 nt, Escherichia coli CFT073
uccccggagcccuacaa

SEQ ID NO: 2618736 - RNA, 21 nt, Escherichia coli CFT073
uccccggagcccuacaaacca

SEQ ID NO: 2618737 - RNA, 22 nt, Escherichia coli CFT073
uccccggagcccuacaaaccau

SEQ ID NO: 2618738 - RNA, 23 nt, Escherichia coli CFT073
uccccggagcccuacaaaccauc

SEQ ID NO: 2618739 - RNA, 17 nt, Escherichia coli CFT073
uccccggauucauacug

SEQ ID NO: 2618740 - RNA, 15 nt, Escherichia coli CFT073
uccccggcacuguca

SEQ ID NO: 2618741 - RNA, 20 nt, Escherichia coli CFT073
uccccggcagugcuuucauu

SEQ ID NO: 2618742 - RNA, 11 nt, Escherichia coli CFT073
uccccggugaa

SEQ ID NO: 2618743 - RNA, 19 nt, Escherichia coli CFT073
uccccguaggccagauaag

SEQ ID NO: 2618744 - RNA, 20 nt, Escherichia coli CFT073
uccccguugguuuugaggug

SEQ ID NO: 2618745 - RNA, 15 nt, Escherichia coli CFT073
uccccuaacucuuuc

SEQ ID NO: 2618746 - RNA, 17 nt, Escherichia coli CFT073
uccccuaacucuuucaa

SEQ ID NO: 2618747 - RNA, 17 nt, Escherichia coli CFT073
uccccugagcauacauu

SEQ ID NO: 2618748 - RNA, 23 nt, Escherichia coli CFT073
uccccugagcauacauugccgca

SEQ ID NO: 2618749 - RNA, 13 nt, Escherichia coli CFT073
uccccugccagaa

SEQ ID NO: 2618750 - RNA, 24 nt, Escherichia coli CFT073
uccccuucagcaaggcuuuccaga

SEQ ID NO: 2618751 - RNA, 21 nt, Escherichia coli CFT073
uccccuucucaaucccuuucu

SEQ ID NO: 2618752 - RNA, 16 nt, Escherichia coli CFT073
uccccuuuaugguggc

SEQ ID NO: 2618753 - RNA, 17 nt, Escherichia coli CFT073
uccccuuucacauugau

SEQ ID NO: 2618754 - RNA, 22 nt, Escherichia coli CFT073
uccccuuuugccuucugagccc

SEQ ID NO: 2618755 - RNA, 14 nt, Escherichia coli CFT073
ucccgacacacugc

SEQ ID NO: 2618756 - RNA, 14 nt, Escherichia coli CFT073
ucccgagcggccaa

SEQ ID NO: 2618757 - RNA, 19 nt, Escherichia coli CFT073
ucccgauaaccuucuucau

SEQ ID NO: 2618758 - RNA, 19 nt, Escherichia coli CFT073
ucccgcagccacgucaccu

SEQ ID NO: 2618759 - RNA, 19 nt, Escherichia coli CFT073
ucccgcaggagcgccgaau

SEQ ID NO: 2618760 - RNA, 11 nt, Escherichia coli CFT073
ucccgccaacc

SEQ ID NO: 2618761 - RNA, 14 nt, Escherichia coli CFT073
ucccgccagcacca

SEQ ID NO: 2618762 - RNA, 22 nt, Escherichia coli CFT073
ucccgcccccgccagcgccauc

SEQ ID NO: 2618763 - RNA, 18 nt, Escherichia coli CFT073
ucccgccgcuucgccaau

SEQ ID NO: 2618764 - RNA, 16 nt, Escherichia coli CFT073
ucccgccguaccggca

SEQ ID NO: 2618765 - RNA, 13 nt, Escherichia coli CFT073
ucccgccugcugc

SEQ ID NO: 2618766 - RNA, 14 nt, Escherichia coli CFT073
ucccgccugcugcg

SEQ ID NO: 2618767 - RNA, 14 nt, Escherichia coli CFT073
ucccgcgccagcgc

SEQ ID NO: 2618768 - RNA, 23 nt, Escherichia coli CFT073
ucccgcgccgcagccggaaaacc

SEQ ID NO: 2618769 - RNA, 19 nt, Escherichia coli CFT073
ucccgcgccucaggcacuu

SEQ ID NO: 2618770 - RNA, 16 nt, Escherichia coli CFT073
ucccgcuaccugccgc

SEQ ID NO: 2618771 - RNA, 14 nt, Escherichia coli CFT073
ucccgcuccaaaau

SEQ ID NO: 2618772 - RNA, 14 nt, Escherichia coli CFT073
ucccgcucuguaag

SEQ ID NO: 2618773 - RNA, 15 nt, Escherichia coli CFT073
ucccgcuuuggcauc

SEQ ID NO: 2618774 - RNA, 20 nt, Escherichia coli CFT073
uccgcgaauuaugcagccuu

SEQ ID NO: 2618775 - RNA, 20 nt, Escherichia coli CFT073
uccgcgguugguuuuaucca

SEQ ID NO: 2618776 - RNA, 20 nt, Escherichia coli CFT073
uccgcguaguugcgcuggug

SEQ ID NO: 2618777 - RNA, 19 nt, Escherichia coli CFT073
uccgcgucauugacgcugg

SEQ ID NO: 2618778 - RNA, 20 nt, Escherichia coli CFT073
uccgcgugacgcuggcagaa

SEQ ID NO: 2618779 - RNA, 23 nt, Escherichia coli CFT073
uccgcgugacgcuggcagaaagu

SEQ ID NO: 2618780 - RNA, 20 nt, Escherichia coli CFT073
uccgcuaaaaauaguucuga

SEQ ID NO: 2618781 - RNA, 19 nt, Escherichia coli CFT073
uccgcuacccgaacaccaa

SEQ ID NO: 2618782 - RNA, 16 nt, Escherichia coli CFT073
uccgcucaauauauuc

SEQ ID NO: 2618783 - RNA, 18 nt, Escherichia coli CFT073
uccgcucgccgcagagau

SEQ ID NO: 2618784 - RNA, 15 nt, Escherichia coli CFT073
uccgcucugcccacg

SEQ ID NO: 2618785 - RNA, 14 nt, Escherichia coli CFT073
uccgcucuguaacc

SEQ ID NO: 2618786 - RNA, 15 nt, Escherichia coli CFT073
uccgcucuguaaccc

SEQ ID NO: 2618787 - RNA, 19 nt, Escherichia coli CFT073
uccgcucuucaucuuccag

SEQ ID NO: 2618788 - RNA, 16 nt, Escherichia coli CFT073
uccgcugacagcgcgu

SEQ ID NO: 2618789 - RNA, 12 nt, Escherichia coli CFT073
uccgcuggccgg

SEQ ID NO: 2618790 - RNA, 20 nt, Escherichia coli CFT073
uccgcugguggauguuugca

SEQ ID NO: 2618791 - RNA, 16 nt, Escherichia coli CFT073
uccgcuguaauugccg

SEQ ID NO: 2618792 - RNA, 19 nt, Escherichia coli CFT073
uccgcuguaauugccgcuc

SEQ ID NO: 2618793 - RNA, 21 nt, Escherichia coli CFT073
uccgcuguaauugccgcucca

SEQ ID NO: 2618794 - RNA, 13 nt, Escherichia coli CFT073
uccgcuuccgcug

SEQ ID NO: 2618795 - RNA, 14 nt, Escherichia coli CFT073
uccgcuuccgcuga

SEQ ID NO: 2618796 - RNA, 14 nt, Escherichia coli CFT073
uccgcuuucaacgc

SEQ ID NO: 2618797 - RNA, 18 nt, Escherichia coli CFT073
uccgcuuucaacgcgcua

SEQ ID NO: 2618798 - RNA, 16 nt, Escherichia coli CFT073
uccgcuuucacaucag

SEQ ID NO: 2618799 - RNA, 15 nt, Escherichia coli CFT073
uccggaaacuggaug

SEQ ID NO: 2618800 - RNA, 19 nt, Escherichia coli CFT073
uccggaacauauuccggug

SEQ ID NO: 2618801 - RNA, 20 nt, Escherichia coli CFT073
uccggaagaugaaaaacgca

SEQ ID NO: 2618802 - RNA, 20 nt, Escherichia coli CFT073
uccggaguaaugaaaccgaa

SEQ ID NO: 2618803 - RNA, 18 nt, Escherichia coli CFT073
uccggauaaggcguucac

SEQ ID NO: 2618804 - RNA, 13 nt, Escherichia coli CFT073
uccggaucgccaa

SEQ ID NO: 2618805 - RNA, 15 nt, Escherichia coli CFT073
uccggauuauccagc

SEQ ID NO: 2618806 - RNA, 16 nt, Escherichia coli CFT073
uccggauuauccagcc

SEQ ID NO: 2618807 - RNA, 15 nt, Escherichia coli CFT073
uccggauucaagcau

SEQ ID NO: 2618808 - RNA, 14 nt, Escherichia coli CFT073
uccggauuuuucgc

SEQ ID NO: 2618809 - RNA, 23 nt, Escherichia coli CFT073
uccggcaaauuaagaagcggcua

SEQ ID NO: 2618810 - RNA, 17 nt, Escherichia coli CFT073
uccggcaacccuugacc

SEQ ID NO: 2618811 - RNA, 20 nt, Escherichia coli CFT073
uccggcaaccgcgccaagcc

SEQ ID NO: 2618812 - RNA, 16 nt, Escherichia coli CFT073
uccggcaaucaacaga

SEQ ID NO: 2618813 - RNA, 19 nt, Escherichia coli CFT073
uccggcaaucaacagauaa

SEQ ID NO: 2618814 - RNA, 21 nt, Escherichia coli CFT073
uccggcaaucaacgccugaug

SEQ ID NO: 2618815 - RNA, 12 nt, Escherichia coli CFT073
uccggcaauggc

SEQ ID NO: 2618816 - RNA, 15 nt, Escherichia coli CFT073
uccggcaauggcugc

SEQ ID NO: 2618817 - RNA, 18 nt, Escherichia coli CFT073
uccggcaaugguguccaa

SEQ ID NO: 2618818 - RNA, 15 nt, Escherichia coli CFT073
uccggcacauuucau

SEQ ID NO: 2618819 - RNA, 13 nt, Escherichia coli CFT073
uccggcaccagcg

SEQ ID NO: 2618820 - RNA, 12 nt, Escherichia coli CFT073
uccggcaccauu

SEQ ID NO: 2618821 - RNA, 19 nt, Escherichia coli CFT073
uccggcacucaaucgccaa

SEQ ID NO: 2618822 - RNA, 21 nt, Escherichia coli CFT073
uccggcacuuaauaccacucg

SEQ ID NO: 2618823 - RNA, 15 nt, Escherichia coli CFT073
uccggcacuuuuuca

SEQ ID NO: 2618824 - RNA, 19 nt, Escherichia coli CFT073
uccggcacuuuuucaucag

SEQ ID NO: 2618825 - RNA, 22 nt, Escherichia coli CFT073
uccggcagagaggacucugccg

SEQ ID NO: 2618826 - RNA, 15 nt, Escherichia coli CFT073
uccggcagcagaaag

SEQ ID NO: 2618827 - RNA, 16 nt, Escherichia coli CFT073
uccggcagcagaaagc

SEQ ID NO: 2618828 - RNA, 14 nt, Escherichia coli CFT073
uccggcagcagcac

SEQ ID NO: 2618829 - RNA, 13 nt, Escherichia coli CFT073
uccggcagcgaac

SEQ ID NO: 2618830 - RNA, 20 nt, Escherichia coli CFT073
uccggcaguauuaccagacc

SEQ ID NO: 2618831 - RNA, 16 nt, Escherichia coli CFT073
uccggcauaaacacag

SEQ ID NO: 2618832 - RNA, 22 nt, Escherichia coli CFT073
uccggcauaaacacaggcacuu

SEQ ID NO: 2618833 - RNA, 16 nt, Escherichia coli CFT073
uccggcauacauuuau

SEQ ID NO: 2618834 - RNA, 13 nt, Escherichia coli CFT073
uccggcaucuugu

SEQ ID NO: 2618835 - RNA, 15 nt, Escherichia coli CFT073
uccggcaugaacaaa

SEQ ID NO: 2618836 - RNA, 21 nt, Escherichia coli CFT073
uccggcaugauucauccguca

SEQ ID NO: 2618837 - RNA, 13 nt, Escherichia coli CFT073
uccggcaugguga

SEQ ID NO: 2618838 - RNA, 21 nt, Escherichia coli CFT073
uccggccaguguuuaucaucu

SEQ ID NO: 2618839 - RNA, 18 nt, Escherichia coli CFT073
uccggccuacgggaacag

SEQ ID NO: 2618840 - RNA, 21 nt, Escherichia coli CFT073
uccggccuacgggaacagugc

SEQ ID NO: 2618841 - RNA, 16 nt, Escherichia coli CFT073
uccggccuacggguga

SEQ ID NO: 2618842 - RNA, 16 nt, Escherichia coli CFT073
uccggccuacugguga

SEQ ID NO: 2618843 - RNA, 15 nt, Escherichia coli CFT073
uccggcgacaggaac

SEQ ID NO: 2618844 - RNA, 14 nt, Escherichia coli CFT073
uccggcgcguugau

SEQ ID NO: 2618845 - RNA, 19 nt, Escherichia coli CFT073
uccggcggcacagccagcg

SEQ ID NO: 2618846 - RNA, 23 nt, Escherichia coli CFT073
uccggcgguaaaugcucauacca

SEQ ID NO: 2618847 - RNA, 14 nt, Escherichia coli CFT073
uccggcgucgaaaa

SEQ ID NO: 2618848 - RNA, 20 nt, Escherichia coli CFT073
uccggcguuuugauuuucac

SEQ ID NO: 2618849 - RNA, 21 nt, Escherichia coli CFT073
uccggcuauauugcaggagcg

SEQ ID NO: 2618850 - RNA, 14 nt, Escherichia coli CFT073
uccggcucauaucu

SEQ ID NO: 2618851 - RNA, 22 nt, Escherichia coli CFT073
uccggcuguuuuuugcagugcu

SEQ ID NO: 2618852 - RNA, 21 nt, Escherichia coli CFT073
uccggcuucuuuugcugccuu

SEQ ID NO: 2618853 - RNA, 17 nt, Escherichia coli CFT073
uccggcuuucacuugac

SEQ ID NO: 2618854 - RNA, 22 nt, Escherichia coli CFT073
uccggcuuugguuaauguacca

SEQ ID NO: 2618855 - RNA, 20 nt, Escherichia coli CFT073
uccgggaaauccucaaccgg

SEQ ID NO: 2618856 - RNA, 17 nt, Escherichia coli CFT073
uccgggagcaauuugua

SEQ ID NO: 2618857 - RNA, 15 nt, Escherichia coli CFT073
uccgggauauaaacc

SEQ ID NO: 2618858 - RNA, 16 nt, Escherichia coli CFT073
uccgggaucacaucau

SEQ ID NO: 2618859 - RNA, 14 nt, Escherichia coli CFT073
uccgggaucaccag

SEQ ID NO: 2618860 - RNA, 17 nt, Escherichia coli CFT073
uccgggaucaccagacc

SEQ ID NO: 2618861 - RNA, 22 nt, Escherichia coli CFT073
uccgggauugagauuucaccaa

SEQ ID NO: 2618862 - RNA, 14 nt, Escherichia coli CFT073
uccgggccaccaug

SEQ ID NO: 2618863 - RNA, 17 nt, Escherichia coli CFT073
uccgggccgcaaaccag

SEQ ID NO: 2618864 - RNA, 17 nt, Escherichia coli CFT073
uccgggcuaacacccgu

SEQ ID NO: 2618865 - RNA, 16 nt, Escherichia coli CFT073
uccgggcuaauacccu

SEQ ID NO: 2618866 - RNA, 17 nt, Escherichia coli CFT073
uccgggcuguuuuccag

SEQ ID NO: 2618867 - RNA, 22 nt, Escherichia coli CFT073
uccgggcuguuuuccagcacca

SEQ ID NO: 2618868 - RNA, 14 nt, Escherichia coli CFT073
uccgggggcgauuu

SEQ ID NO: 2618869 - RNA, 15 nt, Escherichia coli CFT073
uccggguaauaaacc

SEQ ID NO: 2618870 - RNA, 14 nt, Escherichia coli CFT073
uccgggucuguaaa

SEQ ID NO: 2618871 - RNA, 13 nt, Escherichia coli CFT073
uccggguuuucga

SEQ ID NO: 2618872 - RNA, 22 nt, Escherichia coli CFT073
uccggguuuucuccaaccagcu

SEQ ID NO: 2618873 - RNA, 15 nt, Escherichia coli CFT073
uccgguaacccuuca

SEQ ID NO: 2618874 - RNA, 16 nt, Escherichia coli CFT073
uccgguacucaucaga

SEQ ID NO: 2618875 - RNA, 19 nt, Escherichia coli CFT073
uccggucgggaagaucacc

SEQ ID NO: 2618876 - RNA, 13 nt, Escherichia coli CFT073
uccggugccggag

SEQ ID NO: 2618877 - RNA, 14 nt, Escherichia coli CFT073
uccgguggagagca

SEQ ID NO: 2618878 - RNA, 18 nt, Escherichia coli CFT073
uccgguggagagcauaua

SEQ ID NO: 2618879 - RNA, 19 nt, Escherichia coli CFT073
uccggugguuaacgcugcc

SEQ ID NO: 2618880 - RNA, 15 nt, Escherichia coli CFT073
uccgguucacuucac

SEQ ID NO: 2618881 - RNA, 19 nt, Escherichia coli CFT073
uccgguuguaggccugauc

SEQ ID NO: 2618882 - RNA, 21 nt, Escherichia coli CFT073
uccgguuuaaucgauuuagaa

SEQ ID NO: 2618883 - RNA, 22 nt, Escherichia coli CFT073
uccuguucgaacauuagcgcau

SEQ ID NO: 2618884 - RNA, 16 nt, Escherichia coli CFT073
uccuguuucacgccca

SEQ ID NO: 2618885 - RNA, 13 nt, Escherichia coli CFT073
uccuguuucacuu

SEQ ID NO: 2618886 - RNA, 18 nt, Escherichia coli CFT073
uccuguuuuuaagugaug

SEQ ID NO: 2618887 - RNA, 19 nt, Escherichia coli CFT073
uccuuaacuucaucggcaa

SEQ ID NO: 2618888 - RNA, 19 nt, Escherichia coli CFT073
uccuuagcagacguuugca

SEQ ID NO: 2618889 - RNA, 20 nt, Escherichia coli CFT073
uccuucaucuucaacggcca

SEQ ID NO: 2618890 - RNA, 12 nt, Escherichia coli CFT073
uccuucaucuuu

SEQ ID NO: 2618891 - RNA, 15 nt, Escherichia coli CFT073
uccuucccccaccac

SEQ ID NO: 2618892 - RNA, 18 nt, Escherichia coli CFT073
uccuucgggaucaaccgc

SEQ ID NO: 2618893 - RNA, 20 nt, Escherichia coli CFT073
uccuucuaaagcaacuccau

SEQ ID NO: 2618894 - RNA, 14 nt, Escherichia coli CFT073
uccuucucaucuuu

SEQ ID NO: 2618895 - RNA, 14 nt, Escherichia coli CFT073
uccuugaaaaagag

SEQ ID NO: 2618896 - RNA, 22 nt, Escherichia coli CFT073
uccuugccgcagacaaaauccu

SEQ ID NO: 2618897 - RNA, 22 nt, Escherichia coli CFT073
uccuugcguacaccaacaucac

SEQ ID NO: 2618898 - RNA, 21 nt, Escherichia coli CFT073
uccuugcugauuuuauuucac

SEQ ID NO: 2618899 - RNA, 16 nt, Escherichia coli CFT073
uccuuguaacgcgcua

SEQ ID NO: 2618900 - RNA, 14 nt, Escherichia coli CFT073
uccuuuaccacucu

SEQ ID NO: 2618901 - RNA, 23 nt, Escherichia coli CFT073
uccuuuagaagcacuaccuugcu

SEQ ID NO: 2618902 - RNA, 15 nt, Escherichia coli CFT073
uccuuuaucugcccu

SEQ ID NO: 2618903 - RNA, 15 nt, Escherichia coli CFT073
uccuuucaugcauuu

SEQ ID NO: 2618904 - RNA, 21 nt, Escherichia coli CFT073
uccuuugcugcucuauugccg

SEQ ID NO: 2618905 - RNA, 22 nt, Escherichia coli CFT073
uccuuuggacucauuaaaccac

SEQ ID NO: 2618906 - RNA, 15 nt, Escherichia coli CFT073
uccuuuucaccuuca

SEQ ID NO: 2618907 - RNA, 19 nt, Escherichia coli CFT073
uccuuuucaccuucaaaau

SEQ ID NO: 2618908 - RNA, 22 nt, Escherichia coli CFT073
ucgaaaaaccugacgcugcuca

SEQ ID NO: 2618909 - RNA, 10 nt, Escherichia coli CFT073
ucgaaaauau

SEQ ID NO: 2618910 - RNA, 18 nt, Escherichia coli CFT073
ucgaaaccacaguucaau

SEQ ID NO: 2618911 - RNA, 22 nt, Escherichia coli CFT073
ucgaaaccacaguucaaugcgc

SEQ ID NO: 2618912 - RNA, 15 nt, Escherichia coli CFT073
ucgaaauaucacuga

SEQ ID NO: 2618913 - RNA, 16 nt, Escherichia coli CFT073
ucgaaauaucacugau

SEQ ID NO: 2618914 - RNA, 18 nt, Escherichia coli CFT073
ucgaaaucauucgcagcu

SEQ ID NO: 2618915 - RNA, 19 nt, Escherichia coli CFT073
ucgaaauggcgggacagaa

SEQ ID NO: 2618916 - RNA, 22 nt, Escherichia coli CFT073
ucgaacaaggcaauuaaaaauu

SEQ ID NO: 2618917 - RNA, 18 nt, Escherichia coli CFT073
ucgaacagguuauugacg

SEQ ID NO: 2618918 - RNA, 21 nt, Escherichia coli CFT073
ucgaacauccccacagaaaca

SEQ ID NO: 2618919 - RNA, 16 nt, Escherichia coli CFT073
ucgaacauuucccgca

SEQ ID NO: 2618920 - RNA, 21 nt, Escherichia coli CFT073
ucgaacauuugcguggcgcgc

SEQ ID NO: 2618921 - RNA, 19 nt, Escherichia coli CFT073
ucgaaccaaacagcgccag

SEQ ID NO: 2618922 - RNA, 20 nt, Escherichia coli CFT073
ucgaaccaaacagcgccaga

SEQ ID NO: 2618923 - RNA, 20 nt, Escherichia coli CFT073
ucgaaccaucggcuuuggca

SEQ ID NO: 2618924 - RNA, 13 nt, Escherichia coli CFT073
ucgaacgcagagg

SEQ ID NO: 2618925 - RNA, 16 nt, Escherichia coli CFT073
ucgaacgcugcgcgac

SEQ ID NO: 2618926 - RNA, 12 nt, Escherichia coli CFT073
ucgaacggguga

SEQ ID NO: 2618927 - RNA, 22 nt, Escherichia coli CFT073
ucgaacggguuaaaucccgucu

SEQ ID NO: 2618928 - RNA, 17 nt, Escherichia coli CFT073
ucgaacgguaacaggaa

SEQ ID NO: 2618929 - RNA, 19 nt, Escherichia coli CFT073
ucgaagaaaaacuggauga

SEQ ID NO: 2618930 - RNA, 17 nt, Escherichia coli CFT073
ucgaagauuacgccgau

SEQ ID NO: 2618931 - RNA, 13 nt, Escherichia coli CFT073
ucgaagcaaagag

SEQ ID NO: 2618932 - RNA, 19 nt, Escherichia coli CFT073
ucgaagguuccugcaaagc

SEQ ID NO: 2618933 - RNA, 17 nt, Escherichia coli CFT073
ucgaaguuuuccucagu

SEQ ID NO: 2618934 - RNA, 14 nt, Escherichia coli CFT073
ucgaauccucccgg

SEQ ID NO: 2618935 - RNA, 21 nt, Escherichia coli CFT073
ucgaauccuucccccaccacc

SEQ ID NO: 2618936 - RNA, 18 nt, Escherichia coli CFT073
ucgaaucuguucuggaaa

SEQ ID NO: 2618937 - RNA, 16 nt, Escherichia coli CFT073
ucgacaaaaucagaaa

SEQ ID NO: 2618938 - RNA, 18 nt, Escherichia coli CFT073
ucgacaaaaucagaaaca

SEQ ID NO: 2618939 - RNA, 20 nt, Escherichia coli CFT073
ucgacaagcguaauuauucc

SEQ ID NO: 2618940 - RNA, 14 nt, Escherichia coli CFT073
ucgacaauaaucaa

SEQ ID NO: 2618941 - RNA, 21 nt, Escherichia coli CFT073
ucgacaauccagucagcgguu

SEQ ID NO: 2618942 - RNA, 20 nt, Escherichia coli CFT073
ucgacaaugguuaaauugaa

SEQ ID NO: 2618943 - RNA, 16 nt, Escherichia coli CFT073
ucgacaaugugaaaac

SEQ ID NO: 2618944 - RNA, 15 nt, Escherichia coli CFT073
ucgacaccagccaga

SEQ ID NO: 2618945 - RNA, 17 nt, Escherichia coli CFT073
ucgacaccagccagacu

SEQ ID NO: 2618946 - RNA, 16 nt, Escherichia coli CFT073
ucgacaccaucgcuuc

SEQ ID NO: 2618947 - RNA, 13 nt, Escherichia coli CFT073
ucgacaccuucag

SEQ ID NO: 2618948 - RNA, 15 nt, Escherichia coli CFT073
ucgacaguugcugcg

SEQ ID NO: 2618949 - RNA, 19 nt, Escherichia coli CFT073
ucgacauaaaucauuccgu

SEQ ID NO: 2618950 - RNA, 16 nt, Escherichia coli CFT073
ucgacauaauugacca

SEQ ID NO: 2618951 - RNA, 15 nt, Escherichia coli CFT073
ucgacaucaagaaau

SEQ ID NO: 2618952 - RNA, 16 nt, Escherichia coli CFT073
ucgacaucacauuaaa

SEQ ID NO: 2618953 - RNA, 14 nt, Escherichia coli CFT073
ucgacauucaacau

SEQ ID NO: 2618954 - RNA, 20 nt, Escherichia coli CFT073
ucgacauucaacauauccag

SEQ ID NO: 2618955 - RNA, 13 nt, Escherichia coli CFT073
ucgacauugacca

SEQ ID NO: 2618956 - RNA, 18 nt, Escherichia coli CFT073
ucgacauuucccccuucc

SEQ ID NO: 2618957 - RNA, 14 nt, Escherichia coli CFT073
ucgaccaaacuuau

SEQ ID NO: 2618958 - RNA, 20 nt, Escherichia coli CFT073
ucgaccagcgcacugccgcc

SEQ ID NO: 2618959 - RNA, 14 nt, Escherichia coli CFT073
ucgaccaggccauc

SEQ ID NO: 2618960 - RNA, 20 nt, Escherichia coli CFT073
ucgaccauugcguguuacgu

SEQ ID NO: 2618961 - RNA, 17 nt, Escherichia coli CFT073
ucgaccgucaccagucc

SEQ ID NO: 2618962 - RNA, 12 nt, Escherichia coli CFT073
ucgaccugcaac

SEQ ID NO: 2618963 - RNA, 18 nt, Escherichia coli CFT073
ucgacgagaauuuccuuc

SEQ ID NO: 2618964 - RNA, 14 nt, Escherichia coli CFT073
ucgacgccaguuug

SEQ ID NO: 2618965 - RNA, 17 nt, Escherichia coli CFT073
ucgacgccaucauucgc

SEQ ID NO: 2618966 - RNA, 22 nt, Escherichia coli CFT073
ucgacgcgugcagagucaucag

SEQ ID NO: 2618967 - RNA, 19 nt, Escherichia coli CFT073
ucgacggaauaaacccaca

SEQ ID NO: 2618968 - RNA, 19 nt, Escherichia coli CFT073
ucgacguaguacccucugc

SEQ ID NO: 2618969 - RNA, 14 nt, Escherichia coli CFT073
ucgacguuuuucag

SEQ ID NO: 2618970 - RNA, 16 nt, Escherichia coli CFT073
ucgacuagauacugac

SEQ ID NO: 2618971 - RNA, 16 nt, Escherichia coli CFT073
ucgacuuccaccagcg

SEQ ID NO: 2618972 - RNA, 21 nt, Escherichia coli CFT073
ucgacuuuagucgcuugcagg

SEQ ID NO: 2618973 - RNA, 12 nt, Escherichia coli CFT073
ucgacuuuuucc

SEQ ID NO: 2618974 - RNA, 14 nt, Escherichia coli CFT073
ucgagaaacgcgcg

SEQ ID NO: 2618975 - RNA, 15 nt, Escherichia coli CFT073
ucgagauaacgagca

SEQ ID NO: 2618976 - RNA, 16 nt, Escherichia coli CFT073
ucgagaucgacaccgg

SEQ ID NO: 2618977 - RNA, 22 nt, Escherichia coli CFT073
ucgagcagaaucgguccgccac

SEQ ID NO: 2618978 - RNA, 16 nt, Escherichia coli CFT073
ucgagcagcuccugcu

SEQ ID NO: 2618979 - RNA, 18 nt, Escherichia coli CFT073
ucgagccgcauccgacac

SEQ ID NO: 2618980 - RNA, 19 nt, Escherichia coli CFT073
ucgaggauccaugacaucu

SEQ ID NO: 2618981 - RNA, 20 nt, Escherichia coli CFT073
ucgaggcgauacgcaguggc

SEQ ID NO: 2618982 - RNA, 23 nt, Escherichia coli CFT073
ucgaguaaggcaaggaugcguuu

SEQ ID NO: 2618983 - RNA, 14 nt, Escherichia coli CFT073
ucgagucucguuuc

SEQ ID NO: 2618984 - RNA, 15 nt, Escherichia coli CFT073
ucgagugcaauaacg

SEQ ID NO: 2618985 - RNA, 15 nt, Escherichia coli CFT073
ucgagugcggcgagc

SEQ ID NO: 2618986 - RNA, 17 nt, Escherichia coli CFT073
ucgauaaacaucgccau

SEQ ID NO: 2618987 - RNA, 12 nt, Escherichia coli CFT073
ucgauaacugcu

SEQ ID NO: 2618988 - RNA, 13 nt, Escherichia coli CFT073
ucgauaacugcuc

SEQ ID NO: 2618989 - RNA, 22 nt, Escherichia coli CFT073
ucgauaagacauaacccagcga

SEQ ID NO: 2618990 - RNA, 14 nt, Escherichia coli CFT073
ucgauaagccagca

SEQ ID NO: 2618991 - RNA, 15 nt, Escherichia coli CFT073
ucgccaucagccacu

SEQ ID NO: 2618992 - RNA, 19 nt, Escherichia coli CFT073
ucgccaucagccacuucaa

SEQ ID NO: 2618993 - RNA, 15 nt, Escherichia coli CFT073
ucgccaucagcgccu

SEQ ID NO: 2618994 - RNA, 14 nt, Escherichia coli CFT073
ucgccaucagcgcu

SEQ ID NO: 2618995 - RNA, 12 nt, Escherichia coli CFT073
ucgccaucaggc

SEQ ID NO: 2618996 - RNA, 18 nt, Escherichia coli CFT073
ucgccauccugauagcuu

SEQ ID NO: 2618997 - RNA, 22 nt, Escherichia coli CFT073
ucgccaucuucggcgaaaauca

SEQ ID NO: 2618998 - RNA, 19 nt, Escherichia coli CFT073
ucgccaugaugagcgccau

SEQ ID NO: 2618999 - RNA, 15 nt, Escherichia coli CFT073
ucgccauguuuggca

SEQ ID NO: 2619000 - RNA, 17 nt, Escherichia coli CFT073
ucgccauuaucgauaau

SEQ ID NO: 2619001 - RNA, 18 nt, Escherichia coli CFT073
ucgccauugcagccgcga

SEQ ID NO: 2619002 - RNA, 19 nt, Escherichia coli CFT073
ucgccauuuucugccgcau

SEQ ID NO: 2619003 - RNA, 15 nt, Escherichia coli CFT073
ucgcccacaccagau

SEQ ID NO: 2619004 - RNA, 13 nt, Escherichia coli CFT073
ucgcccacaucau

SEQ ID NO: 2619005 - RNA, 17 nt, Escherichia coli CFT073
ucgcccacgccagagau

SEQ ID NO: 2619006 - RNA, 14 nt, Escherichia coli CFT073
ucgcccagccaucg

SEQ ID NO: 2619007 - RNA, 16 nt, Escherichia coli CFT073
ucgcccccggagaggg

SEQ ID NO: 2619008 - RNA, 18 nt, Escherichia coli CFT073
ucgcccccggcagugauc

SEQ ID NO: 2619009 - RNA, 17 nt, Escherichia coli CFT073
ucgccccugcccuuuca

SEQ ID NO: 2619010 - RNA, 17 nt, Escherichia coli CFT073
ucgcccgaccaucgcca

SEQ ID NO: 2619011 - RNA, 15 nt, Escherichia coli CFT073
ucgcccgcaaucagc

SEQ ID NO: 2619012 - RNA, 14 nt, Escherichia coli CFT073
ucgcccgccgcuaa

SEQ ID NO: 2619013 - RNA, 16 nt, Escherichia coli CFT073
ucgcccggcguggugc

SEQ ID NO: 2619014 - RNA, 20 nt, Escherichia coli CFT073
ucgcccggcguggugcagcc

SEQ ID NO: 2619015 - RNA, 15 nt, Escherichia coli CFT073
ucgcccgucuuccag

SEQ ID NO: 2619016 - RNA, 15 nt, Escherichia coli CFT073
ucgcccguucuuccu

SEQ ID NO: 2619017 - RNA, 17 nt, Escherichia coli CFT073
ucgcccucuuucaccag

SEQ ID NO: 2619018 - RNA, 20 nt, Escherichia coli CFT073
ucgcccugaauuucaauaau

SEQ ID NO: 2619019 - RNA, 17 nt, Escherichia coli CFT073
ucgcccugccagcgaua

SEQ ID NO: 2619020 - RNA, 16 nt, Escherichia coli CFT073
ucgcccugcgucgcac

SEQ ID NO: 2619021 - RNA, 21 nt, Escherichia coli CFT073
ucgcccugcuccagcagcuca

SEQ ID NO: 2619022 - RNA, 22 nt, Escherichia coli CFT073
ucgcccuggacaacauuccugu

SEQ ID NO: 2619023 - RNA, 14 nt, Escherichia coli CFT073
ucgcccuguuccug

SEQ ID NO: 2619024 - RNA, 18 nt, Escherichia coli CFT073
ucgcccuuaccauuccca

SEQ ID NO: 2619025 - RNA, 21 nt, Escherichia coli CFT073
ucgcccuuaccauucccagac

SEQ ID NO: 2619026 - RNA, 20 nt, Escherichia coli CFT073
ucgcccuucggcaucacgaa

SEQ ID NO: 2619027 - RNA, 17 nt, Escherichia coli CFT073
ucgccgaagcagcugcu

SEQ ID NO: 2619028 - RNA, 17 nt, Escherichia coli CFT073
ucgccgcacccgccaga

SEQ ID NO: 2619029 - RNA, 14 nt, Escherichia coli CFT073
ucgccgcagccaga

SEQ ID NO: 2619030 - RNA, 19 nt, Escherichia coli CFT073
ucgccgcagguagcagcag

SEQ ID NO: 2619031 - RNA, 18 nt, Escherichia coli CFT073
ucgccgccgcaaacaucg

SEQ ID NO: 2619032 - RNA, 13 nt, Escherichia coli CFT073
ucgccgccgcaga

SEQ ID NO: 2619033 - RNA, 14 nt, Escherichia coli CFT073
ucgccgccgcagac

SEQ ID NO: 2619034 - RNA, 22 nt, Escherichia coli CFT073
ucgccgcgcaaauccacguucc

SEQ ID NO: 2619035 - RNA, 21 nt, Escherichia coli CFT073
ucgccgcggcgcagcuucaca

SEQ ID NO: 2619036 - RNA, 12 nt, Escherichia coli CFT073
ucgccgcugcgg

SEQ ID NO: 2619037 - RNA, 20 nt, Escherichia coli CFT073
ucgccggaugaaaagucauc

SEQ ID NO: 2619038 - RNA, 17 nt, Escherichia coli CFT073
ucgccggcgugauaucc

SEQ ID NO: 2619039 - RNA, 21 nt, Escherichia coli CFT073
ucgccgggauauaugucacca

SEQ ID NO: 2619040 - RNA, 21 nt, Escherichia coli CFT073
ucgccggucaggauguugcca

SEQ ID NO: 2619041 - RNA, 20 nt, Escherichia coli CFT073
ucgccguaaacaucauccag

SEQ ID NO: 2619042 - RNA, 15 nt, Escherichia coli CFT073
ucgccguaauuaaca

SEQ ID NO: 2619043 - RNA, 18 nt, Escherichia coli CFT073
ucgccgucaguugugcca

SEQ ID NO: 2619044 - RNA, 16 nt, Escherichia coli CFT073
ucgccguggcuguuga

SEQ ID NO: 2619045 - RNA, 17 nt, Escherichia coli CFT073
ucgccguuggugauguu

SEQ ID NO: 2619046 - RNA, 22 nt, Escherichia coli CFT073
ucgccuaccaucaacgugaauc

SEQ ID NO: 2619047 - RNA, 13 nt, Escherichia coli CFT073
ucgccuccacgcg

SEQ ID NO: 2619048 - RNA, 14 nt, Escherichia coli CFT073
ucgccucgccgaaa

SEQ ID NO: 2619049 - RNA, 12 nt, Escherichia coli CFT073
ucgccugcggcg

SEQ ID NO: 2619050 - RNA, 19 nt, Escherichia coli CFT073
ucgccuucagguuuuucag

SEQ ID NO: 2619051 - RNA, 17 nt, Escherichia coli CFT073
ucgccuucauacgacga

SEQ ID NO: 2619052 - RNA, 18 nt, Escherichia coli CFT073
ucgccuuccagcagcuug

SEQ ID NO: 2619053 - RNA, 20 nt, Escherichia coli CFT073
ucgccuuccggcaguuucau

SEQ ID NO: 2619054 - RNA, 19 nt, Escherichia coli CFT073
ucgccuuucaguucaacgg

SEQ ID NO: 2619055 - RNA, 19 nt, Escherichia coli CFT073
ucgccuuugauuuucaggu

SEQ ID NO: 2619056 - RNA, 17 nt, Escherichia coli CFT073
ucgcgaaaccacgguga

SEQ ID NO: 2619057 - RNA, 16 nt, Escherichia coli CFT073
ucgcgaaucgccacaa

SEQ ID NO: 2619058 - RNA, 12 nt, Escherichia coli CFT073
ucgcgacgcuga

SEQ ID NO: 2619059 - RNA, 21 nt, Escherichia coli CFT073
ucgcgauagccgcuuucuaac

SEQ ID NO: 2619060 - RNA, 18 nt, Escherichia coli CFT073
ucgcgauagcgcaccaac

SEQ ID NO: 2619061 - RNA, 16 nt, Escherichia coli CFT073
ucgcgauagcgcaccg

SEQ ID NO: 2619062 - RNA, 19 nt, Escherichia coli CFT073
ucgcgaugagucgccgcaa

SEQ ID NO: 2619063 - RNA, 24 nt, Escherichia coli CFT073
ucgcgcaauugccagacaacauga

SEQ ID NO: 2619064 - RNA, 24 nt, Escherichia coli CFT073
ucgcgcacgaggaacagcgcgcug

SEQ ID NO: 2619065 - RNA, 22 nt, Escherichia coli CFT073
ucgcgcacgcccaucagcggua

SEQ ID NO: 2619066 - RNA, 14 nt, Escherichia coli CFT073
ucgcgcacggugca

SEQ ID NO: 2619067 - RNA, 20 nt, Escherichia coli CFT073
ucgcgcagucgggugcugcc

SEQ ID NO: 2619068 - RNA, 16 nt, Escherichia coli CFT073
ucgcgcaguguaaacc

SEQ ID NO: 2619069 - RNA, 15 nt, Escherichia coli CFT073
ucgcgcaugcgccua

SEQ ID NO: 2619070 - RNA, 20 nt, Escherichia coli CFT073
ucgcgccaaucagcgcagca

SEQ ID NO: 2619071 - RNA, 14 nt, Escherichia coli CFT073
ucgcgccagccagu

SEQ ID NO: 2619072 - RNA, 21 nt, Escherichia coli CFT073
ucgcgcgaagugagggccagc

SEQ ID NO: 2619073 - RNA, 22 nt, Escherichia coli CFT073
ucgcgcgaagugagggccagcg

SEQ ID NO: 2619074 - RNA, 16 nt, Escherichia coli CFT073
ucgcgcgcgccugcgg

SEQ ID NO: 2619075 - RNA, 17 nt, Escherichia coli CFT073
ucgcgcgcgguggcgua

SEQ ID NO: 2619076 - RNA, 17 nt, Escherichia coli CFT073
ucgcgcgggaaauuaag

SEQ ID NO: 2619077 - RNA, 18 nt, Escherichia coli CFT073
ucgcgcgggcagaugcca

SEQ ID NO: 2619078 - RNA, 13 nt, Escherichia coli CFT073
ucgcgcucaucag

SEQ ID NO: 2619079 - RNA, 14 nt, Escherichia coli CFT073
ucgcgcuccggcac

SEQ ID NO: 2619080 - RNA, 16 nt, Escherichia coli CFT073
ucgcgcucuucuucac

SEQ ID NO: 2619081 - RNA, 19 nt, Escherichia coli CFT073
ucgcgcuuaucgccagcgc

SEQ ID NO: 2619082 - RNA, 21 nt, Escherichia coli CFT073
ucgcgcuuaucgccagcgcga

SEQ ID NO: 2619083 - RNA, 21 nt, Escherichia coli CFT073
ucgcgcuucguuuuccgccac

SEQ ID NO: 2619084 - RNA, 16 nt, Escherichia coli CFT073
ucgcggaccaacaaaa

SEQ ID NO: 2619085 - RNA, 18 nt, Escherichia coli CFT073
ucgcggacuucuggcaga

SEQ ID NO: 2619086 - RNA, 22 nt, Escherichia coli CFT073
ucgcggcgauauccagcgcggc

SEQ ID NO: 2619087 - RNA, 18 nt, Escherichia coli CFT073
ucgcggcuauucaccacu

SEQ ID NO: 2619088 - RNA, 17 nt, Escherichia coli CFT073
ucgcgggaaaaaguacu

SEQ ID NO: 2619089 - RNA, 18 nt, Escherichia coli CFT073
ucgcgguaaauugugucg

SEQ ID NO: 2619090 - RNA, 16 nt, Escherichia coli CFT073
ucgcgguuagcggcuu

SEQ ID NO: 2619091 - RNA, 14 nt, Escherichia coli CFT073
ucgcguaaggcuuc

SEQ ID NO: 2619092 - RNA, 21 nt, Escherichia coli CFT073
ucgcguaauguuuccagcauc

SEQ ID NO: 2619093 - RNA, 16 nt, Escherichia coli CFT073
ucgcguagcugcugcu

SEQ ID NO: 2619094 - RNA, 21 nt, Escherichia coli CFT073
ucgcgucaucgucacaacauu

SEQ ID NO: 2619095 - RNA, 14 nt, Escherichia coli CFT073
ucgcgucuggcauu

SEQ ID NO: 2619096 - RNA, 14 nt, Escherichia coli CFT073
ucgcguucggaaau

SEQ ID NO: 2619097 - RNA, 19 nt, Escherichia coli CFT073
ucgcguuucuccacuggca

SEQ ID NO: 2619098 - RNA, 22 nt, Escherichia coli CFT073
ucgcuaaagcauucucccgccu

SEQ ID NO: 2619099 - RNA, 22 nt, Escherichia coli CFT073
ucggcgcggcgguugacgcccc

SEQ ID NO: 2619100 - RNA, 12 nt, Escherichia coli CFT073
ucggcgcuucaa

SEQ ID NO: 2619101 - RNA, 20 nt, Escherichia coli CFT073
ucggcggcgaucgccugcug

SEQ ID NO: 2619102 - RNA, 13 nt, Escherichia coli CFT073
ucggcggcgugcc

SEQ ID NO: 2619103 - RNA, 18 nt, Escherichia coli CFT073
ucggcgggcaauacaccu

SEQ ID NO: 2619104 - RNA, 18 nt, Escherichia coli CFT073
ucggcguaguuaacuggu

SEQ ID NO: 2619105 - RNA, 17 nt, Escherichia coli CFT073
ucggcgucgcaucaggu

SEQ ID NO: 2619106 - RNA, 19 nt, Escherichia coli CFT073
ucggcgucuuguugaacag

SEQ ID NO: 2619107 - RNA, 21 nt, Escherichia coli CFT073
ucggcguuaacaauaacucuu

SEQ ID NO: 2619108 - RNA, 19 nt, Escherichia coli CFT073
ucggcuacgaaccgagcgg

SEQ ID NO: 2619109 - RNA, 13 nt, Escherichia coli CFT073
ucggcugcaccuu

SEQ ID NO: 2619110 - RNA, 18 nt, Escherichia coli CFT073
ucggcuuccagaagcauc

SEQ ID NO: 2619111 - RNA, 13 nt, Escherichia coli CFT073
ucggcuuuuuacu

SEQ ID NO: 2619112 - RNA, 15 nt, Escherichia coli CFT073
ucgggaagaucacca

SEQ ID NO: 2619113 - RNA, 14 nt, Escherichia coli CFT073
ucgggauauugccc

SEQ ID NO: 2619114 - RNA, 20 nt, Escherichia coli CFT073
ucgggcaacguugaccaguc

SEQ ID NO: 2619115 - RNA, 20 nt, Escherichia coli CFT073
ucgggcaauggcuccgggug

SEQ ID NO: 2619116 - RNA, 21 nt, Escherichia coli CFT073
ucgggcaggcuucaacacagg

SEQ ID NO: 2619117 - RNA, 14 nt, Escherichia coli CFT073
ucgggcaucagaag

SEQ ID NO: 2619118 - RNA, 23 nt, Escherichia coli CFT073
ucgggcgguauuuaaacucgcug

SEQ ID NO: 2619119 - RNA, 20 nt, Escherichia coli CFT073
ucgggcuaauuuccuggacu

SEQ ID NO: 2619120 - RNA, 16 nt, Escherichia coli CFT073
ucggggcaaguuucgu

SEQ ID NO: 2619121 - RNA, 22 nt, Escherichia coli CFT073
ucggggucgcgaguucgagucu

SEQ ID NO: 2619122 - RNA, 18 nt, Escherichia coli CFT073
ucggggugguugucggca

SEQ ID NO: 2619123 - RNA, 14 nt, Escherichia coli CFT073
ucggguucgccauc

SEQ ID NO: 2619124 - RNA, 19 nt, Escherichia coli CFT073
ucggguucgccaucccugc

SEQ ID NO: 2619125 - RNA, 23 nt, Escherichia coli CFT073
ucggguuuacgcgcgcaggcaac

SEQ ID NO: 2619126 - RNA, 21 nt, Escherichia coli CFT073
ucgguaaaaucaacgccgcau

SEQ ID NO: 2619127 - RNA, 20 nt, Escherichia coli CFT073
ucgguaaacggcacaaaucc

SEQ ID NO: 2619128 - RNA, 13 nt, Escherichia coli CFT073
ucgguaacgcuug

SEQ ID NO: 2619129 - RNA, 22 nt, Escherichia coli CFT073
ucgguaaugcacuccgccgcac

SEQ ID NO: 2619130 - RNA, 22 nt, Escherichia coli CFT073
ucgguagagaaaaccacccgca

SEQ ID NO: 2619131 - RNA, 15 nt, Escherichia coli CFT073
ucgguagcaccaguu

SEQ ID NO: 2619132 - RNA, 13 nt, Escherichia coli CFT073
ucggucaccagga

SEQ ID NO: 2619133 - RNA, 20 nt, Escherichia coli CFT073
ucggucaccaugaacaccaa

SEQ ID NO: 2619134 - RNA, 15 nt, Escherichia coli CFT073
ucggucaguuugccc

SEQ ID NO: 2619135 - RNA, 15 nt, Escherichia coli CFT073
ucggugaccauccau

SEQ ID NO: 2619136 - RNA, 19 nt, Escherichia coli CFT073
ucggugauauacgccacuu

SEQ ID NO: 2619137 - RNA, 17 nt, Escherichia coli CFT073
ucggugaugaauccggu

SEQ ID NO: 2619138 - RNA, 23 nt, Escherichia coli CFT073
ucggugcauuuucuaugcugcca

SEQ ID NO: 2619139 - RNA, 15 nt, Escherichia coli CFT073
ucggugccgucaauc

SEQ ID NO: 2619140 - RNA, 16 nt, Escherichia coli CFT073
ucgguggaaaauagca

SEQ ID NO: 2619141 - RNA, 17 nt, Escherichia coli CFT073
ucgguguauuucgaaug

SEQ ID NO: 2619142 - RNA, 14 nt, Escherichia coli CFT073
ucgguguccacuuc

SEQ ID NO: 2619143 - RNA, 16 nt, Escherichia coli CFT073
ucggugucguuacgcc

SEQ ID NO: 2619144 - RNA, 18 nt, Escherichia coli CFT073
ucgguuaacagcgcacca

SEQ ID NO: 2619145 - RNA, 18 nt, Escherichia coli CFT073
ucgguuaccacaccggca

SEQ ID NO: 2619146 - RNA, 19 nt, Escherichia coli CFT073
ucgguuaccaguacaccaa

SEQ ID NO: 2619147 - RNA, 18 nt, Escherichia coli CFT073
ucgguuacuauccugaaa

SEQ ID NO: 2619148 - RNA, 15 nt, Escherichia coli CFT073
ucgguucauaaacac

SEQ ID NO: 2619149 - RNA, 12 nt, Escherichia coli CFT073
ucgguugccaua

SEQ ID NO: 2619150 - RNA, 14 nt, Escherichia coli CFT073
ucgguuguuuucag

SEQ ID NO: 2619151 - RNA, 18 nt, Escherichia coli CFT073
ucgguuuuaacaccacuc

SEQ ID NO: 2619152 - RNA, 13 nt, Escherichia coli CFT073
ucguaacaggaaa

SEQ ID NO: 2619153 - RNA, 18 nt, Escherichia coli CFT073
ucguaagccgugaaaaca

SEQ ID NO: 2619154 - RNA, 17 nt, Escherichia coli CFT073
ucguaagcgagaacugc

SEQ ID NO: 2619155 - RNA, 19 nt, Escherichia coli CFT073
ucguaagcgagaacugccu

SEQ ID NO: 2619156 - RNA, 18 nt, Escherichia coli CFT073
ucguaagucaccgcuuuu

SEQ ID NO: 2619157 - RNA, 16 nt, Escherichia coli CFT073
ucguaaucucuuucca

SEQ ID NO: 2619158 - RNA, 16 nt, Escherichia coli CFT073
ucguaaugaaucagca

SEQ ID NO: 2619159 - RNA, 23 nt, Escherichia coli CFT073
ucguaaugaaucagcagauccau

SEQ ID NO: 2619160 - RNA, 20 nt, Escherichia coli CFT073
ucguacaaacgcuuuacuca

SEQ ID NO: 2619161 - RNA, 14 nt, Escherichia coli CFT073
ucguacacccgcca

SEQ ID NO: 2619162 - RNA, 16 nt, Escherichia coli CFT073
ucguacacccgccaga

SEQ ID NO: 2619163 - RNA, 23 nt, Escherichia coli CFT073
ucguacacccgccagaaucaccg

SEQ ID NO: 2619164 - RNA, 12 nt, Escherichia coli CFT073
ucguaccagugc

SEQ ID NO: 2619165 - RNA, 22 nt, Escherichia coli CFT073
ucguaccagugcagaugcacaa

SEQ ID NO: 2619166 - RNA, 23 nt, Escherichia coli CFT073
ucguaccagugcagcgcaugauu

SEQ ID NO: 2619167 - RNA, 21 nt, Escherichia coli CFT073
ucguaccauacugauccgcuu

SEQ ID NO: 2619168 - RNA, 17 nt, Escherichia coli CFT073
uacuggcgauugucauu

SEQ ID NO: 2619169 - RNA, 15 nt, Escherichia coli CFT073
uacuggcuuucauuu

SEQ ID NO: 2619170 - RNA, 22 nt, Escherichia coli CFT073
uacugguaagcaaagcaaaggc

SEQ ID NO: 2619171 - RNA, 16 nt, Escherichia coli CFT073
uacugguugauuuuaa

SEQ ID NO: 2619172 - RNA, 14 nt, Escherichia coli CFT073
uacugguugcggua

SEQ ID NO: 2619173 - RNA, 19 nt, Escherichia coli CFT073
uacuguaaauaguauuauu

SEQ ID NO: 2619174 - RNA, 14 nt, Escherichia coli CFT073
uacuguacaacaca

SEQ ID NO: 2619175 - RNA, 23 nt, Escherichia coli CFT073
uacuguauacgggcuuuuuaauu

SEQ ID NO: 2619176 - RNA, 18 nt, Escherichia coli CFT073
uacuguaucgaugcuguu

SEQ ID NO: 2619177 - RNA, 21 nt, Escherichia coli CFT073
uacugucguuuagacgcugcg

SEQ ID NO: 2619178 - RNA, 13 nt, Escherichia coli CFT073
uacugucugcucg

SEQ ID NO: 2619179 - RNA, 22 nt, Escherichia coli CFT073
uacuuaacacccccugcaaaac

SEQ ID NO: 2619180 - RNA, 18 nt, Escherichia coli CFT073
uacuuacacaucaugaua

SEQ ID NO: 2619181 - RNA, 17 nt, Escherichia coli CFT073
uacuuaucuaauaaaca

SEQ ID NO: 2619182 - RNA, 15 nt, Escherichia coli CFT073
uacuuauugaaagca

SEQ ID NO: 2619183 - RNA, 20 nt, Escherichia coli CFT073
uacuucaacauaagcaaauc

SEQ ID NO: 2619184 - RNA, 19 nt, Escherichia coli CFT073
uacuucacaugauaauaaa

SEQ ID NO: 2619185 - RNA, 22 nt, Escherichia coli CFT073
uacuucaccauucacauccaca

SEQ ID NO: 2619186 - RNA, 22 nt, Escherichia coli CFT073
uacuucacggcugcuaauauuu

SEQ ID NO: 2619187 - RNA, 12 nt, Escherichia coli CFT073
uacuucuuucac

SEQ ID NO: 2619188 - RNA, 21 nt, Escherichia coli CFT073
uacuuguuuuugaucuccuuu

SEQ ID NO: 2619189 - RNA, 16 nt, Escherichia coli CFT073
uacuuuaaaauaagca

SEQ ID NO: 2619190 - RNA, 15 nt, Escherichia coli CFT073
uacuuucaugcucaa

SEQ ID NO: 2619191 - RNA, 16 nt, Escherichia coli CFT073
uacuuuccagccacag

SEQ ID NO: 2619192 - RNA, 20 nt, Escherichia coli CFT073
uacuuucugauuguuauuca

SEQ ID NO: 2619193 - RNA, 16 nt, Escherichia coli CFT073
uacuuuuuccagcaga

SEQ ID NO: 2619194 - RNA, 18 nt, Escherichia coli CFT073
uagaaaauuauuuuaaau

SEQ ID NO: 2619195 - RNA, 19 nt, Escherichia coli CFT073
uagaaacgcugaaugcugc

SEQ ID NO: 2619196 - RNA, 16 nt, Escherichia coli CFT073
uagaaagugacugcug

SEQ ID NO: 2619197 - RNA, 18 nt, Escherichia coli CFT073
uagaaaguugccagauaa

SEQ ID NO: 2619198 - RNA, 21 nt, Escherichia coli CFT073
uagaaccacgcaaaggcguua

SEQ ID NO: 2619199 - RNA, 16 nt, Escherichia coli CFT073
uagaaccuaagaacca

SEQ ID NO: 2619200 - RNA, 19 nt, Escherichia coli CFT073
uagaaccuaagaaccagaa

SEQ ID NO: 2619201 - RNA, 16 nt, Escherichia coli CFT073
uagaaccuuccacguu

SEQ ID NO: 2619202 - RNA, 17 nt, Escherichia coli CFT073
uagaaccuugcuggcga

SEQ ID NO: 2619203 - RNA, 16 nt, Escherichia coli CFT073
uagaacggcagagaaa

SEQ ID NO: 2619204 - RNA, 20 nt, Escherichia coli CFT073
uagaacggcagagaaaccac

SEQ ID NO: 2619205 - RNA, 18 nt, Escherichia coli CFT073
uagaagccagagaacaga

SEQ ID NO: 2619206 - RNA, 14 nt, Escherichia coli CFT073
uagaagccaguaca

SEQ ID NO: 2619207 - RNA, 19 nt, Escherichia coli CFT073
uagaagccauuaaacacca

SEQ ID NO: 2619208 - RNA, 22 nt, Escherichia coli CFT073
uagaagccauuaaacaccagua

SEQ ID NO: 2619209 - RNA, 23 nt, Escherichia coli CFT073
uagaagccauuaaacaccaguac

SEQ ID NO: 2619210 - RNA, 22 nt, Escherichia coli CFT073
uagaagcuccgguacucaucag

SEQ ID NO: 2619211 - RNA, 17 nt, Escherichia coli CFT073
uagaauaaucuguuucu

SEQ ID NO: 2619212 - RNA, 15 nt, Escherichia coli CFT073
uagaaugcagcagca

SEQ ID NO: 2619213 - RNA, 16 nt, Escherichia coli CFT073
uagacaauguaucuuu

SEQ ID NO: 2619214 - RNA, 19 nt, Escherichia coli CFT073
uagacaauguaucuuucau

SEQ ID NO: 2619215 - RNA, 23 nt, Escherichia coli CFT073
uagacaggguugcagacccgcca

SEQ ID NO: 2619216 - RNA, 21 nt, Escherichia coli CFT073
uagacuuccccacaaaauaac

SEQ ID NO: 2619217 - RNA, 14 nt, Escherichia coli CFT073
uagagaauguaaau

SEQ ID NO: 2619218 - RNA, 22 nt, Escherichia coli CFT073
uagagccgguuuugguuuucug

SEQ ID NO: 2619219 - RNA, 13 nt, Escherichia coli CFT073
uagagcucaucag

SEQ ID NO: 2619220 - RNA, 19 nt, Escherichia coli CFT073
uagagcuugugcaccagcu

SEQ ID NO: 2619221 - RNA, 18 nt, Escherichia coli CFT073
uagaggugauaugaauga

SEQ ID NO: 2619222 - RNA, 21 nt, Escherichia coli CFT073
uagaguauccugacgcuguuu

SEQ ID NO: 2619223 - RNA, 21 nt, Escherichia coli CFT073
uagagucgaucuuuugucgcu

SEQ ID NO: 2619224 - RNA, 12 nt, Escherichia coli CFT073
uagaguguugug

SEQ ID NO: 2619225 - RNA, 15 nt, Escherichia coli CFT073
uagaguuugaacuca

SEQ ID NO: 2619226 - RNA, 14 nt, Escherichia coli CFT073
uagauaauuuugaa

SEQ ID NO: 2619227 - RNA, 22 nt, Escherichia coli CFT073
uagauaauuuugaaauaaaauc

SEQ ID NO: 2619228 - RNA, 22 nt, Escherichia coli CFT073
uagauacccggauacaacucgc

SEQ ID NO: 2619229 - RNA, 21 nt, Escherichia coli CFT073
uagauaccgcuuuugccagca

SEQ ID NO: 2619230 - RNA, 16 nt, Escherichia coli CFT073
uagauagcguucuuua

SEQ ID NO: 2619231 - RNA, 17 nt, Escherichia coli CFT073
uagauaggucaccagag

SEQ ID NO: 2619232 - RNA, 12 nt, Escherichia coli CFT073
uagauauauauu

SEQ ID NO: 2619233 - RNA, 13 nt, Escherichia coli CFT073
uagauauauauua

SEQ ID NO: 2619234 - RNA, 16 nt, Escherichia coli CFT073
uagauauauauuauau

SEQ ID NO: 2619235 - RNA, 16 nt, Escherichia coli CFT073
uagauauauccugaac

SEQ ID NO: 2619236 - RNA, 14 nt, Escherichia coli CFT073
uagauaucaugcuc

SEQ ID NO: 2619237 - RNA, 22 nt, Escherichia coli CFT073
uagauauucaucaaaaugaaca

SEQ ID NO: 2619238 - RNA, 22 nt, Escherichia coli CFT073
uagaucacucacccgccagcgc

SEQ ID NO: 2619239 - RNA, 17 nt, Escherichia coli CFT073
uagaucaggaaaaacgg

SEQ ID NO: 2619240 - RNA, 14 nt, Escherichia coli CFT073
uagaucgccagaaa

SEQ ID NO: 2619241 - RNA, 20 nt, Escherichia coli CFT073
uagaucgccagaaaguggca

SEQ ID NO: 2619242 - RNA, 21 nt, Escherichia coli CFT073
uagaucguacagguaagcaca

SEQ ID NO: 2619243 - RNA, 21 nt, Escherichia coli CFT073
uagaucguacucaaucccucg

SEQ ID NO: 2619244 - RNA, 15 nt, Escherichia coli CFT073
uagaucuaaaugcca

SEQ ID NO: 2619245 - RNA, 17 nt, Escherichia coli CFT073
uagaucuaugucgcauc

SEQ ID NO: 2619246 - RNA, 17 nt, Escherichia coli CFT073
uagaugacacucacgca

SEQ ID NO: 2619247 - RNA, 22 nt, Escherichia coli CFT073
uagauggcggaaauaacgcuga

SEQ ID NO: 2619248 - RNA, 21 nt, Escherichia coli CFT073
uagauuaauuucccaccacua

SEQ ID NO: 2619249 - RNA, 18 nt, Escherichia coli CFT073
uagauuaccagagaaaag

SEQ ID NO: 2619250 - RNA, 14 nt, Escherichia coli CFT073
uagauuguuuucaa

SEQ ID NO: 2619251 - RNA, 22 nt, Escherichia coli CFT073
uagauuuugcagaucaccaaua

SEQ ID NO: 2619252 - RNA, 22 nt, Escherichia coli CFT073
uagcaaaacucaccauccugau

SEQ ID NO: 2619253 - RNA, 20 nt, Escherichia coli CFT073
uagcaaacuaucuguguaau

SEQ ID NO: 2619254 - RNA, 20 nt, Escherichia coli CFT073
uagcaaaguaguaaugauca

SEQ ID NO: 2619255 - RNA, 16 nt, Escherichia coli CFT073
uagcaaccggggcauu

SEQ ID NO: 2619256 - RNA, 24 nt, Escherichia coli CFT073
uagcaaccggggcauucaugaaca

SEQ ID NO: 2619257 - RNA, 21 nt, Escherichia coli CFT073
uagcaacgauaacaaucacca

SEQ ID NO: 2619258 - RNA, 23 nt, Escherichia coli CFT073
uagcaacgauaacaaucaccaaa

SEQ ID NO: 2619259 - RNA, 21 nt, Escherichia coli CFT073
uagcaacgauauccauaucua

SEQ ID NO: 2619260 - RNA, 17 nt, Escherichia coli CFT073
uagcaagacuuuguagg

SEQ ID NO: 2619261 - RNA, 14 nt, Escherichia coli CFT073
uagcaaggaugcca

SEQ ID NO: 2619262 - RNA, 19 nt, Escherichia coli CFT073
uagcacauaaaauggccau

SEQ ID NO: 2619263 - RNA, 17 nt, Escherichia coli CFT073
uagcaccaguuggucgg

SEQ ID NO: 2619264 - RNA, 20 nt, Escherichia coli CFT073
uagcacccgguaaacaaaaa

SEQ ID NO: 2619265 - RNA, 18 nt, Escherichia coli CFT073
uagcacgacguuucuuuc

SEQ ID NO: 2619266 - RNA, 14 nt, Escherichia coli CFT073
uagcacgauuuugu

SEQ ID NO: 2619267 - RNA, 14 nt, Escherichia coli CFT073
uagcaggaaauaua

SEQ ID NO: 2619268 - RNA, 13 nt, Escherichia coli CFT073
uagcaguuccagc

SEQ ID NO: 2619269 - RNA, 17 nt, Escherichia coli CFT073
uagcaguuccagcaucu

SEQ ID NO: 2619270 - RNA, 23 nt, Escherichia coli CFT073
uagcaguuccagcaucuguucuu

SEQ ID NO: 2619271 - RNA, 18 nt, Escherichia coli CFT073
uagcaguucuuaaggcau

SEQ ID NO: 2619272 - RNA, 14 nt, Escherichia coli CFT073
uagcauauacgaaa

SEQ ID NO: 2619273 - RNA, 15 nt, Escherichia coli CFT073
uagcaucaagaaaaa

SEQ ID NO: 2619274 - RNA, 16 nt, Escherichia coli CFT073
uagcaucaagaaaaau

SEQ ID NO: 2619275 - RNA, 14 nt, Escherichia coli CFT073
uagggcagggugcc

SEQ ID NO: 2619276 - RNA, 16 nt, Escherichia coli CFT073
uagggcgcagcugugc

SEQ ID NO: 2619277 - RNA, 17 nt, Escherichia coli CFT073
uaggguggggaaaaaac

SEQ ID NO: 2619278 - RNA, 16 nt, Escherichia coli CFT073
uagguaaacaucacau

SEQ ID NO: 2619279 - RNA, 13 nt, Escherichia coli CFT073
uagguaaacaucc

SEQ ID NO: 2619280 - RNA, 19 nt, Escherichia coli CFT073
uagguacaaagccaacagc

SEQ ID NO: 2619281 - RNA, 20 nt, Escherichia coli CFT073
uagguacaaagccaacagca

SEQ ID NO: 2619282 - RNA, 14 nt, Escherichia coli CFT073
uaggucaccagaga

SEQ ID NO: 2619283 - RNA, 16 nt, Escherichia coli CFT073
uaggucauaucaucaa

SEQ ID NO: 2619284 - RNA, 15 nt, Escherichia coli CFT073
uaggucauuggcgua

SEQ ID NO: 2619285 - RNA, 17 nt, Escherichia coli CFT073
uagguguaaauaucagg

SEQ ID NO: 2619286 - RNA, 16 nt, Escherichia coli CFT073
uagguguuaauggaau

SEQ ID NO: 2619287 - RNA, 12 nt, Escherichia coli CFT073
uagguuucacgu

SEQ ID NO: 2619288 - RNA, 17 nt, Escherichia coli CFT073
uaguaagaaccacagcc

SEQ ID NO: 2619289 - RNA, 13 nt, Escherichia coli CFT073
uaguaagcccagg

SEQ ID NO: 2619290 - RNA, 14 nt, Escherichia coli CFT073
uaguaagcccaggg

SEQ ID NO: 2619291 - RNA, 15 nt, Escherichia coli CFT073
uaguaauguuuucuu

SEQ ID NO: 2619292 - RNA, 20 nt, Escherichia coli CFT073
uaguacaggcggcaauggcg

SEQ ID NO: 2619293 - RNA, 19 nt, Escherichia coli CFT073
uaguacauuguuuuccaga

SEQ ID NO: 2619294 - RNA, 14 nt, Escherichia coli CFT073
uaguacauuucuuc

SEQ ID NO: 2619295 - RNA, 17 nt, Escherichia coli CFT073
uaguacccucugcacca

SEQ ID NO: 2619296 - RNA, 14 nt, Escherichia coli CFT073
uaguaccgcuacgu

SEQ ID NO: 2619297 - RNA, 18 nt, Escherichia coli CFT073
uaguacgccaaucugcaa

SEQ ID NO: 2619298 - RNA, 20 nt, Escherichia coli CFT073
uaguacgcgggaauagcuca

SEQ ID NO: 2619299 - RNA, 18 nt, Escherichia coli CFT073
uaguacucguagcccugg

SEQ ID NO: 2619300 - RNA, 21 nt, Escherichia coli CFT073
uaguaggagaagcauccugca

SEQ ID NO: 2619301 - RNA, 16 nt, Escherichia coli CFT073
uaguagguuguaccca

SEQ ID NO: 2619302 - RNA, 11 nt, Escherichia coli CFT073
uaguauccugg

SEQ ID NO: 2619303 - RNA, 20 nt, Escherichia coli CFT073
uaguaucgauugaugauugc

SEQ ID NO: 2619304 - RNA, 20 nt, Escherichia coli CFT073
uaguauggagcaggaauaua

SEQ ID NO: 2619305 - RNA, 19 nt, Escherichia coli CFT073
uaguauuuuauggcagaau

SEQ ID NO: 2619306 - RNA, 17 nt, Escherichia coli CFT073
uagucaaaagcacucag

SEQ ID NO: 2619307 - RNA, 18 nt, Escherichia coli CFT073
uagucagguauuuuguca

SEQ ID NO: 2619308 - RNA, 11 nt, Escherichia coli CFT073
uagucaggugg

SEQ ID NO: 2619309 - RNA, 23 nt, Escherichia coli CFT073
uagucagguggggcuuuucucug

SEQ ID NO: 2619310 - RNA, 15 nt, Escherichia coli CFT073
uagucaugaugacgc

SEQ ID NO: 2619311 - RNA, 13 nt, Escherichia coli CFT073
uaguccgccagaa

SEQ ID NO: 2619312 - RNA, 18 nt, Escherichia coli CFT073
uaguccggauaaggcguu

SEQ ID NO: 2619313 - RNA, 18 nt, Escherichia coli CFT073
uaguccggcaccagcgcu

SEQ ID NO: 2619314 - RNA, 14 nt, Escherichia coli CFT073
uagucgccagcucu

SEQ ID NO: 2619315 - RNA, 14 nt, Escherichia coli CFT073
uagucgcuuucauu

SEQ ID NO: 2619316 - RNA, 15 nt, Escherichia coli CFT073
uagucggacaaacac

SEQ ID NO: 2619317 - RNA, 14 nt, Escherichia coli CFT073
uagucugaauugaa

SEQ ID NO: 2619318 - RNA, 21 nt, Escherichia coli CFT073
uagucugaauugaauagauau

SEQ ID NO: 2619319 - RNA, 17 nt, Escherichia coli CFT073
uagucugaccucuucua

SEQ ID NO: 2619320 - RNA, 14 nt, Escherichia coli CFT073
uagucuuauuuaau

SEQ ID NO: 2619321 - RNA, 19 nt, Escherichia coli CFT073
uagugaucagccucucucu

SEQ ID NO: 2619322 - RNA, 17 nt, Escherichia coli CFT073
uagugaugcaucauaug

SEQ ID NO: 2619323 - RNA, 14 nt, Escherichia coli CFT073
uagugcgcaguugc

SEQ ID NO: 2619324 - RNA, 18 nt, Escherichia coli CFT073
uagugcggcgugguuccg

SEQ ID NO: 2619325 - RNA, 16 nt, Escherichia coli CFT073
uagugcuucaaauauu

SEQ ID NO: 2619326 - RNA, 20 nt, Escherichia coli CFT073
uaguggcaaccgcaaccgcc

SEQ ID NO: 2619327 - RNA, 21 nt, Escherichia coli CFT073
uagugguaccaggaucagcaa

SEQ ID NO: 2619328 - RNA, 13 nt, Escherichia coli CFT073
uagugucgcauca

SEQ ID NO: 2619329 - RNA, 17 nt, Escherichia coli CFT073
uaguguugcguuuuuau

SEQ ID NO: 2619330 - RNA, 15 nt, Escherichia coli CFT073
uaguuaaacuuucau

SEQ ID NO: 2619331 - RNA, 17 nt, Escherichia coli CFT073
uaguuaauaccugcacc

SEQ ID NO: 2619332 - RNA, 15 nt, Escherichia coli CFT073
uaguuaauucauguc

SEQ ID NO: 2619333 - RNA, 15 nt, Escherichia coli CFT073
uaguuacgaaaagga

SEQ ID NO: 2619334 - RNA, 23 nt, Escherichia coli CFT073
uaguuacgaaaaggauaaauaaa

SEQ ID NO: 2619335 - RNA, 18 nt, Escherichia coli CFT073
uaguucauccccucuucc

SEQ ID NO: 2619336 - RNA, 19 nt, Escherichia coli CFT073
uaguucauccccucuucca

SEQ ID NO: 2619337 - RNA, 22 nt, Escherichia coli CFT073
uaguucauccccucuuccauuu

SEQ ID NO: 2619338 - RNA, 17 nt, Escherichia coli CFT073
uaguucgcaaucgcgcc

SEQ ID NO: 2619339 - RNA, 16 nt, Escherichia coli CFT073
uaguuguacaacugcu

SEQ ID NO: 2619340 - RNA, 18 nt, Escherichia coli CFT073
uaguuuuugcccaucaug

SEQ ID NO: 2619341 - RNA, 19 nt, Escherichia coli CFT073
uaguuuuuuacgaugcaau

SEQ ID NO: 2619342 - RNA, 23 nt, Escherichia coli CFT073
uauaaaacgagcgauccaacuaa

SEQ ID NO: 2619343 - RNA, 15 nt, Escherichia coli CFT073
uauaaaacucaccgc

SEQ ID NO: 2619344 - RNA, 20 nt, Escherichia coli CFT073
uauaaacauaucacuuuuau

SEQ ID NO: 2619345 - RNA, 18 nt, Escherichia coli CFT073
uauaaacccccugaccgg

SEQ ID NO: 2619346 - RNA, 21 nt, Escherichia coli CFT073
uauaaaccguccccaaaaaag

SEQ ID NO: 2619347 - RNA, 18 nt, Escherichia coli CFT073
uauaaagaaugaaauucg

SEQ ID NO: 2619348 - RNA, 19 nt, Escherichia coli CFT073
uauaaaucgagaagacaau

SEQ ID NO: 2619349 - RNA, 13 nt, Escherichia coli CFT073
uauaacaugguga

SEQ ID NO: 2619350 - RNA, 21 nt, Escherichia coli CFT073
uauaaccagacgauuuucccu

SEQ ID NO: 2619351 - RNA, 11 nt, Escherichia coli CFT073
uauaaccauuu

SEQ ID NO: 2619352 - RNA, 12 nt, Escherichia coli CFT073
uauaacccagua

SEQ ID NO: 2619353 - RNA, 18 nt, Escherichia coli CFT073
uauaaccggcaacagaac

SEQ ID NO: 2619354 - RNA, 20 nt, Escherichia coli CFT073
uauaaccggcaacagaacgc

SEQ ID NO: 2619355 - RNA, 21 nt, Escherichia coli CFT073
uauaacgaugggcguuuucua

SEQ ID NO: 2619356 - RNA, 21 nt, Escherichia coli CFT073
uauaacgggcuucccaacuga

SEQ ID NO: 2619357 - RNA, 22 nt, Escherichia coli CFT073
uauaacuauaugacucauaaaa

SEQ ID NO: 2619358 - RNA, 18 nt, Escherichia coli CFT073
uauaacuuuaguaucacc

SEQ ID NO: 2619359 - RNA, 20 nt, Escherichia coli CFT073
uauaagauagucgaaucagu

SEQ ID NO: 2619360 - RNA, 17 nt, Escherichia coli CFT073
uauaaguucaaguaaaa

SEQ ID NO: 2619361 - RNA, 19 nt, Escherichia coli CFT073
uauaaguucaaguaaaaca

SEQ ID NO: 2619362 - RNA, 12 nt, Escherichia coli CFT073
uauaauacgcuu

SEQ ID NO: 2619363 - RNA, 17 nt, Escherichia coli CFT073
uauaauuauuuuaccau

SEQ ID NO: 2619364 - RNA, 19 nt, Escherichia coli CFT073
uauaauuauuuuaccauau

SEQ ID NO: 2619365 - RNA, 12 nt, Escherichia coli CFT073
uauacaaaaucu

SEQ ID NO: 2619366 - RNA, 14 nt, Escherichia coli CFT073
uauacaaccacccc

SEQ ID NO: 2619367 - RNA, 17 nt, Escherichia coli CFT073
uauacaaccagauaacc

SEQ ID NO: 2619368 - RNA, 16 nt, Escherichia coli CFT073
uauacaccuguuccau

SEQ ID NO: 2619369 - RNA, 15 nt, Escherichia coli CFT073
uauacagccuuaaca

SEQ ID NO: 2619370 - RNA, 19 nt, Escherichia coli CFT073
uauacagccuuaacaagau

SEQ ID NO: 2619371 - RNA, 18 nt, Escherichia coli CFT073
uauacaucgcuuuccagg

SEQ ID NO: 2619372 - RNA, 21 nt, Escherichia coli CFT073
uauaccccaccccgagaugcc

SEQ ID NO: 2619373 - RNA, 21 nt, Escherichia coli CFT073
uauaccgccgaagacaaacau

SEQ ID NO: 2619374 - RNA, 17 nt, Escherichia coli CFT073
uauacgaaaauuuggau

SEQ ID NO: 2619375 - RNA, 22 nt, Escherichia coli CFT073
uauacgaucuucgccugaaaca

SEQ ID NO: 2619376 - RNA, 19 nt, Escherichia coli CFT073
uauacggcguuuccagcuc

SEQ ID NO: 2619377 - RNA, 14 nt, Escherichia coli CFT073
uauacuccugaugg

SEQ ID NO: 2619378 - RNA, 13 nt, Escherichia coli CFT073
uauacucuaaaua

SEQ ID NO: 2619379 - RNA, 15 nt, Escherichia coli CFT073
uauacugcaaauauu

SEQ ID NO: 2619380 - RNA, 16 nt, Escherichia coli CFT073
uauacugcaaauauug

SEQ ID NO: 2619381 - RNA, 16 nt, Escherichia coli CFT073
uauagaaugcagcagc

SEQ ID NO: 2619382 - RNA, 13 nt, Escherichia coli CFT073
uauagagcagcgg

SEQ ID NO: 2619383 - RNA, 18 nt, Escherichia coli CFT073
uauagaguacuugcuaca

SEQ ID NO: 2619384 - RNA, 17 nt, Escherichia coli CFT073
uaucccggcaaaaaaca

SEQ ID NO: 2619385 - RNA, 22 nt, Escherichia coli CFT073
uauccgaaacgcggguaaucag

SEQ ID NO: 2619386 - RNA, 19 nt, Escherichia coli CFT073
uauccgacauuucugcugc

SEQ ID NO: 2619387 - RNA, 15 nt, Escherichia coli CFT073
uauccgaccuacaaa

SEQ ID NO: 2619388 - RNA, 14 nt, Escherichia coli CFT073
uauccgacuuauuc

SEQ ID NO: 2619389 - RNA, 22 nt, Escherichia coli CFT073
uauccgccagcgccaaagccag

SEQ ID NO: 2619390 - RNA, 19 nt, Escherichia coli CFT073
uauccggcaugaacaaaac

SEQ ID NO: 2619391 - RNA, 15 nt, Escherichia coli CFT073
uauccggccuacaua

SEQ ID NO: 2619392 - RNA, 21 nt, Escherichia coli CFT073
uauccggccuacauuggucug

SEQ ID NO: 2619393 - RNA, 23 nt, Escherichia coli CFT073
uauccggccuacgggaacagugc

SEQ ID NO: 2619394 - RNA, 15 nt, Escherichia coli CFT073
uauccggccuacuaa

SEQ ID NO: 2619395 - RNA, 15 nt, Escherichia coli CFT073
uauccggcugaccug

SEQ ID NO: 2619396 - RNA, 19 nt, Escherichia coli CFT073
uauccggcugaccuggaag

SEQ ID NO: 2619397 - RNA, 20 nt, Escherichia coli CFT073
uauccggcugaccuggaagu

SEQ ID NO: 2619398 - RNA, 12 nt, Escherichia coli CFT073
uauccgggcaaa

SEQ ID NO: 2619399 - RNA, 18 nt, Escherichia coli CFT073
uauccgggcauccaggcc

SEQ ID NO: 2619400 - RNA, 13 nt, Escherichia coli CFT073
uauccgguucacu

SEQ ID NO: 2619401 - RNA, 15 nt, Escherichia coli CFT073
uauccgguuucugau

SEQ ID NO: 2619402 - RNA, 16 nt, Escherichia coli CFT073
uauccugaacagaaau

SEQ ID NO: 2619403 - RNA, 15 nt, Escherichia coli CFT073
uauccugacgcuguu

SEQ ID NO: 2619404 - RNA, 23 nt, Escherichia coli CFT073
uauccugaguaucgaaaacauca

SEQ ID NO: 2619405 - RNA, 20 nt, Escherichia coli CFT073
uauccugcccgcuccagcua

SEQ ID NO: 2619406 - RNA, 15 nt, Escherichia coli CFT073
uauccuuuaucugcc

SEQ ID NO: 2619407 - RNA, 22 nt, Escherichia coli CFT073
uauccuuuaucugcccuuuagu

SEQ ID NO: 2619408 - RNA, 12 nt, Escherichia coli CFT073
uaucgaacaugc

SEQ ID NO: 2619409 - RNA, 21 nt, Escherichia coli CFT073
uaucgaccagcgcacugccgc

SEQ ID NO: 2619410 - RNA, 18 nt, Escherichia coli CFT073
uaucgacuaacuucugau

SEQ ID NO: 2619411 - RNA, 16 nt, Escherichia coli CFT073
uaucgauuuucaaaau

SEQ ID NO: 2619412 - RNA, 17 nt, Escherichia coli CFT073
uaucgcccugccagcga

SEQ ID NO: 2619413 - RNA, 14 nt, Escherichia coli CFT073
uaucgcccuuacca

SEQ ID NO: 2619414 - RNA, 20 nt, Escherichia coli CFT073
uaucgccucuauucgaccac

SEQ ID NO: 2619415 - RNA, 20 nt, Escherichia coli CFT073
uaucgcgacauccacuuuuc

SEQ ID NO: 2619416 - RNA, 15 nt, Escherichia coli CFT073
uaucgcgcaaccaca

SEQ ID NO: 2619417 - RNA, 15 nt, Escherichia coli CFT073
uaucgcgcagaaauu

SEQ ID NO: 2619418 - RNA, 20 nt, Escherichia coli CFT073
uaucgcggggauaugguggu

SEQ ID NO: 2619419 - RNA, 23 nt, Escherichia coli CFT073
uaucgcggggauauggugguaag

SEQ ID NO: 2619420 - RNA, 21 nt, Escherichia coli CFT073
uaucgcugauauacccuucau

SEQ ID NO: 2619421 - RNA, 23 nt, Escherichia coli CFT073
uaucgcugauauacccuucauca

SEQ ID NO: 2619422 - RNA, 20 nt, Escherichia coli CFT073
uaucggagauaaccacguuc

SEQ ID NO: 2619423 - RNA, 17 nt, Escherichia coli CFT073
uaucggaggcuuguuca

SEQ ID NO: 2619424 - RNA, 16 nt, Escherichia coli CFT073
uaucggcguaaucacg

SEQ ID NO: 2619425 - RNA, 14 nt, Escherichia coli CFT073
uaucgguugcugga

SEQ ID NO: 2619426 - RNA, 17 nt, Escherichia coli CFT073
uaucguaauuuuucggu

SEQ ID NO: 2619427 - RNA, 23 nt, Escherichia coli CFT073
uaucguagccccagucuuccugc

SEQ ID NO: 2619428 - RNA, 15 nt, Escherichia coli CFT073
uaucgucuggcgcgu

SEQ ID NO: 2619429 - RNA, 23 nt, Escherichia coli CFT073
uaucgucuggcgcgugaugugga

SEQ ID NO: 2619430 - RNA, 21 nt, Escherichia coli CFT073
uaucgugcuggauuuguguca

SEQ ID NO: 2619431 - RNA, 16 nt, Escherichia coli CFT073
uaucguuaaagagauc

SEQ ID NO: 2619432 - RNA, 12 nt, Escherichia coli CFT073
uaucguuaucgc

SEQ ID NO: 2619433 - RNA, 13 nt, Escherichia coli CFT073
uaucguuauuaaa

SEQ ID NO: 2619434 - RNA, 15 nt, Escherichia coli CFT073
uaucguugugguuaa

SEQ ID NO: 2619435 - RNA, 16 nt, Escherichia coli CFT073
uaucuaaaaugucacc

SEQ ID NO: 2619436 - RNA, 17 nt, Escherichia coli CFT073
uaucuaaaaugucaccu

SEQ ID NO: 2619437 - RNA, 19 nt, Escherichia coli CFT073
uaucuaaccggauaucuaa

SEQ ID NO: 2619438 - RNA, 20 nt, Escherichia coli CFT073
uaucuaaccggauaucuaau

SEQ ID NO: 2619439 - RNA, 15 nt, Escherichia coli CFT073
uaucuaauaaacauu

SEQ ID NO: 2619440 - RNA, 14 nt, Escherichia coli CFT073
uaucuaauuauuac

SEQ ID NO: 2619441 - RNA, 16 nt, Escherichia coli CFT073
uaucuaccacugccug

SEQ ID NO: 2619442 - RNA, 20 nt, Escherichia coli CFT073
uaucuauauuuauucaucag

SEQ ID NO: 2619443 - RNA, 21 nt, Escherichia coli CFT073
uaucuccaguaaagcgauacg

SEQ ID NO: 2619444 - RNA, 12 nt, Escherichia coli CFT073
uaucuccauccg

SEQ ID NO: 2619445 - RNA, 23 nt, Escherichia coli CFT073
uaucucgccuuugagcaguuucg

SEQ ID NO: 2619446 - RNA, 14 nt, Escherichia coli CFT073
uaucugaaaguugu

SEQ ID NO: 2619447 - RNA, 22 nt, Escherichia coli CFT073
uaucugaaguaaagaaacuggu

SEQ ID NO: 2619448 - RNA, 20 nt, Escherichia coli CFT073
uaucugauuuaaaaaugcca

SEQ ID NO: 2619449 - RNA, 13 nt, Escherichia coli CFT073
uaucugcacugcu

SEQ ID NO: 2619450 - RNA, 20 nt, Escherichia coli CFT073
uaucugccagcacugccagc

SEQ ID NO: 2619451 - RNA, 17 nt, Escherichia coli CFT073
uaucugccagccaguca

SEQ ID NO: 2619452 - RNA, 16 nt, Escherichia coli CFT073
uaucugcccguaccca

SEQ ID NO: 2619453 - RNA, 23 nt, Escherichia coli CFT073
uaucugcccuuuaguaugcugau

SEQ ID NO: 2619454 - RNA, 18 nt, Escherichia coli CFT073
uaucugccggaagacaca

SEQ ID NO: 2619455 - RNA, 22 nt, Escherichia coli CFT073
uaucugcuaauauuuugugauu

SEQ ID NO: 2619456 - RNA, 15 nt, Escherichia coli CFT073
uaucuggccuacaaa

SEQ ID NO: 2619457 - RNA, 18 nt, Escherichia coli CFT073
uaucuggccuacaaaggg

SEQ ID NO: 2619458 - RNA, 23 nt, Escherichia coli CFT073
uaucuggucaguuaacaauaaca

SEQ ID NO: 2619459 - RNA, 15 nt, Escherichia coli CFT073
uaucuguacaguuaa

SEQ ID NO: 2619460 - RNA, 20 nt, Escherichia coli CFT073
uaucugucagacuaucuuug

SEQ ID NO: 2619461 - RNA, 21 nt, Escherichia coli CFT073
uaucugucagacuaucuuugg

SEQ ID NO: 2619462 - RNA, 15 nt, Escherichia coli CFT073
uaucuguucuuuuau

SEQ ID NO: 2619463 - RNA, 14 nt, Escherichia coli CFT073
uaucuucaaucaga

SEQ ID NO: 2619464 - RNA, 10 nt, Escherichia coli CFT073
uaucuucaca

SEQ ID NO: 2619465 - RNA, 18 nt, Escherichia coli CFT073
uaucuucacgauuauuaa

SEQ ID NO: 2619466 - RNA, 13 nt, Escherichia coli CFT073
uaucuucccagcc

SEQ ID NO: 2619467 - RNA, 22 nt, Escherichia coli CFT073
uaucuucugaaggugccuuuau

SEQ ID NO: 2619468 - RNA, 10 nt, Escherichia coli CFT073
uaucuucuuu

SEQ ID NO: 2619469 - RNA, 16 nt, Escherichia coli CFT073
uaucuuuggcauuuau

SEQ ID NO: 2619470 - RNA, 21 nt, Escherichia coli CFT073
uaucuuuuucguaagucagau

SEQ ID NO: 2619471 - RNA, 21 nt, Escherichia coli CFT073
uaugaaacaagaaguuauccu

SEQ ID NO: 2619472 - RNA, 22 nt, Escherichia coli CFT073
uaugaauagcggaaaucuccag

SEQ ID NO: 2619473 - RNA, 17 nt, Escherichia coli CFT073
uaugacauaaccgagaa

SEQ ID NO: 2619474 - RNA, 22 nt, Escherichia coli CFT073
uaugaccguuuuccccaacgau

SEQ ID NO: 2619475 - RNA, 17 nt, Escherichia coli CFT073
uaugacgaaagcgcagu

SEQ ID NO: 2619476 - RNA, 13 nt, Escherichia coli CFT073
uaugagagaggac

SEQ ID NO: 2619477 - RNA, 23 nt, Escherichia coli CFT073
uaugagagccguuaaaacgacuc

SEQ ID NO: 2619478 - RNA, 17 nt, Escherichia coli CFT073
uaugaguucgcggcgca

SEQ ID NO: 2619479 - RNA, 19 nt, Escherichia coli CFT073
uaugauaggcuucaaccgu

SEQ ID NO: 2619480 - RNA, 16 nt, Escherichia coli CFT073
uaugaucugcacagca

SEQ ID NO: 2619481 - RNA, 13 nt, Escherichia coli CFT073
uaugauguauauu

SEQ ID NO: 2619482 - RNA, 14 nt, Escherichia coli CFT073
uaugauguauauuu

SEQ ID NO: 2619483 - RNA, 12 nt, Escherichia coli CFT073
uaugcaaaccau

SEQ ID NO: 2619484 - RNA, 16 nt, Escherichia coli CFT073
uaugcaaaugagaauc

SEQ ID NO: 2619485 - RNA, 17 nt, Escherichia coli CFT073
uaugcaaggcuuuggau

SEQ ID NO: 2619486 - RNA, 21 nt, Escherichia coli CFT073
uaugcaccgacaauccaguug

SEQ ID NO: 2619487 - RNA, 13 nt, Escherichia coli CFT073
uaugcagccuuca

SEQ ID NO: 2619488 - RNA, 13 nt, Escherichia coli CFT073
uaugcagcggaau

SEQ ID NO: 2619489 - RNA, 14 nt, Escherichia coli CFT073
uaugcaggcgcuca

SEQ ID NO: 2619490 - RNA, 13 nt, Escherichia coli CFT073
uaugcauaaaccg

SEQ ID NO: 2619491 - RNA, 22 nt, Escherichia coli CFT073
uaugcauaaaccgggucagccc

SEQ ID NO: 2619492 - RNA, 16 nt, Escherichia coli CFT073
uauugaguaaauucau

SEQ ID NO: 2619493 - RNA, 21 nt, Escherichia coli CFT073
uauugaugcacaccaucgcau

SEQ ID NO: 2619494 - RNA, 15 nt, Escherichia coli CFT073
uauugaugcucgcug

SEQ ID NO: 2619495 - RNA, 22 nt, Escherichia coli CFT073
uauugcaccagaucuuccagcg

SEQ ID NO: 2619496 - RNA, 23 nt, Escherichia coli CFT073
uauugcaccagaucuuccagcgg

SEQ ID NO: 2619497 - RNA, 11 nt, Escherichia coli CFT073
uauugcauuaa

SEQ ID NO: 2619498 - RNA, 21 nt, Escherichia coli CFT073
uauugccccggagaaauccgg

SEQ ID NO: 2619499 - RNA, 13 nt, Escherichia coli CFT073
uauugccucaugc

SEQ ID NO: 2619500 - RNA, 15 nt, Escherichia coli CFT073
uauugccuugaugaa

SEQ ID NO: 2619501 - RNA, 18 nt, Escherichia coli CFT073
uauugcgaaguauggaaa

SEQ ID NO: 2619502 - RNA, 19 nt, Escherichia coli CFT073
uauugcgacgauaaccggu

SEQ ID NO: 2619503 - RNA, 17 nt, Escherichia coli CFT073
uauugcggcauuugucu

SEQ ID NO: 2619504 - RNA, 19 nt, Escherichia coli CFT073
uauugcggcauuugucugu

SEQ ID NO: 2619505 - RNA, 15 nt, Escherichia coli CFT073
uauugcgucuguucu

SEQ ID NO: 2619506 - RNA, 18 nt, Escherichia coli CFT073
uauugcuccauaauugcc

SEQ ID NO: 2619507 - RNA, 12 nt, Escherichia coli CFT073
uauugcucuacc

SEQ ID NO: 2619508 - RNA, 13 nt, Escherichia coli CFT073
uauugcuuugcug

SEQ ID NO: 2619509 - RNA, 23 nt, Escherichia coli CFT073
uauuggagaauauguuuuuaaac

SEQ ID NO: 2619510 - RNA, 16 nt, Escherichia coli CFT073
uauuggaugacaaacc

SEQ ID NO: 2619511 - RNA, 13 nt, Escherichia coli CFT073
uauuggcacugcg

SEQ ID NO: 2619512 - RNA, 17 nt, Escherichia coli CFT073
uauuggccgaacaggau

SEQ ID NO: 2619513 - RNA, 20 nt, Escherichia coli CFT073
uauuggugcuaauuugaaau

SEQ ID NO: 2619514 - RNA, 21 nt, Escherichia coli CFT073
uauugucgcccuguaauucgu

SEQ ID NO: 2619515 - RNA, 15 nt, Escherichia coli CFT073
uauuguugaauuccg

SEQ ID NO: 2619516 - RNA, 16 nt, Escherichia coli CFT073
uauuguugaauuccga

SEQ ID NO: 2619517 - RNA, 21 nt, Escherichia coli CFT073
uauuuaaacccuuucugcugc

SEQ ID NO: 2619518 - RNA, 17 nt, Escherichia coli CFT073
uauuuaguucauauaau

SEQ ID NO: 2619519 - RNA, 23 nt, Escherichia coli CFT073
uauuuaguucauauaauuauuuu

SEQ ID NO: 2619520 - RNA, 16 nt, Escherichia coli CFT073
uauuuauccauaauuu

SEQ ID NO: 2619521 - RNA, 14 nt, Escherichia coli CFT073
uauuuauucagaau

SEQ ID NO: 2619522 - RNA, 13 nt, Escherichia coli CFT073
uauuuauuuccuu

SEQ ID NO: 2619523 - RNA, 19 nt, Escherichia coli CFT073
uauuucacauauucauuac

SEQ ID NO: 2619524 - RNA, 12 nt, Escherichia coli CFT073
uauuucaccggu

SEQ ID NO: 2619525 - RNA, 13 nt, Escherichia coli CFT073
uauuucaucauca

SEQ ID NO: 2619526 - RNA, 13 nt, Escherichia coli CFT073
uauuucauuuuau

SEQ ID NO: 2619527 - RNA, 20 nt, Escherichia coli CFT073
uauuuccagcucaaccagau

SEQ ID NO: 2619528 - RNA, 11 nt, Escherichia coli CFT073
uauuuccaggg

SEQ ID NO: 2619529 - RNA, 21 nt, Escherichia coli CFT073
uauuuccccaauucauacaug

SEQ ID NO: 2619530 - RNA, 13 nt, Escherichia coli CFT073
uauuuccccauuc

SEQ ID NO: 2619531 - RNA, 18 nt, Escherichia coli CFT073
uauuucccuguugccugc

SEQ ID NO: 2619532 - RNA, 19 nt, Escherichia coli CFT073
uauuuccuucgcuuuaauu

SEQ ID NO: 2619533 - RNA, 18 nt, Escherichia coli CFT073
uauuucgucgcaucacag

SEQ ID NO: 2619534 - RNA, 15 nt, Escherichia coli CFT073
uauuucuuuaucacc

SEQ ID NO: 2619535 - RNA, 23 nt, Escherichia coli CFT073
uauuugccaaacgcguccaucac

SEQ ID NO: 2619536 - RNA, 24 nt, Escherichia coli CFT073
uauuuguacugucuaaugauucau

SEQ ID NO: 2619537 - RNA, 15 nt, Escherichia coli CFT073
uauuuguuauaaacg

SEQ ID NO: 2619538 - RNA, 15 nt, Escherichia coli CFT073
uauuuuauauuacgc

SEQ ID NO: 2619539 - RNA, 20 nt, Escherichia coli CFT073
uauuuuaucgcuaucagucc

SEQ ID NO: 2619540 - RNA, 15 nt, Escherichia coli CFT073
uauuuucaaccgggc

SEQ ID NO: 2619541 - RNA, 22 nt, Escherichia coli CFT073
uauuuucaggggagcuuugauu

SEQ ID NO: 2619542 - RNA, 19 nt, Escherichia coli CFT073
uauuuucgccauuguuggc

SEQ ID NO: 2619543 - RNA, 23 nt, Escherichia coli CFT073
uauuuugccaggcuaaccaguaa

SEQ ID NO: 2619544 - RNA, 20 nt, Escherichia coli CFT073
uauuuugccggacgcugagc

SEQ ID NO: 2619545 - RNA, 18 nt, Escherichia coli CFT073
uauuuugcuuccggcaag

SEQ ID NO: 2619546 - RNA, 15 nt, Escherichia coli CFT073
uauuuugcuuuaagu

SEQ ID NO: 2619547 - RNA, 17 nt, Escherichia coli CFT073
uauuuuuauaacuauau

SEQ ID NO: 2619548 - RNA, 20 nt, Escherichia coli CFT073
uauuuuuguugaaauaauac

SEQ ID NO: 2619549 - RNA, 17 nt, Escherichia coli CFT073
uauuuuuuuaauuguga

SEQ ID NO: 2619550 - RNA, 14 nt, Escherichia coli CFT073
ucaaaaaagucaga

SEQ ID NO: 2619551 - RNA, 15 nt, Escherichia coli CFT073
ucaaaaacaaagaau

SEQ ID NO: 2619552 - RNA, 18 nt, Escherichia coli CFT073
ucaaaaacaaauuuugaa

SEQ ID NO: 2619553 - RNA, 12 nt, Escherichia coli CFT073
ucaaaaagcuca

SEQ ID NO: 2619554 - RNA, 20 nt, Escherichia coli CFT073
ucaaaacuggugguaagaau

SEQ ID NO: 2619555 - RNA, 16 nt, Escherichia coli CFT073
ucaaaaggcuccacuu

SEQ ID NO: 2619556 - RNA, 19 nt, Escherichia coli CFT073
ucaaaauaucgacauucaa

SEQ ID NO: 2619557 - RNA, 22 nt, Escherichia coli CFT073
ucaaaaugaucgaagguuccug

SEQ ID NO: 2619558 - RNA, 13 nt, Escherichia coli CFT073
ucaaaauucauaa

SEQ ID NO: 2619559 - RNA, 14 nt, Escherichia coli CFT073
ucaaaauucauaaa

SEQ ID NO: 2619560 - RNA, 17 nt, Escherichia coli CFT073
ucaaaauuuaacauuac

SEQ ID NO: 2619561 - RNA, 15 nt, Escherichia coli CFT073
ucaaacaaccguuca

SEQ ID NO: 2619562 - RNA, 21 nt, Escherichia coli CFT073
ucaaacaaccguucacgcauu

SEQ ID NO: 2619563 - RNA, 23 nt, Escherichia coli CFT073
ucaaacaccaguucaccaccugg

SEQ ID NO: 2619564 - RNA, 14 nt, Escherichia coli CFT073
ucaaacagaaaaac

SEQ ID NO: 2619565 - RNA, 12 nt, Escherichia coli CFT073
ucaaacagcccc

SEQ ID NO: 2619566 - RNA, 13 nt, Escherichia coli CFT073
ucaaacaggcugc

SEQ ID NO: 2619567 - RNA, 17 nt, Escherichia coli CFT073
ucaaacaugccgucaau

SEQ ID NO: 2619568 - RNA, 17 nt, Escherichia coli CFT073
ucaaacccuucuucaau

SEQ ID NO: 2619569 - RNA, 12 nt, Escherichia coli CFT073
ucaaaccuucau

SEQ ID NO: 2619570 - RNA, 20 nt, Escherichia coli CFT073
ucaaacgaaugcaggcgcgc

SEQ ID NO: 2619571 - RNA, 20 nt, Escherichia coli CFT073
ucaaacgauucggcaaucac

SEQ ID NO: 2619572 - RNA, 19 nt, Escherichia coli CFT073
ucaaacggcauaugccaug

SEQ ID NO: 2619573 - RNA, 17 nt, Escherichia coli CFT073
ucaaacguaccgccaga

SEQ ID NO: 2619574 - RNA, 20 nt, Escherichia coli CFT073
ucaaacgugcggcaggcaca

SEQ ID NO: 2619575 - RNA, 14 nt, Escherichia coli CFT073
ucaaacucauaaac

SEQ ID NO: 2619576 - RNA, 17 nt, Escherichia coli CFT073
ucaaacucggcuucgcu

SEQ ID NO: 2619577 - RNA, 20 nt, Escherichia coli CFT073
ucaaacugaccuuuagcgcg

SEQ ID NO: 2619578 - RNA, 12 nt, Escherichia coli CFT073
ucaaacugagcg

SEQ ID NO: 2619579 - RNA, 13 nt, Escherichia coli CFT073
ucaaacugcagca

SEQ ID NO: 2619580 - RNA, 23 nt, Escherichia coli CFT073
ucaaacuggguuuugaucuccag

SEQ ID NO: 2619581 - RNA, 17 nt, Escherichia coli CFT073
ucaaacuucgccacagc

SEQ ID NO: 2619582 - RNA, 14 nt, Escherichia coli CFT073
ucaaacuuuuaaau

SEQ ID NO: 2619583 - RNA, 18 nt, Escherichia coli CFT073
ucaaacuuuuaaauugaa

SEQ ID NO: 2619584 - RNA, 19 nt, Escherichia coli CFT073
ucaaagaacagcccgccaa

SEQ ID NO: 2619585 - RNA, 22 nt, Escherichia coli CFT073
ucaaagaccguuucggugauga

SEQ ID NO: 2619586 - RNA, 23 nt, Escherichia coli CFT073
ucaaagaugcaggaguagaacgg

SEQ ID NO: 2619587 - RNA, 23 nt, Escherichia coli CFT073
ucaaaggcauuaaaugcauacau

SEQ ID NO: 2619588 - RNA, 16 nt, Escherichia coli CFT073
ucaaagguaaugguua

SEQ ID NO: 2619589 - RNA, 21 nt, Escherichia coli CFT073
ucaaaggugccaaugauuuug

SEQ ID NO: 2619590 - RNA, 23 nt, Escherichia coli CFT073
ucaaaggugccaaugauuuugau

SEQ ID NO: 2619591 - RNA, 15 nt, Escherichia coli CFT073
ucaaagugcaccggc

SEQ ID NO: 2619592 - RNA, 18 nt, Escherichia coli CFT073
ucaaaguuaguaaaacua

SEQ ID NO: 2619593 - RNA, 22 nt, Escherichia coli CFT073
ucaaaguuugcccgucugcugc

SEQ ID NO: 2619594 - RNA, 14 nt, Escherichia coli CFT073
ucaaauaaagaagu

SEQ ID NO: 2619595 - RNA, 18 nt, Escherichia coli CFT073
ucaaauagccugccagug

SEQ ID NO: 2619596 - RNA, 14 nt, Escherichia coli CFT073
ucaaauaucugccg

SEQ ID NO: 2619597 - RNA, 20 nt, Escherichia coli CFT073
ucaaaucaacaaccugcauu

SEQ ID NO: 2619598 - RNA, 21 nt, Escherichia coli CFT073
ucaaaucacagcaccuuaugc

SEQ ID NO: 2619599 - RNA, 19 nt, Escherichia coli CFT073
ucaaaucaccaaacugcuc

SEQ ID NO: 2619600 - RNA, 22 nt, Escherichia coli CFT073
ucaagcggacgaucgcugauga

SEQ ID NO: 2619601 - RNA, 15 nt, Escherichia coli CFT073
ucaagcuaaaccaau

SEQ ID NO: 2619602 - RNA, 18 nt, Escherichia coli CFT073
ucaagcuaaaccaauaaa

SEQ ID NO: 2619603 - RNA, 22 nt, Escherichia coli CFT073
ucaagcugcugacggugauaau

SEQ ID NO: 2619604 - RNA, 23 nt, Escherichia coli CFT073
ucaagcugcugacggugauaauc

SEQ ID NO: 2619605 - RNA, 16 nt, Escherichia coli CFT073
ucaagcuggcgcuggc

SEQ ID NO: 2619606 - RNA, 18 nt, Escherichia coli CFT073
ucaagcuggugcuuuaug

SEQ ID NO: 2619607 - RNA, 23 nt, Escherichia coli CFT073
ucaaggcugauaacguccauucc

SEQ ID NO: 2619608 - RNA, 18 nt, Escherichia coli CFT073
ucaaggucaacaguucau

SEQ ID NO: 2619609 - RNA, 23 nt, Escherichia coli CFT073
ucaaggucgcccuggacaugggu

SEQ ID NO: 2619610 - RNA, 18 nt, Escherichia coli CFT073
ucaagguugcacaaccaa

SEQ ID NO: 2619611 - RNA, 21 nt, Escherichia coli CFT073
ucaaguaaucaaucaccucuu

SEQ ID NO: 2619612 - RNA, 18 nt, Escherichia coli CFT073
ucaaguacgccgccgcca

SEQ ID NO: 2619613 - RNA, 18 nt, Escherichia coli CFT073
ucaagugaacuuucucug

SEQ ID NO: 2619614 - RNA, 21 nt, Escherichia coli CFT073
ucaaguguggccgccagugau

SEQ ID NO: 2619615 - RNA, 17 nt, Escherichia coli CFT073
ucaauaaaaacggcgcu

SEQ ID NO: 2619616 - RNA, 15 nt, Escherichia coli CFT073
ucaauaacagcgcaa

SEQ ID NO: 2619617 - RNA, 12 nt, Escherichia coli CFT073
ucaauaauaacc

SEQ ID NO: 2619618 - RNA, 22 nt, Escherichia coli CFT073
ucaauaauauccgguuucugau

SEQ ID NO: 2619619 - RNA, 11 nt, Escherichia coli CFT073
ucaauaaucau

SEQ ID NO: 2619620 - RNA, 18 nt, Escherichia coli CFT073
ucaauaauuucuucauug

SEQ ID NO: 2619621 - RNA, 20 nt, Escherichia coli CFT073
ucaauaccgccugcaaauaa

SEQ ID NO: 2619622 - RNA, 22 nt, Escherichia coli CFT073
ucaauacgacagcuauguuuua

SEQ ID NO: 2619623 - RNA, 13 nt, Escherichia coli CFT073
ucaauacuggcaa

SEQ ID NO: 2619624 - RNA, 16 nt, Escherichia coli CFT073
ucaauacuuuccagca

SEQ ID NO: 2619625 - RNA, 19 nt, Escherichia coli CFT073
ucaauagcccggcaauggu

SEQ ID NO: 2619626 - RNA, 20 nt, Escherichia coli CFT073
ucaauagcguugcagauggc

SEQ ID NO: 2619627 - RNA, 21 nt, Escherichia coli CFT073
ucaauagucaguauuuucccu

SEQ ID NO: 2619628 - RNA, 19 nt, Escherichia coli CFT073
ucaauauaaacagccccuc

SEQ ID NO: 2619629 - RNA, 21 nt, Escherichia coli CFT073
ucaauauacgaaaauuuggau

SEQ ID NO: 2619630 - RNA, 14 nt, Escherichia coli CFT073
ucaauauauuaaaa

SEQ ID NO: 2619631 - RNA, 14 nt, Escherichia coli CFT073
ucaauauccagucg

SEQ ID NO: 2619632 - RNA, 14 nt, Escherichia coli CFT073
ucaauauccugacc

SEQ ID NO: 2619633 - RNA, 19 nt, Escherichia coli CFT073
ucaauauccugaccuuuac

SEQ ID NO: 2619634 - RNA, 14 nt, Escherichia coli CFT073
ucaauaugaauuaa

SEQ ID NO: 2619635 - RNA, 15 nt, Escherichia coli CFT073
ucaauauuccaguca

SEQ ID NO: 2619636 - RNA, 21 nt, Escherichia coli CFT073
ucaauauuccagucagcacca

SEQ ID NO: 2619637 - RNA, 18 nt, Escherichia coli CFT073
ucaauauuugcaccuaaa

SEQ ID NO: 2619638 - RNA, 18 nt, Escherichia coli CFT073
ucaaucaaauagccugcc

SEQ ID NO: 2619639 - RNA, 16 nt, Escherichia coli CFT073
ucaaucacccgauacu

SEQ ID NO: 2619640 - RNA, 17 nt, Escherichia coli CFT073
ucaaucaccgcuucacu

SEQ ID NO: 2619641 - RNA, 17 nt, Escherichia coli CFT073
ucaaucacuuucugcgc

SEQ ID NO: 2619642 - RNA, 19 nt, Escherichia coli CFT073
ucaaucccuucgacuuuca

SEQ ID NO: 2619643 - RNA, 21 nt, Escherichia coli CFT073
ucaaucccuucgacuuucagu

SEQ ID NO: 2619644 - RNA, 20 nt, Escherichia coli CFT073
ucaauccggcaaucaacauc

SEQ ID NO: 2619645 - RNA, 20 nt, Escherichia coli CFT073
ucaauccgucccaauucuuc

SEQ ID NO: 2619646 - RNA, 22 nt, Escherichia coli CFT073
ucaauccgucccaauucuuccu

SEQ ID NO: 2619647 - RNA, 19 nt, Escherichia coli CFT073
ucaaucgcacccgccauca

SEQ ID NO: 2619648 - RNA, 22 nt, Escherichia coli CFT073
ucaaucgcacccgccaucaucc

SEQ ID NO: 2619649 - RNA, 15 nt, Escherichia coli CFT073
ucaaucgccaaaaag

SEQ ID NO: 2619650 - RNA, 18 nt, Escherichia coli CFT073
ucaaucgcggugauuuua

SEQ ID NO: 2619651 - RNA, 15 nt, Escherichia coli CFT073
ucaaucucagcgaua

SEQ ID NO: 2619652 - RNA, 18 nt, Escherichia coli CFT073
ucaaucucgcugaucuua

SEQ ID NO: 2619653 - RNA, 21 nt, Escherichia coli CFT073
ucaaucucugcaagagauaaa

SEQ ID NO: 2619654 - RNA, 14 nt, Escherichia coli CFT073
ucaaucucuucaca

SEQ ID NO: 2619655 - RNA, 20 nt, Escherichia coli CFT073
ucaaucugagcgaagcgcau

SEQ ID NO: 2619656 - RNA, 17 nt, Escherichia coli CFT073
ucaaucuuuacacacaa

SEQ ID NO: 2619657 - RNA, 15 nt, Escherichia coli CFT073
ucaaugaaacgcaaa

SEQ ID NO: 2619658 - RNA, 23 nt, Escherichia coli CFT073
ucaaugaauugcuuaacagcauu

SEQ ID NO: 2619659 - RNA, 21 nt, Escherichia coli CFT073
ucaaugacaguaucaccaacu

SEQ ID NO: 2619660 - RNA, 21 nt, Escherichia coli CFT073
ucaaugauaauucaacagauu

SEQ ID NO: 2619661 - RNA, 20 nt, Escherichia coli CFT073
ucaaugauaugugcagaagc

SEQ ID NO: 2619662 - RNA, 21 nt, Escherichia coli CFT073
ucaaugaugccgacggcgcac

SEQ ID NO: 2619663 - RNA, 21 nt, Escherichia coli CFT073
ucaaugcaauuuaucgcaggu

SEQ ID NO: 2619664 - RNA, 19 nt, Escherichia coli CFT073
ucaaugcauaucauugcgu

SEQ ID NO: 2619665 - RNA, 14 nt, Escherichia coli CFT073
ucaaugccaccaga

SEQ ID NO: 2619666 - RNA, 15 nt, Escherichia coli CFT073
ucaaugccccacaga

SEQ ID NO: 2619667 - RNA, 22 nt, Escherichia coli CFT073
ucaaugccggacuguaaacgau

SEQ ID NO: 2619668 - RNA, 17 nt, Escherichia coli CFT073
ucaaugcgguaaucguc

SEQ ID NO: 2619669 - RNA, 15 nt, Escherichia coli CFT073
ucaaugcugaaagca

SEQ ID NO: 2619670 - RNA, 15 nt, Escherichia coli CFT073
ucaaugcuuuuugca

SEQ ID NO: 2619671 - RNA, 17 nt, Escherichia coli CFT073
ucaaugcuuuuugcauu

SEQ ID NO: 2619672 - RNA, 21 nt, Escherichia coli CFT073
ucaaugcuuuuugcauuuccg

SEQ ID NO: 2619673 - RNA, 19 nt, Escherichia coli CFT073
ucaauggaugcaucuucau

SEQ ID NO: 2619674 - RNA, 16 nt, Escherichia coli CFT073
ucaauggcauccgcca

SEQ ID NO: 2619675 - RNA, 14 nt, Escherichia coli CFT073
ucaauggcgcugca

SEQ ID NO: 2619676 - RNA, 14 nt, Escherichia coli CFT073
ucaauggucagcgc

SEQ ID NO: 2619677 - RNA, 16 nt, Escherichia coli CFT073
ucaauggucagcgcca

SEQ ID NO: 2619678 - RNA, 20 nt, Escherichia coli CFT073
ucaaugguggcaaucugaau

SEQ ID NO: 2619679 - RNA, 17 nt, Escherichia coli CFT073
ucaauggugucuucguu

SEQ ID NO: 2619680 - RNA, 14 nt, Escherichia coli CFT073
ucaaugucuccguu

SEQ ID NO: 2619681 - RNA, 16 nt, Escherichia coli CFT073
ucaauguguugauaau

SEQ ID NO: 2619682 - RNA, 16 nt, Escherichia coli CFT073
ucaauguugacgcgug

SEQ ID NO: 2619683 - RNA, 19 nt, Escherichia coli CFT073
ucaauuaacggcucugcuu

SEQ ID NO: 2619684 - RNA, 21 nt, Escherichia coli CFT073
ucaauuacaccaucacgcccc

SEQ ID NO: 2619685 - RNA, 15 nt, Escherichia coli CFT073
ucaauuacgcggcuu

SEQ ID NO: 2619686 - RNA, 11 nt, Escherichia coli CFT073
ucaauuaugcc

SEQ ID NO: 2619687 - RNA, 14 nt, Escherichia coli CFT073
ucaauuaugcccuc

SEQ ID NO: 2619688 - RNA, 18 nt, Escherichia coli CFT073
ucaauucgucuaucagcu

SEQ ID NO: 2619689 - RNA, 17 nt, Escherichia coli CFT073
ucaauugcguucugucg

SEQ ID NO: 2619690 - RNA, 22 nt, Escherichia coli CFT073
ucaauugcucacucccggggcg

SEQ ID NO: 2619691 - RNA, 15 nt, Escherichia coli CFT073
ucaauugcuucaaua

SEQ ID NO: 2619692 - RNA, 16 nt, Escherichia coli CFT073
ucaauuuccgucgcau

SEQ ID NO: 2619693 - RNA, 20 nt, Escherichia coli CFT073
ucaauuuccgucgcaugggg

SEQ ID NO: 2619694 - RNA, 18 nt, Escherichia coli CFT073
ucaauuugcuccgccagu

SEQ ID NO: 2619695 - RNA, 17 nt, Escherichia coli CFT073
ucaauuuuuuguuggcc

SEQ ID NO: 2619696 - RNA, 19 nt, Escherichia coli CFT073
ucacaaaauuuauccagcg

SEQ ID NO: 2619697 - RNA, 19 nt, Escherichia coli CFT073
ucacaaaggcuugcugcau

SEQ ID NO: 2619698 - RNA, 19 nt, Escherichia coli CFT073
ucacaacaauaucaaagcg

SEQ ID NO: 2619699 - RNA, 17 nt, Escherichia coli CFT073
ucacaacuucgcaaaca

SEQ ID NO: 2619700 - RNA, 18 nt, Escherichia coli CFT073
ucacaagcccaggccauc

SEQ ID NO: 2619701 - RNA, 18 nt, Escherichia coli CFT073
ucacaaucggcuuucacc

SEQ ID NO: 2619702 - RNA, 13 nt, Escherichia coli CFT073
ucacaauguaaau

SEQ ID NO: 2619703 - RNA, 15 nt, Escherichia coli CFT073
ucacacagugaaucu

SEQ ID NO: 2619704 - RNA, 16 nt, Escherichia coli CFT073
ucacaccaucaacaaa

SEQ ID NO: 2619705 - RNA, 16 nt, Escherichia coli CFT073
ucacaccauccagcaa

SEQ ID NO: 2619706 - RNA, 17 nt, Escherichia coli CFT073
ucacaccauccagcaac

SEQ ID NO: 2619707 - RNA, 18 nt, Escherichia coli CFT073
ucacaccugcucagcacg

SEQ ID NO: 2619708 - RNA, 12 nt, Escherichia coli CFT073
gcuuccugcagc

SEQ ID NO: 2619709 - RNA, 16 nt, Escherichia coli CFT073
gcuuccuuaagccgcu

SEQ ID NO: 2619710 - RNA, 17 nt, Escherichia coli CFT073
gcuucgaaacagaaaua

SEQ ID NO: 2619711 - RNA, 23 nt, Escherichia coli CFT073
gcuucgaaacagaaauaccagcc

SEQ ID NO: 2619712 - RNA, 21 nt, Escherichia coli CFT073
gcuucgagcuggaagccacaa

SEQ ID NO: 2619713 - RNA, 14 nt, Escherichia coli CFT073
gcuucgauucccag

SEQ ID NO: 2619714 - RNA, 19 nt, Escherichia coli CFT073
gcuucgccaaugaucccgc

SEQ ID NO: 2619715 - RNA, 20 nt, Escherichia coli CFT073
gcuucgccagugacgaccuu

SEQ ID NO: 2619716 - RNA, 21 nt, Escherichia coli CFT073
gcuucgccaucuccaucaucu

SEQ ID NO: 2619717 - RNA, 17 nt, Escherichia coli CFT073
gcuucgcgaaucgccac

SEQ ID NO: 2619718 - RNA, 19 nt, Escherichia coli CFT073
gcuucgcgaaucgccacaa

SEQ ID NO: 2619719 - RNA, 21 nt, Escherichia coli CFT073
gcuucgcggacaucguccagc

SEQ ID NO: 2619720 - RNA, 23 nt, Escherichia coli CFT073
gcuucgcggacaucguccagcuu

SEQ ID NO: 2619721 - RNA, 16 nt, Escherichia coli CFT073
gcuucgcggacuucug

SEQ ID NO: 2619722 - RNA, 21 nt, Escherichia coli CFT073
gcuucgcuaagauaccccagc

SEQ ID NO: 2619723 - RNA, 21 nt, Escherichia coli CFT073
gcuucgcucucuuucaccagc

SEQ ID NO: 2619724 - RNA, 13 nt, Escherichia coli CFT073
gcuucgcuuccca

SEQ ID NO: 2619725 - RNA, 16 nt, Escherichia coli CFT073
gcuucgucgccagcuc

SEQ ID NO: 2619726 - RNA, 19 nt, Escherichia coli CFT073
gcuucgugauugcuuugau

SEQ ID NO: 2619727 - RNA, 22 nt, Escherichia coli CFT073
gcuucuaccuuauccagcagau

SEQ ID NO: 2619728 - RNA, 17 nt, Escherichia coli CFT073
gcuucuacgccaucagu

SEQ ID NO: 2619729 - RNA, 17 nt, Escherichia coli CFT073
gcuucucggcaaacagu

SEQ ID NO: 2619730 - RNA, 13 nt, Escherichia coli CFT073
gcuucucuuccag

SEQ ID NO: 2619731 - RNA, 12 nt, Escherichia coli CFT073
gcuucugcagcu

SEQ ID NO: 2619732 - RNA, 14 nt, Escherichia coli CFT073
gcuucugcagcuuu

SEQ ID NO: 2619733 - RNA, 20 nt, Escherichia coli CFT073
gcuucuggcgacaucuucuc

SEQ ID NO: 2619734 - RNA, 23 nt, Escherichia coli CFT073
gcuucuggcgacaucuucucuac

SEQ ID NO: 2619735 - RNA, 12 nt, Escherichia coli CFT073
gcuucuggcugg

SEQ ID NO: 2619736 - RNA, 13 nt, Escherichia coli CFT073
gcuucuggcuggc

SEQ ID NO: 2619737 - RNA, 16 nt, Escherichia coli CFT073
gcuucuggcuggcgcu

SEQ ID NO: 2619738 - RNA, 13 nt, Escherichia coli CFT073
gcuucuucaaaaa

SEQ ID NO: 2619739 - RNA, 13 nt, Escherichia coli CFT073
gcuucuuccagca

SEQ ID NO: 2619740 - RNA, 13 nt, Escherichia coli CFT073
gcuucuucuucca

SEQ ID NO: 2619741 - RNA, 17 nt, Escherichia coli CFT073
gcuucuucuuccagguc

SEQ ID NO: 2619742 - RNA, 14 nt, Escherichia coli CFT073
gcuugaaagcgggc

SEQ ID NO: 2619743 - RNA, 18 nt, Escherichia coli CFT073
gcuugaaguuacugacau

SEQ ID NO: 2619744 - RNA, 18 nt, Escherichia coli CFT073
gcuugacgcgucuuauca

SEQ ID NO: 2619745 - RNA, 22 nt, Escherichia coli CFT073
gcuugacgcgucuuaucaggcc

SEQ ID NO: 2619746 - RNA, 16 nt, Escherichia coli CFT073
gcuugagccagugagc

SEQ ID NO: 2619747 - RNA, 13 nt, Escherichia coli CFT073
gcuugaucuuccu

SEQ ID NO: 2619748 - RNA, 15 nt, Escherichia coli CFT073
gcuugaucuuccuga

SEQ ID NO: 2619749 - RNA, 18 nt, Escherichia coli CFT073
gcuugaugcgucuuauca

SEQ ID NO: 2619750 - RNA, 22 nt, Escherichia coli CFT073
gcuugaugcgucuuaucaggcc

SEQ ID NO: 2619751 - RNA, 20 nt, Escherichia coli CFT073
gcuugcaaaagcaggagcaa

SEQ ID NO: 2619752 - RNA, 15 nt, Escherichia coli CFT073
gcuugcaccagcagc

SEQ ID NO: 2619753 - RNA, 19 nt, Escherichia coli CFT073
gcuugcaggaucagcuccg

SEQ ID NO: 2619754 - RNA, 22 nt, Escherichia coli CFT073
gcuugcaggaucagcuccggca

SEQ ID NO: 2619755 - RNA, 15 nt, Escherichia coli CFT073
gcuugccagagcagc

SEQ ID NO: 2619756 - RNA, 15 nt, Escherichia coli CFT073
gcuugccuagggcgc

SEQ ID NO: 2619757 - RNA, 23 nt, Escherichia coli CFT073
gcuugcgaaaauagucguccauu

SEQ ID NO: 2619758 - RNA, 20 nt, Escherichia coli CFT073
ggcgaucuuccgaccgcccu

SEQ ID NO: 2619759 - RNA, 21 nt, Escherichia coli CFT073
ggcgaugaaguaguaacugug

SEQ ID NO: 2619760 - RNA, 15 nt, Escherichia coli CFT073
ggcgaugaugaucug

SEQ ID NO: 2619761 - RNA, 19 nt, Escherichia coli CFT073
ggcgaugcacaugcuucag

SEQ ID NO: 2619762 - RNA, 21 nt, Escherichia coli CFT073
ggcgaugcagcgcaugaccca

SEQ ID NO: 2619763 - RNA, 15 nt, Escherichia coli CFT073
ggcgauuaauccagu

SEQ ID NO: 2619764 - RNA, 14 nt, Escherichia coli CFT073
ggcgauucagcaac

SEQ ID NO: 2619765 - RNA, 19 nt, Escherichia coli CFT073
ggcgauucauaugcgccag

SEQ ID NO: 2619766 - RNA, 23 nt, Escherichia coli CFT073
ggcgauuuaaucccgugccugcu

SEQ ID NO: 2619767 - RNA, 12 nt, Escherichia coli CFT073
ggcgauuucaga

SEQ ID NO: 2619768 - RNA, 17 nt, Escherichia coli CFT073
ggcgauuucagaucagg

SEQ ID NO: 2619769 - RNA, 21 nt, Escherichia coli CFT073
ggcgcaaacgacgggcgcugg

SEQ ID NO: 2619770 - RNA, 19 nt, Escherichia coli CFT073
ggcgcaacauauuccgcac

SEQ ID NO: 2619771 - RNA, 18 nt, Escherichia coli CFT073
ggcgcacacgaucugaca

SEQ ID NO: 2619772 - RNA, 17 nt, Escherichia coli CFT073
ggcgcaccagaauaccu

SEQ ID NO: 2619773 - RNA, 23 nt, Escherichia coli CFT073
ggcgcacguucugucgcucugcu

SEQ ID NO: 2619774 - RNA, 18 nt, Escherichia coli CFT073
ggcgcagacggucuggug

SEQ ID NO: 2619775 - RNA, 17 nt, Escherichia coli CFT073
ggcgcagcaguucgccg

SEQ ID NO: 2619776 - RNA, 12 nt, Escherichia coli CFT073
ggcgcagcgcgc

SEQ ID NO: 2619777 - RNA, 20 nt, Escherichia coli CFT073
ggcgcagcuaauugauugua

SEQ ID NO: 2619778 - RNA, 13 nt, Escherichia coli CFT073
ggcgcaggcgcuu

SEQ ID NO: 2619779 - RNA, 13 nt, Escherichia coli CFT073
ggcgcagggugua

SEQ ID NO: 2619780 - RNA, 20 nt, Escherichia coli CFT073
ggcgcauguuggcgcgguga

SEQ ID NO: 2619781 - RNA, 20 nt, Escherichia coli CFT073
ggcgcauuaacucacuggcg

SEQ ID NO: 2619782 - RNA, 19 nt, Escherichia coli CFT073
ggcgcauucgaucaccgca

SEQ ID NO: 2619783 - RNA, 11 nt, Escherichia coli CFT073
ggcgcauugcc

SEQ ID NO: 2619784 - RNA, 16 nt, Escherichia coli CFT073
ggcgcauugcuggcug

SEQ ID NO: 2619785 - RNA, 15 nt, Escherichia coli CFT073
ggcgcgaccagacgc

SEQ ID NO: 2619786 - RNA, 16 nt, Escherichia coli CFT073
ggcgcgaugacagcgu

SEQ ID NO: 2619787 - RNA, 17 nt, Escherichia coli CFT073
ggcgcgaugacagcgug

SEQ ID NO: 2619788 - RNA, 16 nt, Escherichia coli CFT073
ggcgcgcgucacgaua

SEQ ID NO: 2619789 - RNA, 16 nt, Escherichia coli CFT073
ggcgcggacgcacaua

SEQ ID NO: 2619790 - RNA, 14 nt, Escherichia coli CFT073
ggcgcgugaugugg

SEQ ID NO: 2619791 - RNA, 17 nt, Escherichia coli CFT073
ggcgcucaggcgaucag

SEQ ID NO: 2619792 - RNA, 15 nt, Escherichia coli CFT073
ggcgcucgcgccgca

SEQ ID NO: 2619793 - RNA, 17 nt, Escherichia coli CFT073
ggcgcucgcgccgcauc

SEQ ID NO: 2619794 - RNA, 17 nt, Escherichia coli CFT073
ggcgcugaaucccgcaa

SEQ ID NO: 2619795 - RNA, 16 nt, Escherichia coli CFT073
ggcgcugaauguuugc

SEQ ID NO: 2619796 - RNA, 16 nt, Escherichia coli CFT073
ggcgcugauaaauccc

SEQ ID NO: 2619797 - RNA, 20 nt, Escherichia coli CFT073
ggcgcugcaaagcugauaau

SEQ ID NO: 2619798 - RNA, 22 nt, Escherichia coli CFT073
ggcgcugcucaggcgacgcgga

SEQ ID NO: 2619799 - RNA, 19 nt, Escherichia coli CFT073
ggcgcugugagcaggcgua

SEQ ID NO: 2619800 - RNA, 18 nt, Escherichia coli CFT073
ggcgcuguugcuaucggc

SEQ ID NO: 2619801 - RNA, 16 nt, Escherichia coli CFT073
ggcgcuuugaaacgca

SEQ ID NO: 2619802 - RNA, 21 nt, Escherichia coli CFT073
ggcggaaacaccguaccauca

SEQ ID NO: 2619803 - RNA, 13 nt, Escherichia coli CFT073
ggcggaaacgcug

SEQ ID NO: 2619804 - RNA, 14 nt, Escherichia coli CFT073
ggcggaaacgcugg

SEQ ID NO: 2619805 - RNA, 14 nt, Escherichia coli CFT073
ggcggaaauaacgc

SEQ ID NO: 2619806 - RNA, 15 nt, Escherichia coli CFT073
ggcggaggggaggaa

SEQ ID NO: 2619807 - RNA, 17 nt, Escherichia coli CFT073
ggcggauagcgauacag

SEQ ID NO: 2619808 - RNA, 23 nt, Escherichia coli CFT073
ggcggaucgucacgucuacagua

SEQ ID NO: 2619809 - RNA, 22 nt, Escherichia coli CFT073
ggcggaucugaucagcacgaua

SEQ ID NO: 2619810 - RNA, 17 nt, Escherichia coli CFT073
ggcggauggaguggggc

SEQ ID NO: 2619811 - RNA, 23 nt, Escherichia coli CFT073
ggcggcaaagcgcaucagcuuac

SEQ ID NO: 2619812 - RNA, 15 nt, Escherichia coli CFT073
ggcggcacagccagc

SEQ ID NO: 2619813 - RNA, 15 nt, Escherichia coli CFT073
ggcggcacaggucgc

SEQ ID NO: 2619814 - RNA, 15 nt, Escherichia coli CFT073
ggcggcacucgcuga

SEQ ID NO: 2619815 - RNA, 12 nt, Escherichia coli CFT073
ggcggcgacugg

SEQ ID NO: 2619816 - RNA, 16 nt, Escherichia coli CFT073
ggcggcggcggucauc

SEQ ID NO: 2619817 - RNA, 18 nt, Escherichia coli CFT073
ggcggcgucagcggcugu

SEQ ID NO: 2619818 - RNA, 20 nt, Escherichia coli CFT073
ggcggcguguuauccggcug

SEQ ID NO: 2619819 - RNA, 19 nt, Escherichia coli CFT073
ggcggcuugcaccagcagc

SEQ ID NO: 2619820 - RNA, 20 nt, Escherichia coli CFT073
ggcggcuuucagggcgucaa

SEQ ID NO: 2619821 - RNA, 18 nt, Escherichia coli CFT073
ggcggcuuuuugugaacc

SEQ ID NO: 2619822 - RNA, 22 nt, Escherichia coli CFT073
ggcgggcaaacggaucgcguaa

SEQ ID NO: 2619823 - RNA, 15 nt, Escherichia coli CFT073
ggcggguuaaccagc

SEQ ID NO: 2619824 - RNA, 15 nt, Escherichia coli CFT073
ggcgguaaaaucauc

SEQ ID NO: 2619825 - RNA, 15 nt, Escherichia coli CFT073
ggcgguaaagaaauc

SEQ ID NO: 2619826 - RNA, 17 nt, Escherichia coli CFT073
ggcgguacgaccgcaaa

SEQ ID NO: 2619827 - RNA, 16 nt, Escherichia coli CFT073
ggcgguauuuaaacuc

SEQ ID NO: 2619828 - RNA, 13 nt, Escherichia coli CFT073
ggcggucagguaa

SEQ ID NO: 2619829 - RNA, 21 nt, Escherichia coli CFT073
ggcggucccacaacagguauc

SEQ ID NO: 2619830 - RNA, 20 nt, Escherichia coli CFT073
ggcggucgccgucaauagcg

SEQ ID NO: 2619831 - RNA, 21 nt, Escherichia coli CFT073
ggcggucugcgaugaucgccg

SEQ ID NO: 2619832 - RNA, 14 nt, Escherichia coli CFT073
ggcggugguggcuu

SEQ ID NO: 2619833 - RNA, 15 nt, Escherichia coli CFT073
ggcgguuuuucagcu

SEQ ID NO: 2619834 - RNA, 23 nt, Escherichia coli CFT073
ggcguaaacgccuuauccgacuu

SEQ ID NO: 2619835 - RNA, 15 nt, Escherichia coli CFT073
ggcguaaccaaugcc

SEQ ID NO: 2619836 - RNA, 13 nt, Escherichia coli CFT073
ggcguacagcugg

SEQ ID NO: 2619837 - RNA, 21 nt, Escherichia coli CFT073
ggcguaugccggauggcugau

SEQ ID NO: 2619838 - RNA, 23 nt, Escherichia coli CFT073
ggcguauucggcagacguaaugu

SEQ ID NO: 2619839 - RNA, 15 nt, Escherichia coli CFT073
ggcgucagcgcaaau

SEQ ID NO: 2619840 - RNA, 18 nt, Escherichia coli CFT073
ggcgucagcgccaucccc

SEQ ID NO: 2619841 - RNA, 16 nt, Escherichia coli CFT073
ggcgucaugcucgcag

SEQ ID NO: 2619842 - RNA, 22 nt, Escherichia coli CFT073
ggcgucuaaucgcuuuauagca

SEQ ID NO: 2619843 - RNA, 13 nt, Escherichia coli CFT073
ggcgucuccaccu

SEQ ID NO: 2619844 - RNA, 21 nt, Escherichia coli CFT073
ggcgucuuguugaacagacgc

SEQ ID NO: 2619845 - RNA, 21 nt, Escherichia coli CFT073
ggcgugaacaccuuauccggc

SEQ ID NO: 2619846 - RNA, 18 nt, Escherichia coli CFT073
ggcgugaacgccuuaucc

SEQ ID NO: 2619847 - RNA, 21 nt, Escherichia coli CFT073
ggcgugaacgccuuauccgac

SEQ ID NO: 2619848 - RNA, 21 nt, Escherichia coli CFT073
ggcgugaacgccuuauccggc

SEQ ID NO: 2619849 - RNA, 17 nt, Escherichia coli CFT073
ggcgugaaugcgccaau

SEQ ID NO: 2619850 - RNA, 20 nt, Escherichia coli CFT073
ggcgugauaaaagucaggca

SEQ ID NO: 2619851 - RNA, 13 nt, Escherichia coli CFT073
ggcgugauaaugc

SEQ ID NO: 2619852 - RNA, 15 nt, Escherichia coli CFT073
ggcgugccuucacgg

SEQ ID NO: 2619853 - RNA, 20 nt, Escherichia coli CFT073
ggcgugcucacugaaaucuc

SEQ ID NO: 2619854 - RNA, 12 nt, Escherichia coli CFT073
ggcguggaaacg

SEQ ID NO: 2619855 - RNA, 20 nt, Escherichia coli CFT073
ggcguggccccaggcauaga

SEQ ID NO: 2619856 - RNA, 15 nt, Escherichia coli CFT073
ggcguggucgguuaa

SEQ ID NO: 2619857 - RNA, 18 nt, Escherichia coli CFT073
ggcguguugcuccacgcc

SEQ ID NO: 2619858 - RNA, 13 nt, Escherichia coli CFT073
ggcguuaaaacca

SEQ ID NO: 2619859 - RNA, 21 nt, Escherichia coli CFT073
ggcguuaaugauaucccugcu

SEQ ID NO: 2619860 - RNA, 19 nt, Escherichia coli CFT073
ggcguuaugcugcggcauc

SEQ ID NO: 2619861 - RNA, 15 nt, Escherichia coli CFT073
ggcguucaccagcgc

SEQ ID NO: 2619862 - RNA, 17 nt, Escherichia coli CFT073
ggcguucacgccgcauc

SEQ ID NO: 2619863 - RNA, 18 nt, Escherichia coli CFT073
ggcguucacgccgcaucu

SEQ ID NO: 2619864 - RNA, 20 nt, Escherichia coli CFT073
ggcguugauugccggaugcg

SEQ ID NO: 2619865 - RNA, 16 nt, Escherichia coli CFT073
ggcguugcaaggaacg

SEQ ID NO: 2619866 - RNA, 21 nt, Escherichia coli CFT073
ggcguugcagaaguugugaaa

SEQ ID NO: 2619867 - RNA, 16 nt, Escherichia coli CFT073
ggcguuguccgccaga

SEQ ID NO: 2619868 - RNA, 17 nt, Escherichia coli CFT073
ggcguuuacgccgcauc

SEQ ID NO: 2619869 - RNA, 23 nt, Escherichia coli CFT073
ggcguuuugauuuucaccagcau

SEQ ID NO: 2619870 - RNA, 22 nt, Escherichia coli CFT073
ggcguuuuggcugugaauuacu

SEQ ID NO: 2619871 - RNA, 15 nt, Escherichia coli CFT073
ggcguuuuuggcauc

SEQ ID NO: 2619872 - RNA, 22 nt, Escherichia coli CFT073
ggcguuuuuucaucacugcgcu

SEQ ID NO: 2619873 - RNA, 19 nt, Escherichia coli CFT073
ggcuaaaaaaagccaccac

SEQ ID NO: 2619874 - RNA, 16 nt, Escherichia coli CFT073
ggcuaaccuuauggug

SEQ ID NO: 2619875 - RNA, 15 nt, Escherichia coli CFT073
ggcuaagcaggcugg

SEQ ID NO: 2619876 - RNA, 18 nt, Escherichia coli CFT073
ggcuaaucgucaucgaca

SEQ ID NO: 2619877 - RNA, 16 nt, Escherichia coli CFT073
ggcuacacuuucugca

SEQ ID NO: 2619878 - RNA, 22 nt, Escherichia coli CFT073
ggcuaccauccgcgcgcguaag

SEQ ID NO: 2619879 - RNA, 14 nt, Escherichia coli CFT073
ggcuaccgcaguga

SEQ ID NO: 2619880 - RNA, 15 nt, Escherichia coli CFT073
ggcuagccucccugc

SEQ ID NO: 2619881 - RNA, 18 nt, Escherichia coli CFT073
ggcuauaccccaccccga

SEQ ID NO: 2619882 - RNA, 14 nt, Escherichia coli CFT073
ggcuaucgaaauca

SEQ ID NO: 2619883 - RNA, 13 nt, Escherichia coli CFT073
ggcuaugcuggag

SEQ ID NO: 2619884 - RNA, 12 nt, Escherichia coli CFT073
ggcuauucuggc

SEQ ID NO: 2619885 - RNA, 14 nt, Escherichia coli CFT073
ggcucaaacugcuc

SEQ ID NO: 2619886 - RNA, 14 nt, Escherichia coli CFT073
ggcucaccugcaca

SEQ ID NO: 2619887 - RNA, 15 nt, Escherichia coli CFT073
ggcucagccagacgc

SEQ ID NO: 2619888 - RNA, 16 nt, Escherichia coli CFT073
ggcucauaccuuccac

SEQ ID NO: 2619889 - RNA, 23 nt, Escherichia coli CFT073
ggcucauaucuucuccugucaug

SEQ ID NO: 2619890 - RNA, 21 nt, Escherichia coli CFT073
ggcucaucaaacaacggcacu

SEQ ID NO: 2619891 - RNA, 12 nt, Escherichia coli CFT073
ggcucauccggu

SEQ ID NO: 2619892 - RNA, 21 nt, Escherichia coli CFT073
ggcuccaguuaacgccgcgcc

SEQ ID NO: 2619893 - RNA, 18 nt, Escherichia coli CFT073
ggcuccgggcgcaccagu

SEQ ID NO: 2619894 - RNA, 16 nt, Escherichia coli CFT073
ggcuccuguuugcauu

SEQ ID NO: 2619895 - RNA, 21 nt, Escherichia coli CFT073
ggcucgacaagcguaauuauu

SEQ ID NO: 2619896 - RNA, 14 nt, Escherichia coli CFT073
ggcucgagcgacca

SEQ ID NO: 2619897 - RNA, 18 nt, Escherichia coli CFT073
ggcucgccauccagugaa

SEQ ID NO: 2619898 - RNA, 15 nt, Escherichia coli CFT073
ggcucucauccaaua

SEQ ID NO: 2619899 - RNA, 19 nt, Escherichia coli CFT073
ggcucugauugccuuccac

SEQ ID NO: 2619900 - RNA, 15 nt, Escherichia coli CFT073
ggcugaauaaaagcu

SEQ ID NO: 2619901 - RNA, 21 nt, Escherichia coli CFT073
ggcugacacuauucgccagca

SEQ ID NO: 2619902 - RNA, 18 nt, Escherichia coli CFT073
ggcugacauuaucagaca

SEQ ID NO: 2619903 - RNA, 21 nt, Escherichia coli CFT073
ggcugaccgucgcagccagcg

SEQ ID NO: 2619904 - RNA, 20 nt, Escherichia coli CFT073
ggcugaccuggaagugucca

SEQ ID NO: 2619905 - RNA, 20 nt, Escherichia coli CFT073
ggcugacgauaccaggugug

SEQ ID NO: 2619906 - RNA, 19 nt, Escherichia coli CFT073
ggcugacguuaagaaaacg

SEQ ID NO: 2619907 - RNA, 23 nt, Escherichia coli CFT073
ggcugagaaccgcacagguugca

SEQ ID NO: 2619908 - RNA, 20 nt, Escherichia coli CFT073
ggcugagcaaacaguucugc

SEQ ID NO: 2619909 - RNA, 15 nt, Escherichia coli CFT073
ggcugaguuaccagc

SEQ ID NO: 2619910 - RNA, 12 nt, Escherichia coli CFT073
ggcugaugcugg

SEQ ID NO: 2619911 - RNA, 13 nt, Escherichia coli CFT073
ggcugaugugcuu

SEQ ID NO: 2619912 - RNA, 14 nt, Escherichia coli CFT073
ggcugauuacccac

SEQ ID NO: 2619913 - RNA, 15 nt, Escherichia coli CFT073
ggcugcacuuucagu

SEQ ID NO: 2619914 - RNA, 12 nt, Escherichia coli CFT073
ggcugcaguggu

SEQ ID NO: 2619915 - RNA, 23 nt, Escherichia coli CFT073
ggcugccggaccaucuuccagcu

SEQ ID NO: 2619916 - RNA, 14 nt, Escherichia coli CFT073
ggcugcgcgacggc

SEQ ID NO: 2619917 - RNA, 20 nt, Escherichia coli CFT073
ggcugcgcuugcggccagca

SEQ ID NO: 2619918 - RNA, 22 nt, Escherichia coli CFT073
ggcugcggacgaccaauuaaau

SEQ ID NO: 2619919 - RNA, 23 nt, Escherichia coli CFT073
ggcugcgggaguugcuccacugc

SEQ ID NO: 2619920 - RNA, 18 nt, Escherichia coli CFT073
ggcugcguaauucgccac

SEQ ID NO: 2619921 - RNA, 22 nt, Escherichia coli CFT073
ggcugcguuuuuucacgguuaa

SEQ ID NO: 2619922 - RNA, 15 nt, Escherichia coli CFT073
ggcugcuucgcgccc

SEQ ID NO: 2619923 - RNA, 13 nt, Escherichia coli CFT073
ggcuggcauuccg

SEQ ID NO: 2619924 - RNA, 18 nt, Escherichia coli CFT073
ggcuggcgcuacugaagc

SEQ ID NO: 2619925 - RNA, 21 nt, Escherichia coli CFT073
ggcuggugccugcacuggugg

SEQ ID NO: 2619926 - RNA, 18 nt, Escherichia coli CFT073
ggcugguuuucagcgaaa

SEQ ID NO: 2619927 - RNA, 19 nt, Escherichia coli CFT073
ggcuguauuuuuccagcuc

SEQ ID NO: 2619928 - RNA, 18 nt, Escherichia coli CFT073
ggcugugaauuacugcug

SEQ ID NO: 2619929 - RNA, 19 nt, Escherichia coli CFT073
ggcugugguacugccgacg

SEQ ID NO: 2619930 - RNA, 22 nt, Escherichia coli CFT073
ggcuguuaccuacgcuugcugc

SEQ ID NO: 2619931 - RNA, 17 nt, Escherichia coli CFT073
ggcuguuuucagcacca

SEQ ID NO: 2619932 - RNA, 20 nt, Escherichia coli CFT073
ggcuguuuuccagcaccacu

SEQ ID NO: 2619933 - RNA, 22 nt, Escherichia coli CFT073
ggcuuaacagauugagaauaau

SEQ ID NO: 2619934 - RNA, 17 nt, Escherichia coli CFT073
ggcuuacacuuccuuua

SEQ ID NO: 2619935 - RNA, 15 nt, Escherichia coli CFT073
ggcuuacguuaccca

SEQ ID NO: 2619936 - RNA, 14 nt, Escherichia coli CFT073
ggcuuauccggcau

SEQ ID NO: 2619937 - RNA, 15 nt, Escherichia coli CFT073
ggcuucaaucaacau

SEQ ID NO: 2619938 - RNA, 22 nt, Escherichia coli CFT073
ggcuucaaucaauaacagcgca

SEQ ID NO: 2619939 - RNA, 23 nt, Escherichia coli CFT073
ggcuucaucuuuaucaaucagcc

SEQ ID NO: 2619940 - RNA, 13 nt, Escherichia coli CFT073
ggcuuccccaaca

SEQ ID NO: 2619941 - RNA, 20 nt, Escherichia coli CFT073
ggcuucgaguaaggcaagga

SEQ ID NO: 2619942 - RNA, 16 nt, Escherichia coli CFT073
ggcuucggcguccagu

SEQ ID NO: 2619943 - RNA, 15 nt, Escherichia coli CFT073
ggcuucgucgccagc

SEQ ID NO: 2619944 - RNA, 23 nt, Escherichia coli CFT073
ggcuucguguuaaccuaaagccu

SEQ ID NO: 2619945 - RNA, 23 nt, Escherichia coli CFT073
ggcuucuaccuuauccagcagau

SEQ ID NO: 2619946 - RNA, 15 nt, Escherichia coli CFT073
ggcuucucgcucgag

SEQ ID NO: 2619947 - RNA, 14 nt, Escherichia coli CFT073
ggcuucugccagua

SEQ ID NO: 2619948 - RNA, 15 nt, Escherichia coli CFT073
ggcuugcaccagcag

SEQ ID NO: 2619949 - RNA, 15 nt, Escherichia coli CFT073
ggcuugccagcaggg

SEQ ID NO: 2619950 - RNA, 17 nt, Escherichia coli CFT073
ggcuugcucguuuucaa

SEQ ID NO: 2619951 - RNA, 20 nt, Escherichia coli CFT073
ggcuugcugaugcacgcaga

SEQ ID NO: 2619952 - RNA, 16 nt, Escherichia coli CFT073
ggcuugugcgcccggc

SEQ ID NO: 2619953 - RNA, 20 nt, Escherichia coli CFT073
ggcuuuaauaccugccuggu

SEQ ID NO: 2619954 - RNA, 13 nt, Escherichia coli CFT073
ggcuuuaaucacc

SEQ ID NO: 2619955 - RNA, 13 nt, Escherichia coli CFT073
ggcuuuauaaauu

SEQ ID NO: 2619956 - RNA, 13 nt, Escherichia coli CFT073
ggcuuuaucagaa

SEQ ID NO: 2619957 - RNA, 12 nt, Escherichia coli CFT073
ggcuuuaucaug

SEQ ID NO: 2619958 - RNA, 16 nt, Escherichia coli CFT073
ggcuuucaccgccuga

SEQ ID NO: 2619959 - RNA, 20 nt, Escherichia coli CFT073
ggcuuuccgggagcaauuug

SEQ ID NO: 2619960 - RNA, 18 nt, Escherichia coli CFT073
ggcuuucgcgacaucgcc

SEQ ID NO: 2619961 - RNA, 14 nt, Escherichia coli CFT073
ggcuuucgcuucaa

SEQ ID NO: 2619962 - RNA, 16 nt, Escherichia coli CFT073
ggcuuugaucagcguc

SEQ ID NO: 2619963 - RNA, 17 nt, Escherichia coli CFT073
ggcuuugcuguuuccag

SEQ ID NO: 2619964 - RNA, 12 nt, Escherichia coli CFT073
ggcuuuuuaauu

SEQ ID NO: 2619965 - RNA, 22 nt, Escherichia coli CFT073
ggcuuuuuauguuagccgccug

SEQ ID NO: 2619966 - RNA, 19 nt, Escherichia coli CFT073
ggcuuuuuuacaucaucag

SEQ ID NO: 2619967 - RNA, 18 nt, Escherichia coli CFT073
ggcuuuuuucauuucccg

SEQ ID NO: 2619968 - RNA, 14 nt, Escherichia coli CFT073
ggcuuuuuucucaa

SEQ ID NO: 2619969 - RNA, 16 nt, Escherichia coli CFT073
gggaaaggauggcgau

SEQ ID NO: 2619970 - RNA, 19 nt, Escherichia coli CFT073
gggaaauagcuuaacggca

SEQ ID NO: 2619971 - RNA, 15 nt, Escherichia coli CFT073
gggaaaucaccacca

SEQ ID NO: 2619972 - RNA, 23 nt, Escherichia coli CFT073
gggaacccgaugguucccuuuuu

SEQ ID NO: 2619973 - RNA, 14 nt, Escherichia coli CFT073
gggaacugcaggca

SEQ ID NO: 2619974 - RNA, 14 nt, Escherichia coli CFT073
gggaacugcugacc

SEQ ID NO: 2619975 - RNA, 14 nt, Escherichia coli CFT073
gggaacuuaucauc

SEQ ID NO: 2619976 - RNA, 15 nt, Escherichia coli CFT073
gggaagggagcgccg

SEQ ID NO: 2619977 - RNA, 12 nt, Escherichia coli CFT073
gggaaggucagg

SEQ ID NO: 2619978 - RNA, 13 nt, Escherichia coli CFT073
gggaaggucaggu

SEQ ID NO: 2619979 - RNA, 16 nt, Escherichia coli CFT073
gggaagugcgcccagg

SEQ ID NO: 2619980 - RNA, 17 nt, Escherichia coli CFT073
gggaauaaaagccagga

SEQ ID NO: 2619981 - RNA, 14 nt, Escherichia coli CFT073
gggaauaacccgga

SEQ ID NO: 2619982 - RNA, 14 nt, Escherichia coli CFT073
gggaauagcucagu

SEQ ID NO: 2619983 - RNA, 15 nt, Escherichia coli CFT073
gggaauagcucaguu

SEQ ID NO: 2619984 - RNA, 20 nt, Escherichia coli CFT073
gggaauagcucaguugguag

SEQ ID NO: 2619985 - RNA, 17 nt, Escherichia coli CFT073
gggaaucaaucauuucu

SEQ ID NO: 2619986 - RNA, 18 nt, Escherichia coli CFT073
gggaauucgaagcuguag

SEQ ID NO: 2619987 - RNA, 23 nt, Escherichia coli CFT073
gggaauucguucagacgcucugc

SEQ ID NO: 2619988 - RNA, 17 nt, Escherichia coli CFT073
gggaauugugcuuucag

SEQ ID NO: 2619989 - RNA, 22 nt, Escherichia coli CFT073
gggacgguccgugcgcuuuuua

SEQ ID NO: 2619990 - RNA, 16 nt, Escherichia coli CFT073
gggagaaacccggcca

SEQ ID NO: 2619991 - RNA, 17 nt, Escherichia coli CFT073
gggagacuucacugaaa

SEQ ID NO: 2619992 - RNA, 13 nt, Escherichia coli CFT073
gggagauguaaua

SEQ ID NO: 2619993 - RNA, 16 nt, Escherichia coli CFT073
gggagcagacuguaaa

SEQ ID NO: 2619994 - RNA, 23 nt, Escherichia coli CFT073
gggagcgaaaaagcguucaucug

SEQ ID NO: 2619995 - RNA, 22 nt, Escherichia coli CFT073
gggagcgcuuuuuccugccgcu

SEQ ID NO: 2619996 - RNA, 15 nt, Escherichia coli CFT073
gggaguggugauggu

SEQ ID NO: 2619997 - RNA, 19 nt, Escherichia coli CFT073
gggauaaagacuuuaucgu

SEQ ID NO: 2619998 - RNA, 19 nt, Escherichia coli CFT073
gggauagcguagugauggu

SEQ ID NO: 2619999 - RNA, 14 nt, Escherichia coli CFT073
gggauauaaaccgc

SEQ ID NO: 2620000 - RNA, 22 nt, Escherichia coli CFT073
gggauauccaccgucaaaucca

SEQ ID NO: 2620001 - RNA, 17 nt, Escherichia coli CFT073
gggaucaucucaacaaa

SEQ ID NO: 2620002 - RNA, 11 nt, Escherichia coli CFT073
gggaucauuaa

SEQ ID NO: 2620003 - RNA, 22 nt, Escherichia coli CFT073
gggaucccgugggcugauccgu

SEQ ID NO: 2620004 - RNA, 18 nt, Escherichia coli CFT073
gggaucggcguacuggca

SEQ ID NO: 2620005 - RNA, 18 nt, Escherichia coli CFT073
gggaucuccagugagaga

SEQ ID NO: 2620006 - RNA, 17 nt, Escherichia coli CFT073
gggaucuuccaguucuu

SEQ ID NO: 2620007 - RNA, 13 nt, Escherichia coli CFT073
gggaugaccgaca

SEQ ID NO: 2620008 - RNA, 18 nt, Escherichia coli CFT073
gggauugcauccugcgcg

SEQ ID NO: 2620009 - RNA, 18 nt, Escherichia coli CFT073
gggauuucaaugcgcaag

SEQ ID NO: 2620010 - RNA, 18 nt, Escherichia coli CFT073
gggcaaaugcuccccugc

SEQ ID NO: 2620011 - RNA, 15 nt, Escherichia coli CFT073
gggcaauuucacgcu

SEQ ID NO: 2620012 - RNA, 21 nt, Escherichia coli CFT073
gggcacgcagguaaucaaugc

SEQ ID NO: 2620013 - RNA, 19 nt, Escherichia coli CFT073
gggcacucuuggcaccgcc

SEQ ID NO: 2620014 - RNA, 17 nt, Escherichia coli CFT073
gggcagacaugaccaca

SEQ ID NO: 2620015 - RNA, 17 nt, Escherichia coli CFT073
gggcaggcagaauuaau

SEQ ID NO: 2620016 - RNA, 14 nt, Escherichia coli CFT073
gggcaggccagggu

SEQ ID NO: 2620017 - RNA, 20 nt, Escherichia coli CFT073
gggcaugauuaucaugcccu

SEQ ID NO: 2620018 - RNA, 22 nt, Escherichia coli CFT073
gggcauggugucaccacccugc

SEQ ID NO: 2620019 - RNA, 18 nt, Escherichia coli CFT073
gggcauguguuagcccug

SEQ ID NO: 2620020 - RNA, 19 nt, Escherichia coli CFT073
gggcauguguuagcccugu

SEQ ID NO: 2620021 - RNA, 12 nt, Escherichia coli CFT073
gggcauuucuuu

SEQ ID NO: 2620022 - RNA, 22 nt, Escherichia coli CFT073
gggcauuuuccagugacauacu

SEQ ID NO: 2620023 - RNA, 21 nt, Escherichia coli CFT073
gggccacagauucaauacuuc

SEQ ID NO: 2620024 - RNA, 24 nt, Escherichia coli CFT073
gggccaguaaacugacccgcucgu

SEQ ID NO: 2620025 - RNA, 19 nt, Escherichia coli CFT073
gggccauccaccagugacu

SEQ ID NO: 2620026 - RNA, 16 nt, Escherichia coli CFT073
gggccaugcacccgca

SEQ ID NO: 2620027 - RNA, 17 nt, Escherichia coli CFT073
gggccaugcacccgcaa

SEQ ID NO: 2620028 - RNA, 18 nt, Escherichia coli CFT073
gggccgaacaucagauaa

SEQ ID NO: 2620029 - RNA, 22 nt, Escherichia coli CFT073
gggccgcgucgcccguggagug

SEQ ID NO: 2620030 - RNA, 11 nt, Escherichia coli CFT073
gggccgucccc

SEQ ID NO: 2620031 - RNA, 14 nt, Escherichia coli CFT073
gggccucgcagcgg

SEQ ID NO: 2620032 - RNA, 15 nt, Escherichia coli CFT073
gggccugaacaagca

SEQ ID NO: 2620033 - RNA, 12 nt, Escherichia coli CFT073
gggccugauaag

SEQ ID NO: 2620034 - RNA, 15 nt, Escherichia coli CFT073
gggccuggaaguuga

SEQ ID NO: 2620035 - RNA, 14 nt, Escherichia coli CFT073
gggcgaauuccuga

SEQ ID NO: 2620036 - RNA, 20 nt, Escherichia coli CFT073
gggcgaauuccugacuuacc

SEQ ID NO: 2620037 - RNA, 14 nt, Escherichia coli CFT073
gggcgacauuuagu

SEQ ID NO: 2620038 - RNA, 18 nt, Escherichia coli CFT073
gggcgagaggaauuuauc

SEQ ID NO: 2620039 - RNA, 21 nt, Escherichia coli CFT073
gggcgaggggagacuucacug

SEQ ID NO: 2620040 - RNA, 12 nt, Escherichia coli CFT073
gggcgauuucag

SEQ ID NO: 2620041 - RNA, 16 nt, Escherichia coli CFT073
gggcgcaaugcccgca

SEQ ID NO: 2620042 - RNA, 11 nt, Escherichia coli CFT073
gggcgcgggca

SEQ ID NO: 2620043 - RNA, 20 nt, Escherichia coli CFT073
gggcggaacuucgcgaguga

SEQ ID NO: 2620044 - RNA, 14 nt, Escherichia coli CFT073
gggcgucaaaauca

SEQ ID NO: 2620045 - RNA, 14 nt, Escherichia coli CFT073
gggcguuacagcug

SEQ ID NO: 2620046 - RNA, 15 nt, Escherichia coli CFT073
gggcguuacagcugg

SEQ ID NO: 2620047 - RNA, 16 nt, Escherichia coli CFT073
gggcguuacagcugga

SEQ ID NO: 2620048 - RNA, 19 nt, Escherichia coli CFT073
gggcuauacacccuucucg

SEQ ID NO: 2620049 - RNA, 22 nt, Escherichia coli CFT073
gggcuccauagggcagggugcc

SEQ ID NO: 2620050 - RNA, 21 nt, Escherichia coli CFT073
gggcugauaccgcguuggcgc

SEQ ID NO: 2620051 - RNA, 16 nt, Escherichia coli CFT073
gggcugaugaaguuga

SEQ ID NO: 2620052 - RNA, 21 nt, Escherichia coli CFT073
gggcuggaaacgcgaucgcca

SEQ ID NO: 2620053 - RNA, 12 nt, Escherichia coli CFT073
gggcuggccaau

SEQ ID NO: 2620054 - RNA, 18 nt, Escherichia coli CFT073
gggcuguuuuccagcacc

SEQ ID NO: 2620055 - RNA, 20 nt, Escherichia coli CFT073
gggcuucaaaguuugcccgu

SEQ ID NO: 2620056 - RNA, 18 nt, Escherichia coli CFT073
gggcuuccagcaaaucca

SEQ ID NO: 2620057 - RNA, 16 nt, Escherichia coli CFT073
gggcuugccagguagc

SEQ ID NO: 2620058 - RNA, 17 nt, Escherichia coli CFT073
gggcuuucgcaauaauc

SEQ ID NO: 2620059 - RNA, 21 nt, Escherichia coli CFT073
gggcuuuguagguaauggcgu

SEQ ID NO: 2620060 - RNA, 22 nt, Escherichia coli CFT073
gggcuuuuuuuuauuauuccgu

SEQ ID NO: 2620061 - RNA, 23 nt, Escherichia coli CFT073
ggggaacgcguagcgcaaaucaa

SEQ ID NO: 2620062 - RNA, 14 nt, Escherichia coli CFT073
ggggaaguggugau

SEQ ID NO: 2620063 - RNA, 17 nt, Escherichia coli CFT073
ggggacauuuagcggcc

SEQ ID NO: 2620064 - RNA, 22 nt, Escherichia coli CFT073
ggggcauuuuuuccaggggcug

SEQ ID NO: 2620065 - RNA, 14 nt, Escherichia coli CFT073
ggggcgaccugugc

SEQ ID NO: 2620066 - RNA, 21 nt, Escherichia coli CFT073
ggggcuggcggcaaucgccag

SEQ ID NO: 2620067 - RNA, 20 nt, Escherichia coli CFT073
ggggcuuuucucugucugcc

SEQ ID NO: 2620068 - RNA, 15 nt, Escherichia coli CFT073
gggguaaauccacgu

SEQ ID NO: 2620069 - RNA, 20 nt, Escherichia coli CFT073
ggggucagggcuucaaaguu

SEQ ID NO: 2620070 - RNA, 15 nt, Escherichia coli CFT073
gggguuaaauugauc

SEQ ID NO: 2620071 - RNA, 18 nt, Escherichia coli CFT073
gggguucccgagcggcca

SEQ ID NO: 2620072 - RNA, 22 nt, Escherichia coli CFT073
gggguuuucucuuuccagcaac

SEQ ID NO: 2620073 - RNA, 15 nt, Escherichia coli CFT073
gggguuuugcugauu

SEQ ID NO: 2620074 - RNA, 13 nt, Escherichia coli CFT073
ggguaagcgccac

SEQ ID NO: 2620075 - RNA, 13 nt, Escherichia coli CFT073
ggguaauaaacca

SEQ ID NO: 2620076 - RNA, 15 nt, Escherichia coli CFT073
ggguaaucgccagca

SEQ ID NO: 2620077 - RNA, 21 nt, Escherichia coli CFT073
ggguaaucgucagcaucucug

SEQ ID NO: 2620078 - RNA, 15 nt, Escherichia coli CFT073
ggguaauuucauuaa

SEQ ID NO: 2620079 - RNA, 15 nt, Escherichia coli CFT073
ggguacgacuuccug

SEQ ID NO: 2620080 - RNA, 23 nt, Escherichia coli CFT073
ggguagcaggccggagacgacgc

SEQ ID NO: 2620081 - RNA, 18 nt, Escherichia coli CFT073
ggguagcuuccugcuguu

SEQ ID NO: 2620082 - RNA, 13 nt, Escherichia coli CFT073
ggguauuauuucu

SEQ ID NO: 2620083 - RNA, 18 nt, Escherichia coli CFT073
ggguauuuugucuuucag

SEQ ID NO: 2620084 - RNA, 23 nt, Escherichia coli CFT073
gggucacugcgguguaaaccagc

SEQ ID NO: 2620085 - RNA, 14 nt, Escherichia coli CFT073
gggucagcggcggc

SEQ ID NO: 2620086 - RNA, 17 nt, Escherichia coli CFT073
gggucgccagaagguga

SEQ ID NO: 2620087 - RNA, 21 nt, Escherichia coli CFT073
gggucuaaaaacaauucuucg

SEQ ID NO: 2620088 - RNA, 15 nt, Escherichia coli CFT073
gggugaaagggugcg

SEQ ID NO: 2620089 - RNA, 20 nt, Escherichia coli CFT073
gggugaagacggccauccca

SEQ ID NO: 2620090 - RNA, 20 nt, Escherichia coli CFT073
gggugacagcaggaaaauga

SEQ ID NO: 2620091 - RNA, 20 nt, Escherichia coli CFT073
gggugacggagaaaauccgc

SEQ ID NO: 2620092 - RNA, 22 nt, Escherichia coli CFT073
gggugacguuugaugcgcgagg

SEQ ID NO: 2620093 - RNA, 15 nt, Escherichia coli CFT073
gggugagacuuuacc

SEQ ID NO: 2620094 - RNA, 15 nt, Escherichia coli CFT073
gggugauaagcgagg

SEQ ID NO: 2620095 - RNA, 22 nt, Escherichia coli CFT073
ggguuacgcgcaguuucccaag

SEQ ID NO: 2620096 - RNA, 20 nt, Escherichia coli CFT073
ggguuaucuuccagcggcca

SEQ ID NO: 2620097 - RNA, 22 nt, Escherichia coli CFT073
ggguuaucuuccagcggccaga

SEQ ID NO: 2620098 - RNA, 21 nt, Escherichia coli CFT073
ggguugcagcggagaucgcca

SEQ ID NO: 2620099 - RNA, 15 nt, Escherichia coli CFT073
ggguugcugaccaaa

SEQ ID NO: 2620100 - RNA, 20 nt, Escherichia coli CFT073
ggguuguugcacuauugcgu

SEQ ID NO: 2620101 - RNA, 19 nt, Escherichia coli CFT073
ggguuucgacggcaccaaa

SEQ ID NO: 2620102 - RNA, 21 nt, Escherichia coli CFT073
ggguuucuucaaacugcagca

SEQ ID NO: 2620103 - RNA, 14 nt, Escherichia coli CFT073
ggguuuucuacuuu

SEQ ID NO: 2620104 - RNA, 16 nt, Escherichia coli CFT073
gguaaaacggcagaau

SEQ ID NO: 2620105 - RNA, 20 nt, Escherichia coli CFT073
gguaaaaguagggcgcugcc

SEQ ID NO: 2620106 - RNA, 23 nt, Escherichia coli CFT073
gguaaaaucauccugcugcacgc

SEQ ID NO: 2620107 - RNA, 21 nt, Escherichia coli CFT073
gguaaaauggucagccagcgg

SEQ ID NO: 2620108 - RNA, 17 nt, Escherichia coli CFT073
gguaaacaacaugcuau

SEQ ID NO: 2620109 - RNA, 21 nt, Escherichia coli CFT073
gguaaacaccuucguccagca

SEQ ID NO: 2620110 - RNA, 19 nt, Escherichia coli CFT073
gguaaacccggccugauau

SEQ ID NO: 2620111 - RNA, 23 nt, Escherichia coli CFT073
gguaaagcaccugauuaguggca

SEQ ID NO: 2620112 - RNA, 13 nt, Escherichia coli CFT073
gguaaaucagacc

SEQ ID NO: 2620113 - RNA, 14 nt, Escherichia coli CFT073
gguaaaucauuguu

SEQ ID NO: 2620114 - RNA, 15 nt, Escherichia coli CFT073
gguaacccauccagc

SEQ ID NO: 2620115 - RNA, 18 nt, Escherichia coli CFT073
gguaacgcucacaucugc

SEQ ID NO: 2620116 - RNA, 13 nt, Escherichia coli CFT073
gguaacggcagau

SEQ ID NO: 2620117 - RNA, 19 nt, Escherichia coli CFT073
gguaacguuugccagccac

SEQ ID NO: 2620118 - RNA, 17 nt, Escherichia coli CFT073
gguaacuuaucuguaau

SEQ ID NO: 2620119 - RNA, 17 nt, Escherichia coli CFT073
gguaagcgauaaaaaua

SEQ ID NO: 2620120 - RNA, 24 nt, Escherichia coli CFT073
gguaagcgauaaaaauaccgagca

SEQ ID NO: 2620121 - RNA, 16 nt, Escherichia coli CFT073
gguaagcgugauaaca

SEQ ID NO: 2620122 - RNA, 12 nt, Escherichia coli CFT073
gguaauaaacca

SEQ ID NO: 2620123 - RNA, 13 nt, Escherichia coli CFT073
gguaauaaacgcc

SEQ ID NO: 2620124 - RNA, 14 nt, Escherichia coli CFT073
gguaauacccagac

SEQ ID NO: 2620125 - RNA, 20 nt, Escherichia coli CFT073
gguaauacccagacuuuuca

SEQ ID NO: 2620126 - RNA, 17 nt, Escherichia coli CFT073
gguaauauauaacagaa

SEQ ID NO: 2620127 - RNA, 13 nt, Escherichia coli CFT073
gguaauaucgcgc

SEQ ID NO: 2620128 - RNA, 18 nt, Escherichia coli CFT073
gguaaucagcuuauccag

SEQ ID NO: 2620129 - RNA, 20 nt, Escherichia coli CFT073
gguaauccagcgucgccagc

SEQ ID NO: 2620130 - RNA, 13 nt, Escherichia coli CFT073
gguaaucgccagc

SEQ ID NO: 2620131 - RNA, 16 nt, Escherichia coli CFT073
gguaaucgccagcaaa

SEQ ID NO: 2620132 - RNA, 15 nt, Escherichia coli CFT073
gguaaucgucagcau

SEQ ID NO: 2620133 - RNA, 16 nt, Escherichia coli CFT073
gguaaugauuaacagc

SEQ ID NO: 2620134 - RNA, 18 nt, Escherichia coli CFT073
gguaaugcacuccgccgc

SEQ ID NO: 2620135 - RNA, 18 nt, Escherichia coli CFT073
gguaaugcgcgcuaugau

SEQ ID NO: 2620136 - RNA, 20 nt, Escherichia coli CFT073
gguaaugcgcgcuaugauga

SEQ ID NO: 2620137 - RNA, 16 nt, Escherichia coli CFT073
gguaaugcugaaauua

SEQ ID NO: 2620138 - RNA, 16 nt, Escherichia coli CFT073
gguaauugacgccauc

SEQ ID NO: 2620139 - RNA, 19 nt, Escherichia coli CFT073
gguaauugcccgcagaugu

SEQ ID NO: 2620140 - RNA, 15 nt, Escherichia coli CFT073
gguacaaaagcaaua

SEQ ID NO: 2620141 - RNA, 17 nt, Escherichia coli CFT073
gguacaaacaucaucca

SEQ ID NO: 2620142 - RNA, 23 nt, Escherichia coli CFT073
gguacaauggagcuaaacagagc

SEQ ID NO: 2620143 - RNA, 21 nt, Escherichia coli CFT073
gguacacaaccgccggaugcg

SEQ ID NO: 2620144 - RNA, 19 nt, Escherichia coli CFT073
gguacgaccgcaaagguug

SEQ ID NO: 2620145 - RNA, 17 nt, Escherichia coli CFT073
gguacgacuuccuggcu

SEQ ID NO: 2620146 - RNA, 21 nt, Escherichia coli CFT073
gguacucaugcccacgcaaac

SEQ ID NO: 2620147 - RNA, 20 nt, Escherichia coli CFT073
gguagaauuuguaggccgga

SEQ ID NO: 2620148 - RNA, 22 nt, Escherichia coli CFT073
gguagagcacgaccuugccaag

SEQ ID NO: 2620149 - RNA, 15 nt, Escherichia coli CFT073
gguagagcugaaaau

SEQ ID NO: 2620150 - RNA, 18 nt, Escherichia coli CFT073
gguagagcugaaaauugc

SEQ ID NO: 2620151 - RNA, 21 nt, Escherichia coli CFT073
gguagaugacgcccgggcuug

SEQ ID NO: 2620152 - RNA, 12 nt, Escherichia coli CFT073
gguagcugguga

SEQ ID NO: 2620153 - RNA, 17 nt, Escherichia coli CFT073
  misc_feature (8)..(8): n is a, c, g or u
gguagcungcaggauaa

SEQ ID NO: 2620154 - RNA, 11 nt, Escherichia coli CFT073
gguaggaaaag

SEQ ID NO: 2620155 - RNA, 22 nt, Escherichia coli CFT073
gguaggcgacucguugugugag

SEQ ID NO: 2620156 - RNA, 15 nt, Escherichia coli CFT073
gguagggcgaaacca

SEQ ID NO: 2620157 - RNA, 11 nt, Escherichia coli CFT073
gguaguacuua

SEQ ID NO: 2620158 - RNA, 21 nt, Escherichia coli CFT073
gguagucaaaagcacucagag

SEQ ID NO: 2620159 - RNA, 18 nt, Escherichia coli CFT073
gguauaacuugccaggcc

SEQ ID NO: 2620160 - RNA, 21 nt, Escherichia coli CFT073
gguauaacuugccaggccgau

SEQ ID NO: 2620161 - RNA, 13 nt, Escherichia coli CFT073
gguauagaaacca

SEQ ID NO: 2620162 - RNA, 18 nt, Escherichia coli CFT073
gguauagaaaccauccag

SEQ ID NO: 2620163 - RNA, 21 nt, Escherichia coli CFT073
gguauagucacaaaauaagua

SEQ ID NO: 2620164 - RNA, 13 nt, Escherichia coli CFT073
gguaucaaacaca

SEQ ID NO: 2620165 - RNA, 15 nt, Escherichia coli CFT073
gguaucaaacacagg

SEQ ID NO: 2620166 - RNA, 21 nt, Escherichia coli CFT073
gguaucaucccagccaaugca

SEQ ID NO: 2620167 - RNA, 15 nt, Escherichia coli CFT073
gguaucgccacugcg

SEQ ID NO: 2620168 - RNA, 18 nt, Escherichia coli CFT073
gguaucgcgccagccagu

SEQ ID NO: 2620169 - RNA, 18 nt, Escherichia coli CFT073
gguaucuaucacuauaaa

SEQ ID NO: 2620170 - RNA, 17 nt, Escherichia coli CFT073
gguaucuuuccagccug

SEQ ID NO: 2620171 - RNA, 19 nt, Escherichia coli CFT073
gguaugaauuuucgacagc

SEQ ID NO: 2620172 - RNA, 20 nt, Escherichia coli CFT073
gguaugacccagcgcgguaa

SEQ ID NO: 2620173 - RNA, 14 nt, Escherichia coli CFT073
gguaugcuccggca

SEQ ID NO: 2620174 - RNA, 15 nt, Escherichia coli CFT073
gguaugcuccggcag

SEQ ID NO: 2620175 - RNA, 13 nt, Escherichia coli CFT073
gguauuaauacuc

SEQ ID NO: 2620176 - RNA, 21 nt, Escherichia coli CFT073
gguauuacccucaaacgccag

SEQ ID NO: 2620177 - RNA, 19 nt, Escherichia coli CFT073
gguauucaaccguuuccag

SEQ ID NO: 2620178 - RNA, 17 nt, Escherichia coli CFT073
gguauuuaaacucgcug

SEQ ID NO: 2620179 - RNA, 22 nt, Escherichia coli CFT073
ggucaaagugggcgacaaaguu

SEQ ID NO: 2620180 - RNA, 14 nt, Escherichia coli CFT073
ggucaauaaggaca

SEQ ID NO: 2620181 - RNA, 13 nt, Escherichia coli CFT073
ggucaccaguuca

SEQ ID NO: 2620182 - RNA, 17 nt, Escherichia coli CFT073
ggucaccaugaacacca

SEQ ID NO: 2620183 - RNA, 15 nt, Escherichia coli CFT073
ggucaccggaacuuu

SEQ ID NO: 2620184 - RNA, 22 nt, Escherichia coli CFT073
ggucacggcuguagccagcucg

SEQ ID NO: 2620185 - RNA, 13 nt, Escherichia coli CFT073
ggucacugagccc

SEQ ID NO: 2620186 - RNA, 16 nt, Escherichia coli CFT073
ggucagcaagaaacug

SEQ ID NO: 2620187 - RNA, 22 nt, Escherichia coli CFT073
ggucagcaucgucaacgccgcg

SEQ ID NO: 2620188 - RNA, 20 nt, Escherichia coli CFT073
ggucagccacaguugaucag

SEQ ID NO: 2620189 - RNA, 14 nt, Escherichia coli CFT073
ggucagccagcggc

SEQ ID NO: 2620190 - RNA, 14 nt, Escherichia coli CFT073
ggucaggaauagcg

SEQ ID NO: 2620191 - RNA, 21 nt, Escherichia coli CFT073
ggucaguucaggcugaggcgu

SEQ ID NO: 2620192 - RNA, 22 nt, Escherichia coli CFT073
ggucaguuuaaacagaauaccc

SEQ ID NO: 2620193 - RNA, 15 nt, Escherichia coli CFT073
ggucauaucaucaag

SEQ ID NO: 2620194 - RNA, 13 nt, Escherichia coli CFT073
ggucauauugcca

SEQ ID NO: 2620195 - RNA, 20 nt, Escherichia coli CFT073
ggucaucacaucccagcaga

SEQ ID NO: 2620196 - RNA, 14 nt, Escherichia coli CFT073
ggucaucacccaga

SEQ ID NO: 2620197 - RNA, 23 nt, Escherichia coli CFT073
ggucaucacucuguuuuaacgca

SEQ ID NO: 2620198 - RNA, 10 nt, Escherichia coli CFT073
ggucaucauc

SEQ ID NO: 2620199 - RNA, 20 nt, Escherichia coli CFT073
ggucauuggccggaauacca

SEQ ID NO: 2620200 - RNA, 19 nt, Escherichia coli CFT073
gguccaguuuuuaucauaa

SEQ ID NO: 2620201 - RNA, 21 nt, Escherichia coli CFT073
gguccauauaaucgaaaccuu

SEQ ID NO: 2620202 - RNA, 19 nt, Escherichia coli CFT073
gguccgccauuuccagcgu

SEQ ID NO: 2620203 - RNA, 16 nt, Escherichia coli CFT073
gguccgggcaucaaca

SEQ ID NO: 2620204 - RNA, 17 nt, Escherichia coli CFT073
gguccgggcaucaacag

SEQ ID NO: 2620205 - RNA, 19 nt, Escherichia coli CFT073
gguccuaacaaccaucccc

SEQ ID NO: 2620206 - RNA, 21 nt, Escherichia coli CFT073
gguccuaacaaccauccccaa

SEQ ID NO: 2620207 - RNA, 17 nt, Escherichia coli CFT073
ggucgaggcaaccagca

SEQ ID NO: 2620208 - RNA, 20 nt, Escherichia coli CFT073
ggucgaugauuuccgccagc

SEQ ID NO: 2620209 - RNA, 17 nt, Escherichia coli CFT073
ggucgauggccggguga

SEQ ID NO: 2620210 - RNA, 15 nt, Escherichia coli CFT073
ggucgcaaacggcga

SEQ ID NO: 2620211 - RNA, 18 nt, Escherichia coli CFT073
ggucgcacugcucuuuuu

SEQ ID NO: 2620212 - RNA, 18 nt, Escherichia coli CFT073
ggucgcgacugccagcau

SEQ ID NO: 2620213 - RNA, 22 nt, Escherichia coli CFT073
ggucgcguagccaggcggcagu

SEQ ID NO: 2620214 - RNA, 17 nt, Escherichia coli CFT073
ggucggaaucccaucgc

SEQ ID NO: 2620215 - RNA, 16 nt, Escherichia coli CFT073
ggucggauaagacgcg

SEQ ID NO: 2620216 - RNA, 14 nt, Escherichia coli CFT073
ggucggggucgcga

SEQ ID NO: 2620217 - RNA, 22 nt, Escherichia coli CFT073
ggucggguuaagcccaaggcua

SEQ ID NO: 2620218 - RNA, 19 nt, Escherichia coli CFT073
ggucgucaccgccagguga

SEQ ID NO: 2620219 - RNA, 22 nt, Escherichia coli CFT073
ggucgugacugccgccagcauu

SEQ ID NO: 2620220 - RNA, 13 nt, Escherichia coli CFT073
ggucgugcagaac

SEQ ID NO: 2620221 - RNA, 14 nt, Escherichia coli CFT073
ggucguuuauuucg

SEQ ID NO: 2620222 - RNA, 16 nt, Escherichia coli CFT073
ggucugaauacgcccu

SEQ ID NO: 2620223 - RNA, 22 nt, Escherichia coli CFT073
ggucugaccguucgccccauac

SEQ ID NO: 2620224 - RNA, 13 nt, Escherichia coli CFT073
ggucugauauuca

SEQ ID NO: 2620225 - RNA, 17 nt, Escherichia coli CFT073
ggucugcagacugaagc

SEQ ID NO: 2620226 - RNA, 18 nt, Escherichia coli CFT073
ggucuggcaaaaauaagg

SEQ ID NO: 2620227 - RNA, 13 nt, Escherichia coli CFT073
ggucuggcgacgg

SEQ ID NO: 2620228 - RNA, 21 nt, Escherichia coli CFT073
ggucuucauagauagccagca

SEQ ID NO: 2620229 - RNA, 19 nt, Escherichia coli CFT073
ggucuucuuccgcgccaaa

SEQ ID NO: 2620230 - RNA, 13 nt, Escherichia coli CFT073
ggucuugagcgga

SEQ ID NO: 2620231 - RNA, 21 nt, Escherichia coli CFT073
ggucuugagcggaaacagcgg

SEQ ID NO: 2620232 - RNA, 20 nt, Escherichia coli CFT073
ggucuuuuaaauccugcaca

SEQ ID NO: 2620233 - RNA, 13 nt, Escherichia coli CFT073
ggugaaaaaccaa

SEQ ID NO: 2620234 - RNA, 17 nt, Escherichia coli CFT073
ggugaaagcaaaaaaga

SEQ ID NO: 2620235 - RNA, 18 nt, Escherichia coli CFT073
ggugaaagcaaaaaagaa

SEQ ID NO: 2620236 - RNA, 16 nt, Escherichia coli CFT073
ggugaaguggcugacc

SEQ ID NO: 2620237 - RNA, 19 nt, Escherichia coli CFT073
ggugaauaccugagacaaa

SEQ ID NO: 2620238 - RNA, 22 nt, Escherichia coli CFT073
ggugaauaucgaauggcguuaa

SEQ ID NO: 2620239 - RNA, 12 nt, Escherichia coli CFT073
ggugaaucaauc

SEQ ID NO: 2620240 - RNA, 17 nt, Escherichia coli CFT073
ggugaaugccugaucaa

SEQ ID NO: 2620241 - RNA, 14 nt, Escherichia coli CFT073
ggugacaaacacag

SEQ ID NO: 2620242 - RNA, 14 nt, Escherichia coli CFT073
ggugaccgagcgcc

SEQ ID NO: 2620243 - RNA, 13 nt, Escherichia coli CFT073
ggugaccucaggu

SEQ ID NO: 2620244 - RNA, 15 nt, Escherichia coli CFT073
ggugacuggcagaau

SEQ ID NO: 2620245 - RNA, 19 nt, Escherichia coli CFT073
ggugagacgccagaaccga

SEQ ID NO: 2620246 - RNA, 22 nt, Escherichia coli CFT073
ggugagcacaucagcgcccucu

SEQ ID NO: 2620247 - RNA, 22 nt, Escherichia coli CFT073
ggugagcacgguuuugucggca

SEQ ID NO: 2620248 - RNA, 15 nt, Escherichia coli CFT073
ggugagcgaugcugc

SEQ ID NO: 2620249 - RNA, 14 nt, Escherichia coli CFT073
ggugagcgugcggu

SEQ ID NO: 2620250 - RNA, 22 nt, Escherichia coli CFT073
ggugagugcgguuuugucggca

SEQ ID NO: 2620251 - RNA, 14 nt, Escherichia coli CFT073
ggugaguggcgcga

SEQ ID NO: 2620252 - RNA, 22 nt, Escherichia coli CFT073
ggugaguuugucgggcaggagc

SEQ ID NO: 2620253 - RNA, 19 nt, Escherichia coli CFT073
ggugauaaccgcgcgugcc

SEQ ID NO: 2620254 - RNA, 15 nt, Escherichia coli CFT073
ggugauacugaucgu

SEQ ID NO: 2620255 - RNA, 15 nt, Escherichia coli CFT073
ggugaucagcgucag

SEQ ID NO: 2620256 - RNA, 19 nt, Escherichia coli CFT073
ggugaugaaccuguguuga

SEQ ID NO: 2620257 - RNA, 12 nt, Escherichia coli CFT073
ggugaugaugcu

SEQ ID NO: 2620258 - RNA, 24 nt, Escherichia coli CFT073
ggugauuauugucgugccgcuacu

SEQ ID NO: 2620259 - RNA, 13 nt, Escherichia coli CFT073
ggugauucccagc

SEQ ID NO: 2620260 - RNA, 15 nt, Escherichia coli CFT073
ggugauuuauuucuc

SEQ ID NO: 2620261 - RNA, 18 nt, Escherichia coli CFT073
ggugauuucaaaauuaaa

SEQ ID NO: 2620262 - RNA, 23 nt, Escherichia coli CFT073
ggugauuuugccugugcaaccuu

SEQ ID NO: 2620263 - RNA, 20 nt, Escherichia coli CFT073
ggugcaagccgcggaauugg

SEQ ID NO: 2620264 - RNA, 21 nt, Escherichia coli CFT073
ggugcaauccacaagcacagg

SEQ ID NO: 2620265 - RNA, 18 nt, Escherichia coli CFT073
ggugcacgaugcauuguc

SEQ ID NO: 2620266 - RNA, 18 nt, Escherichia coli CFT073
ggugcagcagacgcugca

SEQ ID NO: 2620267 - RNA, 15 nt, Escherichia coli CFT073
ggugcagccgccauc

SEQ ID NO: 2620268 - RNA, 22 nt, Escherichia coli CFT073
ggugcaggaauggcugggguug

SEQ ID NO: 2620269 - RNA, 23 nt, Escherichia coli CFT073
ggugcauaggccaucggcagcau

SEQ ID NO: 2620270 - RNA, 20 nt, Escherichia coli CFT073
ggugcauugaaggcaauugc

SEQ ID NO: 2620271 - RNA, 13 nt, Escherichia coli CFT073
ggugccagcgcca

SEQ ID NO: 2620272 - RNA, 18 nt, Escherichia coli CFT073
ggugccgggaauauuuac

SEQ ID NO: 2620273 - RNA, 16 nt, Escherichia coli CFT073
ggugccugcuaccggg

SEQ ID NO: 2620274 - RNA, 15 nt, Escherichia coli CFT073
ggugccugucagccc

SEQ ID NO: 2620275 - RNA, 19 nt, Escherichia coli CFT073
ggugcgcaccaggcgugga

SEQ ID NO: 2620276 - RNA, 16 nt, Escherichia coli CFT073
ggugcgcaggcgcuga

SEQ ID NO: 2620277 - RNA, 16 nt, Escherichia coli CFT073
ggugcgccaaacugcc

SEQ ID NO: 2620278 - RNA, 20 nt, Escherichia coli CFT073
ggugcgggaguugaucgcca

SEQ ID NO: 2620279 - RNA, 15 nt, Escherichia coli CFT073
ggugcguuaccagcu

SEQ ID NO: 2620280 - RNA, 15 nt, Escherichia coli CFT073
gguggaacagcugca

SEQ ID NO: 2620281 - RNA, 24 nt, Escherichia coli CFT073
gguggcaucuggugccagcgccag

SEQ ID NO: 2620282 - RNA, 18 nt, Escherichia coli CFT073
gguggccagcaacagcgc

SEQ ID NO: 2620283 - RNA, 15 nt, Escherichia coli CFT073
gguggccauccgcgu

SEQ ID NO: 2620284 - RNA, 15 nt, Escherichia coli CFT073
gguggcggcgucagc

SEQ ID NO: 2620285 - RNA, 17 nt, Escherichia coli CFT073
gguggcguacagcuggc

SEQ ID NO: 2620286 - RNA, 21 nt, Escherichia coli CFT073
gguggcgucaugcucgcaggu

SEQ ID NO: 2620287 - RNA, 14 nt, Escherichia coli CFT073
gguggcuacgacgg

SEQ ID NO: 2620288 - RNA, 17 nt, Escherichia coli CFT073
gguggcuucacgcacug

SEQ ID NO: 2620289 - RNA, 16 nt, Escherichia coli CFT073
ggugggcuacggcaug

SEQ ID NO: 2620290 - RNA, 13 nt, Escherichia coli CFT073
ggugguacggcau

SEQ ID NO: 2620291 - RNA, 17 nt, Escherichia coli CFT073
gguggucggcucgucga

SEQ ID NO: 2620292 - RNA, 14 nt, Escherichia coli CFT073
ggugguuaccagua

SEQ ID NO: 2620293 - RNA, 15 nt, Escherichia coli CFT073
ggugguugugcugag

SEQ ID NO: 2620294 - RNA, 22 nt, Escherichia coli CFT073
gguguaaaauucacaucguuga

SEQ ID NO: 2620295 - RNA, 21 nt, Escherichia coli CFT073
gguguaacgagacaaugcaaa

SEQ ID NO: 2620296 - RNA, 14 nt, Escherichia coli CFT073
gguguacuggcaau

SEQ ID NO: 2620297 - RNA, 20 nt, Escherichia coli CFT073
ggugucgucgauaauaucgg

SEQ ID NO: 2620298 - RNA, 19 nt, Escherichia coli CFT073
ggugucguuacgccgcaga

SEQ ID NO: 2620299 - RNA, 16 nt, Escherichia coli CFT073
ggugugaaugaccagg

SEQ ID NO: 2620300 - RNA, 21 nt, Escherichia coli CFT073
ggugugcgggaacauaucaaa

SEQ ID NO: 2620301 - RNA, 17 nt, Escherichia coli CFT073
gguguggcauggcgaau

SEQ ID NO: 2620302 - RNA, 19 nt, Escherichia coli CFT073
gguguuaauggaauaacga

SEQ ID NO: 2620303 - RNA, 22 nt, Escherichia coli CFT073
gguguuauaggccccagccuca

SEQ ID NO: 2620304 - RNA, 17 nt, Escherichia coli CFT073
gguguugguaaacgcau

SEQ ID NO: 2620305 - RNA, 18 nt, Escherichia coli CFT073
gguguuguugaguccggu

SEQ ID NO: 2620306 - RNA, 18 nt, Escherichia coli CFT073
gguuaaauaauauuuccc

SEQ ID NO: 2620307 - RNA, 22 nt, Escherichia coli CFT073
gguuaaccagcacguugaacug

SEQ ID NO: 2620308 - RNA, 23 nt, Escherichia coli CFT073
gguuaacccacagcgcaccaacg

SEQ ID NO: 2620309 - RNA, 19 nt, Escherichia coli CFT073
gguuaauaccgagcguuca

SEQ ID NO: 2620310 - RNA, 21 nt, Escherichia coli CFT073
gguuaaucggaugaucaucca

SEQ ID NO: 2620311 - RNA, 19 nt, Escherichia coli CFT073
gguuaaucucccguaagug

SEQ ID NO: 2620312 - RNA, 15 nt, Escherichia coli CFT073
gguuacacgggagaa

SEQ ID NO: 2620313 - RNA, 17 nt, Escherichia coli CFT073
gguuaccaguaaccaga

SEQ ID NO: 2620314 - RNA, 16 nt, Escherichia coli CFT073
gguuaccuugauuauc

SEQ ID NO: 2620315 - RNA, 22 nt, Escherichia coli CFT073
gguuacgcaccgguuccgggcu

SEQ ID NO: 2620316 - RNA, 15 nt, Escherichia coli CFT073
gguuaguaaauggac

SEQ ID NO: 2620317 - RNA, 15 nt, Escherichia coli CFT073
gguuagucgcuguga

SEQ ID NO: 2620318 - RNA, 18 nt, Escherichia coli CFT073
gguuaucccaaaucgcaa

SEQ ID NO: 2620319 - RNA, 23 nt, Escherichia coli CFT073
gguuaugcucaacggugaccuca

SEQ ID NO: 2620320 - RNA, 15 nt, Escherichia coli CFT073
gguuauuuguaacug

SEQ ID NO: 2620321 - RNA, 16 nt, Escherichia coli CFT073
gguuauuuguaacugu

SEQ ID NO: 2620322 - RNA, 12 nt, Escherichia coli CFT073
gguucaaccgca

SEQ ID NO: 2620323 - RNA, 19 nt, Escherichia coli CFT073
gguucaagauuagcccccg

SEQ ID NO: 2620324 - RNA, 16 nt, Escherichia coli CFT073
gguucaauaucuuccu

SEQ ID NO: 2620325 - RNA, 16 nt, Escherichia coli CFT073
gguucaucgagcagca

SEQ ID NO: 2620326 - RNA, 12 nt, Escherichia coli CFT073
gguucaugcugc

SEQ ID NO: 2620327 - RNA, 20 nt, Escherichia coli CFT073
gguuccauuucugcggguga

SEQ ID NO: 2620328 - RNA, 13 nt, Escherichia coli CFT073
gguucccugaccu

SEQ ID NO: 2620329 - RNA, 16 nt, Escherichia coli CFT073
gguucgaauccuuccc

SEQ ID NO: 2620330 - RNA, 21 nt, Escherichia coli CFT073
gguucgagguaguagccgucu

SEQ ID NO: 2620331 - RNA, 19 nt, Escherichia coli CFT073
gguucgccaaaugucacca

SEQ ID NO: 2620332 - RNA, 23 nt, Escherichia coli CFT073
gguucgccaaaugucaccagccg

SEQ ID NO: 2620333 - RNA, 13 nt, Escherichia coli CFT073
gguucgccaucac

SEQ ID NO: 2620334 - RNA, 21 nt, Escherichia coli CFT073
gguucgcuuuuauuucugcuu

SEQ ID NO: 2620335 - RNA, 23 nt, Escherichia coli CFT073
gguucuccuggcauaaacacggc

SEQ ID NO: 2620336 - RNA, 22 nt, Escherichia coli CFT073
gguucugcacagcuuaaaaugc

SEQ ID NO: 2620337 - RNA, 14 nt, Escherichia coli CFT073
gguucugcugccgc

SEQ ID NO: 2620338 - RNA, 21 nt, Escherichia coli CFT073
gguucuuuggucaggcgcuga

SEQ ID NO: 2620339 - RNA, 13 nt, Escherichia coli CFT073
gguucuuuuuuga

SEQ ID NO: 2620340 - RNA, 15 nt, Escherichia coli CFT073
gguugaaauaaacca

SEQ ID NO: 2620341 - RNA, 13 nt, Escherichia coli CFT073
gguugaacgccaa

SEQ ID NO: 2620342 - RNA, 13 nt, Escherichia coli CFT073
gguugacgcguaa

SEQ ID NO: 2620343 - RNA, 21 nt, Escherichia coli CFT073
gguugacgcguaaauccagca

SEQ ID NO: 2620344 - RNA, 16 nt, Escherichia coli CFT073
gguugagagcaaacac

SEQ ID NO: 2620345 - RNA, 23 nt, Escherichia coli CFT073
gguugauucauggcauuuucucg

SEQ ID NO: 2620346 - RNA, 11 nt, Escherichia coli CFT073
gguugccagcg

SEQ ID NO: 2620347 - RNA, 15 nt, Escherichia coli CFT073
gguugcucucgccag

SEQ ID NO: 2620348 - RNA, 11 nt, Escherichia coli CFT073
gguugcuggau

SEQ ID NO: 2620349 - RNA, 18 nt, Escherichia coli CFT073
gguuggaauugaagcugu

SEQ ID NO: 2620350 - RNA, 20 nt, Escherichia coli CFT073
gguuggagcacaaugccuga

SEQ ID NO: 2620351 - RNA, 13 nt, Escherichia coli CFT073
gguuggagcgcgu

SEQ ID NO: 2620352 - RNA, 24 nt, Escherichia coli CFT073
gguuguaacgucgcaucuggucag

SEQ ID NO: 2620353 - RNA, 14 nt, Escherichia coli CFT073
gguuguaauccacc

SEQ ID NO: 2620354 - RNA, 17 nt, Escherichia coli CFT073
gguuguacuucgcuuca

SEQ ID NO: 2620355 - RNA, 21 nt, Escherichia coli CFT073
gguugucgaaguacgcaguaa

SEQ ID NO: 2620356 - RNA, 19 nt, Escherichia coli CFT073
gguugucuuggcgugcuca

SEQ ID NO: 2620357 - RNA, 16 nt, Escherichia coli CFT073
gguugugugcuggcca

SEQ ID NO: 2620358 - RNA, 22 nt, Escherichia coli CFT073
gguugugugcuggccaucaccu

SEQ ID NO: 2620359 - RNA, 19 nt, Escherichia coli CFT073
gguuguugaggucugaccg

SEQ ID NO: 2620360 - RNA, 12 nt, Escherichia coli CFT073
gguuuaccacca

SEQ ID NO: 2620361 - RNA, 15 nt, Escherichia coli CFT073
gguuuagaaaagagu

SEQ ID NO: 2620362 - RNA, 14 nt, Escherichia coli CFT073
gguuucaaagauuu

SEQ ID NO: 2620363 - RNA, 14 nt, Escherichia coli CFT073
gguuucaauccagg

SEQ ID NO: 2620364 - RNA, 14 nt, Escherichia coli CFT073
gguuucacccacgg

SEQ ID NO: 2620365 - RNA, 16 nt, Escherichia coli CFT073
gguuucauuccaguaa

SEQ ID NO: 2620366 - RNA, 18 nt, Escherichia coli CFT073
gguuuccacuuccaccac

SEQ ID NO: 2620367 - RNA, 18 nt, Escherichia coli CFT073
gguuucgccgcggcgcag

SEQ ID NO: 2620368 - RNA, 12 nt, Escherichia coli CFT073
gguuucgugcau

SEQ ID NO: 2620369 - RNA, 14 nt, Escherichia coli CFT073
gguuucucccgccu

SEQ ID NO: 2620370 - RNA, 19 nt, Escherichia coli CFT073
gguuugacgccugcagcau

SEQ ID NO: 2620371 - RNA, 13 nt, Escherichia coli CFT073
gguuugccagcag

SEQ ID NO: 2620372 - RNA, 15 nt, Escherichia coli CFT073
gguuugccagcagag

SEQ ID NO: 2620373 - RNA, 15 nt, Escherichia coli CFT073
gguuugccauaaccu

SEQ ID NO: 2620374 - RNA, 16 nt, Escherichia coli CFT073
gguuuguaggccggau

SEQ ID NO: 2620375 - RNA, 14 nt, Escherichia coli CFT073
gguuugucaucauu

SEQ ID NO: 2620376 - RNA, 23 nt, Escherichia coli CFT073
gguuuuauuauuccauccugcuc

SEQ ID NO: 2620377 - RNA, 21 nt, Escherichia coli CFT073
gguuuucaacgugucuuuuac

SEQ ID NO: 2620378 - RNA, 12 nt, Escherichia coli CFT073
gguuuucaacug

SEQ ID NO: 2620379 - RNA, 22 nt, Escherichia coli CFT073
gguuuucuccaaccagcuguuc

SEQ ID NO: 2620380 - RNA, 14 nt, Escherichia coli CFT073
gguuuugaucacgu

SEQ ID NO: 2620381 - RNA, 16 nt, Escherichia coli CFT073
gguuuuuuaucagaca

SEQ ID NO: 2620382 - RNA, 20 nt, Escherichia coli CFT073
guaaaaaagcgucgccguca

SEQ ID NO: 2620383 - RNA, 19 nt, Escherichia coli CFT073
guaaaaacgcuuugcugcc

SEQ ID NO: 2620384 - RNA, 21 nt, Escherichia coli CFT073
guaaaacgcccaaugcccaga

SEQ ID NO: 2620385 - RNA, 20 nt, Escherichia coli CFT073
guaaaacggcagaaucuuaa

SEQ ID NO: 2620386 - RNA, 19 nt, Escherichia coli CFT073
guaaaacgguggccacagc

SEQ ID NO: 2620387 - RNA, 21 nt, Escherichia coli CFT073
guaaaacuaacgccaggaacc

SEQ ID NO: 2620388 - RNA, 19 nt, Escherichia coli CFT073
guaaaagcgcauuuaucuu

SEQ ID NO: 2620389 - RNA, 15 nt, Escherichia coli CFT073
guaaaauaucacucg

SEQ ID NO: 2620390 - RNA, 18 nt, Escherichia coli CFT073
guaaaaugcggaaaaggu

SEQ ID NO: 2620391 - RNA, 21 nt, Escherichia coli CFT073
guaaaauuauccucuucagga

SEQ ID NO: 2620392 - RNA, 13 nt, Escherichia coli CFT073
guaaacaaacaug

SEQ ID NO: 2620393 - RNA, 11 nt, Escherichia coli CFT073
guaaacaacau

SEQ ID NO: 2620394 - RNA, 12 nt, Escherichia coli CFT073
guaaacaacgag

SEQ ID NO: 2620395 - RNA, 16 nt, Escherichia coli CFT073
guaaacacaccacagc

SEQ ID NO: 2620396 - RNA, 13 nt, Escherichia coli CFT073
guaaacaccuucg

SEQ ID NO: 2620397 - RNA, 22 nt, Escherichia coli CFT073
guaaacaccuucguccagcauc

SEQ ID NO: 2620398 - RNA, 23 nt, Escherichia coli CFT073
guaaacaccuucguccagcauca

SEQ ID NO: 2620399 - RNA, 21 nt, Escherichia coli CFT073
guaaacagauaggcaucagca

SEQ ID NO: 2620400 - RNA, 19 nt, Escherichia coli CFT073
guaaaccacaucagcgaac

SEQ ID NO: 2620401 - RNA, 20 nt, Escherichia coli CFT073
guaaaccacccaccagcgcc

SEQ ID NO: 2620402 - RNA, 15 nt, Escherichia coli CFT073
guaaacccgcgauga

SEQ ID NO: 2620403 - RNA, 21 nt, Escherichia coli CFT073
guaaacccgcgaugaccaaaa

SEQ ID NO: 2620404 - RNA, 19 nt, Escherichia coli CFT073
guaaacccuaacaucaucc

SEQ ID NO: 2620405 - RNA, 16 nt, Escherichia coli CFT073
guaaaccgcucgucac

SEQ ID NO: 2620406 - RNA, 20 nt, Escherichia coli CFT073
guaaacgacccugccacagu

SEQ ID NO: 2620407 - RNA, 23 nt, Escherichia coli CFT073
guaaacgacccugccacaguuuu

SEQ ID NO: 2620408 - RNA, 14 nt, Escherichia coli CFT073
guaaacgccuuauc

SEQ ID NO: 2620409 - RNA, 20 nt, Escherichia coli CFT073
guaaacgccuuauccggccu

SEQ ID NO: 2620410 - RNA, 17 nt, Escherichia coli CFT073
guaaacgcgaaggacug

SEQ ID NO: 2620411 - RNA, 20 nt, Escherichia coli CFT073
guaaacgucgcaucugacca

SEQ ID NO: 2620412 - RNA, 23 nt, Escherichia coli CFT073
guaaagacuucauuaucgauccu

SEQ ID NO: 2620413 - RNA, 16 nt, Escherichia coli CFT073
guaaagagugugaaua

SEQ ID NO: 2620414 - RNA, 17 nt, Escherichia coli CFT073
guaaagcacugguggaa

SEQ ID NO: 2620415 - RNA, 12 nt, Escherichia coli CFT073
guaaagcaucag

SEQ ID NO: 2620416 - RNA, 14 nt, Escherichia coli CFT073
guaaagccagcggc

SEQ ID NO: 2620417 - RNA, 19 nt, Escherichia coli CFT073
guaaagcccauaccacagc

SEQ ID NO: 2620418 - RNA, 20 nt, Escherichia coli CFT073
guaaagcccaucgccagcgc

SEQ ID NO: 2620419 - RNA, 21 nt, Escherichia coli CFT073
guaaagccggugcccgccagu

SEQ ID NO: 2620420 - RNA, 14 nt, Escherichia coli CFT073
guaaagccugcugg

SEQ ID NO: 2620421 - RNA, 17 nt, Escherichia coli CFT073
guaaagcggcaacuuua

SEQ ID NO: 2620422 - RNA, 20 nt, Escherichia coli CFT073
guaaagcggcgaguauucuu

SEQ ID NO: 2620423 - RNA, 23 nt, Escherichia coli CFT073
guaaaggacagaguguucgccau

SEQ ID NO: 2620424 - RNA, 19 nt, Escherichia coli CFT073
guaaaguacguguggucuu

SEQ ID NO: 2620425 - RNA, 15 nt, Escherichia coli CFT073
guaaagucuggaaga

SEQ ID NO: 2620426 - RNA, 14 nt, Escherichia coli CFT073
guaaagugcgaguc

SEQ ID NO: 2620427 - RNA, 22 nt, Escherichia coli CFT073
guaaaguggcggggaucacucc

SEQ ID NO: 2620428 - RNA, 23 nt, Escherichia coli CFT073
guaaauaugccccacagacccag

SEQ ID NO: 2620429 - RNA, 20 nt, Escherichia coli CFT073
guaaaucgcuguuguucuuu

SEQ ID NO: 2620430 - RNA, 20 nt, Escherichia coli CFT073
guaaaugcgggcuuggcugg

SEQ ID NO: 2620431 - RNA, 18 nt, Escherichia coli CFT073
guaaaugcucauaccauu

SEQ ID NO: 2620432 - RNA, 16 nt, Escherichia coli CFT073
guaaauggcgcuaaaa

SEQ ID NO: 2620433 - RNA, 23 nt, Escherichia coli CFT073
guaaauucauccaguagaauaau

SEQ ID NO: 2620434 - RNA, 22 nt, Escherichia coli CFT073
guaaauuccccaccccaguucg

SEQ ID NO: 2620435 - RNA, 23 nt, Escherichia coli CFT073
guaaauugugucgacauagccau

SEQ ID NO: 2620436 - RNA, 17 nt, Escherichia coli CFT073
guaaauuuuuugaucaa

SEQ ID NO: 2620437 - RNA, 20 nt, Escherichia coli CFT073
guaacaauaucuaaaauguc

SEQ ID NO: 2620438 - RNA, 16 nt, Escherichia coli CFT073
guaacaccagagugac

SEQ ID NO: 2620439 - RNA, 17 nt, Escherichia coli CFT073
guaacaccagagugacc

SEQ ID NO: 2620440 - RNA, 13 nt, Escherichia coli CFT073
guaacagagcauc

SEQ ID NO: 2620441 - RNA, 16 nt, Escherichia coli CFT073
guaacagagcaucggu

SEQ ID NO: 2620442 - RNA, 23 nt, Escherichia coli CFT073
guaacaggauggcauuugcaaca

SEQ ID NO: 2620443 - RNA, 16 nt, Escherichia coli CFT073
guaacagucaguuauc

SEQ ID NO: 2620444 - RNA, 15 nt, Escherichia coli CFT073
guaacauaacagcca

SEQ ID NO: 2620445 - RNA, 23 nt, Escherichia coli CFT073
guaaccaaacguggucgccagca

SEQ ID NO: 2620446 - RNA, 13 nt, Escherichia coli CFT073
guaaccacccagu

SEQ ID NO: 2620447 - RNA, 15 nt, Escherichia coli CFT073
guaaccaguuuauca

SEQ ID NO: 2620448 - RNA, 19 nt, Escherichia coli CFT073
guaaccaguuuaucaauga

SEQ ID NO: 2620449 - RNA, 16 nt, Escherichia coli CFT073
guaacccagcaccaac

SEQ ID NO: 2620450 - RNA, 23 nt, Escherichia coli CFT073
guaacccauccagcagagauaca

SEQ ID NO: 2620451 - RNA, 17 nt, Escherichia coli CFT073
guaacccgccugacgga

SEQ ID NO: 2620452 - RNA, 19 nt, Escherichia coli CFT073
guaacccuguggaucuucc

SEQ ID NO: 2620453 - RNA, 17 nt, Escherichia coli CFT073
guaacccuuugcggugc

SEQ ID NO: 2620454 - RNA, 23 nt, Escherichia coli CFT073
guaacccuuugcggugcagcagc

SEQ ID NO: 2620455 - RNA, 15 nt, Escherichia coli CFT073
guaaccgaggcggac

SEQ ID NO: 2620456 - RNA, 15 nt, Escherichia coli CFT073
guaaccgcaacggcg

SEQ ID NO: 2620457 - RNA, 16 nt, Escherichia coli CFT073
guaaccugagaucuga

SEQ ID NO: 2620458 - RNA, 12 nt, Escherichia coli CFT073
guaaccuucacc

SEQ ID NO: 2620459 - RNA, 22 nt, Escherichia coli CFT073
guaaccuuuaucacgcagcaga

SEQ ID NO: 2620460 - RNA, 16 nt, Escherichia coli CFT073
guaacgacaugaagau

SEQ ID NO: 2620461 - RNA, 13 nt, Escherichia coli CFT073
guaacgacugcgg

SEQ ID NO: 2620462 - RNA, 23 nt, Escherichia coli CFT073
guaacgagacaaugcaaacggcg

SEQ ID NO: 2620463 - RNA, 20 nt, Escherichia coli CFT073
guaacgauggcgauucagca

SEQ ID NO: 2620464 - RNA, 23 nt, Escherichia coli CFT073
guaacgccccacaagcccgccag

SEQ ID NO: 2620465 - RNA, 20 nt, Escherichia coli CFT073
guaacgcgcuuucuucgcag

SEQ ID NO: 2620466 - RNA, 22 nt, Escherichia coli CFT073
guaacggcauuguucugcaaau

SEQ ID NO: 2620467 - RNA, 14 nt, Escherichia coli CFT073
guaacggccaggcg

SEQ ID NO: 2620468 - RNA, 22 nt, Escherichia coli CFT073
guaacggcucacccccaucagc

SEQ ID NO: 2620469 - RNA, 21 nt, Escherichia coli CFT073
guaacgucgcaucuggucaga

SEQ ID NO: 2620470 - RNA, 15 nt, Escherichia coli CFT073
guaacguggcagcag

SEQ ID NO: 2620471 - RNA, 16 nt, Escherichia coli CFT073
guaacugacaguagcc

SEQ ID NO: 2620472 - RNA, 22 nt, Escherichia coli CFT073
guaacugccuuucccuuucuua

SEQ ID NO: 2620473 - RNA, 20 nt, Escherichia coli CFT073
guaacugcuugaauuuaucu

SEQ ID NO: 2620474 - RNA, 18 nt, Escherichia coli CFT073
guaacuggcgcaguugug

SEQ ID NO: 2620475 - RNA, 23 nt, Escherichia coli CFT073
guaacuguucgagguaauccagc

SEQ ID NO: 2620476 - RNA, 14 nt, Escherichia coli CFT073
guaacuucgcugau

SEQ ID NO: 2620477 - RNA, 13 nt, Escherichia coli CFT073
guaacuuuugccc

SEQ ID NO: 2620478 - RNA, 22 nt, Escherichia coli CFT073
guaagaaccacagcccgccaca

SEQ ID NO: 2620479 - RNA, 14 nt, Escherichia coli CFT073
guaagaacguaaau

SEQ ID NO: 2620480 - RNA, 20 nt, Escherichia coli CFT073
guaagaguuucaacaucauu

SEQ ID NO: 2620481 - RNA, 17 nt, Escherichia coli CFT073
guaagcaaacagagcaa

SEQ ID NO: 2620482 - RNA, 17 nt, Escherichia coli CFT073
guaagcaguccagcgcc

SEQ ID NO: 2620483 - RNA, 13 nt, Escherichia coli CFT073
guaagcauacugc

SEQ ID NO: 2620484 - RNA, 21 nt, Escherichia coli CFT073
guaagccacgauucagcgucg

SEQ ID NO: 2620485 - RNA, 19 nt, Escherichia coli CFT073
guaagccgguaaucaccag

SEQ ID NO: 2620486 - RNA, 20 nt, Escherichia coli CFT073
guaagccguaaacagguuga

SEQ ID NO: 2620487 - RNA, 21 nt, Escherichia coli CFT073
guaagcgcggauuuuauucag

SEQ ID NO: 2620488 - RNA, 21 nt, Escherichia coli CFT073
guaagcgugauaacaguuggu

SEQ ID NO: 2620489 - RNA, 22 nt, Escherichia coli CFT073
guaagcuccagugccuggcaua

SEQ ID NO: 2620490 - RNA, 22 nt, Escherichia coli CFT073
guaaggaacggggguuuuacuu

SEQ ID NO: 2620491 - RNA, 12 nt, Escherichia coli CFT073
guaaggaauaag

SEQ ID NO: 2620492 - RNA, 20 nt, Escherichia coli CFT073
guaaggauaaaaaaggguga

SEQ ID NO: 2620493 - RNA, 21 nt, Escherichia coli CFT073
guaaggauaaaaaagggugac

SEQ ID NO: 2620494 - RNA, 21 nt, Escherichia coli CFT073
guaaggcaucgcuaaucuggc

SEQ ID NO: 2620495 - RNA, 14 nt, Escherichia coli CFT073
guaaggcaucuucu

SEQ ID NO: 2620496 - RNA, 18 nt, Escherichia coli CFT073
guaaggcaucuucuucau

SEQ ID NO: 2620497 - RNA, 16 nt, Escherichia coli CFT073
guaaggcuucaaucaa

SEQ ID NO: 2620498 - RNA, 18 nt, Escherichia coli CFT073
guaagguggguugcugau

SEQ ID NO: 2620499 - RNA, 13 nt, Escherichia coli CFT073
guaaguacgccau

SEQ ID NO: 2620500 - RNA, 16 nt, Escherichia coli CFT073
guaauaaaaucuauua

SEQ ID NO: 2620501 - RNA, 19 nt, Escherichia coli CFT073
guaauaaaaucuauuauua

SEQ ID NO: 2620502 - RNA, 17 nt, Escherichia coli CFT073
guaauaaaccaaagccc

SEQ ID NO: 2620503 - RNA, 20 nt, Escherichia coli CFT073
guaauaagguucauugaacg

SEQ ID NO: 2620504 - RNA, 18 nt, Escherichia coli CFT073
guaauaaugcccaucgug

SEQ ID NO: 2620505 - RNA, 17 nt, Escherichia coli CFT073
guaauaauuacuuacau

SEQ ID NO: 2620506 - RNA, 22 nt, Escherichia coli CFT073
guaauacaaacucacugccagc

SEQ ID NO: 2620507 - RNA, 23 nt, Escherichia coli CFT073
guaauacaaacucacugccagca

SEQ ID NO: 2620508 - RNA, 17 nt, Escherichia coli CFT073
guaauaccagccuucuu

SEQ ID NO: 2620509 - RNA, 21 nt, Escherichia coli CFT073
guaauacccagacuuuucaga

SEQ ID NO: 2620510 - RNA, 20 nt, Escherichia coli CFT073
guaauaggcaggcaucauca

SEQ ID NO: 2620511 - RNA, 22 nt, Escherichia coli CFT073
guaauauauaacagaagguuua

SEQ ID NO: 2620512 - RNA, 13 nt, Escherichia coli CFT073
guaauauccagcg

SEQ ID NO: 2620513 - RNA, 13 nt, Escherichia coli CFT073
guaauaucgcgca

SEQ ID NO: 2620514 - RNA, 24 nt, Escherichia coli CFT073
guaauaugcagacucauuguaucu

SEQ ID NO: 2620515 - RNA, 21 nt, Escherichia coli CFT073
guaaucaacuccgccagcaac

SEQ ID NO: 2620516 - RNA, 18 nt, Escherichia coli CFT073
guaaucaaucaccucuuu

SEQ ID NO: 2620517 - RNA, 16 nt, Escherichia coli CFT073
guaaucaaugcgauag

SEQ ID NO: 2620518 - RNA, 13 nt, Escherichia coli CFT073
guaaucaccaccc

SEQ ID NO: 2620519 - RNA, 17 nt, Escherichia coli CFT073
guaaucagcuuauccag

SEQ ID NO: 2620520 - RNA, 15 nt, Escherichia coli CFT073
guaaucauaaaacac

SEQ ID NO: 2620521 - RNA, 18 nt, Escherichia coli CFT073
guaaucauaauuauaaua

SEQ ID NO: 2620522 - RNA, 21 nt, Escherichia coli CFT073
guaauccaccguuggcagaua

SEQ ID NO: 2620523 - RNA, 14 nt, Escherichia coli CFT073
guaauccugcaaau

SEQ ID NO: 2620524 - RNA, 19 nt, Escherichia coli CFT073
guaauccugccagugcaaa

SEQ ID NO: 2620525 - RNA, 19 nt, Escherichia coli CFT073
guaaucgccagcaaaauca

SEQ ID NO: 2620526 - RNA, 22 nt, Escherichia coli CFT073
guaaucgccagcaaaaucacca

SEQ ID NO: 2620527 - RNA, 18 nt, Escherichia coli CFT073
guaaucgggcaacugcug

SEQ ID NO: 2620528 - RNA, 18 nt, Escherichia coli CFT073
guaaucuauauuucugcg

SEQ ID NO: 2620529 - RNA, 12 nt, Escherichia coli CFT073
guaaucucuuuc

SEQ ID NO: 2620530 - RNA, 14 nt, Escherichia coli CFT073
guaaugacaacauu

SEQ ID NO: 2620531 - RNA, 17 nt, Escherichia coli CFT073
guaaugauuaacagccc

SEQ ID NO: 2620532 - RNA, 14 nt, Escherichia coli CFT073
guaaugcgacgcga

SEQ ID NO: 2620533 - RNA, 20 nt, Escherichia coli CFT073
guaaugcgccgguuggucau

SEQ ID NO: 2620534 - RNA, 16 nt, Escherichia coli CFT073
guaaugcucgacgaga

SEQ ID NO: 2620535 - RNA, 22 nt, Escherichia coli CFT073
guaaugcucgacgagaauuucc

SEQ ID NO: 2620536 - RNA, 18 nt, Escherichia coli CFT073
guaauggaccauauugaa

SEQ ID NO: 2620537 - RNA, 16 nt, Escherichia coli CFT073
guaaugggaucgaaag

SEQ ID NO: 2620538 - RNA, 13 nt, Escherichia coli CFT073
guaauguugcgcc

SEQ ID NO: 2620539 - RNA, 19 nt, Escherichia coli CFT073
guaauguuuccagcaucgc

SEQ ID NO: 2620540 - RNA, 14 nt, Escherichia coli CFT073
guaauguuuugcac

SEQ ID NO: 2620541 - RNA, 13 nt, Escherichia coli CFT073
guaauuaaacagc

SEQ ID NO: 2620542 - RNA, 22 nt, Escherichia coli CFT073
guaauuaaauuaucaacuauca

SEQ ID NO: 2620543 - RNA, 22 nt, Escherichia coli CFT073
guaauuaagcgcaaaggccagc

SEQ ID NO: 2620544 - RNA, 18 nt, Escherichia coli CFT073
guaauuacgcagcgcguu

SEQ ID NO: 2620545 - RNA, 22 nt, Escherichia coli CFT073
guaauuacggggucaauaagga

SEQ ID NO: 2620546 - RNA, 21 nt, Escherichia coli CFT073
guaauuccagcgguuguagcc

SEQ ID NO: 2620547 - RNA, 16 nt, Escherichia coli CFT073
guaauucccaguuacu

SEQ ID NO: 2620548 - RNA, 22 nt, Escherichia coli CFT073
guaauucccugugccagcggca

SEQ ID NO: 2620549 - RNA, 16 nt, Escherichia coli CFT073
guaauugacgccauca

SEQ ID NO: 2620550 - RNA, 22 nt, Escherichia coli CFT073
guaauugauucacauccugcca

SEQ ID NO: 2620551 - RNA, 18 nt, Escherichia coli CFT073
guaauugccgcguucgcc

SEQ ID NO: 2620552 - RNA, 14 nt, Escherichia coli CFT073
guaauuuaaaucau

SEQ ID NO: 2620553 - RNA, 19 nt, Escherichia coli CFT073
guaauuuaacaacucacca

SEQ ID NO: 2620554 - RNA, 23 nt, Escherichia coli CFT073
guaauuuaacaacucaccaacgu

SEQ ID NO: 2620555 - RNA, 12 nt, Escherichia coli CFT073
guaauuuccugc

SEQ ID NO: 2620556 - RNA, 18 nt, Escherichia coli CFT073
guaauuuccugccagcgu

SEQ ID NO: 2620557 - RNA, 19 nt, Escherichia coli CFT073
guaauuugcguuuucacca

SEQ ID NO: 2620558 - RNA, 13 nt, Escherichia coli CFT073
guacaaacaucau

SEQ ID NO: 2620559 - RNA, 20 nt, Escherichia coli CFT073
guacaaacauccaucugcuu

SEQ ID NO: 2620560 - RNA, 17 nt, Escherichia coli CFT073
guacaaagccaacagca

SEQ ID NO: 2620561 - RNA, 20 nt, Escherichia coli CFT073
guacaaagccaacagcagcc

SEQ ID NO: 2620562 - RNA, 19 nt, Escherichia coli CFT073
guacaaccguuucaugcca

SEQ ID NO: 2620563 - RNA, 22 nt, Escherichia coli CFT073
guacaauaucgauaaucuucaa

SEQ ID NO: 2620564 - RNA, 22 nt, Escherichia coli CFT073
guacaaucgccacauugcugca

SEQ ID NO: 2620565 - RNA, 20 nt, Escherichia coli CFT073
guacaauggacgauuaucaa

SEQ ID NO: 2620566 - RNA, 23 nt, Escherichia coli CFT073
guacacaaccgccggaugcggcg

SEQ ID NO: 2620567 - RNA, 17 nt, Escherichia coli CFT073
guacaccaauuguggua

SEQ ID NO: 2620568 - RNA, 20 nt, Escherichia coli CFT073
guacaccgcagccgccacaa

SEQ ID NO: 2620569 - RNA, 21 nt, Escherichia coli CFT073
guacacugguucccaacaaca

SEQ ID NO: 2620570 - RNA, 18 nt, Escherichia coli CFT073
guacagauacauuucagc

SEQ ID NO: 2620571 - RNA, 14 nt, Escherichia coli CFT073
guacagcccaggaa

SEQ ID NO: 2620572 - RNA, 14 nt, Escherichia coli CFT073
guacagccgccaga

SEQ ID NO: 2620573 - RNA, 16 nt, Escherichia coli CFT073
guacagcucgaugaau

SEQ ID NO: 2620574 - RNA, 21 nt, Escherichia coli CFT073
guacaggcagcuuagaaagga

SEQ ID NO: 2620575 - RNA, 16 nt, Escherichia coli CFT073
guacagguaagcacac

SEQ ID NO: 2620576 - RNA, 19 nt, Escherichia coli CFT073
guacagguaagcacacauc

SEQ ID NO: 2620577 - RNA, 22 nt, Escherichia coli CFT073
guacagguaagcacacaucaca

SEQ ID NO: 2620578 - RNA, 21 nt, Escherichia coli CFT073
guacaguacugggauucacgu

SEQ ID NO: 2620579 - RNA, 15 nt, Escherichia coli CFT073
guacaucaauaccau

SEQ ID NO: 2620580 - RNA, 19 nt, Escherichia coli CFT073
guacaucaauaccauuauc

SEQ ID NO: 2620581 - RNA, 12 nt, Escherichia coli CFT073
guacauccggca

SEQ ID NO: 2620582 - RNA, 17 nt, Escherichia coli CFT073
guacauccggcaaugaa

SEQ ID NO: 2620583 - RNA, 22 nt, Escherichia coli CFT073
guacauccggcaaugaaacuca

SEQ ID NO: 2620584 - RNA, 14 nt, Escherichia coli CFT073
guacaucucuccgu

SEQ ID NO: 2620585 - RNA, 15 nt, Escherichia coli CFT073
guacauuaagcgcau

SEQ ID NO: 2620586 - RNA, 18 nt, Escherichia coli CFT073
guacauuguuuuccagac

SEQ ID NO: 2620587 - RNA, 14 nt, Escherichia coli CFT073
guacauuucuucuu

SEQ ID NO: 2620588 - RNA, 20 nt, Escherichia coli CFT073
guaccaaugaccaccaaaua

SEQ ID NO: 2620589 - RNA, 19 nt, Escherichia coli CFT073
guaccaccagaaucgccag

SEQ ID NO: 2620590 - RNA, 20 nt, Escherichia coli CFT073
guaccaccagaaucgccagc

SEQ ID NO: 2620591 - RNA, 22 nt, Escherichia coli CFT073
guaccaccagaaucgccagcau

SEQ ID NO: 2620592 - RNA, 23 nt, Escherichia coli CFT073
guaccaccagaaucgccagcauc

SEQ ID NO: 2620593 - RNA, 15 nt, Escherichia coli CFT073
guaccacccugcuca

SEQ ID NO: 2620594 - RNA, 17 nt, Escherichia coli CFT073
guaccagcaccugaauc

SEQ ID NO: 2620595 - RNA, 12 nt, Escherichia coli CFT073
guaccagcagcg

SEQ ID NO: 2620596 - RNA, 15 nt, Escherichia coli CFT073
guaccagcccgccga

SEQ ID NO: 2620597 - RNA, 15 nt, Escherichia coli CFT073
guaccaggaucagca

SEQ ID NO: 2620598 - RNA, 22 nt, Escherichia coli CFT073
guaccaggcauauucaccguca

SEQ ID NO: 2620599 - RNA, 16 nt, Escherichia coli CFT073
guaccagugcagaugc

SEQ ID NO: 2620600 - RNA, 17 nt, Escherichia coli CFT073
guaccagugcagaugca

SEQ ID NO: 2620601 - RNA, 21 nt, Escherichia coli CFT073
guaccagugcagaugcacaag

SEQ ID NO: 2620602 - RNA, 15 nt, Escherichia coli CFT073
guaccaguggcggca

SEQ ID NO: 2620603 - RNA, 23 nt, Escherichia coli CFT073
guaccaguggcggcauugacauc

SEQ ID NO: 2620604 - RNA, 20 nt, Escherichia coli CFT073
guaccaucaaucuucacgcg

SEQ ID NO: 2620605 - RNA, 13 nt, Escherichia coli CFT073
guaccaucgccag

SEQ ID NO: 2620606 - RNA, 16 nt, Escherichia coli CFT073
guaccaugauccugca

SEQ ID NO: 2620607 - RNA, 17 nt, Escherichia coli CFT073
guaccauugaagcaauc

SEQ ID NO: 2620608 - RNA, 19 nt, Escherichia coli CFT073
guaccauugaagcaaucca

SEQ ID NO: 2620609 - RNA, 16 nt, Escherichia coli CFT073
guaccauuucuucugc

SEQ ID NO: 2620610 - RNA, 22 nt, Escherichia coli CFT073
guacccagucgcgcgcgguggc

SEQ ID NO: 2620611 - RNA, 23 nt, Escherichia coli CFT073
guaccgagaagccgaccagcacc

SEQ ID NO: 2620612 - RNA, 21 nt, Escherichia coli CFT073
guaccgauaccuaacgccagc

SEQ ID NO: 2620613 - RNA, 23 nt, Escherichia coli CFT073
guaccgauaccuaacgccagcgc

SEQ ID NO: 2620614 - RNA, 16 nt, Escherichia coli CFT073
guaccgccgccauaaa

SEQ ID NO: 2620615 - RNA, 20 nt, Escherichia coli CFT073
guaccgggcgcgaggccagc

SEQ ID NO: 2620616 - RNA, 23 nt, Escherichia coli CFT073
guaccgggcgcgaggccagcggc

SEQ ID NO: 2620617 - RNA, 21 nt, Escherichia coli CFT073
guaccgguuagcucaacgcau

SEQ ID NO: 2620618 - RNA, 15 nt, Escherichia coli CFT073
guaccgugcagcgca

SEQ ID NO: 2620619 - RNA, 23 nt, Escherichia coli CFT073
guaccgugcagcgcaaucgccuc

SEQ ID NO: 2620620 - RNA, 22 nt, Escherichia coli CFT073
guaccguuauugcuuauuguug

SEQ ID NO: 2620621 - RNA, 14 nt, Escherichia coli CFT073
guaccguugcugcc

SEQ ID NO: 2620622 - RNA, 14 nt, Escherichia coli CFT073
guaccugucgggac

SEQ ID NO: 2620623 - RNA, 19 nt, Escherichia coli CFT073
guaccugugaagugaaaaa

SEQ ID NO: 2620624 - RNA, 16 nt, Escherichia coli CFT073
guaccuucgaugaaau

SEQ ID NO: 2620625 - RNA, 18 nt, Escherichia coli CFT073
guaccuucguccauccca

SEQ ID NO: 2620626 - RNA, 20 nt, Escherichia coli CFT073
guaccuucguccaucccaca

SEQ ID NO: 2620627 - RNA, 17 nt, Escherichia coli CFT073
guaccuuugaacugcug

SEQ ID NO: 2620628 - RNA, 13 nt, Escherichia coli CFT073
guacgaaauaacu

SEQ ID NO: 2620629 - RNA, 14 nt, Escherichia coli CFT073
guacgacuuccugg

SEQ ID NO: 2620630 - RNA, 21 nt, Escherichia coli CFT073
guacgauaauggcuuccagua

SEQ ID NO: 2620631 - RNA, 19 nt, Escherichia coli CFT073
guacgcaggcggcuggcau

SEQ ID NO: 2620632 - RNA, 14 nt, Escherichia coli CFT073
guacgcauaaccgg

SEQ ID NO: 2620633 - RNA, 19 nt, Escherichia coli CFT073
guacgcauguuguuuucaa

SEQ ID NO: 2620634 - RNA, 16 nt, Escherichia coli CFT073
guacgccaaucugcaa

SEQ ID NO: 2620635 - RNA, 14 nt, Escherichia coli CFT073
guacgccagcguca

SEQ ID NO: 2620636 - RNA, 23 nt, Escherichia coli CFT073
guacgcgaauugcguuaacgcug

SEQ ID NO: 2620637 - RNA, 19 nt, Escherichia coli CFT073
guacgcgggaauagcucag

SEQ ID NO: 2620638 - RNA, 21 nt, Escherichia coli CFT073
guacgcgggcaacgccuucca

SEQ ID NO: 2620639 - RNA, 18 nt, Escherichia coli CFT073
guacgcguucaaucaaau

SEQ ID NO: 2620640 - RNA, 17 nt, Escherichia coli CFT073
guacgcuaugcgccagu

SEQ ID NO: 2620641 - RNA, 15 nt, Escherichia coli CFT073
guacgcugcaaaaag

SEQ ID NO: 2620642 - RNA, 18 nt, Escherichia coli CFT073
guacgcuucacgcaccau

SEQ ID NO: 2620643 - RNA, 16 nt, Escherichia coli CFT073
guacgggacagcaggu

SEQ ID NO: 2620644 - RNA, 22 nt, Escherichia coli CFT073
guacgucgagcaguugcugaau

SEQ ID NO: 2620645 - RNA, 19 nt, Escherichia coli CFT073
guacguguuguuccaguaa

SEQ ID NO: 2620646 - RNA, 16 nt, Escherichia coli CFT073
guacguuaucaccgau

SEQ ID NO: 2620647 - RNA, 18 nt, Escherichia coli CFT073
guacguucacgcagcuca

SEQ ID NO: 2620648 - RNA, 16 nt, Escherichia coli CFT073
guacguuuauuagccc

SEQ ID NO: 2620649 - RNA, 18 nt, Escherichia coli CFT073
guacuaccgaagcgguga

SEQ ID NO: 2620650 - RNA, 16 nt, Escherichia coli CFT073
guacucaccaacgcag

SEQ ID NO: 2620651 - RNA, 17 nt, Escherichia coli CFT073
guacucaccaacgcaga

SEQ ID NO: 2620652 - RNA, 15 nt, Escherichia coli CFT073
guacucaccgcucac

SEQ ID NO: 2620653 - RNA, 21 nt, Escherichia coli CFT073
guacucaccgcucaccugaua

SEQ ID NO: 2620654 - RNA, 14 nt, Escherichia coli CFT073
guacucaucgcccg

SEQ ID NO: 2620655 - RNA, 22 nt, Escherichia coli CFT073
guacucaucgcccgcaacaaac

SEQ ID NO: 2620656 - RNA, 21 nt, Escherichia coli CFT073
guacucccgaggaucacaaug

SEQ ID NO: 2620657 - RNA, 18 nt, Escherichia coli CFT073
guacuccuguucaccgau

SEQ ID NO: 2620658 - RNA, 22 nt, Escherichia coli CFT073
guacucugccacuacccgcauu

SEQ ID NO: 2620659 - RNA, 17 nt, Escherichia coli CFT073
guacucuucaauggcau

SEQ ID NO: 2620660 - RNA, 15 nt, Escherichia coli CFT073
guacucuuccggugu

SEQ ID NO: 2620661 - RNA, 15 nt, Escherichia coli CFT073
guacugaccaucagc

SEQ ID NO: 2620662 - RNA, 20 nt, Escherichia coli CFT073
guacugaccgucgccuucaa

SEQ ID NO: 2620663 - RNA, 17 nt, Escherichia coli CFT073
guacugacuauccacug

SEQ ID NO: 2620664 - RNA, 19 nt, Escherichia coli CFT073
guacugacuauccacugga

SEQ ID NO: 2620665 - RNA, 11 nt, Escherichia coli CFT073
guacugcaacu

SEQ ID NO: 2620666 - RNA, 11 nt, Escherichia coli CFT073
guacugcaggu

SEQ ID NO: 2620667 - RNA, 17 nt, Escherichia coli CFT073
guacuggcaaucgccag

SEQ ID NO: 2620668 - RNA, 20 nt, Escherichia coli CFT073
guacuggcgacugccagcca

SEQ ID NO: 2620669 - RNA, 13 nt, Escherichia coli CFT073
guacuguacaaca

SEQ ID NO: 2620670 - RNA, 13 nt, Escherichia coli CFT073
guacugucugcug

SEQ ID NO: 2620671 - RNA, 12 nt, Escherichia coli CFT073
guacuuaaaacu

SEQ ID NO: 2620672 - RNA, 18 nt, Escherichia coli CFT073
guacuucaccucauguaa

SEQ ID NO: 2620673 - RNA, 21 nt, Escherichia coli CFT073
guacuuccuguugaugccagu

SEQ ID NO: 2620674 - RNA, 16 nt, Escherichia coli CFT073
guacuuuaaaauaagc

SEQ ID NO: 2620675 - RNA, 20 nt, Escherichia coli CFT073
guacuuuaaaauaagcacaa

SEQ ID NO: 2620676 - RNA, 22 nt, Escherichia coli CFT073
guacuuucugauuguuauucau

SEQ ID NO: 2620677 - RNA, 14 nt, Escherichia coli CFT073
guagaacaccuguc

SEQ ID NO: 2620678 - RNA, 21 nt, Escherichia coli CFT073
guagaacgguaacugaacgua

SEQ ID NO: 2620679 - RNA, 18 nt, Escherichia coli CFT073
guagaaggcgacaaagcc

SEQ ID NO: 2620680 - RNA, 13 nt, Escherichia coli CFT073
guagaauaaaagc

SEQ ID NO: 2620681 - RNA, 19 nt, Escherichia coli CFT073
guagaauuuguaggccgga

SEQ ID NO: 2620682 - RNA, 17 nt, Escherichia coli CFT073
guagacagcaucgacca

SEQ ID NO: 2620683 - RNA, 13 nt, Escherichia coli CFT073
guagacauaaccg

SEQ ID NO: 2620684 - RNA, 12 nt, Escherichia coli CFT073
guagagaaaacc

SEQ ID NO: 2620685 - RNA, 13 nt, Escherichia coli CFT073
guagagcagcacg

SEQ ID NO: 2620686 - RNA, 14 nt, Escherichia coli CFT073
guagaguccagcgc

SEQ ID NO: 2620687 - RNA, 12 nt, Escherichia coli CFT073
guagaugcccau

SEQ ID NO: 2620688 - RNA, 22 nt, Escherichia coli CFT073
guagauugcacaugcuaaaaau

SEQ ID NO: 2620689 - RNA, 22 nt, Escherichia coli CFT073
guagcaaauuucgucguaauca

SEQ ID NO: 2620690 - RNA, 23 nt, Escherichia coli CFT073
guagcaccacgguacgccagagu

SEQ ID NO: 2620691 - RNA, 15 nt, Escherichia coli CFT073
guagcaccaguuggu

SEQ ID NO: 2620692 - RNA, 16 nt, Escherichia coli CFT073
guagcagcagcgccag

SEQ ID NO: 2620693 - RNA, 18 nt, Escherichia coli CFT073
guagcagcagcgccaggc

SEQ ID NO: 2620694 - RNA, 19 nt, Escherichia coli CFT073
guagcagcaggaauaauca

SEQ ID NO: 2620695 - RNA, 14 nt, Escherichia coli CFT073
guagcaggaaauau

SEQ ID NO: 2620696 - RNA, 15 nt, Escherichia coli CFT073
guagcaggccggaga

SEQ ID NO: 2620697 - RNA, 18 nt, Escherichia coli CFT073
guagcagguaaucugcca

SEQ ID NO: 2620698 - RNA, 17 nt, Escherichia coli CFT073
guagcaguuccagcauc

SEQ ID NO: 2620699 - RNA, 23 nt, Escherichia coli CFT073
guagccaaucccggaagccacca

SEQ ID NO: 2620700 - RNA, 20 nt, Escherichia coli CFT073
guagccuuuuucagccgcaa

SEQ ID NO: 2620701 - RNA, 19 nt, Escherichia coli CFT073
guagcgaucgucaaaggca

SEQ ID NO: 2620702 - RNA, 21 nt, Escherichia coli CFT073
guagcgauggcccgcuugcca

SEQ ID NO: 2620703 - RNA, 23 nt, Escherichia coli CFT073
guagcgauuuacuauucaccacu

SEQ ID NO: 2620704 - RNA, 15 nt, Escherichia coli CFT073
guagcgcagcaggca

SEQ ID NO: 2620705 - RNA, 15 nt, Escherichia coli CFT073
guagcgccagacuga

SEQ ID NO: 2620706 - RNA, 23 nt, Escherichia coli CFT073
guagcgcgcuuuaccaucgcgca

SEQ ID NO: 2620707 - RNA, 22 nt, Escherichia coli CFT073
guagcguaaaggcugccagagu

SEQ ID NO: 2620708 - RNA, 15 nt, Escherichia coli CFT073
guagcgucgccagca

SEQ ID NO: 2620709 - RNA, 14 nt, Escherichia coli CFT073
guagcgugauuuuu

SEQ ID NO: 2620710 - RNA, 11 nt, Escherichia coli CFT073
guagcgugcgg

SEQ ID NO: 2620711 - RNA, 14 nt, Escherichia coli CFT073
guagcucagcugga

SEQ ID NO: 2620712 - RNA, 22 nt, Escherichia coli CFT073
guagcugcugcucaaucugcgc

SEQ ID NO: 2620713 - RNA, 15 nt, Escherichia coli CFT073
guagcuggcaaugau

SEQ ID NO: 2620714 - RNA, 23 nt, Escherichia coli CFT073
guagcuuaucgcaggcuuccugg

SEQ ID NO: 2620715 - RNA, 19 nt, Escherichia coli CFT073
guaggccgaauaaggcguu

SEQ ID NO: 2620716 - RNA, 19 nt, Escherichia coli CFT073
guaggccggauaagacgcg

SEQ ID NO: 2620717 - RNA, 22 nt, Escherichia coli CFT073
guaggccggauaagacgcguca

SEQ ID NO: 2620718 - RNA, 22 nt, Escherichia coli CFT073
guaggccggauaaggcgcguca

SEQ ID NO: 2620719 - RNA, 18 nt, Escherichia coli CFT073
guaggccggauaaggcgu

SEQ ID NO: 2620720 - RNA, 19 nt, Escherichia coli CFT073
guaggccggauaaggcguu

SEQ ID NO: 2620721 - RNA, 14 nt, Escherichia coli CFT073
guaggccugauaag

SEQ ID NO: 2620722 - RNA, 19 nt, Escherichia coli CFT073
guaggccugauaagcggag

SEQ ID NO: 2620723 - RNA, 19 nt, Escherichia coli CFT073
guaggccugauaagcguag

SEQ ID NO: 2620724 - RNA, 17 nt, Escherichia coli CFT073
guaggcgaucccagcgc

SEQ ID NO: 2620725 - RNA, 23 nt, Escherichia coli CFT073
guaggcguuauacaucgucgcaa

SEQ ID NO: 2620726 - RNA, 16 nt, Escherichia coli CFT073
guaggcugacggcguu

SEQ ID NO: 2620727 - RNA, 16 nt, Escherichia coli CFT073
guaggggaacugcagg

SEQ ID NO: 2620728 - RNA, 16 nt, Escherichia coli CFT073
guaggucggauaaggc

SEQ ID NO: 2620729 - RNA, 18 nt, Escherichia coli CFT073
guagguguauugcccgcc

SEQ ID NO: 2620730 - RNA, 22 nt, Escherichia coli CFT073
guagguuccggcaaucaacaga

SEQ ID NO: 2620731 - RNA, 11 nt, Escherichia coli CFT073
guaguaaguag

SEQ ID NO: 2620732 - RNA, 16 nt, Escherichia coli CFT073
guaguacccucugcac

SEQ ID NO: 2620733 - RNA, 17 nt, Escherichia coli CFT073
guaguacccucugcacc

SEQ ID NO: 2620734 - RNA, 15 nt, Escherichia coli CFT073
guaguacgugaagua

SEQ ID NO: 2620735 - RNA, 18 nt, Escherichia coli CFT073
guaguacucguagcccug

SEQ ID NO: 2620736 - RNA, 23 nt, Escherichia coli CFT073
guaguagccgucuuucaguucgc

SEQ ID NO: 2620737 - RNA, 22 nt, Escherichia coli CFT073
guaguauuugaguucacugccg

SEQ ID NO: 2620738 - RNA, 19 nt, Escherichia coli CFT073
guagucaggaagccccagc

SEQ ID NO: 2620739 - RNA, 19 nt, Escherichia coli CFT073
guaguccaggccugauuaa

SEQ ID NO: 2620740 - RNA, 16 nt, Escherichia coli CFT073
guaguccggauaaggc

SEQ ID NO: 2620741 - RNA, 15 nt, Escherichia coli CFT073
guagugaaggcaaac

SEQ ID NO: 2620742 - RNA, 19 nt, Escherichia coli CFT073
guagugaugcaucauaugc

SEQ ID NO: 2620743 - RNA, 17 nt, Escherichia coli CFT073
guagugcgcagaacaua

SEQ ID NO: 2620744 - RNA, 14 nt, Escherichia coli CFT073
guaguggccacaga

SEQ ID NO: 2620745 - RNA, 16 nt, Escherichia coli CFT073
guaguguaaaugcaaa

SEQ ID NO: 2620746 - RNA, 14 nt, Escherichia coli CFT073
guaguuaagauuca

SEQ ID NO: 2620747 - RNA, 23 nt, Escherichia coli CFT073
guaguuaauaccugcaccaacgu

SEQ ID NO: 2620748 - RNA, 19 nt, Escherichia coli CFT073
guaguuaugaaaauaggaa

SEQ ID NO: 2620749 - RNA, 14 nt, Escherichia coli CFT073
guaguugaucgccc

SEQ ID NO: 2620750 - RNA, 15 nt, Escherichia coli CFT073
guaguugcgcuggug

SEQ ID NO: 2620751 - RNA, 21 nt, Escherichia coli CFT073
guaguugcgcugguggcaggc

SEQ ID NO: 2620752 - RNA, 12 nt, Escherichia coli CFT073
guaguugcugau

SEQ ID NO: 2620753 - RNA, 14 nt, Escherichia coli CFT073
guaguugcugucga

SEQ ID NO: 2620754 - RNA, 14 nt, Escherichia coli CFT073
guauaaaaagaaga

SEQ ID NO: 2620755 - RNA, 20 nt, Escherichia coli CFT073
guauaacucgccuucagguu

SEQ ID NO: 2620756 - RNA, 22 nt, Escherichia coli CFT073
guauaacucgccuucagguuuu

SEQ ID NO: 2620757 - RNA, 19 nt, Escherichia coli CFT073
guauaaggagcaauaauca

SEQ ID NO: 2620758 - RNA, 18 nt, Escherichia coli CFT073
guauaaggcaucagccag

SEQ ID NO: 2620759 - RNA, 18 nt, Escherichia coli CFT073
guauaccugauuaccaaa

SEQ ID NO: 2620760 - RNA, 13 nt, Escherichia coli CFT073
guauacugcaaau

SEQ ID NO: 2620761 - RNA, 14 nt, Escherichia coli CFT073
guauacugcaaaua

SEQ ID NO: 2620762 - RNA, 15 nt, Escherichia coli CFT073
guauacugcaaauau

SEQ ID NO: 2620763 - RNA, 13 nt, Escherichia coli CFT073
guauacugcagcg

SEQ ID NO: 2620764 - RNA, 18 nt, Escherichia coli CFT073
guauacugcagcggucac

SEQ ID NO: 2620765 - RNA, 18 nt, Escherichia coli CFT073
guauagaaaccauccagc

SEQ ID NO: 2620766 - RNA, 17 nt, Escherichia coli CFT073
guauagaaugcagcagc

SEQ ID NO: 2620767 - RNA, 20 nt, Escherichia coli CFT073
guauaggcuccacugauggc

SEQ ID NO: 2620768 - RNA, 15 nt, Escherichia coli CFT073
guauaguccgccaga

SEQ ID NO: 2620769 - RNA, 22 nt, Escherichia coli CFT073
guauaguccgccagaauacccg

SEQ ID NO: 2620770 - RNA, 19 nt, Escherichia coli CFT073
guauauaacgcauaaaccg

SEQ ID NO: 2620771 - RNA, 16 nt, Escherichia coli CFT073
guauaugagaagacug

SEQ ID NO: 2620772 - RNA, 15 nt, Escherichia coli CFT073
guauaugcguugcgg

SEQ ID NO: 2620773 - RNA, 19 nt, Escherichia coli CFT073
guauauuauccaucaaagg

SEQ ID NO: 2620774 - RNA, 16 nt, Escherichia coli CFT073
guauauugcagaaauc

SEQ ID NO: 2620775 - RNA, 17 nt, Escherichia coli CFT073
guauauugcugauuuuc

SEQ ID NO: 2620776 - RNA, 20 nt, Escherichia coli CFT073
guaucaaacacaggcagaac

SEQ ID NO: 2620777 - RNA, 20 nt, Escherichia coli CFT073
guaucaaacagaaaaacgaa

SEQ ID NO: 2620778 - RNA, 14 nt, Escherichia coli CFT073
guaucaaggcugau

SEQ ID NO: 2620779 - RNA, 14 nt, Escherichia coli CFT073
guaucaauaauucg

SEQ ID NO: 2620780 - RNA, 13 nt, Escherichia coli CFT073
guaucaauaccag

SEQ ID NO: 2620781 - RNA, 15 nt, Escherichia coli CFT073
guaucacguagccac

SEQ ID NO: 2620782 - RNA, 19 nt, Escherichia coli CFT073
guaucacguagccacggcg

SEQ ID NO: 2620783 - RNA, 19 nt, Escherichia coli CFT073
guaucagggcgaaacagag

SEQ ID NO: 2620784 - RNA, 11 nt, Escherichia coli CFT073
guaucaucgcu

SEQ ID NO: 2620785 - RNA, 14 nt, Escherichia coli CFT073
guaucaucgcugaa

SEQ ID NO: 2620786 - RNA, 19 nt, Escherichia coli CFT073
guauccaacugugaauccu

SEQ ID NO: 2620787 - RNA, 20 nt, Escherichia coli CFT073
guauccacacugguucccag

SEQ ID NO: 2620788 - RNA, 19 nt, Escherichia coli CFT073
guauccagacccagcuuca

SEQ ID NO: 2620789 - RNA, 23 nt, Escherichia coli CFT073
guauccagacccagcuucagcgu

SEQ ID NO: 2620790 - RNA, 20 nt, Escherichia coli CFT073
guauccaggccacucaugcc

SEQ ID NO: 2620791 - RNA, 11 nt, Escherichia coli CFT073
guauccagugu

SEQ ID NO: 2620792 - RNA, 20 nt, Escherichia coli CFT073
guauccgacguuacgcgcca

SEQ ID NO: 2620793 - RNA, 21 nt, Escherichia coli CFT073
guauccuguuuuuaagugaug

SEQ ID NO: 2620794 - RNA, 18 nt, Escherichia coli CFT073
guaucgaacguuuucacc

SEQ ID NO: 2620795 - RNA, 23 nt, Escherichia coli CFT073
guaucgaacguuuucaccacuuu

SEQ ID NO: 2620796 - RNA, 19 nt, Escherichia coli CFT073
guaucgccuguacgcgcca

SEQ ID NO: 2620797 - RNA, 20 nt, Escherichia coli CFT073
guaucgcggggauauggugg

SEQ ID NO: 2620798 - RNA, 12 nt, Escherichia coli CFT073
guaucggcaucg

SEQ ID NO: 2620799 - RNA, 21 nt, Escherichia coli CFT073
guaucggcaucgauauugugc

SEQ ID NO: 2620800 - RNA, 16 nt, Escherichia coli CFT073
guaucguaaucagcac

SEQ ID NO: 2620801 - RNA, 16 nt, Escherichia coli CFT073
guaucguuaaagagau

SEQ ID NO: 2620802 - RNA, 14 nt, Escherichia coli CFT073
guaucguucgccag

SEQ ID NO: 2620803 - RNA, 18 nt, Escherichia coli CFT073
guaucuaccacugccuga

SEQ ID NO: 2620804 - RNA, 15 nt, Escherichia coli CFT073
guaucuaccccagau

SEQ ID NO: 2620805 - RNA, 16 nt, Escherichia coli CFT073
guaucucgcgccagua

SEQ ID NO: 2620806 - RNA, 19 nt, Escherichia coli CFT073
guaucuucaugcuccagca

SEQ ID NO: 2620807 - RNA, 19 nt, Escherichia coli CFT073
guaugaauuuucgacagca

SEQ ID NO: 2620808 - RNA, 16 nt, Escherichia coli CFT073
guaugacgaggaacau

SEQ ID NO: 2620809 - RNA, 20 nt, Escherichia coli CFT073
guaugacgaguauauucugu

SEQ ID NO: 2620810 - RNA, 17 nt, Escherichia coli CFT073
guaugcaucgguggcga

SEQ ID NO: 2620811 - RNA, 14 nt, Escherichia coli CFT073
guaugccauccggc

SEQ ID NO: 2620812 - RNA, 13 nt, Escherichia coli CFT073
guaugcccagcgc

SEQ ID NO: 2620813 - RNA, 16 nt, Escherichia coli CFT073
guauggaaaucaccca

SEQ ID NO: 2620814 - RNA, 19 nt, Escherichia coli CFT073
guauggagcaggaauauac

SEQ ID NO: 2620815 - RNA, 22 nt, Escherichia coli CFT073
guauggcccagccuuuccagca

SEQ ID NO: 2620816 - RNA, 14 nt, Escherichia coli CFT073
guauggccugguga

SEQ ID NO: 2620817 - RNA, 23 nt, Escherichia coli CFT073
guauggccuuucuggcggccaaa

SEQ ID NO: 2620818 - RNA, 20 nt, Escherichia coli CFT073
guaugguauaucguuuuuca

SEQ ID NO: 2620819 - RNA, 22 nt, Escherichia coli CFT073
guaugguauaucguuuuucauu

SEQ ID NO: 2620820 - RNA, 17 nt, Escherichia coli CFT073
guauggucgugaucaau

SEQ ID NO: 2620821 - RNA, 20 nt, Escherichia coli CFT073
guaugguuuuguaggccgga

SEQ ID NO: 2620822 - RNA, 19 nt, Escherichia coli CFT073
guauguucagaaagcgcca

SEQ ID NO: 2620823 - RNA, 17 nt, Escherichia coli CFT073
guauguuuugucugccc

SEQ ID NO: 2620824 - RNA, 14 nt, Escherichia coli CFT073
guauuaauuugcca

SEQ ID NO: 2620825 - RNA, 20 nt, Escherichia coli CFT073
guauuacccggcacagcuuu

SEQ ID NO: 2620826 - RNA, 21 nt, Escherichia coli CFT073
guauuacccggcacagcuuuc

SEQ ID NO: 2620827 - RNA, 13 nt, Escherichia coli CFT073
guauuauucaggu

SEQ ID NO: 2620828 - RNA, 13 nt, Escherichia coli CFT073
guauucaaccguu

SEQ ID NO: 2620829 - RNA, 14 nt, Escherichia coli CFT073
guauucaaccguuu

SEQ ID NO: 2620830 - RNA, 19 nt, Escherichia coli CFT073
guauucaaccguuuccagu

SEQ ID NO: 2620831 - RNA, 20 nt, Escherichia coli CFT073
guauucacauagcccgguuu

SEQ ID NO: 2620832 - RNA, 23 nt, Escherichia coli CFT073
guauuccaccguacgccagcguc

SEQ ID NO: 2620833 - RNA, 17 nt, Escherichia coli CFT073
guauucccguauuacug

SEQ ID NO: 2620834 - RNA, 17 nt, Escherichia coli CFT073
guauuccugaaucagcc

SEQ ID NO: 2620835 - RNA, 16 nt, Escherichia coli CFT073
guauucguuaaaacca

SEQ ID NO: 2620836 - RNA, 17 nt, Escherichia coli CFT073
guauugccaugcacgca

SEQ ID NO: 2620837 - RNA, 18 nt, Escherichia coli CFT073
guauugcccugaucgcgc

SEQ ID NO: 2620838 - RNA, 21 nt, Escherichia coli CFT073
guauugcccugaucgcgcagu

SEQ ID NO: 2620839 - RNA, 14 nt, Escherichia coli CFT073
guauugcggaacgg

SEQ ID NO: 2620840 - RNA, 19 nt, Escherichia coli CFT073
guauugggauguugauuaa

SEQ ID NO: 2620841 - RNA, 22 nt, Escherichia coli CFT073
guauuuccggauuauccagcca

SEQ ID NO: 2620842 - RNA, 17 nt, Escherichia coli CFT073
guauuucgaaugcucau

SEQ ID NO: 2620843 - RNA, 22 nt, Escherichia coli CFT073
guauuucgcgaggcguuuucca

SEQ ID NO: 2620844 - RNA, 21 nt, Escherichia coli CFT073
guauuugauaccaguuuccac

SEQ ID NO: 2620845 - RNA, 16 nt, Escherichia coli CFT073
guauuuggcugccgag

SEQ ID NO: 2620846 - RNA, 11 nt, Escherichia coli CFT073
guauuuugcau

SEQ ID NO: 2620847 - RNA, 23 nt, Escherichia coli CFT073
guauuuugucagcccuuuuggca

SEQ ID NO: 2620848 - RNA, 19 nt, Escherichia coli CFT073
gucaaaaagcucaaucgaa

SEQ ID NO: 2620849 - RNA, 16 nt, Escherichia coli CFT073
gucaaaagcacucaga

SEQ ID NO: 2620850 - RNA, 12 nt, Escherichia coli CFT073
gucaaaagcggu

SEQ ID NO: 2620851 - RNA, 17 nt, Escherichia coli CFT073
gucaaaaucauccgucg

SEQ ID NO: 2620852 - RNA, 16 nt, Escherichia coli CFT073
gucaaacaguucacgu

SEQ ID NO: 2620853 - RNA, 15 nt, Escherichia coli CFT073
gucaaaccuggcggc

SEQ ID NO: 2620854 - RNA, 22 nt, Escherichia coli CFT073
gucaaacgcacgucugauguaa

SEQ ID NO: 2620855 - RNA, 12 nt, Escherichia coli CFT073
gucaaacugaua

SEQ ID NO: 2620856 - RNA, 13 nt, Escherichia coli CFT073
gucaaagauauua

SEQ ID NO: 2620857 - RNA, 18 nt, Escherichia coli CFT073
gucaaagauauuauuaaa

SEQ ID NO: 2620858 - RNA, 16 nt, Escherichia coli CFT073
gucaaagcgccagcgc

SEQ ID NO: 2620859 - RNA, 16 nt, Escherichia coli CFT073
gucaacagggcagaca

SEQ ID NO: 2620860 - RNA, 15 nt, Escherichia coli CFT073
gucaacccaaccugc

SEQ ID NO: 2620861 - RNA, 21 nt, Escherichia coli CFT073
gucaacugcgccacucgauac

SEQ ID NO: 2620862 - RNA, 19 nt, Escherichia coli CFT073
gucaagcgucgcauccggc

SEQ ID NO: 2620863 - RNA, 14 nt, Escherichia coli CFT073
gucaauaaaaagcg

SEQ ID NO: 2620864 - RNA, 18 nt, Escherichia coli CFT073
gucaauaguuacgaaaag

SEQ ID NO: 2620865 - RNA, 23 nt, Escherichia coli CFT073
gucaauaucaucgauuuucugcu

SEQ ID NO: 2620866 - RNA, 18 nt, Escherichia coli CFT073
gucaauauccagcagguu

SEQ ID NO: 2620867 - RNA, 14 nt, Escherichia coli CFT073
gucaaucacacuga

SEQ ID NO: 2620868 - RNA, 14 nt, Escherichia coli CFT073
gucaaucacuuucu

SEQ ID NO: 2620869 - RNA, 21 nt, Escherichia coli CFT073
gucaaucagggcgaugcggga

SEQ ID NO: 2620870 - RNA, 20 nt, Escherichia coli CFT073
gucaaucauugauaauaacg

SEQ ID NO: 2620871 - RNA, 16 nt, Escherichia coli CFT073
gucaaucgcacgauag

SEQ ID NO: 2620872 - RNA, 14 nt, Escherichia coli CFT073
gucaaugaaauuac

SEQ ID NO: 2620873 - RNA, 19 nt, Escherichia coli CFT073
gucaauuugcuccgccagu

SEQ ID NO: 2620874 - RNA, 19 nt, Escherichia coli CFT073
gucaauuuuaagcagaucg

SEQ ID NO: 2620875 - RNA, 14 nt, Escherichia coli CFT073
gucacaaacaucau

SEQ ID NO: 2620876 - RNA, 19 nt, Escherichia coli CFT073
gucacaaaucucccuugcg

SEQ ID NO: 2620877 - RNA, 14 nt, Escherichia coli CFT073
gucacagaagagag

SEQ ID NO: 2620878 - RNA, 22 nt, Escherichia coli CFT073
gucacagucugcuccaucgcau

SEQ ID NO: 2620879 - RNA, 14 nt, Escherichia coli CFT073
gucacaguuaacca

SEQ ID NO: 2620880 - RNA, 15 nt, Escherichia coli CFT073
gucacaucaggccau

SEQ ID NO: 2620881 - RNA, 14 nt, Escherichia coli CFT073
gucacaucgcugac

SEQ ID NO: 2620882 - RNA, 16 nt, Escherichia coli CFT073
gucacauguuccaggg

SEQ ID NO: 2620883 - RNA, 22 nt, Escherichia coli CFT073
gucaccaaucugaaaccagcgu

SEQ ID NO: 2620884 - RNA, 11 nt, Escherichia coli CFT073
gucaccacaaa

SEQ ID NO: 2620885 - RNA, 12 nt, Escherichia coli CFT073
gucaccacaaau

SEQ ID NO: 2620886 - RNA, 15 nt, Escherichia coli CFT073
gucaccacccugccc

SEQ ID NO: 2620887 - RNA, 17 nt, Escherichia coli CFT073
gucaccagagauaaaau

SEQ ID NO: 2620888 - RNA, 14 nt, Escherichia coli CFT073
gucaccagcaucaa

SEQ ID NO: 2620889 - RNA, 18 nt, Escherichia coli CFT073
gucaccaggaagccuucc

SEQ ID NO: 2620890 - RNA, 12 nt, Escherichia coli CFT073
gucaccaguccc

SEQ ID NO: 2620891 - RNA, 18 nt, Escherichia coli CFT073
gucacccgugcagguucu

SEQ ID NO: 2620892 - RNA, 18 nt, Escherichia coli CFT073
gucaccggaaccgucgcg

SEQ ID NO: 2620893 - RNA, 21 nt, Escherichia coli CFT073
gucaccggaucuuccacaaua

SEQ ID NO: 2620894 - RNA, 18 nt, Escherichia coli CFT073
gucaccgggcaaacgcug

SEQ ID NO: 2620895 - RNA, 16 nt, Escherichia coli CFT073
gucaccuaauuuaaaa

SEQ ID NO: 2620896 - RNA, 16 nt, Escherichia coli CFT073
gucaccugcccgguau

SEQ ID NO: 2620897 - RNA, 16 nt, Escherichia coli CFT073
gucaccuucuggcgac

SEQ ID NO: 2620898 - RNA, 22 nt, Escherichia coli CFT073
gucacgauacgguuauccugca

SEQ ID NO: 2620899 - RNA, 23 nt, Escherichia coli CFT073
gucacgauacgguuauccugcaa

SEQ ID NO: 2620900 - RNA, 20 nt, Escherichia coli CFT073
gucacgcagucagcacuggc

SEQ ID NO: 2620901 - RNA, 19 nt, Escherichia coli CFT073
gucacgcaucacgacaacc

SEQ ID NO: 2620902 - RNA, 16 nt, Escherichia coli CFT073
gucacgccaauaaucg

SEQ ID NO: 2620903 - RNA, 23 nt, Escherichia coli CFT073
gucacgccgaccagaccggcaau

SEQ ID NO: 2620904 - RNA, 16 nt, Escherichia coli CFT073
gucacgggcggugcgg

SEQ ID NO: 2620905 - RNA, 18 nt, Escherichia coli CFT073
gucacgguuucaaagaaa

SEQ ID NO: 2620906 - RNA, 16 nt, Escherichia coli CFT073
gucacguagcggcggc

SEQ ID NO: 2620907 - RNA, 21 nt, Escherichia coli CFT073
gucacguagcggcggcagauu

SEQ ID NO: 2620908 - RNA, 13 nt, Escherichia coli CFT073
gucacuaaauuca

SEQ ID NO: 2620909 - RNA, 15 nt, Escherichia coli CFT073
gucacuaauugcagc

SEQ ID NO: 2620910 - RNA, 19 nt, Escherichia coli CFT073
gucacuaccuguuuaaccu

SEQ ID NO: 2620911 - RNA, 14 nt, Escherichia coli CFT073
gucacucacgcugc

SEQ ID NO: 2620912 - RNA, 14 nt, Escherichia coli CFT073
gucacucgcauggu

SEQ ID NO: 2620913 - RNA, 21 nt, Escherichia coli CFT073
gucacugagcccgcuucgccu

SEQ ID NO: 2620914 - RNA, 18 nt, Escherichia coli CFT073
gucacugauagugcugcc

SEQ ID NO: 2620915 - RNA, 16 nt, Escherichia coli CFT073
gucacugccaccaucc

SEQ ID NO: 2620916 - RNA, 21 nt, Escherichia coli CFT073
gucacugcgguguaaaccagc

SEQ ID NO: 2620917 - RNA, 22 nt, Escherichia coli CFT073
gucacuuugcugucgauuuuca

SEQ ID NO: 2620918 - RNA, 12 nt, Escherichia coli CFT073
gucagaaagaaa

SEQ ID NO: 2620919 - RNA, 16 nt, Escherichia coli CFT073
gucagaaagugccacg

SEQ ID NO: 2620920 - RNA, 23 nt, Escherichia coli CFT073
gucagaaaugguuggcgugcggg

SEQ ID NO: 2620921 - RNA, 19 nt, Escherichia coli CFT073
gucagaccaaaacgcgcca

SEQ ID NO: 2620922 - RNA, 20 nt, Escherichia coli CFT073
gucagaccaaaacgcgccag

SEQ ID NO: 2620923 - RNA, 18 nt, Escherichia coli CFT073
gucagaccggcaaccagc

SEQ ID NO: 2620924 - RNA, 19 nt, Escherichia coli CFT073
gucagaccuccguuuuucu

SEQ ID NO: 2620925 - RNA, 19 nt, Escherichia coli CFT073
gucagacggccccgcgcca

SEQ ID NO: 2620926 - RNA, 16 nt, Escherichia coli CFT073
gucagacuaucuuugg

SEQ ID NO: 2620927 - RNA, 14 nt, Escherichia coli CFT073
gucagacuuaagcc

SEQ ID NO: 2620928 - RNA, 17 nt, Escherichia coli CFT073
gucagaugcugugcaau

SEQ ID NO: 2620929 - RNA, 18 nt, Escherichia coli CFT073
gucagauuagaacugaua

SEQ ID NO: 2620930 - RNA, 21 nt, Escherichia coli CFT073
gucagcaaaauacugaacagg

SEQ ID NO: 2620931 - RNA, 13 nt, Escherichia coli CFT073
gucagcaaacuga

SEQ ID NO: 2620932 - RNA, 18 nt, Escherichia coli CFT073
gucagcaaugccagagug

SEQ ID NO: 2620933 - RNA, 17 nt, Escherichia coli CFT073
gucagcaauuuuacccg

SEQ ID NO: 2620934 - RNA, 16 nt, Escherichia coli CFT073
gucagcacucacgcca

SEQ ID NO: 2620935 - RNA, 19 nt, Escherichia coli CFT073
gucagcacucacgccaggc

SEQ ID NO: 2620936 - RNA, 14 nt, Escherichia coli CFT073
gucagccacaacaa

SEQ ID NO: 2620937 - RNA, 18 nt, Escherichia coli CFT073
gucagccagcacugacau

SEQ ID NO: 2620938 - RNA, 12 nt, Escherichia coli CFT073
gucagccagcgc

SEQ ID NO: 2620939 - RNA, 13 nt, Escherichia coli CFT073
gucagccagcgca

SEQ ID NO: 2620940 - RNA, 18 nt, Escherichia coli CFT073
gucagccaucgccaccgc

SEQ ID NO: 2620941 - RNA, 18 nt, Escherichia coli CFT073
gucagcccccacgccaua

SEQ ID NO: 2620942 - RNA, 13 nt, Escherichia coli CFT073
gucagccgcccgc

SEQ ID NO: 2620943 - RNA, 19 nt, Escherichia coli CFT073
gucagcgcaaucugcuucu

SEQ ID NO: 2620944 - RNA, 23 nt, Escherichia coli CFT073
gucagcgccaggcuuuccgucag

SEQ ID NO: 2620945 - RNA, 17 nt, Escherichia coli CFT073
gucagcgccgcauccga

SEQ ID NO: 2620946 - RNA, 13 nt, Escherichia coli CFT073
gucagcgucgcau

SEQ ID NO: 2620947 - RNA, 22 nt, Escherichia coli CFT073
gucagcgucgcaucuggcauaa

SEQ ID NO: 2620948 - RNA, 17 nt, Escherichia coli CFT073
gucagcgucucaacaaa

SEQ ID NO: 2620949 - RNA, 23 nt, Escherichia coli CFT073
gucagcgucuguuuuaucacauc

SEQ ID NO: 2620950 - RNA, 19 nt, Escherichia coli CFT073
gucagcucauccagcgucu

SEQ ID NO: 2620951 - RNA, 18 nt, Escherichia coli CFT073
gucagcucgcugccaucg

SEQ ID NO: 2620952 - RNA, 13 nt, Escherichia coli CFT073
gucagcugcuguu

SEQ ID NO: 2620953 - RNA, 14 nt, Escherichia coli CFT073
gucaggaucaccaa

SEQ ID NO: 2620954 - RNA, 23 nt, Escherichia coli CFT073
gucaggaucaccaauaccagcau

SEQ ID NO: 2620955 - RNA, 17 nt, Escherichia coli CFT073
gucaggauguugccacg

SEQ ID NO: 2620956 - RNA, 18 nt, Escherichia coli CFT073
gucaggauuaaacuggca

SEQ ID NO: 2620957 - RNA, 20 nt, Escherichia coli CFT073
gucaggcaagccgcuaacag

SEQ ID NO: 2620958 - RNA, 13 nt, Escherichia coli CFT073
gucaggcaucggc

SEQ ID NO: 2620959 - RNA, 21 nt, Escherichia coli CFT073
gucaggccaacauccaucagc

SEQ ID NO: 2620960 - RNA, 21 nt, Escherichia coli CFT073
gucaggcuaaagaaaacgaau

SEQ ID NO: 2620961 - RNA, 18 nt, Escherichia coli CFT073
gucaggggcauuuuccag

SEQ ID NO: 2620962 - RNA, 17 nt, Escherichia coli CFT073
gucagggucuggugcug

SEQ ID NO: 2620963 - RNA, 19 nt, Escherichia coli CFT073
gucaggugagcgucauuau

SEQ ID NO: 2620964 - RNA, 20 nt, Escherichia coli CFT073
gucaguacaaacauccaucu

SEQ ID NO: 2620965 - RNA, 16 nt, Escherichia coli CFT073
gucaguagcgcaauaa

SEQ ID NO: 2620966 - RNA, 17 nt, Escherichia coli CFT073
gucaguaguuuuugcag

SEQ ID NO: 2620967 - RNA, 22 nt, Escherichia coli CFT073
gucaguaguuuuugcagaugga

SEQ ID NO: 2620968 - RNA, 16 nt, Escherichia coli CFT073
gucaguaucgcgggga

SEQ ID NO: 2620969 - RNA, 17 nt, Escherichia coli CFT073
gucaguaucgcggggau

SEQ ID NO: 2620970 - RNA, 14 nt, Escherichia coli CFT073
gucagucaucacuu

SEQ ID NO: 2620971 - RNA, 15 nt, Escherichia coli CFT073
gucagucccaacuga

SEQ ID NO: 2620972 - RNA, 21 nt, Escherichia coli CFT073
gucagucccugcucuuucagc

SEQ ID NO: 2620973 - RNA, 23 nt, Escherichia coli CFT073
gucagucccugcucuuucagcac

SEQ ID NO: 2620974 - RNA, 13 nt, Escherichia coli CFT073
gucagugucagaa

SEQ ID NO: 2620975 - RNA, 21 nt, Escherichia coli CFT073
gucagugucuuaucuggcauu

SEQ ID NO: 2620976 - RNA, 22 nt, Escherichia coli CFT073
gucagugucuuaucuggcauuu

SEQ ID NO: 2620977 - RNA, 16 nt, Escherichia coli CFT073
gucaguucucuggcau

SEQ ID NO: 2620978 - RNA, 16 nt, Escherichia coli CFT073
gucaguugcggcagga

SEQ ID NO: 2620979 - RNA, 13 nt, Escherichia coli CFT073
gucaguuggcugu

SEQ ID NO: 2620980 - RNA, 16 nt, Escherichia coli CFT073
gucaguuggcuguggu

SEQ ID NO: 2620981 - RNA, 14 nt, Escherichia coli CFT073
gucaguuucaccuc

SEQ ID NO: 2620982 - RNA, 21 nt, Escherichia coli CFT073
gucauaaaaucaauaugcaua

SEQ ID NO: 2620983 - RNA, 14 nt, Escherichia coli CFT073
gucauaaaucagcg

SEQ ID NO: 2620984 - RNA, 17 nt, Escherichia coli CFT073
gucauaaucauuaacgg

SEQ ID NO: 2620985 - RNA, 22 nt, Escherichia coli CFT073
gucauacuuauugaaagcaaaa

SEQ ID NO: 2620986 - RNA, 21 nt, Escherichia coli CFT073
gucauagcaauaaaugccugg

SEQ ID NO: 2620987 - RNA, 15 nt, Escherichia coli CFT073
gucauagcgacuacc

SEQ ID NO: 2620988 - RNA, 16 nt, Escherichia coli CFT073
gucauagcgacuacca

SEQ ID NO: 2620989 - RNA, 12 nt, Escherichia coli CFT073
gucauauagccg

SEQ ID NO: 2620990 - RNA, 22 nt, Escherichia coli CFT073
gucauauagccgcgcaguuucu

SEQ ID NO: 2620991 - RNA, 16 nt, Escherichia coli CFT073
gucauaucaucaucgg

SEQ ID NO: 2620992 - RNA, 18 nt, Escherichia coli CFT073
gucauaucgaccagcgca

SEQ ID NO: 2620993 - RNA, 16 nt, Escherichia coli CFT073
gucauauucgccauca

SEQ ID NO: 2620994 - RNA, 16 nt, Escherichia coli CFT073
gucaucaaguuacgau

SEQ ID NO: 2620995 - RNA, 17 nt, Escherichia coli CFT073
gucaucaauccugcagc

SEQ ID NO: 2620996 - RNA, 21 nt, Escherichia coli CFT073
gucaucaauccugcagcaggu

SEQ ID NO: 2620997 - RNA, 19 nt, Escherichia coli CFT073
gucaucacaucccagcaga

SEQ ID NO: 2620998 - RNA, 20 nt, Escherichia coli CFT073
gucaucacaucccagcagag

SEQ ID NO: 2620999 - RNA, 17 nt, Escherichia coli CFT073
gucaucacgcagcguga

SEQ ID NO: 2621000 - RNA, 22 nt, Escherichia coli CFT073
gucaucacgcagcgugaagcua

SEQ ID NO: 2621001 - RNA, 20 nt, Escherichia coli CFT073
gucaucagcgccaacccgcu

SEQ ID NO: 2621002 - RNA, 14 nt, Escherichia coli CFT073
gucaucaucacuuu

SEQ ID NO: 2621003 - RNA, 23 nt, Escherichia coli CFT073
gucaucaucacuuuuuccggugc

SEQ ID NO: 2621004 - RNA, 17 nt, Escherichia coli CFT073
gucaucaucggcugcgc

SEQ ID NO: 2621005 - RNA, 20 nt, Escherichia coli CFT073
gucaucccccaguggcagca

SEQ ID NO: 2621006 - RNA, 15 nt, Escherichia coli CFT073
gucaucccuuccugc

SEQ ID NO: 2621007 - RNA, 16 nt, Escherichia coli CFT073
gucaucgacagcaaau

SEQ ID NO: 2621008 - RNA, 19 nt, Escherichia coli CFT073
gucaucgacgucagcagau

SEQ ID NO: 2621009 - RNA, 22 nt, Escherichia coli CFT073
gucaucgcaucguacaucacga

SEQ ID NO: 2621010 - RNA, 18 nt, Escherichia coli CFT073
gucaucgcccuguuccug

SEQ ID NO: 2621011 - RNA, 13 nt, Escherichia coli CFT073
gucaucgcguuaa

SEQ ID NO: 2621012 - RNA, 18 nt, Escherichia coli CFT073
gucaucgggcguuuucuu

SEQ ID NO: 2621013 - RNA, 19 nt, Escherichia coli CFT073
gucaucuguaagcaauuau

SEQ ID NO: 2621014 - RNA, 14 nt, Escherichia coli CFT073
gucaugacauucau

SEQ ID NO: 2621015 - RNA, 15 nt, Escherichia coli CFT073
gucaugccuuucuua

SEQ ID NO: 2621016 - RNA, 18 nt, Escherichia coli CFT073
gucaugcuccugauuggc

SEQ ID NO: 2621017 - RNA, 12 nt, Escherichia coli CFT073
gucaugucggca

SEQ ID NO: 2621018 - RNA, 19 nt, Escherichia coli CFT073
gucaugucucucagagaau

SEQ ID NO: 2621019 - RNA, 16 nt, Escherichia coli CFT073
gucauuaauacaucaa

SEQ ID NO: 2621020 - RNA, 15 nt, Escherichia coli CFT073
gucauuaucgcugac

SEQ ID NO: 2621021 - RNA, 15 nt, Escherichia coli CFT073
gucauuaugcuggaa

SEQ ID NO: 2621022 - RNA, 20 nt, Escherichia coli CFT073
gucauugaauguugacgcua

SEQ ID NO: 2621023 - RNA, 14 nt, Escherichia coli CFT073
gucauugacgcugg

SEQ ID NO: 2621024 - RNA, 13 nt, Escherichia coli CFT073
gucauugccugau

SEQ ID NO: 2621025 - RNA, 22 nt, Escherichia coli CFT073
gucauugccugauguugauaaa

SEQ ID NO: 2621026 - RNA, 19 nt, Escherichia coli CFT073
gucauugccuguucgccgc

SEQ ID NO: 2621027 - RNA, 20 nt, Escherichia coli CFT073
gucauuggccggaauaccac

SEQ ID NO: 2621028 - RNA, 21 nt, Escherichia coli CFT073
gucauuuuacguguuucagaa

SEQ ID NO: 2621029 - RNA, 12 nt, Escherichia coli CFT073
gucauuuugucg

SEQ ID NO: 2621030 - RNA, 22 nt, Escherichia coli CFT073
guccaagaacuaguagcaugaa

SEQ ID NO: 2621031 - RNA, 13 nt, Escherichia coli CFT073
guccaaucagcac

SEQ ID NO: 2621032 - RNA, 18 nt, Escherichia coli CFT073
guccacccauagcccaug

SEQ ID NO: 2621033 - RNA, 15 nt, Escherichia coli CFT073
guccacccccauaau

SEQ ID NO: 2621034 - RNA, 13 nt, Escherichia coli CFT073
guccaccuggccu

SEQ ID NO: 2621035 - RNA, 15 nt, Escherichia coli CFT073
guccaccuggccugc

SEQ ID NO: 2621036 - RNA, 13 nt, Escherichia coli CFT073
guccacuuccugc

SEQ ID NO: 2621037 - RNA, 21 nt, Escherichia coli CFT073
guccagcccuccucacuguug

SEQ ID NO: 2621038 - RNA, 16 nt, Escherichia coli CFT073
guccagcccuucucgc

SEQ ID NO: 2621039 - RNA, 12 nt, Escherichia coli CFT073
guccagcgccug

SEQ ID NO: 2621040 - RNA, 18 nt, Escherichia coli CFT073
guccagcuccguccagcc

SEQ ID NO: 2621041 - RNA, 22 nt, Escherichia coli CFT073
guccagcugccugcggcgaucu

SEQ ID NO: 2621042 - RNA, 22 nt, Escherichia coli CFT073
guccagcuuuucgauaacccug

SEQ ID NO: 2621043 - RNA, 14 nt, Escherichia coli CFT073
guccaggccugauu

SEQ ID NO: 2621044 - RNA, 17 nt, Escherichia coli CFT073
guccagugcaacuuuac

SEQ ID NO: 2621045 - RNA, 22 nt, Escherichia coli CFT073
guccagugcaacuuuacuaaaa

SEQ ID NO: 2621046 - RNA, 18 nt, Escherichia coli CFT073
guccaguucccaaccauu

SEQ ID NO: 2621047 - RNA, 13 nt, Escherichia coli CFT073
guccauaaaccgu

SEQ ID NO: 2621048 - RNA, 20 nt, Escherichia coli CFT073
guccauaaauuauagaugca

SEQ ID NO: 2621049 - RNA, 22 nt, Escherichia coli CFT073
guccauauuucgucgcaucaca

SEQ ID NO: 2621050 - RNA, 17 nt, Escherichia coli CFT073
guccaucacaaucagcu

SEQ ID NO: 2621051 - RNA, 17 nt, Escherichia coli CFT073
guccauccauacgggca

SEQ ID NO: 2621052 - RNA, 16 nt, Escherichia coli CFT073
guccaucccacacugu

SEQ ID NO: 2621053 - RNA, 13 nt, Escherichia coli CFT073
gucccacaguugu

SEQ ID NO: 2621054 - RNA, 22 nt, Escherichia coli CFT073
gucccacaguuguccauuaaua

SEQ ID NO: 2621055 - RNA, 18 nt, Escherichia coli CFT073
gucccagauagcuguccc

SEQ ID NO: 2621056 - RNA, 14 nt, Escherichia coli CFT073
gucccaugaugcgc

SEQ ID NO: 2621057 - RNA, 17 nt, Escherichia coli CFT073
guccccaaaaaagccac

SEQ ID NO: 2621058 - RNA, 17 nt, Escherichia coli CFT073
gucccccaagacugagu

SEQ ID NO: 2621059 - RNA, 16 nt, Escherichia coli CFT073
gucccgauaaccgcaa

SEQ ID NO: 2621060 - RNA, 20 nt, Escherichia coli CFT073
gucccgauaaccgcaaaacc

SEQ ID NO: 2621061 - RNA, 17 nt, Escherichia coli CFT073
gucccggaauccuucau

SEQ ID NO: 2621062 - RNA, 19 nt, Escherichia coli CFT073
gucccggaauccuucaucu

SEQ ID NO: 2621063 - RNA, 14 nt, Escherichia coli CFT073
gucccguccuucau

SEQ ID NO: 2621064 - RNA, 23 nt, Escherichia coli CFT073
gucccuaauaccguuccaacgcc

SEQ ID NO: 2621065 - RNA, 16 nt, Escherichia coli CFT073
gucccugcucuuucag

SEQ ID NO: 2621066 - RNA, 23 nt, Escherichia coli CFT073
gucccuuccgcaauacagccagc

SEQ ID NO: 2621067 - RNA, 15 nt, Escherichia coli CFT073
gucccuugcugguca

SEQ ID NO: 2621068 - RNA, 12 nt, Escherichia coli CFT073
gucccuuucagg

SEQ ID NO: 2621069 - RNA, 18 nt, Escherichia coli CFT073
guccgagcggcaccacga

SEQ ID NO: 2621070 - RNA, 15 nt, Escherichia coli CFT073
guccgaugccguuaa

SEQ ID NO: 2621071 - RNA, 21 nt, Escherichia coli CFT073
guccgauuuguucucuucugc

SEQ ID NO: 2621072 - RNA, 20 nt, Escherichia coli CFT073
guccgcaauacaucaaagcg

SEQ ID NO: 2621073 - RNA, 21 nt, Escherichia coli CFT073
guccgcauccccuacucucug

SEQ ID NO: 2621074 - RNA, 17 nt, Escherichia coli CFT073
guccgcgcagccgcuga

SEQ ID NO: 2621075 - RNA, 22 nt, Escherichia coli CFT073
guccgcgcgcaccguccagcgu

SEQ ID NO: 2621076 - RNA, 16 nt, Escherichia coli CFT073
guccggcaccagcgcu

SEQ ID NO: 2621077 - RNA, 17 nt, Escherichia coli CFT073
guccggcaccagcgcug

SEQ ID NO: 2621078 - RNA, 17 nt, Escherichia coli CFT073
guccggcagcagaaagc

SEQ ID NO: 2621079 - RNA, 14 nt, Escherichia coli CFT073
guccggcgcugcaa

SEQ ID NO: 2621080 - RNA, 15 nt, Escherichia coli CFT073
guccguaacgcucaa

SEQ ID NO: 2621081 - RNA, 12 nt, Escherichia coli CFT073
guccguugaaau

SEQ ID NO: 2621082 - RNA, 16 nt, Escherichia coli CFT073
guccugcaaggugguc

SEQ ID NO: 2621083 - RNA, 19 nt, Escherichia coli CFT073
guccugcauuguuccacuc

SEQ ID NO: 2621084 - RNA, 22 nt, Escherichia coli CFT073
guccugcccgacgacgucgcug

SEQ ID NO: 2621085 - RNA, 13 nt, Escherichia coli CFT073
guccuggcgcugu

SEQ ID NO: 2621086 - RNA, 19 nt, Escherichia coli CFT073
guccuggguauaaaacuca

SEQ ID NO: 2621087 - RNA, 22 nt, Escherichia coli CFT073
guccuggguauaaaacucaccg

SEQ ID NO: 2621088 - RNA, 14 nt, Escherichia coli CFT073
guccuguaacgcag

SEQ ID NO: 2621089 - RNA, 18 nt, Escherichia coli CFT073
guccuucaauaucauuac

SEQ ID NO: 2621090 - RNA, 18 nt, Escherichia coli CFT073
gucgaauugcaucuacgc

SEQ ID NO: 2621091 - RNA, 18 nt, Escherichia coli CFT073
gucgacaauccagucagc

SEQ ID NO: 2621092 - RNA, 19 nt, Escherichia coli CFT073
gucgacaauccagucagcg

SEQ ID NO: 2621093 - RNA, 14 nt, Escherichia coli CFT073
gucgacauaaucaa

SEQ ID NO: 2621094 - RNA, 18 nt, Escherichia coli CFT073
gucgacauagccaucccu

SEQ ID NO: 2621095 - RNA, 20 nt, Escherichia coli CFT073
gucgagaaucaacacaccgc

SEQ ID NO: 2621096 - RNA, 19 nt, Escherichia coli CFT073
gucgagguuauaaaccccc

SEQ ID NO: 2621097 - RNA, 18 nt, Escherichia coli CFT073
gucgauaaacaucgccau

SEQ ID NO: 2621098 - RNA, 19 nt, Escherichia coli CFT073
gucgauaaacaucgccaua

SEQ ID NO: 2621099 - RNA, 15 nt, Escherichia coli CFT073
gucgauacgcgcuaa

SEQ ID NO: 2621100 - RNA, 15 nt, Escherichia coli CFT073
gucgauaucaaccag

SEQ ID NO: 2621101 - RNA, 17 nt, Escherichia coli CFT073
gucgauaucgauaauca

SEQ ID NO: 2621102 - RNA, 12 nt, Escherichia coli CFT073
gucgaucagacc

SEQ ID NO: 2621103 - RNA, 17 nt, Escherichia coli CFT073
gucgaugggggagguca

SEQ ID NO: 2621104 - RNA, 16 nt, Escherichia coli CFT073
gucgauucgccgucuc

SEQ ID NO: 2621105 - RNA, 16 nt, Escherichia coli CFT073
gucgauugcucaacac

SEQ ID NO: 2621106 - RNA, 22 nt, Escherichia coli CFT073
gucgauuuucacauaagcugaa

SEQ ID NO: 2621107 - RNA, 14 nt, Escherichia coli CFT073
gucgcaaaacucac

SEQ ID NO: 2621108 - RNA, 22 nt, Escherichia coli CFT073
gucgcaagacgaaaaaugaaua

SEQ ID NO: 2621109 - RNA, 22 nt, Escherichia coli CFT073
gucgcagacaaggcgauuuggg

SEQ ID NO: 2621110 - RNA, 14 nt, Escherichia coli CFT073
gucgcagccagcgc

SEQ ID NO: 2621111 - RNA, 15 nt, Escherichia coli CFT073
gucgcagccagcgca

SEQ ID NO: 2621112 - RNA, 22 nt, Escherichia coli CFT073
gucgcaucaggcauugugucug

SEQ ID NO: 2621113 - RNA, 21 nt, Escherichia coli CFT073
gucgcauccaacaauaaaaag

SEQ ID NO: 2621114 - RNA, 12 nt, Escherichia coli CFT073
gucgcauccggc

SEQ ID NO: 2621115 - RNA, 13 nt, Escherichia coli CFT073
gucgcauccggca

SEQ ID NO: 2621116 - RNA, 18 nt, Escherichia coli CFT073
gucgcauccggcaauuac

SEQ ID NO: 2621117 - RNA, 17 nt, Escherichia coli CFT073
gucgcauccggcaucaa

SEQ ID NO: 2621118 - RNA, 18 nt, Escherichia coli CFT073
gucgcauccggcauuauc

SEQ ID NO: 2621119 - RNA, 13 nt, Escherichia coli CFT073
gucgcaucuggca

SEQ ID NO: 2621120 - RNA, 11 nt, Escherichia coli CFT073
gucgcaucuuc

SEQ ID NO: 2621121 - RNA, 22 nt, Escherichia coli CFT073
gucgcauggggaucgugauaau

SEQ ID NO: 2621122 - RNA, 14 nt, Escherichia coli CFT073
gucgccaacuucau

SEQ ID NO: 2621123 - RNA, 16 nt, Escherichia coli CFT073
gucgccaacuucauga

SEQ ID NO: 2621124 - RNA, 15 nt, Escherichia coli CFT073
gucgccaaugcgcaa

SEQ ID NO: 2621125 - RNA, 20 nt, Escherichia coli CFT073
gucgccaccauacugguagg

SEQ ID NO: 2621126 - RNA, 19 nt, Escherichia coli CFT073
gucgccagaaacaccguca

SEQ ID NO: 2621127 - RNA, 14 nt, Escherichia coli CFT073
gucgccagaaauca

SEQ ID NO: 2621128 - RNA, 12 nt, Escherichia coli CFT073
gucgccagcaau

SEQ ID NO: 2621129 - RNA, 12 nt, Escherichia coli CFT073
gucgccagcgcc

SEQ ID NO: 2621130 - RNA, 14 nt, Escherichia coli CFT073
gucgccagcucuuc

SEQ ID NO: 2621131 - RNA, 13 nt, Escherichia coli CFT073
gucgccaucguca

SEQ ID NO: 2621132 - RNA, 13 nt, Escherichia coli CFT073
gucgccaugcggu

SEQ ID NO: 2621133 - RNA, 22 nt, Escherichia coli CFT073
gucgcccgaugccagcacagau

SEQ ID NO: 2621134 - RNA, 13 nt, Escherichia coli CFT073
gucgcccuguaau

SEQ ID NO: 2621135 - RNA, 15 nt, Escherichia coli CFT073
gucgccgaagcagcu

SEQ ID NO: 2621136 - RNA, 19 nt, Escherichia coli CFT073
gucgccgguuugcaguaug

SEQ ID NO: 2621137 - RNA, 12 nt, Escherichia coli CFT073
gucgccguaagc

SEQ ID NO: 2621138 - RNA, 23 nt, Escherichia coli CFT073
gucgccgucaggcaagccgcuaa

SEQ ID NO: 2621139 - RNA, 14 nt, Escherichia coli CFT073
gucgccuaccauca

SEQ ID NO: 2621140 - RNA, 15 nt, Escherichia coli CFT073
gucgccucgccgagc

SEQ ID NO: 2621141 - RNA, 18 nt, Escherichia coli CFT073
gucgccucgccgagcagc

SEQ ID NO: 2621142 - RNA, 19 nt, Escherichia coli CFT073
gucgccucgccgagcagcu

SEQ ID NO: 2621143 - RNA, 21 nt, Escherichia coli CFT073
gucgccugacguacaccauuu

SEQ ID NO: 2621144 - RNA, 22 nt, Escherichia coli CFT073
gucgcgaauucauguucgguaa

SEQ ID NO: 2621145 - RNA, 18 nt, Escherichia coli CFT073
gucgcgcaauugccagac

SEQ ID NO: 2621146 - RNA, 15 nt, Escherichia coli CFT073
gucgcgcgcgguggc

SEQ ID NO: 2621147 - RNA, 14 nt, Escherichia coli CFT073
gucgcgcugggcuu

SEQ ID NO: 2621148 - RNA, 21 nt, Escherichia coli CFT073
gucgcggaccaacaaaaaucu

SEQ ID NO: 2621149 - RNA, 20 nt, Escherichia coli CFT073
gucgcggcaaauuacuggcg

SEQ ID NO: 2621150 - RNA, 18 nt, Escherichia coli CFT073
gucgcguagccaggcggc

SEQ ID NO: 2621151 - RNA, 21 nt, Escherichia coli CFT073
gucgcguuugcccgcaacggc

SEQ ID NO: 2621152 - RNA, 22 nt, Escherichia coli CFT073
gucgcuaagcacgauaucaaua

SEQ ID NO: 2621153 - RNA, 23 nt, Escherichia coli CFT073
gucgcucacuucacgcugccagc

SEQ ID NO: 2621154 - RNA, 15 nt, Escherichia coli CFT073
gucgcugagcgugcc

SEQ ID NO: 2621155 - RNA, 12 nt, Escherichia coli CFT073
gucgcugaucac

SEQ ID NO: 2621156 - RNA, 18 nt, Escherichia coli CFT073
gucgcugauucgcuucaa

SEQ ID NO: 2621157 - RNA, 15 nt, Escherichia coli CFT073
gucgcugcugccugc

SEQ ID NO: 2621158 - RNA, 22 nt, Escherichia coli CFT073
gucgcuggaugcgaugcuggcg

SEQ ID NO: 2621159 - RNA, 17 nt, Escherichia coli CFT073
gucgcugugacauccag

SEQ ID NO: 2621160 - RNA, 13 nt, Escherichia coli CFT073
gucgcuucacgca

SEQ ID NO: 2621161 - RNA, 22 nt, Escherichia coli CFT073
gucgcuucgcgaaucgccacaa

SEQ ID NO: 2621162 - RNA, 16 nt, Escherichia coli CFT073
gucgcuuuaacgcccu

SEQ ID NO: 2621163 - RNA, 12 nt, Escherichia coli CFT073
gucggaacaucg

SEQ ID NO: 2621164 - RNA, 17 nt, Escherichia coli CFT073
gucggaaucccaucgca

SEQ ID NO: 2621165 - RNA, 13 nt, Escherichia coli CFT073
gucggauaagacg

SEQ ID NO: 2621166 - RNA, 15 nt, Escherichia coli CFT073
gucggauaagacgcg

SEQ ID NO: 2621167 - RNA, 16 nt, Escherichia coli CFT073
gucggauaagacgcgc

SEQ ID NO: 2621168 - RNA, 20 nt, Escherichia coli CFT073
gucggauaagacgcgucagc

SEQ ID NO: 2621169 - RNA, 23 nt, Escherichia coli CFT073
gucggauaaggcguuuacgccgc

SEQ ID NO: 2621170 - RNA, 15 nt, Escherichia coli CFT073
gucggcaaagcgggc

SEQ ID NO: 2621171 - RNA, 19 nt, Escherichia coli CFT073
gucggcaagauacugcaua

SEQ ID NO: 2621172 - RNA, 14 nt, Escherichia coli CFT073
gucggcaaucgcaa

SEQ ID NO: 2621173 - RNA, 22 nt, Escherichia coli CFT073
gucggcagauaccaccacagca

SEQ ID NO: 2621174 - RNA, 13 nt, Escherichia coli CFT073
gucggcaguucgu

SEQ ID NO: 2621175 - RNA, 21 nt, Escherichia coli CFT073
gucggcaucguaauuuaacaa

SEQ ID NO: 2621176 - RNA, 19 nt, Escherichia coli CFT073
gucggcaugauaagacgcg

SEQ ID NO: 2621177 - RNA, 21 nt, Escherichia coli CFT073
gucggcgagauauucccccac

SEQ ID NO: 2621178 - RNA, 14 nt, Escherichia coli CFT073
gucggcgugaacgc

SEQ ID NO: 2621179 - RNA, 14 nt, Escherichia coli CFT073
gucggcuucacgcc

SEQ ID NO: 2621180 - RNA, 14 nt, Escherichia coli CFT073
gucggcuuucucau

SEQ ID NO: 2621181 - RNA, 21 nt, Escherichia coli CFT073
gucggcuuugcccaucugggc

SEQ ID NO: 2621182 - RNA, 16 nt, Escherichia coli CFT073
gucgggacacgaacgu

SEQ ID NO: 2621183 - RNA, 14 nt, Escherichia coli CFT073
gucgggcaucagaa

SEQ ID NO: 2621184 - RNA, 20 nt, Escherichia coli CFT073
gucgggccacgcugcgcuug

SEQ ID NO: 2621185 - RNA, 13 nt, Escherichia coli CFT073
gucgggccgauaa

SEQ ID NO: 2621186 - RNA, 15 nt, Escherichia coli CFT073
gucggggccagcgca

SEQ ID NO: 2621187 - RNA, 19 nt, Escherichia coli CFT073
gucggggccagcgcaucca

SEQ ID NO: 2621188 - RNA, 14 nt, Escherichia coli CFT073
gucggggucgcgag

SEQ ID NO: 2621189 - RNA, 21 nt, Escherichia coli CFT073
gucgguauuaucacuaucggu

SEQ ID NO: 2621190 - RNA, 24 nt, Escherichia coli CFT073
gucggugccaucauacagccagca

SEQ ID NO: 2621191 - RNA, 22 nt, Escherichia coli CFT073
gucggugcucauuagcccggca

SEQ ID NO: 2621192 - RNA, 23 nt, Escherichia coli CFT073
gucgguguuaacaaugguggugg

SEQ ID NO: 2621193 - RNA, 15 nt, Escherichia coli CFT073
gucgguuaccaguac

SEQ ID NO: 2621194 - RNA, 18 nt, Escherichia coli CFT073
gucgguucguaggccaga

SEQ ID NO: 2621195 - RNA, 19 nt, Escherichia coli CFT073
gucgguuucgcgcaggauc

SEQ ID NO: 2621196 - RNA, 14 nt, Escherichia coli CFT073
gucguaagcgccaa

SEQ ID NO: 2621197 - RNA, 15 nt, Escherichia coli CFT073
gucguaggccugaua

SEQ ID NO: 2621198 - RNA, 16 nt, Escherichia coli CFT073
gucgucaguuccauaa

SEQ ID NO: 2621199 - RNA, 17 nt, Escherichia coli CFT073
gucgucaucccaguccu

SEQ ID NO: 2621200 - RNA, 14 nt, Escherichia coli CFT073
gucguccggacugg

SEQ ID NO: 2621201 - RNA, 19 nt, Escherichia coli CFT073
gucguccucuucgggggag

SEQ ID NO: 2621202 - RNA, 14 nt, Escherichia coli CFT073
gucgugaaacgcgu

SEQ ID NO: 2621203 - RNA, 22 nt, Escherichia coli CFT073
gucgugaaugccguaggcccag

SEQ ID NO: 2621204 - RNA, 14 nt, Escherichia coli CFT073
gucguuaugcacgc

SEQ ID NO: 2621205 - RNA, 17 nt, Escherichia coli CFT073
gucguucaacaagccac

SEQ ID NO: 2621206 - RNA, 22 nt, Escherichia coli CFT073
gucguucgccagucuccaggca

SEQ ID NO: 2621207 - RNA, 20 nt, Escherichia coli CFT073
gucguugcugucgcgcagca

SEQ ID NO: 2621208 - RNA, 15 nt, Escherichia coli CFT073
gucguugucuggcug

SEQ ID NO: 2621209 - RNA, 16 nt, Escherichia coli CFT073
gucguugucuggcugg

SEQ ID NO: 2621210 - RNA, 19 nt, Escherichia coli CFT073
gucguugucuggcuggugg

SEQ ID NO: 2621211 - RNA, 20 nt, Escherichia coli CFT073
gucguugucuggcuggugga

SEQ ID NO: 2621212 - RNA, 23 nt, Escherichia coli CFT073
gucuaacaugagauccagcgagc

SEQ ID NO: 2621213 - RNA, 15 nt, Escherichia coli CFT073
gucuaacgaugccag

SEQ ID NO: 2621214 - RNA, 19 nt, Escherichia coli CFT073
gucuaacgaugccagcgcu

SEQ ID NO: 2621215 - RNA, 16 nt, Escherichia coli CFT073
gucuaagguaaaacaa

SEQ ID NO: 2621216 - RNA, 15 nt, Escherichia coli CFT073
gucuacauugcucau

SEQ ID NO: 2621217 - RNA, 12 nt, Escherichia coli CFT073
gucuaccagcac

SEQ ID NO: 2621218 - RNA, 23 nt, Escherichia coli CFT073
gucuaccaguuuggugacgccac

SEQ ID NO: 2621219 - RNA, 19 nt, Escherichia coli CFT073
gucucagcaccgucuggca

SEQ ID NO: 2621220 - RNA, 11 nt, Escherichia coli CFT073
gucucaucgcu

SEQ ID NO: 2621221 - RNA, 17 nt, Escherichia coli CFT073
gucucaugcgucaugag

SEQ ID NO: 2621222 - RNA, 18 nt, Escherichia coli CFT073
gucuccaccuuaucgaca

SEQ ID NO: 2621223 - RNA, 17 nt, Escherichia coli CFT073
gucuccauuuuuuugca

SEQ ID NO: 2621224 - RNA, 17 nt, Escherichia coli CFT073
gucucugguacgccugc

SEQ ID NO: 2621225 - RNA, 19 nt, Escherichia coli CFT073
gucucuugccgguuuugca

SEQ ID NO: 2621226 - RNA, 16 nt, Escherichia coli CFT073
gucucuuuuuucagaa

SEQ ID NO: 2621227 - RNA, 18 nt, Escherichia coli CFT073
gucucuuuuuucagaaua

SEQ ID NO: 2621228 - RNA, 16 nt, Escherichia coli CFT073
gucugaacguucugcu

SEQ ID NO: 2621229 - RNA, 17 nt, Escherichia coli CFT073
gucugaacguucugcug

SEQ ID NO: 2621230 - RNA, 19 nt, Escherichia coli CFT073
gucugaaucagucccugaa

SEQ ID NO: 2621231 - RNA, 20 nt, Escherichia coli CFT073
gucugaccucuucuacugca

SEQ ID NO: 2621232 - RNA, 16 nt, Escherichia coli CFT073
gucugauaaaaaaccc

SEQ ID NO: 2621233 - RNA, 19 nt, Escherichia coli CFT073
gucugaucggcaaucacgc

SEQ ID NO: 2621234 - RNA, 13 nt, Escherichia coli CFT073
gucugaugcgacg

SEQ ID NO: 2621235 - RNA, 20 nt, Escherichia coli CFT073
gucugaugcgacgcggcagc

SEQ ID NO: 2621236 - RNA, 14 nt, Escherichia coli CFT073
gucugcagacugaa

SEQ ID NO: 2621237 - RNA, 13 nt, Escherichia coli CFT073
gucugcagauggc

SEQ ID NO: 2621238 - RNA, 17 nt, Escherichia coli CFT073
gucugccacuucuucca

SEQ ID NO: 2621239 - RNA, 20 nt, Escherichia coli CFT073
gucugccacuucuuccagcg

SEQ ID NO: 2621240 - RNA, 20 nt, Escherichia coli CFT073
gucugccuuucggugaauac

SEQ ID NO: 2621241 - RNA, 21 nt, Escherichia coli CFT073
gucugccuuucggugaauacc

SEQ ID NO: 2621242 - RNA, 16 nt, Escherichia coli CFT073
gucugcggugcgccaa

SEQ ID NO: 2621243 - RNA, 20 nt, Escherichia coli CFT073
gucugcgucaucggcagcau

SEQ ID NO: 2621244 - RNA, 21 nt, Escherichia coli CFT073
gucugcugugugauccacugc

SEQ ID NO: 2621245 - RNA, 18 nt, Escherichia coli CFT073
gucuggaagaccagcgaa

SEQ ID NO: 2621246 - RNA, 17 nt, Escherichia coli CFT073
gucuggauugcagagaa

SEQ ID NO: 2621247 - RNA, 16 nt, Escherichia coli CFT073
gucuggauuuacugca

SEQ ID NO: 2621248 - RNA, 22 nt, Escherichia coli CFT073
gucuggcacgaccgccuuucac

SEQ ID NO: 2621249 - RNA, 20 nt, Escherichia coli CFT073
gucugggcgagguccagcuc

SEQ ID NO: 2621250 - RNA, 18 nt, Escherichia coli CFT073
gucuggguauucagcgau

SEQ ID NO: 2621251 - RNA, 15 nt, Escherichia coli CFT073
gucugguaaagcaga

SEQ ID NO: 2621252 - RNA, 16 nt, Escherichia coli CFT073
gucugguaucgcgcca

SEQ ID NO: 2621253 - RNA, 17 nt, Escherichia coli CFT073
gucuggugaauccccuu

SEQ ID NO: 2621254 - RNA, 14 nt, Escherichia coli CFT073
gucugguuuuccuu

SEQ ID NO: 2621255 - RNA, 15 nt, Escherichia coli CFT073
gucugucaaauucac

SEQ ID NO: 2621256 - RNA, 18 nt, Escherichia coli CFT073
gucuguccggggagaacg

SEQ ID NO: 2621257 - RNA, 22 nt, Escherichia coli CFT073
gucuuacagggcguauaacaca

SEQ ID NO: 2621258 - RNA, 21 nt, Escherichia coli CFT073
gucuuaucaggccuacacguu

SEQ ID NO: 2621259 - RNA, 20 nt, Escherichia coli CFT073
gucuuaucaggccuacaggu

SEQ ID NO: 2621260 - RNA, 16 nt, Escherichia coli CFT073
gucuuaucaugccuac

SEQ ID NO: 2621261 - RNA, 17 nt, Escherichia coli CFT073
gucuuauccgaccugcg

SEQ ID NO: 2621262 - RNA, 14 nt, Escherichia coli CFT073
gucuucaaccgcag

SEQ ID NO: 2621263 - RNA, 18 nt, Escherichia coli CFT073
gucuucacaaccgccauc

SEQ ID NO: 2621264 - RNA, 19 nt, Escherichia coli CFT073
gucuucccgagacaucccu

SEQ ID NO: 2621265 - RNA, 21 nt, Escherichia coli CFT073
gucuucccgagacaucccuuu

SEQ ID NO: 2621266 - RNA, 14 nt, Escherichia coli CFT073
gucuucccgcagcc

SEQ ID NO: 2621267 - RNA, 12 nt, Escherichia coli CFT073
gucuucccggcu

SEQ ID NO: 2621268 - RNA, 21 nt, Escherichia coli CFT073
gucuucccugcugaauccccu

SEQ ID NO: 2621269 - RNA, 21 nt, Escherichia coli CFT073
gucuuccgcaauuccgcccgu

SEQ ID NO: 2621270 - RNA, 17 nt, Escherichia coli CFT073
gucuuccggcuguagcc

SEQ ID NO: 2621271 - RNA, 16 nt, Escherichia coli CFT073
gucuuccgggaacggc

SEQ ID NO: 2621272 - RNA, 17 nt, Escherichia coli CFT073
gucuuccgucacaggca

SEQ ID NO: 2621273 - RNA, 10 nt, Escherichia coli CFT073
gucuuccugc

SEQ ID NO: 2621274 - RNA, 15 nt, Escherichia coli CFT073
gucuucguacuacgc

SEQ ID NO: 2621275 - RNA, 22 nt, Escherichia coli CFT073
gucuucguacuacgcgccgcca

SEQ ID NO: 2621276 - RNA, 21 nt, Escherichia coli CFT073
gucuucgucccagucgucauc

SEQ ID NO: 2621277 - RNA, 20 nt, Escherichia coli CFT073
gucuucugcagucaccugcg

SEQ ID NO: 2621278 - RNA, 14 nt, Escherichia coli CFT073
gucuucuucguaac

SEQ ID NO: 2621279 - RNA, 15 nt, Escherichia coli CFT073
gucuugccucccugc

SEQ ID NO: 2621280 - RNA, 13 nt, Escherichia coli CFT073
gucuugcguuucu

SEQ ID NO: 2621281 - RNA, 15 nt, Escherichia coli CFT073
gucuuguuacuggcu

SEQ ID NO: 2621282 - RNA, 14 nt, Escherichia coli CFT073
gucuuuaccgcugu

SEQ ID NO: 2621283 - RNA, 15 nt, Escherichia coli CFT073
gucuuuauccagcac

SEQ ID NO: 2621284 - RNA, 20 nt, Escherichia coli CFT073
gucuuuauccagcaccacua

SEQ ID NO: 2621285 - RNA, 17 nt, Escherichia coli CFT073
gucuuucaacagauaac

SEQ ID NO: 2621286 - RNA, 22 nt, Escherichia coli CFT073
gucuuucaguucgccuuccagc

SEQ ID NO: 2621287 - RNA, 16 nt, Escherichia coli CFT073
gucuuugcgcuccauc

SEQ ID NO: 2621288 - RNA, 19 nt, Escherichia coli CFT073
gucuuugcguuuggcauca

SEQ ID NO: 2621289 - RNA, 13 nt, Escherichia coli CFT073
gucuuuugaucaa

SEQ ID NO: 2621290 - RNA, 14 nt, Escherichia coli CFT073
gugaaaaaagcaag

SEQ ID NO: 2621291 - RNA, 16 nt, Escherichia coli CFT073
gugaaaaaagcaagau

SEQ ID NO: 2621292 - RNA, 21 nt, Escherichia coli CFT073
gugaaaaaccaaucucccagc

SEQ ID NO: 2621293 - RNA, 13 nt, Escherichia coli CFT073
gugaaaaauaaaa

SEQ ID NO: 2621294 - RNA, 22 nt, Escherichia coli CFT073
gugaaaacgacgcgguauuggu

SEQ ID NO: 2621295 - RNA, 14 nt, Escherichia coli CFT073
gugaaaaucgaguu

SEQ ID NO: 2621296 - RNA, 14 nt, Escherichia coli CFT073
gugaaacaccugca

SEQ ID NO: 2621297 - RNA, 17 nt, Escherichia coli CFT073
gugaaacaguaaguuca

SEQ ID NO: 2621298 - RNA, 13 nt, Escherichia coli CFT073
gugaaagaaaaug

SEQ ID NO: 2621299 - RNA, 11 nt, Escherichia coli CFT073
gugaaagagau

SEQ ID NO: 2621300 - RNA, 21 nt, Escherichia coli CFT073
gugaaagagccaucauucugc

SEQ ID NO: 2621301 - RNA, 12 nt, Escherichia coli CFT073
gugaaagcaaaa

SEQ ID NO: 2621302 - RNA, 17 nt, Escherichia coli CFT073
gugaaauaaaaucagca

SEQ ID NO: 2621303 - RNA, 22 nt, Escherichia coli CFT073
gugaaauaaaaucagcaaggaa

SEQ ID NO: 2621304 - RNA, 16 nt, Escherichia coli CFT073
gugaaauacaguuauc

SEQ ID NO: 2621305 - RNA, 20 nt, Escherichia coli CFT073
gugaaaucagccguuucacc

SEQ ID NO: 2621306 - RNA, 22 nt, Escherichia coli CFT073
gugaaaucagccguuucaccac

SEQ ID NO: 2621307 - RNA, 14 nt, Escherichia coli CFT073
gugaacaccuuauc

SEQ ID NO: 2621308 - RNA, 20 nt, Escherichia coli CFT073
gugaacaccuuauccggccu

SEQ ID NO: 2621309 - RNA, 17 nt, Escherichia coli CFT073
gugaacccggcgauuga

SEQ ID NO: 2621310 - RNA, 13 nt, Escherichia coli CFT073
gugaacgccacca

SEQ ID NO: 2621311 - RNA, 17 nt, Escherichia coli CFT073
gugaacgccaccaacgc

SEQ ID NO: 2621312 - RNA, 13 nt, Escherichia coli CFT073
gugaacgccuuau

SEQ ID NO: 2621313 - RNA, 14 nt, Escherichia coli CFT073
gugaacgccuuauc

SEQ ID NO: 2621314 - RNA, 20 nt, Escherichia coli CFT073
gugaacgccuucuccggccu

SEQ ID NO: 2621315 - RNA, 21 nt, Escherichia coli CFT073
gugaacugccacacaggccau

SEQ ID NO: 2621316 - RNA, 18 nt, Escherichia coli CFT073
gugaagagauccaccagc

SEQ ID NO: 2621317 - RNA, 20 nt, Escherichia coli CFT073
gugaagagauccaccagcgc

SEQ ID NO: 2621318 - RNA, 14 nt, Escherichia coli CFT073
gugaagcaccugcg

SEQ ID NO: 2621319 - RNA, 18 nt, Escherichia coli CFT073
gugaagcacguaaaucuu

SEQ ID NO: 2621320 - RNA, 15 nt, Escherichia coli CFT073
gugaaguaauaauca

SEQ ID NO: 2621321 - RNA, 15 nt, Escherichia coli CFT073
gugaagugcaaccgg

SEQ ID NO: 2621322 - RNA, 14 nt, Escherichia coli CFT073
gugaagugcugcaa

SEQ ID NO: 2621323 - RNA, 21 nt, Escherichia coli CFT073
gugaauaauugugcaauuacu

SEQ ID NO: 2621324 - RNA, 16 nt, Escherichia coli CFT073
gugaauaccugagaca

SEQ ID NO: 2621325 - RNA, 14 nt, Escherichia coli CFT073
gugaaucacuccau

SEQ ID NO: 2621326 - RNA, 15 nt, Escherichia coli CFT073
gugaaucacuccauc

SEQ ID NO: 2621327 - RNA, 20 nt, Escherichia coli CFT073
gugaauccccuuuauggugg

SEQ ID NO: 2621328 - RNA, 16 nt, Escherichia coli CFT073
gugaaucucaggcaaa

SEQ ID NO: 2621329 - RNA, 14 nt, Escherichia coli CFT073
gugaauucaucgua

SEQ ID NO: 2621330 - RNA, 17 nt, Escherichia coli CFT073
gugacaaucaccagguc

SEQ ID NO: 2621331 - RNA, 23 nt, Escherichia coli CFT073
gugacaccaccgcccgguuuuuu

SEQ ID NO: 2621332 - RNA, 16 nt, Escherichia coli CFT073
gugacaccaugcccgu

SEQ ID NO: 2621333 - RNA, 18 nt, Escherichia coli CFT073
gugacacgcgcgcauggu

SEQ ID NO: 2621334 - RNA, 12 nt, Escherichia coli CFT073
gugacagcagcg

SEQ ID NO: 2621335 - RNA, 20 nt, Escherichia coli CFT073
gugacaguguuauucccaac

SEQ ID NO: 2621336 - RNA, 13 nt, Escherichia coli CFT073
gugacauuaacca

SEQ ID NO: 2621337 - RNA, 11 nt, Escherichia coli CFT073
gugacauucug

SEQ ID NO: 2621338 - RNA, 22 nt, Escherichia coli CFT073
gugaccaucagcaugacaaaaa

SEQ ID NO: 2621339 - RNA, 13 nt, Escherichia coli CFT073
gugaccaucuucc

SEQ ID NO: 2621340 - RNA, 16 nt, Escherichia coli CFT073
gugacccgcagccagc

SEQ ID NO: 2621341 - RNA, 20 nt, Escherichia coli CFT073
gugaccgccuuauccggccu

SEQ ID NO: 2621342 - RNA, 14 nt, Escherichia coli CFT073
gugaccucuucggc

SEQ ID NO: 2621343 - RNA, 22 nt, Escherichia coli CFT073
gugacgaccuuuuccaucgcau

SEQ ID NO: 2621344 - RNA, 17 nt, Escherichia coli CFT073
gugacgaguccuuccug

SEQ ID NO: 2621345 - RNA, 14 nt, Escherichia coli CFT073
gugacgcuggcagc

SEQ ID NO: 2621346 - RNA, 22 nt, Escherichia coli CFT073
gugacggaaauggacgucaaaa

SEQ ID NO: 2621347 - RNA, 13 nt, Escherichia coli CFT073
gugacgucacuua

SEQ ID NO: 2621348 - RNA, 20 nt, Escherichia coli CFT073
gugacgucucaaucaccacc

SEQ ID NO: 2621349 - RNA, 17 nt, Escherichia coli CFT073
gugacguuucaucgcag

SEQ ID NO: 2621350 - RNA, 17 nt, Escherichia coli CFT073
gugacuagcagcauuuc

SEQ ID NO: 2621351 - RNA, 19 nt, Escherichia coli CFT073
gugacuagcagcauuucaa

SEQ ID NO: 2621352 - RNA, 16 nt, Escherichia coli CFT073
gugacugccgccagca

SEQ ID NO: 2621353 - RNA, 16 nt, Escherichia coli CFT073
gugacugcuuuuucaa

SEQ ID NO: 2621354 - RNA, 16 nt, Escherichia coli CFT073
gugacuggaaaucaaa

SEQ ID NO: 2621355 - RNA, 12 nt, Escherichia coli CFT073
gugacuggcaga

SEQ ID NO: 2621356 - RNA, 17 nt, Escherichia coli CFT073
gugacuggggggagcga

SEQ ID NO: 2621357 - RNA, 22 nt, Escherichia coli CFT073
gugacuucauucagaaaaacua

SEQ ID NO: 2621358 - RNA, 16 nt, Escherichia coli CFT073
gugacuuuaaaaaaau

SEQ ID NO: 2621359 - RNA, 15 nt, Escherichia coli CFT073
gugagcacaucagcg

SEQ ID NO: 2621360 - RNA, 20 nt, Escherichia coli CFT073
gugagcacaucagcgcccuc

SEQ ID NO: 2621361 - RNA, 18 nt, Escherichia coli CFT073
gugagcaugugcaauuuc

SEQ ID NO: 2621362 - RNA, 22 nt, Escherichia coli CFT073
gugagccaggacgauaaaccag

SEQ ID NO: 2621363 - RNA, 18 nt, Escherichia coli CFT073
gugagcgauugcuggccu

SEQ ID NO: 2621364 - RNA, 15 nt, Escherichia coli CFT073
gugagcuguccugua

SEQ ID NO: 2621365 - RNA, 21 nt, Escherichia coli CFT073
gugagcugucugucaaauuca

SEQ ID NO: 2621366 - RNA, 23 nt, Escherichia coli CFT073
gugaggaugcgagucaggccagg

SEQ ID NO: 2621367 - RNA, 17 nt, Escherichia coli CFT073
gugaggcggucuguauu

SEQ ID NO: 2621368 - RNA, 16 nt, Escherichia coli CFT073
gugagguuaucgcccu

SEQ ID NO: 2621369 - RNA, 20 nt, Escherichia coli CFT073
gugaguauauuucaggccaa

SEQ ID NO: 2621370 - RNA, 19 nt, Escherichia coli CFT073
gugagucauguugucuauu

SEQ ID NO: 2621371 - RNA, 14 nt, Escherichia coli CFT073
gugagucuggaaga

SEQ ID NO: 2621372 - RNA, 17 nt, Escherichia coli CFT073
gugaguugguuauucaa

SEQ ID NO: 2621373 - RNA, 22 nt, Escherichia coli CFT073
gugaguuugucgggcaggagcu

SEQ ID NO: 2621374 - RNA, 13 nt, Escherichia coli CFT073
gugauaaaaaucg

SEQ ID NO: 2621375 - RNA, 20 nt, Escherichia coli CFT073
gugauaaaagucaggcaauu

SEQ ID NO: 2621376 - RNA, 23 nt, Escherichia coli CFT073
gugauaaaagucaggcaauucuu

SEQ ID NO: 2621377 - RNA, 23 nt, Escherichia coli CFT073
gugauaaacccaacggcaaacau

SEQ ID NO: 2621378 - RNA, 22 nt, Escherichia coli CFT073
gugauaagcgaggccagccaga

SEQ ID NO: 2621379 - RNA, 15 nt, Escherichia coli CFT073
gugauaauaauucag

SEQ ID NO: 2621380 - RNA, 18 nt, Escherichia coli CFT073
gugauaggguacgaccca

SEQ ID NO: 2621381 - RNA, 19 nt, Escherichia coli CFT073
gugauauuacauaccagca

SEQ ID NO: 2621382 - RNA, 19 nt, Escherichia coli CFT073
gugauauucacguuuuuca

SEQ ID NO: 2621383 - RNA, 22 nt, Escherichia coli CFT073
gugaucacaucaucuaccagca

SEQ ID NO: 2621384 - RNA, 19 nt, Escherichia coli CFT073
gugaucacuuacgauuuua

SEQ ID NO: 2621385 - RNA, 18 nt, Escherichia coli CFT073
gugauccacccuugauua

SEQ ID NO: 2621386 - RNA, 17 nt, Escherichia coli CFT073
gugaucccuaacuggcg

SEQ ID NO: 2621387 - RNA, 17 nt, Escherichia coli CFT073
gugaucguggccaugac

SEQ ID NO: 2621388 - RNA, 20 nt, Escherichia coli CFT073
gugaucgugguggugaucgu

SEQ ID NO: 2621389 - RNA, 21 nt, Escherichia coli CFT073
gugaugaaaaacguugccgga

SEQ ID NO: 2621390 - RNA, 22 nt, Escherichia coli CFT073
gugaugccagcacucugugcgu

SEQ ID NO: 2621391 - RNA, 21 nt, Escherichia coli CFT073
gugaugcccggucgcuccggc

SEQ ID NO: 2621392 - RNA, 17 nt, Escherichia coli CFT073
gugaugcccugaugcgu

SEQ ID NO: 2621393 - RNA, 17 nt, Escherichia coli CFT073
gugaugccgcauccggc

SEQ ID NO: 2621394 - RNA, 16 nt, Escherichia coli CFT073
gugaugcggaaauauc

SEQ ID NO: 2621395 - RNA, 18 nt, Escherichia coli CFT073
gugaugcggcaucuguac

SEQ ID NO: 2621396 - RNA, 20 nt, Escherichia coli CFT073
gugaugcguccgcuaguggc

SEQ ID NO: 2621397 - RNA, 21 nt, Escherichia coli CFT073
gugauuaccgcaaaucaccaa

SEQ ID NO: 2621398 - RNA, 20 nt, Escherichia coli CFT073
gugauucagcguaacgccca

SEQ ID NO: 2621399 - RNA, 19 nt, Escherichia coli CFT073
gugauucagggcagcaaua

SEQ ID NO: 2621400 - RNA, 13 nt, Escherichia coli CFT073
gugauucaguuuu

SEQ ID NO: 2621401 - RNA, 18 nt, Escherichia coli CFT073
gugauuccagucggucga

SEQ ID NO: 2621402 - RNA, 22 nt, Escherichia coli CFT073
gugauuccggugccgcaaccuu

SEQ ID NO: 2621403 - RNA, 16 nt, Escherichia coli CFT073
gugauugcuuuuguua

SEQ ID NO: 2621404 - RNA, 18 nt, Escherichia coli CFT073
gugauugguuucaaccug

SEQ ID NO: 2621405 - RNA, 18 nt, Escherichia coli CFT073
gugauuguuuaaaaauac

SEQ ID NO: 2621406 - RNA, 19 nt, Escherichia coli CFT073
gugauuuacuuucuugcca

SEQ ID NO: 2621407 - RNA, 13 nt, Escherichia coli CFT073
gugauuucaaccg

SEQ ID NO: 2621408 - RNA, 21 nt, Escherichia coli CFT073
gugauuucaggcuuuuuucca

SEQ ID NO: 2621409 - RNA, 18 nt, Escherichia coli CFT073
gugauuuuacccggugcg

SEQ ID NO: 2621410 - RNA, 12 nt, Escherichia coli CFT073
gugcaaaaaauc

SEQ ID NO: 2621411 - RNA, 23 nt, Escherichia coli CFT073
gugcaaccgggcuauuugaauuc

SEQ ID NO: 2621412 - RNA, 18 nt, Escherichia coli CFT073
gugcaacuuuacuaaaaa

SEQ ID NO: 2621413 - RNA, 13 nt, Escherichia coli CFT073
gugcaauaacguu

SEQ ID NO: 2621414 - RNA, 15 nt, Escherichia coli CFT073
gugcaaucagcggcg

SEQ ID NO: 2621415 - RNA, 21 nt, Escherichia coli CFT073
gugcaauucggcuuuuuucuc

SEQ ID NO: 2621416 - RNA, 21 nt, Escherichia coli CFT073
gugcacaaacuucuucaguuu

SEQ ID NO: 2621417 - RNA, 15 nt, Escherichia coli CFT073
gugcacaaugccuga

SEQ ID NO: 2621418 - RNA, 21 nt, Escherichia coli CFT073
gugcacagcauccgaacgcug

SEQ ID NO: 2621419 - RNA, 11 nt, Escherichia coli CFT073
gugcaccugcc

SEQ ID NO: 2621420 - RNA, 14 nt, Escherichia coli CFT073
gugcaccugccagc

SEQ ID NO: 2621421 - RNA, 19 nt, Escherichia coli CFT073
gugcaccugccagcaucuc

SEQ ID NO: 2621422 - RNA, 17 nt, Escherichia coli CFT073
gugcacuucuucacauc

SEQ ID NO: 2621423 - RNA, 20 nt, Escherichia coli CFT073
gugcacuuguuuaugccaga

SEQ ID NO: 2621424 - RNA, 23 nt, Escherichia coli CFT073
gugcacuuguuuaugccagaugc

SEQ ID NO: 2621425 - RNA, 22 nt, Escherichia coli CFT073
gugcagacauuccccgccagga

SEQ ID NO: 2621426 - RNA, 15 nt, Escherichia coli CFT073
gugcagacucaccug

SEQ ID NO: 2621427 - RNA, 22 nt, Escherichia coli CFT073
gugcagauaccaccagcgccau

SEQ ID NO: 2621428 - RNA, 23 nt, Escherichia coli CFT073
gugcagaucaucguaaccgacga

SEQ ID NO: 2621429 - RNA, 17 nt, Escherichia coli CFT073
gugcagaucgccagagu

SEQ ID NO: 2621430 - RNA, 22 nt, Escherichia coli CFT073
gugcagcagacgcugcaccugc

SEQ ID NO: 2621431 - RNA, 14 nt, Escherichia coli CFT073
gugcagcagcuucg

SEQ ID NO: 2621432 - RNA, 14 nt, Escherichia coli CFT073
gugcagccaaaaau

SEQ ID NO: 2621433 - RNA, 13 nt, Escherichia coli CFT073
gugcagcccauaa

SEQ ID NO: 2621434 - RNA, 13 nt, Escherichia coli CFT073
gugcagccgugga

SEQ ID NO: 2621435 - RNA, 16 nt, Escherichia coli CFT073
gugcagcgagugccgg

SEQ ID NO: 2621436 - RNA, 20 nt, Escherichia coli CFT073
gugcagcgcaugauuuucau

SEQ ID NO: 2621437 - RNA, 20 nt, Escherichia coli CFT073
gugcagcgguuccuggcggu

SEQ ID NO: 2621438 - RNA, 11 nt, Escherichia coli CFT073
gugcagcgugc

SEQ ID NO: 2621439 - RNA, 18 nt, Escherichia coli CFT073
gugcaggaauggcugggg

SEQ ID NO: 2621440 - RNA, 20 nt, Escherichia coli CFT073
gugcagggugagggcaauaa

SEQ ID NO: 2621441 - RNA, 15 nt, Escherichia coli CFT073
gugcaguuuguuaug

SEQ ID NO: 2621442 - RNA, 21 nt, Escherichia coli CFT073
gugcauaaauaccggcauguu

SEQ ID NO: 2621443 - RNA, 15 nt, Escherichia coli CFT073
gugcaucaacauaua

SEQ ID NO: 2621444 - RNA, 12 nt, Escherichia coli CFT073
gugcauccagug

SEQ ID NO: 2621445 - RNA, 19 nt, Escherichia coli CFT073
gugcaucuccugacacaac

SEQ ID NO: 2621446 - RNA, 18 nt, Escherichia coli CFT073
gugcaucuucacacugau

SEQ ID NO: 2621447 - RNA, 20 nt, Escherichia coli CFT073
gugcaugguguucagaugac

SEQ ID NO: 2621448 - RNA, 20 nt, Escherichia coli CFT073
gugcauuaugcgcauagcua

SEQ ID NO: 2621449 - RNA, 20 nt, Escherichia coli CFT073
gugcauuccagcauuuguug

SEQ ID NO: 2621450 - RNA, 21 nt, Escherichia coli CFT073
gugcauuuuucgcuuuucacc

SEQ ID NO: 2621451 - RNA, 18 nt, Escherichia coli CFT073
gugccaaagucaucaauu

SEQ ID NO: 2621452 - RNA, 17 nt, Escherichia coli CFT073
gugccacauccagcggc

SEQ ID NO: 2621453 - RNA, 13 nt, Escherichia coli CFT073
gugccaccagcau

SEQ ID NO: 2621454 - RNA, 18 nt, Escherichia coli CFT073
gugccagaauuaacgcug

SEQ ID NO: 2621455 - RNA, 15 nt, Escherichia coli CFT073
gugccagacaaacca

SEQ ID NO: 2621456 - RNA, 14 nt, Escherichia coli CFT073
gugccagauagcca

SEQ ID NO: 2621457 - RNA, 12 nt, Escherichia coli CFT073
gugccagauuga

SEQ ID NO: 2621458 - RNA, 20 nt, Escherichia coli CFT073
gugccagcgccagcacuuua

SEQ ID NO: 2621459 - RNA, 12 nt, Escherichia coli CFT073
gugccaggacca

SEQ ID NO: 2621460 - RNA, 13 nt, Escherichia coli CFT073
gugccagugcacu

SEQ ID NO: 2621461 - RNA, 12 nt, Escherichia coli CFT073
gugccaguuuca

SEQ ID NO: 2621462 - RNA, 12 nt, Escherichia coli CFT073
gugccaucacgc

SEQ ID NO: 2621463 - RNA, 20 nt, Escherichia coli CFT073
gugccauuaaaccaacaaaa

SEQ ID NO: 2621464 - RNA, 16 nt, Escherichia coli CFT073
gugcccgaccacuuca

SEQ ID NO: 2621465 - RNA, 13 nt, Escherichia coli CFT073
gugcccgccagug

SEQ ID NO: 2621466 - RNA, 17 nt, Escherichia coli CFT073
gugcccguccccugagc

SEQ ID NO: 2621467 - RNA, 20 nt, Escherichia coli CFT073
gugccgacaucgccacggca

SEQ ID NO: 2621468 - RNA, 21 nt, Escherichia coli CFT073
gugccgauaucgauaaacagc

SEQ ID NO: 2621469 - RNA, 19 nt, Escherichia coli CFT073
gugccgcaaccuucgccag

SEQ ID NO: 2621470 - RNA, 15 nt, Escherichia coli CFT073
gugccgccgcccggc

SEQ ID NO: 2621471 - RNA, 20 nt, Escherichia coli CFT073
gugccgcgauaccacccgca

SEQ ID NO: 2621472 - RNA, 22 nt, Escherichia coli CFT073
gugccgcgauaccacccgcagu

SEQ ID NO: 2621473 - RNA, 17 nt, Escherichia coli CFT073
gugccgcgaucccagac

SEQ ID NO: 2621474 - RNA, 20 nt, Escherichia coli CFT073
gugccgcgcauagcaccacc

SEQ ID NO: 2621475 - RNA, 14 nt, Escherichia coli CFT073
gugccgcgccgcgc

SEQ ID NO: 2621476 - RNA, 22 nt, Escherichia coli CFT073
gugccggaacgccgcugguggc

SEQ ID NO: 2621477 - RNA, 17 nt, Escherichia coli CFT073
gugccggaugcaaacga

SEQ ID NO: 2621478 - RNA, 22 nt, Escherichia coli CFT073
gugccgggaauauuuaccggau

SEQ ID NO: 2621479 - RNA, 16 nt, Escherichia coli CFT073
gugccgguaaagcaau

SEQ ID NO: 2621480 - RNA, 18 nt, Escherichia coli CFT073
gugccgguaaagcaauga

SEQ ID NO: 2621481 - RNA, 16 nt, Escherichia coli CFT073
gugccgguaacugcuu

SEQ ID NO: 2621482 - RNA, 19 nt, Escherichia coli CFT073
gugccggucugaauacgcc

SEQ ID NO: 2621483 - RNA, 21 nt, Escherichia coli CFT073
gugccggucugaauacgcccu

SEQ ID NO: 2621484 - RNA, 16 nt, Escherichia coli CFT073
gugccguggcgcucgc

SEQ ID NO: 2621485 - RNA, 20 nt, Escherichia coli CFT073
gugccucguucacauauugc

SEQ ID NO: 2621486 - RNA, 16 nt, Escherichia coli CFT073
gugccugacggacgcg

SEQ ID NO: 2621487 - RNA, 19 nt, Escherichia coli CFT073
gugccugacggacgcgcgg

SEQ ID NO: 2621488 - RNA, 23 nt, Escherichia coli CFT073
gugccuuauccgacauuucugcu

SEQ ID NO: 2621489 - RNA, 12 nt, Escherichia coli CFT073
gugccuucacgg

SEQ ID NO: 2621490 - RNA, 15 nt, Escherichia coli CFT073
gugccuuccaucccu

SEQ ID NO: 2621491 - RNA, 17 nt, Escherichia coli CFT073
gugcgaaaaaaauuacu

SEQ ID NO: 2621492 - RNA, 16 nt, Escherichia coli CFT073
gugcgacgccauugcu

SEQ ID NO: 2621493 - RNA, 14 nt, Escherichia coli CFT073
gugcgacgggccaa

SEQ ID NO: 2621494 - RNA, 15 nt, Escherichia coli CFT073
gugcgagagcggagg

SEQ ID NO: 2621495 - RNA, 21 nt, Escherichia coli CFT073
gugcgagugcauccaguugcg

SEQ ID NO: 2621496 - RNA, 13 nt, Escherichia coli CFT073
gugcgauagcaau

SEQ ID NO: 2621497 - RNA, 24 nt, Escherichia coli CFT073
gugcgauggcaggccccgucagca

SEQ ID NO: 2621498 - RNA, 18 nt, Escherichia coli CFT073
gugcgcaauacguugcaa

SEQ ID NO: 2621499 - RNA, 12 nt, Escherichia coli CFT073
gugcgcagcauc

SEQ ID NO: 2621500 - RNA, 17 nt, Escherichia coli CFT073
gugcgcagcaucggccu

SEQ ID NO: 2621501 - RNA, 15 nt, Escherichia coli CFT073
gugcgccacaccgca

SEQ ID NO: 2621502 - RNA, 15 nt, Escherichia coli CFT073
gugcgcccggcguca

SEQ ID NO: 2621503 - RNA, 19 nt, Escherichia coli CFT073
gugcgcccuguucugcaag

SEQ ID NO: 2621504 - RNA, 16 nt, Escherichia coli CFT073
gugcgcgaaccagaga

SEQ ID NO: 2621505 - RNA, 21 nt, Escherichia coli CFT073
gugcgcgauagauagcguucu

SEQ ID NO: 2621506 - RNA, 21 nt, Escherichia coli CFT073
gugcggcaauuagcggccagc

SEQ ID NO: 2621507 - RNA, 14 nt, Escherichia coli CFT073
gugcggcgcaccag

SEQ ID NO: 2621508 - RNA, 19 nt, Escherichia coli CFT073
gugcggcucucuuucucca

SEQ ID NO: 2621509 - RNA, 23 nt, Escherichia coli CFT073
gugcggcuguagagcuaccggca

SEQ ID NO: 2621510 - RNA, 14 nt, Escherichia coli CFT073
gugcgggaccagca

SEQ ID NO: 2621511 - RNA, 16 nt, Escherichia coli CFT073
gugcgguaucaccacc

SEQ ID NO: 2621512 - RNA, 15 nt, Escherichia coli CFT073
gugcggucaggcauc

SEQ ID NO: 2621513 - RNA, 19 nt, Escherichia coli CFT073
gugcgguuucagcucacgg

SEQ ID NO: 2621514 - RNA, 12 nt, Escherichia coli CFT073
gugcgucagggc

SEQ ID NO: 2621515 - RNA, 15 nt, Escherichia coli CFT073
gugcguugcagcaaa

SEQ ID NO: 2621516 - RNA, 17 nt, Escherichia coli CFT073
gugcuaaaugucauccc

SEQ ID NO: 2621517 - RNA, 14 nt, Escherichia coli CFT073
gugcucauagacca

SEQ ID NO: 2621518 - RNA, 14 nt, Escherichia coli CFT073
gugcucauccuuca

SEQ ID NO: 2621519 - RNA, 22 nt, Escherichia coli CFT073
gugcuccaaucguucaaccacu

SEQ ID NO: 2621520 - RNA, 13 nt, Escherichia coli CFT073
gugcuccaucagg

SEQ ID NO: 2621521 - RNA, 22 nt, Escherichia coli CFT073
gugcuccaucaggucaucaauc

SEQ ID NO: 2621522 - RNA, 13 nt, Escherichia coli CFT073
gugcuccauuguu

SEQ ID NO: 2621523 - RNA, 17 nt, Escherichia coli CFT073
gugcucccugagcaaca

SEQ ID NO: 2621524 - RNA, 23 nt, Escherichia coli CFT073
gugcuccgcucaucaggccuggc

SEQ ID NO: 2621525 - RNA, 14 nt, Escherichia coli CFT073
gugcuccuucagcc

SEQ ID NO: 2621526 - RNA, 20 nt, Escherichia coli CFT073
gugcuccuucucugagcugg

SEQ ID NO: 2621527 - RNA, 22 nt, Escherichia coli CFT073
gugcuccuucucugagcuggga

SEQ ID NO: 2621528 - RNA, 21 nt, Escherichia coli CFT073
gugcugaagggcaucagccuc

SEQ ID NO: 2621529 - RNA, 19 nt, Escherichia coli CFT073
gugcugaugucaguauucc

SEQ ID NO: 2621530 - RNA, 19 nt, Escherichia coli CFT073
gugcugcaccaacaucaug

SEQ ID NO: 2621531 - RNA, 21 nt, Escherichia coli CFT073
gugcugcauuuggacaccauu

SEQ ID NO: 2621532 - RNA, 21 nt, Escherichia coli CFT073
gugcugccagccagaguugaa

SEQ ID NO: 2621533 - RNA, 16 nt, Escherichia coli CFT073
gugcugcgauucaggg

SEQ ID NO: 2621534 - RNA, 17 nt, Escherichia coli CFT073
gugcugcgauucagggu

SEQ ID NO: 2621535 - RNA, 20 nt, Escherichia coli CFT073
gugcuggauuugugucagaa

SEQ ID NO: 2621536 - RNA, 14 nt, Escherichia coli CFT073
gugcugggcugggu

SEQ ID NO: 2621537 - RNA, 14 nt, Escherichia coli CFT073
gugcuguacagcag

SEQ ID NO: 2621538 - RNA, 23 nt, Escherichia coli CFT073
gugcuguccagaucgggccuggc

SEQ ID NO: 2621539 - RNA, 18 nt, Escherichia coli CFT073
gugcuucgaaacagaaau

SEQ ID NO: 2621540 - RNA, 16 nt, Escherichia coli CFT073
gugcuuuaaucagcac

SEQ ID NO: 2621541 - RNA, 21 nt, Escherichia coli CFT073
gugcuuucagugccuguggau

SEQ ID NO: 2621542 - RNA, 14 nt, Escherichia coli CFT073
guggaaagccccag

SEQ ID NO: 2621543 - RNA, 13 nt, Escherichia coli CFT073
guggaaaucccca

SEQ ID NO: 2621544 - RNA, 17 nt, Escherichia coli CFT073
guggaaugauuaaacga

SEQ ID NO: 2621545 - RNA, 16 nt, Escherichia coli CFT073
guggaaugguuggcga

SEQ ID NO: 2621546 - RNA, 20 nt, Escherichia coli CFT073
guggagagcaacaucaacag

SEQ ID NO: 2621547 - RNA, 17 nt, Escherichia coli CFT073
guggagagcauauaaau

SEQ ID NO: 2621548 - RNA, 16 nt, Escherichia coli CFT073
guggauagacgcaggu

SEQ ID NO: 2621549 - RNA, 13 nt, Escherichia coli CFT073
guggaugcgccau

SEQ ID NO: 2621550 - RNA, 23 nt, Escherichia coli CFT073
guggauuaucuucaccgguagua

SEQ ID NO: 2621551 - RNA, 14 nt, Escherichia coli CFT073
guggcaaaauccaa

SEQ ID NO: 2621552 - RNA, 15 nt, Escherichia coli CFT073
guggcaaacugcgua

SEQ ID NO: 2621553 - RNA, 20 nt, Escherichia coli CFT073
guggcaaagaaaucaacaaa

SEQ ID NO: 2621554 - RNA, 17 nt, Escherichia coli CFT073
guggcaaaucgacgcca

SEQ ID NO: 2621555 - RNA, 22 nt, Escherichia coli CFT073
guggcaaccgcaaccgccguug

SEQ ID NO: 2621556 - RNA, 14 nt, Escherichia coli CFT073
guggcaagcaguag

SEQ ID NO: 2621557 - RNA, 14 nt, Escherichia coli CFT073
guggcaaucaucgu

SEQ ID NO: 2621558 - RNA, 14 nt, Escherichia coli CFT073
guggcaggcaaaaa

SEQ ID NO: 2621559 - RNA, 13 nt, Escherichia coli CFT073
guggcagggcagc

SEQ ID NO: 2621560 - RNA, 17 nt, Escherichia coli CFT073
guggcagguaauccgca

SEQ ID NO: 2621561 - RNA, 15 nt, Escherichia coli CFT073
guggcaucagguuua

SEQ ID NO: 2621562 - RNA, 20 nt, Escherichia coli CFT073
guggcaucuggugccagcgc

SEQ ID NO: 2621563 - RNA, 15 nt, Escherichia coli CFT073
guggcauuuuuauua

SEQ ID NO: 2621564 - RNA, 17 nt, Escherichia coli CFT073
guggccaaauucagugu

SEQ ID NO: 2621565 - RNA, 13 nt, Escherichia coli CFT073
guggccacagcaa

SEQ ID NO: 2621566 - RNA, 16 nt, Escherichia coli CFT073
guggccacagcaagca

SEQ ID NO: 2621567 - RNA, 18 nt, Escherichia coli CFT073
guggccaucggcccguua

SEQ ID NO: 2621568 - RNA, 16 nt, Escherichia coli CFT073
guggcccgccagcaug

SEQ ID NO: 2621569 - RNA, 18 nt, Escherichia coli CFT073
guggcccgccagcaugcc

SEQ ID NO: 2621570 - RNA, 16 nt, Escherichia coli CFT073
guggccugcuuuugcc

SEQ ID NO: 2621571 - RNA, 22 nt, Escherichia coli CFT073
guggcgaauuaacaccaccagc

SEQ ID NO: 2621572 - RNA, 21 nt, Escherichia coli CFT073
guggcgauaaucagcgccagc

SEQ ID NO: 2621573 - RNA, 15 nt, Escherichia coli CFT073
guggcgaugaugauc

SEQ ID NO: 2621574 - RNA, 20 nt, Escherichia coli CFT073
guggcgauucauaugcgcca

SEQ ID NO: 2621575 - RNA, 22 nt, Escherichia coli CFT073
guggcgcauccguuauagggaa

SEQ ID NO: 2621576 - RNA, 12 nt, Escherichia coli CFT073
guggcgguagcg

SEQ ID NO: 2621577 - RNA, 12 nt, Escherichia coli CFT073
guggcgguuuug

SEQ ID NO: 2621578 - RNA, 23 nt, Escherichia coli CFT073
guggcgguuuugucguccggacu

SEQ ID NO: 2621579 - RNA, 14 nt, Escherichia coli CFT073
guggcguaaacgcc

SEQ ID NO: 2621580 - RNA, 20 nt, Escherichia coli CFT073
guggcguguuguaaaacgcg

SEQ ID NO: 2621581 - RNA, 15 nt, Escherichia coli CFT073
guggcguuuccagca

SEQ ID NO: 2621582 - RNA, 19 nt, Escherichia coli CFT073
guggcguuuuuaucgccca

SEQ ID NO: 2621583 - RNA, 21 nt, Escherichia coli CFT073
guggcguuuuuaucgcccacg

SEQ ID NO: 2621584 - RNA, 11 nt, Escherichia coli CFT073
guggcuggggu

SEQ ID NO: 2621585 - RNA, 16 nt, Escherichia coli CFT073
gugggauuccagcgcc

SEQ ID NO: 2621586 - RNA, 12 nt, Escherichia coli CFT073
gugggccugaua

SEQ ID NO: 2621587 - RNA, 16 nt, Escherichia coli CFT073
guggggaaugauauuu

SEQ ID NO: 2621588 - RNA, 22 nt, Escherichia coli CFT073
guggguacuguaucgaugcugu

SEQ ID NO: 2621589 - RNA, 17 nt, Escherichia coli CFT073
gugggucagcggcggcu

SEQ ID NO: 2621590 - RNA, 24 nt, Escherichia coli CFT073
gugggucugacugguaacguggca

SEQ ID NO: 2621591 - RNA, 21 nt, Escherichia coli CFT073
gugggugauuaaauucaggcc

SEQ ID NO: 2621592 - RNA, 17 nt, Escherichia coli CFT073
guggguuucgcggccaa

SEQ ID NO: 2621593 - RNA, 16 nt, Escherichia coli CFT073
gugguaaacacaacga

SEQ ID NO: 2621594 - RNA, 20 nt, Escherichia coli CFT073
gugguaccaggaucagcaaa

SEQ ID NO: 2621595 - RNA, 22 nt, Escherichia coli CFT073
gugguaccaggaucagcaaaau

SEQ ID NO: 2621596 - RNA, 15 nt, Escherichia coli CFT073
gugguacugccgacg

SEQ ID NO: 2621597 - RNA, 12 nt, Escherichia coli CFT073
gugguagcggcu

SEQ ID NO: 2621598 - RNA, 20 nt, Escherichia coli CFT073
guggucaaauuucuucagcc

SEQ ID NO: 2621599 - RNA, 12 nt, Escherichia coli CFT073
gugguccagcug

SEQ ID NO: 2621600 - RNA, 22 nt, Escherichia coli CFT073
guggucgaugauuuccgccagc

SEQ ID NO: 2621601 - RNA, 15 nt, Escherichia coli CFT073
guggucgcaucaucc

SEQ ID NO: 2621602 - RNA, 18 nt, Escherichia coli CFT073
guggucgguaaacaucag

SEQ ID NO: 2621603 - RNA, 16 nt, Escherichia coli CFT073
guggugauacaccuca

SEQ ID NO: 2621604 - RNA, 22 nt, Escherichia coli CFT073
guggugcaauccacaagcacag

SEQ ID NO: 2621605 - RNA, 18 nt, Escherichia coli CFT073
guggugcaggcuuccggc

SEQ ID NO: 2621606 - RNA, 18 nt, Escherichia coli CFT073
guggugccgauaucgaua

SEQ ID NO: 2621607 - RNA, 15 nt, Escherichia coli CFT073
gugguggcuucacgc

SEQ ID NO: 2621608 - RNA, 18 nt, Escherichia coli CFT073
gugguguaaccuucaccc

SEQ ID NO: 2621609 - RNA, 22 nt, Escherichia coli CFT073
gugguguguuugaucacuucca

SEQ ID NO: 2621610 - RNA, 16 nt, Escherichia coli CFT073
gugguuaccgccagca

SEQ ID NO: 2621611 - RNA, 17 nt, Escherichia coli CFT073
guguaaaaacugccagg

SEQ ID NO: 2621612 - RNA, 12 nt, Escherichia coli CFT073
guguaaucagcc

SEQ ID NO: 2621613 - RNA, 19 nt, Escherichia coli CFT073
guguacauccuuguacaug

SEQ ID NO: 2621614 - RNA, 14 nt, Escherichia coli CFT073
guguacccagcagc

SEQ ID NO: 2621615 - RNA, 14 nt, Escherichia coli CFT073
guguaccgguagca

SEQ ID NO: 2621616 - RNA, 20 nt, Escherichia coli CFT073
guguagccaauuaagucaac

SEQ ID NO: 2621617 - RNA, 13 nt, Escherichia coli CFT073
guguaggccggau

SEQ ID NO: 2621618 - RNA, 18 nt, Escherichia coli CFT073
guguaggccggauaaggu

SEQ ID NO: 2621619 - RNA, 23 nt, Escherichia coli CFT073
guguaggccggauaagguguuca

SEQ ID NO: 2621620 - RNA, 23 nt, Escherichia coli CFT073
guguaguauuugaguucacugcc

SEQ ID NO: 2621621 - RNA, 14 nt, Escherichia coli CFT073
guguaguucaccuu

SEQ ID NO: 2621622 - RNA, 12 nt, Escherichia coli CFT073
guguaucagguc

SEQ ID NO: 2621623 - RNA, 12 nt, Escherichia coli CFT073
guguaucuucau

SEQ ID NO: 2621624 - RNA, 21 nt, Escherichia coli CFT073
guguauucaugcccugcccgc

SEQ ID NO: 2621625 - RNA, 11 nt, Escherichia coli CFT073
guguauuucug

SEQ ID NO: 2621626 - RNA, 18 nt, Escherichia coli CFT073
gugucacggugucgguau

SEQ ID NO: 2621627 - RNA, 21 nt, Escherichia coli CFT073
gugucagcaccagagaacuga

SEQ ID NO: 2621628 - RNA, 23 nt, Escherichia coli CFT073
gugucagugcgcgauagauagcg

SEQ ID NO: 2621629 - RNA, 18 nt, Escherichia coli CFT073
guguccaguaauggccaa

SEQ ID NO: 2621630 - RNA, 14 nt, Escherichia coli CFT073
gugucgccagcaau

SEQ ID NO: 2621631 - RNA, 19 nt, Escherichia coli CFT073
gugucgccagcaauacaaa

SEQ ID NO: 2621632 - RNA, 12 nt, Escherichia coli CFT073
gugucggaugcg

SEQ ID NO: 2621633 - RNA, 17 nt, Escherichia coli CFT073
gugucgguguagacagc

SEQ ID NO: 2621634 - RNA, 17 nt, Escherichia coli CFT073
gugucguuacgccgcag

SEQ ID NO: 2621635 - RNA, 20 nt, Escherichia coli CFT073
gugucuaacgaugccagcgc

SEQ ID NO: 2621636 - RNA, 13 nt, Escherichia coli CFT073
gugugaaaccuuu

SEQ ID NO: 2621637 - RNA, 18 nt, Escherichia coli CFT073
gugugauccacugcagaa

SEQ ID NO: 2621638 - RNA, 22 nt, Escherichia coli CFT073
gugugcguugcagcaaauaaaa

SEQ ID NO: 2621639 - RNA, 17 nt, Escherichia coli CFT073
gugugcuacggucugcc

SEQ ID NO: 2621640 - RNA, 16 nt, Escherichia coli CFT073
guguggagugcagcac

SEQ ID NO: 2621641 - RNA, 17 nt, Escherichia coli CFT073
guguggcaucguccguc

SEQ ID NO: 2621642 - RNA, 15 nt, Escherichia coli CFT073
gugugguaaauuuug

SEQ ID NO: 2621643 - RNA, 21 nt, Escherichia coli CFT073
gugugguuauugggugacugg

SEQ ID NO: 2621644 - RNA, 16 nt, Escherichia coli CFT073
gugugguugcggacug

SEQ ID NO: 2621645 - RNA, 12 nt, Escherichia coli CFT073
guguuaauaaug

SEQ ID NO: 2621646 - RNA, 18 nt, Escherichia coli CFT073
guguuaaugcccaucagu

SEQ ID NO: 2621647 - RNA, 23 nt, Escherichia coli CFT073
guguuaccguaccaggcauauuc

SEQ ID NO: 2621648 - RNA, 12 nt, Escherichia coli CFT073
guguucaugacc

SEQ ID NO: 2621649 - RNA, 14 nt, Escherichia coli CFT073
guguuccagagaac

SEQ ID NO: 2621650 - RNA, 16 nt, Escherichia coli CFT073
guguucccgcgccagc

SEQ ID NO: 2621651 - RNA, 23 nt, Escherichia coli CFT073
guguucccguccgcacgcuggag

SEQ ID NO: 2621652 - RNA, 22 nt, Escherichia coli CFT073
guguuccggcugguugaucaau

SEQ ID NO: 2621653 - RNA, 13 nt, Escherichia coli CFT073
guguuccucugcc

SEQ ID NO: 2621654 - RNA, 14 nt, Escherichia coli CFT073
guguuccucugcuc

SEQ ID NO: 2621655 - RNA, 11 nt, Escherichia coli CFT073
guguucuuccg

SEQ ID NO: 2621656 - RNA, 17 nt, Escherichia coli CFT073
guguucuuccggccagu

SEQ ID NO: 2621657 - RNA, 12 nt, Escherichia coli CFT073
guguugagcaau

SEQ ID NO: 2621658 - RNA, 16 nt, Escherichia coli CFT073
guguugaucacauaau

SEQ ID NO: 2621659 - RNA, 16 nt, Escherichia coli CFT073
guguugcaccaucagg

SEQ ID NO: 2621660 - RNA, 14 nt, Escherichia coli CFT073
guguugcauccggc

SEQ ID NO: 2621661 - RNA, 22 nt, Escherichia coli CFT073
guguugccgccaccuuucuguu

SEQ ID NO: 2621662 - RNA, 21 nt, Escherichia coli CFT073
guguuggcaaucagcggcagu

SEQ ID NO: 2621663 - RNA, 15 nt, Escherichia coli CFT073
guguuggcggcagau

SEQ ID NO: 2621664 - RNA, 19 nt, Escherichia coli CFT073
guguuuaucuuccagcauu

SEQ ID NO: 2621665 - RNA, 21 nt, Escherichia coli CFT073
guguuuaucuuccagcauuuc

SEQ ID NO: 2621666 - RNA, 19 nt, Escherichia coli CFT073
guguuucaucucaucaaug

SEQ ID NO: 2621667 - RNA, 19 nt, Escherichia coli CFT073
guguuugaucacuuccagc

SEQ ID NO: 2621668 - RNA, 23 nt, Escherichia coli CFT073
guguuuuccaccgugauccgccg

SEQ ID NO: 2621669 - RNA, 17 nt, Escherichia coli CFT073
guuaaaaacagccagca

SEQ ID NO: 2621670 - RNA, 17 nt, Escherichia coli CFT073
guuaaaaagauuaagaa

SEQ ID NO: 2621671 - RNA, 21 nt, Escherichia coli CFT073
guuaaaacaauuaacccgcga

SEQ ID NO: 2621672 - RNA, 13 nt, Escherichia coli CFT073
guuaaaauuucac

SEQ ID NO: 2621673 - RNA, 19 nt, Escherichia coli CFT073
guuaaagagaucaaagucu

SEQ ID NO: 2621674 - RNA, 16 nt, Escherichia coli CFT073
guuaaaggcuuuguua

SEQ ID NO: 2621675 - RNA, 14 nt, Escherichia coli CFT073
guuaaauugaaauu

SEQ ID NO: 2621676 - RNA, 12 nt, Escherichia coli CFT073
guuaacaacaac

SEQ ID NO: 2621677 - RNA, 16 nt, Escherichia coli CFT073
guuaacaauacgccca

SEQ ID NO: 2621678 - RNA, 20 nt, Escherichia coli CFT073
guuaacaauauuaacaacau

SEQ ID NO: 2621679 - RNA, 15 nt, Escherichia coli CFT073
guuaacagcgcacca

SEQ ID NO: 2621680 - RNA, 17 nt, Escherichia coli CFT073
guuaacagcgcaccaga

SEQ ID NO: 2621681 - RNA, 10 nt, Escherichia coli CFT073
guuaaccagc

SEQ ID NO: 2621682 - RNA, 12 nt, Escherichia coli CFT073
guuaaccagcac

SEQ ID NO: 2621683 - RNA, 14 nt, Escherichia coli CFT073
guuaaccagcacca

SEQ ID NO: 2621684 - RNA, 16 nt, Escherichia coli CFT073
guuaaccagcaccagc

SEQ ID NO: 2621685 - RNA, 13 nt, Escherichia coli CFT073
guuaaccauaauc

SEQ ID NO: 2621686 - RNA, 18 nt, Escherichia coli CFT073
guuaacgccgcauccggc

SEQ ID NO: 2621687 - RNA, 15 nt, Escherichia coli CFT073
guuaacgccgcgccc

SEQ ID NO: 2621688 - RNA, 19 nt, Escherichia coli CFT073
guuaacgccgcugcucuau

SEQ ID NO: 2621689 - RNA, 20 nt, Escherichia coli CFT073
guuaacgccuuauccggccu

SEQ ID NO: 2621690 - RNA, 17 nt, Escherichia coli CFT073
guuaacgcugucuacaa

SEQ ID NO: 2621691 - RNA, 16 nt, Escherichia coli CFT073
guuaacggauaacguu

SEQ ID NO: 2621692 - RNA, 21 nt, Escherichia coli CFT073
guuaacugaauauuccaguua

SEQ ID NO: 2621693 - RNA, 20 nt, Escherichia coli CFT073
guuaacugcaugucaggcgu

SEQ ID NO: 2621694 - RNA, 15 nt, Escherichia coli CFT073
guuaagaaaacggaa

SEQ ID NO: 2621695 - RNA, 13 nt, Escherichia coli CFT073
guuaagauucagc

SEQ ID NO: 2621696 - RNA, 20 nt, Escherichia coli CFT073
guuaagcacagcggacaucu

SEQ ID NO: 2621697 - RNA, 21 nt, Escherichia coli CFT073
guuaagcauuggcaugcacgu

SEQ ID NO: 2621698 - RNA, 17 nt, Escherichia coli CFT073
guuaaggccaaacacca

SEQ ID NO: 2621699 - RNA, 23 nt, Escherichia coli CFT073
guuaauaaagugcgcuuugugug

SEQ ID NO: 2621700 - RNA, 22 nt, Escherichia coli CFT073
guuaauaagagauccaggccag

SEQ ID NO: 2621701 - RNA, 16 nt, Escherichia coli CFT073
guuaauaccugcacca

SEQ ID NO: 2621702 - RNA, 23 nt, Escherichia coli CFT073
guuaauacuacgcagacggcuuu

SEQ ID NO: 2621703 - RNA, 19 nt, Escherichia coli CFT073
guuaauccacagcaaugca

SEQ ID NO: 2621704 - RNA, 17 nt, Escherichia coli CFT073
guuaauccgcucugccc

SEQ ID NO: 2621705 - RNA, 18 nt, Escherichia coli CFT073
guuaaucgccugcugaau

SEQ ID NO: 2621706 - RNA, 13 nt, Escherichia coli CFT073
guuaaucggauga

SEQ ID NO: 2621707 - RNA, 20 nt, Escherichia coli CFT073
guuaaucugcccguagccca

SEQ ID NO: 2621708 - RNA, 22 nt, Escherichia coli CFT073
guuaaucuucagaucgaaaucu

SEQ ID NO: 2621709 - RNA, 19 nt, Escherichia coli CFT073
guuaaugcuccccuuucuu

SEQ ID NO: 2621710 - RNA, 20 nt, Escherichia coli CFT073
guuaaugcuccccuuucuua

SEQ ID NO: 2621711 - RNA, 20 nt, Escherichia coli CFT073
guuaauggcuuuacgugcca

SEQ ID NO: 2621712 - RNA, 14 nt, Escherichia coli CFT073
guuaauucucccug

SEQ ID NO: 2621713 - RNA, 19 nt, Escherichia coli CFT073
guuaauucuuaacaccggc

SEQ ID NO: 2621714 - RNA, 18 nt, Escherichia coli CFT073
guuaauuuccucuucccg

SEQ ID NO: 2621715 - RNA, 13 nt, Escherichia coli CFT073
guuaauuucucgc

SEQ ID NO: 2621716 - RNA, 14 nt, Escherichia coli CFT073
guuacaaccuccuc

SEQ ID NO: 2621717 - RNA, 20 nt, Escherichia coli CFT073
guuaccaguaaccagaaacc

SEQ ID NO: 2621718 - RNA, 14 nt, Escherichia coli CFT073
guuaccaguacacc

SEQ ID NO: 2621719 - RNA, 12 nt, Escherichia coli CFT073
guuacccagcac

SEQ ID NO: 2621720 - RNA, 14 nt, Escherichia coli CFT073
guuacccagcgcca

SEQ ID NO: 2621721 - RNA, 15 nt, Escherichia coli CFT073
guuacccagcgccau

SEQ ID NO: 2621722 - RNA, 13 nt, Escherichia coli CFT073
guuaccccugcgg

SEQ ID NO: 2621723 - RNA, 16 nt, Escherichia coli CFT073
guuacccgacgcgcca

SEQ ID NO: 2621724 - RNA, 21 nt, Escherichia coli CFT073
guuacccgacgcgccagguac

SEQ ID NO: 2621725 - RNA, 15 nt, Escherichia coli CFT073
guuaccgccagcacc

SEQ ID NO: 2621726 - RNA, 22 nt, Escherichia coli CFT073
guuaccgccuuaacgcggcggu

SEQ ID NO: 2621727 - RNA, 16 nt, Escherichia coli CFT073
guuaccggaagacuga

SEQ ID NO: 2621728 - RNA, 13 nt, Escherichia coli CFT073
guuacgcaccggu

SEQ ID NO: 2621729 - RNA, 17 nt, Escherichia coli CFT073
guuacgcacuucuucgu

SEQ ID NO: 2621730 - RNA, 17 nt, Escherichia coli CFT073
guuacgccccgguuucu

SEQ ID NO: 2621731 - RNA, 15 nt, Escherichia coli CFT073
guuacgccgcauccg

SEQ ID NO: 2621732 - RNA, 21 nt, Escherichia coli CFT073
guuacgccgggcgacuggccg

SEQ ID NO: 2621733 - RNA, 22 nt, Escherichia coli CFT073
guuacgccggugauuaaaccaa

SEQ ID NO: 2621734 - RNA, 18 nt, Escherichia coli CFT073
guuacuaaaaguaaauaa

SEQ ID NO: 2621735 - RNA, 23 nt, Escherichia coli CFT073
guuacucccggauaaaucuccau

SEQ ID NO: 2621736 - RNA, 23 nt, Escherichia coli CFT073
guuacucugcaagucuugcugcg

SEQ ID NO: 2621737 - RNA, 21 nt, Escherichia coli CFT073
guuacugcccgcacaccucac

SEQ ID NO: 2621738 - RNA, 14 nt, Escherichia coli CFT073
guuagaaaacgccu

SEQ ID NO: 2621739 - RNA, 15 nt, Escherichia coli CFT073
guuagaaaacgccug

SEQ ID NO: 2621740 - RNA, 13 nt, Escherichia coli CFT073
guuagaaagcugc

SEQ ID NO: 2621741 - RNA, 16 nt, Escherichia coli CFT073
guuagaaagcugcugc

SEQ ID NO: 2621742 - RNA, 22 nt, Escherichia coli CFT073
guuagaagcaucguggaugaaa

SEQ ID NO: 2621743 - RNA, 14 nt, Escherichia coli CFT073
guuagagcacagau

SEQ ID NO: 2621744 - RNA, 20 nt, Escherichia coli CFT073
guuagcaaacgacacaugcu

SEQ ID NO: 2621745 - RNA, 18 nt, Escherichia coli CFT073
guuagcggcgguaaaauc

SEQ ID NO: 2621746 - RNA, 17 nt, Escherichia coli CFT073
guuauacaccuguucca

SEQ ID NO: 2621747 - RNA, 13 nt, Escherichia coli CFT073
guuauacaucgcu

SEQ ID NO: 2621748 - RNA, 19 nt, Escherichia coli CFT073
guuauacaucgcuuuccag

SEQ ID NO: 2621749 - RNA, 18 nt, Escherichia coli CFT073
guuauagcgauuuuucau

SEQ ID NO: 2621750 - RNA, 18 nt, Escherichia coli CFT073
guuauaguguuccugcgg

SEQ ID NO: 2621751 - RNA, 17 nt, Escherichia coli CFT073
guuauaucuucuuuaua

SEQ ID NO: 2621752 - RNA, 13 nt, Escherichia coli CFT073
guuaucaaauuca

SEQ ID NO: 2621753 - RNA, 12 nt, Escherichia coli CFT073
guuaucaauuau

SEQ ID NO: 2621754 - RNA, 14 nt, Escherichia coli CFT073
guuaucagaaccgc

SEQ ID NO: 2621755 - RNA, 23 nt, Escherichia coli CFT073
guuaucagaaccgcccagaccug

SEQ ID NO: 2621756 - RNA, 17 nt, Escherichia coli CFT073
guuauccagcaaccagg

SEQ ID NO: 2621757 - RNA, 20 nt, Escherichia coli CFT073
guuauccgacuuauucuuca

SEQ ID NO: 2621758 - RNA, 15 nt, Escherichia coli CFT073
guuauccgccgcaua

SEQ ID NO: 2621759 - RNA, 18 nt, Escherichia coli CFT073
guuauccggcugaccugg

SEQ ID NO: 2621760 - RNA, 14 nt, Escherichia coli CFT073
guuauccugcaaau

SEQ ID NO: 2621761 - RNA, 15 nt, Escherichia coli CFT073
guuauccuucugcgu

SEQ ID NO: 2621762 - RNA, 17 nt, Escherichia coli CFT073
guuaucgcccugccagc

SEQ ID NO: 2621763 - RNA, 18 nt, Escherichia coli CFT073
guuaucgcccugccagcg

SEQ ID NO: 2621764 - RNA, 21 nt, Escherichia coli CFT073
guuaucgcccugccagcgaua

SEQ ID NO: 2621765 - RNA, 16 nt, Escherichia coli CFT073
guuaucgccugcgcca

SEQ ID NO: 2621766 - RNA, 22 nt, Escherichia coli CFT073
guuaucgcgccaucaaaucugc

SEQ ID NO: 2621767 - RNA, 23 nt, Escherichia coli CFT073
guuaucgcucgucgcgacgacca

SEQ ID NO: 2621768 - RNA, 18 nt, Escherichia coli CFT073
guuaucguaccaggcgac

SEQ ID NO: 2621769 - RNA, 22 nt, Escherichia coli CFT073
guuaugcaccgacaauccaguu

SEQ ID NO: 2621770 - RNA, 19 nt, Escherichia coli CFT073
guuaugcgaaauagcgcca

SEQ ID NO: 2621771 - RNA, 20 nt, Escherichia coli CFT073
guuauguacgcguaaaauau

SEQ ID NO: 2621772 - RNA, 22 nt, Escherichia coli CFT073
guuauuacugcgaauuuccugc

SEQ ID NO: 2621773 - RNA, 22 nt, Escherichia coli CFT073
guuauuauuacguccaccagaa

SEQ ID NO: 2621774 - RNA, 15 nt, Escherichia coli CFT073
guuauuauucauaaa

SEQ ID NO: 2621775 - RNA, 12 nt, Escherichia coli CFT073
guuauucaucgc

SEQ ID NO: 2621776 - RNA, 15 nt, Escherichia coli CFT073
guuauucccguggcc

SEQ ID NO: 2621777 - RNA, 13 nt, Escherichia coli CFT073
guuauugauggug

SEQ ID NO: 2621778 - RNA, 14 nt, Escherichia coli CFT073
guuauugccuggca

SEQ ID NO: 2621779 - RNA, 17 nt, Escherichia coli CFT073
guuauuuguucagcaaa

SEQ ID NO: 2621780 - RNA, 20 nt, Escherichia coli CFT073
guuauuuguugccggaugcg

SEQ ID NO: 2621781 - RNA, 22 nt, Escherichia coli CFT073
guuauuuuggcacacaccagau

SEQ ID NO: 2621782 - RNA, 23 nt, Escherichia coli CFT073
guucaaacuucgccacagcggca

SEQ ID NO: 2621783 - RNA, 17 nt, Escherichia coli CFT073
guucaaaugugggagcu

SEQ ID NO: 2621784 - RNA, 21 nt, Escherichia coli CFT073
guucaaccacuucggcaucuu

SEQ ID NO: 2621785 - RNA, 17 nt, Escherichia coli CFT073
guucaagacgaauaccu

SEQ ID NO: 2621786 - RNA, 14 nt, Escherichia coli CFT073
guucaagagcuuca

SEQ ID NO: 2621787 - RNA, 15 nt, Escherichia coli CFT073
guucaauaccgucug

SEQ ID NO: 2621788 - RNA, 22 nt, Escherichia coli CFT073
guucaauacgcaguuuugucuu

SEQ ID NO: 2621789 - RNA, 16 nt, Escherichia coli CFT073
guucaauaucuuccug

SEQ ID NO: 2621790 - RNA, 23 nt, Escherichia coli CFT073
guucaaucaaauagccugccagu

SEQ ID NO: 2621791 - RNA, 21 nt, Escherichia coli CFT073
guucaaucauuugcaccaggc

SEQ ID NO: 2621792 - RNA, 13 nt, Escherichia coli CFT073
guucaauuuccag

SEQ ID NO: 2621793 - RNA, 20 nt, Escherichia coli CFT073
guucaauuuccaguuucaca

SEQ ID NO: 2621794 - RNA, 17 nt, Escherichia coli CFT073
guucacacucugcuuga

SEQ ID NO: 2621795 - RNA, 18 nt, Escherichia coli CFT073
guucacccgguccgcgaa

SEQ ID NO: 2621796 - RNA, 13 nt, Escherichia coli CFT073
guucaccgccauu

SEQ ID NO: 2621797 - RNA, 17 nt, Escherichia coli CFT073
guucacgaauauuuccc

SEQ ID NO: 2621798 - RNA, 19 nt, Escherichia coli CFT073
guucacgaccaucaaccuu

SEQ ID NO: 2621799 - RNA, 21 nt, Escherichia coli CFT073
guucacgaccaucaaccuuca

SEQ ID NO: 2621800 - RNA, 15 nt, Escherichia coli CFT073
guucacgcagcucac

SEQ ID NO: 2621801 - RNA, 18 nt, Escherichia coli CFT073
guucacgccgcauccggc

SEQ ID NO: 2621802 - RNA, 19 nt, Escherichia coli CFT073
guucacgccgcaucuggca

SEQ ID NO: 2621803 - RNA, 22 nt, Escherichia coli CFT073
guucacggcgauaccaguaaua

SEQ ID NO: 2621804 - RNA, 22 nt, Escherichia coli CFT073
guucacuuaaucucugacgcgc

SEQ ID NO: 2621805 - RNA, 14 nt, Escherichia coli CFT073
guucagaaagcgcc

SEQ ID NO: 2621806 - RNA, 21 nt, Escherichia coli CFT073
guucagacgcucuuucaccag

SEQ ID NO: 2621807 - RNA, 13 nt, Escherichia coli CFT073
guucagacgcugc

SEQ ID NO: 2621808 - RNA, 15 nt, Escherichia coli CFT073
guucagauacaccau

SEQ ID NO: 2621809 - RNA, 19 nt, Escherichia coli CFT073
guucagaugaccaauaacc

SEQ ID NO: 2621810 - RNA, 19 nt, Escherichia coli CFT073
guucagcaaccacaaccuc

SEQ ID NO: 2621811 - RNA, 19 nt, Escherichia coli CFT073
guucagcacguuaaguuca

SEQ ID NO: 2621812 - RNA, 22 nt, Escherichia coli CFT073
guucagcaguucugccaggcug

SEQ ID NO: 2621813 - RNA, 19 nt, Escherichia coli CFT073
guucagccgcuuuaucuga

SEQ ID NO: 2621814 - RNA, 20 nt, Escherichia coli CFT073
guucagcgauguuagcguca

SEQ ID NO: 2621815 - RNA, 14 nt, Escherichia coli CFT073
guucagcggcugac

SEQ ID NO: 2621816 - RNA, 18 nt, Escherichia coli CFT073
guucagcgggcagggcau

SEQ ID NO: 2621817 - RNA, 19 nt, Escherichia coli CFT073
guucagcggugucugccag

SEQ ID NO: 2621818 - RNA, 17 nt, Escherichia coli CFT073
guucaggauaauuaucu

SEQ ID NO: 2621819 - RNA, 16 nt, Escherichia coli CFT073
guucaggcguuucuuc

SEQ ID NO: 2621820 - RNA, 19 nt, Escherichia coli CFT073
guucaggcguuucuucacc

SEQ ID NO: 2621821 - RNA, 19 nt, Escherichia coli CFT073
guucagggauacaagccac

SEQ ID NO: 2621822 - RNA, 16 nt, Escherichia coli CFT073
guucagucacuucaaa

SEQ ID NO: 2621823 - RNA, 18 nt, Escherichia coli CFT073
guucagucguauccucag

SEQ ID NO: 2621824 - RNA, 15 nt, Escherichia coli CFT073
guucagugaccgaac

SEQ ID NO: 2621825 - RNA, 14 nt, Escherichia coli CFT073
guucagugauggca

SEQ ID NO: 2621826 - RNA, 20 nt, Escherichia coli CFT073
guucagugauggcacaccau

SEQ ID NO: 2621827 - RNA, 18 nt, Escherichia coli CFT073
guucauauaauuccaccc

SEQ ID NO: 2621828 - RNA, 22 nt, Escherichia coli CFT073
guucaucacgaaaaucaucugc

SEQ ID NO: 2621829 - RNA, 11 nt, Escherichia coli CFT073
guucaucaucg

SEQ ID NO: 2621830 - RNA, 19 nt, Escherichia coli CFT073
guucauccauaccacaggu

SEQ ID NO: 2621831 - RNA, 17 nt, Escherichia coli CFT073
guucaucgauagaacgg

SEQ ID NO: 2621832 - RNA, 17 nt, Escherichia coli CFT073
guucaucuacuacugga

SEQ ID NO: 2621833 - RNA, 21 nt, Escherichia coli CFT073
guucauuaaugccguuauaca

SEQ ID NO: 2621834 - RNA, 20 nt, Escherichia coli CFT073
guucauuggguucaucugau

SEQ ID NO: 2621835 - RNA, 18 nt, Escherichia coli CFT073
guucauuuuguaggccug

SEQ ID NO: 2621836 - RNA, 21 nt, Escherichia coli CFT073
guucauuuuguaggccugaua

SEQ ID NO: 2621837 - RNA, 21 nt, Escherichia coli CFT073
guucauuuuuaggauaaauca

SEQ ID NO: 2621838 - RNA, 21 nt, Escherichia coli CFT073
guuccaacgccaccacucaaa

SEQ ID NO: 2621839 - RNA, 15 nt, Escherichia coli CFT073
guuccacucuuucag

SEQ ID NO: 2621840 - RNA, 17 nt, Escherichia coli CFT073
guuccacucuuucagca

SEQ ID NO: 2621841 - RNA, 22 nt, Escherichia coli CFT073
guuccacucuuucagcaccagc

SEQ ID NO: 2621842 - RNA, 14 nt, Escherichia coli CFT073
guuccagcaaauca

SEQ ID NO: 2621843 - RNA, 18 nt, Escherichia coli CFT073
guuccagcaaaucaaucu

SEQ ID NO: 2621844 - RNA, 17 nt, Escherichia coli CFT073
guuccagcagcuccggc

SEQ ID NO: 2621845 - RNA, 20 nt, Escherichia coli CFT073
guuccagggccuccugcagc

SEQ ID NO: 2621846 - RNA, 14 nt, Escherichia coli CFT073
guuccauaaucgcc

SEQ ID NO: 2621847 - RNA, 22 nt, Escherichia coli CFT073
guuccauaaucgccugaccgau

SEQ ID NO: 2621848 - RNA, 14 nt, Escherichia coli CFT073
guuccauccaccag

SEQ ID NO: 2621849 - RNA, 16 nt, Escherichia coli CFT073
guuccauugagaaaau

SEQ ID NO: 2621850 - RNA, 21 nt, Escherichia coli CFT073
guucccaaaucaaaucauccu

SEQ ID NO: 2621851 - RNA, 13 nt, Escherichia coli CFT073
guucccagagaau

SEQ ID NO: 2621852 - RNA, 21 nt, Escherichia coli CFT073
guucccagccaguccggcaau

SEQ ID NO: 2621853 - RNA, 13 nt, Escherichia coli CFT073
guuccccaucacc

SEQ ID NO: 2621854 - RNA, 20 nt, Escherichia coli CFT073
guuccccccacaaucagcca

SEQ ID NO: 2621855 - RNA, 15 nt, Escherichia coli CFT073
guucccccugccaga

SEQ ID NO: 2621856 - RNA, 13 nt, Escherichia coli CFT073
guuccccucaccc

SEQ ID NO: 2621857 - RNA, 15 nt, Escherichia coli CFT073
guucccgcggcgcag

SEQ ID NO: 2621858 - RNA, 21 nt, Escherichia coli CFT073
guucccgcggcgcagcuccag

SEQ ID NO: 2621859 - RNA, 22 nt, Escherichia coli CFT073
guucccguccgcacgcuggaga

SEQ ID NO: 2621860 - RNA, 21 nt, Escherichia coli CFT073
guuccggcaaucaacagauaa

SEQ ID NO: 2621861 - RNA, 22 nt, Escherichia coli CFT073
guuccggcaaucaacagauaaa

SEQ ID NO: 2621862 - RNA, 16 nt, Escherichia coli CFT073
guuccgggaucaccag

SEQ ID NO: 2621863 - RNA, 20 nt, Escherichia coli CFT073
guuccgggcuguuuuccagc

SEQ ID NO: 2621864 - RNA, 15 nt, Escherichia coli CFT073
guuccugaucgauaa

SEQ ID NO: 2621865 - RNA, 15 nt, Escherichia coli CFT073
guuccugaugaaaaa

SEQ ID NO: 2621866 - RNA, 18 nt, Escherichia coli CFT073
guuccugaugaaaaaucu

SEQ ID NO: 2621867 - RNA, 14 nt, Escherichia coli CFT073
guuccugcaucgcc

SEQ ID NO: 2621868 - RNA, 20 nt, Escherichia coli CFT073
guuccugccagucuuccgcc

SEQ ID NO: 2621869 - RNA, 15 nt, Escherichia coli CFT073
guuccuucaagccau

SEQ ID NO: 2621870 - RNA, 21 nt, Escherichia coli CFT073
guucgaacguaggccucaggu

SEQ ID NO: 2621871 - RNA, 15 nt, Escherichia coli CFT073
guucgcaaucgcgcc

SEQ ID NO: 2621872 - RNA, 13 nt, Escherichia coli CFT073
guucgccagguca

SEQ ID NO: 2621873 - RNA, 21 nt, Escherichia coli CFT073
guucgccauuuagcagggcag

SEQ ID NO: 2621874 - RNA, 22 nt, Escherichia coli CFT073
guucgccgcagguagcagcagc

SEQ ID NO: 2621875 - RNA, 17 nt, Escherichia coli CFT073
guucgccgggauuucaa

SEQ ID NO: 2621876 - RNA, 20 nt, Escherichia coli CFT073
guucgccuuccagcagcuug

SEQ ID NO: 2621877 - RNA, 22 nt, Escherichia coli CFT073
guucgcgaaaguuaccgcgcca

SEQ ID NO: 2621878 - RNA, 19 nt, Escherichia coli CFT073
guucgcgguuuucuuccag

SEQ ID NO: 2621879 - RNA, 15 nt, Escherichia coli CFT073
guucgcguccagcuu

SEQ ID NO: 2621880 - RNA, 19 nt, Escherichia coli CFT073
guucgcuuucgcgaaugcg

SEQ ID NO: 2621881 - RNA, 23 nt, Escherichia coli CFT073
guucgugaauaugucgcgccagg

SEQ ID NO: 2621882 - RNA, 14 nt, Escherichia coli CFT073
guucguugaucaac

SEQ ID NO: 2621883 - RNA, 17 nt, Escherichia coli CFT073
guucguugaucacuuuc

SEQ ID NO: 2621884 - RNA, 21 nt, Escherichia coli CFT073
guucguugaucacuuucaccg

SEQ ID NO: 2621885 - RNA, 21 nt, Escherichia coli CFT073
guucuccacucugccaggcag

SEQ ID NO: 2621886 - RNA, 22 nt, Escherichia coli CFT073
guucuccacucugccaggcagc

SEQ ID NO: 2621887 - RNA, 17 nt, Escherichia coli CFT073
guucuccuggcauaaac

SEQ ID NO: 2621888 - RNA, 15 nt, Escherichia coli CFT073
guucucgcaaaacgu

SEQ ID NO: 2621889 - RNA, 22 nt, Escherichia coli CFT073
guucucgcaaaacgucgccagc

SEQ ID NO: 2621890 - RNA, 13 nt, Escherichia coli CFT073
guucucuucacgc

SEQ ID NO: 2621891 - RNA, 22 nt, Escherichia coli CFT073
guucucuucauuaccuucaaua

SEQ ID NO: 2621892 - RNA, 14 nt, Escherichia coli CFT073
guucugaacguugc

SEQ ID NO: 2621893 - RNA, 15 nt, Escherichia coli CFT073
guucugaauacccgc

SEQ ID NO: 2621894 - RNA, 12 nt, Escherichia coli CFT073
guucugauuuug

SEQ ID NO: 2621895 - RNA, 16 nt, Escherichia coli CFT073
guucuggaaaaaauuc

SEQ ID NO: 2621896 - RNA, 17 nt, Escherichia coli CFT073
guucuggccguacccag

SEQ ID NO: 2621897 - RNA, 16 nt, Escherichia coli CFT073
guucuggcgcagcgca

SEQ ID NO: 2621898 - RNA, 14 nt, Escherichia coli CFT073
guucugucgcucug

SEQ ID NO: 2621899 - RNA, 21 nt, Escherichia coli CFT073
guucuguggcagggcagcgau

SEQ ID NO: 2621900 - RNA, 13 nt, Escherichia coli CFT073
guucugugguugg

SEQ ID NO: 2621901 - RNA, 20 nt, Escherichia coli CFT073
guucuuacccacuguaucga

SEQ ID NO: 2621902 - RNA, 10 nt, Escherichia coli CFT073
guucuuauaa

SEQ ID NO: 2621903 - RNA, 22 nt, Escherichia coli CFT073
guucuucgccaauggcugccgc

SEQ ID NO: 2621904 - RNA, 13 nt, Escherichia coli CFT073
guucuucggcgcu

SEQ ID NO: 2621905 - RNA, 23 nt, Escherichia coli CFT073
guucuucuucugcaaucaacacu

SEQ ID NO: 2621906 - RNA, 14 nt, Escherichia coli CFT073
guucuuuagcaguu

SEQ ID NO: 2621907 - RNA, 21 nt, Escherichia coli CFT073
guucuuucaacacaugcacau

SEQ ID NO: 2621908 - RNA, 12 nt, Escherichia coli CFT073
guucuuuccugc

SEQ ID NO: 2621909 - RNA, 14 nt, Escherichia coli CFT073
guucuuucggugca

SEQ ID NO: 2621910 - RNA, 19 nt, Escherichia coli CFT073
guucuuucggugcaucgug

SEQ ID NO: 2621911 - RNA, 12 nt, Escherichia coli CFT073
guugaaauaaac

SEQ ID NO: 2621912 - RNA, 15 nt, Escherichia coli CFT073
guugaaauaaaccag

SEQ ID NO: 2621913 - RNA, 19 nt, Escherichia coli CFT073
guugaacgguuuggugaug

SEQ ID NO: 2621914 - RNA, 14 nt, Escherichia coli CFT073
guugaagaugcggu

SEQ ID NO: 2621915 - RNA, 12 nt, Escherichia coli CFT073
guugaagucagg

SEQ ID NO: 2621916 - RNA, 18 nt, Escherichia coli CFT073
guugaauuccgaauuuca

SEQ ID NO: 2621917 - RNA, 14 nt, Escherichia coli CFT073
guugacaaaaauac

SEQ ID NO: 2621918 - RNA, 13 nt, Escherichia coli CFT073
guugaccaagaac

SEQ ID NO: 2621919 - RNA, 23 nt, Escherichia coli CFT073
guugaccauaucaucaauaugaa

SEQ ID NO: 2621920 - RNA, 13 nt, Escherichia coli CFT073
guugaccgcccgg

SEQ ID NO: 2621921 - RNA, 18 nt, Escherichia coli CFT073
guugacguccagcccuuc

SEQ ID NO: 2621922 - RNA, 16 nt, Escherichia coli CFT073
guugagagaagaaacg

SEQ ID NO: 2621923 - RNA, 14 nt, Escherichia coli CFT073
guugagagcaaaca

SEQ ID NO: 2621924 - RNA, 20 nt, Escherichia coli CFT073
guugagcaacaacuucaggu

SEQ ID NO: 2621925 - RNA, 18 nt, Escherichia coli CFT073
guugaggaacucaaacca

SEQ ID NO: 2621926 - RNA, 22 nt, Escherichia coli CFT073
guugaggcgaucgucgccgugc

SEQ ID NO: 2621927 - RNA, 18 nt, Escherichia coli CFT073
guugaggcuaauaaacag

SEQ ID NO: 2621928 - RNA, 20 nt, Escherichia coli CFT073
guugaguagaccagacgacu

SEQ ID NO: 2621929 - RNA, 13 nt, Escherichia coli CFT073
guugaguccggua

SEQ ID NO: 2621930 - RNA, 22 nt, Escherichia coli CFT073
guugauacucauuguuaucagc

SEQ ID NO: 2621931 - RNA, 22 nt, Escherichia coli CFT073
guugaucaggugauggcagcca

SEQ ID NO: 2621932 - RNA, 12 nt, Escherichia coli CFT073
guugaucgccac

SEQ ID NO: 2621933 - RNA, 19 nt, Escherichia coli CFT073
guugaucuucucgucaauc

SEQ ID NO: 2621934 - RNA, 14 nt, Escherichia coli CFT073
guugaucuucucuu

SEQ ID NO: 2621935 - RNA, 14 nt, Escherichia coli CFT073
guugaugauguuca

SEQ ID NO: 2621936 - RNA, 18 nt, Escherichia coli CFT073
guugaugccggaugcggc

SEQ ID NO: 2621937 - RNA, 16 nt, Escherichia coli CFT073
guugaugcucagccuc

SEQ ID NO: 2621938 - RNA, 14 nt, Escherichia coli CFT073
guugaugguaaaau

SEQ ID NO: 2621939 - RNA, 16 nt, Escherichia coli CFT073
guugauuuaacagcaa

SEQ ID NO: 2621940 - RNA, 13 nt, Escherichia coli CFT073
guugauuuuaaag

SEQ ID NO: 2621941 - RNA, 15 nt, Escherichia coli CFT073
guugauuuuguucaa

SEQ ID NO: 2621942 - RNA, 19 nt, Escherichia coli CFT073
guugauuuuucguuuuaau

SEQ ID NO: 2621943 - RNA, 11 nt, Escherichia coli CFT073
guugcaccagc

SEQ ID NO: 2621944 - RNA, 13 nt, Escherichia coli CFT073
guugcaccagcaa

SEQ ID NO: 2621945 - RNA, 14 nt, Escherichia coli CFT073
guugcaccagcaau

SEQ ID NO: 2621946 - RNA, 15 nt, Escherichia coli CFT073
guugcagacccgcca

SEQ ID NO: 2621947 - RNA, 16 nt, Escherichia coli CFT073
guugcagcucugccau

SEQ ID NO: 2621948 - RNA, 16 nt, Escherichia coli CFT073
guugcaguuauuauaa

SEQ ID NO: 2621949 - RNA, 19 nt, Escherichia coli CFT073
guugcauaaaugccgcaau

SEQ ID NO: 2621950 - RNA, 18 nt, Escherichia coli CFT073
guugcauaauuucuucgu

SEQ ID NO: 2621951 - RNA, 14 nt, Escherichia coli CFT073
guugcauuccagau

SEQ ID NO: 2621952 - RNA, 16 nt, Escherichia coli CFT073
guugcauuccagauga

SEQ ID NO: 2621953 - RNA, 14 nt, Escherichia coli CFT073
guugccaccgguac

SEQ ID NO: 2621954 - RNA, 17 nt, Escherichia coli CFT073
guugccacucaggcaaa

SEQ ID NO: 2621955 - RNA, 17 nt, Escherichia coli CFT073
guugccagcagcaacca

SEQ ID NO: 2621956 - RNA, 19 nt, Escherichia coli CFT073
guugccauugccgcacucu

SEQ ID NO: 2621957 - RNA, 18 nt, Escherichia coli CFT073
guugcccuuugcuggcau

SEQ ID NO: 2621958 - RNA, 12 nt, Escherichia coli CFT073
guugccgcccgu

SEQ ID NO: 2621959 - RNA, 22 nt, Escherichia coli CFT073
guugccggauguguugcauccg

SEQ ID NO: 2621960 - RNA, 17 nt, Escherichia coli CFT073
guugccguacucuucaa

SEQ ID NO: 2621961 - RNA, 18 nt, Escherichia coli CFT073
guugccguucuucccgcc

SEQ ID NO: 2621962 - RNA, 19 nt, Escherichia coli CFT073
guugccugaauacacugcu

SEQ ID NO: 2621963 - RNA, 19 nt, Escherichia coli CFT073
guugccugaugcgcugcgc

SEQ ID NO: 2621964 - RNA, 14 nt, Escherichia coli CFT073
guugccugcacuca

SEQ ID NO: 2621965 - RNA, 15 nt, Escherichia coli CFT073
guugccuguuucaua

SEQ ID NO: 2621966 - RNA, 13 nt, Escherichia coli CFT073
guugcgaacuuca

SEQ ID NO: 2621967 - RNA, 21 nt, Escherichia coli CFT073
guugcgcagaguuuccaggcu

SEQ ID NO: 2621968 - RNA, 16 nt, Escherichia coli CFT073
guugcgcaugaccuuu

SEQ ID NO: 2621969 - RNA, 14 nt, Escherichia coli CFT073
guugcgcccaucau

SEQ ID NO: 2621970 - RNA, 17 nt, Escherichia coli CFT073
guugcgcccaucaucau

SEQ ID NO: 2621971 - RNA, 17 nt, Escherichia coli CFT073
guugcgcgacggugcgg

SEQ ID NO: 2621972 - RNA, 18 nt, Escherichia coli CFT073
guugcgcgguuagaaaau

SEQ ID NO: 2621973 - RNA, 20 nt, Escherichia coli CFT073
guugcgcugaaacuucacca

SEQ ID NO: 2621974 - RNA, 18 nt, Escherichia coli CFT073
guugcgcugguggcaggc

SEQ ID NO: 2621975 - RNA, 20 nt, Escherichia coli CFT073
guugcggaaagagcauccga

SEQ ID NO: 2621976 - RNA, 16 nt, Escherichia coli CFT073
guugcggacgcgcagg

SEQ ID NO: 2621977 - RNA, 14 nt, Escherichia coli CFT073
guugcggauuaaau

SEQ ID NO: 2621978 - RNA, 18 nt, Escherichia coli CFT073
guugcggcugcccaucau

SEQ ID NO: 2621979 - RNA, 21 nt, Escherichia coli CFT073
guugcggcugcccaucaucgu

SEQ ID NO: 2621980 - RNA, 18 nt, Escherichia coli CFT073
guugcguaacugaucgua

SEQ ID NO: 2621981 - RNA, 15 nt, Escherichia coli CFT073
guugcgucgaaacca

SEQ ID NO: 2621982 - RNA, 22 nt, Escherichia coli CFT073
guugcgugcuaaaugucauccc

SEQ ID NO: 2621983 - RNA, 15 nt, Escherichia coli CFT073
guugcguucaucagu

SEQ ID NO: 2621984 - RNA, 15 nt, Escherichia coli CFT073
guugcuaacggccac

SEQ ID NO: 2621985 - RNA, 22 nt, Escherichia coli CFT073
guugcucggcaaggccaauacc

SEQ ID NO: 2621986 - RNA, 17 nt, Escherichia coli CFT073
guugcucucgccagcac

SEQ ID NO: 2621987 - RNA, 23 nt, Escherichia coli CFT073
guugcucuucguuaauuucugcu

SEQ ID NO: 2621988 - RNA, 17 nt, Escherichia coli CFT073
guugcugacgaucggca

SEQ ID NO: 2621989 - RNA, 19 nt, Escherichia coli CFT073
guugcugucgcgcagcacu

SEQ ID NO: 2621990 - RNA, 19 nt, Escherichia coli CFT073
guugcuguuguuccagcuu

SEQ ID NO: 2621991 - RNA, 20 nt, Escherichia coli CFT073
guugcuuauugccggaugcg

SEQ ID NO: 2621992 - RNA, 13 nt, Escherichia coli CFT073
guugcuucacgcg

SEQ ID NO: 2621993 - RNA, 13 nt, Escherichia coli CFT073
guugcuuuggcuu

SEQ ID NO: 2621994 - RNA, 15 nt, Escherichia coli CFT073
guuggaauaaacaaa

SEQ ID NO: 2621995 - RNA, 19 nt, Escherichia coli CFT073
guuggacggucuaccaguu

SEQ ID NO: 2621996 - RNA, 14 nt, Escherichia coli CFT073
guuggagaucccgu

SEQ ID NO: 2621997 - RNA, 21 nt, Escherichia coli CFT073
guuggcaagauacgcaucgcg

SEQ ID NO: 2621998 - RNA, 15 nt, Escherichia coli CFT073
guuggcagcggcaag

SEQ ID NO: 2621999 - RNA, 18 nt, Escherichia coli CFT073
guuggcagugccaucaau

SEQ ID NO: 2622000 - RNA, 18 nt, Escherichia coli CFT073
guuggcaucaagaaaacu

SEQ ID NO: 2622001 - RNA, 14 nt, Escherichia coli CFT073
guuggcauuucgac

SEQ ID NO: 2622002 - RNA, 14 nt, Escherichia coli CFT073
guuggccaaaguuc

SEQ ID NO: 2622003 - RNA, 23 nt, Escherichia coli CFT073
guuggcgacgucgguuuccagca

SEQ ID NO: 2622004 - RNA, 15 nt, Escherichia coli CFT073
guuggcgauugcaua

SEQ ID NO: 2622005 - RNA, 15 nt, Escherichia coli CFT073
guuggcgcagcaaau

SEQ ID NO: 2622006 - RNA, 20 nt, Escherichia coli CFT073
guuggcgcguguuccagaga

SEQ ID NO: 2622007 - RNA, 19 nt, Escherichia coli CFT073
guuggcgcugaaucccgca

SEQ ID NO: 2622008 - RNA, 21 nt, Escherichia coli CFT073
guuggcgcugaaucccgcaau

SEQ ID NO: 2622009 - RNA, 14 nt, Escherichia coli CFT073
guuggguuagccaa

SEQ ID NO: 2622010 - RNA, 22 nt, Escherichia coli CFT073
guuggguugccagcgacagaaa

SEQ ID NO: 2622011 - RNA, 21 nt, Escherichia coli CFT073
guugguagagcacgaccuugc

SEQ ID NO: 2622012 - RNA, 13 nt, Escherichia coli CFT073
guuggucaucauc

SEQ ID NO: 2622013 - RNA, 20 nt, Escherichia coli CFT073
guuggucugcagacugaagc

SEQ ID NO: 2622014 - RNA, 21 nt, Escherichia coli CFT073
guuguaaaaaaccccgcuccg

SEQ ID NO: 2622015 - RNA, 18 nt, Escherichia coli CFT073
guuguaaucugcaccagg

SEQ ID NO: 2622016 - RNA, 20 nt, Escherichia coli CFT073
guuguaccagcuucagaaua

SEQ ID NO: 2622017 - RNA, 22 nt, Escherichia coli CFT073
guuguacggcaauaucugcacc

SEQ ID NO: 2622018 - RNA, 18 nt, Escherichia coli CFT073
guuguagacaugguaaaa

SEQ ID NO: 2622019 - RNA, 21 nt, Escherichia coli CFT073
guuguagguacccggaaugua

SEQ ID NO: 2622020 - RNA, 18 nt, Escherichia coli CFT073
guuguaugucauaaaaau

SEQ ID NO: 2622021 - RNA, 20 nt, Escherichia coli CFT073
guugucagcccuuauucacg

SEQ ID NO: 2622022 - RNA, 12 nt, Escherichia coli CFT073
guuguccgccag

SEQ ID NO: 2622023 - RNA, 16 nt, Escherichia coli CFT073
guugucggucgccaua

SEQ ID NO: 2622024 - RNA, 15 nt, Escherichia coli CFT073
guugucuggcuggug

SEQ ID NO: 2622025 - RNA, 14 nt, Escherichia coli CFT073
guugugcaccacca

SEQ ID NO: 2622026 - RNA, 18 nt, Escherichia coli CFT073
guugugccuuccaucccu

SEQ ID NO: 2622027 - RNA, 15 nt, Escherichia coli CFT073
guuguggcaacauaa

SEQ ID NO: 2622028 - RNA, 12 nt, Escherichia coli CFT073
guuguucugcga

SEQ ID NO: 2622029 - RNA, 21 nt, Escherichia coli CFT073
guuguucugcgacgcgcggug

SEQ ID NO: 2622030 - RNA, 17 nt, Escherichia coli CFT073
guuguugauaagcccca

SEQ ID NO: 2622031 - RNA, 19 nt, Escherichia coli CFT073
guuguugcaggaacagaau

SEQ ID NO: 2622032 - RNA, 13 nt, Escherichia coli CFT073
guuguugcaugaa

SEQ ID NO: 2622033 - RNA, 19 nt, Escherichia coli CFT073
guuuaacacgcucuggaug

SEQ ID NO: 2622034 - RNA, 20 nt, Escherichia coli CFT073
guuuaaccgggagauuuucu

SEQ ID NO: 2622035 - RNA, 21 nt, Escherichia coli CFT073
guuuaacgguuucaaccagca

SEQ ID NO: 2622036 - RNA, 19 nt, Escherichia coli CFT073
guuuaagcacuuuaucgau

SEQ ID NO: 2622037 - RNA, 12 nt, Escherichia coli CFT073
guuuaccagcag

SEQ ID NO: 2622038 - RNA, 23 nt, Escherichia coli CFT073
guuuaccgcccaugccaguaaua

SEQ ID NO: 2622039 - RNA, 20 nt, Escherichia coli CFT073
guuuaccggugauuucgcca

SEQ ID NO: 2622040 - RNA, 14 nt, Escherichia coli CFT073
guuuaccggugcca

SEQ ID NO: 2622041 - RNA, 18 nt, Escherichia coli CFT073
guuuaccgucuuucgcca

SEQ ID NO: 2622042 - RNA, 15 nt, Escherichia coli CFT073
guuuacgcagcucac

SEQ ID NO: 2622043 - RNA, 17 nt, Escherichia coli CFT073
guuuacgccgcaucagg

SEQ ID NO: 2622044 - RNA, 16 nt, Escherichia coli CFT073
guuuacgccggaugcg

SEQ ID NO: 2622045 - RNA, 18 nt, Escherichia coli CFT073
guuuacgccggaugcgga

SEQ ID NO: 2622046 - RNA, 15 nt, Escherichia coli CFT073
guuuacgcgcgcagg

SEQ ID NO: 2622047 - RNA, 22 nt, Escherichia coli CFT073
guuuacgcguuuuucagaacuu

SEQ ID NO: 2622048 - RNA, 17 nt, Escherichia coli CFT073
guuuacuaaaaguuauu

SEQ ID NO: 2622049 - RNA, 20 nt, Escherichia coli CFT073
guuuacuuccccggcagugc

SEQ ID NO: 2622050 - RNA, 20 nt, Escherichia coli CFT073
guuuagccgcuucugcagcu

SEQ ID NO: 2622051 - RNA, 16 nt, Escherichia coli CFT073
guuuauaacggugcug

SEQ ID NO: 2622052 - RNA, 21 nt, Escherichia coli CFT073
guuuaucaauuaacugugcca

SEQ ID NO: 2622053 - RNA, 18 nt, Escherichia coli CFT073
guuuaucgucacgcauca

SEQ ID NO: 2622054 - RNA, 17 nt, Escherichia coli CFT073
guuuaugaaucaaauca

SEQ ID NO: 2622055 - RNA, 15 nt, Escherichia coli CFT073
guuuauuagcccagc

SEQ ID NO: 2622056 - RNA, 15 nt, Escherichia coli CFT073
guuuauucacauaga

SEQ ID NO: 2622057 - RNA, 18 nt, Escherichia coli CFT073
guuuauucuuuacugcca

SEQ ID NO: 2622058 - RNA, 17 nt, Escherichia coli CFT073
guuuauuguugauucga

SEQ ID NO: 2622059 - RNA, 22 nt, Escherichia coli CFT073
guuuauuugacccgcaguaaau

SEQ ID NO: 2622060 - RNA, 14 nt, Escherichia coli CFT073
guuucaaacaggcu

SEQ ID NO: 2622061 - RNA, 17 nt, Escherichia coli CFT073
guuucaaaggugccaau

SEQ ID NO: 2622062 - RNA, 18 nt, Escherichia coli CFT073
guuucaacauuuccagcg

SEQ ID NO: 2622063 - RNA, 11 nt, Escherichia coli CFT073
guuucaaccug

SEQ ID NO: 2622064 - RNA, 18 nt, Escherichia coli CFT073
guuucaauauccgguuca

SEQ ID NO: 2622065 - RNA, 14 nt, Escherichia coli CFT073
guuucacacugaca

SEQ ID NO: 2622066 - RNA, 20 nt, Escherichia coli CFT073
guuucaccgaugcacagaac

SEQ ID NO: 2622067 - RNA, 21 nt, Escherichia coli CFT073
guuucaccgaugcacagaacc

SEQ ID NO: 2622068 - RNA, 21 nt, Escherichia coli CFT073
guuucaccgcacgacgaaucu

SEQ ID NO: 2622069 - RNA, 18 nt, Escherichia coli CFT073
guuucacggucggccagu

SEQ ID NO: 2622070 - RNA, 23 nt, Escherichia coli CFT073
guuucacuaagauguuguucaau

SEQ ID NO: 2622071 - RNA, 20 nt, Escherichia coli CFT073
guuucagagcgaauuaagaa

SEQ ID NO: 2622072 - RNA, 17 nt, Escherichia coli CFT073
guuucagauuggugaca

SEQ ID NO: 2622073 - RNA, 17 nt, Escherichia coli CFT073
guuucagccacgcguuc

SEQ ID NO: 2622074 - RNA, 17 nt, Escherichia coli CFT073
guuucauccugccaugc

SEQ ID NO: 2622075 - RNA, 13 nt, Escherichia coli CFT073
guuucaucuucag

SEQ ID NO: 2622076 - RNA, 15 nt, Escherichia coli CFT073
guuucaucuucaguc

SEQ ID NO: 2622077 - RNA, 13 nt, Escherichia coli CFT073
guuucaugaagca

SEQ ID NO: 2622078 - RNA, 21 nt, Escherichia coli CFT073
guuuccagcaucgaccaggau

SEQ ID NO: 2622079 - RNA, 12 nt, Escherichia coli CFT073
guuuccaggcag

SEQ ID NO: 2622080 - RNA, 13 nt, Escherichia coli CFT073
guuuccauaaccg

SEQ ID NO: 2622081 - RNA, 14 nt, Escherichia coli CFT073
guuuccauccggca

SEQ ID NO: 2622082 - RNA, 13 nt, Escherichia coli CFT073
guuuccauucgcu

SEQ ID NO: 2622083 - RNA, 18 nt, Escherichia coli CFT073
guuuccauucgcugcugc

SEQ ID NO: 2622084 - RNA, 14 nt, Escherichia coli CFT073
guuuccccugguuc

SEQ ID NO: 2622085 - RNA, 20 nt, Escherichia coli CFT073
guuuccccugguucaauaaa

SEQ ID NO: 2622086 - RNA, 15 nt, Escherichia coli CFT073
guuucccugauaaug

SEQ ID NO: 2622087 - RNA, 20 nt, Escherichia coli CFT073
guuucccugcauaaucagga

SEQ ID NO: 2622088 - RNA, 18 nt, Escherichia coli CFT073
guuuccuuccagaaacau

SEQ ID NO: 2622089 - RNA, 18 nt, Escherichia coli CFT073
guuucgagaaauucucgu

SEQ ID NO: 2622090 - RNA, 23 nt, Escherichia coli CFT073
guuucgauauaaccauggcuggc

SEQ ID NO: 2622091 - RNA, 21 nt, Escherichia coli CFT073
guuucgaucagcaauuucucc

SEQ ID NO: 2622092 - RNA, 17 nt, Escherichia coli CFT073
guuucgcauccagagau

SEQ ID NO: 2622093 - RNA, 15 nt, Escherichia coli CFT073
guuucgccauaaaac

SEQ ID NO: 2622094 - RNA, 18 nt, Escherichia coli CFT073
guuucgcccguucuuccu

SEQ ID NO: 2622095 - RNA, 15 nt, Escherichia coli CFT073
guuucgccugccaga

SEQ ID NO: 2622096 - RNA, 20 nt, Escherichia coli CFT073
guuucgccuugcguaccggc

SEQ ID NO: 2622097 - RNA, 23 nt, Escherichia coli CFT073
guuucgggcagccuccccagcac

SEQ ID NO: 2622098 - RNA, 23 nt, Escherichia coli CFT073
guuucgguagaaaaauucaaccu

SEQ ID NO: 2622099 - RNA, 14 nt, Escherichia coli CFT073
guuucggugaugaa

SEQ ID NO: 2622100 - RNA, 15 nt, Escherichia coli CFT073
guuucggugaugaau

SEQ ID NO: 2622101 - RNA, 15 nt, Escherichia coli CFT073
guuucguuaaacgcc

SEQ ID NO: 2622102 - RNA, 13 nt, Escherichia coli CFT073
guuucuaucccuu

SEQ ID NO: 2622103 - RNA, 21 nt, Escherichia coli CFT073
guuucuccccaaggacgcguc

SEQ ID NO: 2622104 - RNA, 18 nt, Escherichia coli CFT073
guuucucgacuuuuucca

SEQ ID NO: 2622105 - RNA, 12 nt, Escherichia coli CFT073
guuucucuucug

SEQ ID NO: 2622106 - RNA, 13 nt, Escherichia coli CFT073
guuucucuuucuu

SEQ ID NO: 2622107 - RNA, 16 nt, Escherichia coli CFT073
guuucugcgcuucugc

SEQ ID NO: 2622108 - RNA, 15 nt, Escherichia coli CFT073
guuucuggcaccagg

SEQ ID NO: 2622109 - RNA, 21 nt, Escherichia coli CFT073
guuucugucgagcaucacuau

SEQ ID NO: 2622110 - RNA, 17 nt, Escherichia coli CFT073
guuucuucacccuuuuc

SEQ ID NO: 2622111 - RNA, 13 nt, Escherichia coli CFT073
guuucuuccagcc

SEQ ID NO: 2622112 - RNA, 18 nt, Escherichia coli CFT073
guuugaaagaugcuggau

SEQ ID NO: 2622113 - RNA, 19 nt, Escherichia coli CFT073
guuugacauaaauuccgcu

SEQ ID NO: 2622114 - RNA, 19 nt, Escherichia coli CFT073
guuugaguucaccgccauu

SEQ ID NO: 2622115 - RNA, 20 nt, Escherichia coli CFT073
guuugaguucaccgccauua

SEQ ID NO: 2622116 - RNA, 18 nt, Escherichia coli CFT073
guuugaucacuuccagca

SEQ ID NO: 2622117 - RNA, 20 nt, Escherichia coli CFT073
guuugaugguggucgcauca

SEQ ID NO: 2622118 - RNA, 22 nt, Escherichia coli CFT073
guuugaugguggucgcaucauc

SEQ ID NO: 2622119 - RNA, 15 nt, Escherichia coli CFT073
guuugcaaacccaca

SEQ ID NO: 2622120 - RNA, 16 nt, Escherichia coli CFT073
guuugcaauuugcagc

SEQ ID NO: 2622121 - RNA, 13 nt, Escherichia coli CFT073
guuugcagcagaa

SEQ ID NO: 2622122 - RNA, 21 nt, Escherichia coli CFT073
guuugcagugaucgugugcca

SEQ ID NO: 2622123 - RNA, 15 nt, Escherichia coli CFT073
guuugcauccaguuc

SEQ ID NO: 2622124 - RNA, 13 nt, Escherichia coli CFT073
guuugcaucgcca

SEQ ID NO: 2622125 - RNA, 19 nt, Escherichia coli CFT073
guuugccaaaccagcuaau

SEQ ID NO: 2622126 - RNA, 17 nt, Escherichia coli CFT073
guuugcccuucacaggu

SEQ ID NO: 2622127 - RNA, 21 nt, Escherichia coli CFT073
guuugccgcuuuuaacccaac

SEQ ID NO: 2622128 - RNA, 19 nt, Escherichia coli CFT073
guuugccggauacguuuga

SEQ ID NO: 2622129 - RNA, 12 nt, Escherichia coli CFT073
guuugcgcagcu

SEQ ID NO: 2622130 - RNA, 16 nt, Escherichia coli CFT073
guuugcgggacaacuu

SEQ ID NO: 2622131 - RNA, 18 nt, Escherichia coli CFT073
guuugcgguguguggcug

SEQ ID NO: 2622132 - RNA, 19 nt, Escherichia coli CFT073
guuugcgucagcuucagau

SEQ ID NO: 2622133 - RNA, 23 nt, Escherichia coli CFT073
guuugcucaucaugaaaugcagg

SEQ ID NO: 2622134 - RNA, 22 nt, Escherichia coli CFT073
guuugcuggcaaugaguaguuu

SEQ ID NO: 2622135 - RNA, 16 nt, Escherichia coli CFT073
guuuggagccgcuggc

SEQ ID NO: 2622136 - RNA, 20 nt, Escherichia coli CFT073
guuuggauucauccggcaac

SEQ ID NO: 2622137 - RNA, 22 nt, Escherichia coli CFT073
guuugggccgguacuuuugccc

SEQ ID NO: 2622138 - RNA, 16 nt, Escherichia coli CFT073
guuugggcguuacagc

SEQ ID NO: 2622139 - RNA, 22 nt, Escherichia coli CFT073
guuugguuaagucacgggcggu

SEQ ID NO: 2622140 - RNA, 15 nt, Escherichia coli CFT073
guuuguaaucgaugg

SEQ ID NO: 2622141 - RNA, 13 nt, Escherichia coli CFT073
guuuguagcagaa

SEQ ID NO: 2622142 - RNA, 21 nt, Escherichia coli CFT073
guuuguagcagaaaagaacca

SEQ ID NO: 2622143 - RNA, 17 nt, Escherichia coli CFT073
guuuguagccgccaaac

SEQ ID NO: 2622144 - RNA, 20 nt, Escherichia coli CFT073
guuuguaggccggauaaggc

SEQ ID NO: 2622145 - RNA, 17 nt, Escherichia coli CFT073
guuuguccgccagaaau

SEQ ID NO: 2622146 - RNA, 16 nt, Escherichia coli CFT073
guuugugguaaauuaa

SEQ ID NO: 2622147 - RNA, 21 nt, Escherichia coli CFT073
guuuguuaaccaccaguaaau

SEQ ID NO: 2622148 - RNA, 16 nt, Escherichia coli CFT073
guuuguucaagcgcaa

SEQ ID NO: 2622149 - RNA, 22 nt, Escherichia coli CFT073
guuuguugaaacuuuccaugcc

SEQ ID NO: 2622150 - RNA, 21 nt, Escherichia coli CFT073
guuuguuucccccacugugca

SEQ ID NO: 2622151 - RNA, 14 nt, Escherichia coli CFT073
guuuuaaauauugu

SEQ ID NO: 2622152 - RNA, 13 nt, Escherichia coli CFT073
guuuuaagcaaau

SEQ ID NO: 2622153 - RNA, 22 nt, Escherichia coli CFT073
guuuuaauagugguaccaggau

SEQ ID NO: 2622154 - RNA, 19 nt, Escherichia coli CFT073
guuuuacaauauccagcgc

SEQ ID NO: 2622155 - RNA, 20 nt, Escherichia coli CFT073
guuuuacauugauagcccaa

SEQ ID NO: 2622156 - RNA, 16 nt, Escherichia coli CFT073
guuuuaccuucauccc

SEQ ID NO: 2622157 - RNA, 21 nt, Escherichia coli CFT073
guuuuacgcugacgcggguau

SEQ ID NO: 2622158 - RNA, 13 nt, Escherichia coli CFT073
guuuuaguaacaa

SEQ ID NO: 2622159 - RNA, 17 nt, Escherichia coli CFT073
guuuuaguaguugugug

SEQ ID NO: 2622160 - RNA, 18 nt, Escherichia coli CFT073
guuuuauuauuccauccu

SEQ ID NO: 2622161 - RNA, 20 nt, Escherichia coli CFT073
guuuucaacgugucuuuuac

SEQ ID NO: 2622162 - RNA, 12 nt, Escherichia coli CFT073
guuuucaccagu

SEQ ID NO: 2622163 - RNA, 18 nt, Escherichia coli CFT073
guuuucacccucgccaua

SEQ ID NO: 2622164 - RNA, 14 nt, Escherichia coli CFT073
guuuucaccggcac

SEQ ID NO: 2622165 - RNA, 21 nt, Escherichia coli CFT073
guuuucaccuuacuuccggcu

SEQ ID NO: 2622166 - RNA, 16 nt, Escherichia coli CFT073
guuuucagcaccagau

SEQ ID NO: 2622167 - RNA, 11 nt, Escherichia coli CFT073
guuuucauccc

SEQ ID NO: 2622168 - RNA, 17 nt, Escherichia coli CFT073
guuuuccagccuuuuuc

SEQ ID NO: 2622169 - RNA, 17 nt, Escherichia coli CFT073
guuuuccagggccagua

SEQ ID NO: 2622170 - RNA, 18 nt, Escherichia coli CFT073
guuuuccagggccaguac

SEQ ID NO: 2622171 - RNA, 22 nt, Escherichia coli CFT073
guuuuccauccuccgcagccau

SEQ ID NO: 2622172 - RNA, 20 nt, Escherichia coli CFT073
guuuuccgcuucuucuucca

SEQ ID NO: 2622173 - RNA, 12 nt, Escherichia coli CFT073
guuuuccuuuuc

SEQ ID NO: 2622174 - RNA, 17 nt, Escherichia coli CFT073
guuuucgauuuuuucca

SEQ ID NO: 2622175 - RNA, 21 nt, Escherichia coli CFT073
guuuucgauuuuuuccagcgc

SEQ ID NO: 2622176 - RNA, 18 nt, Escherichia coli CFT073
guuuucgccgcauccggc

SEQ ID NO: 2622177 - RNA, 20 nt, Escherichia coli CFT073
guuuucgucaacguagcuau

SEQ ID NO: 2622178 - RNA, 18 nt, Escherichia coli CFT073
guuuucguuacuccgcca

SEQ ID NO: 2622179 - RNA, 20 nt, Escherichia coli CFT073
guuuucuacuuuguaaacga

SEQ ID NO: 2622180 - RNA, 14 nt, Escherichia coli CFT073
guuuucuacuuuuu

SEQ ID NO: 2622181 - RNA, 16 nt, Escherichia coli CFT073
guuuucuacuuuuucu

SEQ ID NO: 2622182 - RNA, 16 nt, Escherichia coli CFT073
guuuucucguccagcu

SEQ ID NO: 2622183 - RNA, 17 nt, Escherichia coli CFT073
guuuucucguccagcuu

SEQ ID NO: 2622184 - RNA, 13 nt, Escherichia coli CFT073
guuuucugccaga

SEQ ID NO: 2622185 - RNA, 13 nt, Escherichia coli CFT073
guuuucuuugcca

SEQ ID NO: 2622186 - RNA, 20 nt, Escherichia coli CFT073
guuuugaaaagaguucaucg

SEQ ID NO: 2622187 - RNA, 17 nt, Escherichia coli CFT073
guuuugcaucaacugcg

SEQ ID NO: 2622188 - RNA, 17 nt, Escherichia coli CFT073
guuuugccagucagcuc

SEQ ID NO: 2622189 - RNA, 11 nt, Escherichia coli CFT073
guuuugccauc

SEQ ID NO: 2622190 - RNA, 20 nt, Escherichia coli CFT073
guuuuggcugugaauuacug

SEQ ID NO: 2622191 - RNA, 18 nt, Escherichia coli CFT073
guuuuguagugcgcgcca

SEQ ID NO: 2622192 - RNA, 17 nt, Escherichia coli CFT073
guuuugucggcaugaua

SEQ ID NO: 2622193 - RNA, 13 nt, Escherichia coli CFT073
guuuuuaaaccaa

SEQ ID NO: 2622194 - RNA, 17 nt, Escherichia coli CFT073
guuuuuacccagcagca

SEQ ID NO: 2622195 - RNA, 15 nt, Escherichia coli CFT073
guuuuuaucuucaca

SEQ ID NO: 2622196 - RNA, 18 nt, Escherichia coli CFT073
guuuuucacccgcaauca

SEQ ID NO: 2622197 - RNA, 12 nt, Escherichia coli CFT073
guuuuucauccc

SEQ ID NO: 2622198 - RNA, 22 nt, Escherichia coli CFT073
guuuuucauugcacucuccucc

SEQ ID NO: 2622199 - RNA, 16 nt, Escherichia coli CFT073
guuuuuccccugccag

SEQ ID NO: 2622200 - RNA, 17 nt, Escherichia coli CFT073
guuuuuccccugccaga

SEQ ID NO: 2622201 - RNA, 15 nt, Escherichia coli CFT073
guuuuucccuucccg

SEQ ID NO: 2622202 - RNA, 12 nt, Escherichia coli CFT073
guuuuucuuccg

SEQ ID NO: 2622203 - RNA, 12 nt, Escherichia coli CFT073
guuuuucuuuuu

SEQ ID NO: 2622204 - RNA, 15 nt, Escherichia coli CFT073
guuuuucuuuuucaa

SEQ ID NO: 2622205 - RNA, 14 nt, Escherichia coli CFT073
guuuuugguuucac

SEQ ID NO: 2622206 - RNA, 19 nt, Escherichia coli CFT073
guuuuuguaucgaacaaga

SEQ ID NO: 2622207 - RNA, 15 nt, Escherichia coli CFT073
guuuuuuaagguuua

SEQ ID NO: 2622208 - RNA, 18 nt, Escherichia coli CFT073
guuuuuugcgaaaaauaa

SEQ ID NO: 2622209 - RNA, 14 nt, Escherichia coli CFT073
guuuuuuuuaucac

SEQ ID NO: 2622210 - RNA, 20 nt, Escherichia coli CFT073
uaaaaaaacaucauaauaau

SEQ ID NO: 2622211 - RNA, 19 nt, Escherichia coli CFT073
uaaaaaaacuuuugucauu

SEQ ID NO: 2622212 - RNA, 21 nt, Escherichia coli CFT073
uaaaaaaagaacaaccaagac

SEQ ID NO: 2622213 - RNA, 13 nt, Escherichia coli CFT073
uaaaaaaauuaau

SEQ ID NO: 2622214 - RNA, 13 nt, Escherichia coli CFT073
uaaaaaacagugc

SEQ ID NO: 2622215 - RNA, 19 nt, Escherichia coli CFT073
uaaaaaacagugcuucuaa

SEQ ID NO: 2622216 - RNA, 20 nt, Escherichia coli CFT073
uaaaaaagcgucgccgucaa

SEQ ID NO: 2622217 - RNA, 11 nt, Escherichia coli CFT073
uaaaaaccaga

SEQ ID NO: 2622218 - RNA, 18 nt, Escherichia coli CFT073
uaaaaacgcuuugcugcc

SEQ ID NO: 2622219 - RNA, 21 nt, Escherichia coli CFT073
uaaaaacucaucgucaaaauu

SEQ ID NO: 2622220 - RNA, 12 nt, Escherichia coli CFT073
uaaaaagcggca

SEQ ID NO: 2622221 - RNA, 20 nt, Escherichia coli CFT073
uaaaaaguuguuaauaaguu

SEQ ID NO: 2622222 - RNA, 23 nt, Escherichia coli CFT073
uaaaaauaaacaacaaaauaccg

SEQ ID NO: 2622223 - RNA, 21 nt, Escherichia coli CFT073
uaaaaauauauuccuauauau

SEQ ID NO: 2622224 - RNA, 18 nt, Escherichia coli CFT073
uaaaaauccgguugcuac

SEQ ID NO: 2622225 - RNA, 16 nt, Escherichia coli CFT073
uaaaaaucggcaacau

SEQ ID NO: 2622226 - RNA, 14 nt, Escherichia coli CFT073
uaaaaauuucuccc

SEQ ID NO: 2622227 - RNA, 17 nt, Escherichia coli CFT073
uaaaacaagcagcugcc

SEQ ID NO: 2622228 - RNA, 13 nt, Escherichia coli CFT073
uaaaacaauuaac

SEQ ID NO: 2622229 - RNA, 23 nt, Escherichia coli CFT073
uaaaacacaucagugauacaucu

SEQ ID NO: 2622230 - RNA, 13 nt, Escherichia coli CFT073
uaaaacagcagug

SEQ ID NO: 2622231 - RNA, 13 nt, Escherichia coli CFT073
uaaaaccaccgac

SEQ ID NO: 2622232 - RNA, 11 nt, Escherichia coli CFT073
uaaaaccauua

SEQ ID NO: 2622233 - RNA, 20 nt, Escherichia coli CFT073
uaaaaccccgcguacugaau

SEQ ID NO: 2622234 - RNA, 15 nt, Escherichia coli CFT073
uaaaaccgacuuaaa

SEQ ID NO: 2622235 - RNA, 14 nt, Escherichia coli CFT073
uaaaaccgugcuuc

SEQ ID NO: 2622236 - RNA, 20 nt, Escherichia coli CFT073
uaaaacgacucucauagacu

SEQ ID NO: 2622237 - RNA, 23 nt, Escherichia coli CFT073
uaaaacgauaguggcucaggcuc

SEQ ID NO: 2622238 - RNA, 13 nt, Escherichia coli CFT073
uaaaacgcgccca

SEQ ID NO: 2622239 - RNA, 15 nt, Escherichia coli CFT073
uaaaacggaauaucc

SEQ ID NO: 2622240 - RNA, 19 nt, Escherichia coli CFT073
uaaaacgguggccacagca

SEQ ID NO: 2622241 - RNA, 18 nt, Escherichia coli CFT073
uaaaacuaacgccaggaa

SEQ ID NO: 2622242 - RNA, 23 nt, Escherichia coli CFT073
uaaaacuucauuugucucaaaac

SEQ ID NO: 2622243 - RNA, 16 nt, Escherichia coli CFT073
uaaaacuuuauucagu

SEQ ID NO: 2622244 - RNA, 12 nt, Escherichia coli CFT073
uaaaagauaaac

SEQ ID NO: 2622245 - RNA, 13 nt, Escherichia coli CFT073
uaaaagcaaacug

SEQ ID NO: 2622246 - RNA, 14 nt, Escherichia coli CFT073
uaaaagcaaacugu

SEQ ID NO: 2622247 - RNA, 21 nt, Escherichia coli CFT073
uaaaagcacagaaucuaagau

SEQ ID NO: 2622248 - RNA, 21 nt, Escherichia coli CFT073
uaaaagcauagccccagcgca

SEQ ID NO: 2622249 - RNA, 13 nt, Escherichia coli CFT073
uaaaagccaggag

SEQ ID NO: 2622250 - RNA, 20 nt, Escherichia coli CFT073
uaaaagcgcgcccaacagua

SEQ ID NO: 2622251 - RNA, 15 nt, Escherichia coli CFT073
uaaaagcgugaaaca

SEQ ID NO: 2622252 - RNA, 21 nt, Escherichia coli CFT073
uaaaagcgugaaacaaaucac

SEQ ID NO: 2622253 - RNA, 22 nt, Escherichia coli CFT073
uaaaagcuguacaucgcgccaa

SEQ ID NO: 2622254 - RNA, 21 nt, Escherichia coli CFT073
uaaaagcuuuccggaaaaauc

SEQ ID NO: 2622255 - RNA, 18 nt, Escherichia coli CFT073
uaaaaguaaauaagaaaa

SEQ ID NO: 2622256 - RNA, 22 nt, Escherichia coli CFT073
uaaaaguuuccuguuucucauu

SEQ ID NO: 2622257 - RNA, 20 nt, Escherichia coli CFT073
uaaaauaagcacaaagcaau

SEQ ID NO: 2622258 - RNA, 15 nt, Escherichia coli CFT073
uaaaauaaucaccag

SEQ ID NO: 2622259 - RNA, 19 nt, Escherichia coli CFT073
uaaaauaaucaccagagga

SEQ ID NO: 2622260 - RNA, 14 nt, Escherichia coli CFT073
uaaaauaucacucg

SEQ ID NO: 2622261 - RNA, 13 nt, Escherichia coli CFT073
uaaaauaucuucu

SEQ ID NO: 2622262 - RNA, 21 nt, Escherichia coli CFT073
uaaaauaucuucuacuucacg

SEQ ID NO: 2622263 - RNA, 12 nt, Escherichia coli CFT073
uaaaaucacagg

SEQ ID NO: 2622264 - RNA, 18 nt, Escherichia coli CFT073
uaaaaucagaaaucacca

SEQ ID NO: 2622265 - RNA, 14 nt, Escherichia coli CFT073
uaaaauccaacucc

SEQ ID NO: 2622266 - RNA, 16 nt, Escherichia coli CFT073
uaaaaucccauaagug

SEQ ID NO: 2622267 - RNA, 15 nt, Escherichia coli CFT073
uaaaaucgccaaacu

SEQ ID NO: 2622268 - RNA, 23 nt, Escherichia coli CFT073
uaaaaucuaaugcuccuuuaauc

SEQ ID NO: 2622269 - RNA, 14 nt, Escherichia coli CFT073
uaaaaugcgaaaaa

SEQ ID NO: 2622270 - RNA, 13 nt, Escherichia coli CFT073
uaaaauuauccag

SEQ ID NO: 2622271 - RNA, 18 nt, Escherichia coli CFT073
uaaaauugauaaccaaua

SEQ ID NO: 2622272 - RNA, 21 nt, Escherichia coli CFT073
uaaaauuucuuuuuuucauug

SEQ ID NO: 2622273 - RNA, 16 nt, Escherichia coli CFT073
uaaacaaacagcgcgc

SEQ ID NO: 2622274 - RNA, 13 nt, Escherichia coli CFT073
uaaacaaacauga

SEQ ID NO: 2622275 - RNA, 13 nt, Escherichia coli CFT073
uaaacaacaaaau

SEQ ID NO: 2622276 - RNA, 15 nt, Escherichia coli CFT073
uaaacaacaaaauac

SEQ ID NO: 2622277 - RNA, 15 nt, Escherichia coli CFT073
uaaacaacgccgcca

SEQ ID NO: 2622278 - RNA, 14 nt, Escherichia coli CFT073
uaaacaauacagcg

SEQ ID NO: 2622279 - RNA, 19 nt, Escherichia coli CFT073
uaaacaauugcauaucaau

SEQ ID NO: 2622280 - RNA, 14 nt, Escherichia coli CFT073
uaaacacaccacag

SEQ ID NO: 2622281 - RNA, 15 nt, Escherichia coli CFT073
uaaacaccaccgaaa

SEQ ID NO: 2622282 - RNA, 14 nt, Escherichia coli CFT073
uaaacaccagcaau

SEQ ID NO: 2622283 - RNA, 14 nt, Escherichia coli CFT073
uaaacaccagcagc

SEQ ID NO: 2622284 - RNA, 15 nt, Escherichia coli CFT073
uaaacaccagcagca

SEQ ID NO: 2622285 - RNA, 22 nt, Escherichia coli CFT073
uaaacaccguuuuaccaucgau

SEQ ID NO: 2622286 - RNA, 21 nt, Escherichia coli CFT073
uaaacaccugggcaaugguga

SEQ ID NO: 2622287 - RNA, 18 nt, Escherichia coli CFT073
uaaacaccuucguccagc

SEQ ID NO: 2622288 - RNA, 24 nt, Escherichia coli CFT073
uaaacagaauacccagcaaugcca

SEQ ID NO: 2622289 - RNA, 13 nt, Escherichia coli CFT073
uaaacagcacuga

SEQ ID NO: 2622290 - RNA, 22 nt, Escherichia coli CFT073
uaaacagcccuuugauuugucu

SEQ ID NO: 2622291 - RNA, 15 nt, Escherichia coli CFT073
uaaacaggcaguaau

SEQ ID NO: 2622292 - RNA, 22 nt, Escherichia coli CFT073
uaaacagggggaggcaucuucc

SEQ ID NO: 2622293 - RNA, 13 nt, Escherichia coli CFT073
uaaaccaaagccc

SEQ ID NO: 2622294 - RNA, 17 nt, Escherichia coli CFT073
uaaaccaacaaaacuca

SEQ ID NO: 2622295 - RNA, 12 nt, Escherichia coli CFT073
uaaaccaauggu

SEQ ID NO: 2622296 - RNA, 15 nt, Escherichia coli CFT073
uaaaccacaucagcg

SEQ ID NO: 2622297 - RNA, 15 nt, Escherichia coli CFT073
uaaaccacccaccag

SEQ ID NO: 2622298 - RNA, 23 nt, Escherichia coli CFT073
uaaaccacugacacaggcagcaa

SEQ ID NO: 2622299 - RNA, 19 nt, Escherichia coli CFT073
uaaacccgaccacuuccac

SEQ ID NO: 2622300 - RNA, 16 nt, Escherichia coli CFT073
uaaacccggcaucaug

SEQ ID NO: 2622301 - RNA, 13 nt, Escherichia coli CFT073
uaaacccggccug

SEQ ID NO: 2622302 - RNA, 15 nt, Escherichia coli CFT073
uaaacccuaacauca

SEQ ID NO: 2622303 - RNA, 18 nt, Escherichia coli CFT073
uaaacccuaacaucaucc

SEQ ID NO: 2622304 - RNA, 22 nt, Escherichia coli CFT073
uaaacccuucacuguaggcaua

SEQ ID NO: 2622305 - RNA, 14 nt, Escherichia coli CFT073
uaaacccuuucugc

SEQ ID NO: 2622306 - RNA, 15 nt, Escherichia coli CFT073
uaaacccuuucugcu

SEQ ID NO: 2622307 - RNA, 23 nt, Escherichia coli CFT073
uaaaccgcaucauguaaaucaau

SEQ ID NO: 2622308 - RNA, 17 nt, Escherichia coli CFT073
uaaaccgcucgucacau

SEQ ID NO: 2622309 - RNA, 19 nt, Escherichia coli CFT073
uaaaccggacaauaaaaaa

SEQ ID NO: 2622310 - RNA, 20 nt, Escherichia coli CFT073
uaaaccguccccaaaaaagc

SEQ ID NO: 2622311 - RNA, 19 nt, Escherichia coli CFT073
uaaaccguggcaaaaucca

SEQ ID NO: 2622312 - RNA, 13 nt, Escherichia coli CFT073
uaaaccuccagca

SEQ ID NO: 2622313 - RNA, 14 nt, Escherichia coli CFT073
uaaaccugcucacc

SEQ ID NO: 2622314 - RNA, 21 nt, Escherichia coli CFT073
uaaaccugcucaccagucacu

SEQ ID NO: 2622315 - RNA, 23 nt, Escherichia coli CFT073
uaaaccugcucaccagucacuaa

SEQ ID NO: 2622316 - RNA, 16 nt, Escherichia coli CFT073
uaaaccuuguuuaauc

SEQ ID NO: 2622317 - RNA, 18 nt, Escherichia coli CFT073
uaaaccuuguuuaaucuc

SEQ ID NO: 2622318 - RNA, 19 nt, Escherichia coli CFT073
uaaaccuuguuuaaucucg

SEQ ID NO: 2622319 - RNA, 23 nt, Escherichia coli CFT073
uaaacgaaaugcgcuuaaucaau

SEQ ID NO: 2622320 - RNA, 16 nt, Escherichia coli CFT073
uaaacgaaucugcaaa

SEQ ID NO: 2622321 - RNA, 19 nt, Escherichia coli CFT073
uaaacgacccugccacagu

SEQ ID NO: 2622322 - RNA, 18 nt, Escherichia coli CFT073
uaaacgccgguuccugca

SEQ ID NO: 2622323 - RNA, 19 nt, Escherichia coli CFT073
uaaacgccugcuuaucgcc

SEQ ID NO: 2622324 - RNA, 21 nt, Escherichia coli CFT073
uaaacgccugcuuaucgcccu

SEQ ID NO: 2622325 - RNA, 14 nt, Escherichia coli CFT073
uaaacgccuuaucc

SEQ ID NO: 2622326 - RNA, 20 nt, Escherichia coli CFT073
uaaacgccuuauccgaccua

SEQ ID NO: 2622327 - RNA, 20 nt, Escherichia coli CFT073
uaaacgccuuauccggccua

SEQ ID NO: 2622328 - RNA, 20 nt, Escherichia coli CFT073
uaaacgccuuauccguccua

SEQ ID NO: 2622329 - RNA, 18 nt, Escherichia coli CFT073
uaaacggaacauacggca

SEQ ID NO: 2622330 - RNA, 22 nt, Escherichia coli CFT073
uaaacggcauaaauuucaggca

SEQ ID NO: 2622331 - RNA, 19 nt, Escherichia coli CFT073
uaaacggcugggaaaucac

SEQ ID NO: 2622332 - RNA, 15 nt, Escherichia coli CFT073
uaaacgggcgaugga

SEQ ID NO: 2622333 - RNA, 14 nt, Escherichia coli CFT073
uaaacgugaauuuu

SEQ ID NO: 2622334 - RNA, 23 nt, Escherichia coli CFT073
uaaacuacgcucgcgguagccca

SEQ ID NO: 2622335 - RNA, 20 nt, Escherichia coli CFT073
uaaacucaccuuguguuuug

SEQ ID NO: 2622336 - RNA, 19 nt, Escherichia coli CFT073
uaaacucgcugcggacaaa

SEQ ID NO: 2622337 - RNA, 16 nt, Escherichia coli CFT073
uaaacugaucuuuauc

SEQ ID NO: 2622338 - RNA, 22 nt, Escherichia coli CFT073
uaaacugaugugucccuuuacu

SEQ ID NO: 2622339 - RNA, 13 nt, Escherichia coli CFT073
uaaacuggcugug

SEQ ID NO: 2622340 - RNA, 16 nt, Escherichia coli CFT073
uaaacugggcgcggcc

SEQ ID NO: 2622341 - RNA, 18 nt, Escherichia coli CFT073
uaaacugggcgcggccca

SEQ ID NO: 2622342 - RNA, 12 nt, Escherichia coli CFT073
uaaacugucaac

SEQ ID NO: 2622343 - RNA, 17 nt, Escherichia coli CFT073
uaaacuucaacgcugcg

SEQ ID NO: 2622344 - RNA, 21 nt, Escherichia coli CFT073
uaaacuucaacgcugcggcgu

SEQ ID NO: 2622345 - RNA, 14 nt, Escherichia coli CFT073
uaaacuucacgcuc

SEQ ID NO: 2622346 - RNA, 12 nt, Escherichia coli CFT073
uaaacuuucaua

SEQ ID NO: 2622347 - RNA, 22 nt, Escherichia coli CFT073
uaaagaaacugguugcaacauc

SEQ ID NO: 2622348 - RNA, 16 nt, Escherichia coli CFT073
uaaagaacccggcaau

SEQ ID NO: 2622349 - RNA, 14 nt, Escherichia coli CFT073
uaaagaaugaaauu

SEQ ID NO: 2622350 - RNA, 16 nt, Escherichia coli CFT073
uaaagacuauccgcca

SEQ ID NO: 2622351 - RNA, 18 nt, Escherichia coli CFT073
uaaagacuauccgccaua

SEQ ID NO: 2622352 - RNA, 19 nt, Escherichia coli CFT073
uaaagacuuuaucgugcgg

SEQ ID NO: 2622353 - RNA, 15 nt, Escherichia coli CFT073
uaaagagaucaaagu

SEQ ID NO: 2622354 - RNA, 16 nt, Escherichia coli CFT073
uaaagagaucaaaguc

SEQ ID NO: 2622355 - RNA, 21 nt, Escherichia coli CFT073
uaaagagaucaaagucucugu

SEQ ID NO: 2622356 - RNA, 16 nt, Escherichia coli CFT073
uaaagauaaugccagc

SEQ ID NO: 2622357 - RNA, 19 nt, Escherichia coli CFT073
uaaagauacacagcccagu

SEQ ID NO: 2622358 - RNA, 17 nt, Escherichia coli CFT073
uaaagauauugucgccc

SEQ ID NO: 2622359 - RNA, 22 nt, Escherichia coli CFT073
uaaagaugaaaacgccaccaga

SEQ ID NO: 2622360 - RNA, 19 nt, Escherichia coli CFT073
uaaagauguuuugccugaa

SEQ ID NO: 2622361 - RNA, 15 nt, Escherichia coli CFT073
uaaagauuguucuuu

SEQ ID NO: 2622362 - RNA, 18 nt, Escherichia coli CFT073
uaaagauuguucuuuauc

SEQ ID NO: 2622363 - RNA, 20 nt, Escherichia coli CFT073
uaaagauuguucuuuauccg

SEQ ID NO: 2622364 - RNA, 14 nt, Escherichia coli CFT073
uaaagcaauaaacc

SEQ ID NO: 2622365 - RNA, 19 nt, Escherichia coli CFT073
uaaagcacugguggaaugg

SEQ ID NO: 2622366 - RNA, 14 nt, Escherichia coli CFT073
uaaagcaucagacu

SEQ ID NO: 2622367 - RNA, 12 nt, Escherichia coli CFT073
uaaagccagcgg

SEQ ID NO: 2622368 - RNA, 16 nt, Escherichia coli CFT073
uaaagcccaucguuga

SEQ ID NO: 2622369 - RNA, 20 nt, Escherichia coli CFT073
uaaagcccgcagcguccagc

SEQ ID NO: 2622370 - RNA, 17 nt, Escherichia coli CFT073
uaaagcccgccaucgcc

SEQ ID NO: 2622371 - RNA, 21 nt, Escherichia coli CFT073
uaaagcccgcuucaaacgcug

SEQ ID NO: 2622372 - RNA, 22 nt, Escherichia coli CFT073
uaaagccggugcggucaggcau

SEQ ID NO: 2622373 - RNA, 23 nt, Escherichia coli CFT073
uaaagccgugaguauauuucagg

SEQ ID NO: 2622374 - RNA, 15 nt, Escherichia coli CFT073
uaaagccugauaccc

SEQ ID NO: 2622375 - RNA, 14 nt, Escherichia coli CFT073
uaaagccuuuuacc

SEQ ID NO: 2622376 - RNA, 19 nt, Escherichia coli CFT073
uaaagccuuuuaccgccuu

SEQ ID NO: 2622377 - RNA, 23 nt, Escherichia coli CFT073
uaaagcgcguaguuugucuucaa

SEQ ID NO: 2622378 - RNA, 13 nt, Escherichia coli CFT073
uaaagcguccagc

SEQ ID NO: 2622379 - RNA, 18 nt, Escherichia coli CFT073
uaaagcguuccagcagcu

SEQ ID NO: 2622380 - RNA, 19 nt, Escherichia coli CFT073
uaaagcugccuugccaggu

SEQ ID NO: 2622381 - RNA, 23 nt, Escherichia coli CFT073
uaaagcugcggauccugagcaaa

SEQ ID NO: 2622382 - RNA, 23 nt, Escherichia coli CFT073
uaaagcuuuuuauuacucuccag

SEQ ID NO: 2622383 - RNA, 19 nt, Escherichia coli CFT073
uaaaggauauucgucgcag

SEQ ID NO: 2622384 - RNA, 16 nt, Escherichia coli CFT073
uaaaggcaaaaugcca

SEQ ID NO: 2622385 - RNA, 18 nt, Escherichia coli CFT073
uaaaggcaaacaggaucc

SEQ ID NO: 2622386 - RNA, 14 nt, Escherichia coli CFT073
uaaaggccaucccu

SEQ ID NO: 2622387 - RNA, 22 nt, Escherichia coli CFT073
uaaagggaugcccccagauugu

SEQ ID NO: 2622388 - RNA, 17 nt, Escherichia coli CFT073
uaaaguaacgaauaauc

SEQ ID NO: 2622389 - RNA, 18 nt, Escherichia coli CFT073
uaaaguacgcuuucccuu

SEQ ID NO: 2622390 - RNA, 17 nt, Escherichia coli CFT073
uaaaguacucuuugaac

SEQ ID NO: 2622391 - RNA, 16 nt, Escherichia coli CFT073
uaaaguaguaaguagc

SEQ ID NO: 2622392 - RNA, 21 nt, Escherichia coli CFT073
uaaaguaguaaguagcaccga

SEQ ID NO: 2622393 - RNA, 18 nt, Escherichia coli CFT073
uaaagucauucaggcgua

SEQ ID NO: 2622394 - RNA, 17 nt, Escherichia coli CFT073
uaaagugaaauauuucu

SEQ ID NO: 2622395 - RNA, 15 nt, Escherichia coli CFT073
uaaagugcgcuuugu

SEQ ID NO: 2622396 - RNA, 19 nt, Escherichia coli CFT073
uaaaguuaccuguggcgua

SEQ ID NO: 2622397 - RNA, 16 nt, Escherichia coli CFT073
uaaaguuuuuauauuu

SEQ ID NO: 2622398 - RNA, 14 nt, Escherichia coli CFT073
uaaauaaaaacccg

SEQ ID NO: 2622399 - RNA, 14 nt, Escherichia coli CFT073
uaaauaaaauaacc

SEQ ID NO: 2622400 - RNA, 15 nt, Escherichia coli CFT073
uaaauaaacaccagc

SEQ ID NO: 2622401 - RNA, 19 nt, Escherichia coli CFT073
uaaauaacagugccgcgca

SEQ ID NO: 2622402 - RNA, 17 nt, Escherichia coli CFT073
uaaauaaccuuauuaug

SEQ ID NO: 2622403 - RNA, 14 nt, Escherichia coli CFT073
uaaauaauaaauua

SEQ ID NO: 2622404 - RNA, 15 nt, Escherichia coli CFT073
uaaauaauauuuccc

SEQ ID NO: 2622405 - RNA, 17 nt, Escherichia coli CFT073
uaaauaauauuucccca

SEQ ID NO: 2622406 - RNA, 22 nt, Escherichia coli CFT073
uaaauaauauuuccccaauuca

SEQ ID NO: 2622407 - RNA, 13 nt, Escherichia coli CFT073
uaaauacagagca

SEQ ID NO: 2622408 - RNA, 24 nt, Escherichia coli CFT073
uaaauaccaagccaagccagagca

SEQ ID NO: 2622409 - RNA, 16 nt, Escherichia coli CFT073
uaaauacucauuaauu

SEQ ID NO: 2622410 - RNA, 14 nt, Escherichia coli CFT073
uaaauacugcgcau

SEQ ID NO: 2622411 - RNA, 18 nt, Escherichia coli CFT073
uaaauaguggcaaauucu

SEQ ID NO: 2622412 - RNA, 11 nt, Escherichia coli CFT073
uaaauauccuc

SEQ ID NO: 2622413 - RNA, 13 nt, Escherichia coli CFT073
uaaauauuauaug

SEQ ID NO: 2622414 - RNA, 14 nt, Escherichia coli CFT073
uaaauauuauuggc

SEQ ID NO: 2622415 - RNA, 22 nt, Escherichia coli CFT073
uaaauauuauuggcaucguauu

SEQ ID NO: 2622416 - RNA, 15 nt, Escherichia coli CFT073
uaaauauucugccca

SEQ ID NO: 2622417 - RNA, 21 nt, Escherichia coli CFT073
uaaauauuuuuuagcacaaga

SEQ ID NO: 2622418 - RNA, 22 nt, Escherichia coli CFT073
uaaaucaggaaaacgugccacu

SEQ ID NO: 2622419 - RNA, 23 nt, Escherichia coli CFT073
uaaaucaucugguuccuaaauaa

SEQ ID NO: 2622420 - RNA, 18 nt, Escherichia coli CFT073
uaaaucaugcuccuguaa

SEQ ID NO: 2622421 - RNA, 23 nt, Escherichia coli CFT073
uaaaucaugcuccuguaauggcu

SEQ ID NO: 2622422 - RNA, 18 nt, Escherichia coli CFT073
uaaaucauuguuuucauu

SEQ ID NO: 2622423 - RNA, 14 nt, Escherichia coli CFT073
uaaauccgccgcca

SEQ ID NO: 2622424 - RNA, 13 nt, Escherichia coli CFT073
uaaauccugccaa

SEQ ID NO: 2622425 - RNA, 14 nt, Escherichia coli CFT073
uaaauccuuuguac

SEQ ID NO: 2622426 - RNA, 18 nt, Escherichia coli CFT073
uaaaucgacguucugcca

SEQ ID NO: 2622427 - RNA, 23 nt, Escherichia coli CFT073
uaaaucgauaacgcgcugccaga

SEQ ID NO: 2622428 - RNA, 17 nt, Escherichia coli CFT073
uaaaucgcccacggcgg

SEQ ID NO: 2622429 - RNA, 12 nt, Escherichia coli CFT073
uaaaucggcgaa

SEQ ID NO: 2622430 - RNA, 17 nt, Escherichia coli CFT073
uaaaucggggucugauu

SEQ ID NO: 2622431 - RNA, 15 nt, Escherichia coli CFT073
uaaaucguaccagga

SEQ ID NO: 2622432 - RNA, 16 nt, Escherichia coli CFT073
uaaaucguugcccgca

SEQ ID NO: 2622433 - RNA, 14 nt, Escherichia coli CFT073
uaaaucugccguca

SEQ ID NO: 2622434 - RNA, 21 nt, Escherichia coli CFT073
uaaaucugccgucaucgacuu

SEQ ID NO: 2622435 - RNA, 14 nt, Escherichia coli CFT073
uaaaucugcuuuuc

SEQ ID NO: 2622436 - RNA, 17 nt, Escherichia coli CFT073
uaaaucugcuuuucaua

SEQ ID NO: 2622437 - RNA, 14 nt, Escherichia coli CFT073
uaaaucuucaagca

SEQ ID NO: 2622438 - RNA, 15 nt, Escherichia coli CFT073
uaaaucuucaagcau

SEQ ID NO: 2622439 - RNA, 14 nt, Escherichia coli CFT073
uaaaucuucuucuu

SEQ ID NO: 2622440 - RNA, 13 nt, Escherichia coli CFT073
uaaaugaagaaaa

SEQ ID NO: 2622441 - RNA, 15 nt, Escherichia coli CFT073
uaaaugaagaaaaac

SEQ ID NO: 2622442 - RNA, 22 nt, Escherichia coli CFT073
uaaaugaagaaaaaccguauuc

SEQ ID NO: 2622443 - RNA, 22 nt, Escherichia coli CFT073
uaaaugcacaggagacaccagc

SEQ ID NO: 2622444 - RNA, 19 nt, Escherichia coli CFT073
uaaaugccacugaauaaag

SEQ ID NO: 2622445 - RNA, 17 nt, Escherichia coli CFT073
uaaaugcccgacaaaaa

SEQ ID NO: 2622446 - RNA, 21 nt, Escherichia coli CFT073
uaaaugcccgacaaaaauuau

SEQ ID NO: 2622447 - RNA, 19 nt, Escherichia coli CFT073
uaaaugccggguaaagauu

SEQ ID NO: 2622448 - RNA, 21 nt, Escherichia coli CFT073
uaaaugccggguaaagauugu

SEQ ID NO: 2622449 - RNA, 19 nt, Escherichia coli CFT073
uaaaugcuugacucugugg

SEQ ID NO: 2622450 - RNA, 14 nt, Escherichia coli CFT073
uaaauggcacagug

SEQ ID NO: 2622451 - RNA, 18 nt, Escherichia coli CFT073
uaaauggcacagugguca

SEQ ID NO: 2622452 - RNA, 22 nt, Escherichia coli CFT073
uaaauggcuuaaccccguaucc

SEQ ID NO: 2622453 - RNA, 15 nt, Escherichia coli CFT073
uaaauggugauauca

SEQ ID NO: 2622454 - RNA, 12 nt, Escherichia coli CFT073
uaaaugucaucc

SEQ ID NO: 2622455 - RNA, 15 nt, Escherichia coli CFT073
uaaaugucaugacau

SEQ ID NO: 2622456 - RNA, 15 nt, Escherichia coli CFT073
uaaauuacugagcaa

SEQ ID NO: 2622457 - RNA, 17 nt, Escherichia coli CFT073
uaaauuauagaugcagc

SEQ ID NO: 2622458 - RNA, 21 nt, Escherichia coli CFT073
uaaauuauagaugcagcauag

SEQ ID NO: 2622459 - RNA, 19 nt, Escherichia coli CFT073
uaaauuauuugcguagucu

SEQ ID NO: 2622460 - RNA, 23 nt, Escherichia coli CFT073
uaaauuauuugcguagucugacc

SEQ ID NO: 2622461 - RNA, 13 nt, Escherichia coli CFT073
uaaauuccacgcg

SEQ ID NO: 2622462 - RNA, 21 nt, Escherichia coli CFT073
uaaauucucccgcccccgcca

SEQ ID NO: 2622463 - RNA, 19 nt, Escherichia coli CFT073
uaaauugcaauuuuuauau

SEQ ID NO: 2622464 - RNA, 15 nt, Escherichia coli CFT073
uaaauugcagcgauu

SEQ ID NO: 2622465 - RNA, 23 nt, Escherichia coli CFT073
uaaauugcaguacgauaauggcu

SEQ ID NO: 2622466 - RNA, 18 nt, Escherichia coli CFT073
uaaauugccccagacaca

SEQ ID NO: 2622467 - RNA, 17 nt, Escherichia coli CFT073
uaaauuguucauauuaa

SEQ ID NO: 2622468 - RNA, 20 nt, Escherichia coli CFT073
uaaauuucaggcaacaaaaa

SEQ ID NO: 2622469 - RNA, 19 nt, Escherichia coli CFT073
uaaauuugccaucucugca

SEQ ID NO: 2622470 - RNA, 21 nt, Escherichia coli CFT073
uaaauuuuaagccauuaaauc

SEQ ID NO: 2622471 - RNA, 12 nt, Escherichia coli CFT073
uaacaaacggcg

SEQ ID NO: 2622472 - RNA, 23 nt, Escherichia coli CFT073
uaacaaacuccccgcaaaccaga

SEQ ID NO: 2622473 - RNA, 16 nt, Escherichia coli CFT073
uaacaaauaauugcca

SEQ ID NO: 2622474 - RNA, 16 nt, Escherichia coli CFT073
uaacaaaugugccauu

SEQ ID NO: 2622475 - RNA, 14 nt, Escherichia coli CFT073
uaacaauaacaauu

SEQ ID NO: 2622476 - RNA, 16 nt, Escherichia coli CFT073
uaacaauacgcccacg

SEQ ID NO: 2622477 - RNA, 19 nt, Escherichia coli CFT073
uaacaauagcgaacagaca

SEQ ID NO: 2622478 - RNA, 13 nt, Escherichia coli CFT073
uaacaaucaccaa

SEQ ID NO: 2622479 - RNA, 20 nt, Escherichia coli CFT073
uaacaaucaccaaaccaaca

SEQ ID NO: 2622480 - RNA, 20 nt, Escherichia coli CFT073
uaacaauccgauaaucccuu

SEQ ID NO: 2622481 - RNA, 14 nt, Escherichia coli CFT073
uaacaauuaucugg

SEQ ID NO: 2622482 - RNA, 14 nt, Escherichia coli CFT073
uaacaauucuccaa

SEQ ID NO: 2622483 - RNA, 20 nt, Escherichia coli CFT073
uaacaauuuaucagacaauc

SEQ ID NO: 2622484 - RNA, 16 nt, Escherichia coli CFT073
uaacacagcaauaaua

SEQ ID NO: 2622485 - RNA, 15 nt, Escherichia coli CFT073
uaacaccaaucagcg

SEQ ID NO: 2622486 - RNA, 15 nt, Escherichia coli CFT073
uaacaccaccagcgc

SEQ ID NO: 2622487 - RNA, 17 nt, Escherichia coli CFT073
uaacaccaguuuccagu

SEQ ID NO: 2622488 - RNA, 14 nt, Escherichia coli CFT073
uaacaccggcgcac

SEQ ID NO: 2622489 - RNA, 23 nt, Escherichia coli CFT073
uaacacgacggcauucgccacug

SEQ ID NO: 2622490 - RNA, 22 nt, Escherichia coli CFT073
uaacacgcucuggcaggcuuca

SEQ ID NO: 2622491 - RNA, 20 nt, Escherichia coli CFT073
uaacacugagcgugagugcg

SEQ ID NO: 2622492 - RNA, 15 nt, Escherichia coli CFT073
uaacacuucugccgc

SEQ ID NO: 2622493 - RNA, 16 nt, Escherichia coli CFT073
uaacacuuucgccugc

SEQ ID NO: 2622494 - RNA, 23 nt, Escherichia coli CFT073
uaacacuuucgccugcggcgcau

SEQ ID NO: 2622495 - RNA, 17 nt, Escherichia coli CFT073
uaacagaauacugccgu

SEQ ID NO: 2622496 - RNA, 17 nt, Escherichia coli CFT073
uaacagaaugcgcgcga

SEQ ID NO: 2622497 - RNA, 17 nt, Escherichia coli CFT073
uaacagauugagaauaa

SEQ ID NO: 2622498 - RNA, 17 nt, Escherichia coli CFT073
uaacagcaaaacacccc

SEQ ID NO: 2622499 - RNA, 11 nt, Escherichia coli CFT073
uaacagcagca

SEQ ID NO: 2622500 - RNA, 14 nt, Escherichia coli CFT073
uaacagcagcagcg

SEQ ID NO: 2622501 - RNA, 23 nt, Escherichia coli CFT073
uaacagcccaauaccuucaucga

SEQ ID NO: 2622502 - RNA, 15 nt, Escherichia coli CFT073
uaacagcgcaccaga

SEQ ID NO: 2622503 - RNA, 21 nt, Escherichia coli CFT073
uaacagcgcaccagaaacaau

SEQ ID NO: 2622504 - RNA, 22 nt, Escherichia coli CFT073
uaacagcgcaccagaaacaaua

SEQ ID NO: 2622505 - RNA, 21 nt, Escherichia coli CFT073
uaacagcgccgcgauaaaauc

SEQ ID NO: 2622506 - RNA, 16 nt, Escherichia coli CFT073
uaacagcggugcaccu

SEQ ID NO: 2622507 - RNA, 17 nt, Escherichia coli CFT073
uaacagcguccacagcc

SEQ ID NO: 2622508 - RNA, 15 nt, Escherichia coli CFT073
uaacaggcgauuuca

SEQ ID NO: 2622509 - RNA, 16 nt, Escherichia coli CFT073
uaacaggcgcacacga

SEQ ID NO: 2622510 - RNA, 20 nt, Escherichia coli CFT073
uaacagucuggcguuuucuu

SEQ ID NO: 2622511 - RNA, 19 nt, Escherichia coli CFT073
uaacagugauugcuuuugu

SEQ ID NO: 2622512 - RNA, 20 nt, Escherichia coli CFT073
uaacaguguuucuccgccaa

SEQ ID NO: 2622513 - RNA, 15 nt, Escherichia coli CFT073
uaacaguuccagcaa

SEQ ID NO: 2622514 - RNA, 20 nt, Escherichia coli CFT073
uaacaguuccagcaaaucaa

SEQ ID NO: 2622515 - RNA, 20 nt, Escherichia coli CFT073
uaacaguugcaguuauuaua

SEQ ID NO: 2622516 - RNA, 18 nt, Escherichia coli CFT073
uaacaguuugccaaacca

SEQ ID NO: 2622517 - RNA, 14 nt, Escherichia coli CFT073
uaacauaacagcca

SEQ ID NO: 2622518 - RNA, 15 nt, Escherichia coli CFT073
uaacauaacagccau

SEQ ID NO: 2622519 - RNA, 21 nt, Escherichia coli CFT073
uaacauccccauaucccggaa

SEQ ID NO: 2622520 - RNA, 17 nt, Escherichia coli CFT073
uaacaucccuucaauua

SEQ ID NO: 2622521 - RNA, 17 nt, Escherichia coli CFT073
uaacaucgcaaaauaca

SEQ ID NO: 2622522 - RNA, 18 nt, Escherichia coli CFT073
uaacaucguccaugccuu

SEQ ID NO: 2622523 - RNA, 17 nt, Escherichia coli CFT073
uaacaucugacacagcg

SEQ ID NO: 2622524 - RNA, 17 nt, Escherichia coli CFT073
uaacaugagauccagcg

SEQ ID NO: 2622525 - RNA, 13 nt, Escherichia coli CFT073
uaacauggcggua

SEQ ID NO: 2622526 - RNA, 13 nt, Escherichia coli CFT073
uaacauuacuaaa

SEQ ID NO: 2622527 - RNA, 16 nt, Escherichia coli CFT073
uaacauuaugucuguu

SEQ ID NO: 2622528 - RNA, 21 nt, Escherichia coli CFT073
uaacauuuuaguuuacauuaa

SEQ ID NO: 2622529 - RNA, 13 nt, Escherichia coli CFT073
uaaccaaacuuca

SEQ ID NO: 2622530 - RNA, 14 nt, Escherichia coli CFT073
uaaccaaacuucag

SEQ ID NO: 2622531 - RNA, 21 nt, Escherichia coli CFT073
uaaccaacaauacaaaauagg

SEQ ID NO: 2622532 - RNA, 15 nt, Escherichia coli CFT073
uaaccaacaucuuua

SEQ ID NO: 2622533 - RNA, 19 nt, Escherichia coli CFT073
uaaccaaccaccaaagaug

SEQ ID NO: 2622534 - RNA, 12 nt, Escherichia coli CFT073
uaaccaaucacg

SEQ ID NO: 2622535 - RNA, 17 nt, Escherichia coli CFT073
uaaccaccagcacugau

SEQ ID NO: 2622536 - RNA, 18 nt, Escherichia coli CFT073
uaaccaccaguaaauugu

SEQ ID NO: 2622537 - RNA, 15 nt, Escherichia coli CFT073
uaaccagaaaccgug

SEQ ID NO: 2622538 - RNA, 19 nt, Escherichia coli CFT073
uaaccagacgauuuucccu

SEQ ID NO: 2622539 - RNA, 20 nt, Escherichia coli CFT073
uaaccagacgccccaguaaa

SEQ ID NO: 2622540 - RNA, 22 nt, Escherichia coli CFT073
uaaccagacgccccaguaaaca

SEQ ID NO: 2622541 - RNA, 20 nt, Escherichia coli CFT073
uaaccagagagcuuauccag

SEQ ID NO: 2622542 - RNA, 20 nt, Escherichia coli CFT073
uaaccagaugucgcgcacug

SEQ ID NO: 2622543 - RNA, 10 nt, Escherichia coli CFT073
uaaccagcac

SEQ ID NO: 2622544 - RNA, 15 nt, Escherichia coli CFT073
uaaccagcaccagcu

SEQ ID NO: 2622545 - RNA, 15 nt, Escherichia coli CFT073
uaaccagcgcagaca

SEQ ID NO: 2622546 - RNA, 21 nt, Escherichia coli CFT073
uaaccagcgcagacaccagaa

SEQ ID NO: 2622547 - RNA, 23 nt, Escherichia coli CFT073
uaaccagcgcagacaccagaaua

SEQ ID NO: 2622548 - RNA, 17 nt, Escherichia coli CFT073
uaaccagguaaagacca

SEQ ID NO: 2622549 - RNA, 15 nt, Escherichia coli CFT073
uaaccaucagcuccg

SEQ ID NO: 2622550 - RNA, 13 nt, Escherichia coli CFT073
uaaccauccacau

SEQ ID NO: 2622551 - RNA, 22 nt, Escherichia coli CFT073
uaaccauccgagcagcaaugcu

SEQ ID NO: 2622552 - RNA, 21 nt, Escherichia coli CFT073
uaaccaugacgucgaaucggu

SEQ ID NO: 2622553 - RNA, 15 nt, Escherichia coli CFT073
uaaccaugcagcgcc

SEQ ID NO: 2622554 - RNA, 17 nt, Escherichia coli CFT073
uaacccacaccauaaug

SEQ ID NO: 2622555 - RNA, 19 nt, Escherichia coli CFT073
uaacccacagcgcaccaac

SEQ ID NO: 2622556 - RNA, 20 nt, Escherichia coli CFT073
uaacccaccaccgcuaacug

SEQ ID NO: 2622557 - RNA, 20 nt, Escherichia coli CFT073
uaacccagcaccaacaaagc

SEQ ID NO: 2622558 - RNA, 21 nt, Escherichia coli CFT073
uaacccagcaccaacaaagcc

SEQ ID NO: 2622559 - RNA, 21 nt, Escherichia coli CFT073
uaacccaguacaacgccgauu

SEQ ID NO: 2622560 - RNA, 18 nt, Escherichia coli CFT073
uaacccauuuaaaaauca

SEQ ID NO: 2622561 - RNA, 14 nt, Escherichia coli CFT073
uaacccccugcccc

SEQ ID NO: 2622562 - RNA, 15 nt, Escherichia coli CFT073
uaacccgagaucuuu

SEQ ID NO: 2622563 - RNA, 22 nt, Escherichia coli CFT073
uaacccgagaucuuuaauacac

SEQ ID NO: 2622564 - RNA, 17 nt, Escherichia coli CFT073
uaacccggcauaaugau

SEQ ID NO: 2622565 - RNA, 22 nt, Escherichia coli CFT073
uaacccuucauauuccugaccc

SEQ ID NO: 2622566 - RNA, 21 nt, Escherichia coli CFT073
uaaccgaccgguccacuuccu

SEQ ID NO: 2622567 - RNA, 23 nt, Escherichia coli CFT073
uaaccgcccagugccagcaccac

SEQ ID NO: 2622568 - RNA, 14 nt, Escherichia coli CFT073
uaaccgccgccaga

SEQ ID NO: 2622569 - RNA, 14 nt, Escherichia coli CFT073
uaaccgcugccagg

SEQ ID NO: 2622570 - RNA, 22 nt, Escherichia coli CFT073
uaaccggccuugcggaaagcca

SEQ ID NO: 2622571 - RNA, 19 nt, Escherichia coli CFT073
uaaccggcuuuuugauacu

SEQ ID NO: 2622572 - RNA, 15 nt, Escherichia coli CFT073
uaaccgggagauuuu

SEQ ID NO: 2622573 - RNA, 22 nt, Escherichia coli CFT073
uaaccgggagauuuucuccugc

SEQ ID NO: 2622574 - RNA, 21 nt, Escherichia coli CFT073
uaaccgguacgccgcguuuau

SEQ ID NO: 2622575 - RNA, 22 nt, Escherichia coli CFT073
uaaccgucagcgcaugauuccc

SEQ ID NO: 2622576 - RNA, 16 nt, Escherichia coli CFT073
uaaccguccaguugug

SEQ ID NO: 2622577 - RNA, 20 nt, Escherichia coli CFT073
uaaccgucuuugcugauacu

SEQ ID NO: 2622578 - RNA, 18 nt, Escherichia coli CFT073
uaaccguugguuauccug

SEQ ID NO: 2622579 - RNA, 21 nt, Escherichia coli CFT073
uaaccguugguuauccuggua

SEQ ID NO: 2622580 - RNA, 20 nt, Escherichia coli CFT073
uaaccguuuguuuuuuaagg

SEQ ID NO: 2622581 - RNA, 18 nt, Escherichia coli CFT073
uaaccucaugguuuuuau

SEQ ID NO: 2622582 - RNA, 17 nt, Escherichia coli CFT073
uaaccucugacucacug

SEQ ID NO: 2622583 - RNA, 14 nt, Escherichia coli CFT073
uaaccuguuccuua

SEQ ID NO: 2622584 - RNA, 16 nt, Escherichia coli CFT073
uaaccuguuuucgauu

SEQ ID NO: 2622585 - RNA, 22 nt, Escherichia coli CFT073
uaaccuguuuucgauuuuuucc

SEQ ID NO: 2622586 - RNA, 19 nt, Escherichia coli CFT073
uaaccuuauggugucuaug

SEQ ID NO: 2622587 - RNA, 13 nt, Escherichia coli CFT073
uaaccuuccagcu

SEQ ID NO: 2622588 - RNA, 17 nt, Escherichia coli CFT073
uaaccuucuucauuaug

SEQ ID NO: 2622589 - RNA, 21 nt, Escherichia coli CFT073
uaaccuuuaucacgcagcaga

SEQ ID NO: 2622590 - RNA, 16 nt, Escherichia coli CFT073
uaaccuuugaacagcc

SEQ ID NO: 2622591 - RNA, 16 nt, Escherichia coli CFT073
uaaccuuuuagcugug

SEQ ID NO: 2622592 - RNA, 19 nt, Escherichia coli CFT073
uaacgaacgcagugauaac

SEQ ID NO: 2622593 - RNA, 21 nt, Escherichia coli CFT073
uaacgaagucguuaguaacca

SEQ ID NO: 2622594 - RNA, 15 nt, Escherichia coli CFT073
uaacgauaauuuaca

SEQ ID NO: 2622595 - RNA, 15 nt, Escherichia coli CFT073
uaacgaucacggcga

SEQ ID NO: 2622596 - RNA, 17 nt, Escherichia coli CFT073
uaacgaucaucacgaca

SEQ ID NO: 2622597 - RNA, 16 nt, Escherichia coli CFT073
uaacgaugccagcgcu

SEQ ID NO: 2622598 - RNA, 20 nt, Escherichia coli CFT073
uaacgauuacucguuaucag

SEQ ID NO: 2622599 - RNA, 21 nt, Escherichia coli CFT073
uaacgauuucaucgcccaggc

SEQ ID NO: 2622600 - RNA, 14 nt, Escherichia coli CFT073
uaacgcacaaccag

SEQ ID NO: 2622601 - RNA, 18 nt, Escherichia coli CFT073
uaacgcacaguacgcgcc

SEQ ID NO: 2622602 - RNA, 23 nt, Escherichia coli CFT073
uaacgcagaaucuucuucucagc

SEQ ID NO: 2622603 - RNA, 21 nt, Escherichia coli CFT073
uaacgcagcaaaagcaggcac

SEQ ID NO: 2622604 - RNA, 17 nt, Escherichia coli CFT073
uaacgcagcgauagcuu

SEQ ID NO: 2622605 - RNA, 15 nt, Escherichia coli CFT073
uaacgcauaauaaag

SEQ ID NO: 2622606 - RNA, 23 nt, Escherichia coli CFT073
uaacgccaauucauuccuugaaa

SEQ ID NO: 2622607 - RNA, 19 nt, Escherichia coli CFT073
uaacgccagccacaaacca

SEQ ID NO: 2622608 - RNA, 14 nt, Escherichia coli CFT073
uaacgccagugaug

SEQ ID NO: 2622609 - RNA, 12 nt, Escherichia coli CFT073
uaacgccccaca

SEQ ID NO: 2622610 - RNA, 21 nt, Escherichia coli CFT073
uaacgccccacaagcccgcca

SEQ ID NO: 2622611 - RNA, 15 nt, Escherichia coli CFT073
uaacgccccacuccu

SEQ ID NO: 2622612 - RNA, 17 nt, Escherichia coli CFT073
uaacgccccggcaaaac

SEQ ID NO: 2622613 - RNA, 14 nt, Escherichia coli CFT073
uaacgccgcuauac

SEQ ID NO: 2622614 - RNA, 22 nt, Escherichia coli CFT073
uaacgccuuauccggccugcaa

SEQ ID NO: 2622615 - RNA, 16 nt, Escherichia coli CFT073
uaacgccuucccuuuc

SEQ ID NO: 2622616 - RNA, 20 nt, Escherichia coli CFT073
uaacgcgccaauagccgcac

SEQ ID NO: 2622617 - RNA, 18 nt, Escherichia coli CFT073
uaacgcgcugccagauca

SEQ ID NO: 2622618 - RNA, 16 nt, Escherichia coli CFT073
uaacgcgcuuucuucg

SEQ ID NO: 2622619 - RNA, 21 nt, Escherichia coli CFT073
uaacgcggcagcaaccgcuuc

SEQ ID NO: 2622620 - RNA, 23 nt, Escherichia coli CFT073
uaacgcguuagcuuaauaagaaa

SEQ ID NO: 2622621 - RNA, 14 nt, Escherichia coli CFT073
uaacgcguuaucag

SEQ ID NO: 2622622 - RNA, 21 nt, Escherichia coli CFT073
uaacgcugauacccggcacac

SEQ ID NO: 2622623 - RNA, 23 nt, Escherichia coli CFT073
uaacgcugauacccggcacacaa

SEQ ID NO: 2622624 - RNA, 19 nt, Escherichia coli CFT073
uaacggagaauccagcccc

SEQ ID NO: 2622625 - RNA, 17 nt, Escherichia coli CFT073
uaacggcagaucgguaa

SEQ ID NO: 2622626 - RNA, 20 nt, Escherichia coli CFT073
uaacggcagcaaggcuauuc

SEQ ID NO: 2622627 - RNA, 17 nt, Escherichia coli CFT073
uaacggcauuuuccagc

SEQ ID NO: 2622628 - RNA, 15 nt, Escherichia coli CFT073
uaacggcccggcgac

SEQ ID NO: 2622629 - RNA, 22 nt, Escherichia coli CFT073
uaacggcucacccccaucagca

SEQ ID NO: 2622630 - RNA, 17 nt, Escherichia coli CFT073
uaacgguaucuuuccag

SEQ ID NO: 2622631 - RNA, 23 nt, Escherichia coli CFT073
uaacgguggugcuguuuucuccc

SEQ ID NO: 2622632 - RNA, 16 nt, Escherichia coli CFT073
uaacgguuucaaccag

SEQ ID NO: 2622633 - RNA, 20 nt, Escherichia coli CFT073
uaacgguuucaaccagcagg

SEQ ID NO: 2622634 - RNA, 21 nt, Escherichia coli CFT073
uaacguaaggcgcaacauauu

SEQ ID NO: 2622635 - RNA, 12 nt, Escherichia coli CFT073
uaacguaauucg

SEQ ID NO: 2622636 - RNA, 18 nt, Escherichia coli CFT073
uaacguaguguaaaugca

SEQ ID NO: 2622637 - RNA, 18 nt, Escherichia coli CFT073
uaacguauaacucgccuu

SEQ ID NO: 2622638 - RNA, 13 nt, Escherichia coli CFT073
uaacguccaguug

SEQ ID NO: 2622639 - RNA, 17 nt, Escherichia coli CFT073
uaacguccaguugaagc

SEQ ID NO: 2622640 - RNA, 22 nt, Escherichia coli CFT073
uaacgucgcaagacgaaaaaug

SEQ ID NO: 2622641 - RNA, 20 nt, Escherichia coli CFT073
uaacgucgccagaaaucagc

SEQ ID NO: 2622642 - RNA, 16 nt, Escherichia coli CFT073
uaacguuaauccugau

SEQ ID NO: 2622643 - RNA, 19 nt, Escherichia coli CFT073
uaacguugaaccgccccac

SEQ ID NO: 2622644 - RNA, 22 nt, Escherichia coli CFT073
uaacguugcucaaggguuucgc

SEQ ID NO: 2622645 - RNA, 13 nt, Escherichia coli CFT073
uaacguuuaagau

SEQ ID NO: 2622646 - RNA, 20 nt, Escherichia coli CFT073
uaacguuucuuucaucagau

SEQ ID NO: 2622647 - RNA, 21 nt, Escherichia coli CFT073
uaacguuugccagccacacca

SEQ ID NO: 2622648 - RNA, 13 nt, Escherichia coli CFT073
uaacguuuuacgc

SEQ ID NO: 2622649 - RNA, 18 nt, Escherichia coli CFT073
uaacuaaaugaaauauuu

SEQ ID NO: 2622650 - RNA, 19 nt, Escherichia coli CFT073
uaacuagcaacaaaaaaac

SEQ ID NO: 2622651 - RNA, 23 nt, Escherichia coli CFT073
uaacuaucaggucuuucugaaau

SEQ ID NO: 2622652 - RNA, 14 nt, Escherichia coli CFT073
uaacucaccaucaa

SEQ ID NO: 2622653 - RNA, 19 nt, Escherichia coli CFT073
uaacucaggaugagaaaag

SEQ ID NO: 2622654 - RNA, 18 nt, Escherichia coli CFT073
uaacucagguggcgguau

SEQ ID NO: 2622655 - RNA, 17 nt, Escherichia coli CFT073
uaacucaugacaaccug

SEQ ID NO: 2622656 - RNA, 18 nt, Escherichia coli CFT073
uaacucauugauuuucaa

SEQ ID NO: 2622657 - RNA, 16 nt, Escherichia coli CFT073
uaacucgaauuauuca

SEQ ID NO: 2622658 - RNA, 19 nt, Escherichia coli CFT073
uaacucgaauuauucagag

SEQ ID NO: 2622659 - RNA, 22 nt, Escherichia coli CFT073
uaacucgaauuauucagaguau

SEQ ID NO: 2622660 - RNA, 14 nt, Escherichia coli CFT073
uaacucucaugcuu

SEQ ID NO: 2622661 - RNA, 13 nt, Escherichia coli CFT073
uaacucuuccugc

SEQ ID NO: 2622662 - RNA, 14 nt, Escherichia coli CFT073
uaacucuuucaaug

SEQ ID NO: 2622663 - RNA, 18 nt, Escherichia coli CFT073
uaacucuuugggcagaaa

SEQ ID NO: 2622664 - RNA, 23 nt, Escherichia coli CFT073
uaacucuuugggcagaaaaucca

SEQ ID NO: 2622665 - RNA, 12 nt, Escherichia coli CFT073
uaacugaauaau

SEQ ID NO: 2622666 - RNA, 20 nt, Escherichia coli CFT073
uaacugacaguagccuuuau

SEQ ID NO: 2622667 - RNA, 17 nt, Escherichia coli CFT073
uaacugacgggcuuuuu

SEQ ID NO: 2622668 - RNA, 21 nt, Escherichia coli CFT073
uaacugauggcaaaugcaaca

SEQ ID NO: 2622669 - RNA, 17 nt, Escherichia coli CFT073
uaacugcccgcaucaag

SEQ ID NO: 2622670 - RNA, 21 nt, Escherichia coli CFT073
uaacugccuccugcaaaugcu

SEQ ID NO: 2622671 - RNA, 16 nt, Escherichia coli CFT073
uaacuggcaaaaacaa

SEQ ID NO: 2622672 - RNA, 15 nt, Escherichia coli CFT073
uaacuggcaaucaug

SEQ ID NO: 2622673 - RNA, 22 nt, Escherichia coli CFT073
uaacuguucgagguaauccagc

SEQ ID NO: 2622674 - RNA, 15 nt, Escherichia coli CFT073
uaacuuaucaagaaa

SEQ ID NO: 2622675 - RNA, 15 nt, Escherichia coli CFT073
uaacuuaucuguaau

SEQ ID NO: 2622676 - RNA, 19 nt, Escherichia coli CFT073
uaacuucaccgguucauca

SEQ ID NO: 2622677 - RNA, 11 nt, Escherichia coli CFT073
uaacuuccugc

SEQ ID NO: 2622678 - RNA, 23 nt, Escherichia coli CFT073
uaacuuccugcuggcuguaaaau

SEQ ID NO: 2622679 - RNA, 22 nt, Escherichia coli CFT073
uaacuucuuuacuggcuuucau

SEQ ID NO: 2622680 - RNA, 15 nt, Escherichia coli CFT073
uaacuuuaauuuugu

SEQ ID NO: 2622681 - RNA, 23 nt, Escherichia coli CFT073
uaacuuuaauuuugugcagcaca

SEQ ID NO: 2622682 - RNA, 17 nt, Escherichia coli CFT073
uaacuuugaagcccagu

SEQ ID NO: 2622683 - RNA, 16 nt, Escherichia coli CFT073
uaacuuugaucgcguu

SEQ ID NO: 2622684 - RNA, 19 nt, Escherichia coli CFT073
uaacuuuguaaggaguuuu

SEQ ID NO: 2622685 - RNA, 18 nt, Escherichia coli CFT073
uaagaaaacggaagcuca

SEQ ID NO: 2622686 - RNA, 17 nt, Escherichia coli CFT073
uaagaaaguucgacaac

SEQ ID NO: 2622687 - RNA, 23 nt, Escherichia coli CFT073
uaagaacugacuuccacuuccug

SEQ ID NO: 2622688 - RNA, 12 nt, Escherichia coli CFT073
uaagaagcggcu

SEQ ID NO: 2622689 - RNA, 16 nt, Escherichia coli CFT073
uaagaagggcuggcca

SEQ ID NO: 2622690 - RNA, 21 nt, Escherichia coli CFT073
uaagaagguagguguuacaug

SEQ ID NO: 2622691 - RNA, 20 nt, Escherichia coli CFT073
uaagaagucauuggccgagc

SEQ ID NO: 2622692 - RNA, 11 nt, Escherichia coli CFT073
uaagaauaaaa

SEQ ID NO: 2622693 - RNA, 15 nt, Escherichia coli CFT073
uaagaauaauaagug

SEQ ID NO: 2622694 - RNA, 17 nt, Escherichia coli CFT073
uaagaaugcgaaaacga

SEQ ID NO: 2622695 - RNA, 18 nt, Escherichia coli CFT073
uaagacgcauccaccaga

SEQ ID NO: 2622696 - RNA, 18 nt, Escherichia coli CFT073
uaagacgcgccagcaucg

SEQ ID NO: 2622697 - RNA, 16 nt, Escherichia coli CFT073
uaagacgcgccagcgu

SEQ ID NO: 2622698 - RNA, 21 nt, Escherichia coli CFT073
uaagacgcguagugucgcauc

SEQ ID NO: 2622699 - RNA, 22 nt, Escherichia coli CFT073
uaagacgcgucugcgucgcauc

SEQ ID NO: 2622700 - RNA, 21 nt, Escherichia coli CFT073
uaagaggcuaaccuuauggug

SEQ ID NO: 2622701 - RNA, 19 nt, Escherichia coli CFT073
uaagauaccccagcgcaag

SEQ ID NO: 2622702 - RNA, 21 nt, Escherichia coli CFT073
uaagauagacuguugaaauac

SEQ ID NO: 2622703 - RNA, 14 nt, Escherichia coli CFT073
uaagaucagaagca

SEQ ID NO: 2622704 - RNA, 22 nt, Escherichia coli CFT073
uaagaucaucggccagauaaua

SEQ ID NO: 2622705 - RNA, 16 nt, Escherichia coli CFT073
uaagaugaagaaaaua

SEQ ID NO: 2622706 - RNA, 17 nt, Escherichia coli CFT073
uaagaugcgaguaaaca

SEQ ID NO: 2622707 - RNA, 18 nt, Escherichia coli CFT073
uaagaugcgccaacauca

SEQ ID NO: 2622708 - RNA, 22 nt, Escherichia coli CFT073
uaagaugcgccaacaucaaugg

SEQ ID NO: 2622709 - RNA, 17 nt, Escherichia coli CFT073
uaagauuccuuccagua

SEQ ID NO: 2622710 - RNA, 20 nt, Escherichia coli CFT073
uaagcaaauaauuccccacc

SEQ ID NO: 2622711 - RNA, 18 nt, Escherichia coli CFT073
uaagcaacgccaaauuua

SEQ ID NO: 2622712 - RNA, 13 nt, Escherichia coli CFT073
uaagcaaucacuu

SEQ ID NO: 2622713 - RNA, 17 nt, Escherichia coli CFT073
uaagcaauguuauccgg

SEQ ID NO: 2622714 - RNA, 20 nt, Escherichia coli CFT073
uaagcaauguuauccggcua

SEQ ID NO: 2622715 - RNA, 14 nt, Escherichia coli CFT073
uaagcaauuauuca

SEQ ID NO: 2622716 - RNA, 15 nt, Escherichia coli CFT073
uaagcacguuaccca

SEQ ID NO: 2622717 - RNA, 18 nt, Escherichia coli CFT073
uaagcaggguugcagcgg

SEQ ID NO: 2622718 - RNA, 16 nt, Escherichia coli CFT073
uaagcaguccagcgcc

SEQ ID NO: 2622719 - RNA, 17 nt, Escherichia coli CFT073
uaagcaguccagcgccu

SEQ ID NO: 2622720 - RNA, 17 nt, Escherichia coli CFT073
uaagcaucgcaacgcau

SEQ ID NO: 2622721 - RNA, 22 nt, Escherichia coli CFT073
uaagcaucgcaacgcaucuuuu

SEQ ID NO: 2622722 - RNA, 21 nt, Escherichia coli CFT073
uaagcauuauauauaauagug

SEQ ID NO: 2622723 - RNA, 23 nt, Escherichia coli CFT073
uaagccaguucucaccaaaggca

SEQ ID NO: 2622724 - RNA, 18 nt, Escherichia coli CFT073
uaagccauauuuaacucc

SEQ ID NO: 2622725 - RNA, 13 nt, Escherichia coli CFT073
uaagcccagggaa

SEQ ID NO: 2622726 - RNA, 17 nt, Escherichia coli CFT073
uaagccgcaaccaccug

SEQ ID NO: 2622727 - RNA, 15 nt, Escherichia coli CFT073
uaagccgccgccauc

SEQ ID NO: 2622728 - RNA, 20 nt, Escherichia coli CFT073
uaagccgguaaucaccagca

SEQ ID NO: 2622729 - RNA, 15 nt, Escherichia coli CFT073
uaagccugcaucacg

SEQ ID NO: 2622730 - RNA, 12 nt, Escherichia coli CFT073
uaagccuuccgc

SEQ ID NO: 2622731 - RNA, 15 nt, Escherichia coli CFT073
uaagccuuccgcuga

SEQ ID NO: 2622732 - RNA, 17 nt, Escherichia coli CFT073
uaagcgacgggcgacaa

SEQ ID NO: 2622733 - RNA, 16 nt, Escherichia coli CFT073
uaagcgaguuauugau

SEQ ID NO: 2622734 - RNA, 20 nt, Escherichia coli CFT073
uaagcgauaaaaauaccgag

SEQ ID NO: 2622735 - RNA, 14 nt, Escherichia coli CFT073
uaagcgcaaaggcc

SEQ ID NO: 2622736 - RNA, 19 nt, Escherichia coli CFT073
uaagcgcaucgacgccauc

SEQ ID NO: 2622737 - RNA, 23 nt, Escherichia coli CFT073
uaagcgcgcggccucaucuccag

SEQ ID NO: 2622738 - RNA, 21 nt, Escherichia coli CFT073
uaagcgcguuucugcgcuucu

SEQ ID NO: 2622739 - RNA, 21 nt, Escherichia coli CFT073
uaagcggcaaaccggacgauc

SEQ ID NO: 2622740 - RNA, 17 nt, Escherichia coli CFT073
uaagcggcuccggucca

SEQ ID NO: 2622741 - RNA, 14 nt, Escherichia coli CFT073
uaagcguagcgcau

SEQ ID NO: 2622742 - RNA, 15 nt, Escherichia coli CFT073
uaagcguagcgcauc

SEQ ID NO: 2622743 - RNA, 16 nt, Escherichia coli CFT073
uaagcgucgcaucagg

SEQ ID NO: 2622744 - RNA, 18 nt, Escherichia coli CFT073
uaagcguggaggggcgac

SEQ ID NO: 2622745 - RNA, 14 nt, Escherichia coli CFT073
uaagcguucugcaa

SEQ ID NO: 2622746 - RNA, 17 nt, Escherichia coli CFT073
uaagcguuuucugccag

SEQ ID NO: 2622747 - RNA, 19 nt, Escherichia coli CFT073
uaagcguuuucugccagac

SEQ ID NO: 2622748 - RNA, 16 nt, Escherichia coli CFT073
uaagcuauaaaaaaac

SEQ ID NO: 2622749 - RNA, 16 nt, Escherichia coli CFT073
uaagcucaaugguguu

SEQ ID NO: 2622750 - RNA, 13 nt, Escherichia coli CFT073
uaagcuggaaucc

SEQ ID NO: 2622751 - RNA, 20 nt, Escherichia coli CFT073
uaagcuguacacuucccagc

SEQ ID NO: 2622752 - RNA, 20 nt, Escherichia coli CFT073
uaagcuguucagauacacca

SEQ ID NO: 2622753 - RNA, 16 nt, Escherichia coli CFT073
uaagcuuagucuuauu

SEQ ID NO: 2622754 - RNA, 16 nt, Escherichia coli CFT073
uaagcuuuuucugcuu

SEQ ID NO: 2622755 - RNA, 16 nt, Escherichia coli CFT073
uaaggaaaucgauaaa

SEQ ID NO: 2622756 - RNA, 22 nt, Escherichia coli CFT073
uaaggaacggggguuuuacuuu

SEQ ID NO: 2622757 - RNA, 20 nt, Escherichia coli CFT073
uaaggacggaauuugcugcu

SEQ ID NO: 2622758 - RNA, 14 nt, Escherichia coli CFT073
uaaggagcaauaau

SEQ ID NO: 2622759 - RNA, 12 nt, Escherichia coli CFT073
uaaggauaaaaa

SEQ ID NO: 2622760 - RNA, 17 nt, Escherichia coli CFT073
uaaggcaacgccccuuc

SEQ ID NO: 2622761 - RNA, 13 nt, Escherichia coli CFT073
uaaggccaaauac

SEQ ID NO: 2622762 - RNA, 17 nt, Escherichia coli CFT073
uaaggccaccagcggca

SEQ ID NO: 2622763 - RNA, 15 nt, Escherichia coli CFT073
uaaggcuguucccac

SEQ ID NO: 2622764 - RNA, 16 nt, Escherichia coli CFT073
uaagggcugacaguug

SEQ ID NO: 2622765 - RNA, 14 nt, Escherichia coli CFT073
uaaggguauagaaa

SEQ ID NO: 2622766 - RNA, 18 nt, Escherichia coli CFT073
uaagggugaaagggugcg

SEQ ID NO: 2622767 - RNA, 21 nt, Escherichia coli CFT073
uaaggguugcugaccaaaucu

SEQ ID NO: 2622768 - RNA, 15 nt, Escherichia coli CFT073
uaagguacggcccgu

SEQ ID NO: 2622769 - RNA, 22 nt, Escherichia coli CFT073
uaagguaucgcgaaaaaaaaga

SEQ ID NO: 2622770 - RNA, 18 nt, Escherichia coli CFT073
uaagguguucacgccgca

SEQ ID NO: 2622771 - RNA, 15 nt, Escherichia coli CFT073
uaaguaaacaaacau

SEQ ID NO: 2622772 - RNA, 16 nt, Escherichia coli CFT073
uaaguaaacaaacaug

SEQ ID NO: 2622773 - RNA, 17 nt, Escherichia coli CFT073
uaaguaaacaaacauga

SEQ ID NO: 2622774 - RNA, 13 nt, Escherichia coli CFT073
uaaguaacaauau

SEQ ID NO: 2622775 - RNA, 14 nt, Escherichia coli CFT073
uaaguaaucauaau

SEQ ID NO: 2622776 - RNA, 14 nt, Escherichia coli CFT073
uaaguacauuaaaa

SEQ ID NO: 2622777 - RNA, 16 nt, Escherichia coli CFT073
uaaguacauuaaaauc

SEQ ID NO: 2622778 - RNA, 15 nt, Escherichia coli CFT073
uaaguacguuuucuu

SEQ ID NO: 2622779 - RNA, 15 nt, Escherichia coli CFT073
uaaguacuaaauaau

SEQ ID NO: 2622780 - RNA, 22 nt, Escherichia coli CFT073
uaaguacuuuccauuuuggaau

SEQ ID NO: 2622781 - RNA, 23 nt, Escherichia coli CFT073
uaaguacuuuccauuuuggaaua

SEQ ID NO: 2622782 - RNA, 16 nt, Escherichia coli CFT073
uaauccugaaagcgug

SEQ ID NO: 2622783 - RNA, 17 nt, Escherichia coli CFT073
uaauccuggccauacca

SEQ ID NO: 2622784 - RNA, 13 nt, Escherichia coli CFT073
uaauccuguaucu

SEQ ID NO: 2622785 - RNA, 21 nt, Escherichia coli CFT073
uaaucgaacuccaguagcgag

SEQ ID NO: 2622786 - RNA, 18 nt, Escherichia coli CFT073
uaaucgccagcaaaauca

SEQ ID NO: 2622787 - RNA, 22 nt, Escherichia coli CFT073
uaaucgccagcaaaaucaccau

SEQ ID NO: 2622788 - RNA, 16 nt, Escherichia coli CFT073
uaaucgcccucgccuu

SEQ ID NO: 2622789 - RNA, 12 nt, Escherichia coli CFT073
uaaucgccgcau

SEQ ID NO: 2622790 - RNA, 21 nt, Escherichia coli CFT073
uaaucgccgcauaauaucuuu

SEQ ID NO: 2622791 - RNA, 14 nt, Escherichia coli CFT073
uaaucgccuuaccc

SEQ ID NO: 2622792 - RNA, 21 nt, Escherichia coli CFT073
uaaucgccuuacccugaccgu

SEQ ID NO: 2622793 - RNA, 14 nt, Escherichia coli CFT073
uaaucgccuuuuuu

SEQ ID NO: 2622794 - RNA, 16 nt, Escherichia coli CFT073
uaaucgcgaaauaacu

SEQ ID NO: 2622795 - RNA, 18 nt, Escherichia coli CFT073
uaaucgcgccgcgauacu

SEQ ID NO: 2622796 - RNA, 14 nt, Escherichia coli CFT073
uaaucgcuuuauag

SEQ ID NO: 2622797 - RNA, 18 nt, Escherichia coli CFT073
uaaucggcgcggcgguug

SEQ ID NO: 2622798 - RNA, 18 nt, Escherichia coli CFT073
uaaucgggggaggcgaua

SEQ ID NO: 2622799 - RNA, 14 nt, Escherichia coli CFT073
uaaucgucaucagc

SEQ ID NO: 2622800 - RNA, 20 nt, Escherichia coli CFT073
uaaucgucaucagcgccaac

SEQ ID NO: 2622801 - RNA, 22 nt, Escherichia coli CFT073
uaaucguuggcagacguuuuuu

SEQ ID NO: 2622802 - RNA, 22 nt, Escherichia coli CFT073
uaaucucaccagguucgccaac

SEQ ID NO: 2622803 - RNA, 12 nt, Escherichia coli CFT073
uaaucucaccau

SEQ ID NO: 2622804 - RNA, 18 nt, Escherichia coli CFT073
uaaucucaccauuuuuug

SEQ ID NO: 2622805 - RNA, 13 nt, Escherichia coli CFT073
uaaucucaucggc

SEQ ID NO: 2622806 - RNA, 15 nt, Escherichia coli CFT073
uaaucucgccuuauc

SEQ ID NO: 2622807 - RNA, 16 nt, Escherichia coli CFT073
uaaucucgccuuauca

SEQ ID NO: 2622808 - RNA, 16 nt, Escherichia coli CFT073
uaaucucuucaccaua

SEQ ID NO: 2622809 - RNA, 19 nt, Escherichia coli CFT073
uaaucucuuuacccagcgg

SEQ ID NO: 2622810 - RNA, 15 nt, Escherichia coli CFT073
uaaucucuuuccauu

SEQ ID NO: 2622811 - RNA, 13 nt, Escherichia coli CFT073
uaaucucuuucuu

SEQ ID NO: 2622812 - RNA, 23 nt, Escherichia coli CFT073
uaaucugaacggcugcauuccuu

SEQ ID NO: 2622813 - RNA, 21 nt, Escherichia coli CFT073
uaaucugcucggcgagcaacg

SEQ ID NO: 2622814 - RNA, 20 nt, Escherichia coli CFT073
uaaucuggcggaucugauca

SEQ ID NO: 2622815 - RNA, 22 nt, Escherichia coli CFT073
uaaucugguaucgaguggcgca

SEQ ID NO: 2622816 - RNA, 20 nt, Escherichia coli CFT073
uaaucuguugauuuaacagc

SEQ ID NO: 2622817 - RNA, 13 nt, Escherichia coli CFT073
uaaucuucacuac

SEQ ID NO: 2622818 - RNA, 21 nt, Escherichia coli CFT073
uaaugaaucgucggaauggca

SEQ ID NO: 2622819 - RNA, 18 nt, Escherichia coli CFT073
uaaugacaaaaagaguuc

SEQ ID NO: 2622820 - RNA, 15 nt, Escherichia coli CFT073
uaaugacgauaaaag

SEQ ID NO: 2622821 - RNA, 17 nt, Escherichia coli CFT073
uaaugacgauaaaagug

SEQ ID NO: 2622822 - RNA, 18 nt, Escherichia coli CFT073
uaaugacguguaugcaua

SEQ ID NO: 2622823 - RNA, 21 nt, Escherichia coli CFT073
uaaugacuuuuggaccacgga

SEQ ID NO: 2622824 - RNA, 16 nt, Escherichia coli CFT073
uaaugauauguuuauu

SEQ ID NO: 2622825 - RNA, 19 nt, Escherichia coli CFT073
uaaugaucccuucacuucu

SEQ ID NO: 2622826 - RNA, 22 nt, Escherichia coli CFT073
uaaugauggugaaagcaaaaaa

SEQ ID NO: 2622827 - RNA, 18 nt, Escherichia coli CFT073
uaaugauucauaaacaau

SEQ ID NO: 2622828 - RNA, 11 nt, Escherichia coli CFT073
uaaugauuuug

SEQ ID NO: 2622829 - RNA, 21 nt, Escherichia coli CFT073
uaaugcaacacuaccggucag

SEQ ID NO: 2622830 - RNA, 17 nt, Escherichia coli CFT073
uaaugcacuuccagcgg

SEQ ID NO: 2622831 - RNA, 24 nt, Escherichia coli CFT073
uaaugcagauaacuuaguuaauca

SEQ ID NO: 2622832 - RNA, 14 nt, Escherichia coli CFT073
uaaugccagcgaua

SEQ ID NO: 2622833 - RNA, 13 nt, Escherichia coli CFT073
uaaugccaguccc

SEQ ID NO: 2622834 - RNA, 13 nt, Escherichia coli CFT073
uaaugccaguuca

SEQ ID NO: 2622835 - RNA, 18 nt, Escherichia coli CFT073
uaaugccaguucaguaaa

SEQ ID NO: 2622836 - RNA, 22 nt, Escherichia coli CFT073
uaaugccauuaacaucccuuca

SEQ ID NO: 2622837 - RNA, 16 nt, Escherichia coli CFT073
uaaugccccagcgcac

SEQ ID NO: 2622838 - RNA, 23 nt, Escherichia coli CFT073
uaaugccgacauaggccagccgc

SEQ ID NO: 2622839 - RNA, 15 nt, Escherichia coli CFT073
uaaugccgcaacuuu

SEQ ID NO: 2622840 - RNA, 17 nt, Escherichia coli CFT073
uaaugccggacuccagc

SEQ ID NO: 2622841 - RNA, 22 nt, Escherichia coli CFT073
uaaugccggauaagccucgcuu

SEQ ID NO: 2622842 - RNA, 22 nt, Escherichia coli CFT073
uaaugccucuccccagcggaaa

SEQ ID NO: 2622843 - RNA, 18 nt, Escherichia coli CFT073
uaaugcgacccacgcccc

SEQ ID NO: 2622844 - RNA, 15 nt, Escherichia coli CFT073
uaaugcgcuuccggc

SEQ ID NO: 2622845 - RNA, 14 nt, Escherichia coli CFT073
uaaugcgcuuuuac

SEQ ID NO: 2622846 - RNA, 22 nt, Escherichia coli CFT073
uaaugcuucuaccgucuguaac

SEQ ID NO: 2622847 - RNA, 15 nt, Escherichia coli CFT073
uaauggcaauggucu

SEQ ID NO: 2622848 - RNA, 17 nt, Escherichia coli CFT073
uaauggcgauaaucgaa

SEQ ID NO: 2622849 - RNA, 18 nt, Escherichia coli CFT073
uaaugguaacgccagcca

SEQ ID NO: 2622850 - RNA, 18 nt, Escherichia coli CFT073
uaaugguauuaagccagu

SEQ ID NO: 2622851 - RNA, 21 nt, Escherichia coli CFT073
uaaugguauuaagccaguucu

SEQ ID NO: 2622852 - RNA, 22 nt, Escherichia coli CFT073
uaauguaucugaaguaaagaaa

SEQ ID NO: 2622853 - RNA, 22 nt, Escherichia coli CFT073
uaauguccauauauaaaaucau

SEQ ID NO: 2622854 - RNA, 20 nt, Escherichia coli CFT073
uaaugucgcgaucauggucu

SEQ ID NO: 2622855 - RNA, 21 nt, Escherichia coli CFT073
uaaugucucgguagagaaaac

SEQ ID NO: 2622856 - RNA, 13 nt, Escherichia coli CFT073
uaauguggcuggg

SEQ ID NO: 2622857 - RNA, 14 nt, Escherichia coli CFT073
uaauguggcugggg

SEQ ID NO: 2622858 - RNA, 14 nt, Escherichia coli CFT073
uaauguguucaacu

SEQ ID NO: 2622859 - RNA, 19 nt, Escherichia coli CFT073
uaauguguucaacuucgag

SEQ ID NO: 2622860 - RNA, 16 nt, Escherichia coli CFT073
uaauguucguugcauu

SEQ ID NO: 2622861 - RNA, 20 nt, Escherichia coli CFT073
uaauguucguugcauuccag

SEQ ID NO: 2622862 - RNA, 13 nt, Escherichia coli CFT073
uaauguuuucagu

SEQ ID NO: 2622863 - RNA, 14 nt, Escherichia coli CFT073
uaauuaaauuauca

SEQ ID NO: 2622864 - RNA, 21 nt, Escherichia coli CFT073
uaauuaacaccuuaaccucag

SEQ ID NO: 2622865 - RNA, 16 nt, Escherichia coli CFT073
uaauuaagacugaugc

SEQ ID NO: 2622866 - RNA, 19 nt, Escherichia coli CFT073
uaauuaauaauauaaauua

SEQ ID NO: 2622867 - RNA, 17 nt, Escherichia coli CFT073
uaauuaccccauccauu

SEQ ID NO: 2622868 - RNA, 12 nt, Escherichia coli CFT073
uaauuagcuguu

SEQ ID NO: 2622869 - RNA, 16 nt, Escherichia coli CFT073
uaauuagcuguuggca

SEQ ID NO: 2622870 - RNA, 19 nt, Escherichia coli CFT073
uaauuagcuguuggcaacg

SEQ ID NO: 2622871 - RNA, 18 nt, Escherichia coli CFT073
uaauuagcuuaucaaucu

SEQ ID NO: 2622872 - RNA, 20 nt, Escherichia coli CFT073
uaauuaucaaucuccgccuc

SEQ ID NO: 2622873 - RNA, 19 nt, Escherichia coli CFT073
uaauuaugccgaucaucau

SEQ ID NO: 2622874 - RNA, 13 nt, Escherichia coli CFT073
uaauucaaaaacc

SEQ ID NO: 2622875 - RNA, 15 nt, Escherichia coli CFT073
uaauucaaaaaccug

SEQ ID NO: 2622876 - RNA, 14 nt, Escherichia coli CFT073
uaauucaacagauu

SEQ ID NO: 2622877 - RNA, 11 nt, Escherichia coli CFT073
uaauucaacgc

SEQ ID NO: 2622878 - RNA, 22 nt, Escherichia coli CFT073
uaauucaccguucaauuccgca

SEQ ID NO: 2622879 - RNA, 18 nt, Escherichia coli CFT073
uaauucaccucagaaauc

SEQ ID NO: 2622880 - RNA, 12 nt, Escherichia coli CFT073
uaauucagcaga

SEQ ID NO: 2622881 - RNA, 14 nt, Escherichia coli CFT073
uaauucauuguaug

SEQ ID NO: 2622882 - RNA, 16 nt, Escherichia coli CFT073
uaauuccccugccaga

SEQ ID NO: 2622883 - RNA, 16 nt, Escherichia coli CFT073
uaauuccugaagagaa

SEQ ID NO: 2622884 - RNA, 15 nt, Escherichia coli CFT073
uaauucguaacggcc

SEQ ID NO: 2622885 - RNA, 23 nt, Escherichia coli CFT073
uaauugacaagguaguagaaauc

SEQ ID NO: 2622886 - RNA, 16 nt, Escherichia coli CFT073
uaauugaccagaucuu

SEQ ID NO: 2622887 - RNA, 19 nt, Escherichia coli CFT073
uaauugaccagaucuucau

SEQ ID NO: 2622888 - RNA, 18 nt, Escherichia coli CFT073
uaauugacgccaucaacg

SEQ ID NO: 2622889 - RNA, 21 nt, Escherichia coli CFT073
uaauugccagccaucgccugc

SEQ ID NO: 2622890 - RNA, 19 nt, Escherichia coli CFT073
uacaucaucagaaaugcca

SEQ ID NO: 2622891 - RNA, 14 nt, Escherichia coli CFT073
uacauccacugcau

SEQ ID NO: 2622892 - RNA, 20 nt, Escherichia coli CFT073
uacauccgggcgagcuuaua

SEQ ID NO: 2622893 - RNA, 21 nt, Escherichia coli CFT073
uacaucgacaacguuuucaac

SEQ ID NO: 2622894 - RNA, 23 nt, Escherichia coli CFT073
uacaucgauuucgcuaaaaguau

SEQ ID NO: 2622895 - RNA, 14 nt, Escherichia coli CFT073
uacaucgcgauacu

SEQ ID NO: 2622896 - RNA, 14 nt, Escherichia coli CFT073
uacaucugcaucaa

SEQ ID NO: 2622897 - RNA, 16 nt, Escherichia coli CFT073
uacaucugguaauuga

SEQ ID NO: 2622898 - RNA, 14 nt, Escherichia coli CFT073
uacaugauccggca

SEQ ID NO: 2622899 - RNA, 12 nt, Escherichia coli CFT073
uacaugcagggc

SEQ ID NO: 2622900 - RNA, 12 nt, Escherichia coli CFT073
uacaugcugcuu

SEQ ID NO: 2622901 - RNA, 15 nt, Escherichia coli CFT073
uacauguauaaaaag

SEQ ID NO: 2622902 - RNA, 13 nt, Escherichia coli CFT073
uacauuaaccgcc

SEQ ID NO: 2622903 - RNA, 13 nt, Escherichia coli CFT073
uacauugccgggc

SEQ ID NO: 2622904 - RNA, 17 nt, Escherichia coli CFT073
uacauugcugacauggc

SEQ ID NO: 2622905 - RNA, 20 nt, Escherichia coli CFT073
uacauugggaagauaaaaac

SEQ ID NO: 2622906 - RNA, 18 nt, Escherichia coli CFT073
uacauugguacagagaac

SEQ ID NO: 2622907 - RNA, 16 nt, Escherichia coli CFT073
uacauuguuuuccaga

SEQ ID NO: 2622908 - RNA, 15 nt, Escherichia coli CFT073
uacauuucuguaguc

SEQ ID NO: 2622909 - RNA, 13 nt, Escherichia coli CFT073
uaccaaaaacggu

SEQ ID NO: 2622910 - RNA, 17 nt, Escherichia coli CFT073
uaccaaaaacggucaua

SEQ ID NO: 2622911 - RNA, 22 nt, Escherichia coli CFT073
uaccaaaacggguacgaugcgc

SEQ ID NO: 2622912 - RNA, 22 nt, Escherichia coli CFT073
uaccaaauaaacgaaucugcaa

SEQ ID NO: 2622913 - RNA, 14 nt, Escherichia coli CFT073
uaccaacgcacccg

SEQ ID NO: 2622914 - RNA, 20 nt, Escherichia coli CFT073
uaccaagaaagauaguaacc

SEQ ID NO: 2622915 - RNA, 15 nt, Escherichia coli CFT073
uaccaauaaucaauu

SEQ ID NO: 2622916 - RNA, 14 nt, Escherichia coli CFT073
uaccaaucugcucu

SEQ ID NO: 2622917 - RNA, 20 nt, Escherichia coli CFT073
uaccaauuuauuuuaucgcu

SEQ ID NO: 2622918 - RNA, 17 nt, Escherichia coli CFT073
uaccacaaugguauugc

SEQ ID NO: 2622919 - RNA, 21 nt, Escherichia coli CFT073
uaccacagguccuggcuauuc

SEQ ID NO: 2622920 - RNA, 11 nt, Escherichia coli CFT073
uaccacaucaa

SEQ ID NO: 2622921 - RNA, 21 nt, Escherichia coli CFT073
uaccaccaaaugcagcaacca

SEQ ID NO: 2622922 - RNA, 21 nt, Escherichia coli CFT073
uaccaccagcgacagccagcc

SEQ ID NO: 2622923 - RNA, 21 nt, Escherichia coli CFT073
uaccaccuuacuuacacauca

SEQ ID NO: 2622924 - RNA, 15 nt, Escherichia coli CFT073
uaccaccuuccucuu

SEQ ID NO: 2622925 - RNA, 18 nt, Escherichia coli CFT073
uaccacgauauucauuuu

SEQ ID NO: 2622926 - RNA, 15 nt, Escherichia coli CFT073
uaccacgccuuguuc

SEQ ID NO: 2622927 - RNA, 22 nt, Escherichia coli CFT073
uaccacuucauccggauacagc

SEQ ID NO: 2622928 - RNA, 16 nt, Escherichia coli CFT073
uaccacuuccagcaga

SEQ ID NO: 2622929 - RNA, 15 nt, Escherichia coli CFT073
uaccagacagaacga

SEQ ID NO: 2622930 - RNA, 17 nt, Escherichia coli CFT073
uaccagaccgcacaccg

SEQ ID NO: 2622931 - RNA, 23 nt, Escherichia coli CFT073
uaccagagauagcgaaccgcagg

SEQ ID NO: 2622932 - RNA, 16 nt, Escherichia coli CFT073
uaccagauaaacaucg

SEQ ID NO: 2622933 - RNA, 18 nt, Escherichia coli CFT073
uaccagauaagcagcgug

SEQ ID NO: 2622934 - RNA, 17 nt, Escherichia coli CFT073
uaccagaucuaucuggc

SEQ ID NO: 2622935 - RNA, 16 nt, Escherichia coli CFT073
uaccagauuaauuauu

SEQ ID NO: 2622936 - RNA, 18 nt, Escherichia coli CFT073
uaccagauuaauuauuga

SEQ ID NO: 2622937 - RNA, 22 nt, Escherichia coli CFT073
uaccagcaacugauggcccauc

SEQ ID NO: 2622938 - RNA, 17 nt, Escherichia coli CFT073
uaccagcaccugcuuga

SEQ ID NO: 2622939 - RNA, 19 nt, Escherichia coli CFT073
uaccagcaccugcuugaac

SEQ ID NO: 2622940 - RNA, 15 nt, Escherichia coli CFT073
uaccagcaggaaucc

SEQ ID NO: 2622941 - RNA, 15 nt, Escherichia coli CFT073
uaccagcaguacagu

SEQ ID NO: 2622942 - RNA, 19 nt, Escherichia coli CFT073
uaccagcaguacaguaccg

SEQ ID NO: 2622943 - RNA, 14 nt, Escherichia coli CFT073
uaccagccccauca

SEQ ID NO: 2622944 - RNA, 20 nt, Escherichia coli CFT073
uaccagccgcgcccuaacag

SEQ ID NO: 2622945 - RNA, 20 nt, Escherichia coli CFT073
uaccagccuucuucauccag

SEQ ID NO: 2622946 - RNA, 17 nt, Escherichia coli CFT073
uaccagcgguaaucaug

SEQ ID NO: 2622947 - RNA, 19 nt, Escherichia coli CFT073
uaccaggcaauaaacaucc

SEQ ID NO: 2622948 - RNA, 19 nt, Escherichia coli CFT073
uaccagguuguaucaccac

SEQ ID NO: 2622949 - RNA, 15 nt, Escherichia coli CFT073
uaccagugccagaac

SEQ ID NO: 2622950 - RNA, 18 nt, Escherichia coli CFT073
uaccagugccagaacaga

SEQ ID NO: 2622951 - RNA, 14 nt, Escherichia coli CFT073
uaccaguggcggca

SEQ ID NO: 2622952 - RNA, 14 nt, Escherichia coli CFT073
uaccaguuccagcg

SEQ ID NO: 2622953 - RNA, 21 nt, Escherichia coli CFT073
uaccaguuuggugacgccaca

SEQ ID NO: 2622954 - RNA, 14 nt, Escherichia coli CFT073
uaccauauaaacau

SEQ ID NO: 2622955 - RNA, 21 nt, Escherichia coli CFT073
uaccaucacuuugcagaaaau

SEQ ID NO: 2622956 - RNA, 14 nt, Escherichia coli CFT073
uaccauccacacca

SEQ ID NO: 2622957 - RNA, 20 nt, Escherichia coli CFT073
uaccauccggccauuuucau

SEQ ID NO: 2622958 - RNA, 22 nt, Escherichia coli CFT073
uaccaucgacaccaucgcuuca

SEQ ID NO: 2622959 - RNA, 17 nt, Escherichia coli CFT073
uaccaucggcagcgcca

SEQ ID NO: 2622960 - RNA, 15 nt, Escherichia coli CFT073
uaccaugaauuucac

SEQ ID NO: 2622961 - RNA, 15 nt, Escherichia coli CFT073
uaccaugaucugcaa

SEQ ID NO: 2622962 - RNA, 23 nt, Escherichia coli CFT073
uaccaugggaaauggcuggucag

SEQ ID NO: 2622963 - RNA, 23 nt, Escherichia coli CFT073
uacccaaccgauaaccacgcuca

SEQ ID NO: 2622964 - RNA, 15 nt, Escherichia coli CFT073
uacccaaucccccac

SEQ ID NO: 2622965 - RNA, 19 nt, Escherichia coli CFT073
uacccaaugaccacuccgg

SEQ ID NO: 2622966 - RNA, 14 nt, Escherichia coli CFT073
uacccagacaaaau

SEQ ID NO: 2622967 - RNA, 17 nt, Escherichia coli CFT073
uacccagacuuuucaga

SEQ ID NO: 2622968 - RNA, 18 nt, Escherichia coli CFT073
uacccagcaaugccaggc

SEQ ID NO: 2622969 - RNA, 19 nt, Escherichia coli CFT073
uacccagcacggauaccgc

SEQ ID NO: 2622970 - RNA, 12 nt, Escherichia coli CFT073
uaccccaccgcc

SEQ ID NO: 2622971 - RNA, 17 nt, Escherichia coli CFT073
uaccccagaugaguaau

SEQ ID NO: 2622972 - RNA, 23 nt, Escherichia coli CFT073
uaccccagcggcaaccagcagca

SEQ ID NO: 2622973 - RNA, 21 nt, Escherichia coli CFT073
uaccccagcuggcgccaggcu

SEQ ID NO: 2622974 - RNA, 20 nt, Escherichia coli CFT073
uaccccauaacgacccaacu

SEQ ID NO: 2622975 - RNA, 15 nt, Escherichia coli CFT073
uaccccaucagcgua

SEQ ID NO: 2622976 - RNA, 12 nt, Escherichia coli CFT073
uaccccauccau

SEQ ID NO: 2622977 - RNA, 17 nt, Escherichia coli CFT073
uaccccgcauccugaau

SEQ ID NO: 2622978 - RNA, 23 nt, Escherichia coli CFT073
uaccccgcaucguggccugcuca

SEQ ID NO: 2622979 - RNA, 14 nt, Escherichia coli CFT073
uaccccgccagcag

SEQ ID NO: 2622980 - RNA, 15 nt, Escherichia coli CFT073
uaccccgccagcaga

SEQ ID NO: 2622981 - RNA, 17 nt, Escherichia coli CFT073
uaccccgccagcagaau

SEQ ID NO: 2622982 - RNA, 19 nt, Escherichia coli CFT073
uacccgaagcgccaauacc

SEQ ID NO: 2622983 - RNA, 20 nt, Escherichia coli CFT073
uacccgacagauaaaucauc

SEQ ID NO: 2622984 - RNA, 16 nt, Escherichia coli CFT073
uacccgauccacugaa

SEQ ID NO: 2622985 - RNA, 21 nt, Escherichia coli CFT073
uacccgccaguguagcgauuu

SEQ ID NO: 2622986 - RNA, 13 nt, Escherichia coli CFT073
uacccgcgcagug

SEQ ID NO: 2622987 - RNA, 23 nt, Escherichia coli CFT073
uacccgcgcuuuuucggaaagcc

SEQ ID NO: 2622988 - RNA, 21 nt, Escherichia coli CFT073
uacccggauuuuucagcgcca

SEQ ID NO: 2622989 - RNA, 14 nt, Escherichia coli CFT073
uacccggcacagcu

SEQ ID NO: 2622990 - RNA, 13 nt, Escherichia coli CFT073
uacccggugccgc

SEQ ID NO: 2622991 - RNA, 13 nt, Escherichia coli CFT073
uacccgugcaucc

SEQ ID NO: 2622992 - RNA, 17 nt, Escherichia coli CFT073
uacccgugcaucccaga

SEQ ID NO: 2622993 - RNA, 22 nt, Escherichia coli CFT073
uacccucaacggaauaaacgcu

SEQ ID NO: 2622994 - RNA, 15 nt, Escherichia coli CFT073
uacccugguuagcaa

SEQ ID NO: 2622995 - RNA, 21 nt, Escherichia coli CFT073
uacccuucgauaaaggccauc

SEQ ID NO: 2622996 - RNA, 19 nt, Escherichia coli CFT073
uacccuuguggauaacgcc

SEQ ID NO: 2622997 - RNA, 20 nt, Escherichia coli CFT073
uaccgaaaaucgccugaaca

SEQ ID NO: 2622998 - RNA, 13 nt, Escherichia coli CFT073
uacgcuuaucagg

SEQ ID NO: 2622999 - RNA, 17 nt, Escherichia coli CFT073
uacgcuuaucaggccua

SEQ ID NO: 2623000 - RNA, 19 nt, Escherichia coli CFT073
uacgcuuaucaggccuaca

SEQ ID NO: 2623001 - RNA, 17 nt, Escherichia coli CFT073
uacgcuucacgcaccau

SEQ ID NO: 2623002 - RNA, 15 nt, Escherichia coli CFT073
uacgcuucucucugu

SEQ ID NO: 2623003 - RNA, 16 nt, Escherichia coli CFT073
uacgcuuuacuguaca

SEQ ID NO: 2623004 - RNA, 22 nt, Escherichia coli CFT073
uacgcuuuuccacucacacagc

SEQ ID NO: 2623005 - RNA, 16 nt, Escherichia coli CFT073
uacggaaaaucucauu

SEQ ID NO: 2623006 - RNA, 13 nt, Escherichia coli CFT073
uacggaacugcuc

SEQ ID NO: 2623007 - RNA, 18 nt, Escherichia coli CFT073
uacggaagaguuuuucag

SEQ ID NO: 2623008 - RNA, 19 nt, Escherichia coli CFT073
uacggauaugucgguuauc

SEQ ID NO: 2623009 - RNA, 16 nt, Escherichia coli CFT073
uacggcauucugcaca

SEQ ID NO: 2623010 - RNA, 16 nt, Escherichia coli CFT073
uacggcauugucugaa

SEQ ID NO: 2623011 - RNA, 20 nt, Escherichia coli CFT073
uacggcgcaucaguuucgau

SEQ ID NO: 2623012 - RNA, 15 nt, Escherichia coli CFT073
uacggcguuucacuu

SEQ ID NO: 2623013 - RNA, 14 nt, Escherichia coli CFT073
uacggcuaaaaaaa

SEQ ID NO: 2623014 - RNA, 20 nt, Escherichia coli CFT073
uacggcuaaaaaaagccacc

SEQ ID NO: 2623015 - RNA, 14 nt, Escherichia coli CFT073
uacggcucagcaau

SEQ ID NO: 2623016 - RNA, 15 nt, Escherichia coli CFT073
uacggcuuuuuucau

SEQ ID NO: 2623017 - RNA, 17 nt, Escherichia coli CFT073
uacgggaggucaucagc

SEQ ID NO: 2623018 - RNA, 21 nt, Escherichia coli CFT073
uacgggauuuuacuucccagu

SEQ ID NO: 2623019 - RNA, 23 nt, Escherichia coli CFT073
uacgguaaggauauucauuaaua

SEQ ID NO: 2623020 - RNA, 14 nt, Escherichia coli CFT073
accggaaagaauau

SEQ ID NO: 2623021 - RNA, 17 nt, Escherichia coli CFT073
accggaaauugcugccg

SEQ ID NO: 2623022 - RNA, 16 nt, Escherichia coli CFT073
accggaacaacccagc

SEQ ID NO: 2623023 - RNA, 12 nt, Escherichia coli CFT073
accggaaccagc

SEQ ID NO: 2623024 - RNA, 15 nt, Escherichia coli CFT073
accggaagcgccacc

SEQ ID NO: 2623025 - RNA, 21 nt, Escherichia coli CFT073
accggaaggugagggggcgau

SEQ ID NO: 2623026 - RNA, 13 nt, Escherichia coli CFT073
accggaaucgcgc

SEQ ID NO: 2623027 - RNA, 18 nt, Escherichia coli CFT073
accggaauggucaguuuc

SEQ ID NO: 2623028 - RNA, 19 nt, Escherichia coli CFT073
accggaauuuacccgccag

SEQ ID NO: 2623029 - RNA, 19 nt, Escherichia coli CFT073
accggacaguuugaucagu

SEQ ID NO: 2623030 - RNA, 20 nt, Escherichia coli CFT073
accggagaaaagaccagcca

SEQ ID NO: 2623031 - RNA, 13 nt, Escherichia coli CFT073
accggagcugcag

SEQ ID NO: 2623032 - RNA, 15 nt, Escherichia coli CFT073
accggagcugcagcc

SEQ ID NO: 2623033 - RNA, 15 nt, Escherichia coli CFT073
accggagucugugcu

SEQ ID NO: 2623034 - RNA, 22 nt, Escherichia coli CFT073
accggagucugugcuccgguuu

SEQ ID NO: 2623035 - RNA, 16 nt, Escherichia coli CFT073
accggauaaucggcaa

SEQ ID NO: 2623036 - RNA, 16 nt, Escherichia coli CFT073
accggaucugccauau

SEQ ID NO: 2623037 - RNA, 20 nt, Escherichia coli CFT073
accggaugacguuucgcgcc

SEQ ID NO: 2623038 - RNA, 22 nt, Escherichia coli CFT073
accggauuagucugguugagca

SEQ ID NO: 2623039 - RNA, 17 nt, Escherichia coli CFT073
accggauugaccaacag

SEQ ID NO: 2623040 - RNA, 13 nt, Escherichia coli CFT073
accggauuuucac

SEQ ID NO: 2623041 - RNA, 14 nt, Escherichia coli CFT073
accggauuuucacc

SEQ ID NO: 2623042 - RNA, 15 nt, Escherichia coli CFT073
accggcaaccagcac

SEQ ID NO: 2623043 - RNA, 13 nt, Escherichia coli CFT073
accggcaagaaug

SEQ ID NO: 2623044 - RNA, 14 nt, Escherichia coli CFT073
accggcaagaauga

SEQ ID NO: 2623045 - RNA, 16 nt, Escherichia coli CFT073
accggcaaucgcgcca

SEQ ID NO: 2623046 - RNA, 13 nt, Escherichia coli CFT073
accggcaaugguu

SEQ ID NO: 2623047 - RNA, 15 nt, Escherichia coli CFT073
accggcaaugguuuc

SEQ ID NO: 2623048 - RNA, 13 nt, Escherichia coli CFT073
accggcacccaau

SEQ ID NO: 2623049 - RNA, 18 nt, Escherichia coli CFT073
accggcauuuuuugcugc

SEQ ID NO: 2623050 - RNA, 17 nt, Escherichia coli CFT073
accggcgacuuccugag

SEQ ID NO: 2623051 - RNA, 23 nt, Escherichia coli CFT073
accggcgauaucccaggcaaaau

SEQ ID NO: 2623052 - RNA, 18 nt, Escherichia coli CFT073
accggcguaacggccacg

SEQ ID NO: 2623053 - RNA, 20 nt, Escherichia coli CFT073
accggcguaacggccacggc

SEQ ID NO: 2623054 - RNA, 22 nt, Escherichia coli CFT073
accggcuucgucgccagcucuu

SEQ ID NO: 2623055 - RNA, 15 nt, Escherichia coli CFT073
accggcuuucgcuuc

SEQ ID NO: 2623056 - RNA, 18 nt, Escherichia coli CFT073
accggcuuucgcuucaac

SEQ ID NO: 2623057 - RNA, 12 nt, Escherichia coli CFT073
accgggcgcaga

SEQ ID NO: 2623058 - RNA, 17 nt, Escherichia coli CFT073
accgggcggacuuucac

SEQ ID NO: 2623059 - RNA, 21 nt, Escherichia coli CFT073
accgggcugucgucauaagcg

SEQ ID NO: 2623060 - RNA, 16 nt, Escherichia coli CFT073
accggggcauucauga

SEQ ID NO: 2623061 - RNA, 17 nt, Escherichia coli CFT073
accggguuuucaaugau

SEQ ID NO: 2623062 - RNA, 21 nt, Escherichia coli CFT073
accggguuuucaaugauaaag

SEQ ID NO: 2623063 - RNA, 17 nt, Escherichia coli CFT073
accgguacaaacaucau

SEQ ID NO: 2623064 - RNA, 16 nt, Escherichia coli CFT073
accgguagcagagcca

SEQ ID NO: 2623065 - RNA, 12 nt, Escherichia coli CFT073
accgguaugacg

SEQ ID NO: 2623066 - RNA, 14 nt, Escherichia coli CFT073
accgguauugcucc

SEQ ID NO: 2623067 - RNA, 18 nt, Escherichia coli CFT073
accgguccacuuccugcg

SEQ ID NO: 2623068 - RNA, 21 nt, Escherichia coli CFT073
accgguccacuuccugcgcca

SEQ ID NO: 2623069 - RNA, 19 nt, Escherichia coli CFT073
accggucggggccagcgca

SEQ ID NO: 2623070 - RNA, 13 nt, Escherichia coli CFT073
accggucgugacu

SEQ ID NO: 2623071 - RNA, 19 nt, Escherichia coli CFT073
accggucgugacugccgcc

SEQ ID NO: 2623072 - RNA, 17 nt, Escherichia coli CFT073
accggucucagcccaga

SEQ ID NO: 2623073 - RNA, 20 nt, Escherichia coli CFT073
accggugaccaucagcauga

SEQ ID NO: 2623074 - RNA, 22 nt, Escherichia coli CFT073
accgguggucggcucgucgaga

SEQ ID NO: 2623075 - RNA, 23 nt, Escherichia coli CFT073
accgguguaggcauacacaucac

SEQ ID NO: 2623076 - RNA, 15 nt, Escherichia coli CFT073
accgguuagcucaac

SEQ ID NO: 2623077 - RNA, 22 nt, Escherichia coli CFT073
accgguucaucacgaaaaucau

SEQ ID NO: 2623078 - RNA, 20 nt, Escherichia coli CFT073
accgguucggacauguuuuc

SEQ ID NO: 2623079 - RNA, 22 nt, Escherichia coli CFT073
accgguucggacauguuuucca

SEQ ID NO: 2623080 - RNA, 20 nt, Escherichia coli CFT073
accgguugucgugguuggua

SEQ ID NO: 2623081 - RNA, 19 nt, Escherichia coli CFT073
accgguuuguaggccggau

SEQ ID NO: 2623082 - RNA, 14 nt, Escherichia coli CFT073
accguaaaaauagc

SEQ ID NO: 2623083 - RNA, 13 nt, Escherichia coli CFT073
accguaaacagau

SEQ ID NO: 2623084 - RNA, 15 nt, Escherichia coli CFT073
accguaaagcacugg

SEQ ID NO: 2623085 - RNA, 18 nt, Escherichia coli CFT073
accguaaauucucccgcc

SEQ ID NO: 2623086 - RNA, 14 nt, Escherichia coli CFT073
accguaaauugcau

SEQ ID NO: 2623087 - RNA, 15 nt, Escherichia coli CFT073
accguaacccugaaa

SEQ ID NO: 2623088 - RNA, 14 nt, Escherichia coli CFT073
accguaacgaacac

SEQ ID NO: 2623089 - RNA, 23 nt, Escherichia coli CFT073
accguaaguaagauaaaagcaau

SEQ ID NO: 2623090 - RNA, 17 nt, Escherichia coli CFT073
accguacaaccaaaucu

SEQ ID NO: 2623091 - RNA, 18 nt, Escherichia coli CFT073
accguacagauacauuuc

SEQ ID NO: 2623092 - RNA, 18 nt, Escherichia coli CFT073
accguacauugccgggcg

SEQ ID NO: 2623093 - RNA, 16 nt, Escherichia coli CFT073
accguacgccagcguc

SEQ ID NO: 2623094 - RNA, 21 nt, Escherichia coli CFT073
accguagaggugauaugaaug

SEQ ID NO: 2623095 - RNA, 14 nt, Escherichia coli CFT073
accguagcguguug

SEQ ID NO: 2623096 - RNA, 21 nt, Escherichia coli CFT073
accguagguuuaccguugccg

SEQ ID NO: 2623097 - RNA, 19 nt, Escherichia coli CFT073
accgucaaagcgccagcgc

SEQ ID NO: 2623098 - RNA, 15 nt, Escherichia coli CFT073
accgucaaauccaga

SEQ ID NO: 2623099 - RNA, 14 nt, Escherichia coli CFT073
accgucaauaaaaa

SEQ ID NO: 2623100 - RNA, 16 nt, Escherichia coli CFT073
accgucacaucaauua

SEQ ID NO: 2623101 - RNA, 14 nt, Escherichia coli CFT073
accgucaccagucc

SEQ ID NO: 2623102 - RNA, 13 nt, Escherichia coli CFT073
accgucacuucuu

SEQ ID NO: 2623103 - RNA, 14 nt, Escherichia coli CFT073
accgucacuucuuc

SEQ ID NO: 2623104 - RNA, 14 nt, Escherichia coli CFT073
accgucagccagca

SEQ ID NO: 2623105 - RNA, 16 nt, Escherichia coli CFT073
accgucagccagcacu

SEQ ID NO: 2623106 - RNA, 13 nt, Escherichia coli CFT073
accgucaggcgua

SEQ ID NO: 2623107 - RNA, 16 nt, Escherichia coli CFT073
accgucaucacgcagc

SEQ ID NO: 2623108 - RNA, 19 nt, Escherichia coli CFT073
accguccagcguucccacg

SEQ ID NO: 2623109 - RNA, 14 nt, Escherichia coli CFT073
accguccauccaca

SEQ ID NO: 2623110 - RNA, 17 nt, Escherichia coli CFT073
accguccgcauucuucu

SEQ ID NO: 2623111 - RNA, 23 nt, Escherichia coli CFT073
accguccucacuuaaagcaacac

SEQ ID NO: 2623112 - RNA, 17 nt, Escherichia coli CFT073
accgucgcagccagcgc

SEQ ID NO: 2623113 - RNA, 23 nt, Escherichia coli CFT073
accgucuggcagauccugaaauu

SEQ ID NO: 2623114 - RNA, 23 nt, Escherichia coli CFT073
accgucuguguaccugucgggac

SEQ ID NO: 2623115 - RNA, 16 nt, Escherichia coli CFT073
accgucuucccgcagc

SEQ ID NO: 2623116 - RNA, 18 nt, Escherichia coli CFT073
accgucuucccgcagcca

SEQ ID NO: 2623117 - RNA, 19 nt, Escherichia coli CFT073
accgucuucccgcagccac

SEQ ID NO: 2623118 - RNA, 20 nt, Escherichia coli CFT073
accgucuucccgcagccacg

SEQ ID NO: 2623119 - RNA, 17 nt, Escherichia coli CFT073
accgucuuuauccagca

SEQ ID NO: 2623120 - RNA, 20 nt, Escherichia coli CFT073
accgucuuuauccagcacca

SEQ ID NO: 2623121 - RNA, 22 nt, Escherichia coli CFT073
accgucuuugcugauacuccau

SEQ ID NO: 2623122 - RNA, 13 nt, Escherichia coli CFT073
accgugaccgccu

SEQ ID NO: 2623123 - RNA, 19 nt, Escherichia coli CFT073
accgugcagcacggagaga

SEQ ID NO: 2623124 - RNA, 21 nt, Escherichia coli CFT073
accgugcagcgcaaucgccuc

SEQ ID NO: 2623125 - RNA, 16 nt, Escherichia coli CFT073
accgugccgccgugac

SEQ ID NO: 2623126 - RNA, 17 nt, Escherichia coli CFT073
accgugcuucagccaaa

SEQ ID NO: 2623127 - RNA, 13 nt, Escherichia coli CFT073
accguggcaaaau

SEQ ID NO: 2623128 - RNA, 15 nt, Escherichia coli CFT073
accgugugcggcgau

SEQ ID NO: 2623129 - RNA, 18 nt, Escherichia coli CFT073
accguguucaugaccgug

SEQ ID NO: 2623130 - RNA, 14 nt, Escherichia coli CFT073
accguucagcuugc

SEQ ID NO: 2623131 - RNA, 19 nt, Escherichia coli CFT073
accguucauuaacgcccca

SEQ ID NO: 2623132 - RNA, 20 nt, Escherichia coli CFT073
accguucauuaacgccccaa

SEQ ID NO: 2623133 - RNA, 16 nt, Escherichia coli CFT073
accguucgccccauac

SEQ ID NO: 2623134 - RNA, 17 nt, Escherichia coli CFT073
accguucgccccauaca

SEQ ID NO: 2623135 - RNA, 16 nt, Escherichia coli CFT073
accguugaccauauca

SEQ ID NO: 2623136 - RNA, 18 nt, Escherichia coli CFT073
accguugcggcuccagac

SEQ ID NO: 2623137 - RNA, 23 nt, Escherichia coli CFT073
accguuggcgcguguuccagaga

SEQ ID NO: 2623138 - RNA, 22 nt, Escherichia coli CFT073
accguuuaccucgucaccaccu

SEQ ID NO: 2623139 - RNA, 20 nt, Escherichia coli CFT073
accguuuuagcgaaaaucgu

SEQ ID NO: 2623140 - RNA, 13 nt, Escherichia coli CFT073
accuaaagcgcgu

SEQ ID NO: 2623141 - RNA, 13 nt, Escherichia coli CFT073
accuaacagcauc

SEQ ID NO: 2623142 - RNA, 14 nt, Escherichia coli CFT073
accuaacaguucac

SEQ ID NO: 2623143 - RNA, 15 nt, Escherichia coli CFT073
accuaagaaccagaa

SEQ ID NO: 2623144 - RNA, 16 nt, Escherichia coli CFT073
accuaagaaccagaau

SEQ ID NO: 2623145 - RNA, 15 nt, Escherichia coli CFT073
accuaauacucuggc

SEQ ID NO: 2623146 - RNA, 17 nt, Escherichia coli CFT073
accuaauuuauuaccgc

SEQ ID NO: 2623147 - RNA, 16 nt, Escherichia coli CFT073
accuacagccacaccu

SEQ ID NO: 2623148 - RNA, 21 nt, Escherichia coli CFT073
accuacagccacaccuucuug

SEQ ID NO: 2623149 - RNA, 14 nt, Escherichia coli CFT073
accuacgacuuugc

SEQ ID NO: 2623150 - RNA, 15 nt, Escherichia coli CFT073
accuacgcccgccag

SEQ ID NO: 2623151 - RNA, 21 nt, Escherichia coli CFT073
accuagcaaacuaucugugua

SEQ ID NO: 2623152 - RNA, 22 nt, Escherichia coli CFT073
accuagcaaacuaucuguguaa

SEQ ID NO: 2623153 - RNA, 19 nt, Escherichia coli CFT073
accuaucgcgucgccgguc

SEQ ID NO: 2623154 - RNA, 22 nt, Escherichia coli CFT073
accuaucgcgucgccggucagg

SEQ ID NO: 2623155 - RNA, 16 nt, Escherichia coli CFT073
accuauuuaaauccua

SEQ ID NO: 2623156 - RNA, 17 nt, Escherichia coli CFT073
accuauuucauucaggc

SEQ ID NO: 2623157 - RNA, 19 nt, Escherichia coli CFT073
accucaaaaccaacgggga

SEQ ID NO: 2623158 - RNA, 11 nt, Escherichia coli CFT073
accucaacccg

SEQ ID NO: 2623159 - RNA, 18 nt, Escherichia coli CFT073
accucaauaauuucuuca

SEQ ID NO: 2623160 - RNA, 20 nt, Escherichia coli CFT073
accucaauggcagcaucacg

SEQ ID NO: 2623161 - RNA, 15 nt, Escherichia coli CFT073
accucacccgccggu

SEQ ID NO: 2623162 - RNA, 18 nt, Escherichia coli CFT073
accucaccuuucgguuca

SEQ ID NO: 2623163 - RNA, 16 nt, Escherichia coli CFT073
accucagcaguuucgg

SEQ ID NO: 2623164 - RNA, 19 nt, Escherichia coli CFT073
accucaggaaaagcaaaau

SEQ ID NO: 2623165 - RNA, 23 nt, Escherichia coli CFT073
accucaguacccgcguucuggau

SEQ ID NO: 2623166 - RNA, 21 nt, Escherichia coli CFT073
accucaucaccacagacaaac

SEQ ID NO: 2623167 - RNA, 22 nt, Escherichia coli CFT073
accucaucaccacagacaaaca

SEQ ID NO: 2623168 - RNA, 13 nt, Escherichia coli CFT073
accuccaguccca

SEQ ID NO: 2623169 - RNA, 14 nt, Escherichia coli CFT073
accuccaucgcacc

SEQ ID NO: 2623170 - RNA, 23 nt, Escherichia coli CFT073
accucccgucgcccacaccagau

SEQ ID NO: 2623171 - RNA, 22 nt, Escherichia coli CFT073
accuccgcuaaauccgccgcca

SEQ ID NO: 2623172 - RNA, 12 nt, Escherichia coli CFT073
accuccgcuuug

SEQ ID NO: 2623173 - RNA, 15 nt, Escherichia coli CFT073
accuccguuuuucug

SEQ ID NO: 2623174 - RNA, 22 nt, Escherichia coli CFT073
accucgcaacaaugucaucgcg

SEQ ID NO: 2623175 - RNA, 19 nt, Escherichia coli CFT073
accucgccccgugaugaac

SEQ ID NO: 2623176 - RNA, 23 nt, Escherichia coli CFT073
accucgccccgugaugaacugcg

SEQ ID NO: 2623177 - RNA, 22 nt, Escherichia coli CFT073
accucgguuaacagcgcaccag

SEQ ID NO: 2623178 - RNA, 23 nt, Escherichia coli CFT073
accucgguuaacagcgcaccaga

SEQ ID NO: 2623179 - RNA, 14 nt, Escherichia coli CFT073
accucgucaccacc

SEQ ID NO: 2623180 - RNA, 17 nt, Escherichia coli CFT073
accucgugcaccgccug

SEQ ID NO: 2623181 - RNA, 19 nt, Escherichia coli CFT073
accucugcaacgucuuccc

SEQ ID NO: 2623182 - RNA, 20 nt, Escherichia coli CFT073
accucugcaacgucuucccg

SEQ ID NO: 2623183 - RNA, 20 nt, Escherichia coli CFT073
accucuuaaugcaggcagca

SEQ ID NO: 2623184 - RNA, 22 nt, Escherichia coli CFT073
accucuuccagcgauaaugaau

SEQ ID NO: 2623185 - RNA, 23 nt, Escherichia coli CFT073
accucuucggcagucacuuuuuu

SEQ ID NO: 2623186 - RNA, 16 nt, Escherichia coli CFT073
accugaaucuggcuuc

SEQ ID NO: 2623187 - RNA, 14 nt, Escherichia coli CFT073
accugacauuaagu

SEQ ID NO: 2623188 - RNA, 16 nt, Escherichia coli CFT073
accugaccgagccagu

SEQ ID NO: 2623189 - RNA, 13 nt, Escherichia coli CFT073
accugacgcugcu

SEQ ID NO: 2623190 - RNA, 15 nt, Escherichia coli CFT073
accugacgcugcuca

SEQ ID NO: 2623191 - RNA, 17 nt, Escherichia coli CFT073
accugacgcugcucagg

SEQ ID NO: 2623192 - RNA, 17 nt, Escherichia coli CFT073
accugacguugcagguu

SEQ ID NO: 2623193 - RNA, 19 nt, Escherichia coli CFT073
accugauaagacgcgccag

SEQ ID NO: 2623194 - RNA, 21 nt, Escherichia coli CFT073
accugauaagacgcgccagca

SEQ ID NO: 2623195 - RNA, 16 nt, Escherichia coli CFT073
accugauccagcucuu

SEQ ID NO: 2623196 - RNA, 24 nt, Escherichia coli CFT073
accugauugcugcugccgcgccag

SEQ ID NO: 2623197 - RNA, 13 nt, Escherichia coli CFT073
accugcaacggca

SEQ ID NO: 2623198 - RNA, 21 nt, Escherichia coli CFT073
accugcaacguuuuaagcaaa

SEQ ID NO: 2623199 - RNA, 22 nt, Escherichia coli CFT073
accugcacguuagcccuuugua

SEQ ID NO: 2623200 - RNA, 21 nt, Escherichia coli CFT073
accugcauuagcaaugcccug

SEQ ID NO: 2623201 - RNA, 16 nt, Escherichia coli CFT073
accugcauuuacggcc

SEQ ID NO: 2623202 - RNA, 19 nt, Escherichia coli CFT073
accugccagcaucuccaua

SEQ ID NO: 2623203 - RNA, 19 nt, Escherichia coli CFT073
accugccagggugcaggcg

SEQ ID NO: 2623204 - RNA, 15 nt, Escherichia coli CFT073
accugcccggcagcu

SEQ ID NO: 2623205 - RNA, 14 nt, Escherichia coli CFT073
accugcccuccggu

SEQ ID NO: 2623206 - RNA, 15 nt, Escherichia coli CFT073
accugcccuccggua

SEQ ID NO: 2623207 - RNA, 15 nt, Escherichia coli CFT073
accugccugcagcug

SEQ ID NO: 2623208 - RNA, 15 nt, Escherichia coli CFT073
accugcgaaaaucag

SEQ ID NO: 2623209 - RNA, 16 nt, Escherichia coli CFT073
accugcgccucaguuu

SEQ ID NO: 2623210 - RNA, 19 nt, Escherichia coli CFT073
accugcgcggccagugcca

SEQ ID NO: 2623211 - RNA, 13 nt, Escherichia coli CFT073
accugcggaauca

SEQ ID NO: 2623212 - RNA, 20 nt, Escherichia coli CFT073
accugcggggaugaauaugu

SEQ ID NO: 2623213 - RNA, 16 nt, Escherichia coli CFT073
accugcggugcagccg

SEQ ID NO: 2623214 - RNA, 13 nt, Escherichia coli CFT073
accugcguucagc

SEQ ID NO: 2623215 - RNA, 23 nt, Escherichia coli CFT073
accugcguucagcaguucugcca

SEQ ID NO: 2623216 - RNA, 17 nt, Escherichia coli CFT073
accugcguugcucaugc

SEQ ID NO: 2623217 - RNA, 23 nt, Escherichia coli CFT073
accugcguugcucaugcaacaca

SEQ ID NO: 2623218 - RNA, 19 nt, Escherichia coli CFT073
accugcuauagccuccucu

SEQ ID NO: 2623219 - RNA, 16 nt, Escherichia coli CFT073
accugcucgaacguga

SEQ ID NO: 2623220 - RNA, 17 nt, Escherichia coli CFT073
accugcucgucauccgc

SEQ ID NO: 2623221 - RNA, 21 nt, Escherichia coli CFT073
accugcuguguaauuugcguu

SEQ ID NO: 2623222 - RNA, 15 nt, Escherichia coli CFT073
accugcuucgauaga

SEQ ID NO: 2623223 - RNA, 22 nt, Escherichia coli CFT073
accuggagcaguauugauagau

SEQ ID NO: 2623224 - RNA, 14 nt, Escherichia coli CFT073
accuggauugccug

SEQ ID NO: 2623225 - RNA, 21 nt, Escherichia coli CFT073
accuggcaguggcaaccagcg

SEQ ID NO: 2623226 - RNA, 18 nt, Escherichia coli CFT073
accuggccccuggcuggu

SEQ ID NO: 2623227 - RNA, 21 nt, Escherichia coli CFT073
accuggccccuggcuggucag

SEQ ID NO: 2623228 - RNA, 17 nt, Escherichia coli CFT073
accuggcgcaguggaua

SEQ ID NO: 2623229 - RNA, 20 nt, Escherichia coli CFT073
accuggcgcauuaacggcaa

SEQ ID NO: 2623230 - RNA, 19 nt, Escherichia coli CFT073
accuggcggcguguuaucc

SEQ ID NO: 2623231 - RNA, 20 nt, Escherichia coli CFT073
accuggcggcguguuauccg

SEQ ID NO: 2623232 - RNA, 23 nt, Escherichia coli CFT073
accuguaaaaaaggcagccaucu

SEQ ID NO: 2623233 - RNA, 22 nt, Escherichia coli CFT073
accuguaaguuacuaaaaguaa

SEQ ID NO: 2623234 - RNA, 21 nt, Escherichia coli CFT073
accuguacaagcaacuugcaa

SEQ ID NO: 2623235 - RNA, 13 nt, Escherichia coli CFT073
accuguccggcgg

SEQ ID NO: 2623236 - RNA, 19 nt, Escherichia coli CFT073
accugucgcgucaaucacu

SEQ ID NO: 2623237 - RNA, 20 nt, Escherichia coli CFT073
accugucgcgucaaucacuu

SEQ ID NO: 2623238 - RNA, 22 nt, Escherichia coli CFT073
accugucgcuuuugcaucuuca

SEQ ID NO: 2623239 - RNA, 14 nt, Escherichia coli CFT073
accugucucuuaua

SEQ ID NO: 2623240 - RNA, 16 nt, Escherichia coli CFT073
accugugacagcagcg

SEQ ID NO: 2623241 - RNA, 17 nt, Escherichia coli CFT073
accugugacagcagcgg

SEQ ID NO: 2623242 - RNA, 16 nt, Escherichia coli CFT073
accugugccgccgccc

SEQ ID NO: 2623243 - RNA, 22 nt, Escherichia coli CFT073
accuguucacgaccaucaaccu

SEQ ID NO: 2623244 - RNA, 22 nt, Escherichia coli CFT073
accuguucgcgguuuucuucca

SEQ ID NO: 2623245 - RNA, 23 nt, Escherichia coli CFT073
accuguuuucccauaauuucagc

SEQ ID NO: 2623246 - RNA, 18 nt, Escherichia coli CFT073
accuuaaaacgaaucucu

SEQ ID NO: 2623247 - RNA, 13 nt, Escherichia coli CFT073
accuuaaccucag

SEQ ID NO: 2623248 - RNA, 16 nt, Escherichia coli CFT073
accuuaccaaccgcaa

SEQ ID NO: 2623249 - RNA, 19 nt, Escherichia coli CFT073
accuuaccgccacguaccg

SEQ ID NO: 2623250 - RNA, 17 nt, Escherichia coli CFT073
accuuacuggaguaaau

SEQ ID NO: 2623251 - RNA, 16 nt, Escherichia coli CFT073
accuuauccagcagau

SEQ ID NO: 2623252 - RNA, 22 nt, Escherichia coli CFT073
accuuauccagcagaucgaucu

SEQ ID NO: 2623253 - RNA, 20 nt, Escherichia coli CFT073
accuuauggugucuaugcau

SEQ ID NO: 2623254 - RNA, 14 nt, Escherichia coli CFT073
accuucaaaauuua

SEQ ID NO: 2623255 - RNA, 17 nt, Escherichia coli CFT073
accuucaaaauuuaaca

SEQ ID NO: 2623256 - RNA, 22 nt, Escherichia coli CFT073
accuucaaaauuuaacauuacu

SEQ ID NO: 2623257 - RNA, 21 nt, Escherichia coli CFT073
accuucaagaauccuuauuuu

SEQ ID NO: 2623258 - RNA, 15 nt, Escherichia coli CFT073
accuucaauacuggc

SEQ ID NO: 2623259 - RNA, 23 nt, Escherichia coli CFT073
accuucaauacuggcaaaaucaa

SEQ ID NO: 2623260 - RNA, 21 nt, Escherichia coli CFT073
accuucacaaaaugccagcaa

SEQ ID NO: 2623261 - RNA, 22 nt, Escherichia coli CFT073
accuucauagguaaacaucaca

SEQ ID NO: 2623262 - RNA, 15 nt, Escherichia coli CFT073
accuuccagaaaaag

SEQ ID NO: 2623263 - RNA, 16 nt, Escherichia coli CFT073
accuuccagaaaaaga

SEQ ID NO: 2623264 - RNA, 19 nt, Escherichia coli CFT073
accuucgaaugccgcagca

SEQ ID NO: 2623265 - RNA, 23 nt, Escherichia coli CFT073
accuucgccagaauauugccauu

SEQ ID NO: 2623266 - RNA, 13 nt, Escherichia coli CFT073
accuucgcggcac

SEQ ID NO: 2623267 - RNA, 16 nt, Escherichia coli CFT073
accuucgcggcacugg

SEQ ID NO: 2623268 - RNA, 22 nt, Escherichia coli CFT073
accuucgggcgcuuccagccau

SEQ ID NO: 2623269 - RNA, 20 nt, Escherichia coli CFT073
accuucucucccgcauucca

SEQ ID NO: 2623270 - RNA, 19 nt, Escherichia coli CFT073
accuucugcgcccgcccgc

SEQ ID NO: 2623271 - RNA, 11 nt, Escherichia coli CFT073
accuucuuccu

SEQ ID NO: 2623272 - RNA, 20 nt, Escherichia coli CFT073
accuugauuauccucuguaa

SEQ ID NO: 2623273 - RNA, 11 nt, Escherichia coli CFT073
accuugccaag

SEQ ID NO: 2623274 - RNA, 20 nt, Escherichia coli CFT073
accuugccaaggucgggguc

SEQ ID NO: 2623275 - RNA, 16 nt, Escherichia coli CFT073
accuugcggaaacugu

SEQ ID NO: 2623276 - RNA, 12 nt, Escherichia coli CFT073
accuugcguuuu

SEQ ID NO: 2623277 - RNA, 14 nt, Escherichia coli CFT073
accuugcuucuuac

SEQ ID NO: 2623278 - RNA, 20 nt, Escherichia coli CFT073
accuugcuucuuacuauaua

SEQ ID NO: 2623279 - RNA, 22 nt, Escherichia coli CFT073
accuuguggaaauuccagcggc

SEQ ID NO: 2623280 - RNA, 21 nt, Escherichia coli CFT073
accuuguuggaucaugcucuu

SEQ ID NO: 2623281 - RNA, 12 nt, Escherichia coli CFT073
accuuguuuaau

SEQ ID NO: 2623282 - RNA, 18 nt, Escherichia coli CFT073
accuuguuucagcgcauc

SEQ ID NO: 2623283 - RNA, 21 nt, Escherichia coli CFT073
accuuuaaacaggccgacaaa

SEQ ID NO: 2623284 - RNA, 12 nt, Escherichia coli CFT073
accuuucaccuc

SEQ ID NO: 2623285 - RNA, 14 nt, Escherichia coli CFT073
accuuuccccggca

SEQ ID NO: 2623286 - RNA, 19 nt, Escherichia coli CFT073
accuuuccccggcagcauc

SEQ ID NO: 2623287 - RNA, 13 nt, Escherichia coli CFT073
accuuucgguuca

SEQ ID NO: 2623288 - RNA, 12 nt, Escherichia coli CFT073
accuuugaaaau

SEQ ID NO: 2623289 - RNA, 13 nt, Escherichia coli CFT073
accuuugaaaaua

SEQ ID NO: 2623290 - RNA, 12 nt, Escherichia coli CFT073
accuuugccuuc

SEQ ID NO: 2623291 - RNA, 16 nt, Escherichia coli CFT073
accuuugcuguugccg

SEQ ID NO: 2623292 - RNA, 18 nt, Escherichia coli CFT073
accuuuuccaguggcuga

SEQ ID NO: 2623293 - RNA, 15 nt, Escherichia coli CFT073
accuuuuccauugcc

SEQ ID NO: 2623294 - RNA, 21 nt, Escherichia coli CFT073
accuuuugccgcccagucacg

SEQ ID NO: 2623295 - RNA, 16 nt, Escherichia coli CFT073
accuuuugcugucuca

SEQ ID NO: 2623296 - RNA, 13 nt, Escherichia coli CFT073
accuuuuuugcac

SEQ ID NO: 2623297 - RNA, 21 nt, Escherichia coli CFT073
acgaaacccgaaccacgcagg

SEQ ID NO: 2623298 - RNA, 15 nt, Escherichia coli CFT073
acgaaacgaaaccca

SEQ ID NO: 2623299 - RNA, 17 nt, Escherichia coli CFT073
acgaaagcgcaguaagc

SEQ ID NO: 2623300 - RNA, 19 nt, Escherichia coli CFT073
acgaaaguuaauccacagc

SEQ ID NO: 2623301 - RNA, 15 nt, Escherichia coli CFT073
acgaaaucuuccagu

SEQ ID NO: 2623302 - RNA, 15 nt, Escherichia coli CFT073
acgaacacgaaucag

SEQ ID NO: 2623303 - RNA, 20 nt, Escherichia coli CFT073
acgaacgcagcgucucauaa

SEQ ID NO: 2623304 - RNA, 15 nt, Escherichia coli CFT073
acgaacuaaccgcac

SEQ ID NO: 2623305 - RNA, 23 nt, Escherichia coli CFT073
acgaacuaccgugcuguacagca

SEQ ID NO: 2623306 - RNA, 19 nt, Escherichia coli CFT073
acgaagaaaucgacauuga

SEQ ID NO: 2623307 - RNA, 18 nt, Escherichia coli CFT073
acgaagcgccauucacaa

SEQ ID NO: 2623308 - RNA, 17 nt, Escherichia coli CFT073
acgaauaccuucuuccu

SEQ ID NO: 2623309 - RNA, 20 nt, Escherichia coli CFT073
acgaauauguuuuugaauua

SEQ ID NO: 2623310 - RNA, 14 nt, Escherichia coli CFT073
acgaaucaggcggc

SEQ ID NO: 2623311 - RNA, 19 nt, Escherichia coli CFT073
acgaaugguuucacgcugg

SEQ ID NO: 2623312 - RNA, 15 nt, Escherichia coli CFT073
acgaauuccuucgcg

SEQ ID NO: 2623313 - RNA, 14 nt, Escherichia coli CFT073
acgaauugcagaac

SEQ ID NO: 2623314 - RNA, 21 nt, Escherichia coli CFT073
acgaauugcuuccaguaacac

SEQ ID NO: 2623315 - RNA, 15 nt, Escherichia coli CFT073
acgaauuucaucgcu

SEQ ID NO: 2623316 - RNA, 15 nt, Escherichia coli CFT073
acgaauuuuuuguuc

SEQ ID NO: 2623317 - RNA, 18 nt, Escherichia coli CFT073
acgaauuuuuuguucagc

SEQ ID NO: 2623318 - RNA, 11 nt, Escherichia coli CFT073
acgacaaucuc

SEQ ID NO: 2623319 - RNA, 15 nt, Escherichia coli CFT073
acgacacaaugccau

SEQ ID NO: 2623320 - RNA, 17 nt, Escherichia coli CFT073
acgacacaaugccauau

SEQ ID NO: 2623321 - RNA, 17 nt, Escherichia coli CFT073
acgacacauaaauaaca

SEQ ID NO: 2623322 - RNA, 18 nt, Escherichia coli CFT073
acgacaugguagauaacc

SEQ ID NO: 2623323 - RNA, 14 nt, Escherichia coli CFT073
acgaccacccaccg

SEQ ID NO: 2623324 - RNA, 15 nt, Escherichia coli CFT073
acgaccacucuuucg

SEQ ID NO: 2623325 - RNA, 16 nt, Escherichia coli CFT073
acgaccagaaagacug

SEQ ID NO: 2623326 - RNA, 18 nt, Escherichia coli CFT073
acgaccagcggcaacauc

SEQ ID NO: 2623327 - RNA, 23 nt, Escherichia coli CFT073
acgaccagcggcaacaucaucac

SEQ ID NO: 2623328 - RNA, 17 nt, Escherichia coli CFT073
acgaccaguucacaccg

SEQ ID NO: 2623329 - RNA, 13 nt, Escherichia coli CFT073
acgacccauuacg

SEQ ID NO: 2623330 - RNA, 16 nt, Escherichia coli CFT073
acgaccgaucaccaca

SEQ ID NO: 2623331 - RNA, 16 nt, Escherichia coli CFT073
acgaccggguuuucaa

SEQ ID NO: 2623332 - RNA, 16 nt, Escherichia coli CFT073
acgaccuacacgcccg

SEQ ID NO: 2623333 - RNA, 19 nt, Escherichia coli CFT073
acgaccuuccugacgguga

SEQ ID NO: 2623334 - RNA, 14 nt, Escherichia coli CFT073
acgaccuugccaag

SEQ ID NO: 2623335 - RNA, 15 nt, Escherichia coli CFT073
acgacgacaggcaag

SEQ ID NO: 2623336 - RNA, 22 nt, Escherichia coli CFT073
acgacgaccaccgaaugcgccu

SEQ ID NO: 2623337 - RNA, 19 nt, Escherichia coli CFT073
acgacgggauucgaaccug

SEQ ID NO: 2623338 - RNA, 17 nt, Escherichia coli CFT073
acgacgguaaaccacgc

SEQ ID NO: 2623339 - RNA, 21 nt, Escherichia coli CFT073
acgacgguucauuggguucau

SEQ ID NO: 2623340 - RNA, 15 nt, Escherichia coli CFT073
acgacgguuuccacc

SEQ ID NO: 2623341 - RNA, 19 nt, Escherichia coli CFT073
acgacucaaaucacgcagu

SEQ ID NO: 2623342 - RNA, 18 nt, Escherichia coli CFT073
acgacugaugcgacgcag

SEQ ID NO: 2623343 - RNA, 19 nt, Escherichia coli CFT073
acgacugaugcgacgcagg

SEQ ID NO: 2623344 - RNA, 16 nt, Escherichia coli CFT073
acgacuucaucgccaa

SEQ ID NO: 2623345 - RNA, 22 nt, Escherichia coli CFT073
acgacuuccuggcuaccauccg

SEQ ID NO: 2623346 - RNA, 20 nt, Escherichia coli CFT073
acgacuuugcgcaggcaagc

SEQ ID NO: 2623347 - RNA, 21 nt, Escherichia coli CFT073
acgacuuugcuaccgucgccu

SEQ ID NO: 2623348 - RNA, 20 nt, Escherichia coli CFT073
acgagaacgucgcagggaga

SEQ ID NO: 2623349 - RNA, 14 nt, Escherichia coli CFT073
acgagacuuauuaa

SEQ ID NO: 2623350 - RNA, 18 nt, Escherichia coli CFT073
acgagagcgggaaaacau

SEQ ID NO: 2623351 - RNA, 14 nt, Escherichia coli CFT073
acgagccauaaaau

SEQ ID NO: 2623352 - RNA, 19 nt, Escherichia coli CFT073
acgagcuucgacuuccugc

SEQ ID NO: 2623353 - RNA, 14 nt, Escherichia coli CFT073
acgaggaacauucg

SEQ ID NO: 2623354 - RNA, 18 nt, Escherichia coli CFT073
acgaggcgacgguuucca

SEQ ID NO: 2623355 - RNA, 14 nt, Escherichia coli CFT073
acgaggugccacca

SEQ ID NO: 2623356 - RNA, 16 nt, Escherichia coli CFT073
acgaguauauucugua

SEQ ID NO: 2623357 - RNA, 15 nt, Escherichia coli CFT073
acgaguccuuccugg

SEQ ID NO: 2623358 - RNA, 23 nt, Escherichia coli CFT073
acgagucgccuguacuuccuguu

SEQ ID NO: 2623359 - RNA, 13 nt, Escherichia coli CFT073
acgaguggcggac

SEQ ID NO: 2623360 - RNA, 22 nt, Escherichia coli CFT073
acgaguugcgguuucaacugcg

SEQ ID NO: 2623361 - RNA, 16 nt, Escherichia coli CFT073
acgauaaaagugcaga

SEQ ID NO: 2623362 - RNA, 20 nt, Escherichia coli CFT073
acgauaacaaucaccaaacc

SEQ ID NO: 2623363 - RNA, 22 nt, Escherichia coli CFT073
acgauaaccgguuacggauuuc

SEQ ID NO: 2623364 - RNA, 18 nt, Escherichia coli CFT073
acgauaauuuacaaucac

SEQ ID NO: 2623365 - RNA, 17 nt, Escherichia coli CFT073
acgauacaaaagcaccg

SEQ ID NO: 2623366 - RNA, 18 nt, Escherichia coli CFT073
acgauacgcgucccggaa

SEQ ID NO: 2623367 - RNA, 21 nt, Escherichia coli CFT073
acgauacggaauaucgcuggc

SEQ ID NO: 2623368 - RNA, 20 nt, Escherichia coli CFT073
acgauacgguuauccugcaa

SEQ ID NO: 2623369 - RNA, 20 nt, Escherichia coli CFT073
acgauagaaccuuccacguu

SEQ ID NO: 2623370 - RNA, 18 nt, Escherichia coli CFT073
acgauaggucauaucauc

SEQ ID NO: 2623371 - RNA, 15 nt, Escherichia coli CFT073
acgaucaacagaaug

SEQ ID NO: 2623372 - RNA, 20 nt, Escherichia coli CFT073
acgaucaguuacucugcaag

SEQ ID NO: 2623373 - RNA, 16 nt, Escherichia coli CFT073
acgauccguccgacgg

SEQ ID NO: 2623374 - RNA, 11 nt, Escherichia coli CFT073
acgaucgccga

SEQ ID NO: 2623375 - RNA, 14 nt, Escherichia coli CFT073
acgaucuucacgga

SEQ ID NO: 2623376 - RNA, 21 nt, Escherichia coli CFT073
acgaugaccgcaucaauuacc

SEQ ID NO: 2623377 - RNA, 14 nt, Escherichia coli CFT073
acgaugauugccac

SEQ ID NO: 2623378 - RNA, 17 nt, Escherichia coli CFT073
acgaugcaaauuuuuaa

SEQ ID NO: 2623379 - RNA, 18 nt, Escherichia coli CFT073
acgaugcaaauuuuuaau

SEQ ID NO: 2623380 - RNA, 15 nt, Escherichia coli CFT073
acgaugccagcgcug

SEQ ID NO: 2623381 - RNA, 15 nt, Escherichia coli CFT073
acgaugccauucagu

SEQ ID NO: 2623382 - RNA, 19 nt, Escherichia coli CFT073
acgauggaaccguauagca

SEQ ID NO: 2623383 - RNA, 17 nt, Escherichia coli CFT073
acgauuaacgccagacu

SEQ ID NO: 2623384 - RNA, 16 nt, Escherichia coli CFT073
acgauuccaacgaaaa

SEQ ID NO: 2623385 - RNA, 13 nt, Escherichia coli CFT073
acgauuccggcaa

SEQ ID NO: 2623386 - RNA, 16 nt, Escherichia coli CFT073
acgauucggcaaucac

SEQ ID NO: 2623387 - RNA, 17 nt, Escherichia coli CFT073
acgauucucccacagca

SEQ ID NO: 2623388 - RNA, 18 nt, Escherichia coli CFT073
acgauuucacccagcguu

SEQ ID NO: 2623389 - RNA, 13 nt, Escherichia coli CFT073
acgauuuuuacuc

SEQ ID NO: 2623390 - RNA, 14 nt, Escherichia coli CFT073
acgcaaacaacuug

SEQ ID NO: 2623391 - RNA, 17 nt, Escherichia coli CFT073
acgcaaacugcuucagg

SEQ ID NO: 2623392 - RNA, 15 nt, Escherichia coli CFT073
acgcaaacuucgguu

SEQ ID NO: 2623393 - RNA, 21 nt, Escherichia coli CFT073
acgcaaccagcgucgcaucag

SEQ ID NO: 2623394 - RNA, 20 nt, Escherichia coli CFT073
acgcaaccugauguuucugc

SEQ ID NO: 2623395 - RNA, 20 nt, Escherichia coli CFT073
acgcaaggcacaaagucgcg

SEQ ID NO: 2623396 - RNA, 18 nt, Escherichia coli CFT073
acgcaaucgaguuugccg

SEQ ID NO: 2623397 - RNA, 20 nt, Escherichia coli CFT073
acgcacagcccgccgccauc

SEQ ID NO: 2623398 - RNA, 14 nt, Escherichia coli CFT073
acgcacauaacauc

SEQ ID NO: 2623399 - RNA, 13 nt, Escherichia coli CFT073
acgcaccaccagc

SEQ ID NO: 2623400 - RNA, 24 nt, Escherichia coli CFT073
acgcacccucaaaauuucucuuuc

SEQ ID NO: 2623401 - RNA, 19 nt, Escherichia coli CFT073
acgcaccggaaauugcugc

SEQ ID NO: 2623402 - RNA, 17 nt, Escherichia coli CFT073
acgcaccguaacccuga

SEQ ID NO: 2623403 - RNA, 19 nt, Escherichia coli CFT073
acgcaccuugccaaauuua

SEQ ID NO: 2623404 - RNA, 15 nt, Escherichia coli CFT073
acgcaccuuguucau

SEQ ID NO: 2623405 - RNA, 17 nt, Escherichia coli CFT073
acgcacgcgggugccug

SEQ ID NO: 2623406 - RNA, 13 nt, Escherichia coli CFT073
acgcacuuccggu

SEQ ID NO: 2623407 - RNA, 23 nt, Escherichia coli CFT073
acgcacuucuuccgggcuauaca

SEQ ID NO: 2623408 - RNA, 21 nt, Escherichia coli CFT073
acgcacuucuucguuuucugc

SEQ ID NO: 2623409 - RNA, 21 nt, Escherichia coli CFT073
acgcagaccaaagucaaacug

SEQ ID NO: 2623410 - RNA, 14 nt, Escherichia coli CFT073
acgcagaccaaccg

SEQ ID NO: 2623411 - RNA, 15 nt, Escherichia coli CFT073
acgcagaccaaccgu

SEQ ID NO: 2623412 - RNA, 21 nt, Escherichia coli CFT073
acgcagaccgaagucaaacug

SEQ ID NO: 2623413 - RNA, 17 nt, Escherichia coli CFT073
acgcagagugcgcagca

SEQ ID NO: 2623414 - RNA, 23 nt, Escherichia coli CFT073
acgcagaucccacucaucaagca

SEQ ID NO: 2623415 - RNA, 14 nt, Escherichia coli CFT073
acgcagcaaaagca

SEQ ID NO: 2623416 - RNA, 14 nt, Escherichia coli CFT073
acgcagccccagcg

SEQ ID NO: 2623417 - RNA, 11 nt, Escherichia coli CFT073
acgcagcgaua

SEQ ID NO: 2623418 - RNA, 14 nt, Escherichia coli CFT073
acgcagcggcggca

SEQ ID NO: 2623419 - RNA, 19 nt, Escherichia coli CFT073
acgcagcgugaagcuaccg

SEQ ID NO: 2623420 - RNA, 13 nt, Escherichia coli CFT073
acgcagcucacgc

SEQ ID NO: 2623421 - RNA, 23 nt, Escherichia coli CFT073
acgcagcucauaaccguccaguu

SEQ ID NO: 2623422 - RNA, 20 nt, Escherichia coli CFT073
acgcaggauguaauccggca

SEQ ID NO: 2623423 - RNA, 20 nt, Escherichia coli CFT073
acgcaggcaucuuuuucaau

SEQ ID NO: 2623424 - RNA, 18 nt, Escherichia coli CFT073
acgcaggcggcuggcauc

SEQ ID NO: 2623425 - RNA, 23 nt, Escherichia coli CFT073
acgcaggcguuucacuuucagau

SEQ ID NO: 2623426 - RNA, 11 nt, Escherichia coli CFT073
acgcaggcugg

SEQ ID NO: 2623427 - RNA, 18 nt, Escherichia coli CFT073
acgcaguaaauaaaaaau

SEQ ID NO: 2623428 - RNA, 16 nt, Escherichia coli CFT073
acgcagucagcacugg

SEQ ID NO: 2623429 - RNA, 22 nt, Escherichia coli CFT073
acgcagugucagcaccagagaa

SEQ ID NO: 2623430 - RNA, 22 nt, Escherichia coli CFT073
acgcagugugcuacggucugcc

SEQ ID NO: 2623431 - RNA, 16 nt, Escherichia coli CFT073
acgcaguugcugacga

SEQ ID NO: 2623432 - RNA, 22 nt, Escherichia coli CFT073
acgcaguugcugacgaucggca

SEQ ID NO: 2623433 - RNA, 17 nt, Escherichia coli CFT073
acgcauaaaacggcgca

SEQ ID NO: 2623434 - RNA, 15 nt, Escherichia coli CFT073
acgcauaaacaucuu

SEQ ID NO: 2623435 - RNA, 15 nt, Escherichia coli CFT073
acgcauaaccgguac

SEQ ID NO: 2623436 - RNA, 22 nt, Escherichia coli CFT073
acgcauaaugcgccccgcaacg

SEQ ID NO: 2623437 - RNA, 16 nt, Escherichia coli CFT073
acgcauagacagccac

SEQ ID NO: 2623438 - RNA, 16 nt, Escherichia coli CFT073
acgcauaucuucugaa

SEQ ID NO: 2623439 - RNA, 16 nt, Escherichia coli CFT073
acgcaucacccgcaua

SEQ ID NO: 2623440 - RNA, 14 nt, Escherichia coli CFT073
acgcaucagucacg

SEQ ID NO: 2623441 - RNA, 14 nt, Escherichia coli CFT073
acgcauccaccaga

SEQ ID NO: 2623442 - RNA, 17 nt, Escherichia coli CFT073
acgcauccaccagauaa

SEQ ID NO: 2623443 - RNA, 22 nt, Escherichia coli CFT073
acgcauccggcacgucgcguua

SEQ ID NO: 2623444 - RNA, 16 nt, Escherichia coli CFT073
acgcaucgcgcaccag

SEQ ID NO: 2623445 - RNA, 15 nt, Escherichia coli CFT073
acgcauggucaguug

SEQ ID NO: 2623446 - RNA, 18 nt, Escherichia coli CFT073
acgcauguuguuuucaac

SEQ ID NO: 2623447 - RNA, 19 nt, Escherichia coli CFT073
acgcauucgccguuaccag

SEQ ID NO: 2623448 - RNA, 22 nt, Escherichia coli CFT073
acgcauucgccguuaccagcac

SEQ ID NO: 2623449 - RNA, 21 nt, Escherichia coli CFT073
acgcauucucuuuucacgcaa

SEQ ID NO: 2623450 - RNA, 13 nt, Escherichia coli CFT073
acgcauugccgcc

SEQ ID NO: 2623451 - RNA, 17 nt, Escherichia coli CFT073
acgccaaaagcgauuau

SEQ ID NO: 2623452 - RNA, 15 nt, Escherichia coli CFT073
acgccaaauucuuua

SEQ ID NO: 2623453 - RNA, 14 nt, Escherichia coli CFT073
acgccaacaaaaau

SEQ ID NO: 2623454 - RNA, 13 nt, Escherichia coli CFT073
acgccaaccaccg

SEQ ID NO: 2623455 - RNA, 13 nt, Escherichia coli CFT073
acgccaagaaaca

SEQ ID NO: 2623456 - RNA, 17 nt, Escherichia coli CFT073
acgccaagaaacaccag

SEQ ID NO: 2623457 - RNA, 19 nt, Escherichia coli CFT073
acgccaagaaacaccagaa

SEQ ID NO: 2623458 - RNA, 15 nt, Escherichia coli CFT073
acgccaauaaucugc

SEQ ID NO: 2623459 - RNA, 18 nt, Escherichia coli CFT073
acgccaauacgugaucgc

SEQ ID NO: 2623460 - RNA, 21 nt, Escherichia coli CFT073
acgccaaucugcaaaauacca

SEQ ID NO: 2623461 - RNA, 21 nt, Escherichia coli CFT073
acgccaauugccugguuuuuu

SEQ ID NO: 2623462 - RNA, 21 nt, Escherichia coli CFT073
acgccacaauacugaucauca

SEQ ID NO: 2623463 - RNA, 12 nt, Escherichia coli CFT073
acgccacauccg

SEQ ID NO: 2623464 - RNA, 17 nt, Escherichia coli CFT073
acgccaccaacgcacca

SEQ ID NO: 2623465 - RNA, 13 nt, Escherichia coli CFT073
acgccaccagcgu

SEQ ID NO: 2623466 - RNA, 14 nt, Escherichia coli CFT073
acgccaccagcguc

SEQ ID NO: 2623467 - RNA, 12 nt, Escherichia coli CFT073
acgccaccauca

SEQ ID NO: 2623468 - RNA, 17 nt, Escherichia coli CFT073
acgccaccuguuucuua

SEQ ID NO: 2623469 - RNA, 16 nt, Escherichia coli CFT073
acgccacgcucacuca

SEQ ID NO: 2623470 - RNA, 16 nt, Escherichia coli CFT073
acgccacuggcaauaa

SEQ ID NO: 2623471 - RNA, 17 nt, Escherichia coli CFT073
acgccacuuuuuucacc

SEQ ID NO: 2623472 - RNA, 16 nt, Escherichia coli CFT073
acgccagaaacgggug

SEQ ID NO: 2623473 - RNA, 13 nt, Escherichia coli CFT073
acgccagaaucaa

SEQ ID NO: 2623474 - RNA, 18 nt, Escherichia coli CFT073
acgccagaaucaaacugc

SEQ ID NO: 2623475 - RNA, 15 nt, Escherichia coli CFT073
acgccagauccgcca

SEQ ID NO: 2623476 - RNA, 14 nt, Escherichia coli CFT073
acgccagccgccag

SEQ ID NO: 2623477 - RNA, 16 nt, Escherichia coli CFT073
acgccagccgccagca

SEQ ID NO: 2623478 - RNA, 16 nt, Escherichia coli CFT073
acgccagcgaagccag

SEQ ID NO: 2623479 - RNA, 11 nt, Escherichia coli CFT073
acgccagcgcg

SEQ ID NO: 2623480 - RNA, 19 nt, Escherichia coli CFT073
acgccagugaugucugauu

SEQ ID NO: 2623481 - RNA, 18 nt, Escherichia coli CFT073
acgccagugucgcaucag

SEQ ID NO: 2623482 - RNA, 15 nt, Escherichia coli CFT073
acgccaucaacgaaa

SEQ ID NO: 2623483 - RNA, 15 nt, Escherichia coli CFT073
acgccauccagccgg

SEQ ID NO: 2623484 - RNA, 12 nt, Escherichia coli CFT073
acgcccacgcca

SEQ ID NO: 2623485 - RNA, 21 nt, Escherichia coli CFT073
acgcccauaaauacgucuuua

SEQ ID NO: 2623486 - RNA, 16 nt, Escherichia coli CFT073
acgcccauacucaucu

SEQ ID NO: 2623487 - RNA, 13 nt, Escherichia coli CFT073
acgcccaucagcg

SEQ ID NO: 2623488 - RNA, 14 nt, Escherichia coli CFT073
acgcccaucgcgcc

SEQ ID NO: 2623489 - RNA, 23 nt, Escherichia coli CFT073
acgcccccaauguggagagcaac

SEQ ID NO: 2623490 - RNA, 18 nt, Escherichia coli CFT073
acgccccgguuucucuuc

SEQ ID NO: 2623491 - RNA, 15 nt, Escherichia coli CFT073
acgcccgauagcgaa

SEQ ID NO: 2623492 - RNA, 23 nt, Escherichia coli CFT073
acgcccgcaaucaacauaaugcc

SEQ ID NO: 2623493 - RNA, 22 nt, Escherichia coli CFT073
acgcccgcacugucgccauacg

SEQ ID NO: 2623494 - RNA, 22 nt, Escherichia coli CFT073
acgcccgcgcgguguacgcugc

SEQ ID NO: 2623495 - RNA, 12 nt, Escherichia coli CFT073
acgcccugcaac

SEQ ID NO: 2623496 - RNA, 20 nt, Escherichia coli CFT073
acgcccuguaaaaaagaaau

SEQ ID NO: 2623497 - RNA, 21 nt, Escherichia coli CFT073
acgccgaauaacgcgcagcgu

SEQ ID NO: 2623498 - RNA, 16 nt, Escherichia coli CFT073
acgccgaccagaccgg

SEQ ID NO: 2623499 - RNA, 17 nt, Escherichia coli CFT073
acgccgacgcccugcgc

SEQ ID NO: 2623500 - RNA, 22 nt, Escherichia coli CFT073
acgccgagacguuuugccaguu

SEQ ID NO: 2623501 - RNA, 21 nt, Escherichia coli CFT073
acgccgauaaucaacgcgccg

SEQ ID NO: 2623502 - RNA, 23 nt, Escherichia coli CFT073
acgccgauaaucaacgcgccgcc

SEQ ID NO: 2623503 - RNA, 19 nt, Escherichia coli CFT073
acgccgauaauucucauca

SEQ ID NO: 2623504 - RNA, 19 nt, Escherichia coli CFT073
acgccgauggcagaaauca

SEQ ID NO: 2623505 - RNA, 14 nt, Escherichia coli CFT073
acgccgcacccggc

SEQ ID NO: 2623506 - RNA, 15 nt, Escherichia coli CFT073
acgccgcauccgaca

SEQ ID NO: 2623507 - RNA, 19 nt, Escherichia coli CFT073
acgccgcauccgacaaaau

SEQ ID NO: 2623508 - RNA, 16 nt, Escherichia coli CFT073
acgccgcauccggcaa

SEQ ID NO: 2623509 - RNA, 20 nt, Escherichia coli CFT073
acgccgcauccggccaucag

SEQ ID NO: 2623510 - RNA, 23 nt, Escherichia coli CFT073
acgccgcauccggcgacaggaac

SEQ ID NO: 2623511 - RNA, 16 nt, Escherichia coli CFT073
acgccgccagaccaau

SEQ ID NO: 2623512 - RNA, 21 nt, Escherichia coli CFT073
acgccgccagaccaauagaaa

SEQ ID NO: 2623513 - RNA, 19 nt, Escherichia coli CFT073
acgccgccaguacgcgccc

SEQ ID NO: 2623514 - RNA, 20 nt, Escherichia coli CFT073
acgccgccgccaaucgcccg

SEQ ID NO: 2623515 - RNA, 20 nt, Escherichia coli CFT073
acgccgccgggucagcgggg

SEQ ID NO: 2623516 - RNA, 18 nt, Escherichia coli CFT073
acgccgcgauagagagca

SEQ ID NO: 2623517 - RNA, 15 nt, Escherichia coli CFT073
acgccgcguuugcgc

SEQ ID NO: 2623518 - RNA, 14 nt, Escherichia coli CFT073
acgccgcuauacgc

SEQ ID NO: 2623519 - RNA, 20 nt, Escherichia coli CFT073
acgccggauggcacaugacu

SEQ ID NO: 2623520 - RNA, 18 nt, Escherichia coli CFT073
acgccgggaaauuuuucc

SEQ ID NO: 2623521 - RNA, 23 nt, Escherichia coli CFT073
acgccggguuauugguuucgucg

SEQ ID NO: 2623522 - RNA, 22 nt, Escherichia coli CFT073
acgccggugauuaaaccaacca

SEQ ID NO: 2623523 - RNA, 16 nt, Escherichia coli CFT073
acgccgguuccugcau

SEQ ID NO: 2623524 - RNA, 17 nt, Escherichia coli CFT073
acgccgguugcgacaga

SEQ ID NO: 2623525 - RNA, 16 nt, Escherichia coli CFT073
acgccgucgccuucau

SEQ ID NO: 2623526 - RNA, 17 nt, Escherichia coli CFT073
acgccuaacucuugcca

SEQ ID NO: 2623527 - RNA, 19 nt, Escherichia coli CFT073
acgccuaaugccagcgaua

SEQ ID NO: 2623528 - RNA, 13 nt, Escherichia coli CFT073
acgccucaggcgc

SEQ ID NO: 2623529 - RNA, 20 nt, Escherichia coli CFT073
acgccucgggaaggucaggu

SEQ ID NO: 2623530 - RNA, 15 nt, Escherichia coli CFT073
acgccugcaagcguc

SEQ ID NO: 2623531 - RNA, 20 nt, Escherichia coli CFT073
acgccugcaagcgucgcgcc

SEQ ID NO: 2623532 - RNA, 16 nt, Escherichia coli CFT073
acgccugcaccagccu

SEQ ID NO: 2623533 - RNA, 13 nt, Escherichia coli CFT073
acgccugcagcau

SEQ ID NO: 2623534 - RNA, 15 nt, Escherichia coli CFT073
acgccugccagcucu

SEQ ID NO: 2623535 - RNA, 13 nt, Escherichia coli CFT073
acgccugccgcau

SEQ ID NO: 2623536 - RNA, 13 nt, Escherichia coli CFT073
acgccugcggcug

SEQ ID NO: 2623537 - RNA, 18 nt, Escherichia coli CFT073
acgccugcggcugauaau

SEQ ID NO: 2623538 - RNA, 19 nt, Escherichia coli CFT073
acgccugcuccaucauccg

SEQ ID NO: 2623539 - RNA, 22 nt, Escherichia coli CFT073
acgccuguaccagcggcuucca

SEQ ID NO: 2623540 - RNA, 15 nt, Escherichia coli CFT073
acgccuuauccgacc

SEQ ID NO: 2623541 - RNA, 21 nt, Escherichia coli CFT073
acgccuuauccgaccuacaaa

SEQ ID NO: 2623542 - RNA, 23 nt, Escherichia coli CFT073
acgccuuauccggccuacgggaa

SEQ ID NO: 2623543 - RNA, 21 nt, Escherichia coli CFT073
acgccuuauccggccugcaaa

SEQ ID NO: 2623544 - RNA, 20 nt, Escherichia coli CFT073
acgccuuauucggccuacca

SEQ ID NO: 2623545 - RNA, 20 nt, Escherichia coli CFT073
acgccuuccagacucaucuu

SEQ ID NO: 2623546 - RNA, 21 nt, Escherichia coli CFT073
acgccuuccagacucaucuuc

SEQ ID NO: 2623547 - RNA, 17 nt, Escherichia coli CFT073
acgccuuccgucagcaa

SEQ ID NO: 2623548 - RNA, 18 nt, Escherichia coli CFT073
acgccuuccgucagcaaa

SEQ ID NO: 2623549 - RNA, 17 nt, Escherichia coli CFT073
acgccuuuuucuccgag

SEQ ID NO: 2623550 - RNA, 16 nt, Escherichia coli CFT073
acgcgaaauaaucaaa

SEQ ID NO: 2623551 - RNA, 21 nt, Escherichia coli CFT073
acgcgaacagcgucgcaucag

SEQ ID NO: 2623552 - RNA, 14 nt, Escherichia coli CFT073
acgcgaagcacaca

SEQ ID NO: 2623553 - RNA, 19 nt, Escherichia coli CFT073
acgcgaaggccagcaccac

SEQ ID NO: 2623554 - RNA, 20 nt, Escherichia coli CFT073
acgcgacauaaagcgcaaua

SEQ ID NO: 2623555 - RNA, 23 nt, Escherichia coli CFT073
acgcgauaaaaaaccccgacauc

SEQ ID NO: 2623556 - RNA, 13 nt, Escherichia coli CFT073
acgcgauggcuuu

SEQ ID NO: 2623557 - RNA, 19 nt, Escherichia coli CFT073
acgcgauucccagucgcgc

SEQ ID NO: 2623558 - RNA, 18 nt, Escherichia coli CFT073
acgcgcaccgcgugaugc

SEQ ID NO: 2623559 - RNA, 23 nt, Escherichia coli CFT073
acgcgcagaccccccaggcgcac

SEQ ID NO: 2623560 - RNA, 13 nt, Escherichia coli CFT073
acgcgcagcgucg

SEQ ID NO: 2623561 - RNA, 12 nt, Escherichia coli CFT073
acgcgcauauug

SEQ ID NO: 2623562 - RNA, 15 nt, Escherichia coli CFT073
acgcgccaccgacca

SEQ ID NO: 2623563 - RNA, 21 nt, Escherichia coli CFT073
acgcgccagagagaacugugc

SEQ ID NO: 2623564 - RNA, 22 nt, Escherichia coli CFT073
acgcgccagagcuggcaccgca

SEQ ID NO: 2623565 - RNA, 22 nt, Escherichia coli CFT073
acgcgcccguagucggugccau

SEQ ID NO: 2623566 - RNA, 19 nt, Escherichia coli CFT073
acgcgccgacgaauuucau

SEQ ID NO: 2623567 - RNA, 14 nt, Escherichia coli CFT073
acgcgccgccaccg

SEQ ID NO: 2623568 - RNA, 18 nt, Escherichia coli CFT073
acgcgccgccaccgccag

SEQ ID NO: 2623569 - RNA, 23 nt, Escherichia coli CFT073
acgcgccgccaccgccagaagaa

SEQ ID NO: 2623570 - RNA, 15 nt, Escherichia coli CFT073
acgcgccgccagcca

SEQ ID NO: 2623571 - RNA, 16 nt, Escherichia coli CFT073
acgcgccgccagccac

SEQ ID NO: 2623572 - RNA, 14 nt, Escherichia coli CFT073
acgcgccuuaaaaa

SEQ ID NO: 2623573 - RNA, 23 nt, Escherichia coli CFT073
acgcgcggugguacggcauuuug

SEQ ID NO: 2623574 - RNA, 14 nt, Escherichia coli CFT073
acgcgcguuuucaa

SEQ ID NO: 2623575 - RNA, 17 nt, Escherichia coli CFT073
acgcgcuaauuucagca

SEQ ID NO: 2623576 - RNA, 19 nt, Escherichia coli CFT073
acgcgcuacugaaucccug

SEQ ID NO: 2623577 - RNA, 18 nt, Escherichia coli CFT073
acgcgcuguaauuucaca

SEQ ID NO: 2623578 - RNA, 22 nt, Escherichia coli CFT073
acgcgcuguaauuucacaccau

SEQ ID NO: 2623579 - RNA, 16 nt, Escherichia coli CFT073
acgcgcuuucuucgca

SEQ ID NO: 2623580 - RNA, 21 nt, Escherichia coli CFT073
acgcgcuuucuucgcagcaaa

SEQ ID NO: 2623581 - RNA, 22 nt, Escherichia coli CFT073
acgcgcuuucuucgcagcaaau

SEQ ID NO: 2623582 - RNA, 13 nt, Escherichia coli CFT073
acgcggcaacggc

SEQ ID NO: 2623583 - RNA, 18 nt, Escherichia coli CFT073
acgcggcaacggcuucgc

SEQ ID NO: 2623584 - RNA, 21 nt, Escherichia coli CFT073
acgcggcaagcgucgcaucag

SEQ ID NO: 2623585 - RNA, 20 nt, Escherichia coli CFT073
acgcggcacgcccugcucgu

SEQ ID NO: 2623586 - RNA, 17 nt, Escherichia coli CFT073
acgcggcacuccgccac

SEQ ID NO: 2623587 - RNA, 20 nt, Escherichia coli CFT073
acgcggcagcgucgcaucag

SEQ ID NO: 2623588 - RNA, 21 nt, Escherichia coli CFT073
acgcggcagcgucgcauccga

SEQ ID NO: 2623589 - RNA, 14 nt, Escherichia coli CFT073
acgcggcagguaac

SEQ ID NO: 2623590 - RNA, 17 nt, Escherichia coli CFT073
acgcggccugcacugag

SEQ ID NO: 2623591 - RNA, 14 nt, Escherichia coli CFT073
acgcgggaagucac

SEQ ID NO: 2623592 - RNA, 14 nt, Escherichia coli CFT073
acgcgggaauagcu

SEQ ID NO: 2623593 - RNA, 18 nt, Escherichia coli CFT073
acgcgggcaaucggcugc

SEQ ID NO: 2623594 - RNA, 23 nt, Escherichia coli CFT073
acgcgggccgcgucuuaucaggc

SEQ ID NO: 2623595 - RNA, 16 nt, Escherichia coli CFT073
acgcgggguaaaaccc

SEQ ID NO: 2623596 - RNA, 20 nt, Escherichia coli CFT073
acgcgguaaaagcccaucau

SEQ ID NO: 2623597 - RNA, 23 nt, Escherichia coli CFT073
acgcgguacguuuuccagguuau

SEQ ID NO: 2623598 - RNA, 19 nt, Escherichia coli CFT073
acgcgguuacgcaccgguu

SEQ ID NO: 2623599 - RNA, 16 nt, Escherichia coli CFT073
acgcgguuaucccaaa

SEQ ID NO: 2623600 - RNA, 20 nt, Escherichia coli CFT073
acgcgguuaucccaaaucgc

SEQ ID NO: 2623601 - RNA, 21 nt, Escherichia coli CFT073
acgcguaaagcgucgcaucag

SEQ ID NO: 2623602 - RNA, 15 nt, Escherichia coli CFT073
acgcguaaauccagc

SEQ ID NO: 2623603 - RNA, 20 nt, Escherichia coli CFT073
acgcguaccuaacaguucac

SEQ ID NO: 2623604 - RNA, 17 nt, Escherichia coli CFT073
acgcguagcgcaaauca

SEQ ID NO: 2623605 - RNA, 19 nt, Escherichia coli CFT073
acgcguagugucgcaucag

SEQ ID NO: 2623606 - RNA, 20 nt, Escherichia coli CFT073
acgcgucacaccuuguggaa

SEQ ID NO: 2623607 - RNA, 20 nt, Escherichia coli CFT073
acgcgucagcgccgcauccg

SEQ ID NO: 2623608 - RNA, 20 nt, Escherichia coli CFT073
acgcgucagcgucgcaucug

SEQ ID NO: 2623609 - RNA, 16 nt, Escherichia coli CFT073
acgcgucccggaaucc

SEQ ID NO: 2623610 - RNA, 16 nt, Escherichia coli CFT073
acgcgucugaccgucu

SEQ ID NO: 2623611 - RNA, 20 nt, Escherichia coli CFT073
acgcgucugcgucgcaucug

SEQ ID NO: 2623612 - RNA, 12 nt, Escherichia coli CFT073
acgcgucuuauc

SEQ ID NO: 2623613 - RNA, 16 nt, Escherichia coli CFT073
acgcgucuuaucaggc

SEQ ID NO: 2623614 - RNA, 21 nt, Escherichia coli CFT073
acgcgucuuaucaggccuaca

SEQ ID NO: 2623615 - RNA, 19 nt, Escherichia coli CFT073
acgcguggcgucgcaucug

SEQ ID NO: 2623616 - RNA, 20 nt, Escherichia coli CFT073
acgcgugguuacgccgggcg

SEQ ID NO: 2623617 - RNA, 21 nt, Escherichia coli CFT073
acgcgugguugguuucaaaga

SEQ ID NO: 2623618 - RNA, 21 nt, Escherichia coli CFT073
acgcguuaagcgucgcaucag

SEQ ID NO: 2623619 - RNA, 17 nt, Escherichia coli CFT073
acgcguuaauaccugau

SEQ ID NO: 2623620 - RNA, 20 nt, Escherichia coli CFT073
acgcguuagcgucgcaucag

SEQ ID NO: 2623621 - RNA, 19 nt, Escherichia coli CFT073
acgcuaacuucgccaucag

SEQ ID NO: 2623622 - RNA, 17 nt, Escherichia coli CFT073
acgcuaccuaagcgcca

SEQ ID NO: 2623623 - RNA, 21 nt, Escherichia coli CFT073
acgcuacucgccugccacauc

SEQ ID NO: 2623624 - RNA, 19 nt, Escherichia coli CFT073
acgcuaugugcuucaucag

SEQ ID NO: 2623625 - RNA, 14 nt, Escherichia coli CFT073
acgcucaacguuua

SEQ ID NO: 2623626 - RNA, 17 nt, Escherichia coli CFT073
acgcucaagaacggcaa

SEQ ID NO: 2623627 - RNA, 21 nt, Escherichia coli CFT073
acgcucaauauuugcaccuaa

SEQ ID NO: 2623628 - RNA, 16 nt, Escherichia coli CFT073
acgcucacaucugcaa

SEQ ID NO: 2623629 - RNA, 19 nt, Escherichia coli CFT073
acgcucacaucugcaaugc

SEQ ID NO: 2623630 - RNA, 15 nt, Escherichia coli CFT073
acgcucacccaucac

SEQ ID NO: 2623631 - RNA, 14 nt, Escherichia coli CFT073
acgcucagcaacau

SEQ ID NO: 2623632 - RNA, 23 nt, Escherichia coli CFT073
acgcucagcaacauggcgcggca

SEQ ID NO: 2623633 - RNA, 19 nt, Escherichia coli CFT073
acgcucagcaaucgcauau

SEQ ID NO: 2623634 - RNA, 20 nt, Escherichia coli CFT073
acgcucccacggaauagaac

SEQ ID NO: 2623635 - RNA, 14 nt, Escherichia coli CFT073
acgcucccagcagu

SEQ ID NO: 2623636 - RNA, 15 nt, Escherichia coli CFT073
acgcucccuggauca

SEQ ID NO: 2623637 - RNA, 15 nt, Escherichia coli CFT073
acgcuccggguuuuc

SEQ ID NO: 2623638 - RNA, 13 nt, Escherichia coli CFT073
acgcucgccauuu

SEQ ID NO: 2623639 - RNA, 13 nt, Escherichia coli CFT073
acgcucgcugcaa

SEQ ID NO: 2623640 - RNA, 16 nt, Escherichia coli CFT073
acgcucggcgcaaucg

SEQ ID NO: 2623641 - RNA, 16 nt, Escherichia coli CFT073
acgcucucaacgcccu

SEQ ID NO: 2623642 - RNA, 19 nt, Escherichia coli CFT073
acgcucuggugagugacaa

SEQ ID NO: 2623643 - RNA, 21 nt, Escherichia coli CFT073
acgcucuguucugcgccuggu

SEQ ID NO: 2623644 - RNA, 12 nt, Escherichia coli CFT073
acgcucuucacg

SEQ ID NO: 2623645 - RNA, 15 nt, Escherichia coli CFT073
acgcucuuucaccag

SEQ ID NO: 2623646 - RNA, 18 nt, Escherichia coli CFT073
acgcucuuucaccagugg

SEQ ID NO: 2623647 - RNA, 20 nt, Escherichia coli CFT073
acgcucuuucaccaguggga

SEQ ID NO: 2623648 - RNA, 20 nt, Escherichia coli CFT073
acgcugaagucagcacaucc

SEQ ID NO: 2623649 - RNA, 19 nt, Escherichia coli CFT073
acgcugaauacgcaccaca

SEQ ID NO: 2623650 - RNA, 17 nt, Escherichia coli CFT073
acgcugacaaacugcgu

SEQ ID NO: 2623651 - RNA, 19 nt, Escherichia coli CFT073
acgcugacaucaacagaag

SEQ ID NO: 2623652 - RNA, 15 nt, Escherichia coli CFT073
acgcugacgcgucuu

SEQ ID NO: 2623653 - RNA, 19 nt, Escherichia coli CFT073
acgcugacggugccaggua

SEQ ID NO: 2623654 - RNA, 23 nt, Escherichia coli CFT073
acgcugcaaggcucuauacgcau

SEQ ID NO: 2623655 - RNA, 22 nt, Escherichia coli CFT073
acgcugcauggcaacuuuaaua

SEQ ID NO: 2623656 - RNA, 14 nt, Escherichia coli CFT073
acgcugccgucuuc

SEQ ID NO: 2623657 - RNA, 16 nt, Escherichia coli CFT073
acgcugcgcuugcugc

SEQ ID NO: 2623658 - RNA, 14 nt, Escherichia coli CFT073
acgcugcucaaugg

SEQ ID NO: 2623659 - RNA, 14 nt, Escherichia coli CFT073
acgcugcucaggcg

SEQ ID NO: 2623660 - RNA, 23 nt, Escherichia coli CFT073
acgcugcugccggaacaggcauc

SEQ ID NO: 2623661 - RNA, 23 nt, Escherichia coli CFT073
acgcuggacgccgaugcgcuggc

SEQ ID NO: 2623662 - RNA, 19 nt, Escherichia coli CFT073
acgcuggacguggugcgcc

SEQ ID NO: 2623663 - RNA, 14 nt, Escherichia coli CFT073
acgcuggcagauuu

SEQ ID NO: 2623664 - RNA, 18 nt, Escherichia coli CFT073
acgcuggcagcagaacca

SEQ ID NO: 2623665 - RNA, 16 nt, Escherichia coli CFT073
acgcuggcaucaaucg

SEQ ID NO: 2623666 - RNA, 20 nt, Escherichia coli CFT073
acgcuggcaucaaucgcucc

SEQ ID NO: 2623667 - RNA, 15 nt, Escherichia coli CFT073
acgcuggcgcgucuu

SEQ ID NO: 2623668 - RNA, 21 nt, Escherichia coli CFT073
acgcuggcuuuacccuggcgc

SEQ ID NO: 2623669 - RNA, 20 nt, Escherichia coli CFT073
acgcuggggccaucgccgcc

SEQ ID NO: 2623670 - RNA, 16 nt, Escherichia coli CFT073
acgcuggugaaaucag

SEQ ID NO: 2623671 - RNA, 23 nt, Escherichia coli CFT073
acgcugguugcgucuuaucaggc

SEQ ID NO: 2623672 - RNA, 21 nt, Escherichia coli CFT073
acgcuguaagccgccgccauc

SEQ ID NO: 2623673 - RNA, 19 nt, Escherichia coli CFT073
acgcuguaauuaccagcgc

SEQ ID NO: 2623674 - RNA, 13 nt, Escherichia coli CFT073
acgcugucggcaa

SEQ ID NO: 2623675 - RNA, 23 nt, Escherichia coli CFT073
acgcugucggcaagauacugcau

SEQ ID NO: 2623676 - RNA, 17 nt, Escherichia coli CFT073
acgcugucggugccauc

SEQ ID NO: 2623677 - RNA, 18 nt, Escherichia coli CFT073
acgcugucuuuugaucaa

SEQ ID NO: 2623678 - RNA, 19 nt, Escherichia coli CFT073
acgcuguuccggcggcagg

SEQ ID NO: 2623679 - RNA, 21 nt, Escherichia coli CFT073
acgcuguuccggcggcagggu

SEQ ID NO: 2623680 - RNA, 23 nt, Escherichia coli CFT073
acgcuuaaagcguuccacgucac

SEQ ID NO: 2623681 - RNA, 15 nt, Escherichia coli CFT073
acgcuuacucuuuca

SEQ ID NO: 2623682 - RNA, 18 nt, Escherichia coli CFT073
acgcuuaucaggccugca

SEQ ID NO: 2623683 - RNA, 15 nt, Escherichia coli CFT073
acgcuucaaccaguu

SEQ ID NO: 2623684 - RNA, 19 nt, Escherichia coli CFT073
acgcuucaaucugauauuu

SEQ ID NO: 2623685 - RNA, 20 nt, Escherichia coli CFT073
acgcuucaaucugauauuua

SEQ ID NO: 2623686 - RNA, 20 nt, Escherichia coli CFT073
acgcuucaccacgccccacg

SEQ ID NO: 2623687 - RNA, 13 nt, Escherichia coli CFT073
acgcuucagcgua

SEQ ID NO: 2623688 - RNA, 12 nt, Escherichia coli CFT073
acgcuucagcug

SEQ ID NO: 2623689 - RNA, 22 nt, Escherichia coli CFT073
acgcuucaucugccauuguugc

SEQ ID NO: 2623690 - RNA, 20 nt, Escherichia coli CFT073
acgcuucggcaauuucagug

SEQ ID NO: 2623691 - RNA, 15 nt, Escherichia coli CFT073
acgcuucggcgcaua

SEQ ID NO: 2623692 - RNA, 21 nt, Escherichia coli CFT073
acgcuucgguaaauugcccca

SEQ ID NO: 2623693 - RNA, 23 nt, Escherichia coli CFT073
acgcuucugucgcuucacgcagg

SEQ ID NO: 2623694 - RNA, 13 nt, Escherichia coli CFT073
acgcuugccgcgu

SEQ ID NO: 2623695 - RNA, 23 nt, Escherichia coli CFT073
acgcuugccgcgucuuaucaggc

SEQ ID NO: 2623696 - RNA, 14 nt, Escherichia coli CFT073
acgcuuucucacca

SEQ ID NO: 2623697 - RNA, 16 nt, Escherichia coli CFT073
acgcuuucugcgugau

SEQ ID NO: 2623698 - RNA, 16 nt, Escherichia coli CFT073
acgcuuugcugccuuc

SEQ ID NO: 2623699 - RNA, 22 nt, Escherichia coli CFT073
acggaaaaaccccggucguugu

SEQ ID NO: 2623700 - RNA, 14 nt, Escherichia coli CFT073
acggaaaagcaaca

SEQ ID NO: 2623701 - RNA, 17 nt, Escherichia coli CFT073
acggaaagcagauaacc

SEQ ID NO: 2623702 - RNA, 21 nt, Escherichia coli CFT073
acggaaagcagauaacccagc

SEQ ID NO: 2623703 - RNA, 18 nt, Escherichia coli CFT073
acggaaaucauccagcac

SEQ ID NO: 2623704 - RNA, 19 nt, Escherichia coli CFT073
acggaaaucauccagcacg

SEQ ID NO: 2623705 - RNA, 19 nt, Escherichia coli CFT073
acggaagacguucaguuca

SEQ ID NO: 2623706 - RNA, 13 nt, Escherichia coli CFT073
acggaaguuuaau

SEQ ID NO: 2623707 - RNA, 14 nt, Escherichia coli CFT073
acggaauaaaccca

SEQ ID NO: 2623708 - RNA, 13 nt, Escherichia coli CFT073
acggaauaaaccg

SEQ ID NO: 2623709 - RNA, 17 nt, Escherichia coli CFT073
acggaauaucgcuggcc

SEQ ID NO: 2623710 - RNA, 20 nt, Escherichia coli CFT073
acggaaugaggcacgacaca

SEQ ID NO: 2623711 - RNA, 19 nt, Escherichia coli CFT073
acggaauuuaaaugacaau

SEQ ID NO: 2623712 - RNA, 11 nt, Escherichia coli CFT073
acggacaugaa

SEQ ID NO: 2623713 - RNA, 13 nt, Escherichia coli CFT073
acggaccaauaaa

SEQ ID NO: 2623714 - RNA, 20 nt, Escherichia coli CFT073
acggaccaauaaacgccagg

SEQ ID NO: 2623715 - RNA, 15 nt, Escherichia coli CFT073
acggaccgcaugcag

SEQ ID NO: 2623716 - RNA, 15 nt, Escherichia coli CFT073
acggacgcaacugau

SEQ ID NO: 2623717 - RNA, 15 nt, Escherichia coli CFT073
acggacgcgcggcga

SEQ ID NO: 2623718 - RNA, 18 nt, Escherichia coli CFT073
acggagaauccagcccca

SEQ ID NO: 2623719 - RNA, 23 nt, Escherichia coli CFT073
acggagaauccagccccaccagc

SEQ ID NO: 2623720 - RNA, 17 nt, Escherichia coli CFT073
acggagauuaaacgcau

SEQ ID NO: 2623721 - RNA, 18 nt, Escherichia coli CFT073
acggagcugccaggccgc

SEQ ID NO: 2623722 - RNA, 15 nt, Escherichia coli CFT073
acggauagccgcccc

SEQ ID NO: 2623723 - RNA, 21 nt, Escherichia coli CFT073
acggaucacacggccaucacg

SEQ ID NO: 2623724 - RNA, 14 nt, Escherichia coli CFT073
acggauccagaacu

SEQ ID NO: 2623725 - RNA, 15 nt, Escherichia coli CFT073
acggauccagaacug

SEQ ID NO: 2623726 - RNA, 16 nt, Escherichia coli CFT073
acggaucuuccagcgc

SEQ ID NO: 2623727 - RNA, 23 nt, Escherichia coli CFT073
acggaugauuaccggagcugcag

SEQ ID NO: 2623728 - RNA, 14 nt, Escherichia coli CFT073
acggauucaaugca

SEQ ID NO: 2623729 - RNA, 16 nt, Escherichia coli CFT073
acggauucacaauugg

SEQ ID NO: 2623730 - RNA, 22 nt, Escherichia coli CFT073
acggauugcuuguucgaugccu

SEQ ID NO: 2623731 - RNA, 19 nt, Escherichia coli CFT073
acggcaaacacgccgccgg

SEQ ID NO: 2623732 - RNA, 21 nt, Escherichia coli CFT073
acggcaaacaucgggauaucg

SEQ ID NO: 2623733 - RNA, 18 nt, Escherichia coli CFT073
acggcacggaaagcagca

SEQ ID NO: 2623734 - RNA, 16 nt, Escherichia coli CFT073
acggcagaguaaaccg

SEQ ID NO: 2623735 - RNA, 19 nt, Escherichia coli CFT073
acggcagaguaaaccgccu

SEQ ID NO: 2623736 - RNA, 14 nt, Escherichia coli CFT073
acggcagauaaaca

SEQ ID NO: 2623737 - RNA, 19 nt, Escherichia coli CFT073
acggcagcaacagcaguuu

SEQ ID NO: 2623738 - RNA, 23 nt, Escherichia coli CFT073
acggcagcaaggcuauucagcag

SEQ ID NO: 2623739 - RNA, 14 nt, Escherichia coli CFT073
acggcagcaugaua

SEQ ID NO: 2623740 - RNA, 11 nt, Escherichia coli CFT073
acggcaggaga

SEQ ID NO: 2623741 - RNA, 23 nt, Escherichia coli CFT073
acggcaggagagauaccccugcc

SEQ ID NO: 2623742 - RNA, 16 nt, Escherichia coli CFT073
acggcauaagccgucc

SEQ ID NO: 2623743 - RNA, 14 nt, Escherichia coli CFT073
acggcauaauaccg

SEQ ID NO: 2623744 - RNA, 16 nt, Escherichia coli CFT073
acggcaucaaugccgg

SEQ ID NO: 2623745 - RNA, 16 nt, Escherichia coli CFT073
acggcaucgccaacca

SEQ ID NO: 2623746 - RNA, 14 nt, Escherichia coli CFT073
acggcauuaacgaa

SEQ ID NO: 2623747 - RNA, 22 nt, Escherichia coli CFT073
acggcauucgccacugccagca

SEQ ID NO: 2623748 - RNA, 21 nt, Escherichia coli CFT073
acggccaaaucgccauauccg

SEQ ID NO: 2623749 - RNA, 17 nt, Escherichia coli CFT073
acggccacgaugcacag

SEQ ID NO: 2623750 - RNA, 18 nt, Escherichia coli CFT073
acggcccauaacccacac

SEQ ID NO: 2623751 - RNA, 19 nt, Escherichia coli CFT073
acggcccauaacccacacc

SEQ ID NO: 2623752 - RNA, 22 nt, Escherichia coli CFT073
acggcccguacugaacccgggu

SEQ ID NO: 2623753 - RNA, 15 nt, Escherichia coli CFT073
acggcgaaagcguca

SEQ ID NO: 2623754 - RNA, 16 nt, Escherichia coli CFT073
acggcgacggcuggca

SEQ ID NO: 2623755 - RNA, 14 nt, Escherichia coli CFT073
acggcgagccagcg

SEQ ID NO: 2623756 - RNA, 14 nt, Escherichia coli CFT073
acggcgcaccagaa

SEQ ID NO: 2623757 - RNA, 20 nt, Escherichia coli CFT073
acggcgcagacggucuggug

SEQ ID NO: 2623758 - RNA, 22 nt, Escherichia coli CFT073
acggcgcgacuuuaaucaccug

SEQ ID NO: 2623759 - RNA, 16 nt, Escherichia coli CFT073
acggcggaaagggccg

SEQ ID NO: 2623760 - RNA, 22 nt, Escherichia coli CFT073
acggcggaacgccuaacucuug

SEQ ID NO: 2623761 - RNA, 13 nt, Escherichia coli CFT073
acggcgguaaaag

SEQ ID NO: 2623762 - RNA, 19 nt, Escherichia coli CFT073
acggcgguuucgcaaacca

SEQ ID NO: 2623763 - RNA, 15 nt, Escherichia coli CFT073
acggcgucagccaca

SEQ ID NO: 2623764 - RNA, 19 nt, Escherichia coli CFT073
acggcgugccaaauauuca

SEQ ID NO: 2623765 - RNA, 14 nt, Escherichia coli CFT073
acggcgugccgucg

SEQ ID NO: 2623766 - RNA, 18 nt, Escherichia coli CFT073
acggcguucuuuacacag

SEQ ID NO: 2623767 - RNA, 22 nt, Escherichia coli CFT073
acggcguucuuuacacagcgua

SEQ ID NO: 2623768 - RNA, 14 nt, Escherichia coli CFT073
acggcguugcugcc

SEQ ID NO: 2623769 - RNA, 13 nt, Escherichia coli CFT073
acggcguuucacu

SEQ ID NO: 2623770 - RNA, 16 nt, Escherichia coli CFT073
acggcuauaccccacc

SEQ ID NO: 2623771 - RNA, 17 nt, Escherichia coli CFT073
acggcucacccccauca

SEQ ID NO: 2623772 - RNA, 14 nt, Escherichia coli CFT073
acggcucagcucug

SEQ ID NO: 2623773 - RNA, 16 nt, Escherichia coli CFT073
acggcuccccgcccug

SEQ ID NO: 2623774 - RNA, 16 nt, Escherichia coli CFT073
acggcugcuaauauuu

SEQ ID NO: 2623775 - RNA, 15 nt, Escherichia coli CFT073
acggcugggaaauca

SEQ ID NO: 2623776 - RNA, 17 nt, Escherichia coli CFT073
acggcugggaaaucacc

SEQ ID NO: 2623777 - RNA, 18 nt, Escherichia coli CFT073
acggcugucauccagcag

SEQ ID NO: 2623778 - RNA, 20 nt, Escherichia coli CFT073
acggcuguugauguccaguu

SEQ ID NO: 2623779 - RNA, 12 nt, Escherichia coli CFT073
acggcuguugca

SEQ ID NO: 2623780 - RNA, 18 nt, Escherichia coli CFT073
acggcuucgccaaaucgu

SEQ ID NO: 2623781 - RNA, 19 nt, Escherichia coli CFT073
acggcuucgccaaaucguu

SEQ ID NO: 2623782 - RNA, 13 nt, Escherichia coli CFT073
acggcuucucggc

SEQ ID NO: 2623783 - RNA, 14 nt, Escherichia coli CFT073
acggcuugcgcgca

SEQ ID NO: 2623784 - RNA, 14 nt, Escherichia coli CFT073
acggcuuugucauu

SEQ ID NO: 2623785 - RNA, 22 nt, Escherichia coli CFT073
acgggaaaccaacuccaguggc

SEQ ID NO: 2623786 - RNA, 18 nt, Escherichia coli CFT073
acgggaaacucugcuggc

SEQ ID NO: 2623787 - RNA, 13 nt, Escherichia coli CFT073
acgggaacagugc

SEQ ID NO: 2623788 - RNA, 15 nt, Escherichia coli CFT073
acgggcaagccagca

SEQ ID NO: 2623789 - RNA, 14 nt, Escherichia coli CFT073
acgggccugcaggu

SEQ ID NO: 2623790 - RNA, 18 nt, Escherichia coli CFT073
acgggcgauacaccuuca

SEQ ID NO: 2623791 - RNA, 16 nt, Escherichia coli CFT073
acggggaguggugaug

SEQ ID NO: 2623792 - RNA, 19 nt, Escherichia coli CFT073
acggggcugccagcucuca

SEQ ID NO: 2623793 - RNA, 14 nt, Escherichia coli CFT073
acggguaaugacgg

SEQ ID NO: 2623794 - RNA, 15 nt, Escherichia coli CFT073
acgggucaucaaaau

SEQ ID NO: 2623795 - RNA, 19 nt, Escherichia coli CFT073
acgggucaucaaaaucauc

SEQ ID NO: 2623796 - RNA, 21 nt, Escherichia coli CFT073
acgggugauaggguacgaccc

SEQ ID NO: 2623797 - RNA, 22 nt, Escherichia coli CFT073
acggguggcgaauuaacaccac

SEQ ID NO: 2623798 - RNA, 20 nt, Escherichia coli CFT073
acgguaaaaccgugcuucag

SEQ ID NO: 2623799 - RNA, 15 nt, Escherichia coli CFT073
acgguaaaauacagg

SEQ ID NO: 2623800 - RNA, 14 nt, Escherichia coli CFT073
acgguaagccgcaa

SEQ ID NO: 2623801 - RNA, 18 nt, Escherichia coli CFT073
acgguaaguucacgcagg

SEQ ID NO: 2623802 - RNA, 18 nt, Escherichia coli CFT073
acgguaauauuuuguggu

SEQ ID NO: 2623803 - RNA, 15 nt, Escherichia coli CFT073
acgguauaacccagu

SEQ ID NO: 2623804 - RNA, 18 nt, Escherichia coli CFT073
acgguaucaagcccgccg

SEQ ID NO: 2623805 - RNA, 14 nt, Escherichia coli CFT073
acggucacggcugu

SEQ ID NO: 2623806 - RNA, 12 nt, Escherichia coli CFT073
acggucagcgca

SEQ ID NO: 2623807 - RNA, 15 nt, Escherichia coli CFT073
acggucagcgcacca

SEQ ID NO: 2623808 - RNA, 22 nt, Escherichia coli CFT073
acggucaggcuaaagaaaacga

SEQ ID NO: 2623809 - RNA, 20 nt, Escherichia coli CFT073
acggucauucgacgcgcgca

SEQ ID NO: 2623810 - RNA, 22 nt, Escherichia coli CFT073
acgguccgccauuuccagcguc

SEQ ID NO: 2623811 - RNA, 21 nt, Escherichia coli CFT073
acggucgaggcaaccagcacg

SEQ ID NO: 2623812 - RNA, 14 nt, Escherichia coli CFT073
acggucgccguaaa

SEQ ID NO: 2623813 - RNA, 14 nt, Escherichia coli CFT073
acggucgugcgguu

SEQ ID NO: 2623814 - RNA, 14 nt, Escherichia coli CFT073
acggucuaccaguu

SEQ ID NO: 2623815 - RNA, 14 nt, Escherichia coli CFT073
acggugaaaaacca

SEQ ID NO: 2623816 - RNA, 23 nt, Escherichia coli CFT073
acggugaaaaaccaaucucccag

SEQ ID NO: 2623817 - RNA, 16 nt, Escherichia coli CFT073
acggugauacagcaaa

SEQ ID NO: 2623818 - RNA, 16 nt, Escherichia coli CFT073
acggugauucagcgua

SEQ ID NO: 2623819 - RNA, 16 nt, Escherichia coli CFT073
acggugcgaccaaacu

SEQ ID NO: 2623820 - RNA, 12 nt, Escherichia coli CFT073
acggugcgggcu

SEQ ID NO: 2623821 - RNA, 18 nt, Escherichia coli CFT073
acggugcuuuaauuucau

SEQ ID NO: 2623822 - RNA, 14 nt, Escherichia coli CFT073
acgguggccacagc

SEQ ID NO: 2623823 - RNA, 20 nt, Escherichia coli CFT073
acgguggcuggcgcggcgca

SEQ ID NO: 2623824 - RNA, 21 nt, Escherichia coli CFT073
acgguguuaccguaccaggca

SEQ ID NO: 2623825 - RNA, 18 nt, Escherichia coli CFT073
acgguguuauucaucgca

SEQ ID NO: 2623826 - RNA, 21 nt, Escherichia coli CFT073
acgguguugguaaacgcauag

SEQ ID NO: 2623827 - RNA, 16 nt, Escherichia coli CFT073
acgguuauccugcaaa

SEQ ID NO: 2623828 - RNA, 16 nt, Escherichia coli CFT073
acgguuaugaauaacu

SEQ ID NO: 2623829 - RNA, 19 nt, Escherichia coli CFT073
acgguucagggauacaagc

SEQ ID NO: 2623830 - RNA, 22 nt, Escherichia coli CFT073
acgguugacgucccacaguugu

SEQ ID NO: 2623831 - RNA, 16 nt, Escherichia coli CFT073
acgguugcggaaccca

SEQ ID NO: 2623832 - RNA, 20 nt, Escherichia coli CFT073
acgguugcuuuacagccagg

SEQ ID NO: 2623833 - RNA, 22 nt, Escherichia coli CFT073
acgguuucucccgccugcugcg

SEQ ID NO: 2623834 - RNA, 20 nt, Escherichia coli CFT073
acgguuugagagucauccau

SEQ ID NO: 2623835 - RNA, 17 nt, Escherichia coli CFT073
acgguuuuuugaacaga

SEQ ID NO: 2623836 - RNA, 14 nt, Escherichia coli CFT073
acguaaaugccagc

SEQ ID NO: 2623837 - RNA, 16 nt, Escherichia coli CFT073
acguaaaugccagccc

SEQ ID NO: 2623838 - RNA, 18 nt, Escherichia coli CFT073
acguaaaugccagcccau

SEQ ID NO: 2623839 - RNA, 21 nt, Escherichia coli CFT073
acguaaauuuauuccgagcag

SEQ ID NO: 2623840 - RNA, 14 nt, Escherichia coli CFT073
acguaacagagcau

SEQ ID NO: 2623841 - RNA, 21 nt, Escherichia coli CFT073
acguaauaaaaucuauuauua

SEQ ID NO: 2623842 - RNA, 14 nt, Escherichia coli CFT073
acguaccaacugau

SEQ ID NO: 2623843 - RNA, 14 nt, Escherichia coli CFT073
acguaccggcgcgu

SEQ ID NO: 2623844 - RNA, 15 nt, Escherichia coli CFT073
acguaccggcgcgua

SEQ ID NO: 2623845 - RNA, 19 nt, Escherichia coli CFT073
acguaccgggcuuccggca

SEQ ID NO: 2623846 - RNA, 19 nt, Escherichia coli CFT073
acguacggcuucagacacc

SEQ ID NO: 2623847 - RNA, 20 nt, Escherichia coli CFT073
acguagcaagcaucccgccg

SEQ ID NO: 2623848 - RNA, 13 nt, Escherichia coli CFT073
acguagccacggc

SEQ ID NO: 2623849 - RNA, 15 nt, Escherichia coli CFT073
acguagcgcaacagg

SEQ ID NO: 2623850 - RNA, 17 nt, Escherichia coli CFT073
acguagcggaaaucaca

SEQ ID NO: 2623851 - RNA, 15 nt, Escherichia coli CFT073
acguagcuauauuuu

SEQ ID NO: 2623852 - RNA, 13 nt, Escherichia coli CFT073
acguaggccggau

SEQ ID NO: 2623853 - RNA, 18 nt, Escherichia coli CFT073
acguaggccucagguuga

SEQ ID NO: 2623854 - RNA, 19 nt, Escherichia coli CFT073
acguaguguaaaugcaaau

SEQ ID NO: 2623855 - RNA, 11 nt, Escherichia coli CFT073
acguaucaggg

SEQ ID NO: 2623856 - RNA, 16 nt, Escherichia coli CFT073
acgucagcugccaguu

SEQ ID NO: 2623857 - RNA, 15 nt, Escherichia coli CFT073
acgucaggccgccac

SEQ ID NO: 2623858 - RNA, 22 nt, Escherichia coli CFT073
acgucaguacaaacauccaucu

SEQ ID NO: 2623859 - RNA, 22 nt, Escherichia coli CFT073
acgucaguguguuauugccugg

SEQ ID NO: 2623860 - RNA, 17 nt, Escherichia coli CFT073
acgucauauacccugcc

SEQ ID NO: 2623861 - RNA, 15 nt, Escherichia coli CFT073
acgucauauucgcca

SEQ ID NO: 2623862 - RNA, 19 nt, Escherichia coli CFT073
acgucauauucgccaucag

SEQ ID NO: 2623863 - RNA, 21 nt, Escherichia coli CFT073
acgucauugcaaucuccuguu

SEQ ID NO: 2623864 - RNA, 16 nt, Escherichia coli CFT073
acguccaaucagcaca

SEQ ID NO: 2623865 - RNA, 11 nt, Escherichia coli CFT073
acgucccacag

SEQ ID NO: 2623866 - RNA, 15 nt, Escherichia coli CFT073
acgucccaugaugcg

SEQ ID NO: 2623867 - RNA, 19 nt, Escherichia coli CFT073
acguccggcaauauagaua

SEQ ID NO: 2623868 - RNA, 13 nt, Escherichia coli CFT073
acguccggucggg

SEQ ID NO: 2623869 - RNA, 20 nt, Escherichia coli CFT073
acgucgcaacuccaccagca

SEQ ID NO: 2623870 - RNA, 16 nt, Escherichia coli CFT073
acgucgcaagacgaaa

SEQ ID NO: 2623871 - RNA, 14 nt, Escherichia coli CFT073
acgucgccagaaau

SEQ ID NO: 2623872 - RNA, 13 nt, Escherichia coli CFT073
acgucgcccaccg

SEQ ID NO: 2623873 - RNA, 14 nt, Escherichia coli CFT073
acgucgcguuaauc

SEQ ID NO: 2623874 - RNA, 14 nt, Escherichia coli CFT073
acgucgcuuuauag

SEQ ID NO: 2623875 - RNA, 15 nt, Escherichia coli CFT073
acgucgucaggcaau

SEQ ID NO: 2623876 - RNA, 22 nt, Escherichia coli CFT073
acgucgucgccaaugcgcaaua

SEQ ID NO: 2623877 - RNA, 20 nt, Escherichia coli CFT073
acgucguuccccaucaccug

SEQ ID NO: 2623878 - RNA, 17 nt, Escherichia coli CFT073
acgucguucgggccgaa

SEQ ID NO: 2623879 - RNA, 14 nt, Escherichia coli CFT073
acgucuacaguacg

SEQ ID NO: 2623880 - RNA, 13 nt, Escherichia coli CFT073
acgucucaaucac

SEQ ID NO: 2623881 - RNA, 16 nt, Escherichia coli CFT073
acgucucaaucaccac

SEQ ID NO: 2623882 - RNA, 17 nt, Escherichia coli CFT073
acgucucaaucaccacc

SEQ ID NO: 2623883 - RNA, 12 nt, Escherichia coli CFT073
acgucugcgccu

SEQ ID NO: 2623884 - RNA, 23 nt, Escherichia coli CFT073
acgucuucccgagacaucccuuu

SEQ ID NO: 2623885 - RNA, 12 nt, Escherichia coli CFT073
acgucuucgcca

SEQ ID NO: 2623886 - RNA, 22 nt, Escherichia coli CFT073
acgugaaaucaacguuaccaag

SEQ ID NO: 2623887 - RNA, 19 nt, Escherichia coli CFT073
acgugaaaugucauuacga

SEQ ID NO: 2623888 - RNA, 18 nt, Escherichia coli CFT073
acgugaacgcgacauauc

SEQ ID NO: 2623889 - RNA, 13 nt, Escherichia coli CFT073
acgugaauuuuua

SEQ ID NO: 2623890 - RNA, 14 nt, Escherichia coli CFT073
acgugacauucuga

SEQ ID NO: 2623891 - RNA, 12 nt, Escherichia coli CFT073
acgugaucgaac

SEQ ID NO: 2623892 - RNA, 22 nt, Escherichia coli CFT073
acgugaucgcaauucuucauuc

SEQ ID NO: 2623893 - RNA, 23 nt, Escherichia coli CFT073
acgugaucgucuucaaccgcagu

SEQ ID NO: 2623894 - RNA, 19 nt, Escherichia coli CFT073
acgugauuccagacggguc

SEQ ID NO: 2623895 - RNA, 17 nt, Escherichia coli CFT073
acgugauuguucaacga

SEQ ID NO: 2623896 - RNA, 15 nt, Escherichia coli CFT073
acgugcaaaaucaaa

SEQ ID NO: 2623897 - RNA, 18 nt, Escherichia coli CFT073
acgugcaaaaucaaacag

SEQ ID NO: 2623898 - RNA, 20 nt, Escherichia coli CFT073
acgugcaaaaucaaacagaa

SEQ ID NO: 2623899 - RNA, 17 nt, Escherichia coli CFT073
acgugcaccgucacuuc

SEQ ID NO: 2623900 - RNA, 19 nt, Escherichia coli CFT073
acgugcaguagcagcagga

SEQ ID NO: 2623901 - RNA, 18 nt, Escherichia coli CFT073
acgugcucugcgccgccu

SEQ ID NO: 2623902 - RNA, 22 nt, Escherichia coli CFT073
acgugcugcauuuggacaccau

SEQ ID NO: 2623903 - RNA, 19 nt, Escherichia coli CFT073
acguggcggagugccgcgu

SEQ ID NO: 2623904 - RNA, 13 nt, Escherichia coli CFT073
acgugggcgacgg

SEQ ID NO: 2623905 - RNA, 19 nt, Escherichia coli CFT073
acguggucgaauccccuca

SEQ ID NO: 2623906 - RNA, 17 nt, Escherichia coli CFT073
acgugguuuaccaccag

SEQ ID NO: 2623907 - RNA, 15 nt, Escherichia coli CFT073
acguguacccagcag

SEQ ID NO: 2623908 - RNA, 17 nt, Escherichia coli CFT073
acguguaggccugauaa

SEQ ID NO: 2623909 - RNA, 17 nt, Escherichia coli CFT073
acguguaugcauaacca

SEQ ID NO: 2623910 - RNA, 18 nt, Escherichia coli CFT073
acgugucaacgcuucagc

SEQ ID NO: 2623911 - RNA, 16 nt, Escherichia coli CFT073
acguguugcugcaugu

SEQ ID NO: 2623912 - RNA, 13 nt, Escherichia coli CFT073
acguguuucagaa

SEQ ID NO: 2623913 - RNA, 22 nt, Escherichia coli CFT073
acguuaacaauguugucgccag

SEQ ID NO: 2623914 - RNA, 16 nt, Escherichia coli CFT073
acguuaaguucauuuu

SEQ ID NO: 2623915 - RNA, 16 nt, Escherichia coli CFT073
acguuaauacucacga

SEQ ID NO: 2623916 - RNA, 15 nt, Escherichia coli CFT073
acguuacaaccacau

SEQ ID NO: 2623917 - RNA, 16 nt, Escherichia coli CFT073
acguuacaaccacaua

SEQ ID NO: 2623918 - RNA, 19 nt, Escherichia coli CFT073
acguuacccaaucgcccca

SEQ ID NO: 2623919 - RNA, 15 nt, Escherichia coli CFT073
acguuacccagcacg

SEQ ID NO: 2623920 - RNA, 20 nt, Escherichia coli CFT073
acguuacuuaacacccccug

SEQ ID NO: 2623921 - RNA, 22 nt, Escherichia coli CFT073
acguuaguucgcguagcugcug

SEQ ID NO: 2623922 - RNA, 16 nt, Escherichia coli CFT073
acguuaucugaccguu

SEQ ID NO: 2623923 - RNA, 16 nt, Escherichia coli CFT073
acguuaugcuuacuga

SEQ ID NO: 2623924 - RNA, 20 nt, Escherichia coli CFT073
acguuaugcuuacugagaua

SEQ ID NO: 2623925 - RNA, 13 nt, Escherichia coli CFT073
acguuauuuugcu

SEQ ID NO: 2623926 - RNA, 12 nt, Escherichia coli CFT073
acguucacuuuu

SEQ ID NO: 2623927 - RNA, 22 nt, Escherichia coli CFT073
acguucagcacguuaaguucau

SEQ ID NO: 2623928 - RNA, 16 nt, Escherichia coli CFT073
acguucagccauacgu

SEQ ID NO: 2623929 - RNA, 14 nt, Escherichia coli CFT073
acguucagccgcuu

SEQ ID NO: 2623930 - RNA, 13 nt, Escherichia coli CFT073
acguucaguucac

SEQ ID NO: 2623931 - RNA, 23 nt, Escherichia coli CFT073
acguucccuucuugcgcaaaccu

SEQ ID NO: 2623932 - RNA, 16 nt, Escherichia coli CFT073
acguucgacugcgccu

SEQ ID NO: 2623933 - RNA, 14 nt, Escherichia coli CFT073
acguucgcccacuu

SEQ ID NO: 2623934 - RNA, 20 nt, Escherichia coli CFT073
acguucggcaaagcgcugaa

SEQ ID NO: 2623935 - RNA, 22 nt, Escherichia coli CFT073
acguucggugauauacgccacu

SEQ ID NO: 2623936 - RNA, 16 nt, Escherichia coli CFT073
acguucgugaauaugu

SEQ ID NO: 2623937 - RNA, 24 nt, Escherichia coli CFT073
acguucucugauacucaacucaca

SEQ ID NO: 2623938 - RNA, 21 nt, Escherichia coli CFT073
acguucuucgcugacaguacc

SEQ ID NO: 2623939 - RNA, 14 nt, Escherichia coli CFT073
acguugcaaauauu

SEQ ID NO: 2623940 - RNA, 19 nt, Escherichia coli CFT073
acguugccagcaacuguaa

SEQ ID NO: 2623941 - RNA, 13 nt, Escherichia coli CFT073
acguugccaguac

SEQ ID NO: 2623942 - RNA, 22 nt, Escherichia coli CFT073
acguugccguaagcaacgccaa

SEQ ID NO: 2623943 - RNA, 20 nt, Escherichia coli CFT073
acguugcgacaaaccaggua

SEQ ID NO: 2623944 - RNA, 18 nt, Escherichia coli CFT073
acguugcucaaggguuuc

SEQ ID NO: 2623945 - RNA, 17 nt, Escherichia coli CFT073
acguuggcagugccauc

SEQ ID NO: 2623946 - RNA, 19 nt, Escherichia coli CFT073
acguuggcagugccaucaa

SEQ ID NO: 2623947 - RNA, 15 nt, Escherichia coli CFT073
acguuggcgauugca

SEQ ID NO: 2623948 - RNA, 23 nt, Escherichia coli CFT073
acguugugauguacuaaccaugc

SEQ ID NO: 2623949 - RNA, 15 nt, Escherichia coli CFT073
acguugugcccuucc

SEQ ID NO: 2623950 - RNA, 15 nt, Escherichia coli CFT073
acguuuaauauuacc

SEQ ID NO: 2623951 - RNA, 14 nt, Escherichia coli CFT073
acguuuaauugcag

SEQ ID NO: 2623952 - RNA, 15 nt, Escherichia coli CFT073
acguuuaccgcaucc

SEQ ID NO: 2623953 - RNA, 21 nt, Escherichia coli CFT073
acguuuaccgcccaugccagu

SEQ ID NO: 2623954 - RNA, 15 nt, Escherichia coli CFT073
acguuuacuucgcuu

SEQ ID NO: 2623955 - RNA, 18 nt, Escherichia coli CFT073
acguuucacggucggcca

SEQ ID NO: 2623956 - RNA, 21 nt, Escherichia coli CFT073
acguuucacggucggccagua

SEQ ID NO: 2623957 - RNA, 14 nt, Escherichia coli CFT073
acguuucagccacg

SEQ ID NO: 2623958 - RNA, 15 nt, Escherichia coli CFT073
acguuucgccagccu

SEQ ID NO: 2623959 - RNA, 17 nt, Escherichia coli CFT073
acguuucuuccacacca

SEQ ID NO: 2623960 - RNA, 13 nt, Escherichia coli CFT073
acguuuggcacgc

SEQ ID NO: 2623961 - RNA, 17 nt, Escherichia coli CFT073
acguuuggucagaucag

SEQ ID NO: 2623962 - RNA, 20 nt, Escherichia coli CFT073
acguuuguaacccaccaugc

SEQ ID NO: 2623963 - RNA, 22 nt, Escherichia coli CFT073
acguuuuaaugauuuccaggau

SEQ ID NO: 2623964 - RNA, 15 nt, Escherichia coli CFT073
acguuuucucaaguc

SEQ ID NO: 2623965 - RNA, 22 nt, Escherichia coli CFT073
acuaaacguagcggaaaucaca

SEQ ID NO: 2623966 - RNA, 14 nt, Escherichia coli CFT073
acuaaauaugaaaa

SEQ ID NO: 2623967 - RNA, 13 nt, Escherichia coli CFT073
acuaacagcacau

SEQ ID NO: 2623968 - RNA, 14 nt, Escherichia coli CFT073
acuaaccagacgcc

SEQ ID NO: 2623969 - RNA, 17 nt, Escherichia coli CFT073
acuaaccaugcgcccau

SEQ ID NO: 2623970 - RNA, 18 nt, Escherichia coli CFT073
acuaacgguagccugcaa

SEQ ID NO: 2623971 - RNA, 13 nt, Escherichia coli CFT073
acuaacuucugau

SEQ ID NO: 2623972 - RNA, 14 nt, Escherichia coli CFT073
acuaagauaaucca

SEQ ID NO: 2623973 - RNA, 16 nt, Escherichia coli CFT073
acuaauagcaaaauau

SEQ ID NO: 2623974 - RNA, 18 nt, Escherichia coli CFT073
acuaaucacuucaucaac

SEQ ID NO: 2623975 - RNA, 14 nt, Escherichia coli CFT073
acuaauuaagacug

SEQ ID NO: 2623976 - RNA, 17 nt, Escherichia coli CFT073
acuaauuaauaauauaa

SEQ ID NO: 2623977 - RNA, 16 nt, Escherichia coli CFT073
acuaauugcaaacaga

SEQ ID NO: 2623978 - RNA, 17 nt, Escherichia coli CFT073
acuacaaaaaaagccac

SEQ ID NO: 2623979 - RNA, 14 nt, Escherichia coli CFT073
acuacaaacaaugc

SEQ ID NO: 2623980 - RNA, 22 nt, Escherichia coli CFT073
acuacagaugaaauaccacuca

SEQ ID NO: 2623981 - RNA, 23 nt, Escherichia coli CFT073
acuacagcggaacuuuuuucauc

SEQ ID NO: 2623982 - RNA, 19 nt, Escherichia coli CFT073
acuaccacguaacgacuga

SEQ ID NO: 2623983 - RNA, 22 nt, Escherichia coli CFT073
acuacccgcgccaauaacagaa

SEQ ID NO: 2623984 - RNA, 23 nt, Escherichia coli CFT073
acuacccgcgccaauaacagaau

SEQ ID NO: 2623985 - RNA, 16 nt, Escherichia coli CFT073
acuaccgccgagcaca

SEQ ID NO: 2623986 - RNA, 18 nt, Escherichia coli CFT073
acuaccgccgagcacaaa

SEQ ID NO: 2623987 - RNA, 16 nt, Escherichia coli CFT073
acuaccgcguuuuuua

SEQ ID NO: 2623988 - RNA, 18 nt, Escherichia coli CFT073
acuaccguaaauaaugac

SEQ ID NO: 2623989 - RNA, 22 nt, Escherichia coli CFT073
acuaccguuuuacucaaaaugc

SEQ ID NO: 2623990 - RNA, 23 nt, Escherichia coli CFT073
acuacgcagacggcuuucuucag

SEQ ID NO: 2623991 - RNA, 14 nt, Escherichia coli CFT073
acuacgcccgcaau

SEQ ID NO: 2623992 - RNA, 15 nt, Escherichia coli CFT073
acuacgcgccgccag

SEQ ID NO: 2623993 - RNA, 13 nt, Escherichia coli CFT073
acuacggcucagc

SEQ ID NO: 2623994 - RNA, 15 nt, Escherichia coli CFT073
acuacggcucagcaa

SEQ ID NO: 2623995 - RNA, 19 nt, Escherichia coli CFT073
acuacggcuuuuuucauuu

SEQ ID NO: 2623996 - RNA, 17 nt, Escherichia coli CFT073
acuacguagucuuuacc

SEQ ID NO: 2623997 - RNA, 21 nt, Escherichia coli CFT073
acuacgugaucgucuucaacc

SEQ ID NO: 2623998 - RNA, 20 nt, Escherichia coli CFT073
acuacugccagauucuccag

SEQ ID NO: 2623999 - RNA, 17 nt, Escherichia coli CFT073
acuacuggagacagauu

SEQ ID NO: 2624000 - RNA, 20 nt, Escherichia coli CFT073
acuacuggagacagauuuau

SEQ ID NO: 2624001 - RNA, 22 nt, Escherichia coli CFT073
acuagauuaccagagaaaagau

SEQ ID NO: 2624002 - RNA, 16 nt, Escherichia coli CFT073
acuagcagcauuucaa

SEQ ID NO: 2624003 - RNA, 14 nt, Escherichia coli CFT073
acuagugauaacca

SEQ ID NO: 2624004 - RNA, 19 nt, Escherichia coli CFT073
acuauacuccugauggccu

SEQ ID NO: 2624005 - RNA, 18 nt, Escherichia coli CFT073
acuauauaaaccuucugu

SEQ ID NO: 2624006 - RNA, 15 nt, Escherichia coli CFT073
acuauaucucaauca

SEQ ID NO: 2624007 - RNA, 15 nt, Escherichia coli CFT073
acuaucaaccacggc

SEQ ID NO: 2624008 - RNA, 20 nt, Escherichia coli CFT073
acuaucacucccucauuuuc

SEQ ID NO: 2624009 - RNA, 15 nt, Escherichia coli CFT073
acuaucaggucuuuc

SEQ ID NO: 2624010 - RNA, 14 nt, Escherichia coli CFT073
acuauccacuggaa

SEQ ID NO: 2624011 - RNA, 15 nt, Escherichia coli CFT073
acuauccacuggaau

SEQ ID NO: 2624012 - RNA, 16 nt, Escherichia coli CFT073
acuaucccaucagcgg

SEQ ID NO: 2624013 - RNA, 17 nt, Escherichia coli CFT073
acuauccgccauaucac

SEQ ID NO: 2624014 - RNA, 21 nt, Escherichia coli CFT073
acuaucgguucugugguuggu

SEQ ID NO: 2624015 - RNA, 14 nt, Escherichia coli CFT073
acuauuaauauaua

SEQ ID NO: 2624016 - RNA, 16 nt, Escherichia coli CFT073
acuauuaauauauauu

SEQ ID NO: 2624017 - RNA, 22 nt, Escherichia coli CFT073
acuauugaagcccaaaaacuac

SEQ ID NO: 2624018 - RNA, 18 nt, Escherichia coli CFT073
acuauuguauaccaaucg

SEQ ID NO: 2624019 - RNA, 20 nt, Escherichia coli CFT073
acuauuguauaccaaucguc

SEQ ID NO: 2624020 - RNA, 16 nt, Escherichia coli CFT073
acuauuuacagauuuc

SEQ ID NO: 2624021 - RNA, 16 nt, Escherichia coli CFT073
acuauuuacuugccug

SEQ ID NO: 2624022 - RNA, 16 nt, Escherichia coli CFT073
acuauuucaucagaag

SEQ ID NO: 2624023 - RNA, 13 nt, Escherichia coli CFT073
acucaaaaaaaau

SEQ ID NO: 2624024 - RNA, 17 nt, Escherichia coli CFT073
acucaaaaauaaucauc

SEQ ID NO: 2624025 - RNA, 13 nt, Escherichia coli CFT073
acucaaaucacgc

SEQ ID NO: 2624026 - RNA, 13 nt, Escherichia coli CFT073
acucaaccgccac

SEQ ID NO: 2624027 - RNA, 19 nt, Escherichia coli CFT073
acucaacuuauugaucauc

SEQ ID NO: 2624028 - RNA, 20 nt, Escherichia coli CFT073
acucaacuuauugaucaucc

SEQ ID NO: 2624029 - RNA, 16 nt, Escherichia coli CFT073
acucaagccguuaauu

SEQ ID NO: 2624030 - RNA, 17 nt, Escherichia coli CFT073
acucaagccguuaauuc

SEQ ID NO: 2624031 - RNA, 23 nt, Escherichia coli CFT073
acucaagccguuaauucuuaaca

SEQ ID NO: 2624032 - RNA, 20 nt, Escherichia coli CFT073
acucaagcuaaaccaauaaa

SEQ ID NO: 2624033 - RNA, 16 nt, Escherichia coli CFT073
acucaaucgccaaaaa

SEQ ID NO: 2624034 - RNA, 12 nt, Escherichia coli CFT073
acucacagggcu

SEQ ID NO: 2624035 - RNA, 16 nt, Escherichia coli CFT073
acucacaucaacaacg

SEQ ID NO: 2624036 - RNA, 22 nt, Escherichia coli CFT073
acucacauccagcggcgagcuu

SEQ ID NO: 2624037 - RNA, 14 nt, Escherichia coli CFT073
acucacccgccagc

SEQ ID NO: 2624038 - RNA, 16 nt, Escherichia coli CFT073
acucacccgccagcgc

SEQ ID NO: 2624039 - RNA, 19 nt, Escherichia coli CFT073
acucaccgaugaucgccau

SEQ ID NO: 2624040 - RNA, 13 nt, Escherichia coli CFT073
acucaccgcucac

SEQ ID NO: 2624041 - RNA, 17 nt, Escherichia coli CFT073
acucaccgcucaccuga

SEQ ID NO: 2624042 - RNA, 15 nt, Escherichia coli CFT073
acucaccugauuacc

SEQ ID NO: 2624043 - RNA, 20 nt, Escherichia coli CFT073
acucaccuuuuuucuuauua

SEQ ID NO: 2624044 - RNA, 18 nt, Escherichia coli CFT073
acucacgaaucgccucac

SEQ ID NO: 2624045 - RNA, 20 nt, Escherichia coli CFT073
acucacgaaucgccucacga

SEQ ID NO: 2624046 - RNA, 21 nt, Escherichia coli CFT073
acucacgaaucgccucacgac

SEQ ID NO: 2624047 - RNA, 20 nt, Escherichia coli CFT073
acucacgauuguuaaucaca

SEQ ID NO: 2624048 - RNA, 13 nt, Escherichia coli CFT073
acucacuaccagu

SEQ ID NO: 2624049 - RNA, 22 nt, Escherichia coli CFT073
acucacuaccagugccagaaca

SEQ ID NO: 2624050 - RNA, 15 nt, Escherichia coli CFT073
acucacugaugccgu

SEQ ID NO: 2624051 - RNA, 17 nt, Escherichia coli CFT073
acucagcgccugcugca

SEQ ID NO: 2624052 - RNA, 20 nt, Escherichia coli CFT073
acucagcgggucauucuucg

SEQ ID NO: 2624053 - RNA, 21 nt, Escherichia coli CFT073
acucagcgugccaucaaaguu

SEQ ID NO: 2624054 - RNA, 15 nt, Escherichia coli CFT073
acucaggaugagaaa

SEQ ID NO: 2624055 - RNA, 16 nt, Escherichia coli CFT073
acucagguggcgguau

SEQ ID NO: 2624056 - RNA, 14 nt, Escherichia coli CFT073
acucaguccgguau

SEQ ID NO: 2624057 - RNA, 18 nt, Escherichia coli CFT073
acucaguccgguauucua

SEQ ID NO: 2624058 - RNA, 13 nt, Escherichia coli CFT073
acucauaaaaaua

SEQ ID NO: 2624059 - RNA, 14 nt, Escherichia coli CFT073
acucauaaaaauau

SEQ ID NO: 2624060 - RNA, 15 nt, Escherichia coli CFT073
acucauaaaaauaua

SEQ ID NO: 2624061 - RNA, 18 nt, Escherichia coli CFT073
acucauaaguuucccagc

SEQ ID NO: 2624062 - RNA, 22 nt, Escherichia coli CFT073
acucauaauccgccuuuuuaau

SEQ ID NO: 2624063 - RNA, 18 nt, Escherichia coli CFT073
acucauacaucgcgcuua

SEQ ID NO: 2624064 - RNA, 16 nt, Escherichia coli CFT073
acucauacugagcaag

SEQ ID NO: 2624065 - RNA, 20 nt, Escherichia coli CFT073
acucaucaaaaaaacucauu

SEQ ID NO: 2624066 - RNA, 12 nt, Escherichia coli CFT073
acucauccccug

SEQ ID NO: 2624067 - RNA, 14 nt, Escherichia coli CFT073
acucaucgccgcca

SEQ ID NO: 2624068 - RNA, 13 nt, Escherichia coli CFT073
acucaucgucaaa

SEQ ID NO: 2624069 - RNA, 17 nt, Escherichia coli CFT073
acucaugcccacgcaaa

SEQ ID NO: 2624070 - RNA, 15 nt, Escherichia coli CFT073
acucauggaaucuuu

SEQ ID NO: 2624071 - RNA, 20 nt, Escherichia coli CFT073
acucauggaaucuuuaauga

SEQ ID NO: 2624072 - RNA, 22 nt, Escherichia coli CFT073
acucauuaaucaauuuuuugau

SEQ ID NO: 2624073 - RNA, 14 nt, Escherichia coli CFT073
acucauuccccgga

SEQ ID NO: 2624074 - RNA, 19 nt, Escherichia coli CFT073
acucauugauuuucaaauc

SEQ ID NO: 2624075 - RNA, 22 nt, Escherichia coli CFT073
acucauuguuaucagcaauaaa

SEQ ID NO: 2624076 - RNA, 15 nt, Escherichia coli CFT073
acucauuuuuucggu

SEQ ID NO: 2624077 - RNA, 21 nt, Escherichia coli CFT073
acuccaacucuuuuaccaccg

SEQ ID NO: 2624078 - RNA, 14 nt, Escherichia coli CFT073
acuccaccagcacc

SEQ ID NO: 2624079 - RNA, 12 nt, Escherichia coli CFT073
acuccacccgga

SEQ ID NO: 2624080 - RNA, 17 nt, Escherichia coli CFT073
acuccacccggagcaag

SEQ ID NO: 2624081 - RNA, 22 nt, Escherichia coli CFT073
acuccacgcuaugugcuucauc

SEQ ID NO: 2624082 - RNA, 14 nt, Escherichia coli CFT073
acuccacugcgcau

SEQ ID NO: 2624083 - RNA, 12 nt, Escherichia coli CFT073
acuccagaauac

SEQ ID NO: 2624084 - RNA, 21 nt, Escherichia coli CFT073
acuccagcccuuucgacgcgu

SEQ ID NO: 2624085 - RNA, 20 nt, Escherichia coli CFT073
acuccagcuuaacaucccca

SEQ ID NO: 2624086 - RNA, 14 nt, Escherichia coli CFT073
acuccaguagcgcc

SEQ ID NO: 2624087 - RNA, 18 nt, Escherichia coli CFT073
acuccagucuuuuaaccg

SEQ ID NO: 2624088 - RNA, 18 nt, Escherichia coli CFT073
acuccaguggcgcaucag

SEQ ID NO: 2624089 - RNA, 15 nt, Escherichia coli CFT073
acuccauugucuuuu

SEQ ID NO: 2624090 - RNA, 16 nt, Escherichia coli CFT073
acuccauugucuuuuc

SEQ ID NO: 2624091 - RNA, 15 nt, Escherichia coli CFT073
acucccaccgcguga

SEQ ID NO: 2624092 - RNA, 19 nt, Escherichia coli CFT073
acuccccgcaaaccagaca

SEQ ID NO: 2624093 - RNA, 17 nt, Escherichia coli CFT073
acuccccgcaacaguga

SEQ ID NO: 2624094 - RNA, 20 nt, Escherichia coli CFT073
acuccccgcauuuacucuca

SEQ ID NO: 2624095 - RNA, 14 nt, Escherichia coli CFT073
acuccccuuuaaau

SEQ ID NO: 2624096 - RNA, 14 nt, Escherichia coli CFT073
acucccgcgccgca

SEQ ID NO: 2624097 - RNA, 22 nt, Escherichia coli CFT073
acucccgcgcggguaauuaccc

SEQ ID NO: 2624098 - RNA, 13 nt, Escherichia coli CFT073
acucccugcugau

SEQ ID NO: 2624099 - RNA, 19 nt, Escherichia coli CFT073
acucccuguuccuguauuu

SEQ ID NO: 2624100 - RNA, 20 nt, Escherichia coli CFT073
acucccuguuccuguauuug

SEQ ID NO: 2624101 - RNA, 17 nt, Escherichia coli CFT073
acucccuugccugcagg

SEQ ID NO: 2624102 - RNA, 20 nt, Escherichia coli CFT073
acucccuugccugcaggaaa

SEQ ID NO: 2624103 - RNA, 20 nt, Escherichia coli CFT073
acucccuuucugccacgcca

SEQ ID NO: 2624104 - RNA, 14 nt, Escherichia coli CFT073
acuccgauuaccgg

SEQ ID NO: 2624105 - RNA, 22 nt, Escherichia coli CFT073
acuccgcauuuguaggcaggau

SEQ ID NO: 2624106 - RNA, 16 nt, Escherichia coli CFT073
acuccgccccggcaau

SEQ ID NO: 2624107 - RNA, 19 nt, Escherichia coli CFT073
acuccgccccggcaauaaa

SEQ ID NO: 2624108 - RNA, 19 nt, Escherichia coli CFT073
acuccgcgaccacacucaa

SEQ ID NO: 2624109 - RNA, 19 nt, Escherichia coli CFT073
acuccgcuuaccauccaca

SEQ ID NO: 2624110 - RNA, 21 nt, Escherichia coli CFT073
acuccgcuuaccauccacacc

SEQ ID NO: 2624111 - RNA, 13 nt, Escherichia coli CFT073
acuccggccugca

SEQ ID NO: 2624112 - RNA, 21 nt, Escherichia coli CFT073
acuccgguaauaucgcgcaga

SEQ ID NO: 2624113 - RNA, 19 nt, Escherichia coli CFT073
acuccugacuugccaggua

SEQ ID NO: 2624114 - RNA, 20 nt, Escherichia coli CFT073
acuccugcgucggaacaucg

SEQ ID NO: 2624115 - RNA, 14 nt, Escherichia coli CFT073
acucgaaaauauug

SEQ ID NO: 2624116 - RNA, 23 nt, Escherichia coli CFT073
acucgauaccagauuaauuauug

SEQ ID NO: 2624117 - RNA, 18 nt, Escherichia coli CFT073
acucgaugacaacaccau

SEQ ID NO: 2624118 - RNA, 17 nt, Escherichia coli CFT073
acucgcagcuuuguuga

SEQ ID NO: 2624119 - RNA, 22 nt, Escherichia coli CFT073
acucgccgaaccaaacgaggua

SEQ ID NO: 2624120 - RNA, 16 nt, Escherichia coli CFT073
acucgccgcaaaaccc

SEQ ID NO: 2624121 - RNA, 18 nt, Escherichia coli CFT073
acucgccgcaaaacccag

SEQ ID NO: 2624122 - RNA, 20 nt, Escherichia coli CFT073
acucgccgcaaaacccaggc

SEQ ID NO: 2624123 - RNA, 17 nt, Escherichia coli CFT073
acucgccuauacgcacg

SEQ ID NO: 2624124 - RNA, 23 nt, Escherichia coli CFT073
acucgccuuucacacgcucaaua

SEQ ID NO: 2624125 - RNA, 15 nt, Escherichia coli CFT073
acucgcgaaucgccg

SEQ ID NO: 2624126 - RNA, 16 nt, Escherichia coli CFT073
acucgcgaaucgccgu

SEQ ID NO: 2624127 - RNA, 18 nt, Escherichia coli CFT073
acucgcguucuguugccg

SEQ ID NO: 2624128 - RNA, 13 nt, Escherichia coli CFT073
acucgcuaaccac

SEQ ID NO: 2624129 - RNA, 20 nt, Escherichia coli CFT073
acucgcugcggacaaaucgu

SEQ ID NO: 2624130 - RNA, 17 nt, Escherichia coli CFT073
acucgcuuaagccauca

SEQ ID NO: 2624131 - RNA, 11 nt, Escherichia coli CFT073
acucggcgcgg

SEQ ID NO: 2624132 - RNA, 14 nt, Escherichia coli CFT073
acucggcgcggaug

SEQ ID NO: 2624133 - RNA, 22 nt, Escherichia coli CFT073
acucggcgucgguaaagaaaau

SEQ ID NO: 2624134 - RNA, 18 nt, Escherichia coli CFT073
acucguaagaggcgugug

SEQ ID NO: 2624135 - RNA, 16 nt, Escherichia coli CFT073
acucguccagucgccu

SEQ ID NO: 2624136 - RNA, 22 nt, Escherichia coli CFT073
acucguccauaguaacgcggca

SEQ ID NO: 2624137 - RNA, 20 nt, Escherichia coli CFT073
acucgucgcgcacgcccauc

SEQ ID NO: 2624138 - RNA, 19 nt, Escherichia coli CFT073
acucuacauguguucugca

SEQ ID NO: 2624139 - RNA, 19 nt, Escherichia coli CFT073
acucuaccguuaaaauacg

SEQ ID NO: 2624140 - RNA, 13 nt, Escherichia coli CFT073
acucuaccugguc

SEQ ID NO: 2624141 - RNA, 22 nt, Escherichia coli CFT073
acucuaccuuccuacaagaggu

SEQ ID NO: 2624142 - RNA, 23 nt, Escherichia coli CFT073
acucuccccguuuuccgggcaag

SEQ ID NO: 2624143 - RNA, 16 nt, Escherichia coli CFT073
acucugaccgggaaua

SEQ ID NO: 2624144 - RNA, 19 nt, Escherichia coli CFT073
acucugaccgggaauauaa

SEQ ID NO: 2624145 - RNA, 22 nt, Escherichia coli CFT073
acucugaccugucgcagauauu

SEQ ID NO: 2624146 - RNA, 23 nt, Escherichia coli CFT073
acucugaccugucgcagauauug

SEQ ID NO: 2624147 - RNA, 18 nt, Escherichia coli CFT073
acucugaugacugaugcu

SEQ ID NO: 2624148 - RNA, 21 nt, Escherichia coli CFT073
acucugcaagucuugcugcgc

SEQ ID NO: 2624149 - RNA, 15 nt, Escherichia coli CFT073
acucugcaccgccuc

SEQ ID NO: 2624150 - RNA, 19 nt, Escherichia coli CFT073
acucugcgacgguuucugg

SEQ ID NO: 2624151 - RNA, 22 nt, Escherichia coli CFT073
acucugcuugaauucauuuaca

SEQ ID NO: 2624152 - RNA, 21 nt, Escherichia coli CFT073
acucugugcgucugcuuuuau

SEQ ID NO: 2624153 - RNA, 18 nt, Escherichia coli CFT073
acucuuaagguucacuua

SEQ ID NO: 2624154 - RNA, 21 nt, Escherichia coli CFT073
acucuuaagguucacuuaauc

SEQ ID NO: 2624155 - RNA, 18 nt, Escherichia coli CFT073
acucuucaacacacugaa

SEQ ID NO: 2624156 - RNA, 20 nt, Escherichia coli CFT073
acucuucaagauuaaagcag

SEQ ID NO: 2624157 - RNA, 18 nt, Escherichia coli CFT073
acucuuccagaccaaaca

SEQ ID NO: 2624158 - RNA, 17 nt, Escherichia coli CFT073
acucuucguucuucuuc

SEQ ID NO: 2624159 - RNA, 14 nt, Escherichia coli CFT073
acucuucugaccag

SEQ ID NO: 2624160 - RNA, 16 nt, Escherichia coli CFT073
acucuucuuuaauuaa

SEQ ID NO: 2624161 - RNA, 21 nt, Escherichia coli CFT073
acucuugccagauuuucuuca

SEQ ID NO: 2624162 - RNA, 22 nt, Escherichia coli CFT073
acucuugccagauuuucuucag

SEQ ID NO: 2624163 - RNA, 15 nt, Escherichia coli CFT073
acucuuggcaccgcc

SEQ ID NO: 2624164 - RNA, 18 nt, Escherichia coli CFT073
acucuuucccggcaauca

SEQ ID NO: 2624165 - RNA, 20 nt, Escherichia coli CFT073
acucuuucccuccucaaauc

SEQ ID NO: 2624166 - RNA, 17 nt, Escherichia coli CFT073
acucuuucgacggcaua

SEQ ID NO: 2624167 - RNA, 18 nt, Escherichia coli CFT073
acucuuuuaccaccgcaa

SEQ ID NO: 2624168 - RNA, 21 nt, Escherichia coli CFT073
acucuuuuugacguuuuuaca

SEQ ID NO: 2624169 - RNA, 16 nt, Escherichia coli CFT073
acugaaacaugaacau

SEQ ID NO: 2624170 - RNA, 11 nt, Escherichia coli CFT073
acugaacccgg

SEQ ID NO: 2624171 - RNA, 13 nt, Escherichia coli CFT073
acugaagauucgc

SEQ ID NO: 2624172 - RNA, 17 nt, Escherichia coli CFT073
acugaagcgaccaccac

SEQ ID NO: 2624173 - RNA, 19 nt, Escherichia coli CFT073
acugaaggcgcauugcugg

SEQ ID NO: 2624174 - RNA, 15 nt, Escherichia coli CFT073
acugaaguucuggug

SEQ ID NO: 2624175 - RNA, 17 nt, Escherichia coli CFT073
acugaauaaacagcaga

SEQ ID NO: 2624176 - RNA, 18 nt, Escherichia coli CFT073
acugaauaccguaaaacu

SEQ ID NO: 2624177 - RNA, 22 nt, Escherichia coli CFT073
acugaauaccguaaaacucaca

SEQ ID NO: 2624178 - RNA, 17 nt, Escherichia coli CFT073
acugaauagugccgcac

SEQ ID NO: 2624179 - RNA, 19 nt, Escherichia coli CFT073
acugaaugaucacuuguuc

SEQ ID NO: 2624180 - RNA, 18 nt, Escherichia coli CFT073
acugaauggcauuuccac

SEQ ID NO: 2624181 - RNA, 12 nt, Escherichia coli CFT073
acugaauugcca

SEQ ID NO: 2624182 - RNA, 18 nt, Escherichia coli CFT073
acugaauugugaugguuu

SEQ ID NO: 2624183 - RNA, 15 nt, Escherichia coli CFT073
acugacaaucaaucc

SEQ ID NO: 2624184 - RNA, 17 nt, Escherichia coli CFT073
acugacaaucaucgccg

SEQ ID NO: 2624185 - RNA, 19 nt, Escherichia coli CFT073
acugacacaggcagcaauc

SEQ ID NO: 2624186 - RNA, 13 nt, Escherichia coli CFT073
acugacaccagca

SEQ ID NO: 2624187 - RNA, 13 nt, Escherichia coli CFT073
acugacauacaaa

SEQ ID NO: 2624188 - RNA, 22 nt, Escherichia coli CFT073
acugacaucacgccacucacua

SEQ ID NO: 2624189 - RNA, 14 nt, Escherichia coli CFT073
acugacaucgcuua

SEQ ID NO: 2624190 - RNA, 23 nt, Escherichia coli CFT073
acugacaucgcuuaguuaaacca

SEQ ID NO: 2624191 - RNA, 17 nt, Escherichia coli CFT073
acugaccuuaccaaugc

SEQ ID NO: 2624192 - RNA, 19 nt, Escherichia coli CFT073
acugacgauuacguaauuc

SEQ ID NO: 2624193 - RNA, 14 nt, Escherichia coli CFT073
acugacgcagcaga

SEQ ID NO: 2624194 - RNA, 17 nt, Escherichia coli CFT073
acugacgcgcagugccu

SEQ ID NO: 2624195 - RNA, 16 nt, Escherichia coli CFT073
acugacgcucugcuuu

SEQ ID NO: 2624196 - RNA, 19 nt, Escherichia coli CFT073
acugacgguuucucccgcc

SEQ ID NO: 2624197 - RNA, 18 nt, Escherichia coli CFT073
acugacguugcggauuaa

SEQ ID NO: 2624198 - RNA, 20 nt, Escherichia coli CFT073
acugacguugcggauuaaau

SEQ ID NO: 2624199 - RNA, 18 nt, Escherichia coli CFT073
acugacuauccacuggaa

SEQ ID NO: 2624200 - RNA, 13 nt, Escherichia coli CFT073
acugacuauccug

SEQ ID NO: 2624201 - RNA, 18 nt, Escherichia coli CFT073
acugacugacagacugcu

SEQ ID NO: 2624202 - RNA, 12 nt, Escherichia coli CFT073
acugacuuccac

SEQ ID NO: 2624203 - RNA, 12 nt, Escherichia coli CFT073
acugacuuucuu

SEQ ID NO: 2624204 - RNA, 17 nt, Escherichia coli CFT073
acugaggcgauagcauc

SEQ ID NO: 2624205 - RNA, 21 nt, Escherichia coli CFT073
acugaggcgauagcauccagu

SEQ ID NO: 2624206 - RNA, 20 nt, Escherichia coli CFT073
acugagguaacucucaugcu

SEQ ID NO: 2624207 - RNA, 22 nt, Escherichia coli CFT073
acugagguaacucucaugcuuc

SEQ ID NO: 2624208 - RNA, 22 nt, Escherichia coli CFT073
acugaguuacguccauguagcu

SEQ ID NO: 2624209 - RNA, 12 nt, Escherichia coli CFT073
acugaguucaua

SEQ ID NO: 2624210 - RNA, 15 nt, Escherichia coli CFT073
acugaguuuuauucu

SEQ ID NO: 2624211 - RNA, 17 nt, Escherichia coli CFT073
acugaguuuuauucuuu

SEQ ID NO: 2624212 - RNA, 16 nt, Escherichia coli CFT073
acugauaacuuuuuau

SEQ ID NO: 2624213 - RNA, 18 nt, Escherichia coli CFT073
acugauaagcugagcaca

SEQ ID NO: 2624214 - RNA, 15 nt, Escherichia coli CFT073
acugauacaccuuca

SEQ ID NO: 2624215 - RNA, 14 nt, Escherichia coli CFT073
acugauauccagcc

SEQ ID NO: 2624216 - RNA, 13 nt, Escherichia coli CFT073
acugauauuguga

SEQ ID NO: 2624217 - RNA, 20 nt, Escherichia coli CFT073
acugauauugugagcaugug

SEQ ID NO: 2624218 - RNA, 13 nt, Escherichia coli CFT073
acugauauugugc

SEQ ID NO: 2624219 - RNA, 20 nt, Escherichia coli CFT073
acugauauuuaaacggugua

SEQ ID NO: 2624220 - RNA, 13 nt, Escherichia coli CFT073
acugaucaucauu

SEQ ID NO: 2624221 - RNA, 23 nt, Escherichia coli CFT073
acugaucgacaguugcugcguga

SEQ ID NO: 2624222 - RNA, 16 nt, Escherichia coli CFT073
acugaucgucaucaaa

SEQ ID NO: 2624223 - RNA, 17 nt, Escherichia coli CFT073
acugaucgucaucaaac

SEQ ID NO: 2624224 - RNA, 16 nt, Escherichia coli CFT073
acugaucuuuaucaag

SEQ ID NO: 2624225 - RNA, 18 nt, Escherichia coli CFT073
acugaucuuuaucaagca

SEQ ID NO: 2624226 - RNA, 21 nt, Escherichia coli CFT073
acugaucuuuaucaagcacca

SEQ ID NO: 2624227 - RNA, 15 nt, Escherichia coli CFT073
acugaugaucuccau

SEQ ID NO: 2624228 - RNA, 22 nt, Escherichia coli CFT073
acugaugaucuccauugccggc

SEQ ID NO: 2624229 - RNA, 15 nt, Escherichia coli CFT073
acugaugccaaacgc

SEQ ID NO: 2624230 - RNA, 16 nt, Escherichia coli CFT073
acugaugcccugcgga

SEQ ID NO: 2624231 - RNA, 22 nt, Escherichia coli CFT073
acugauggaauuucaucaucac

SEQ ID NO: 2624232 - RNA, 19 nt, Escherichia coli CFT073
acugauggcaaaugcaaca

SEQ ID NO: 2624233 - RNA, 22 nt, Escherichia coli CFT073
acugauuaacuugcgacagcca

SEQ ID NO: 2624234 - RNA, 17 nt, Escherichia coli CFT073
acugauugauugcgaca

SEQ ID NO: 2624235 - RNA, 22 nt, Escherichia coli CFT073
acugauuuccccccggcagcug

SEQ ID NO: 2624236 - RNA, 19 nt, Escherichia coli CFT073
acugcaaauacccaaaaaa

SEQ ID NO: 2624237 - RNA, 14 nt, Escherichia coli CFT073
acugcaaaucacca

SEQ ID NO: 2624238 - RNA, 15 nt, Escherichia coli CFT073
acugcaaaucaccac

SEQ ID NO: 2624239 - RNA, 16 nt, Escherichia coli CFT073
acugcaaaucaccaca

SEQ ID NO: 2624240 - RNA, 21 nt, Escherichia coli CFT073
acugcaaauuuuaacgcauaa

SEQ ID NO: 2624241 - RNA, 17 nt, Escherichia coli CFT073
acugcaagccaugacgc

SEQ ID NO: 2624242 - RNA, 14 nt, Escherichia coli CFT073
acugcaaggagagc

SEQ ID NO: 2624243 - RNA, 17 nt, Escherichia coli CFT073
acugcaaggccaucggc

SEQ ID NO: 2624244 - RNA, 15 nt, Escherichia coli CFT073
acugcacgcccauac

SEQ ID NO: 2624245 - RNA, 23 nt, Escherichia coli CFT073
acugcagcaggcgagcugccagu

SEQ ID NO: 2624246 - RNA, 14 nt, Escherichia coli CFT073
acugcauaaucgcu

SEQ ID NO: 2624247 - RNA, 17 nt, Escherichia coli CFT073
acugcauucccaucgca

SEQ ID NO: 2624248 - RNA, 17 nt, Escherichia coli CFT073
acugccacacaggccau

SEQ ID NO: 2624249 - RNA, 22 nt, Escherichia coli CFT073
acugccacacaggccauuuccc

SEQ ID NO: 2624250 - RNA, 13 nt, Escherichia coli CFT073
acugccaccaucc

SEQ ID NO: 2624251 - RNA, 13 nt, Escherichia coli CFT073
acugccagaauag

SEQ ID NO: 2624252 - RNA, 14 nt, Escherichia coli CFT073
acugccagcaaaaa

SEQ ID NO: 2624253 - RNA, 15 nt, Escherichia coli CFT073
acugccagcaaaaaa

SEQ ID NO: 2624254 - RNA, 11 nt, Escherichia coli CFT073
acugccagcca

SEQ ID NO: 2624255 - RNA, 17 nt, Escherichia coli CFT073
acugccagccacacugc

SEQ ID NO: 2624256 - RNA, 21 nt, Escherichia coli CFT073
acugccagccacacugcggcc

SEQ ID NO: 2624257 - RNA, 20 nt, Escherichia coli CFT073
acugccagccacaggccggu

SEQ ID NO: 2624258 - RNA, 24 nt, Escherichia coli CFT073
acugccagccacaggccggucauc

SEQ ID NO: 2624259 - RNA, 17 nt, Escherichia coli CFT073
acugccagugucggaug

SEQ ID NO: 2624260 - RNA, 23 nt, Escherichia coli CFT073
acugccagugucggaugcggcuc

SEQ ID NO: 2624261 - RNA, 14 nt, Escherichia coli CFT073
acugccaucuuccg

SEQ ID NO: 2624262 - RNA, 14 nt, Escherichia coli CFT073
acugcccaggcaaa

SEQ ID NO: 2624263 - RNA, 17 nt, Escherichia coli CFT073
acugcccccggcguuau

SEQ ID NO: 2624264 - RNA, 22 nt, Escherichia coli CFT073
acugccccgccagugcuuucag

SEQ ID NO: 2624265 - RNA, 14 nt, Escherichia coli CFT073
acugcccgcaucaa

SEQ ID NO: 2624266 - RNA, 14 nt, Escherichia coli CFT073
acugccgcacauuu

SEQ ID NO: 2624267 - RNA, 22 nt, Escherichia coli CFT073
acugccgccgucaucugggcag

SEQ ID NO: 2624268 - RNA, 21 nt, Escherichia coli CFT073
acugccggggaaguaaacccg

SEQ ID NO: 2624269 - RNA, 13 nt, Escherichia coli CFT073
acugccgggugga

SEQ ID NO: 2624270 - RNA, 15 nt, Escherichia coli CFT073
acugccguacaggca

SEQ ID NO: 2624271 - RNA, 20 nt, Escherichia coli CFT073
acugccguagugaugcauca

SEQ ID NO: 2624272 - RNA, 20 nt, Escherichia coli CFT073
acugccgucagggccugcgu

SEQ ID NO: 2624273 - RNA, 17 nt, Escherichia coli CFT073
acugccgucgagaauca

SEQ ID NO: 2624274 - RNA, 17 nt, Escherichia coli CFT073
acugccuuaaacuccau

SEQ ID NO: 2624275 - RNA, 20 nt, Escherichia coli CFT073
acugccuugcgauaucccau

SEQ ID NO: 2624276 - RNA, 15 nt, Escherichia coli CFT073
acugccuuucccuua

SEQ ID NO: 2624277 - RNA, 16 nt, Escherichia coli CFT073
acugccuuucccuuuc

SEQ ID NO: 2624278 - RNA, 20 nt, Escherichia coli CFT073
acugcgaauuuccugccaga

SEQ ID NO: 2624279 - RNA, 15 nt, Escherichia coli CFT073
acugcgaccagugaa

SEQ ID NO: 2624280 - RNA, 21 nt, Escherichia coli CFT073
acugcgaucgcccgcaaucag

SEQ ID NO: 2624281 - RNA, 21 nt, Escherichia coli CFT073
acugcgcauuaaauaccaagc

SEQ ID NO: 2624282 - RNA, 18 nt, Escherichia coli CFT073
acugcgccacucgauacc

SEQ ID NO: 2624283 - RNA, 13 nt, Escherichia coli CFT073
acugcgccgggca

SEQ ID NO: 2624284 - RNA, 19 nt, Escherichia coli CFT073
acugcgccucaacauacaa

SEQ ID NO: 2624285 - RNA, 22 nt, Escherichia coli CFT073
acugcgcgccgaagcugaccag

SEQ ID NO: 2624286 - RNA, 19 nt, Escherichia coli CFT073
acugcgcucuaaaaucauc

SEQ ID NO: 2624287 - RNA, 22 nt, Escherichia coli CFT073
acugcggcaagaauuacuucuu

SEQ ID NO: 2624288 - RNA, 12 nt, Escherichia coli CFT073
acugcgggcaac

SEQ ID NO: 2624289 - RNA, 15 nt, Escherichia coli CFT073
acugcgguucagcuu

SEQ ID NO: 2624290 - RNA, 19 nt, Escherichia coli CFT073
acugcguagaguccagcgc

SEQ ID NO: 2624291 - RNA, 19 nt, Escherichia coli CFT073
acugcgugucguaagccac

SEQ ID NO: 2624292 - RNA, 21 nt, Escherichia coli CFT073
acugcgugucguaagccaccg

SEQ ID NO: 2624293 - RNA, 14 nt, Escherichia coli CFT073
acugcgugugacaa

SEQ ID NO: 2624294 - RNA, 21 nt, Escherichia coli CFT073
acugcucauuaauauacuucu

SEQ ID NO: 2624295 - RNA, 14 nt, Escherichia coli CFT073
acugcuccagggca

SEQ ID NO: 2624296 - RNA, 14 nt, Escherichia coli CFT073
acugcucguucagc

SEQ ID NO: 2624297 - RNA, 16 nt, Escherichia coli CFT073
acugcucguucagcac

SEQ ID NO: 2624298 - RNA, 15 nt, Escherichia coli CFT073
acugcugaaugaggc

SEQ ID NO: 2624299 - RNA, 17 nt, Escherichia coli CFT073
acugcugaaugaggcuu

SEQ ID NO: 2624300 - RNA, 21 nt, Escherichia coli CFT073
acugcugauguuguuucucuu

SEQ ID NO: 2624301 - RNA, 12 nt, Escherichia coli CFT073
acugcugcgcca

SEQ ID NO: 2624302 - RNA, 16 nt, Escherichia coli CFT073
acugcuguugcugccg

SEQ ID NO: 2624303 - RNA, 19 nt, Escherichia coli CFT073
acugcuguugcugccgugc

SEQ ID NO: 2624304 - RNA, 14 nt, Escherichia coli CFT073
acugcuugccauuc

SEQ ID NO: 2624305 - RNA, 17 nt, Escherichia coli CFT073
acugcuuuuaaaugccc

SEQ ID NO: 2624306 - RNA, 18 nt, Escherichia coli CFT073
acugcuuuuugcucucgg

SEQ ID NO: 2624307 - RNA, 15 nt, Escherichia coli CFT073
acuggaaaucaaaua

SEQ ID NO: 2624308 - RNA, 16 nt, Escherichia coli CFT073
acuggaaaucaaauac

SEQ ID NO: 2624309 - RNA, 14 nt, Escherichia coli CFT073
acuggaagacgcug

SEQ ID NO: 2624310 - RNA, 19 nt, Escherichia coli CFT073
acuggacccgaugaucaaa

SEQ ID NO: 2624311 - RNA, 18 nt, Escherichia coli CFT073
acuggauggccugauuca

SEQ ID NO: 2624312 - RNA, 15 nt, Escherichia coli CFT073
acuggcaaaaacaag

SEQ ID NO: 2624313 - RNA, 16 nt, Escherichia coli CFT073
acuggcaaaaucaaaa

SEQ ID NO: 2624314 - RNA, 15 nt, Escherichia coli CFT073
acuggcaaucgccag

SEQ ID NO: 2624315 - RNA, 23 nt, Escherichia coli CFT073
acuggcaaucgccagcggcagcu

SEQ ID NO: 2624316 - RNA, 23 nt, Escherichia coli CFT073
acuggcacaagacugacaaucaa

SEQ ID NO: 2624317 - RNA, 15 nt, Escherichia coli CFT073
acuggcauacaucaa

SEQ ID NO: 2624318 - RNA, 21 nt, Escherichia coli CFT073
acuggccauggauucaagcau

SEQ ID NO: 2624319 - RNA, 15 nt, Escherichia coli CFT073
acuggccucuucucu

SEQ ID NO: 2624320 - RNA, 18 nt, Escherichia coli CFT073
acuggcgacacgcaucac

SEQ ID NO: 2624321 - RNA, 19 nt, Escherichia coli CFT073
acuggcgacugccagccac

SEQ ID NO: 2624322 - RNA, 16 nt, Escherichia coli CFT073
acuggcgauaucaaua

SEQ ID NO: 2624323 - RNA, 17 nt, Escherichia coli CFT073
acuggcgcggcagguug

SEQ ID NO: 2624324 - RNA, 19 nt, Escherichia coli CFT073
acuggcgcggcagguugag

SEQ ID NO: 2624325 - RNA, 22 nt, Escherichia coli CFT073
acuggcgcggcagguugagcaa

SEQ ID NO: 2624326 - RNA, 23 nt, Escherichia coli CFT073
acuggcgcuggcauggcgaaaau

SEQ ID NO: 2624327 - RNA, 15 nt, Escherichia coli CFT073
acuggcgggcggcuu

SEQ ID NO: 2624328 - RNA, 19 nt, Escherichia coli CFT073
acuggcucgccgcagccaa

SEQ ID NO: 2624329 - RNA, 22 nt, Escherichia coli CFT073
acuggcucugaauaaagcguuu

SEQ ID NO: 2624330 - RNA, 17 nt, Escherichia coli CFT073
acuggcucuuuuucggg

SEQ ID NO: 2624331 - RNA, 15 nt, Escherichia coli CFT073
acuggcugaugcugg

SEQ ID NO: 2624332 - RNA, 14 nt, Escherichia coli CFT073
acuggcugccguug

SEQ ID NO: 2624333 - RNA, 20 nt, Escherichia coli CFT073
acuggcuguauauaauaccg

SEQ ID NO: 2624334 - RNA, 16 nt, Escherichia coli CFT073
acuggcuuaauaauuc

SEQ ID NO: 2624335 - RNA, 15 nt, Escherichia coli CFT073
acuggcuugccagca

SEQ ID NO: 2624336 - RNA, 17 nt, Escherichia coli CFT073
acuggcuugccagcagg

SEQ ID NO: 2624337 - RNA, 18 nt, Escherichia coli CFT073
acuggcuuuccugaucaa

SEQ ID NO: 2624338 - RNA, 17 nt, Escherichia coli CFT073
acugggcgauuaauaaa

SEQ ID NO: 2624339 - RNA, 13 nt, Escherichia coli CFT073
acugggcgcggcc

SEQ ID NO: 2624340 - RNA, 18 nt, Escherichia coli CFT073
acuggggcauuuuuucca

SEQ ID NO: 2624341 - RNA, 16 nt, Escherichia coli CFT073
acuggggcuggcggca

SEQ ID NO: 2624342 - RNA, 23 nt, Escherichia coli CFT073
acugggugaagacggccauccca

SEQ ID NO: 2624343 - RNA, 13 nt, Escherichia coli CFT073
acuggguuaacgu

SEQ ID NO: 2624344 - RNA, 18 nt, Escherichia coli CFT073
acugguaaccgaggcgga

SEQ ID NO: 2624345 - RNA, 24 nt, Escherichia coli CFT073
acugguaacgauuucaucgcccag

SEQ ID NO: 2624346 - RNA, 22 nt, Escherichia coli CFT073
acugguaacguggcagcaggau

SEQ ID NO: 2624347 - RNA, 16 nt, Escherichia coli CFT073
acugguaagcaaagca

SEQ ID NO: 2624348 - RNA, 13 nt, Escherichia coli CFT073
acugguacucaac

SEQ ID NO: 2624349 - RNA, 18 nt, Escherichia coli CFT073
acugguagcgcauuucau

SEQ ID NO: 2624350 - RNA, 17 nt, Escherichia coli CFT073
acugguagggauaaugu

SEQ ID NO: 2624351 - RNA, 14 nt, Escherichia coli CFT073
acuggucaaacuga

SEQ ID NO: 2624352 - RNA, 21 nt, Escherichia coli CFT073
acuggucaucaaguuacgaua

SEQ ID NO: 2624353 - RNA, 21 nt, Escherichia coli CFT073
acuggugacuuuugcccggca

SEQ ID NO: 2624354 - RNA, 23 nt, Escherichia coli CFT073
acuggugacuuuugcccggcaug

SEQ ID NO: 2624355 - RNA, 13 nt, Escherichia coli CFT073
acuggugccauga

SEQ ID NO: 2624356 - RNA, 21 nt, Escherichia coli CFT073
acuggugcguuuaccugccug

SEQ ID NO: 2624357 - RNA, 14 nt, Escherichia coli CFT073
acuggugggaccaa

SEQ ID NO: 2624358 - RNA, 19 nt, Escherichia coli CFT073
acugguuaccugcggacgu

SEQ ID NO: 2624359 - RNA, 22 nt, Escherichia coli CFT073
acugguuauaugaauacgcgau

SEQ ID NO: 2624360 - RNA, 19 nt, Escherichia coli CFT073
acugguucccaacaacagc

SEQ ID NO: 2624361 - RNA, 20 nt, Escherichia coli CFT073
acugguucccaacaacagcg

SEQ ID NO: 2624362 - RNA, 17 nt, Escherichia coli CFT073
acugguugauuuuaaag

SEQ ID NO: 2624363 - RNA, 14 nt, Escherichia coli CFT073
acuguaacgcagaa

SEQ ID NO: 2624364 - RNA, 14 nt, Escherichia coli CFT073
acuguagguaaaac

SEQ ID NO: 2624365 - RNA, 21 nt, Escherichia coli CFT073
acuguauacgggcuuuuuaau

SEQ ID NO: 2624366 - RNA, 23 nt, Escherichia coli CFT073
acuguauacgggcuuuuuaauuc

SEQ ID NO: 2624367 - RNA, 23 nt, Escherichia coli CFT073
acuguaucgacguaguacccucu

SEQ ID NO: 2624368 - RNA, 16 nt, Escherichia coli CFT073
acugucaccuuuuacc

SEQ ID NO: 2624369 - RNA, 19 nt, Escherichia coli CFT073
acugucagugaccagcggc

SEQ ID NO: 2624370 - RNA, 15 nt, Escherichia coli CFT073
acugucaucgacaaa

SEQ ID NO: 2624371 - RNA, 21 nt, Escherichia coli CFT073
acugucccaaaaugucggaug

SEQ ID NO: 2624372 - RNA, 23 nt, Escherichia coli CFT073
acuguccgcauccccuacucucu

SEQ ID NO: 2624373 - RNA, 24 nt, Escherichia coli CFT073
acuguccugcggcguaccaauacg

SEQ ID NO: 2624374 - RNA, 19 nt, Escherichia coli CFT073
acugucggguaagcgccac

SEQ ID NO: 2624375 - RNA, 15 nt, Escherichia coli CFT073
acugucguucauugu

SEQ ID NO: 2624376 - RNA, 21 nt, Escherichia coli CFT073
acugugacgcggugcuuccgg

SEQ ID NO: 2624377 - RNA, 22 nt, Escherichia coli CFT073
acugugauugugauuaccgcaa

SEQ ID NO: 2624378 - RNA, 21 nt, Escherichia coli CFT073
acugugcauuuggcgcaucgg

SEQ ID NO: 2624379 - RNA, 15 nt, Escherichia coli CFT073
acugugccagcguuu

SEQ ID NO: 2624380 - RNA, 18 nt, Escherichia coli CFT073
acugugccgcgaccaccu

SEQ ID NO: 2624381 - RNA, 18 nt, Escherichia coli CFT073
acuguggucgacaaccag

SEQ ID NO: 2624382 - RNA, 12 nt, Escherichia coli CFT073
acugugugcuga

SEQ ID NO: 2624383 - RNA, 22 nt, Escherichia coli CFT073
acuguguuggguucacuuuccc

SEQ ID NO: 2624384 - RNA, 12 nt, Escherichia coli CFT073
acuguuacucau

SEQ ID NO: 2624385 - RNA, 19 nt, Escherichia coli CFT073
acuguucgagguaauccag

SEQ ID NO: 2624386 - RNA, 15 nt, Escherichia coli CFT073
acuguucgccgcagc

SEQ ID NO: 2624387 - RNA, 15 nt, Escherichia coli CFT073
acuguugcuguagcu

SEQ ID NO: 2624388 - RNA, 15 nt, Escherichia coli CFT073
acuguuggaaucacu

SEQ ID NO: 2624389 - RNA, 20 nt, Escherichia coli CFT073
acuguuggcuugugcgcccg

SEQ ID NO: 2624390 - RNA, 22 nt, Escherichia coli CFT073
acuguuuaacgguuucaaccag

SEQ ID NO: 2624391 - RNA, 23 nt, Escherichia coli CFT073
acuguuuaucgucacgcaucacg

SEQ ID NO: 2624392 - RNA, 17 nt, Escherichia coli CFT073
acuguuuauuguugauu

SEQ ID NO: 2624393 - RNA, 20 nt, Escherichia coli CFT073
acuguuucgcggcaaacugc

SEQ ID NO: 2624394 - RNA, 15 nt, Escherichia coli CFT073
acuuaaauaaugcuu

SEQ ID NO: 2624395 - RNA, 21 nt, Escherichia coli CFT073
acuuaaccacaaacgauccug

SEQ ID NO: 2624396 - RNA, 21 nt, Escherichia coli CFT073
acuuaagcacguuacccaauc

SEQ ID NO: 2624397 - RNA, 18 nt, Escherichia coli CFT073
acuuaagcgccugauaca

SEQ ID NO: 2624398 - RNA, 21 nt, Escherichia coli CFT073
acuuaauauugccguccggca

SEQ ID NO: 2624399 - RNA, 21 nt, Escherichia coli CFT073
acuuaaucgccaguucaguca

SEQ ID NO: 2624400 - RNA, 22 nt, Escherichia coli CFT073
acuuaaugguucugcacagcuu

SEQ ID NO: 2624401 - RNA, 14 nt, Escherichia coli CFT073
acuuacacaucaug

SEQ ID NO: 2624402 - RNA, 21 nt, Escherichia coli CFT073
acuuacaucugucugauaaaa

SEQ ID NO: 2624403 - RNA, 23 nt, Escherichia coli CFT073
acuuaccuccugucuaaccgccu

SEQ ID NO: 2624404 - RNA, 14 nt, Escherichia coli CFT073
acuuaccuucacga

SEQ ID NO: 2624405 - RNA, 13 nt, Escherichia coli CFT073
acuuacucauuaa

SEQ ID NO: 2624406 - RNA, 20 nt, Escherichia coli CFT073
acuuagugcacuucuucaca

SEQ ID NO: 2624407 - RNA, 18 nt, Escherichia coli CFT073
acuuauaagucucagaaa

SEQ ID NO: 2624408 - RNA, 14 nt, Escherichia coli CFT073
acuuaucaagaaag

SEQ ID NO: 2624409 - RNA, 23 nt, Escherichia coli CFT073
acuuaucaauugaugcuuuuugc

SEQ ID NO: 2624410 - RNA, 11 nt, Escherichia coli CFT073
acuuaucauca

SEQ ID NO: 2624411 - RNA, 15 nt, Escherichia coli CFT073
acuuaucaucgcaaa

SEQ ID NO: 2624412 - RNA, 19 nt, Escherichia coli CFT073
acuuaugaguucgcggcgc

SEQ ID NO: 2624413 - RNA, 15 nt, Escherichia coli CFT073
acuuaugcagcugcu

SEQ ID NO: 2624414 - RNA, 13 nt, Escherichia coli CFT073
acuuaugcugcgc

SEQ ID NO: 2624415 - RNA, 20 nt, Escherichia coli CFT073
acuuauggcguacugaagcc

SEQ ID NO: 2624416 - RNA, 23 nt, Escherichia coli CFT073
acuuauuaaagaucuuauugcca

SEQ ID NO: 2624417 - RNA, 17 nt, Escherichia coli CFT073
acuuauucaaucucuuc

SEQ ID NO: 2624418 - RNA, 22 nt, Escherichia coli CFT073
acuuauucaccaccaucaaaug

SEQ ID NO: 2624419 - RNA, 13 nt, Escherichia coli CFT073
acuucaaauuuca

SEQ ID NO: 2624420 - RNA, 12 nt, Escherichia coli CFT073
acuucacaucau

SEQ ID NO: 2624421 - RNA, 13 nt, Escherichia coli CFT073
acuucaccauuca

SEQ ID NO: 2624422 - RNA, 23 nt, Escherichia coli CFT073
acuucaccauucacauccacaca

SEQ ID NO: 2624423 - RNA, 17 nt, Escherichia coli CFT073
acuucaccgguucauca

SEQ ID NO: 2624424 - RNA, 20 nt, Escherichia coli CFT073
acuucaccuuuuguugcuuu

SEQ ID NO: 2624425 - RNA, 22 nt, Escherichia coli CFT073
acuucacgguuacggccuucgg

SEQ ID NO: 2624426 - RNA, 22 nt, Escherichia coli CFT073
acuucaggugacauuaaagcuu

SEQ ID NO: 2624427 - RNA, 14 nt, Escherichia coli CFT073
acuucagguucagc

SEQ ID NO: 2624428 - RNA, 22 nt, Escherichia coli CFT073
acuucagguucagcaaccacaa

SEQ ID NO: 2624429 - RNA, 22 nt, Escherichia coli CFT073
acuucaguaaauacugcgcaug

SEQ ID NO: 2624430 - RNA, 18 nt, Escherichia coli CFT073
acuucaguggaaucauca

SEQ ID NO: 2624431 - RNA, 22 nt, Escherichia coli CFT073
acuucauacauugccagacggg

SEQ ID NO: 2624432 - RNA, 18 nt, Escherichia coli CFT073
acuucauaggucauuggc

SEQ ID NO: 2624433 - RNA, 17 nt, Escherichia coli CFT073
acuucaucacgaugcaa

SEQ ID NO: 2624434 - RNA, 23 nt, Escherichia coli CFT073
acuucauccgacaccagccgugc

SEQ ID NO: 2624435 - RNA, 12 nt, Escherichia coli CFT073
acuucaugcccc

SEQ ID NO: 2624436 - RNA, 15 nt, Escherichia coli CFT073
acuucauucagaaaa

SEQ ID NO: 2624437 - RNA, 18 nt, Escherichia coli CFT073
acuuccaccacuuccugc

SEQ ID NO: 2624438 - RNA, 21 nt, Escherichia coli CFT073
acuuccaccagcggcugaaua

SEQ ID NO: 2624439 - RNA, 17 nt, Escherichia coli CFT073
acuuccacguuccccag

SEQ ID NO: 2624440 - RNA, 20 nt, Escherichia coli CFT073
acuuccagcagaccagcaau

SEQ ID NO: 2624441 - RNA, 12 nt, Escherichia coli CFT073
acuuccagcggc

SEQ ID NO: 2624442 - RNA, 14 nt, Escherichia coli CFT073
acuucccagccccg

SEQ ID NO: 2624443 - RNA, 23 nt, Escherichia coli CFT073
acuuccccggcagugcuuucauu

SEQ ID NO: 2624444 - RNA, 12 nt, Escherichia coli CFT073
acuuccccugcc

SEQ ID NO: 2624445 - RNA, 15 nt, Escherichia coli CFT073
acuuccgcaacgaca

SEQ ID NO: 2624446 - RNA, 13 nt, Escherichia coli CFT073
acuuccgccacca

SEQ ID NO: 2624447 - RNA, 16 nt, Escherichia coli CFT073
acuuccgccaccacgc

SEQ ID NO: 2624448 - RNA, 19 nt, Escherichia coli CFT073
acuuccgcguaguugcgcu

SEQ ID NO: 2624449 - RNA, 20 nt, Escherichia coli CFT073
acuuccgggucgcugucuuu

SEQ ID NO: 2624450 - RNA, 23 nt, Escherichia coli CFT073
acuuccgggucgcugucuuucaa

SEQ ID NO: 2624451 - RNA, 18 nt, Escherichia coli CFT073
acuuccugcaaucuuucc

SEQ ID NO: 2624452 - RNA, 20 nt, Escherichia coli CFT073
acuuccugcaaucuuuccug

SEQ ID NO: 2624453 - RNA, 19 nt, Escherichia coli CFT073
acuuccugccaguuuuucc

SEQ ID NO: 2624454 - RNA, 15 nt, Escherichia coli CFT073
acuuccugcggagca

SEQ ID NO: 2624455 - RNA, 12 nt, Escherichia coli CFT073
acuuccugcucg

SEQ ID NO: 2624456 - RNA, 22 nt, Escherichia coli CFT073
acuuccugcucuuucgccggau

SEQ ID NO: 2624457 - RNA, 16 nt, Escherichia coli CFT073
acuuccugucuucccu

SEQ ID NO: 2624458 - RNA, 15 nt, Escherichia coli CFT073
acuucgcaaacaccc

SEQ ID NO: 2624459 - RNA, 23 nt, Escherichia coli CFT073
acuucgcauuuugcagcuguugc

SEQ ID NO: 2624460 - RNA, 18 nt, Escherichia coli CFT073
acuucgccacagcggcau

SEQ ID NO: 2624461 - RNA, 14 nt, Escherichia coli CFT073
acuucgccagcgug

SEQ ID NO: 2624462 - RNA, 24 nt, Escherichia coli CFT073
acuucgccagcgugacuauuaaaa

SEQ ID NO: 2624463 - RNA, 22 nt, Escherichia coli CFT073
acuucgccaucagcgccugaug

SEQ ID NO: 2624464 - RNA, 14 nt, Escherichia coli CFT073
acuucgcuaccggc

SEQ ID NO: 2624465 - RNA, 17 nt, Escherichia coli CFT073
acuucgcucuuaucacc

SEQ ID NO: 2624466 - RNA, 22 nt, Escherichia coli CFT073
acuucgcugguguacugcaacu

SEQ ID NO: 2624467 - RNA, 15 nt, Escherichia coli CFT073
acuucggcagagaaa

SEQ ID NO: 2624468 - RNA, 22 nt, Escherichia coli CFT073
acuucggcagagaaagcaaaaa

SEQ ID NO: 2624469 - RNA, 15 nt, Escherichia coli CFT073
acuucggcaucaaua

SEQ ID NO: 2624470 - RNA, 20 nt, Escherichia coli CFT073
acuucggcaucaauaaagcc

SEQ ID NO: 2624471 - RNA, 12 nt, Escherichia coli CFT073
acuucggcgcga

SEQ ID NO: 2624472 - RNA, 14 nt, Escherichia coli CFT073
acuucuauucacca

SEQ ID NO: 2624473 - RNA, 15 nt, Escherichia coli CFT073
acuucucuucuuccg

SEQ ID NO: 2624474 - RNA, 16 nt, Escherichia coli CFT073
acuucugaucuacagc

SEQ ID NO: 2624475 - RNA, 12 nt, Escherichia coli CFT073
acuucugcugca

SEQ ID NO: 2624476 - RNA, 15 nt, Escherichia coli CFT073
acuucugcugcacga

SEQ ID NO: 2624477 - RNA, 15 nt, Escherichia coli CFT073
acuucugcugugacu

SEQ ID NO: 2624478 - RNA, 20 nt, Escherichia coli CFT073
acuucugcugugacuucagc

SEQ ID NO: 2624479 - RNA, 22 nt, Escherichia coli CFT073
acuucuguuuguagaugcccau

SEQ ID NO: 2624480 - RNA, 24 nt, Escherichia coli CFT073
acuucuuagucccaaacagcagaa

SEQ ID NO: 2624481 - RNA, 22 nt, Escherichia coli CFT073
acuucuucacaucaauauucca

SEQ ID NO: 2624482 - RNA, 16 nt, Escherichia coli CFT073
acuucuucauucaucc

SEQ ID NO: 2624483 - RNA, 18 nt, Escherichia coli CFT073
acuucuuccagcggcagg

SEQ ID NO: 2624484 - RNA, 18 nt, Escherichia coli CFT073
acuucuucuuguucauca

SEQ ID NO: 2624485 - RNA, 19 nt, Escherichia coli CFT073
acuucuuucacgcccgcgu

SEQ ID NO: 2624486 - RNA, 16 nt, Escherichia coli CFT073
acuucuuuuaccuuca

SEQ ID NO: 2624487 - RNA, 14 nt, Escherichia coli CFT073
acuucuuuuugaac

SEQ ID NO: 2624488 - RNA, 16 nt, Escherichia coli CFT073
acuugaacuuaucauc

SEQ ID NO: 2624489 - RNA, 16 nt, Escherichia coli CFT073
acuugacuaagcguuu

SEQ ID NO: 2624490 - RNA, 19 nt, Escherichia coli CFT073
acuugagccgccaccagaa

SEQ ID NO: 2624491 - RNA, 23 nt, Escherichia coli CFT073
acuugccugugaccgcugcugcc

SEQ ID NO: 2624492 - RNA, 14 nt, Escherichia coli CFT073
acuugcggcaccca

SEQ ID NO: 2624493 - RNA, 22 nt, Escherichia coli CFT073
acuugcggucaggugcccgcgu

SEQ ID NO: 2624494 - RNA, 14 nt, Escherichia coli CFT073
acuuggucgaauac

SEQ ID NO: 2624495 - RNA, 21 nt, Escherichia coli CFT073
acuuguaaaaucuucgccacu

SEQ ID NO: 2624496 - RNA, 18 nt, Escherichia coli CFT073
acuuguaccuucagcggc

SEQ ID NO: 2624497 - RNA, 18 nt, Escherichia coli CFT073
acuugugcgcuuguucau

SEQ ID NO: 2624498 - RNA, 18 nt, Escherichia coli CFT073
acuuguuuacaaauaauu

SEQ ID NO: 2624499 - RNA, 23 nt, Escherichia coli CFT073
acuuuaaaaaaauuaauuuuuua

SEQ ID NO: 2624500 - RNA, 18 nt, Escherichia coli CFT073
acuuuaaaaucuuugaaa

SEQ ID NO: 2624501 - RNA, 17 nt, Escherichia coli CFT073
acuuuaaauucagcauu

SEQ ID NO: 2624502 - RNA, 19 nt, Escherichia coli CFT073
acuuuaauaaucucgccuu

SEQ ID NO: 2624503 - RNA, 13 nt, Escherichia coli CFT073
acuuuaaucaccu

SEQ ID NO: 2624504 - RNA, 16 nt, Escherichia coli CFT073
acuuuaauuuugugca

SEQ ID NO: 2624505 - RNA, 19 nt, Escherichia coli CFT073
acuuuaauuuugugcagca

SEQ ID NO: 2624506 - RNA, 20 nt, Escherichia coli CFT073
acuuuaccgguuucaaucca

SEQ ID NO: 2624507 - RNA, 21 nt, Escherichia coli CFT073
acuuuaccgguuucaauccag

SEQ ID NO: 2624508 - RNA, 15 nt, Escherichia coli CFT073
acuuuaccugccuga

SEQ ID NO: 2624509 - RNA, 13 nt, Escherichia coli CFT073
acuuuacgggcaa

SEQ ID NO: 2624510 - RNA, 16 nt, Escherichia coli CFT073
acuuuacucauccccu

SEQ ID NO: 2624511 - RNA, 18 nt, Escherichia coli CFT073
acuuuaugauccagcuug

SEQ ID NO: 2624512 - RNA, 16 nt, Escherichia coli CFT073
acuuuauucaguggca

SEQ ID NO: 2624513 - RNA, 16 nt, Escherichia coli CFT073
acuuucacgccgccaa

SEQ ID NO: 2624514 - RNA, 17 nt, Escherichia coli CFT073
acuuucacgccgccaaa

SEQ ID NO: 2624515 - RNA, 16 nt, Escherichia coli CFT073
acuuucagaccgccga

SEQ ID NO: 2624516 - RNA, 21 nt, Escherichia coli CFT073
acuuucaucgcggucagcugc

SEQ ID NO: 2624517 - RNA, 14 nt, Escherichia coli CFT073
acuuuccagccaca

SEQ ID NO: 2624518 - RNA, 20 nt, Escherichia coli CFT073
acuuuccagccacaguucga

SEQ ID NO: 2624519 - RNA, 14 nt, Escherichia coli CFT073
acuuuccaguucaa

SEQ ID NO: 2624520 - RNA, 16 nt, Escherichia coli CFT073
acuuuccaucuuuccu

SEQ ID NO: 2624521 - RNA, 18 nt, Escherichia coli CFT073
acuuuccaugccaucugc

SEQ ID NO: 2624522 - RNA, 20 nt, Escherichia coli CFT073
acuuuccaugccaucugcca

SEQ ID NO: 2624523 - RNA, 20 nt, Escherichia coli CFT073
acuuuccuaaacuccucgcc

SEQ ID NO: 2624524 - RNA, 13 nt, Escherichia coli CFT073
acuuuccuuccuc

SEQ ID NO: 2624525 - RNA, 21 nt, Escherichia coli CFT073
acuuucgagcaauuuuccuug

SEQ ID NO: 2624526 - RNA, 16 nt, Escherichia coli CFT073
acuuucgccaguucuu

SEQ ID NO: 2624527 - RNA, 19 nt, Escherichia coli CFT073
acuuucggcaaccucgccc

SEQ ID NO: 2624528 - RNA, 22 nt, Escherichia coli CFT073
acuuucggcagaaaauccacca

SEQ ID NO: 2624529 - RNA, 18 nt, Escherichia coli CFT073
acuuucucacaagcccag

SEQ ID NO: 2624530 - RNA, 19 nt, Escherichia coli CFT073
acuuucucacaagcccagg

SEQ ID NO: 2624531 - RNA, 18 nt, Escherichia coli CFT073
acuuucucuucaucuaua

SEQ ID NO: 2624532 - RNA, 23 nt, Escherichia coli CFT073
acuuucugaaggauuagacgaau

SEQ ID NO: 2624533 - RNA, 20 nt, Escherichia coli CFT073
acuuucugauuguuauucau

SEQ ID NO: 2624534 - RNA, 15 nt, Escherichia coli CFT073
acuuucugcaaacaa

SEQ ID NO: 2624535 - RNA, 12 nt, Escherichia coli CFT073
acuuucuucagg

SEQ ID NO: 2624536 - RNA, 12 nt, Escherichia coli CFT073
acuuucuugcca

SEQ ID NO: 2624537 - RNA, 14 nt, Escherichia coli CFT073
acuuucuuuucccu

SEQ ID NO: 2624538 - RNA, 22 nt, Escherichia coli CFT073
acuuucuuuuuguugcgcugaa

SEQ ID NO: 2624539 - RNA, 18 nt, Escherichia coli CFT073
acuuugaaggauaagacg

SEQ ID NO: 2624540 - RNA, 9 nt, Escherichia coli CFT073
acuuugaga

SEQ ID NO: 2624541 - RNA, 13 nt, Escherichia coli CFT073
acuuugauuuaua

SEQ ID NO: 2624542 - RNA, 17 nt, Escherichia coli CFT073
acuuugccgucugccac

SEQ ID NO: 2624543 - RNA, 11 nt, Escherichia coli CFT073
acuuugccugg

SEQ ID NO: 2624544 - RNA, 12 nt, Escherichia coli CFT073
acuuugccuggc

SEQ ID NO: 2624545 - RNA, 22 nt, Escherichia coli CFT073
acuuuggugaaugccugaucaa

SEQ ID NO: 2624546 - RNA, 19 nt, Escherichia coli CFT073
acuuuguaaggaguuuugu

SEQ ID NO: 2624547 - RNA, 16 nt, Escherichia coli CFT073
acuuuguaccagcggg

SEQ ID NO: 2624548 - RNA, 15 nt, Escherichia coli CFT073
acuuuguaggccuga

SEQ ID NO: 2624549 - RNA, 18 nt, Escherichia coli CFT073
acuuuguaggccugauaa

SEQ ID NO: 2624550 - RNA, 19 nt, Escherichia coli CFT073
acuuuguaggccugauaag

SEQ ID NO: 2624551 - RNA, 21 nt, Escherichia coli CFT073
acuuugucaucagucagagcc

SEQ ID NO: 2624552 - RNA, 19 nt, Escherichia coli CFT073
acuuugugucagugucaga

SEQ ID NO: 2624553 - RNA, 16 nt, Escherichia coli CFT073
acuuuguuccugaauu

SEQ ID NO: 2624554 - RNA, 17 nt, Escherichia coli CFT073
acuuuguugaacacaac

SEQ ID NO: 2624555 - RNA, 17 nt, Escherichia coli CFT073
acuuuguuguuuaccaa

SEQ ID NO: 2624556 - RNA, 17 nt, Escherichia coli CFT073
acuuuuaaaucgccaag

SEQ ID NO: 2624557 - RNA, 17 nt, Escherichia coli CFT073
acuuuuaaauugaagag

SEQ ID NO: 2624558 - RNA, 14 nt, Escherichia coli CFT073
acuuuuauuucacc

SEQ ID NO: 2624559 - RNA, 13 nt, Escherichia coli CFT073
acuuuucagauug

SEQ ID NO: 2624560 - RNA, 21 nt, Escherichia coli CFT073
acuuuucaggcuagccgccag

SEQ ID NO: 2624561 - RNA, 20 nt, Escherichia coli CFT073
acuuuuccuuugcgcgucac

SEQ ID NO: 2624562 - RNA, 16 nt, Escherichia coli CFT073
acuuuucgcacugcag

SEQ ID NO: 2624563 - RNA, 18 nt, Escherichia coli CFT073
acuuuucggcaaccgcau

SEQ ID NO: 2624564 - RNA, 12 nt, Escherichia coli CFT073
acuuuugauugu

SEQ ID NO: 2624565 - RNA, 15 nt, Escherichia coli CFT073
acuuuugcccggcau

SEQ ID NO: 2624566 - RNA, 21 nt, Escherichia coli CFT073
acuuuuuauccgguaaugcca

SEQ ID NO: 2624567 - RNA, 19 nt, Escherichia coli CFT073
acuuuuuauuuacucuccu

SEQ ID NO: 2624568 - RNA, 12 nt, Escherichia coli CFT073
acuuuuuuuccg

SEQ ID NO: 2624569 - RNA, 16 nt, Escherichia coli CFT073
agaaaaaaagcaucug

SEQ ID NO: 2624570 - RNA, 12 nt, Escherichia coli CFT073
agaaaaaucucc

SEQ ID NO: 2624571 - RNA, 13 nt, Escherichia coli CFT073
agaaaaauucaac

SEQ ID NO: 2624572 - RNA, 15 nt, Escherichia coli CFT073
agaaaacauuuuaaa

SEQ ID NO: 2624573 - RNA, 22 nt, Escherichia coli CFT073
agaaaaccaaaaccggcucuau

SEQ ID NO: 2624574 - RNA, 20 nt, Escherichia coli CFT073
agaaaacuaucugaaaauga

SEQ ID NO: 2624575 - RNA, 19 nt, Escherichia coli CFT073
agaaaacuuaucuuauucc

SEQ ID NO: 2624576 - RNA, 22 nt, Escherichia coli CFT073
agaaaagaacuauugaagccca

SEQ ID NO: 2624577 - RNA, 19 nt, Escherichia coli CFT073
agaaaagaccagccagcaa

SEQ ID NO: 2624578 - RNA, 16 nt, Escherichia coli CFT073
agaaaagcuguaaggu

SEQ ID NO: 2624579 - RNA, 22 nt, Escherichia coli CFT073
agaaaauacucagcaccccgag

SEQ ID NO: 2624580 - RNA, 13 nt, Escherichia coli CFT073
agaaaaucacggc

SEQ ID NO: 2624581 - RNA, 11 nt, Escherichia coli CFT073
agaaaauccag

SEQ ID NO: 2624582 - RNA, 12 nt, Escherichia coli CFT073
agaaaauccagc

SEQ ID NO: 2624583 - RNA, 16 nt, Escherichia coli CFT073
agaaaaucgugccaga

SEQ ID NO: 2624584 - RNA, 21 nt, Escherichia coli CFT073
agaaaaucguuggucugcaga

SEQ ID NO: 2624585 - RNA, 24 nt, Escherichia coli CFT073
agaaaaugagcguauagagcagcg

SEQ ID NO: 2624586 - RNA, 16 nt, Escherichia coli CFT073
agaaaauguauuucau

SEQ ID NO: 2624587 - RNA, 19 nt, Escherichia coli CFT073
agaaaauguauuucaucau

SEQ ID NO: 2624588 - RNA, 19 nt, Escherichia coli CFT073
agaaaauuuuagggaagua

SEQ ID NO: 2624589 - RNA, 15 nt, Escherichia coli CFT073
agaaacaccagaaug

SEQ ID NO: 2624590 - RNA, 12 nt, Escherichia coli CFT073
agaaacaccguc

SEQ ID NO: 2624591 - RNA, 12 nt, Escherichia coli CFT073
agaaacaucauc

SEQ ID NO: 2624592 - RNA, 15 nt, Escherichia coli CFT073
agaaacaucaucccc

SEQ ID NO: 2624593 - RNA, 18 nt, Escherichia coli CFT073
agaaacaucggcaguaau

SEQ ID NO: 2624594 - RNA, 15 nt, Escherichia coli CFT073
agaaaccagccacgg

SEQ ID NO: 2624595 - RNA, 14 nt, Escherichia coli CFT073
agaaacccggccac

SEQ ID NO: 2624596 - RNA, 15 nt, Escherichia coli CFT073
agaaacgagcguacu

SEQ ID NO: 2624597 - RNA, 17 nt, Escherichia coli CFT073
agaaacgccagcagcag

SEQ ID NO: 2624598 - RNA, 16 nt, Escherichia coli CFT073
agaaacgccaucugaa

SEQ ID NO: 2624599 - RNA, 23 nt, Escherichia coli CFT073
agaaacgcgcggcaaugggguuu

SEQ ID NO: 2624600 - RNA, 20 nt, Escherichia coli CFT073
agaaacgcucauaaauugca

SEQ ID NO: 2624601 - RNA, 20 nt, Escherichia coli CFT073
agaaacgcuggugaaaucag

SEQ ID NO: 2624602 - RNA, 15 nt, Escherichia coli CFT073
agaaacucugcggca

SEQ ID NO: 2624603 - RNA, 23 nt, Escherichia coli CFT073
agaaagacgguuaacgccagcca

SEQ ID NO: 2624604 - RNA, 16 nt, Escherichia coli CFT073
agaaagcgccagcaag

SEQ ID NO: 2624605 - RNA, 23 nt, Escherichia coli CFT073
agaaagcugcugaccaccagcac

SEQ ID NO: 2624606 - RNA, 16 nt, Escherichia coli CFT073
agaaaggcgggaauaa

SEQ ID NO: 2624607 - RNA, 17 nt, Escherichia coli CFT073
agaaaggcguuguccuu

SEQ ID NO: 2624608 - RNA, 14 nt, Escherichia coli CFT073
agaaagggaagaac

SEQ ID NO: 2624609 - RNA, 19 nt, Escherichia coli CFT073
agaaagggaagaacaucac

SEQ ID NO: 2624610 - RNA, 15 nt, Escherichia coli CFT073
agaaaguaaauuauu

SEQ ID NO: 2624611 - RNA, 22 nt, Escherichia coli CFT073
agaaaguaacaauagcgaacag

SEQ ID NO: 2624612 - RNA, 18 nt, Escherichia coli CFT073
agaaaguaauuacgcccu

SEQ ID NO: 2624613 - RNA, 23 nt, Escherichia coli CFT073
agaaagucgagugaacccccuga

SEQ ID NO: 2624614 - RNA, 16 nt, Escherichia coli CFT073
agaaagucguaggccu

SEQ ID NO: 2624615 - RNA, 22 nt, Escherichia coli CFT073
agaaagucguaggccugauaag

SEQ ID NO: 2624616 - RNA, 16 nt, Escherichia coli CFT073
agaaaguggcacacac

SEQ ID NO: 2624617 - RNA, 21 nt, Escherichia coli CFT073
agaaaguucgacaacuuuugc

SEQ ID NO: 2624618 - RNA, 22 nt, Escherichia coli CFT073
agaaaguugccagauaaauauu

SEQ ID NO: 2624619 - RNA, 13 nt, Escherichia coli CFT073
agaaaguuguuuu

SEQ ID NO: 2624620 - RNA, 14 nt, Escherichia coli CFT073
agaaaguuuuucaa

SEQ ID NO: 2624621 - RNA, 22 nt, Escherichia coli CFT073
agaaauaaccgaaucguuuuuu

SEQ ID NO: 2624622 - RNA, 16 nt, Escherichia coli CFT073
agaaauaccccgccag

SEQ ID NO: 2624623 - RNA, 17 nt, Escherichia coli CFT073
agaaauaccccgccagc

SEQ ID NO: 2624624 - RNA, 14 nt, Escherichia coli CFT073
agaaauauaaagaa

SEQ ID NO: 2624625 - RNA, 18 nt, Escherichia coli CFT073
agaaauauugcagcgaug

SEQ ID NO: 2624626 - RNA, 13 nt, Escherichia coli CFT073
agaaaucaacaaa

SEQ ID NO: 2624627 - RNA, 15 nt, Escherichia coli CFT073
agaaaucaacaaauu

SEQ ID NO: 2624628 - RNA, 22 nt, Escherichia coli CFT073
agaaaucagauaaaacaggcgg

SEQ ID NO: 2624629 - RNA, 13 nt, Escherichia coli CFT073
agaaaucagcagg

SEQ ID NO: 2624630 - RNA, 22 nt, Escherichia coli CFT073
agaaaucccccagcaucacgcc

SEQ ID NO: 2624631 - RNA, 21 nt, Escherichia coli CFT073
agaaaucgacauugaugaaaa

SEQ ID NO: 2624632 - RNA, 16 nt, Escherichia coli CFT073
agaaaugccaguaacu

SEQ ID NO: 2624633 - RNA, 19 nt, Escherichia coli CFT073
agaaauggcuggcagcaga

SEQ ID NO: 2624634 - RNA, 14 nt, Escherichia coli CFT073
agaaauuaaacugu

SEQ ID NO: 2624635 - RNA, 17 nt, Escherichia coli CFT073
agaacaaccaagacuau

SEQ ID NO: 2624636 - RNA, 18 nt, Escherichia coli CFT073
agaacaagauugccugau

SEQ ID NO: 2624637 - RNA, 16 nt, Escherichia coli CFT073
agaacacgcucccagc

SEQ ID NO: 2624638 - RNA, 21 nt, Escherichia coli CFT073
agaacacgcucccagcaguga

SEQ ID NO: 2624639 - RNA, 19 nt, Escherichia coli CFT073
agaacacuguuaccgcugc

SEQ ID NO: 2624640 - RNA, 20 nt, Escherichia coli CFT073
agaacagaaauggcuggcag

SEQ ID NO: 2624641 - RNA, 17 nt, Escherichia coli CFT073
agaacagccccaacggu

SEQ ID NO: 2624642 - RNA, 17 nt, Escherichia coli CFT073
agaacauaaacacccac

SEQ ID NO: 2624643 - RNA, 15 nt, Escherichia coli CFT073
agaacauaaacagcg

SEQ ID NO: 2624644 - RNA, 16 nt, Escherichia coli CFT073
agaacaucaauccaaa

SEQ ID NO: 2624645 - RNA, 16 nt, Escherichia coli CFT073
agaacaucauccccac

SEQ ID NO: 2624646 - RNA, 16 nt, Escherichia coli CFT073
agaacaugucauagca

SEQ ID NO: 2624647 - RNA, 19 nt, Escherichia coli CFT073
agaacaugucauagcaaua

SEQ ID NO: 2624648 - RNA, 18 nt, Escherichia coli CFT073
agaacauucaucauuuca

SEQ ID NO: 2624649 - RNA, 16 nt, Escherichia coli CFT073
agaaccagcgcacaga

SEQ ID NO: 2624650 - RNA, 13 nt, Escherichia coli CFT073
agaaccagcugcc

SEQ ID NO: 2624651 - RNA, 21 nt, Escherichia coli CFT073
agaaccagggaaaaaagcccc

SEQ ID NO: 2624652 - RNA, 13 nt, Escherichia coli CFT073
agaaccccagcca

SEQ ID NO: 2624653 - RNA, 16 nt, Escherichia coli CFT073
agaacccggcaauggu

SEQ ID NO: 2624654 - RNA, 17 nt, Escherichia coli CFT073
agaacccggcaaugguc

SEQ ID NO: 2624655 - RNA, 16 nt, Escherichia coli CFT073
agaacccuuucaccaa

SEQ ID NO: 2624656 - RNA, 18 nt, Escherichia coli CFT073
agaaccgcacagguugca

SEQ ID NO: 2624657 - RNA, 22 nt, Escherichia coli CFT073
agaaccgcacagguugcacgga

SEQ ID NO: 2624658 - RNA, 19 nt, Escherichia coli CFT073
agaaccgcaccgacggugu

SEQ ID NO: 2624659 - RNA, 20 nt, Escherichia coli CFT073
agaaccgccgcugucugaau

SEQ ID NO: 2624660 - RNA, 23 nt, Escherichia coli CFT073
agaaccgccgcugucugaaugau

SEQ ID NO: 2624661 - RNA, 15 nt, Escherichia coli CFT073
agaaccuaagaacca

SEQ ID NO: 2624662 - RNA, 19 nt, Escherichia coli CFT073
agaacgacccucagcugcc

SEQ ID NO: 2624663 - RNA, 18 nt, Escherichia coli CFT073
agaacgaugaagucgauc

SEQ ID NO: 2624664 - RNA, 23 nt, Escherichia coli CFT073
agaacgcagcauuuccucaacau

SEQ ID NO: 2624665 - RNA, 19 nt, Escherichia coli CFT073
agaacgccaugccaaagaa

SEQ ID NO: 2624666 - RNA, 20 nt, Escherichia coli CFT073
agaacgcgccuuaaaaacca

SEQ ID NO: 2624667 - RNA, 12 nt, Escherichia coli CFT073
agaacgcugcaa

SEQ ID NO: 2624668 - RNA, 23 nt, Escherichia coli CFT073
agaacgcugcaauuuauugaauu

SEQ ID NO: 2624669 - RNA, 21 nt, Escherichia coli CFT073
agaacggcagagaaaccacau

SEQ ID NO: 2624670 - RNA, 22 nt, Escherichia coli CFT073
agaacggcgcaccagaauaccu

SEQ ID NO: 2624671 - RNA, 19 nt, Escherichia coli CFT073
agaacggggcuauaccaga

SEQ ID NO: 2624672 - RNA, 22 nt, Escherichia coli CFT073
agaacggugcgaccaaacugcu

SEQ ID NO: 2624673 - RNA, 16 nt, Escherichia coli CFT073
agaacguaaucaacgc

SEQ ID NO: 2624674 - RNA, 20 nt, Escherichia coli CFT073
agaacguacacagcccgaca

SEQ ID NO: 2624675 - RNA, 22 nt, Escherichia coli CFT073
agaacguccgcaggaugagcgc

SEQ ID NO: 2624676 - RNA, 15 nt, Escherichia coli CFT073
agaacgucgcaggga

SEQ ID NO: 2624677 - RNA, 17 nt, Escherichia coli CFT073
agaacuaguagcaugaa

SEQ ID NO: 2624678 - RNA, 20 nt, Escherichia coli CFT073
agaacuaguagcaugaagua

SEQ ID NO: 2624679 - RNA, 22 nt, Escherichia coli CFT073
agaacuccggcgcguugauacc

SEQ ID NO: 2624680 - RNA, 14 nt, Escherichia coli CFT073
agaacucggaagca

SEQ ID NO: 2624681 - RNA, 20 nt, Escherichia coli CFT073
agaacugcaacucaccuuua

SEQ ID NO: 2624682 - RNA, 18 nt, Escherichia coli CFT073
agaacugcggcagguuga

SEQ ID NO: 2624683 - RNA, 20 nt, Escherichia coli CFT073
agaacugguagcgcauuuca

SEQ ID NO: 2624684 - RNA, 15 nt, Escherichia coli CFT073
agaacugugccagac

SEQ ID NO: 2624685 - RNA, 14 nt, Escherichia coli CFT073
agaagaaagccgga

SEQ ID NO: 2624686 - RNA, 14 nt, Escherichia coli CFT073
agaagaauaucucc

SEQ ID NO: 2624687 - RNA, 14 nt, Escherichia coli CFT073
agaagacugugauu

SEQ ID NO: 2624688 - RNA, 15 nt, Escherichia coli CFT073
agaagagacuaacau

SEQ ID NO: 2624689 - RNA, 12 nt, Escherichia coli CFT073
agaagaggagag

SEQ ID NO: 2624690 - RNA, 18 nt, Escherichia coli CFT073
agaagagugaccauacau

SEQ ID NO: 2624691 - RNA, 13 nt, Escherichia coli CFT073
agaagauccauga

SEQ ID NO: 2624692 - RNA, 21 nt, Escherichia coli CFT073
agaagauccaugaagcaauga

SEQ ID NO: 2624693 - RNA, 20 nt, Escherichia coli CFT073
agaagauuuuuugccagcac

SEQ ID NO: 2624694 - RNA, 18 nt, Escherichia coli CFT073
agaagcacuaccuugcuu

SEQ ID NO: 2624695 - RNA, 17 nt, Escherichia coli CFT073
agaagcaucguggauga

SEQ ID NO: 2624696 - RNA, 12 nt, Escherichia coli CFT073
agaagccaccgc

SEQ ID NO: 2624697 - RNA, 23 nt, Escherichia coli CFT073
agaagccaccgcaccacgaccua

SEQ ID NO: 2624698 - RNA, 19 nt, Escherichia coli CFT073
agaagccauuaaacaccag

SEQ ID NO: 2624699 - RNA, 19 nt, Escherichia coli CFT073
agaagccgcuccggcagca

SEQ ID NO: 2624700 - RNA, 22 nt, Escherichia coli CFT073
agaagccgcuccggcagcagca

SEQ ID NO: 2624701 - RNA, 19 nt, Escherichia coli CFT073
agaagcgcagcgcaucagg

SEQ ID NO: 2624702 - RNA, 23 nt, Escherichia coli CFT073
agaagcuccgguacucaucagag

SEQ ID NO: 2624703 - RNA, 23 nt, Escherichia coli CFT073
agaagcugcugccgcuguugcgu

SEQ ID NO: 2624704 - RNA, 14 nt, Escherichia coli CFT073
agaaggaaaauaca

SEQ ID NO: 2624705 - RNA, 16 nt, Escherichia coli CFT073
agaaggauauaaaaau

SEQ ID NO: 2624706 - RNA, 20 nt, Escherichia coli CFT073
agaaggcguucacgccgcau

SEQ ID NO: 2624707 - RNA, 12 nt, Escherichia coli CFT073
agaagggaauau

SEQ ID NO: 2624708 - RNA, 15 nt, Escherichia coli CFT073
agaaguaaaacaguc

SEQ ID NO: 2624709 - RNA, 21 nt, Escherichia coli CFT073
agaagucggcuuuuagcgaca

SEQ ID NO: 2624710 - RNA, 16 nt, Escherichia coli CFT073
agaagugcucuuugcc

SEQ ID NO: 2624711 - RNA, 13 nt, Escherichia coli CFT073
agaaguucuccau

SEQ ID NO: 2624712 - RNA, 12 nt, Escherichia coli CFT073
agaauaaaacaa

SEQ ID NO: 2624713 - RNA, 14 nt, Escherichia coli CFT073
agaauaaaacaagc

SEQ ID NO: 2624714 - RNA, 16 nt, Escherichia coli CFT073
agaauaaaacaagcag

SEQ ID NO: 2624715 - RNA, 23 nt, Escherichia coli CFT073
agaauaaaacaagcagcugccag

SEQ ID NO: 2624716 - RNA, 19 nt, Escherichia coli CFT073
agaauaacgcggcaggaga

SEQ ID NO: 2624717 - RNA, 22 nt, Escherichia coli CFT073
agaauaacggcugauaacaaua

SEQ ID NO: 2624718 - RNA, 20 nt, Escherichia coli CFT073
agaauaagcuauaaaaaaac

SEQ ID NO: 2624719 - RNA, 15 nt, Escherichia coli CFT073
agaauaaugccuuua

SEQ ID NO: 2624720 - RNA, 13 nt, Escherichia coli CFT073
agaauacccagca

SEQ ID NO: 2624721 - RNA, 18 nt, Escherichia coli CFT073
agaauacccgaagcgcca

SEQ ID NO: 2624722 - RNA, 22 nt, Escherichia coli CFT073
agaauaccuugcugcuccagcg

SEQ ID NO: 2624723 - RNA, 17 nt, Escherichia coli CFT073
agaauacgccccagaau

SEQ ID NO: 2624724 - RNA, 20 nt, Escherichia coli CFT073
agaauacuucacaugauaau

SEQ ID NO: 2624725 - RNA, 20 nt, Escherichia coli CFT073
agaauaguguuaaccgguac

SEQ ID NO: 2624726 - RNA, 19 nt, Escherichia coli CFT073
agaauaucguuguuggcuu

SEQ ID NO: 2624727 - RNA, 15 nt, Escherichia coli CFT073
agaauaucuucuguu

SEQ ID NO: 2624728 - RNA, 20 nt, Escherichia coli CFT073
agaauauguuuuuaaaccaa

SEQ ID NO: 2624729 - RNA, 19 nt, Escherichia coli CFT073
agaauauugccgaagacca

SEQ ID NO: 2624730 - RNA, 18 nt, Escherichia coli CFT073
agaaucaaacugccguua

SEQ ID NO: 2624731 - RNA, 16 nt, Escherichia coli CFT073
agaaucaacgauguca

SEQ ID NO: 2624732 - RNA, 15 nt, Escherichia coli CFT073
agaaucaaucucagc

SEQ ID NO: 2624733 - RNA, 17 nt, Escherichia coli CFT073
agaaucaccggagcugc

SEQ ID NO: 2624734 - RNA, 13 nt, Escherichia coli CFT073
agaaucaccucuu

SEQ ID NO: 2624735 - RNA, 14 nt, Escherichia coli CFT073
agaaucacgccaac

SEQ ID NO: 2624736 - RNA, 20 nt, Escherichia coli CFT073
agaaucacgccaacaaauag

SEQ ID NO: 2624737 - RNA, 20 nt, Escherichia coli CFT073
agaaucaucauaucgucauu

SEQ ID NO: 2624738 - RNA, 13 nt, Escherichia coli CFT073
agaaucauccagg

SEQ ID NO: 2624739 - RNA, 16 nt, Escherichia coli CFT073
agaaucaugccaaaaa

SEQ ID NO: 2624740 - RNA, 13 nt, Escherichia coli CFT073
agaaucaugucag

SEQ ID NO: 2624741 - RNA, 16 nt, Escherichia coli CFT073
agaauccagccccacc

SEQ ID NO: 2624742 - RNA, 20 nt, Escherichia coli CFT073
agaauccagccccaccagca

SEQ ID NO: 2624743 - RNA, 16 nt, Escherichia coli CFT073
agaauccccacugcau

SEQ ID NO: 2624744 - RNA, 18 nt, Escherichia coli CFT073
agaauccgcccucuucca

SEQ ID NO: 2624745 - RNA, 16 nt, Escherichia coli CFT073
agaauccggugccuua

SEQ ID NO: 2624746 - RNA, 16 nt, Escherichia coli CFT073
agaaucgacaccaguu

SEQ ID NO: 2624747 - RNA, 22 nt, Escherichia coli CFT073
agaaucgagcaauaaacacugc

SEQ ID NO: 2624748 - RNA, 21 nt, Escherichia coli CFT073
agaaucgccagcaucggcaac

SEQ ID NO: 2624749 - RNA, 15 nt, Escherichia coli CFT073
agaaucggaugaccc

SEQ ID NO: 2624750 - RNA, 17 nt, Escherichia coli CFT073
agaaucguaaagaucug

SEQ ID NO: 2624751 - RNA, 18 nt, Escherichia coli CFT073
agaaucuaagaucccugc

SEQ ID NO: 2624752 - RNA, 12 nt, Escherichia coli CFT073
agaaucucugcg

SEQ ID NO: 2624753 - RNA, 19 nt, Escherichia coli CFT073
agaaucucuuuuguuuccc

SEQ ID NO: 2624754 - RNA, 19 nt, Escherichia coli CFT073
agaaugaaugauacagaaa

SEQ ID NO: 2624755 - RNA, 17 nt, Escherichia coli CFT073
agaaugacaucaucgcc

SEQ ID NO: 2624756 - RNA, 18 nt, Escherichia coli CFT073
agaaugacaucaucgccc

SEQ ID NO: 2624757 - RNA, 14 nt, Escherichia coli CFT073
agaaugcagcagca

SEQ ID NO: 2624758 - RNA, 10 nt, Escherichia coli CFT073
agaaugccag

SEQ ID NO: 2624759 - RNA, 15 nt, Escherichia coli CFT073
agaaugccagcagca

SEQ ID NO: 2624760 - RNA, 11 nt, Escherichia coli CFT073
agaaugcccca

SEQ ID NO: 2624761 - RNA, 16 nt, Escherichia coli CFT073
agaaugccgaaaucaa

SEQ ID NO: 2624762 - RNA, 21 nt, Escherichia coli CFT073
agaaugcgcgcgaaaacaucg

SEQ ID NO: 2624763 - RNA, 19 nt, Escherichia coli CFT073
agaaugcucgcuggcaggc

SEQ ID NO: 2624764 - RNA, 13 nt, Escherichia coli CFT073
agaauggugccga

SEQ ID NO: 2624765 - RNA, 17 nt, Escherichia coli CFT073
agaaugguuucauucca

SEQ ID NO: 2624766 - RNA, 15 nt, Escherichia coli CFT073
agaaugguuucgcuu

SEQ ID NO: 2624767 - RNA, 11 nt, Escherichia coli CFT073
agaauguagau

SEQ ID NO: 2624768 - RNA, 13 nt, Escherichia coli CFT073
agaaugugaugcc

SEQ ID NO: 2624769 - RNA, 16 nt, Escherichia coli CFT073
agaauuaaaauaucag

SEQ ID NO: 2624770 - RNA, 14 nt, Escherichia coli CFT073
agaauuaacgcuga

SEQ ID NO: 2624771 - RNA, 14 nt, Escherichia coli CFT073
agaauuccggcaga

SEQ ID NO: 2624772 - RNA, 21 nt, Escherichia coli CFT073
agaauuccgugccagcaccaa

SEQ ID NO: 2624773 - RNA, 15 nt, Escherichia coli CFT073
agaauugaccaguaa

SEQ ID NO: 2624774 - RNA, 17 nt, Escherichia coli CFT073
agaauugaccaguaaua

SEQ ID NO: 2624775 - RNA, 16 nt, Escherichia coli CFT073
agaauuuccagaaagu

SEQ ID NO: 2624776 - RNA, 12 nt, Escherichia coli CFT073
agaauuucucag

SEQ ID NO: 2624777 - RNA, 15 nt, Escherichia coli CFT073
agaauuuucgcugga

SEQ ID NO: 2624778 - RNA, 20 nt, Escherichia coli CFT073
agacaaaacauacccaguuu

SEQ ID NO: 2624779 - RNA, 17 nt, Escherichia coli CFT073
agacaaaauccugccag

SEQ ID NO: 2624780 - RNA, 11 nt, Escherichia coli CFT073
agacaaauaac

SEQ ID NO: 2624781 - RNA, 22 nt, Escherichia coli CFT073
agacaaauaacgagcgagaaua

SEQ ID NO: 2624782 - RNA, 22 nt, Escherichia coli CFT073
agacaaaugucagaaagaaauu

SEQ ID NO: 2624783 - RNA, 13 nt, Escherichia coli CFT073
agacaacauugau

SEQ ID NO: 2624784 - RNA, 21 nt, Escherichia coli CFT073
agacaacauugauuucuuauu

SEQ ID NO: 2624785 - RNA, 11 nt, Escherichia coli CFT073
agacaaggcga

SEQ ID NO: 2624786 - RNA, 16 nt, Escherichia coli CFT073
agacaauccagcgaaa

SEQ ID NO: 2624787 - RNA, 12 nt, Escherichia coli CFT073
agacaauccccg

SEQ ID NO: 2624788 - RNA, 14 nt, Escherichia coli CFT073
agacaaucugugug

SEQ ID NO: 2624789 - RNA, 19 nt, Escherichia coli CFT073
agacaaugcaaacggcgcg

SEQ ID NO: 2624790 - RNA, 20 nt, Escherichia coli CFT073
agacaauguaucuuucauca

SEQ ID NO: 2624791 - RNA, 21 nt, Escherichia coli CFT073
agacaauguaucuuucaucau

SEQ ID NO: 2624792 - RNA, 22 nt, Escherichia coli CFT073
agacaauguaucuuucaucauu

SEQ ID NO: 2624793 - RNA, 23 nt, Escherichia coli CFT073
agacaauuacucgccuuucacac

SEQ ID NO: 2624794 - RNA, 17 nt, Escherichia coli CFT073
agacacaacaauaccgu

SEQ ID NO: 2624795 - RNA, 22 nt, Escherichia coli CFT073
agacacacugucaaucgcacgc

SEQ ID NO: 2624796 - RNA, 23 nt, Escherichia coli CFT073
agacaccaaucagcccugcccag

SEQ ID NO: 2624797 - RNA, 15 nt, Escherichia coli CFT073
agacaccauguccau

SEQ ID NO: 2624798 - RNA, 14 nt, Escherichia coli CFT073
agacaccggcgcac

SEQ ID NO: 2624799 - RNA, 18 nt, Escherichia coli CFT073
agacaccuugcaacuccg

SEQ ID NO: 2624800 - RNA, 19 nt, Escherichia coli CFT073
agacacgccagugucgcau

SEQ ID NO: 2624801 - RNA, 21 nt, Escherichia coli CFT073
agacacgccgccagaccaaua

SEQ ID NO: 2624802 - RNA, 19 nt, Escherichia coli CFT073
agacacugcgaucgcccgc

SEQ ID NO: 2624803 - RNA, 13 nt, Escherichia coli CFT073
agacacuggaaac

SEQ ID NO: 2624804 - RNA, 17 nt, Escherichia coli CFT073
agacacuggaaacagcc

SEQ ID NO: 2624805 - RNA, 19 nt, Escherichia coli CFT073
agacacuggaaacagccaa

SEQ ID NO: 2624806 - RNA, 20 nt, Escherichia coli CFT073
agacacuggaaacagccaau

SEQ ID NO: 2624807 - RNA, 15 nt, Escherichia coli CFT073
agacagacagccuca

SEQ ID NO: 2624808 - RNA, 21 nt, Escherichia coli CFT073
agacagaccaaaacgugcagc

SEQ ID NO: 2624809 - RNA, 15 nt, Escherichia coli CFT073
agacagaccuggcgc

SEQ ID NO: 2624810 - RNA, 21 nt, Escherichia coli CFT073
agacagauguaaguaauuauu

SEQ ID NO: 2624811 - RNA, 20 nt, Escherichia coli CFT073
agacagauuuauaaaaucca

SEQ ID NO: 2624812 - RNA, 20 nt, Escherichia coli CFT073
agacagcaucgaccaugcug

SEQ ID NO: 2624813 - RNA, 23 nt, Escherichia coli CFT073
agacagcguaauagccugaugua

SEQ ID NO: 2624814 - RNA, 15 nt, Escherichia coli CFT073
agacagcgucacauc

SEQ ID NO: 2624815 - RNA, 17 nt, Escherichia coli CFT073
agacagcgucacaucag

SEQ ID NO: 2624816 - RNA, 21 nt, Escherichia coli CFT073
agacauacuggcuucgauacc

SEQ ID NO: 2624817 - RNA, 23 nt, Escherichia coli CFT073
agacauacuggcuucgauaccgu

SEQ ID NO: 2624818 - RNA, 19 nt, Escherichia coli CFT073
agacauagcacauaaaaug

SEQ ID NO: 2624819 - RNA, 20 nt, Escherichia coli CFT073
agacauagggaaacuccagc

SEQ ID NO: 2624820 - RNA, 21 nt, Escherichia coli CFT073
agacauagggaaacuccagcc

SEQ ID NO: 2624821 - RNA, 14 nt, Escherichia coli CFT073
agacaucaucguga

SEQ ID NO: 2624822 - RNA, 17 nt, Escherichia coli CFT073
agacaucccuuuauuca

SEQ ID NO: 2624823 - RNA, 22 nt, Escherichia coli CFT073
agacaucgcccgauucacauaa

SEQ ID NO: 2624824 - RNA, 15 nt, Escherichia coli CFT073
agacaucgcuggagg

SEQ ID NO: 2624825 - RNA, 18 nt, Escherichia coli CFT073
agacaugcugacaaaaua

SEQ ID NO: 2624826 - RNA, 14 nt, Escherichia coli CFT073
agacaugguaaaac

SEQ ID NO: 2624827 - RNA, 16 nt, Escherichia coli CFT073
agacauuacaaaauac

SEQ ID NO: 2624828 - RNA, 17 nt, Escherichia coli CFT073
agacauuacaaaauaca

SEQ ID NO: 2624829 - RNA, 22 nt, Escherichia coli CFT073
agacauuacguccaucacaauc

SEQ ID NO: 2624830 - RNA, 19 nt, Escherichia coli CFT073
agacauuccccgccaggaa

SEQ ID NO: 2624831 - RNA, 19 nt, Escherichia coli CFT073
agacauuggcaaaaccaaa

SEQ ID NO: 2624832 - RNA, 21 nt, Escherichia coli CFT073
agaccaaaacgugcagcugcc

SEQ ID NO: 2624833 - RNA, 12 nt, Escherichia coli CFT073
agaccaaaccau

SEQ ID NO: 2624834 - RNA, 17 nt, Escherichia coli CFT073
agaccaaagucaaacug

SEQ ID NO: 2624835 - RNA, 18 nt, Escherichia coli CFT073
agaccaacacccacagcc

SEQ ID NO: 2624836 - RNA, 16 nt, Escherichia coli CFT073
agaccaauccgccagc

SEQ ID NO: 2624837 - RNA, 18 nt, Escherichia coli CFT073
agaccaauggcuuuugcc

SEQ ID NO: 2624838 - RNA, 21 nt, Escherichia coli CFT073
agaccacaaucaacgccacca

SEQ ID NO: 2624839 - RNA, 21 nt, Escherichia coli CFT073
agaccacucauuuuuucgguu

SEQ ID NO: 2624840 - RNA, 15 nt, Escherichia coli CFT073
agaccacucucuggc

SEQ ID NO: 2624841 - RNA, 23 nt, Escherichia coli CFT073
agaccacucucuggcaacuuugu

SEQ ID NO: 2624842 - RNA, 23 nt, Escherichia coli CFT073
agaccagacuuggucgguauuuc

SEQ ID NO: 2624843 - RNA, 19 nt, Escherichia coli CFT073
agaccagauuaaucagcag

SEQ ID NO: 2624844 - RNA, 20 nt, Escherichia coli CFT073
agaccagcaaagugcgcuuu

SEQ ID NO: 2624845 - RNA, 17 nt, Escherichia coli CFT073
agaccagcaauaaaaaa

SEQ ID NO: 2624846 - RNA, 17 nt, Escherichia coli CFT073
agaccagccagcaaugu

SEQ ID NO: 2624847 - RNA, 20 nt, Escherichia coli CFT073
agaccaggaugcuucaacga

SEQ ID NO: 2624848 - RNA, 13 nt, Escherichia coli CFT073
agaccaucggcgc

SEQ ID NO: 2624849 - RNA, 19 nt, Escherichia coli CFT073
agacccacccaacaugguc

SEQ ID NO: 2624850 - RNA, 12 nt, Escherichia coli CFT073
agacccaguuuu

SEQ ID NO: 2624851 - RNA, 13 nt, Escherichia coli CFT073
agaccccaguuuu

SEQ ID NO: 2624852 - RNA, 15 nt, Escherichia coli CFT073
agaccgaacagcaua

SEQ ID NO: 2624853 - RNA, 21 nt, Escherichia coli CFT073
agaccgaagucaaacugauau

SEQ ID NO: 2624854 - RNA, 17 nt, Escherichia coli CFT073
agaccgauacacaucgu

SEQ ID NO: 2624855 - RNA, 19 nt, Escherichia coli CFT073
agaccgauagcagcccaga

SEQ ID NO: 2624856 - RNA, 15 nt, Escherichia coli CFT073
agaccgcgcaguacc

SEQ ID NO: 2624857 - RNA, 16 nt, Escherichia coli CFT073
agaccgcuuuccucau

SEQ ID NO: 2624858 - RNA, 23 nt, Escherichia coli CFT073
agaccggcaaucgcgccagaaca

SEQ ID NO: 2624859 - RNA, 21 nt, Escherichia coli CFT073
agaccguauucggaaauaugc

SEQ ID NO: 2624860 - RNA, 17 nt, Escherichia coli CFT073
agaccguggucggaaaa

SEQ ID NO: 2624861 - RNA, 16 nt, Escherichia coli CFT073
agaccguugcucagaa

SEQ ID NO: 2624862 - RNA, 17 nt, Escherichia coli CFT073
agaccguugcucagaau

SEQ ID NO: 2624863 - RNA, 18 nt, Escherichia coli CFT073
agaccguugcucagaauc

SEQ ID NO: 2624864 - RNA, 20 nt, Escherichia coli CFT073
agaccuaacuuggcaaagcu

SEQ ID NO: 2624865 - RNA, 17 nt, Escherichia coli CFT073
agaccuacggauucaau

SEQ ID NO: 2624866 - RNA, 21 nt, Escherichia coli CFT073
agaccuacggauucaaugcaa

SEQ ID NO: 2624867 - RNA, 22 nt, Escherichia coli CFT073
agaccugaauuugcuccagaaa

SEQ ID NO: 2624868 - RNA, 15 nt, Escherichia coli CFT073
agaccugcgcaucgg

SEQ ID NO: 2624869 - RNA, 22 nt, Escherichia coli CFT073
agaccugcgcaucggucgcguu

SEQ ID NO: 2624870 - RNA, 22 nt, Escherichia coli CFT073
agaccuuaucacaaucggcuuu

SEQ ID NO: 2624871 - RNA, 15 nt, Escherichia coli CFT073
agaccuucugccaga

SEQ ID NO: 2624872 - RNA, 16 nt, Escherichia coli CFT073
agaccuucugccagac

SEQ ID NO: 2624873 - RNA, 17 nt, Escherichia coli CFT073
agacgaaccggcaccca

SEQ ID NO: 2624874 - RNA, 23 nt, Escherichia coli CFT073
agacgaugaaugcaacugcccag

SEQ ID NO: 2624875 - RNA, 17 nt, Escherichia coli CFT073
agacgaugcgucuugcc

SEQ ID NO: 2624876 - RNA, 14 nt, Escherichia coli CFT073
agacgcaacagaaa

SEQ ID NO: 2624877 - RNA, 20 nt, Escherichia coli CFT073
agacgcaacagaaacgccau

SEQ ID NO: 2624878 - RNA, 21 nt, Escherichia coli CFT073
agacgcaaccagcgucgcauc

SEQ ID NO: 2624879 - RNA, 20 nt, Escherichia coli CFT073
agacgcacccucaaaauuuc

SEQ ID NO: 2624880 - RNA, 15 nt, Escherichia coli CFT073
agacgcaguacgcca

SEQ ID NO: 2624881 - RNA, 13 nt, Escherichia coli CFT073
agacgcaucgccc

SEQ ID NO: 2624882 - RNA, 16 nt, Escherichia coli CFT073
agacgcaucgcccagc

SEQ ID NO: 2624883 - RNA, 17 nt, Escherichia coli CFT073
agacgcaucgcccagcc

SEQ ID NO: 2624884 - RNA, 19 nt, Escherichia coli CFT073
agacgcaucgcccagccau

SEQ ID NO: 2624885 - RNA, 20 nt, Escherichia coli CFT073
agacgcaucgcccagccauc

SEQ ID NO: 2624886 - RNA, 23 nt, Escherichia coli CFT073
agacgcaucgcccagccaucgac

SEQ ID NO: 2624887 - RNA, 14 nt, Escherichia coli CFT073
agacgccauugaug

SEQ ID NO: 2624888 - RNA, 20 nt, Escherichia coli CFT073
agacgccccaguaaacacac

SEQ ID NO: 2624889 - RNA, 21 nt, Escherichia coli CFT073
agacgcccgcgcccaggccau

SEQ ID NO: 2624890 - RNA, 20 nt, Escherichia coli CFT073
agacgcgccagcgucgcauc

SEQ ID NO: 2624891 - RNA, 14 nt, Escherichia coli CFT073
agacgcgccgccac

SEQ ID NO: 2624892 - RNA, 17 nt, Escherichia coli CFT073
agacgcgccgccaccgc

SEQ ID NO: 2624893 - RNA, 23 nt, Escherichia coli CFT073
agacgcgcggugaucgggucacc

SEQ ID NO: 2624894 - RNA, 14 nt, Escherichia coli CFT073
agacgcggcaagcg

SEQ ID NO: 2624895 - RNA, 19 nt, Escherichia coli CFT073
agacgcggcacuccgccac

SEQ ID NO: 2624896 - RNA, 20 nt, Escherichia coli CFT073
agacgcggcagcgucgcauc

SEQ ID NO: 2624897 - RNA, 21 nt, Escherichia coli CFT073
agacgcggcagcgucgcauca

SEQ ID NO: 2624898 - RNA, 21 nt, Escherichia coli CFT073
agacgcggcaggcgucgcauc

SEQ ID NO: 2624899 - RNA, 21 nt, Escherichia coli CFT073
agacgcggcccgcgucgcauc

SEQ ID NO: 2624900 - RNA, 21 nt, Escherichia coli CFT073
agacgcgguaaaagcccauca

SEQ ID NO: 2624901 - RNA, 13 nt, Escherichia coli CFT073
agacgcgucagcg

SEQ ID NO: 2624902 - RNA, 20 nt, Escherichia coli CFT073
agacgcgucagcgccgcauc

SEQ ID NO: 2624903 - RNA, 16 nt, Escherichia coli CFT073
agacgcgucagugucu

SEQ ID NO: 2624904 - RNA, 20 nt, Escherichia coli CFT073
agacgcgucugcgucgcauc

SEQ ID NO: 2624905 - RNA, 19 nt, Escherichia coli CFT073
agacgcguggcgucgcauc

SEQ ID NO: 2624906 - RNA, 19 nt, Escherichia coli CFT073
agacgcguuaauaccugau

SEQ ID NO: 2624907 - RNA, 20 nt, Escherichia coli CFT073
agacgcguuagcgucgcauc

SEQ ID NO: 2624908 - RNA, 21 nt, Escherichia coli CFT073
agacgcguuagcgucgcauca

SEQ ID NO: 2624909 - RNA, 18 nt, Escherichia coli CFT073
agacgcguuuacagagcc

SEQ ID NO: 2624910 - RNA, 13 nt, Escherichia coli CFT073
agacgcucuuuca

SEQ ID NO: 2624911 - RNA, 21 nt, Escherichia coli CFT073
agacgcugcaccugcucaggc

SEQ ID NO: 2624912 - RNA, 14 nt, Escherichia coli CFT073
agacggccauccca

SEQ ID NO: 2624913 - RNA, 21 nt, Escherichia coli CFT073
agacggccaucccagugaauu

SEQ ID NO: 2624914 - RNA, 14 nt, Escherichia coli CFT073
agacggcgcaacau

SEQ ID NO: 2624915 - RNA, 18 nt, Escherichia coli CFT073
agacggcgcuuacucaug

SEQ ID NO: 2624916 - RNA, 20 nt, Escherichia coli CFT073
agacggcugucauccagcag

SEQ ID NO: 2624917 - RNA, 17 nt, Escherichia coli CFT073
agacgggccaugcaccc

SEQ ID NO: 2624918 - RNA, 15 nt, Escherichia coli CFT073
agacgggcgucagcg

SEQ ID NO: 2624919 - RNA, 17 nt, Escherichia coli CFT073
agacggugccagguaau

SEQ ID NO: 2624920 - RNA, 17 nt, Escherichia coli CFT073
agacgguuaacgccagc

SEQ ID NO: 2624921 - RNA, 22 nt, Escherichia coli CFT073
agacgguugaucucaucuucca

SEQ ID NO: 2624922 - RNA, 14 nt, Escherichia coli CFT073
agacguagaaaauc

SEQ ID NO: 2624923 - RNA, 14 nt, Escherichia coli CFT073
agacguccggcgcu

SEQ ID NO: 2624924 - RNA, 15 nt, Escherichia coli CFT073
agacguucuuccugu

SEQ ID NO: 2624925 - RNA, 15 nt, Escherichia coli CFT073
agacguuucgccagc

SEQ ID NO: 2624926 - RNA, 17 nt, Escherichia coli CFT073
agacguuugagacccca

SEQ ID NO: 2624927 - RNA, 18 nt, Escherichia coli CFT073
agacguuuguaacccacc

SEQ ID NO: 2624928 - RNA, 22 nt, Escherichia coli CFT073
agacguuuguaacccaccaugc

SEQ ID NO: 2624929 - RNA, 16 nt, Escherichia coli CFT073
agacuauauuaaagau

SEQ ID NO: 2624930 - RNA, 22 nt, Escherichia coli CFT073
agacuauucauuguaaauaauu

SEQ ID NO: 2624931 - RNA, 14 nt, Escherichia coli CFT073
agacucaaaccaau

SEQ ID NO: 2624932 - RNA, 21 nt, Escherichia coli CFT073
agacucaauggcauccgccac

SEQ ID NO: 2624933 - RNA, 16 nt, Escherichia coli CFT073
agacucauuaaaacgg

SEQ ID NO: 2624934 - RNA, 18 nt, Escherichia coli CFT073
agacucauuaaaacggau

SEQ ID NO: 2624935 - RNA, 12 nt, Escherichia coli CFT073
agacucauugua

SEQ ID NO: 2624936 - RNA, 13 nt, Escherichia coli CFT073
agacucauuguau

SEQ ID NO: 2624937 - RNA, 15 nt, Escherichia coli CFT073
agacucauuguaucu

SEQ ID NO: 2624938 - RNA, 20 nt, Escherichia coli CFT073
agacucauuuuuaacagugu

SEQ ID NO: 2624939 - RNA, 12 nt, Escherichia coli CFT073
agacuccagcag

SEQ ID NO: 2624940 - RNA, 12 nt, Escherichia coli CFT073
agacuccagcgc

SEQ ID NO: 2624941 - RNA, 19 nt, Escherichia coli CFT073
agacucggugaccauccau

SEQ ID NO: 2624942 - RNA, 20 nt, Escherichia coli CFT073
agacugaagcuccgcugaaa

SEQ ID NO: 2624943 - RNA, 14 nt, Escherichia coli CFT073
agacugacaaucau

SEQ ID NO: 2624944 - RNA, 17 nt, Escherichia coli CFT073
agacugacagagaacau

SEQ ID NO: 2624945 - RNA, 16 nt, Escherichia coli CFT073
agacugauagccucuu

SEQ ID NO: 2624946 - RNA, 14 nt, Escherichia coli CFT073
agacugaucaucgc

SEQ ID NO: 2624947 - RNA, 16 nt, Escherichia coli CFT073
agacugaucaucgccc

SEQ ID NO: 2624948 - RNA, 16 nt, Escherichia coli CFT073
agacugaugacaaacg

SEQ ID NO: 2624949 - RNA, 16 nt, Escherichia coli CFT073
agacuggagcacugcg

SEQ ID NO: 2624950 - RNA, 14 nt, Escherichia coli CFT073
agacuguugaaaua

SEQ ID NO: 2624951 - RNA, 15 nt, Escherichia coli CFT073
agacuuaagccuguu

SEQ ID NO: 2624952 - RNA, 17 nt, Escherichia coli CFT073
agacuuuacuaauagca

SEQ ID NO: 2624953 - RNA, 20 nt, Escherichia coli CFT073
agacuuuauagaucaggaaa

SEQ ID NO: 2624954 - RNA, 13 nt, Escherichia coli CFT073
agacuuugcugcc

SEQ ID NO: 2624955 - RNA, 12 nt, Escherichia coli CFT073
agacuuuuccuu

SEQ ID NO: 2624956 - RNA, 17 nt, Escherichia coli CFT073
agacuuuuugcggcagc

SEQ ID NO: 2624957 - RNA, 21 nt, Escherichia coli CFT073
agacuuuuugcggcagcaaug

SEQ ID NO: 2624958 - RNA, 12 nt, Escherichia coli CFT073
agagaaaaccac

SEQ ID NO: 2624959 - RNA, 13 nt, Escherichia coli CFT073
agagaaaaucaca

SEQ ID NO: 2624960 - RNA, 22 nt, Escherichia coli CFT073
agagaaaaugccgcacaucacc

SEQ ID NO: 2624961 - RNA, 15 nt, Escherichia coli CFT073
agagaaaccacauca

SEQ ID NO: 2624962 - RNA, 16 nt, Escherichia coli CFT073
agagaaaccacaucaa

SEQ ID NO: 2624963 - RNA, 18 nt, Escherichia coli CFT073
agagaaacgccagcagca

SEQ ID NO: 2624964 - RNA, 13 nt, Escherichia coli CFT073
agagaaagagugc

SEQ ID NO: 2624965 - RNA, 17 nt, Escherichia coli CFT073
agagaacugagcgauca

SEQ ID NO: 2624966 - RNA, 13 nt, Escherichia coli CFT073
agagaacugcugc

SEQ ID NO: 2624967 - RNA, 15 nt, Escherichia coli CFT073
agagaacugugccag

SEQ ID NO: 2624968 - RNA, 16 nt, Escherichia coli CFT073
agagaacugugccaga

SEQ ID NO: 2624969 - RNA, 15 nt, Escherichia coli CFT073
agagaagaaaaccga

SEQ ID NO: 2624970 - RNA, 15 nt, Escherichia coli CFT073
agagaagagugacca

SEQ ID NO: 2624971 - RNA, 13 nt, Escherichia coli CFT073
agagaagccaggu

SEQ ID NO: 2624972 - RNA, 21 nt, Escherichia coli CFT073
agagaagcgcguucaucccac

SEQ ID NO: 2624973 - RNA, 18 nt, Escherichia coli CFT073
agagaaucaugucagagc

SEQ ID NO: 2624974 - RNA, 13 nt, Escherichia coli CFT073
agagaauguaaau

SEQ ID NO: 2624975 - RNA, 16 nt, Escherichia coli CFT073
agagaauuaaccagaa

SEQ ID NO: 2624976 - RNA, 22 nt, Escherichia coli CFT073
agagacauuggcaaaaccaaac

SEQ ID NO: 2624977 - RNA, 13 nt, Escherichia coli CFT073
agagagcagucca

SEQ ID NO: 2624978 - RNA, 13 nt, Escherichia coli CFT073
agagagccagccc

SEQ ID NO: 2624979 - RNA, 20 nt, Escherichia coli CFT073
agagagccagccccacagca

SEQ ID NO: 2624980 - RNA, 17 nt, Escherichia coli CFT073
agagagcuuuuuuguuc

SEQ ID NO: 2624981 - RNA, 20 nt, Escherichia coli CFT073
agagagguuuucaacucauc

SEQ ID NO: 2624982 - RNA, 18 nt, Escherichia coli CFT073
agagauaaacgaccacuc

SEQ ID NO: 2624983 - RNA, 20 nt, Escherichia coli CFT073
agagauaacuggcaaaaaca

SEQ ID NO: 2624984 - RNA, 21 nt, Escherichia coli CFT073
agagauaacuggcaaaaacaa

SEQ ID NO: 2624985 - RNA, 14 nt, Escherichia coli CFT073
agagauaaucacac

SEQ ID NO: 2624986 - RNA, 22 nt, Escherichia coli CFT073
agagauagcacgacguuucuuu

SEQ ID NO: 2624987 - RNA, 19 nt, Escherichia coli CFT073
agagauagcgaaccgcagg

SEQ ID NO: 2624988 - RNA, 12 nt, Escherichia coli CFT073
agagaucaaagu

SEQ ID NO: 2624989 - RNA, 13 nt, Escherichia coli CFT073
agagaucaaaguc

SEQ ID NO: 2624990 - RNA, 13 nt, Escherichia coli CFT073
agagauccuggcg

SEQ ID NO: 2624991 - RNA, 22 nt, Escherichia coli CFT073
agagaucgauguuuucugccuc

SEQ ID NO: 2624992 - RNA, 17 nt, Escherichia coli CFT073
agagaucuucauacggc

SEQ ID NO: 2624993 - RNA, 15 nt, Escherichia coli CFT073
agagauguaaaguga

SEQ ID NO: 2624994 - RNA, 17 nt, Escherichia coli CFT073
agagauuugcuccagcg

SEQ ID NO: 2624995 - RNA, 14 nt, Escherichia coli CFT073
agagcaaaccgccg

SEQ ID NO: 2624996 - RNA, 17 nt, Escherichia coli CFT073
agagcaaccagcaaugc

SEQ ID NO: 2624997 - RNA, 16 nt, Escherichia coli CFT073
agagcaacgagacuca

SEQ ID NO: 2624998 - RNA, 23 nt, Escherichia coli CFT073
agagcaacgagacucaauggcau

SEQ ID NO: 2624999 - RNA, 19 nt, Escherichia coli CFT073
agagcaccgccucgcggau

SEQ ID NO: 2625000 - RNA, 12 nt, Escherichia coli CFT073
agagcacgaccu

SEQ ID NO: 2625001 - RNA, 16 nt, Escherichia coli CFT073
agagcacuaacaugac

SEQ ID NO: 2625002 - RNA, 18 nt, Escherichia coli CFT073
agagcacuaacaugacac

SEQ ID NO: 2625003 - RNA, 11 nt, Escherichia coli CFT073
agagcagcacg

SEQ ID NO: 2625004 - RNA, 15 nt, Escherichia coli CFT073
agagcaggccaguuu

SEQ ID NO: 2625005 - RNA, 24 nt, Escherichia coli CFT073
agagccagcaccgcuggcucacca

SEQ ID NO: 2625006 - RNA, 13 nt, Escherichia coli CFT073
agagccagcccca

SEQ ID NO: 2625007 - RNA, 18 nt, Escherichia coli CFT073
agagccagccccacagca

SEQ ID NO: 2625008 - RNA, 12 nt, Escherichia coli CFT073
agagcccaugcg

SEQ ID NO: 2625009 - RNA, 20 nt, Escherichia coli CFT073
agagccgguuuugguuuucu

SEQ ID NO: 2625010 - RNA, 17 nt, Escherichia coli CFT073
agagccguuaaaacgac

SEQ ID NO: 2625011 - RNA, 18 nt, Escherichia coli CFT073
agagccugaauaaacgcc

SEQ ID NO: 2625012 - RNA, 13 nt, Escherichia coli CFT073
agagccuggcugc

SEQ ID NO: 2625013 - RNA, 15 nt, Escherichia coli CFT073
agagcgcaccgcgcg

SEQ ID NO: 2625014 - RNA, 12 nt, Escherichia coli CFT073
agagcgccagua

SEQ ID NO: 2625015 - RNA, 13 nt, Escherichia coli CFT073
agagcgccgggca

SEQ ID NO: 2625016 - RNA, 20 nt, Escherichia coli CFT073
agagcgccucauaugcggca

SEQ ID NO: 2625017 - RNA, 14 nt, Escherichia coli CFT073
agagcggagcaaug

SEQ ID NO: 2625018 - RNA, 19 nt, Escherichia coli CFT073
agagcguugccgcaggcaa

SEQ ID NO: 2625019 - RNA, 16 nt, Escherichia coli CFT073
agagcuaaaaucgcca

SEQ ID NO: 2625020 - RNA, 23 nt, Escherichia coli CFT073
agagcuaccggcaggaaauuaag

SEQ ID NO: 2625021 - RNA, 13 nt, Escherichia coli CFT073
agagcuaugaaua

SEQ ID NO: 2625022 - RNA, 16 nt, Escherichia coli CFT073
agagcucaucagguau

SEQ ID NO: 2625023 - RNA, 14 nt, Escherichia coli CFT073
agagcugcaaaagu

SEQ ID NO: 2625024 - RNA, 17 nt, Escherichia coli CFT073
agagcugcaaaaguacc

SEQ ID NO: 2625025 - RNA, 23 nt, Escherichia coli CFT073
agagcuguagauauauccugaac

SEQ ID NO: 2625026 - RNA, 13 nt, Escherichia coli CFT073
agagcuucaagaa

SEQ ID NO: 2625027 - RNA, 21 nt, Escherichia coli CFT073
agagcuugugcaccagcuggc

SEQ ID NO: 2625028 - RNA, 22 nt, Escherichia coli CFT073
agagcuuuuuuguucuguaauc

SEQ ID NO: 2625029 - RNA, 20 nt, Escherichia coli CFT073
agaggaccugcgucugauga

SEQ ID NO: 2625030 - RNA, 22 nt, Escherichia coli CFT073
agaggaccugcgucugaugaaa

SEQ ID NO: 2625031 - RNA, 13 nt, Escherichia coli CFT073
agaggaggacagc

SEQ ID NO: 2625032 - RNA, 14 nt, Escherichia coli CFT073
agaggaggagagca

SEQ ID NO: 2625033 - RNA, 18 nt, Escherichia coli CFT073
agaggaucuggacgccaa

SEQ ID NO: 2625034 - RNA, 21 nt, Escherichia coli CFT073
agaggcccuuggcgucuaagg

SEQ ID NO: 2625035 - RNA, 20 nt, Escherichia coli CFT073
agaggccgccguaggagugc

SEQ ID NO: 2625036 - RNA, 23 nt, Escherichia coli CFT073
agaggcgcgcgggugaugugcca

SEQ ID NO: 2625037 - RNA, 21 nt, Escherichia coli CFT073
agaggcguuccugcaacggau

SEQ ID NO: 2625038 - RNA, 14 nt, Escherichia coli CFT073
agagggaaagauuu

SEQ ID NO: 2625039 - RNA, 22 nt, Escherichia coli CFT073
agagguuaaucccuugagugac

SEQ ID NO: 2625040 - RNA, 17 nt, Escherichia coli CFT073
agaguaaacggugauac

SEQ ID NO: 2625041 - RNA, 23 nt, Escherichia coli CFT073
agaguaaagcccgccaucgccca

SEQ ID NO: 2625042 - RNA, 16 nt, Escherichia coli CFT073
agaguacguucacuuu

SEQ ID NO: 2625043 - RNA, 20 nt, Escherichia coli CFT073
agaguaugcgcgucagagau

SEQ ID NO: 2625044 - RNA, 14 nt, Escherichia coli CFT073
agagucagcaaugc

SEQ ID NO: 2625045 - RNA, 17 nt, Escherichia coli CFT073
agagucagcaaugccag

SEQ ID NO: 2625046 - RNA, 20 nt, Escherichia coli CFT073
agagucaucucugccuugag

SEQ ID NO: 2625047 - RNA, 15 nt, Escherichia coli CFT073
agagucgccagcugc

SEQ ID NO: 2625048 - RNA, 19 nt, Escherichia coli CFT073
agagugcccacguugcauc

SEQ ID NO: 2625049 - RNA, 21 nt, Escherichia coli CFT073
agagugcccacguugcaucac

SEQ ID NO: 2625050 - RNA, 13 nt, Escherichia coli CFT073
agagugcgccagu

SEQ ID NO: 2625051 - RNA, 23 nt, Escherichia coli CFT073
agaguuacuggcgaguauugcuu

SEQ ID NO: 2625052 - RNA, 14 nt, Escherichia coli CFT073
agaguugagcaguc

SEQ ID NO: 2625053 - RNA, 15 nt, Escherichia coli CFT073
agaguugcaccagca

SEQ ID NO: 2625054 - RNA, 16 nt, Escherichia coli CFT073
agaguugcaccagcaa

SEQ ID NO: 2625055 - RNA, 18 nt, Escherichia coli CFT073
agaguugcaccagcaaua

SEQ ID NO: 2625056 - RNA, 13 nt, Escherichia coli CFT073
agaguuugaacuc

SEQ ID NO: 2625057 - RNA, 17 nt, Escherichia coli CFT073
agaguuuuaaaaccauu

SEQ ID NO: 2625058 - RNA, 15 nt, Escherichia coli CFT073
agaguuuucaugaau

SEQ ID NO: 2625059 - RNA, 13 nt, Escherichia coli CFT073
agauaaaacacau

SEQ ID NO: 2625060 - RNA, 18 nt, Escherichia coli CFT073
agauaaaacaucucuucc

SEQ ID NO: 2625061 - RNA, 13 nt, Escherichia coli CFT073
agauaaacaaccc

SEQ ID NO: 2625062 - RNA, 21 nt, Escherichia coli CFT073
agauaaacgaccacucuuucg

SEQ ID NO: 2625063 - RNA, 16 nt, Escherichia coli CFT073
agauaaacgauacgcu

SEQ ID NO: 2625064 - RNA, 16 nt, Escherichia coli CFT073
agauaaacgauuuuua

SEQ ID NO: 2625065 - RNA, 12 nt, Escherichia coli CFT073
agauaaaugcca

SEQ ID NO: 2625066 - RNA, 18 nt, Escherichia coli CFT073
agauaaaugccaaagaau

SEQ ID NO: 2625067 - RNA, 19 nt, Escherichia coli CFT073
agauaaccacguucauuuc

SEQ ID NO: 2625068 - RNA, 20 nt, Escherichia coli CFT073
agauaaccacuggcacaaga

SEQ ID NO: 2625069 - RNA, 16 nt, Escherichia coli CFT073
agauaacccagcagcc

SEQ ID NO: 2625070 - RNA, 18 nt, Escherichia coli CFT073
agauaagaggcgcgcggg

SEQ ID NO: 2625071 - RNA, 13 nt, Escherichia coli CFT073
agauaagcaacaa

SEQ ID NO: 2625072 - RNA, 16 nt, Escherichia coli CFT073
agauaagcaacaaacu

SEQ ID NO: 2625073 - RNA, 18 nt, Escherichia coli CFT073
agauaagcaacaaacuca

SEQ ID NO: 2625074 - RNA, 12 nt, Escherichia coli CFT073
agauaagcaagg

SEQ ID NO: 2625075 - RNA, 15 nt, Escherichia coli CFT073
agauaaggcguucac

SEQ ID NO: 2625076 - RNA, 18 nt, Escherichia coli CFT073
agauaaggcguucacgcc

SEQ ID NO: 2625077 - RNA, 16 nt, Escherichia coli CFT073
agauaauaaaaaagaa

SEQ ID NO: 2625078 - RNA, 16 nt, Escherichia coli CFT073
agauaauaauguguuc

SEQ ID NO: 2625079 - RNA, 18 nt, Escherichia coli CFT073
agauaauagguaaacauc

SEQ ID NO: 2625080 - RNA, 17 nt, Escherichia coli CFT073
agauaaucaacccccac

SEQ ID NO: 2625081 - RNA, 13 nt, Escherichia coli CFT073
agauaaucacaca

SEQ ID NO: 2625082 - RNA, 15 nt, Escherichia coli CFT073
agauaaucacacagc

SEQ ID NO: 2625083 - RNA, 18 nt, Escherichia coli CFT073
agauaaugacuuccgcca

SEQ ID NO: 2625084 - RNA, 23 nt, Escherichia coli CFT073
agauaaugacuuccgccaccacg

SEQ ID NO: 2625085 - RNA, 15 nt, Escherichia coli CFT073
agauaaugagacaca

SEQ ID NO: 2625086 - RNA, 13 nt, Escherichia coli CFT073
agauaaugccagc

SEQ ID NO: 2625087 - RNA, 16 nt, Escherichia coli CFT073
agauaauggcaauggu

SEQ ID NO: 2625088 - RNA, 14 nt, Escherichia coli CFT073
agauaauggcuguu

SEQ ID NO: 2625089 - RNA, 22 nt, Escherichia coli CFT073
agauaauuaugccgaucaucau

SEQ ID NO: 2625090 - RNA, 20 nt, Escherichia coli CFT073
agauaauuuugaaauaaaau

SEQ ID NO: 2625091 - RNA, 19 nt, Escherichia coli CFT073
agauaauuuugcaguccca

SEQ ID NO: 2625092 - RNA, 21 nt, Escherichia coli CFT073
agauaauuuugcagucccauc

SEQ ID NO: 2625093 - RNA, 15 nt, Escherichia coli CFT073
agauacaaaacaugu

SEQ ID NO: 2625094 - RNA, 15 nt, Escherichia coli CFT073
agauacaaccaaucg

SEQ ID NO: 2625095 - RNA, 18 nt, Escherichia coli CFT073
agauacacagcccaguuu

SEQ ID NO: 2625096 - RNA, 22 nt, Escherichia coli CFT073
agauaccaccacagcacaggcg

SEQ ID NO: 2625097 - RNA, 13 nt, Escherichia coli CFT073
agauaccaccagc

SEQ ID NO: 2625098 - RNA, 15 nt, Escherichia coli CFT073
agauaccaccagcgc

SEQ ID NO: 2625099 - RNA, 23 nt, Escherichia coli CFT073
agauaccaccagcgccauuaaca

SEQ ID NO: 2625100 - RNA, 15 nt, Escherichia coli CFT073
agauaccccagcgca

SEQ ID NO: 2625101 - RNA, 18 nt, Escherichia coli CFT073
agauacccgacagauaaa

SEQ ID NO: 2625102 - RNA, 19 nt, Escherichia coli CFT073
agauacccgacagauaaau

SEQ ID NO: 2625103 - RNA, 20 nt, Escherichia coli CFT073
agauacccgacagauaaauc

SEQ ID NO: 2625104 - RNA, 21 nt, Escherichia coli CFT073
agauacccggauacaacucgc

SEQ ID NO: 2625105 - RNA, 13 nt, Escherichia coli CFT073
agauaccuucuug

SEQ ID NO: 2625106 - RNA, 21 nt, Escherichia coli CFT073
agauacggcggacgugcaccg

SEQ ID NO: 2625107 - RNA, 16 nt, Escherichia coli CFT073
agauacugaugaacgc

SEQ ID NO: 2625108 - RNA, 18 nt, Escherichia coli CFT073
agauacugaugaacgcgc

SEQ ID NO: 2625109 - RNA, 14 nt, Escherichia coli CFT073
agauagaaccacgc

SEQ ID NO: 2625110 - RNA, 20 nt, Escherichia coli CFT073
agauagaggucauuaggcca

SEQ ID NO: 2625111 - RNA, 21 nt, Escherichia coli CFT073
agauagccagguuuaccagca

SEQ ID NO: 2625112 - RNA, 23 nt, Escherichia coli CFT073
agauagccagguuuaccagcagc

SEQ ID NO: 2625113 - RNA, 19 nt, Escherichia coli CFT073
agauagccuauaccuaaca

SEQ ID NO: 2625114 - RNA, 21 nt, Escherichia coli CFT073
agauagcguucuuuaacugcc

SEQ ID NO: 2625115 - RNA, 15 nt, Escherichia coli CFT073
agauaggucaccaga

SEQ ID NO: 2625116 - RNA, 19 nt, Escherichia coli CFT073
agauaguuucacggcacca

SEQ ID NO: 2625117 - RNA, 17 nt, Escherichia coli CFT073
agauauagccuaacaca

SEQ ID NO: 2625118 - RNA, 19 nt, Escherichia coli CFT073
agauauagccuaacacagc

SEQ ID NO: 2625119 - RNA, 20 nt, Escherichia coli CFT073
agauauagccuaacacagca

SEQ ID NO: 2625120 - RNA, 16 nt, Escherichia coli CFT073
agauauccacaacaau

SEQ ID NO: 2625121 - RNA, 13 nt, Escherichia coli CFT073
agauaucccgcca

SEQ ID NO: 2625122 - RNA, 23 nt, Escherichia coli CFT073
agauaucccgccagcaccagcaa

SEQ ID NO: 2625123 - RNA, 23 nt, Escherichia coli CFT073
agauaugcgcugucauucauuca

SEQ ID NO: 2625124 - RNA, 15 nt, Escherichia coli CFT073
agauauucaucagca

SEQ ID NO: 2625125 - RNA, 19 nt, Escherichia coli CFT073
agauauucccccaccgccg

SEQ ID NO: 2625126 - RNA, 16 nt, Escherichia coli CFT073
agauauuuaacaucau

SEQ ID NO: 2625127 - RNA, 17 nt, Escherichia coli CFT073
agauauuuaacaucauu

SEQ ID NO: 2625128 - RNA, 17 nt, Escherichia coli CFT073
agauauuucaccagcgc

SEQ ID NO: 2625129 - RNA, 14 nt, Escherichia coli CFT073
agauauuuuguuca

SEQ ID NO: 2625130 - RNA, 21 nt, Escherichia coli CFT073
agauauuuuguucaaaggcag

SEQ ID NO: 2625131 - RNA, 22 nt, Escherichia coli CFT073
agauauuuuguucaaaggcaga

SEQ ID NO: 2625132 - RNA, 23 nt, Escherichia coli CFT073
agauauuuuguucaaaggcagaa

SEQ ID NO: 2625133 - RNA, 15 nt, Escherichia coli CFT073
agaucaacagcauau

SEQ ID NO: 2625134 - RNA, 18 nt, Escherichia coli CFT073
agaucaaugcgccaaccu

SEQ ID NO: 2625135 - RNA, 23 nt, Escherichia coli CFT073
agaucaccuugcaguuguaauca

SEQ ID NO: 2625136 - RNA, 22 nt, Escherichia coli CFT073
agaucacuucuguuugcgccac

SEQ ID NO: 2625137 - RNA, 12 nt, Escherichia coli CFT073
agaucagauaau

SEQ ID NO: 2625138 - RNA, 14 nt, Escherichia coli CFT073
agaucagcaaauaa

SEQ ID NO: 2625139 - RNA, 20 nt, Escherichia coli CFT073
agaucagcaaauaauucauc

SEQ ID NO: 2625140 - RNA, 15 nt, Escherichia coli CFT073
agaucagcggcggcg

SEQ ID NO: 2625141 - RNA, 19 nt, Escherichia coli CFT073
agaucaggaaaaacggaau

SEQ ID NO: 2625142 - RNA, 14 nt, Escherichia coli CFT073
agaucagggaaggg

SEQ ID NO: 2625143 - RNA, 23 nt, Escherichia coli CFT073
agaucaugaugaugccaaaaugc

SEQ ID NO: 2625144 - RNA, 22 nt, Escherichia coli CFT073
agauccaaaccgacugccugca

SEQ ID NO: 2625145 - RNA, 13 nt, Escherichia coli CFT073
agauccagcgagc

SEQ ID NO: 2625146 - RNA, 18 nt, Escherichia coli CFT073
agauccagcuucgccagc

SEQ ID NO: 2625147 - RNA, 20 nt, Escherichia coli CFT073
agauccagugcucauccuuc

SEQ ID NO: 2625148 - RNA, 18 nt, Escherichia coli CFT073
agauccaugaagcaauga

SEQ ID NO: 2625149 - RNA, 14 nt, Escherichia coli CFT073
agauccauuaugau

SEQ ID NO: 2625150 - RNA, 16 nt, Escherichia coli CFT073
agaucccccgcacacu

SEQ ID NO: 2625151 - RNA, 16 nt, Escherichia coli CFT073
agauccgcacucaacu

SEQ ID NO: 2625152 - RNA, 12 nt, Escherichia coli CFT073
agauccgccagu

SEQ ID NO: 2625153 - RNA, 15 nt, Escherichia coli CFT073
agauccgccaugcug

SEQ ID NO: 2625154 - RNA, 17 nt, Escherichia coli CFT073
agauccgcuucgccagu

SEQ ID NO: 2625155 - RNA, 13 nt, Escherichia coli CFT073
agauccugaaauu

SEQ ID NO: 2625156 - RNA, 17 nt, Escherichia coli CFT073
agauccugaaauuccug

SEQ ID NO: 2625157 - RNA, 20 nt, Escherichia coli CFT073
agauccugauccugcaacaa

SEQ ID NO: 2625158 - RNA, 23 nt, Escherichia coli CFT073
agauccugauccugcaacaacac

SEQ ID NO: 2625159 - RNA, 23 nt, Escherichia coli CFT073
agauccuggcgaaaacgcccggc

SEQ ID NO: 2625160 - RNA, 23 nt, Escherichia coli CFT073
agauccuggcuguauuuuuccag

SEQ ID NO: 2625161 - RNA, 15 nt, Escherichia coli CFT073
agaucgcacauguca

SEQ ID NO: 2625162 - RNA, 19 nt, Escherichia coli CFT073
agaucgcccuuuuuugcuu

SEQ ID NO: 2625163 - RNA, 11 nt, Escherichia coli CFT073
agaucgcgacc

SEQ ID NO: 2625164 - RNA, 21 nt, Escherichia coli CFT073
agaucgcgaccgccuucaguc

SEQ ID NO: 2625165 - RNA, 19 nt, Escherichia coli CFT073
agaucgcgaugagucgccg

SEQ ID NO: 2625166 - RNA, 20 nt, Escherichia coli CFT073
agaucgcgaugagucgccgc

SEQ ID NO: 2625167 - RNA, 13 nt, Escherichia coli CFT073
agaucgcggccua

SEQ ID NO: 2625168 - RNA, 20 nt, Escherichia coli CFT073
agaucgguuuuuuucgaacc

SEQ ID NO: 2625169 - RNA, 19 nt, Escherichia coli CFT073
agaucgugcagcaccgccg

SEQ ID NO: 2625170 - RNA, 18 nt, Escherichia coli CFT073
agaucguuaagcacagcg

SEQ ID NO: 2625171 - RNA, 18 nt, Escherichia coli CFT073
agaucugaccuauuucau

SEQ ID NO: 2625172 - RNA, 19 nt, Escherichia coli CFT073
agaucugaccuauuucauu

SEQ ID NO: 2625173 - RNA, 15 nt, Escherichia coli CFT073
agaucuuccagcggc

SEQ ID NO: 2625174 - RNA, 16 nt, Escherichia coli CFT073
agaucuuuaucaauca

SEQ ID NO: 2625175 - RNA, 17 nt, Escherichia coli CFT073
agaucuuuaucaaucac

SEQ ID NO: 2625176 - RNA, 16 nt, Escherichia coli CFT073
agaucuuucacgccca

SEQ ID NO: 2625177 - RNA, 15 nt, Escherichia coli CFT073
agaugaaaacgccac

SEQ ID NO: 2625178 - RNA, 23 nt, Escherichia coli CFT073
agaugaauaacuccgucauccug

SEQ ID NO: 2625179 - RNA, 18 nt, Escherichia coli CFT073
agaugaaugaaaacgaau

SEQ ID NO: 2625180 - RNA, 17 nt, Escherichia coli CFT073
agaugacgaucagggcg

SEQ ID NO: 2625181 - RNA, 18 nt, Escherichia coli CFT073
agaugaguuauucccgug

SEQ ID NO: 2625182 - RNA, 21 nt, Escherichia coli CFT073
agaugcagcauagaagaaaua

SEQ ID NO: 2625183 - RNA, 13 nt, Escherichia coli CFT073
agaugcagcggua

SEQ ID NO: 2625184 - RNA, 17 nt, Escherichia coli CFT073
agaugcauuaccggaga

SEQ ID NO: 2625185 - RNA, 19 nt, Escherichia coli CFT073
agaugcgacguuacaacca

SEQ ID NO: 2625186 - RNA, 22 nt, Escherichia coli CFT073
agaugcgacguuuaccgcaucc

SEQ ID NO: 2625187 - RNA, 11 nt, Escherichia coli CFT073
agaugcggcgu

SEQ ID NO: 2625188 - RNA, 17 nt, Escherichia coli CFT073
agaugcggggauuuucg

SEQ ID NO: 2625189 - RNA, 22 nt, Escherichia coli CFT073
agaugcggugcgccacaccgca

SEQ ID NO: 2625190 - RNA, 19 nt, Escherichia coli CFT073
agaugcguuaagcgucgca

SEQ ID NO: 2625191 - RNA, 21 nt, Escherichia coli CFT073
agaugcguuaagcgucgcauc

SEQ ID NO: 2625192 - RNA, 12 nt, Escherichia coli CFT073
agaugcguucac

SEQ ID NO: 2625193 - RNA, 17 nt, Escherichia coli CFT073
agaugcugcaaggugau

SEQ ID NO: 2625194 - RNA, 22 nt, Escherichia coli CFT073
agaugcugcucuucacgcccgc

SEQ ID NO: 2625195 - RNA, 16 nt, Escherichia coli CFT073
agaugcuguaccaggu

SEQ ID NO: 2625196 - RNA, 22 nt, Escherichia coli CFT073
agaugcugugccuccugcggcu

SEQ ID NO: 2625197 - RNA, 23 nt, Escherichia coli CFT073
agaugcugugccuccugcggcuu

SEQ ID NO: 2625198 - RNA, 17 nt, Escherichia coli CFT073
agauggacgcagaccga

SEQ ID NO: 2625199 - RNA, 12 nt, Escherichia coli CFT073
agauggaucagc

SEQ ID NO: 2625200 - RNA, 19 nt, Escherichia coli CFT073
agauggcauacaacgccau

SEQ ID NO: 2625201 - RNA, 15 nt, Escherichia coli CFT073
agauggcauccagcg

SEQ ID NO: 2625202 - RNA, 21 nt, Escherichia coli CFT073
agauggcggaaauaacgcuga

SEQ ID NO: 2625203 - RNA, 19 nt, Escherichia coli CFT073
agauggcuuugcccuuucu

SEQ ID NO: 2625204 - RNA, 14 nt, Escherichia coli CFT073
agaugguuuugcuu

SEQ ID NO: 2625205 - RNA, 22 nt, Escherichia coli CFT073
agaugucggcaaucgcaaucau

SEQ ID NO: 2625206 - RNA, 14 nt, Escherichia coli CFT073
agaugucuuuaccc

SEQ ID NO: 2625207 - RNA, 20 nt, Escherichia coli CFT073
agaugugguuagcuggagag

SEQ ID NO: 2625208 - RNA, 16 nt, Escherichia coli CFT073
agauguuccgccauuu

SEQ ID NO: 2625209 - RNA, 18 nt, Escherichia coli CFT073
agauguugcugcucuuga

SEQ ID NO: 2625210 - RNA, 18 nt, Escherichia coli CFT073
agauuaaaggcaccaaua

SEQ ID NO: 2625211 - RNA, 22 nt, Escherichia coli CFT073
agauuaaguguagucagcaauu

SEQ ID NO: 2625212 - RNA, 17 nt, Escherichia coli CFT073
agauuaaucagcagaua

SEQ ID NO: 2625213 - RNA, 18 nt, Escherichia coli CFT073
agauuaaucagcagauau

SEQ ID NO: 2625214 - RNA, 22 nt, Escherichia coli CFT073
agauuacauugggaagauaaaa

SEQ ID NO: 2625215 - RNA, 16 nt, Escherichia coli CFT073
agauuaccagagaaaa

SEQ ID NO: 2625216 - RNA, 23 nt, Escherichia coli CFT073
agauuagccgguaaaucaccauc

SEQ ID NO: 2625217 - RNA, 23 nt, Escherichia coli CFT073
agauuaguaaugcguaacguuuc

SEQ ID NO: 2625218 - RNA, 17 nt, Escherichia coli CFT073
agauuaugaaauucagu

SEQ ID NO: 2625219 - RNA, 18 nt, Escherichia coli CFT073
agauucagcgucgccagc

SEQ ID NO: 2625220 - RNA, 15 nt, Escherichia coli CFT073
agauucauccaguuc

SEQ ID NO: 2625221 - RNA, 23 nt, Escherichia coli CFT073
agauucaugguacgggacagcag

SEQ ID NO: 2625222 - RNA, 14 nt, Escherichia coli CFT073
agauuccgguuuaa

SEQ ID NO: 2625223 - RNA, 14 nt, Escherichia coli CFT073
agauucgauaacau

SEQ ID NO: 2625224 - RNA, 12 nt, Escherichia coli CFT073
agauucgccaga

SEQ ID NO: 2625225 - RNA, 22 nt, Escherichia coli CFT073
agauucgcggguaagugcggag

SEQ ID NO: 2625226 - RNA, 17 nt, Escherichia coli CFT073
agauucggcgcaaugau

SEQ ID NO: 2625227 - RNA, 18 nt, Escherichia coli CFT073
agauucguauuuaaaacc

SEQ ID NO: 2625228 - RNA, 15 nt, Escherichia coli CFT073
agauucuccaccugc

SEQ ID NO: 2625229 - RNA, 20 nt, Escherichia coli CFT073
agauugaacgcuggcggcag

SEQ ID NO: 2625230 - RNA, 22 nt, Escherichia coli CFT073
agauugaugcgaguaaucaggc

SEQ ID NO: 2625231 - RNA, 19 nt, Escherichia coli CFT073
agauugauguuaccaacac

SEQ ID NO: 2625232 - RNA, 19 nt, Escherichia coli CFT073
agauugcguaacgugacau

SEQ ID NO: 2625233 - RNA, 13 nt, Escherichia coli CFT073
agauugcugacaa

SEQ ID NO: 2625234 - RNA, 21 nt, Escherichia coli CFT073
agauuggcuucacugauuaac

SEQ ID NO: 2625235 - RNA, 19 nt, Escherichia coli CFT073
agauugucaauauccagca

SEQ ID NO: 2625236 - RNA, 18 nt, Escherichia coli CFT073
agauugucggcagccagu

SEQ ID NO: 2625237 - RNA, 19 nt, Escherichia coli CFT073
agauuguugaucguaacgg

SEQ ID NO: 2625238 - RNA, 16 nt, Escherichia coli CFT073
agauuuaacggcagca

SEQ ID NO: 2625239 - RNA, 17 nt, Escherichia coli CFT073
agauuugccagauuagu

SEQ ID NO: 2625240 - RNA, 15 nt, Escherichia coli CFT073
agauuuuuauuaaua

SEQ ID NO: 2625241 - RNA, 14 nt, Escherichia coli CFT073
agauuuuuugccag

SEQ ID NO: 2625242 - RNA, 20 nt, Escherichia coli CFT073
agauuuuuugccagcaccau

SEQ ID NO: 2625243 - RNA, 14 nt, Escherichia coli CFT073
agcaaaaaaagaau

SEQ ID NO: 2625244 - RNA, 14 nt, Escherichia coli CFT073
agcaaaaaauagaa

SEQ ID NO: 2625245 - RNA, 12 nt, Escherichia coli CFT073
agcaaaaucacc

SEQ ID NO: 2625246 - RNA, 14 nt, Escherichia coli CFT073
agcaaaaucaccau

SEQ ID NO: 2625247 - RNA, 19 nt, Escherichia coli CFT073
agcaaaaucguaagcagga

SEQ ID NO: 2625248 - RNA, 22 nt, Escherichia coli CFT073
agcaaaaugguacucggcacgu

SEQ ID NO: 2625249 - RNA, 18 nt, Escherichia coli CFT073
agcaaaccgccgauggcc

SEQ ID NO: 2625250 - RNA, 20 nt, Escherichia coli CFT073
agcaaacuaucuguguaaug

SEQ ID NO: 2625251 - RNA, 22 nt, Escherichia coli CFT073
agcaaacuugaacuuaucauca

SEQ ID NO: 2625252 - RNA, 23 nt, Escherichia coli CFT073
agcaaagagagauccagcuucgc

SEQ ID NO: 2625253 - RNA, 16 nt, Escherichia coli CFT073
agcaaaguaccaucgu

SEQ ID NO: 2625254 - RNA, 22 nt, Escherichia coli CFT073
agcaaaguaccaucguccagca

SEQ ID NO: 2625255 - RNA, 21 nt, Escherichia coli CFT073
agcaaagugugugcgggcauu

SEQ ID NO: 2625256 - RNA, 17 nt, Escherichia coli CFT073
agcaaauaaaacaucac

SEQ ID NO: 2625257 - RNA, 16 nt, Escherichia coli CFT073
agcaaauaaaacugcg

SEQ ID NO: 2625258 - RNA, 17 nt, Escherichia coli CFT073
agcaaauaauuccccac

SEQ ID NO: 2625259 - RNA, 21 nt, Escherichia coli CFT073
agcaaauaauuccccaccuga

SEQ ID NO: 2625260 - RNA, 22 nt, Escherichia coli CFT073
agcaaauaguaagaaccacagc

SEQ ID NO: 2625261 - RNA, 16 nt, Escherichia coli CFT073
agcaaaucaaucugau

SEQ ID NO: 2625262 - RNA, 19 nt, Escherichia coli CFT073
agcaaauccuuccgccagu

SEQ ID NO: 2625263 - RNA, 20 nt, Escherichia coli CFT073
agcaaaucgcggcaguggcu

SEQ ID NO: 2625264 - RNA, 20 nt, Escherichia coli CFT073
agcaaauuaucccccagcac

SEQ ID NO: 2625265 - RNA, 17 nt, Escherichia coli CFT073
agcaaauuccucaaacg

SEQ ID NO: 2625266 - RNA, 18 nt, Escherichia coli CFT073
agcaaauucuaagcugac

SEQ ID NO: 2625267 - RNA, 21 nt, Escherichia coli CFT073
agcaaauucuaagcugacuug

SEQ ID NO: 2625268 - RNA, 12 nt, Escherichia coli CFT073
agcaaauuuuua

SEQ ID NO: 2625269 - RNA, 17 nt, Escherichia coli CFT073
agcaacaaacguggugc

SEQ ID NO: 2625270 - RNA, 15 nt, Escherichia coli CFT073
agcaacaaacucauu

SEQ ID NO: 2625271 - RNA, 12 nt, Escherichia coli CFT073
agcaacaacagc

SEQ ID NO: 2625272 - RNA, 14 nt, Escherichia coli CFT073
agcaacaaccacca

SEQ ID NO: 2625273 - RNA, 17 nt, Escherichia coli CFT073
agcaacaacuucagguu

SEQ ID NO: 2625274 - RNA, 19 nt, Escherichia coli CFT073
agcaacaacuucagguuca

SEQ ID NO: 2625275 - RNA, 19 nt, Escherichia coli CFT073
agcaacaauuugcggucca

SEQ ID NO: 2625276 - RNA, 22 nt, Escherichia coli CFT073
agcaacaauuuucccuucccgc

SEQ ID NO: 2625277 - RNA, 14 nt, Escherichia coli CFT073
agcaacagcaaaga

SEQ ID NO: 2625278 - RNA, 19 nt, Escherichia coli CFT073
agcaacagcaaagagagca

SEQ ID NO: 2625279 - RNA, 14 nt, Escherichia coli CFT073
agcaacaucaccaa

SEQ ID NO: 2625280 - RNA, 16 nt, Escherichia coli CFT073
agcaaccacaaccuca

SEQ ID NO: 2625281 - RNA, 14 nt, Escherichia coli CFT073
agcaaccagcaaug

SEQ ID NO: 2625282 - RNA, 13 nt, Escherichia coli CFT073
agcaaccggggca

SEQ ID NO: 2625283 - RNA, 16 nt, Escherichia coli CFT073
agcaaccggggcauuc

SEQ ID NO: 2625284 - RNA, 17 nt, Escherichia coli CFT073
agcaaccggugucauca

SEQ ID NO: 2625285 - RNA, 16 nt, Escherichia coli CFT073
agcaaccugcacguua

SEQ ID NO: 2625286 - RNA, 15 nt, Escherichia coli CFT073
agcaacgaaacaccg

SEQ ID NO: 2625287 - RNA, 18 nt, Escherichia coli CFT073
agcaacgauaacaaucac

SEQ ID NO: 2625288 - RNA, 21 nt, Escherichia coli CFT073
agcaacgauaacaaucaccaa

SEQ ID NO: 2625289 - RNA, 15 nt, Escherichia coli CFT073
agcaacgccuaaacu

SEQ ID NO: 2625290 - RNA, 18 nt, Escherichia coli CFT073
agcaacgccuaaacugau

SEQ ID NO: 2625291 - RNA, 23 nt, Escherichia coli CFT073
agcaacgccuaaacugaucgaca

SEQ ID NO: 2625292 - RNA, 18 nt, Escherichia coli CFT073
agcaacggaaaagcaaca

SEQ ID NO: 2625293 - RNA, 14 nt, Escherichia coli CFT073
agcaacguugaacg

SEQ ID NO: 2625294 - RNA, 23 nt, Escherichia coli CFT073
agcaacucgucgcugauauugcu

SEQ ID NO: 2625295 - RNA, 13 nt, Escherichia coli CFT073
agcaacucugcua

SEQ ID NO: 2625296 - RNA, 13 nt, Escherichia coli CFT073
agcaacugacugg

SEQ ID NO: 2625297 - RNA, 14 nt, Escherichia coli CFT073
agcaacuggcuugc

SEQ ID NO: 2625298 - RNA, 17 nt, Escherichia coli CFT073
agcaacugguuaucacg

SEQ ID NO: 2625299 - RNA, 11 nt, Escherichia coli CFT073
agcaacuguaa

SEQ ID NO: 2625300 - RNA, 21 nt, Escherichia coli CFT073
agcaacuguaacgcagaaggu

SEQ ID NO: 2625301 - RNA, 16 nt, Escherichia coli CFT073
agcaacuuaaucauca

SEQ ID NO: 2625302 - RNA, 17 nt, Escherichia coli CFT073
agcaacuuaaucaucaa

SEQ ID NO: 2625303 - RNA, 19 nt, Escherichia coli CFT073
agcaacuuaaucaucaaug

SEQ ID NO: 2625304 - RNA, 22 nt, Escherichia coli CFT073
agcaacuuaaucaucaaugcca

SEQ ID NO: 2625305 - RNA, 14 nt, Escherichia coli CFT073
agcaagaaccaugc

SEQ ID NO: 2625306 - RNA, 19 nt, Escherichia coli CFT073
agcaagaaccaugcaauca

SEQ ID NO: 2625307 - RNA, 14 nt, Escherichia coli CFT073
agcaagaccaacac

SEQ ID NO: 2625308 - RNA, 13 nt, Escherichia coli CFT073
agcaagagcaaau

SEQ ID NO: 2625309 - RNA, 23 nt, Escherichia coli CFT073
agcaagagcaaauaaaacaucac

SEQ ID NO: 2625310 - RNA, 17 nt, Escherichia coli CFT073
agcaagaguuuuaaaac

SEQ ID NO: 2625311 - RNA, 18 nt, Escherichia coli CFT073
agcaagccgucgugaaug

SEQ ID NO: 2625312 - RNA, 18 nt, Escherichia coli CFT073
agcaagccuuacuucaca

SEQ ID NO: 2625313 - RNA, 15 nt, Escherichia coli CFT073
agcaagcgcaccgau

SEQ ID NO: 2625314 - RNA, 23 nt, Escherichia coli CFT073
agcaaggcuuucacgucaggguc

SEQ ID NO: 2625315 - RNA, 14 nt, Escherichia coli CFT073
agcaaguaguccgc

SEQ ID NO: 2625316 - RNA, 15 nt, Escherichia coli CFT073
agcaauaaacacugc

SEQ ID NO: 2625317 - RNA, 12 nt, Escherichia coli CFT073
agcaauaaacca

SEQ ID NO: 2625318 - RNA, 14 nt, Escherichia coli CFT073
agcaauaaaccaua

SEQ ID NO: 2625319 - RNA, 16 nt, Escherichia coli CFT073
agcaauaaaugccugg

SEQ ID NO: 2625320 - RNA, 16 nt, Escherichia coli CFT073
agcaauaagcacucug

SEQ ID NO: 2625321 - RNA, 19 nt, Escherichia coli CFT073
agcaauaagccaguccaga

SEQ ID NO: 2625322 - RNA, 14 nt, Escherichia coli CFT073
agcaauaaugccag

SEQ ID NO: 2625323 - RNA, 14 nt, Escherichia coli CFT073
agcaauaauuucaa

SEQ ID NO: 2625324 - RNA, 17 nt, Escherichia coli CFT073
agcaauagccgccauac

SEQ ID NO: 2625325 - RNA, 23 nt, Escherichia coli CFT073
agcaauagccgccauacggaaaa

SEQ ID NO: 2625326 - RNA, 23 nt, Escherichia coli CFT073
agcaauauagcgcauggcagcca

SEQ ID NO: 2625327 - RNA, 22 nt, Escherichia coli CFT073
agcaaucaggucuuucagggug

SEQ ID NO: 2625328 - RNA, 20 nt, Escherichia coli CFT073
agcaauccagcuaaccaucc

SEQ ID NO: 2625329 - RNA, 18 nt, Escherichia coli CFT073
agcaauccauaccagcac

SEQ ID NO: 2625330 - RNA, 16 nt, Escherichia coli CFT073
agcaauccugcaugua

SEQ ID NO: 2625331 - RNA, 12 nt, Escherichia coli CFT073
agcaaucgacca

SEQ ID NO: 2625332 - RNA, 22 nt, Escherichia coli CFT073
agcaaucgaccaggccaucagc

SEQ ID NO: 2625333 - RNA, 23 nt, Escherichia coli CFT073
agcaaucgcauauuucaacgacg

SEQ ID NO: 2625334 - RNA, 20 nt, Escherichia coli CFT073
agcaaucucuucaagcugcu

SEQ ID NO: 2625335 - RNA, 16 nt, Escherichia coli CFT073
agcaaugaagaaccgc

SEQ ID NO: 2625336 - RNA, 14 nt, Escherichia coli CFT073
agcaaugagcuaug

SEQ ID NO: 2625337 - RNA, 12 nt, Escherichia coli CFT073
agcaaugcacac

SEQ ID NO: 2625338 - RNA, 18 nt, Escherichia coli CFT073
agcaaugcagguaccugu

SEQ ID NO: 2625339 - RNA, 12 nt, Escherichia coli CFT073
agcaaugccaga

SEQ ID NO: 2625340 - RNA, 17 nt, Escherichia coli CFT073
agcaaugccaucaccaa

SEQ ID NO: 2625341 - RNA, 16 nt, Escherichia coli CFT073
agcaaugcccugugau

SEQ ID NO: 2625342 - RNA, 20 nt, Escherichia coli CFT073
agcaauggcacugucgagau

SEQ ID NO: 2625343 - RNA, 17 nt, Escherichia coli CFT073
agcaauguagucuccaa

SEQ ID NO: 2625344 - RNA, 23 nt, Escherichia coli CFT073
agcaauguauuuguccacgccgc

SEQ ID NO: 2625345 - RNA, 18 nt, Escherichia coli CFT073
agcaaugucauaaaccgc

SEQ ID NO: 2625346 - RNA, 21 nt, Escherichia coli CFT073
agcaaugugaaaucagcgaga

SEQ ID NO: 2625347 - RNA, 17 nt, Escherichia coli CFT073
agcaauuaacagugaca

SEQ ID NO: 2625348 - RNA, 22 nt, Escherichia coli CFT073
agcaauuacaggugaaucuuac

SEQ ID NO: 2625349 - RNA, 20 nt, Escherichia coli CFT073
agcaauuccagcgccaguaa

SEQ ID NO: 2625350 - RNA, 13 nt, Escherichia coli CFT073
agcaauuuaucuu

SEQ ID NO: 2625351 - RNA, 15 nt, Escherichia coli CFT073
agcaauuuccggcac

SEQ ID NO: 2625352 - RNA, 14 nt, Escherichia coli CFT073
agcaauuucuccgc

SEQ ID NO: 2625353 - RNA, 15 nt, Escherichia coli CFT073
agcaauuucuccgcc

SEQ ID NO: 2625354 - RNA, 16 nt, Escherichia coli CFT073
agcaauuuuaauaucc

SEQ ID NO: 2625355 - RNA, 20 nt, Escherichia coli CFT073
agcaauuuugcccagccgaa

SEQ ID NO: 2625356 - RNA, 18 nt, Escherichia coli CFT073
agcacaaacgcaauccag

SEQ ID NO: 2625357 - RNA, 13 nt, Escherichia coli CFT073
agcacaaaguggc

SEQ ID NO: 2625358 - RNA, 17 nt, Escherichia coli CFT073
agcacaauaaucagccc

SEQ ID NO: 2625359 - RNA, 20 nt, Escherichia coli CFT073
agcacaauaaucagcccaac

SEQ ID NO: 2625360 - RNA, 18 nt, Escherichia coli CFT073
agcacaaucacgucauau

SEQ ID NO: 2625361 - RNA, 19 nt, Escherichia coli CFT073
agcacaaucacgucauauu

SEQ ID NO: 2625362 - RNA, 19 nt, Escherichia coli CFT073
agcacaauccgccaggaca

SEQ ID NO: 2625363 - RNA, 13 nt, Escherichia coli CFT073
agcacaaucgcau

SEQ ID NO: 2625364 - RNA, 19 nt, Escherichia coli CFT073
agcacacauaacagcggga

SEQ ID NO: 2625365 - RNA, 14 nt, Escherichia coli CFT073
agcacacauacaug

SEQ ID NO: 2625366 - RNA, 19 nt, Escherichia coli CFT073
agcacaccacaucgccgac

SEQ ID NO: 2625367 - RNA, 20 nt, Escherichia coli CFT073
agcacagccagugauuccgg

SEQ ID NO: 2625368 - RNA, 21 nt, Escherichia coli CFT073
agcacagcggacaucuggucg

SEQ ID NO: 2625369 - RNA, 18 nt, Escherichia coli CFT073
agcacauagccgaaaaug

SEQ ID NO: 2625370 - RNA, 23 nt, Escherichia coli CFT073
agcacaucaccuuguuucagcgc

SEQ ID NO: 2625371 - RNA, 11 nt, Escherichia coli CFT073
agcacaucagc

SEQ ID NO: 2625372 - RNA, 18 nt, Escherichia coli CFT073
agcacaucaucaaagcca

SEQ ID NO: 2625373 - RNA, 16 nt, Escherichia coli CFT073
agcacaucucaaaucu

SEQ ID NO: 2625374 - RNA, 12 nt, Escherichia coli CFT073
agcacaucuccc

SEQ ID NO: 2625375 - RNA, 14 nt, Escherichia coli CFT073
agcacaucucccac

SEQ ID NO: 2625376 - RNA, 17 nt, Escherichia coli CFT073
agcacaugcaacuugaa

SEQ ID NO: 2625377 - RNA, 22 nt, Escherichia coli CFT073
agcacauugccugaugcgacgc

SEQ ID NO: 2625378 - RNA, 14 nt, Escherichia coli CFT073
agcaccaacucgcc

SEQ ID NO: 2625379 - RNA, 23 nt, Escherichia coli CFT073
agcaccacauaagaucaucggcc

SEQ ID NO: 2625380 - RNA, 14 nt, Escherichia coli CFT073
agcaccaccgcccg

SEQ ID NO: 2625381 - RNA, 22 nt, Escherichia coli CFT073
agcaccaccgcccguuccaccg

SEQ ID NO: 2625382 - RNA, 21 nt, Escherichia coli CFT073
agcaccacgguacgccagagu

SEQ ID NO: 2625383 - RNA, 19 nt, Escherichia coli CFT073
agcaccacuuuacgggcaa

SEQ ID NO: 2625384 - RNA, 13 nt, Escherichia coli CFT073
agcaccagauaau

SEQ ID NO: 2625385 - RNA, 14 nt, Escherichia coli CFT073
agcaccagcaacaa

SEQ ID NO: 2625386 - RNA, 13 nt, Escherichia coli CFT073
agcaccagcaacg

SEQ ID NO: 2625387 - RNA, 15 nt, Escherichia coli CFT073
agcaccauaaacacc

SEQ ID NO: 2625388 - RNA, 15 nt, Escherichia coli CFT073
agcacccagcaaucc

SEQ ID NO: 2625389 - RNA, 18 nt, Escherichia coli CFT073
agcacccgcggcugcagc

SEQ ID NO: 2625390 - RNA, 23 nt, Escherichia coli CFT073
agcaccgauugccggaugcgaag

SEQ ID NO: 2625391 - RNA, 13 nt, Escherichia coli CFT073
agcaccgccgcca

SEQ ID NO: 2625392 - RNA, 18 nt, Escherichia coli CFT073
agcaccgcgaauuuuuuc

SEQ ID NO: 2625393 - RNA, 17 nt, Escherichia coli CFT073
agcaccgcgacaaucag

SEQ ID NO: 2625394 - RNA, 23 nt, Escherichia coli CFT073
agcaccguguuuucgucgccauc

SEQ ID NO: 2625395 - RNA, 12 nt, Escherichia coli CFT073
agcaccuaaauc

SEQ ID NO: 2625396 - RNA, 17 nt, Escherichia coli CFT073
agcaccuaaauccaccg

SEQ ID NO: 2625397 - RNA, 13 nt, Escherichia coli CFT073
agcaccugaaucc

SEQ ID NO: 2625398 - RNA, 15 nt, Escherichia coli CFT073
agcaccugcacaggc

SEQ ID NO: 2625399 - RNA, 16 nt, Escherichia coli CFT073
agcaccugcaucacgc

SEQ ID NO: 2625400 - RNA, 14 nt, Escherichia coli CFT073
agcacgaccgccau

SEQ ID NO: 2625401 - RNA, 17 nt, Escherichia coli CFT073
agcacgaccuugccaag

SEQ ID NO: 2625402 - RNA, 19 nt, Escherichia coli CFT073
agcacgaccuugccaaggu

SEQ ID NO: 2625403 - RNA, 13 nt, Escherichia coli CFT073
agcacgcaggcau

SEQ ID NO: 2625404 - RNA, 18 nt, Escherichia coli CFT073
agcacggauaccgcacgc

SEQ ID NO: 2625405 - RNA, 22 nt, Escherichia coli CFT073
agcacggauaccgcacgcucaa

SEQ ID NO: 2625406 - RNA, 15 nt, Escherichia coli CFT073
agcacggcaucaaug

SEQ ID NO: 2625407 - RNA, 15 nt, Escherichia coli CFT073
agcacggcgcagacg

SEQ ID NO: 2625408 - RNA, 14 nt, Escherichia coli CFT073
agcacgguggcugg

SEQ ID NO: 2625409 - RNA, 13 nt, Escherichia coli CFT073
agcacgguuuugu

SEQ ID NO: 2625410 - RNA, 18 nt, Escherichia coli CFT073
agcacguaaaucuuuacc

SEQ ID NO: 2625411 - RNA, 18 nt, Escherichia coli CFT073
agcacguuaaucaaauca

SEQ ID NO: 2625412 - RNA, 19 nt, Escherichia coli CFT073
agcacguuaaucaaaucaa

SEQ ID NO: 2625413 - RNA, 20 nt, Escherichia coli CFT073
agcacguuacccaaucgccc

SEQ ID NO: 2625414 - RNA, 14 nt, Escherichia coli CFT073
agcacuaccgcccg

SEQ ID NO: 2625415 - RNA, 13 nt, Escherichia coli CFT073
agcacuaccuugc

SEQ ID NO: 2625416 - RNA, 21 nt, Escherichia coli CFT073
agcacuacggagauuaaacgc

SEQ ID NO: 2625417 - RNA, 14 nt, Escherichia coli CFT073
agcacucacgccag

SEQ ID NO: 2625418 - RNA, 15 nt, Escherichia coli CFT073
agcacucacgccagg

SEQ ID NO: 2625419 - RNA, 17 nt, Escherichia coli CFT073
agcacucacgccaggca

SEQ ID NO: 2625420 - RNA, 21 nt, Escherichia coli CFT073
agcacugauuuuuuccaacag

SEQ ID NO: 2625421 - RNA, 18 nt, Escherichia coli CFT073
agcacugcgcccgccagc

SEQ ID NO: 2625422 - RNA, 24 nt, Escherichia coli CFT073
agcacuggcgaauucugcagacug

SEQ ID NO: 2625423 - RNA, 15 nt, Escherichia coli CFT073
agcacuggcggcagc

SEQ ID NO: 2625424 - RNA, 18 nt, Escherichia coli CFT073
agcacuggcggcagcagg

SEQ ID NO: 2625425 - RNA, 19 nt, Escherichia coli CFT073
agcacuggcggcagcaggu

SEQ ID NO: 2625426 - RNA, 20 nt, Escherichia coli CFT073
agcacugguggaaugguugg

SEQ ID NO: 2625427 - RNA, 22 nt, Escherichia coli CFT073
agcacuguucgccgcagccaga

SEQ ID NO: 2625428 - RNA, 23 nt, Escherichia coli CFT073
agcacuguucgccgcagccagau

SEQ ID NO: 2625429 - RNA, 21 nt, Escherichia coli CFT073
agcacuuccugaaucacaauc

SEQ ID NO: 2625430 - RNA, 16 nt, Escherichia coli CFT073
agcacuugcagcauau

SEQ ID NO: 2625431 - RNA, 23 nt, Escherichia coli CFT073
agcacuuuaucgaucacauccag

SEQ ID NO: 2625432 - RNA, 21 nt, Escherichia coli CFT073
agcacuuuucgcacugcaggc

SEQ ID NO: 2625433 - RNA, 19 nt, Escherichia coli CFT073
agcagaaaagaaccaaugc

SEQ ID NO: 2625434 - RNA, 13 nt, Escherichia coli CFT073
agcagaaagcgac

SEQ ID NO: 2625435 - RNA, 14 nt, Escherichia coli CFT073
agcagaaccaggga

SEQ ID NO: 2625436 - RNA, 18 nt, Escherichia coli CFT073
agcagaaccagggaaaaa

SEQ ID NO: 2625437 - RNA, 13 nt, Escherichia coli CFT073
agcagaagccgag

SEQ ID NO: 2625438 - RNA, 20 nt, Escherichia coli CFT073
agcagaaugaaugauacaga

SEQ ID NO: 2625439 - RNA, 22 nt, Escherichia coli CFT073
agcagaaugaaugauacagaaa

SEQ ID NO: 2625440 - RNA, 23 nt, Escherichia coli CFT073
agcagaaugaaugauacagaaag

SEQ ID NO: 2625441 - RNA, 20 nt, Escherichia coli CFT073
agcagaccaauguuacgacc

SEQ ID NO: 2625442 - RNA, 13 nt, Escherichia coli CFT073
agcagaccagcaa

SEQ ID NO: 2625443 - RNA, 19 nt, Escherichia coli CFT073
agcagacgcaucgcccagc

SEQ ID NO: 2625444 - RNA, 20 nt, Escherichia coli CFT073
agcagacgcaucgcccagcc

SEQ ID NO: 2625445 - RNA, 21 nt, Escherichia coli CFT073
agcagacgcaucgcccagcca

SEQ ID NO: 2625446 - RNA, 23 nt, Escherichia coli CFT073
agcagacgcuccauugcccgccc

SEQ ID NO: 2625447 - RNA, 17 nt, Escherichia coli CFT073
agcagacgcugcaccug

SEQ ID NO: 2625448 - RNA, 14 nt, Escherichia coli CFT073
agcagacguuaaug

SEQ ID NO: 2625449 - RNA, 19 nt, Escherichia coli CFT073
agcagacguuugcaauuug

SEQ ID NO: 2625450 - RNA, 16 nt, Escherichia coli CFT073
agcagagaaacgccag

SEQ ID NO: 2625451 - RNA, 18 nt, Escherichia coli CFT073
agcagagaaacgccagca

SEQ ID NO: 2625452 - RNA, 20 nt, Escherichia coli CFT073
agcagagaaacgccagcagc

SEQ ID NO: 2625453 - RNA, 16 nt, Escherichia coli CFT073
agcagagcaaaaaucg

SEQ ID NO: 2625454 - RNA, 15 nt, Escherichia coli CFT073
agcagagcaugguua

SEQ ID NO: 2625455 - RNA, 14 nt, Escherichia coli CFT073
agcagagccagaga

SEQ ID NO: 2625456 - RNA, 12 nt, Escherichia coli CFT073
agcagagcguuu

SEQ ID NO: 2625457 - RNA, 15 nt, Escherichia coli CFT073
agcagaggaauaucu

SEQ ID NO: 2625458 - RNA, 17 nt, Escherichia coli CFT073
agcagauaaaagaccac

SEQ ID NO: 2625459 - RNA, 18 nt, Escherichia coli CFT073
agcagauaaaagaccaca

SEQ ID NO: 2625460 - RNA, 22 nt, Escherichia coli CFT073
agcagauaaaagaccacaauca

SEQ ID NO: 2625461 - RNA, 21 nt, Escherichia coli CFT073
agcagauaccaacccuggugc

SEQ ID NO: 2625462 - RNA, 23 nt, Escherichia coli CFT073
agcagauacugaugaacgcgcag

SEQ ID NO: 2625463 - RNA, 19 nt, Escherichia coli CFT073
agcagauaucccgccagca

SEQ ID NO: 2625464 - RNA, 20 nt, Escherichia coli CFT073
agcagauaucccgccagcac

SEQ ID NO: 2625465 - RNA, 16 nt, Escherichia coli CFT073
agcagauccauugcga

SEQ ID NO: 2625466 - RNA, 14 nt, Escherichia coli CFT073
agcagaucgaacuc

SEQ ID NO: 2625467 - RNA, 23 nt, Escherichia coli CFT073
agcagauucaacauaaucggcgc

SEQ ID NO: 2625468 - RNA, 14 nt, Escherichia coli CFT073
agcagcaaacgccg

SEQ ID NO: 2625469 - RNA, 14 nt, Escherichia coli CFT073
agcagcaauauagc

SEQ ID NO: 2625470 - RNA, 17 nt, Escherichia coli CFT073
agcagcaauauguugau

SEQ ID NO: 2625471 - RNA, 14 nt, Escherichia coli CFT073
agcagcacaccaca

SEQ ID NO: 2625472 - RNA, 21 nt, Escherichia coli CFT073
agcagcacaccacaucgccga

SEQ ID NO: 2625473 - RNA, 17 nt, Escherichia coli CFT073
agcagcaccaccgcccg

SEQ ID NO: 2625474 - RNA, 13 nt, Escherichia coli CFT073
agcagcacccgau

SEQ ID NO: 2625475 - RNA, 17 nt, Escherichia coli CFT073
agcagcagaauuggcau

SEQ ID NO: 2625476 - RNA, 21 nt, Escherichia coli CFT073
agcagcagaauuggcaucagg

SEQ ID NO: 2625477 - RNA, 16 nt, Escherichia coli CFT073
agcagcaggaccauac

SEQ ID NO: 2625478 - RNA, 14 nt, Escherichia coli CFT073
agcagcaucaccac

SEQ ID NO: 2625479 - RNA, 15 nt, Escherichia coli CFT073
agcagcaucaccacg

SEQ ID NO: 2625480 - RNA, 13 nt, Escherichia coli CFT073
agcagcaucagca

SEQ ID NO: 2625481 - RNA, 17 nt, Escherichia coli CFT073
agcagccacaccaauca

SEQ ID NO: 2625482 - RNA, 15 nt, Escherichia coli CFT073
agcagccacugcggc

SEQ ID NO: 2625483 - RNA, 14 nt, Escherichia coli CFT073
agcagccagcgcuu

SEQ ID NO: 2625484 - RNA, 22 nt, Escherichia coli CFT073
agcagccagcgcuuugauggca

SEQ ID NO: 2625485 - RNA, 16 nt, Escherichia coli CFT073
agcagcccgagcaaca

SEQ ID NO: 2625486 - RNA, 16 nt, Escherichia coli CFT073
agcagcccggcaacca

SEQ ID NO: 2625487 - RNA, 12 nt, Escherichia coli CFT073
agcagcccugcc

SEQ ID NO: 2625488 - RNA, 16 nt, Escherichia coli CFT073
agcagcgaagcauuca

SEQ ID NO: 2625489 - RNA, 14 nt, Escherichia coli CFT073
agcagcgaauaauu

SEQ ID NO: 2625490 - RNA, 22 nt, Escherichia coli CFT073
agcagcgacucacgaaucgccu

SEQ ID NO: 2625491 - RNA, 12 nt, Escherichia coli CFT073
agcagcgcaauu

SEQ ID NO: 2625492 - RNA, 14 nt, Escherichia coli CFT073
agcagcgccaggca

SEQ ID NO: 2625493 - RNA, 16 nt, Escherichia coli CFT073
agcagcggcagaucaa

SEQ ID NO: 2625494 - RNA, 19 nt, Escherichia coli CFT073
agcagcggcagaucaaauu

SEQ ID NO: 2625495 - RNA, 16 nt, Escherichia coli CFT073
agcagcgguuucuccc

SEQ ID NO: 2625496 - RNA, 22 nt, Escherichia coli CFT073
agcagcucaaucgccucgccga

SEQ ID NO: 2625497 - RNA, 13 nt, Escherichia coli CFT073
agcagcucacgca

SEQ ID NO: 2625498 - RNA, 13 nt, Escherichia coli CFT073
agcagcuccgcca

SEQ ID NO: 2625499 - RNA, 14 nt, Escherichia coli CFT073
agcagcuccggcuc

SEQ ID NO: 2625500 - RNA, 15 nt, Escherichia coli CFT073
agcagcuccggcucu

SEQ ID NO: 2625501 - RNA, 23 nt, Escherichia coli CFT073
agcagcuccggcucuaaaucuuc

SEQ ID NO: 2625502 - RNA, 17 nt, Escherichia coli CFT073
agcagcugacugacuuc

SEQ ID NO: 2625503 - RNA, 16 nt, Escherichia coli CFT073
agcagcugcucccagc

SEQ ID NO: 2625504 - RNA, 17 nt, Escherichia coli CFT073
agcagcuuaagcgacca

SEQ ID NO: 2625505 - RNA, 12 nt, Escherichia coli CFT073
agcagcuugaga

SEQ ID NO: 2625506 - RNA, 14 nt, Escherichia coli CFT073
agcagcuugcgccg

SEQ ID NO: 2625507 - RNA, 18 nt, Escherichia coli CFT073
agcaggaaauauaaucgg

SEQ ID NO: 2625508 - RNA, 17 nt, Escherichia coli CFT073
agcaggaauaaucagca

SEQ ID NO: 2625509 - RNA, 18 nt, Escherichia coli CFT073
agcaggaccauacuggcg

SEQ ID NO: 2625510 - RNA, 19 nt, Escherichia coli CFT073
agcaggaucagaccgccaa

SEQ ID NO: 2625511 - RNA, 18 nt, Escherichia coli CFT073
agcaggaugacauaaccu

SEQ ID NO: 2625512 - RNA, 14 nt, Escherichia coli CFT073
agcaggcacuuggu

SEQ ID NO: 2625513 - RNA, 17 nt, Escherichia coli CFT073
agcaggcauccugaucg

SEQ ID NO: 2625514 - RNA, 20 nt, Escherichia coli CFT073
agcaggccauuugcucuacc

SEQ ID NO: 2625515 - RNA, 23 nt, Escherichia coli CFT073
agcaggccgucgcguagcaccac

SEQ ID NO: 2625516 - RNA, 23 nt, Escherichia coli CFT073
agcaggcugcgcgcuuucuccag

SEQ ID NO: 2625517 - RNA, 19 nt, Escherichia coli CFT073
agcagggcaaucgcgccaa

SEQ ID NO: 2625518 - RNA, 16 nt, Escherichia coli CFT073
agcaggguugcagcgg

SEQ ID NO: 2625519 - RNA, 16 nt, Escherichia coli CFT073
agcagguugaggugcu

SEQ ID NO: 2625520 - RNA, 19 nt, Escherichia coli CFT073
agcaguaaaccacccacca

SEQ ID NO: 2625521 - RNA, 15 nt, Escherichia coli CFT073
agcaguaauuuauag

SEQ ID NO: 2625522 - RNA, 22 nt, Escherichia coli CFT073
agcaguaauuuauagauucuac

SEQ ID NO: 2625523 - RNA, 13 nt, Escherichia coli CFT073
agcaguacagccg

SEQ ID NO: 2625524 - RNA, 16 nt, Escherichia coli CFT073
agcaguacagccgcca

SEQ ID NO: 2625525 - RNA, 23 nt, Escherichia coli CFT073
agcaguacgccgagaauaaaaca

SEQ ID NO: 2625526 - RNA, 17 nt, Escherichia coli CFT073
agcaguacggcagguca

SEQ ID NO: 2625527 - RNA, 21 nt, Escherichia coli CFT073
agcaguagcgucgccagcagu

SEQ ID NO: 2625528 - RNA, 17 nt, Escherichia coli CFT073
agcaguccagcgccuga

SEQ ID NO: 2625529 - RNA, 22 nt, Escherichia coli CFT073
agcaguccccagguuuucaacg

SEQ ID NO: 2625530 - RNA, 17 nt, Escherichia coli CFT073
agcaguggaucgaacuc

SEQ ID NO: 2625531 - RNA, 18 nt, Escherichia coli CFT073
agcagugggauuaaggcu

SEQ ID NO: 2625532 - RNA, 18 nt, Escherichia coli CFT073
agcaguguuuccggcauu

SEQ ID NO: 2625533 - RNA, 20 nt, Escherichia coli CFT073
agcaguuacuccgauuaccg

SEQ ID NO: 2625534 - RNA, 20 nt, Escherichia coli CFT073
agcaguuagcuuuucuccug

SEQ ID NO: 2625535 - RNA, 19 nt, Escherichia coli CFT073
agcaguucagucagcagug

SEQ ID NO: 2625536 - RNA, 14 nt, Escherichia coli CFT073
agcaguuccagcau

SEQ ID NO: 2625537 - RNA, 16 nt, Escherichia coli CFT073
agcaguucugccaggc

SEQ ID NO: 2625538 - RNA, 22 nt, Escherichia coli CFT073
agcaguucuuaaggcauauaug

SEQ ID NO: 2625539 - RNA, 14 nt, Escherichia coli CFT073
agcaguugcaggcu

SEQ ID NO: 2625540 - RNA, 21 nt, Escherichia coli CFT073
agcaguugugugccaguaaug

SEQ ID NO: 2625541 - RNA, 21 nt, Escherichia coli CFT073
agcaguuuagcucagaauucu

SEQ ID NO: 2625542 - RNA, 15 nt, Escherichia coli CFT073
agcaguuucaccagc

SEQ ID NO: 2625543 - RNA, 16 nt, Escherichia coli CFT073
agcaguuucaccagca

SEQ ID NO: 2625544 - RNA, 17 nt, Escherichia coli CFT073
agcaguuucgucaacuu

SEQ ID NO: 2625545 - RNA, 20 nt, Escherichia coli CFT073
agcaguuugaucgcuuccau

SEQ ID NO: 2625546 - RNA, 21 nt, Escherichia coli CFT073
agcaguuugaucgcuuccauu

SEQ ID NO: 2625547 - RNA, 22 nt, Escherichia coli CFT073
agcaguuuuuccccugccagau

SEQ ID NO: 2625548 - RNA, 14 nt, Escherichia coli CFT073
agcauaacaaaaug

SEQ ID NO: 2625549 - RNA, 17 nt, Escherichia coli CFT073
agcauaacaaaaugccg

SEQ ID NO: 2625550 - RNA, 17 nt, Escherichia coli CFT073
agcauaacguggcgcga

SEQ ID NO: 2625551 - RNA, 16 nt, Escherichia coli CFT073
agcauaauaagcuuuu

SEQ ID NO: 2625552 - RNA, 18 nt, Escherichia coli CFT073
agcauaaucaccaucagc

SEQ ID NO: 2625553 - RNA, 21 nt, Escherichia coli CFT073
agcauaaucaccaucagcagc

SEQ ID NO: 2625554 - RNA, 20 nt, Escherichia coli CFT073
agcauaccgccgaggaacau

SEQ ID NO: 2625555 - RNA, 23 nt, Escherichia coli CFT073
agcauaccgccgaggaacauaaa

SEQ ID NO: 2625556 - RNA, 13 nt, Escherichia coli CFT073
agcauaccuucac

SEQ ID NO: 2625557 - RNA, 15 nt, Escherichia coli CFT073
agcauaccuuccagc

SEQ ID NO: 2625558 - RNA, 21 nt, Escherichia coli CFT073
agcauacuaauaucauugaag

SEQ ID NO: 2625559 - RNA, 14 nt, Escherichia coli CFT073
agcauacuccagcc

SEQ ID NO: 2625560 - RNA, 18 nt, Escherichia coli CFT073
agcauagccccagcgcag

SEQ ID NO: 2625561 - RNA, 20 nt, Escherichia coli CFT073
agcauaguacgggcaauuuc

SEQ ID NO: 2625562 - RNA, 21 nt, Escherichia coli CFT073
agcauaugacgaaagcgcagu

SEQ ID NO: 2625563 - RNA, 19 nt, Escherichia coli CFT073
agcauauguuuacgcuggc

SEQ ID NO: 2625564 - RNA, 15 nt, Escherichia coli CFT073
agcaucaaacuuuua

SEQ ID NO: 2625565 - RNA, 19 nt, Escherichia coli CFT073
agcaucaaacuuuuaaauu

SEQ ID NO: 2625566 - RNA, 21 nt, Escherichia coli CFT073
agcaucaacccgcucauaaua

SEQ ID NO: 2625567 - RNA, 21 nt, Escherichia coli CFT073
agcaucaauacgauuaacgua

SEQ ID NO: 2625568 - RNA, 12 nt, Escherichia coli CFT073
agcaucaaugac

SEQ ID NO: 2625569 - RNA, 20 nt, Escherichia coli CFT073
agcaucaaugaccugacuuc

SEQ ID NO: 2625570 - RNA, 22 nt, Escherichia coli CFT073
agcaucacauaaucgaaaacau

SEQ ID NO: 2625571 - RNA, 16 nt, Escherichia coli CFT073
agcaucacgcaacauu

SEQ ID NO: 2625572 - RNA, 22 nt, Escherichia coli CFT073
agcaucagggagcggaauugcg

SEQ ID NO: 2625573 - RNA, 23 nt, Escherichia coli CFT073
agcaucauauggaagaaacgcuu

SEQ ID NO: 2625574 - RNA, 16 nt, Escherichia coli CFT073
agcaucccaccugaaa

SEQ ID NO: 2625575 - RNA, 14 nt, Escherichia coli CFT073
agcaucccaggcau

SEQ ID NO: 2625576 - RNA, 19 nt, Escherichia coli CFT073
agcaucccaggcauccagu

SEQ ID NO: 2625577 - RNA, 13 nt, Escherichia coli CFT073
agcauccgcgcac

SEQ ID NO: 2625578 - RNA, 21 nt, Escherichia coli CFT073
agcauccgcgcacaggcggcc

SEQ ID NO: 2625579 - RNA, 16 nt, Escherichia coli CFT073
agcauccugcacuuca

SEQ ID NO: 2625580 - RNA, 15 nt, Escherichia coli CFT073
agcaucgaccaugcu

SEQ ID NO: 2625581 - RNA, 21 nt, Escherichia coli CFT073
agcaucgcaacgcaucuuuuu

SEQ ID NO: 2625582 - RNA, 16 nt, Escherichia coli CFT073
agcaucgcaucaggcu

SEQ ID NO: 2625583 - RNA, 19 nt, Escherichia coli CFT073
agcaucgcccaggcgacca

SEQ ID NO: 2625584 - RNA, 15 nt, Escherichia coli CFT073
agcaucgcuagauau

SEQ ID NO: 2625585 - RNA, 21 nt, Escherichia coli CFT073
agcaucgcuagauauauauua

SEQ ID NO: 2625586 - RNA, 22 nt, Escherichia coli CFT073
agcaucggcaacgccagcgaag

SEQ ID NO: 2625587 - RNA, 23 nt, Escherichia coli CFT073
agcaucggcaacgccagcgaagc

SEQ ID NO: 2625588 - RNA, 16 nt, Escherichia coli CFT073
agcaucggcauaccca

SEQ ID NO: 2625589 - RNA, 15 nt, Escherichia coli CFT073
agcaucggccugcaa

SEQ ID NO: 2625590 - RNA, 18 nt, Escherichia coli CFT073
agcaucgguaucauccca

SEQ ID NO: 2625591 - RNA, 15 nt, Escherichia coli CFT073
agcaucgucacacca

SEQ ID NO: 2625592 - RNA, 14 nt, Escherichia coli CFT073
agcaucgucaucag

SEQ ID NO: 2625593 - RNA, 16 nt, Escherichia coli CFT073
agcaucgucaucagcu

SEQ ID NO: 2625594 - RNA, 13 nt, Escherichia coli CFT073
agcaucucaucca

SEQ ID NO: 2625595 - RNA, 16 nt, Escherichia coli CFT073
agcaucucauccauca

SEQ ID NO: 2625596 - RNA, 19 nt, Escherichia coli CFT073
agcaucucauccaucaaau

SEQ ID NO: 2625597 - RNA, 19 nt, Escherichia coli CFT073
agcaucugguaacccaucc

SEQ ID NO: 2625598 - RNA, 23 nt, Escherichia coli CFT073
agcaucuuaccgaugagcugcaa

SEQ ID NO: 2625599 - RNA, 17 nt, Escherichia coli CFT073
agcaugaacauugcugc

SEQ ID NO: 2625600 - RNA, 19 nt, Escherichia coli CFT073
agcaugaacauugcugcug

SEQ ID NO: 2625601 - RNA, 18 nt, Escherichia coli CFT073
agcaugaaguaacagaag

SEQ ID NO: 2625602 - RNA, 22 nt, Escherichia coli CFT073
agcaugaaguaacagaagauca

SEQ ID NO: 2625603 - RNA, 19 nt, Escherichia coli CFT073
agcaugaguaacccggcgu

SEQ ID NO: 2625604 - RNA, 21 nt, Escherichia coli CFT073
agcaugauuucaucaucaggc

SEQ ID NO: 2625605 - RNA, 18 nt, Escherichia coli CFT073
agcaugccuguggcgcga

SEQ ID NO: 2625606 - RNA, 16 nt, Escherichia coli CFT073
agcaugcugacugcgc

SEQ ID NO: 2625607 - RNA, 17 nt, Escherichia coli CFT073
agcauggcacgcuucau

SEQ ID NO: 2625608 - RNA, 21 nt, Escherichia coli CFT073
agcauggcacgcuucaucugc

SEQ ID NO: 2625609 - RNA, 23 nt, Escherichia coli CFT073
agcauggcuucuuccccggauga

SEQ ID NO: 2625610 - RNA, 17 nt, Escherichia coli CFT073
agcauggguaaagccca

SEQ ID NO: 2625611 - RNA, 12 nt, Escherichia coli CFT073
agcaugguaacg

SEQ ID NO: 2625612 - RNA, 15 nt, Escherichia coli CFT073
agcaugucuugccuc

SEQ ID NO: 2625613 - RNA, 19 nt, Escherichia coli CFT073
agcaugucuugccucccug

SEQ ID NO: 2625614 - RNA, 15 nt, Escherichia coli CFT073
agcaugugcaauuuc

SEQ ID NO: 2625615 - RNA, 13 nt, Escherichia coli CFT073
agcauguuccauu

SEQ ID NO: 2625616 - RNA, 18 nt, Escherichia coli CFT073
agcauguuccauugagaa

SEQ ID NO: 2625617 - RNA, 23 nt, Escherichia coli CFT073
agcauguuccauugagaaaaucc

SEQ ID NO: 2625618 - RNA, 22 nt, Escherichia coli CFT073
agcauuaacuccccuuuaaauu

SEQ ID NO: 2625619 - RNA, 14 nt, Escherichia coli CFT073
agcauuaccuucaa

SEQ ID NO: 2625620 - RNA, 23 nt, Escherichia coli CFT073
agcauuacgaaaucggcaccgcc

SEQ ID NO: 2625621 - RNA, 20 nt, Escherichia coli CFT073
agcauuacgcguccuuguaa

SEQ ID NO: 2625622 - RNA, 23 nt, Escherichia coli CFT073
agcauuacgcguccuuguaacgc

SEQ ID NO: 2625623 - RNA, 16 nt, Escherichia coli CFT073
agcauuauuuuugcua

SEQ ID NO: 2625624 - RNA, 15 nt, Escherichia coli CFT073
agcauucaucacaaa

SEQ ID NO: 2625625 - RNA, 24 nt, Escherichia coli CFT073
agcauucaucacaaaauagaaauu

SEQ ID NO: 2625626 - RNA, 16 nt, Escherichia coli CFT073
agcauuccuaaaccau

SEQ ID NO: 2625627 - RNA, 21 nt, Escherichia coli CFT073
agcauucgucauggcccauga

SEQ ID NO: 2625628 - RNA, 13 nt, Escherichia coli CFT073
agcauugcgccag

SEQ ID NO: 2625629 - RNA, 17 nt, Escherichia coli CFT073
agcauuggcaugcacgu

SEQ ID NO: 2625630 - RNA, 17 nt, Escherichia coli CFT073
agcauugucaggaucac

SEQ ID NO: 2625631 - RNA, 20 nt, Escherichia coli CFT073
agcauugucaggaucaccaa

SEQ ID NO: 2625632 - RNA, 17 nt, Escherichia coli CFT073
agcauuuggccuggccc

SEQ ID NO: 2625633 - RNA, 18 nt, Escherichia coli CFT073
agcauuuucucacuggcg

SEQ ID NO: 2625634 - RNA, 20 nt, Escherichia coli CFT073
agccaaacgcccagcuaauc

SEQ ID NO: 2625635 - RNA, 16 nt, Escherichia coli CFT073
agccaaagaauuggcu

SEQ ID NO: 2625636 - RNA, 18 nt, Escherichia coli CFT073
agccaaagcgacacaauc

SEQ ID NO: 2625637 - RNA, 13 nt, Escherichia coli CFT073
agccaaauccagc

SEQ ID NO: 2625638 - RNA, 14 nt, Escherichia coli CFT073
agccaaauccagca

SEQ ID NO: 2625639 - RNA, 13 nt, Escherichia coli CFT073
agccaaaucgccc

SEQ ID NO: 2625640 - RNA, 20 nt, Escherichia coli CFT073
agccaaaucgccccgcagcc

SEQ ID NO: 2625641 - RNA, 12 nt, Escherichia coli CFT073
agccaacagcag

SEQ ID NO: 2625642 - RNA, 19 nt, Escherichia coli CFT073
agccaacagcagccacacc

SEQ ID NO: 2625643 - RNA, 20 nt, Escherichia coli CFT073
agccaacagcagccacacca

SEQ ID NO: 2625644 - RNA, 22 nt, Escherichia coli CFT073
agccaaccgggccgcagagaua

SEQ ID NO: 2625645 - RNA, 22 nt, Escherichia coli CFT073
agccaacgcauuagcaguuacu

SEQ ID NO: 2625646 - RNA, 21 nt, Escherichia coli CFT073
agccaacgccuuuaccaccag

SEQ ID NO: 2625647 - RNA, 19 nt, Escherichia coli CFT073
agccaagcgccgccucagc

SEQ ID NO: 2625648 - RNA, 22 nt, Escherichia coli CFT073
agccaagcgccgccucagccag

SEQ ID NO: 2625649 - RNA, 23 nt, Escherichia coli CFT073
agccaaucaucguaccgauaccu

SEQ ID NO: 2625650 - RNA, 17 nt, Escherichia coli CFT073
agccaaucggcccgccc

SEQ ID NO: 2625651 - RNA, 17 nt, Escherichia coli CFT073
agccaauuugcgccgcc

SEQ ID NO: 2625652 - RNA, 17 nt, Escherichia coli CFT073
agccacacaccgcaaac

SEQ ID NO: 2625653 - RNA, 14 nt, Escherichia coli CFT073
agccacaggccgcu

SEQ ID NO: 2625654 - RNA, 14 nt, Escherichia coli CFT073
agccacaucgccau

SEQ ID NO: 2625655 - RNA, 20 nt, Escherichia coli CFT073
agccaccacgccaagaaaca

SEQ ID NO: 2625656 - RNA, 18 nt, Escherichia coli CFT073
agccaccgcccagagaau

SEQ ID NO: 2625657 - RNA, 20 nt, Escherichia coli CFT073
agccaccuggcugcguuuuc

SEQ ID NO: 2625658 - RNA, 17 nt, Escherichia coli CFT073
agccacgacguuuggug

SEQ ID NO: 2625659 - RNA, 20 nt, Escherichia coli CFT073
agccacgaucgaugugauaa

SEQ ID NO: 2625660 - RNA, 14 nt, Escherichia coli CFT073
agccacgcaccauc

SEQ ID NO: 2625661 - RNA, 20 nt, Escherichia coli CFT073
agccacgcgacauaaagcgc

SEQ ID NO: 2625662 - RNA, 22 nt, Escherichia coli CFT073
agccacgcguucggaccaaugc

SEQ ID NO: 2625663 - RNA, 14 nt, Escherichia coli CFT073
agccacggaauaaa

SEQ ID NO: 2625664 - RNA, 17 nt, Escherichia coli CFT073
agccacggaauaaaccg

SEQ ID NO: 2625665 - RNA, 12 nt, Escherichia coli CFT073
agccacggcagc

SEQ ID NO: 2625666 - RNA, 16 nt, Escherichia coli CFT073
agccacggcagcaacu

SEQ ID NO: 2625667 - RNA, 16 nt, Escherichia coli CFT073
agccacggcuccagca

SEQ ID NO: 2625668 - RNA, 18 nt, Escherichia coli CFT073
agccacggcuccagcaau

SEQ ID NO: 2625669 - RNA, 23 nt, Escherichia coli CFT073
agccacgguccgccauuuccagc

SEQ ID NO: 2625670 - RNA, 19 nt, Escherichia coli CFT073
agccacgucugccacggca

SEQ ID NO: 2625671 - RNA, 15 nt, Escherichia coli CFT073
agccacguuaauacu

SEQ ID NO: 2625672 - RNA, 16 nt, Escherichia coli CFT073
agccacucaccgccgu

SEQ ID NO: 2625673 - RNA, 16 nt, Escherichia coli CFT073
agccacugcgcaucuu

SEQ ID NO: 2625674 - RNA, 14 nt, Escherichia coli CFT073
agccagaaaucacc

SEQ ID NO: 2625675 - RNA, 15 nt, Escherichia coli CFT073
agccagaaaucacca

SEQ ID NO: 2625676 - RNA, 16 nt, Escherichia coli CFT073
agccagaaaucaccac

SEQ ID NO: 2625677 - RNA, 13 nt, Escherichia coli CFT073
agccagaagaaaa

SEQ ID NO: 2625678 - RNA, 22 nt, Escherichia coli CFT073
agccagacaaaugucagaaaga

SEQ ID NO: 2625679 - RNA, 14 nt, Escherichia coli CFT073
agccagacgugcac

SEQ ID NO: 2625680 - RNA, 18 nt, Escherichia coli CFT073
agccagaguugaaaaucu

SEQ ID NO: 2625681 - RNA, 15 nt, Escherichia coli CFT073
agccagauggcugcc

SEQ ID NO: 2625682 - RNA, 15 nt, Escherichia coli CFT073
agccagcaccaggcu

SEQ ID NO: 2625683 - RNA, 16 nt, Escherichia coli CFT073
agccagcaccaggcuu

SEQ ID NO: 2625684 - RNA, 17 nt, Escherichia coli CFT073
agccagcagagcaaaaa

SEQ ID NO: 2625685 - RNA, 14 nt, Escherichia coli CFT073
agccagcaucgcau

SEQ ID NO: 2625686 - RNA, 18 nt, Escherichia coli CFT073
agccagccaagcauguca

SEQ ID NO: 2625687 - RNA, 15 nt, Escherichia coli CFT073
agccagccccacagc

SEQ ID NO: 2625688 - RNA, 22 nt, Escherichia coli CFT073
agccagccuccaacccacaaaa

SEQ ID NO: 2625689 - RNA, 18 nt, Escherichia coli CFT073
agccagcgaccgcgccau

SEQ ID NO: 2625690 - RNA, 19 nt, Escherichia coli CFT073
agccagcgaccgcgccaua

SEQ ID NO: 2625691 - RNA, 18 nt, Escherichia coli CFT073
agccagcgcaccuucauu

SEQ ID NO: 2625692 - RNA, 14 nt, Escherichia coli CFT073
agccagcgcauccu

SEQ ID NO: 2625693 - RNA, 18 nt, Escherichia coli CFT073
agccagcgcauccuggcu

SEQ ID NO: 2625694 - RNA, 16 nt, Escherichia coli CFT073
agccagcggcggcaca

SEQ ID NO: 2625695 - RNA, 21 nt, Escherichia coli CFT073
agccagcguaccuugcggcgg

SEQ ID NO: 2625696 - RNA, 19 nt, Escherichia coli CFT073
agccagcguuacccagaca

SEQ ID NO: 2625697 - RNA, 15 nt, Escherichia coli CFT073
agccagcucgcgcca

SEQ ID NO: 2625698 - RNA, 21 nt, Escherichia coli CFT073
agccagcugccugccaguaaa

SEQ ID NO: 2625699 - RNA, 18 nt, Escherichia coli CFT073
agccaggacgauaaacca

SEQ ID NO: 2625700 - RNA, 23 nt, Escherichia coli CFT073
agccaggcaccaaaaaucaccgc

SEQ ID NO: 2625701 - RNA, 18 nt, Escherichia coli CFT073
agccagggauaagccaga

SEQ ID NO: 2625702 - RNA, 18 nt, Escherichia coli CFT073
agccaggucguggguuca

SEQ ID NO: 2625703 - RNA, 18 nt, Escherichia coli CFT073
agccagguuuaccagcag

SEQ ID NO: 2625704 - RNA, 15 nt, Escherichia coli CFT073
agccaguagaacaau

SEQ ID NO: 2625705 - RNA, 21 nt, Escherichia coli CFT073
agccaguagcaccucuccacg

SEQ ID NO: 2625706 - RNA, 15 nt, Escherichia coli CFT073
agccagugcccgcga

SEQ ID NO: 2625707 - RNA, 15 nt, Escherichia coli CFT073
agccaguucgagaaa

SEQ ID NO: 2625708 - RNA, 17 nt, Escherichia coli CFT073
agccaguucgagaaaaa

SEQ ID NO: 2625709 - RNA, 15 nt, Escherichia coli CFT073
agccaguugcucuuc

SEQ ID NO: 2625710 - RNA, 16 nt, Escherichia coli CFT073
agccaguuuuucuuuu

SEQ ID NO: 2625711 - RNA, 12 nt, Escherichia coli CFT073
agccauaaaauc

SEQ ID NO: 2625712 - RNA, 18 nt, Escherichia coli CFT073
agccauaaaaucacaggu

SEQ ID NO: 2625713 - RNA, 16 nt, Escherichia coli CFT073
agccauaaagaaauca

SEQ ID NO: 2625714 - RNA, 13 nt, Escherichia coli CFT073
agccauaaucugc

SEQ ID NO: 2625715 - RNA, 15 nt, Escherichia coli CFT073
agccauaccgggauc

SEQ ID NO: 2625716 - RNA, 15 nt, Escherichia coli CFT073
agccauaccuggugc

SEQ ID NO: 2625717 - RNA, 21 nt, Escherichia coli CFT073
agccauauggcugcauccaga

SEQ ID NO: 2625718 - RNA, 17 nt, Escherichia coli CFT073
agccaucaccggcaucu

SEQ ID NO: 2625719 - RNA, 15 nt, Escherichia coli CFT073
agccaucauuuuuac

SEQ ID NO: 2625720 - RNA, 18 nt, Escherichia coli CFT073
agccaucgacaccagcca

SEQ ID NO: 2625721 - RNA, 20 nt, Escherichia coli CFT073
agccaucgacaccagccaga

SEQ ID NO: 2625722 - RNA, 21 nt, Escherichia coli CFT073
agccaucgacaccagccagac

SEQ ID NO: 2625723 - RNA, 14 nt, Escherichia coli CFT073
agccaucgccaccg

SEQ ID NO: 2625724 - RNA, 21 nt, Escherichia coli CFT073
agccaucgccacugcaaauuu

SEQ ID NO: 2625725 - RNA, 15 nt, Escherichia coli CFT073
agccaucuggcugcc

SEQ ID NO: 2625726 - RNA, 19 nt, Escherichia coli CFT073
agccaugaaaaaguuaccu

SEQ ID NO: 2625727 - RNA, 23 nt, Escherichia coli CFT073
agccaugaaaaaguuaccuggau

SEQ ID NO: 2625728 - RNA, 20 nt, Escherichia coli CFT073
agccaugccgccaccaccag

SEQ ID NO: 2625729 - RNA, 15 nt, Escherichia coli CFT073
agccaugcggcaucu

SEQ ID NO: 2625730 - RNA, 19 nt, Escherichia coli CFT073
agccaugcggcaucuucuc

SEQ ID NO: 2625731 - RNA, 18 nt, Escherichia coli CFT073
agccauuaccgauaucaa

SEQ ID NO: 2625732 - RNA, 23 nt, Escherichia coli CFT073
agccauuaccgauaucaauaaca

SEQ ID NO: 2625733 - RNA, 20 nt, Escherichia coli CFT073
agccauucauucaaauuaaa

SEQ ID NO: 2625734 - RNA, 19 nt, Escherichia coli CFT073
agccauuccugcaccucaa

SEQ ID NO: 2625735 - RNA, 22 nt, Escherichia coli CFT073
agccauugaguagccucugcgu

SEQ ID NO: 2625736 - RNA, 14 nt, Escherichia coli CFT073
agccauuuuacuca

SEQ ID NO: 2625737 - RNA, 15 nt, Escherichia coli CFT073
agcccaaaaauugcc

SEQ ID NO: 2625738 - RNA, 23 nt, Escherichia coli CFT073
agcccaaagagcaagaaccccag

SEQ ID NO: 2625739 - RNA, 16 nt, Escherichia coli CFT073
agcccacaugccugca

SEQ ID NO: 2625740 - RNA, 12 nt, Escherichia coli CFT073
agcccaccccaa

SEQ ID NO: 2625741 - RNA, 22 nt, Escherichia coli CFT073
agcccacuacgcccgcaaucaa

SEQ ID NO: 2625742 - RNA, 19 nt, Escherichia coli CFT073
agcccagcgcuucagcgau

SEQ ID NO: 2625743 - RNA, 20 nt, Escherichia coli CFT073
agcccagcggaaauuaccgc

SEQ ID NO: 2625744 - RNA, 16 nt, Escherichia coli CFT073
agcccaggccaucgcc

SEQ ID NO: 2625745 - RNA, 18 nt, Escherichia coli CFT073
agcccaggccaucgccac

SEQ ID NO: 2625746 - RNA, 17 nt, Escherichia coli CFT073
agcccaguucagcggcu

SEQ ID NO: 2625747 - RNA, 19 nt, Escherichia coli CFT073
agcccaguucagcggcuga

SEQ ID NO: 2625748 - RNA, 13 nt, Escherichia coli CFT073
agcccaguuuuuc

SEQ ID NO: 2625749 - RNA, 18 nt, Escherichia coli CFT073
agcccauaccacagcaaa

SEQ ID NO: 2625750 - RNA, 22 nt, Escherichia coli CFT073
agcccauacuuaaugccaguuc

SEQ ID NO: 2625751 - RNA, 16 nt, Escherichia coli CFT073
agcccaucaccgccag

SEQ ID NO: 2625752 - RNA, 18 nt, Escherichia coli CFT073
agcccaucaccgccaggc

SEQ ID NO: 2625753 - RNA, 22 nt, Escherichia coli CFT073
agcccaucaccgccaggccuaa

SEQ ID NO: 2625754 - RNA, 21 nt, Escherichia coli CFT073
agcccaucagguccacgccau

SEQ ID NO: 2625755 - RNA, 20 nt, Escherichia coli CFT073
agcccaucauccgcgcaaua

SEQ ID NO: 2625756 - RNA, 17 nt, Escherichia coli CFT073
agcccaucgccagcgcu

SEQ ID NO: 2625757 - RNA, 18 nt, Escherichia coli CFT073
agcccaucgccagcgcuu

SEQ ID NO: 2625758 - RNA, 17 nt, Escherichia coli CFT073
agcccaucguugaaaaa

SEQ ID NO: 2625759 - RNA, 21 nt, Escherichia coli CFT073
agcccauuuuuuugagaacau

SEQ ID NO: 2625760 - RNA, 16 nt, Escherichia coli CFT073
agccccaccagcaaau

SEQ ID NO: 2625761 - RNA, 16 nt, Escherichia coli CFT073
agccccagaacucacg

SEQ ID NO: 2625762 - RNA, 15 nt, Escherichia coli CFT073
agccccagcgcaaua

SEQ ID NO: 2625763 - RNA, 15 nt, Escherichia coli CFT073
agccccaggucaaua

SEQ ID NO: 2625764 - RNA, 18 nt, Escherichia coli CFT073
agccccauaugcagcacu

SEQ ID NO: 2625765 - RNA, 23 nt, Escherichia coli CFT073
agccccauaugcagcacuugcag

SEQ ID NO: 2625766 - RNA, 17 nt, Escherichia coli CFT073
agccccaucagcgccau

SEQ ID NO: 2625767 - RNA, 23 nt, Escherichia coli CFT073
agcccccacgccauacccgcaca

SEQ ID NO: 2625768 - RNA, 14 nt, Escherichia coli CFT073
agcccccaguaauc

SEQ ID NO: 2625769 - RNA, 14 nt, Escherichia coli CFT073
agccccgcagccau

SEQ ID NO: 2625770 - RNA, 15 nt, Escherichia coli CFT073
agccccgcagccaug

SEQ ID NO: 2625771 - RNA, 15 nt, Escherichia coli CFT073
agccccgcgcggcgc

SEQ ID NO: 2625772 - RNA, 16 nt, Escherichia coli CFT073
agccccucagcgguca

SEQ ID NO: 2625773 - RNA, 15 nt, Escherichia coli CFT073
agccccuucgccagu

SEQ ID NO: 2625774 - RNA, 14 nt, Escherichia coli CFT073
agcccgagcaacag

SEQ ID NO: 2625775 - RNA, 15 nt, Escherichia coli CFT073
agcccgagcaacagu

SEQ ID NO: 2625776 - RNA, 20 nt, Escherichia coli CFT073
agcccgauggcaucaccauc

SEQ ID NO: 2625777 - RNA, 18 nt, Escherichia coli CFT073
agcccgcagcguccagcg

SEQ ID NO: 2625778 - RNA, 17 nt, Escherichia coli CFT073
agcccgccaaugccgcg

SEQ ID NO: 2625779 - RNA, 15 nt, Escherichia coli CFT073
agcccgccgagaauu

SEQ ID NO: 2625780 - RNA, 12 nt, Escherichia coli CFT073
agcccgccgcca

SEQ ID NO: 2625781 - RNA, 22 nt, Escherichia coli CFT073
agcccgccgccacaaucaccag

SEQ ID NO: 2625782 - RNA, 14 nt, Escherichia coli CFT073
agcccgcugguugu

SEQ ID NO: 2625783 - RNA, 18 nt, Escherichia coli CFT073
agcccgcuucaaacgcug

SEQ ID NO: 2625784 - RNA, 16 nt, Escherichia coli CFT073
agcccgggcacaucac

SEQ ID NO: 2625785 - RNA, 16 nt, Escherichia coli CFT073
agcccguguuucugau

SEQ ID NO: 2625786 - RNA, 22 nt, Escherichia coli CFT073
agcccguuacccugguggccau

SEQ ID NO: 2625787 - RNA, 17 nt, Escherichia coli CFT073
agcccguucuucgccau

SEQ ID NO: 2625788 - RNA, 15 nt, Escherichia coli CFT073
agcccuacaaaccau

SEQ ID NO: 2625789 - RNA, 16 nt, Escherichia coli CFT073
agcccuacaaaccauc

SEQ ID NO: 2625790 - RNA, 24 nt, Escherichia coli CFT073
agcccuaucaucgcggcacacagc

SEQ ID NO: 2625791 - RNA, 17 nt, Escherichia coli CFT073
agcccuccucacuguug

SEQ ID NO: 2625792 - RNA, 12 nt, Escherichia coli CFT073
agcccugcaggg

SEQ ID NO: 2625793 - RNA, 12 nt, Escherichia coli CFT073
agcccugccgga

SEQ ID NO: 2625794 - RNA, 11 nt, Escherichia coli CFT073
agcccugcucg

SEQ ID NO: 2625795 - RNA, 21 nt, Escherichia coli CFT073
agcccugucgaggccaauuug

SEQ ID NO: 2625796 - RNA, 11 nt, Escherichia coli CFT073
agcccuucuuu

SEQ ID NO: 2625797 - RNA, 19 nt, Escherichia coli CFT073
agcccuugcuucgccaguu

SEQ ID NO: 2625798 - RNA, 16 nt, Escherichia coli CFT073
agcccuuucgacgcgu

SEQ ID NO: 2625799 - RNA, 12 nt, Escherichia coli CFT073
agcccuuucuuu

SEQ ID NO: 2625800 - RNA, 22 nt, Escherichia coli CFT073
agcccuuugauuugucugccau

SEQ ID NO: 2625801 - RNA, 14 nt, Escherichia coli CFT073
agccgaacagucgc

SEQ ID NO: 2625802 - RNA, 15 nt, Escherichia coli CFT073
agccgaccagcaccg

SEQ ID NO: 2625803 - RNA, 14 nt, Escherichia coli CFT073
agccgaccgcaagg

SEQ ID NO: 2625804 - RNA, 20 nt, Escherichia coli CFT073
agccgagcgcuaccaucgac

SEQ ID NO: 2625805 - RNA, 22 nt, Escherichia coli CFT073
agccgagcgcuaccaucgacac

SEQ ID NO: 2625806 - RNA, 14 nt, Escherichia coli CFT073
agccgaucagcggc

SEQ ID NO: 2625807 - RNA, 12 nt, Escherichia coli CFT073
agccgauccgcg

SEQ ID NO: 2625808 - RNA, 18 nt, Escherichia coli CFT073
agccgauguuauugcaga

SEQ ID NO: 2625809 - RNA, 12 nt, Escherichia coli CFT073
agccgauuaaaa

SEQ ID NO: 2625810 - RNA, 15 nt, Escherichia coli CFT073
agccgauuaaaauca

SEQ ID NO: 2625811 - RNA, 17 nt, Escherichia coli CFT073
agccgauuaaucuucca

SEQ ID NO: 2625812 - RNA, 21 nt, Escherichia coli CFT073
agccgauuaaucuuccagauc

SEQ ID NO: 2625813 - RNA, 16 nt, Escherichia coli CFT073
agccgcauaguccagu

SEQ ID NO: 2625814 - RNA, 14 nt, Escherichia coli CFT073
agccgcauccgaca

SEQ ID NO: 2625815 - RNA, 21 nt, Escherichia coli CFT073
agccgcauccgacacuggcag

SEQ ID NO: 2625816 - RNA, 16 nt, Escherichia coli CFT073
agccgccaaacgccgc

SEQ ID NO: 2625817 - RNA, 22 nt, Escherichia coli CFT073
agccgccaccagaaccgccgcu

SEQ ID NO: 2625818 - RNA, 18 nt, Escherichia coli CFT073
agccgccauacggaaaau

SEQ ID NO: 2625819 - RNA, 13 nt, Escherichia coli CFT073
agccgccauucca

SEQ ID NO: 2625820 - RNA, 14 nt, Escherichia coli CFT073
agccgcccagcgaa

SEQ ID NO: 2625821 - RNA, 11 nt, Escherichia coli CFT073
agccgccgcau

SEQ ID NO: 2625822 - RNA, 12 nt, Escherichia coli CFT073
agccgccgccau

SEQ ID NO: 2625823 - RNA, 19 nt, Escherichia coli CFT073
agccgccugcgaguuuuac

SEQ ID NO: 2625824 - RNA, 20 nt, Escherichia coli CFT073
agccgccuuuacgcaaagca

SEQ ID NO: 2625825 - RNA, 17 nt, Escherichia coli CFT073
agccgccuuuuuguugu

SEQ ID NO: 2625826 - RNA, 21 nt, Escherichia coli CFT073
agccgcgaaacugcguggcga

SEQ ID NO: 2625827 - RNA, 17 nt, Escherichia coli CFT073
agccgcgcuuucuucuu

SEQ ID NO: 2625828 - RNA, 14 nt, Escherichia coli CFT073
agccgcggcguugc

SEQ ID NO: 2625829 - RNA, 13 nt, Escherichia coli CFT073
agccgcgugcugc

SEQ ID NO: 2625830 - RNA, 17 nt, Escherichia coli CFT073
agccgcuaacagcagca

SEQ ID NO: 2625831 - RNA, 19 nt, Escherichia coli CFT073
agccgcuccggcagcagca

SEQ ID NO: 2625832 - RNA, 19 nt, Escherichia coli CFT073
agccgcuggcgcagcaggc

SEQ ID NO: 2625833 - RNA, 17 nt, Escherichia coli CFT073
agccgcuucugcagcuu

SEQ ID NO: 2625834 - RNA, 12 nt, Escherichia coli CFT073
agccgcuugcga

SEQ ID NO: 2625835 - RNA, 15 nt, Escherichia coli CFT073
agccgcuugcgauau

SEQ ID NO: 2625836 - RNA, 18 nt, Escherichia coli CFT073
agccgcuuuuucugcaca

SEQ ID NO: 2625837 - RNA, 21 nt, Escherichia coli CFT073
agccggaauauucuuccggcu

SEQ ID NO: 2625838 - RNA, 14 nt, Escherichia coli CFT073
agccggagcuucac

SEQ ID NO: 2625839 - RNA, 17 nt, Escherichia coli CFT073
agccggaguugcagauu

SEQ ID NO: 2625840 - RNA, 18 nt, Escherichia coli CFT073
agccggauaaugcgccag

SEQ ID NO: 2625841 - RNA, 19 nt, Escherichia coli CFT073
agccggauaaugcgccaga

SEQ ID NO: 2625842 - RNA, 22 nt, Escherichia coli CFT073
agccggauagaguguuguggau

SEQ ID NO: 2625843 - RNA, 15 nt, Escherichia coli CFT073
agccggaugaucauc

SEQ ID NO: 2625844 - RNA, 13 nt, Escherichia coli CFT073
agccgguaaauca

SEQ ID NO: 2625845 - RNA, 21 nt, Escherichia coli CFT073
agccgguaaucaccagcaaca

SEQ ID NO: 2625846 - RNA, 17 nt, Escherichia coli CFT073
agccggugcuugcaccg

SEQ ID NO: 2625847 - RNA, 20 nt, Escherichia coli CFT073
agccgguuuugguuuucugu

SEQ ID NO: 2625848 - RNA, 21 nt, Escherichia coli CFT073
agccgguuuugguuuucuguc

SEQ ID NO: 2625849 - RNA, 19 nt, Escherichia coli CFT073
agccguaaacgugcgcgaa

SEQ ID NO: 2625850 - RNA, 19 nt, Escherichia coli CFT073
agccguagcuggcaaugau

SEQ ID NO: 2625851 - RNA, 16 nt, Escherichia coli CFT073
agccguaggugaaacg

SEQ ID NO: 2625852 - RNA, 13 nt, Escherichia coli CFT073
agccgugaaaaca

SEQ ID NO: 2625853 - RNA, 14 nt, Escherichia coli CFT073
agccgugccagaug

SEQ ID NO: 2625854 - RNA, 14 nt, Escherichia coli CFT073
agccguuaaaacga

SEQ ID NO: 2625855 - RNA, 18 nt, Escherichia coli CFT073
agccguucuggugggcga

SEQ ID NO: 2625856 - RNA, 19 nt, Escherichia coli CFT073
agccguuggucaucaucag

SEQ ID NO: 2625857 - RNA, 16 nt, Escherichia coli CFT073
agccguuuaauugccu

SEQ ID NO: 2625858 - RNA, 16 nt, Escherichia coli CFT073
agccuaacacagcaau

SEQ ID NO: 2625859 - RNA, 23 nt, Escherichia coli CFT073
agccuaagccauuuaacucaccg

SEQ ID NO: 2625860 - RNA, 16 nt, Escherichia coli CFT073
agccuacagaacgcug

SEQ ID NO: 2625861 - RNA, 17 nt, Escherichia coli CFT073
agccuacagaacgcugc

SEQ ID NO: 2625862 - RNA, 13 nt, Escherichia coli CFT073
agccuaccagacc

SEQ ID NO: 2625863 - RNA, 14 nt, Escherichia coli CFT073
agccuaccggcaua

SEQ ID NO: 2625864 - RNA, 14 nt, Escherichia coli CFT073
agccuaugcagguu

SEQ ID NO: 2625865 - RNA, 13 nt, Escherichia coli CFT073
agccucaagcacc

SEQ ID NO: 2625866 - RNA, 21 nt, Escherichia coli CFT073
agccucaagcacccaaugcca

SEQ ID NO: 2625867 - RNA, 14 nt, Escherichia coli CFT073
agccucaaugcuga

SEQ ID NO: 2625868 - RNA, 19 nt, Escherichia coli CFT073
agccucacgguucauuagu

SEQ ID NO: 2625869 - RNA, 12 nt, Escherichia coli CFT073
agccucauccau

SEQ ID NO: 2625870 - RNA, 19 nt, Escherichia coli CFT073
agccuccaacccacaaaaa

SEQ ID NO: 2625871 - RNA, 15 nt, Escherichia coli CFT073
agccucccgcaacau

SEQ ID NO: 2625872 - RNA, 17 nt, Escherichia coli CFT073
agccucccgcaacauau

SEQ ID NO: 2625873 - RNA, 15 nt, Escherichia coli CFT073
agccuccggccacga

SEQ ID NO: 2625874 - RNA, 20 nt, Escherichia coli CFT073
agccucgcugcucacaccau

SEQ ID NO: 2625875 - RNA, 22 nt, Escherichia coli CFT073
agccucgcugcucacaccaugc

SEQ ID NO: 2625876 - RNA, 15 nt, Escherichia coli CFT073
agccucucucugagg

SEQ ID NO: 2625877 - RNA, 18 nt, Escherichia coli CFT073
agccucugcguuauuuuc

SEQ ID NO: 2625878 - RNA, 18 nt, Escherichia coli CFT073
agccugaacgagaaaagc

SEQ ID NO: 2625879 - RNA, 12 nt, Escherichia coli CFT073
agccugaauaaa

SEQ ID NO: 2625880 - RNA, 15 nt, Escherichia coli CFT073
agccugaauaaacgc

SEQ ID NO: 2625881 - RNA, 14 nt, Escherichia coli CFT073
agccugaaugccgc

SEQ ID NO: 2625882 - RNA, 15 nt, Escherichia coli CFT073
agccugaaugccgcg

SEQ ID NO: 2625883 - RNA, 20 nt, Escherichia coli CFT073
agccugaaugccgcgcccca

SEQ ID NO: 2625884 - RNA, 15 nt, Escherichia coli CFT073
agccugacauuuccg

SEQ ID NO: 2625885 - RNA, 21 nt, Escherichia coli CFT073
agccugacgcccguuuucacc

SEQ ID NO: 2625886 - RNA, 18 nt, Escherichia coli CFT073
agccugaugcgaugcugg

SEQ ID NO: 2625887 - RNA, 18 nt, Escherichia coli CFT073
agccugauguagcgugau

SEQ ID NO: 2625888 - RNA, 22 nt, Escherichia coli CFT073
agccugauguagcgugauuuuu

SEQ ID NO: 2625889 - RNA, 22 nt, Escherichia coli CFT073
agccugcaauuuccgcuuucaa

SEQ ID NO: 2625890 - RNA, 18 nt, Escherichia coli CFT073
agccugccaauggcagga

SEQ ID NO: 2625891 - RNA, 19 nt, Escherichia coli CFT073
agccugccaguggagccau

SEQ ID NO: 2625892 - RNA, 23 nt, Escherichia coli CFT073
agccugcgcuaccagaaagcgac

SEQ ID NO: 2625893 - RNA, 18 nt, Escherichia coli CFT073
agccugcggauaaucgcg

SEQ ID NO: 2625894 - RNA, 15 nt, Escherichia coli CFT073
agccugcuuaagacg

SEQ ID NO: 2625895 - RNA, 13 nt, Escherichia coli CFT073
agccuggaauuuc

SEQ ID NO: 2625896 - RNA, 22 nt, Escherichia coli CFT073
agccuggcugcgugaggcgguc

SEQ ID NO: 2625897 - RNA, 18 nt, Escherichia coli CFT073
agccuguccacauccaga

SEQ ID NO: 2625898 - RNA, 21 nt, Escherichia coli CFT073
agccuucgccuuucaguucaa

SEQ ID NO: 2625899 - RNA, 19 nt, Escherichia coli CFT073
agccuugcugaaucaaaua

SEQ ID NO: 2625900 - RNA, 13 nt, Escherichia coli CFT073
agccuuucucgcg

SEQ ID NO: 2625901 - RNA, 21 nt, Escherichia coli CFT073
agccuuugacuauuucaucag

SEQ ID NO: 2625902 - RNA, 22 nt, Escherichia coli CFT073
agccuuugacuauuucaucaga

SEQ ID NO: 2625903 - RNA, 18 nt, Escherichia coli CFT073
agccuuuuucagccgcaa

SEQ ID NO: 2625904 - RNA, 14 nt, Escherichia coli CFT073
agccuuuuucucug

SEQ ID NO: 2625905 - RNA, 21 nt, Escherichia coli CFT073
agcgaaaaagucccuucccag

SEQ ID NO: 2625906 - RNA, 13 nt, Escherichia coli CFT073
agcgaaacagcug

SEQ ID NO: 2625907 - RNA, 14 nt, Escherichia coli CFT073
agcgaaauaaaagu

SEQ ID NO: 2625908 - RNA, 21 nt, Escherichia coli CFT073
agcgaaaucaacacgccugca

SEQ ID NO: 2625909 - RNA, 13 nt, Escherichia coli CFT073
agcgaacaccagc

SEQ ID NO: 2625910 - RNA, 15 nt, Escherichia coli CFT073
agcgaacaccagcag

SEQ ID NO: 2625911 - RNA, 20 nt, Escherichia coli CFT073
agcgaaccguucauuucacg

SEQ ID NO: 2625912 - RNA, 16 nt, Escherichia coli CFT073
agcgaacgacauccgc

SEQ ID NO: 2625913 - RNA, 15 nt, Escherichia coli CFT073
agcgaagccagcucc

SEQ ID NO: 2625914 - RNA, 15 nt, Escherichia coli CFT073
agcgaagcccacacc

SEQ ID NO: 2625915 - RNA, 17 nt, Escherichia coli CFT073
agcgaagcccacaccgc

SEQ ID NO: 2625916 - RNA, 16 nt, Escherichia coli CFT073
agcgaagcgaacaucg

SEQ ID NO: 2625917 - RNA, 18 nt, Escherichia coli CFT073
agcgaagcgcaugccuuc

SEQ ID NO: 2625918 - RNA, 17 nt, Escherichia coli CFT073
agcgaagcggcacugcu

SEQ ID NO: 2625919 - RNA, 18 nt, Escherichia coli CFT073
agcgaagguaacaccagu

SEQ ID NO: 2625920 - RNA, 20 nt, Escherichia coli CFT073
agcgaagguguugaaaugag

SEQ ID NO: 2625921 - RNA, 22 nt, Escherichia coli CFT073
agcgaagguguugaaaugagaa

SEQ ID NO: 2625922 - RNA, 22 nt, Escherichia coli CFT073
agcgaauaauucagcccaaaga

SEQ ID NO: 2625923 - RNA, 18 nt, Escherichia coli CFT073
agcgaauaccccagcggc

SEQ ID NO: 2625924 - RNA, 16 nt, Escherichia coli CFT073
agcgaauaucauugcc

SEQ ID NO: 2625925 - RNA, 20 nt, Escherichia coli CFT073
agcgaauuaagaauuucuca

SEQ ID NO: 2625926 - RNA, 15 nt, Escherichia coli CFT073
agcgacaaucccugc

SEQ ID NO: 2625927 - RNA, 17 nt, Escherichia coli CFT073
agcgacaaucccugcau

SEQ ID NO: 2625928 - RNA, 17 nt, Escherichia coli CFT073
agcgacagauucagcgc

SEQ ID NO: 2625929 - RNA, 16 nt, Escherichia coli CFT073
agcgacagccagccca

SEQ ID NO: 2625930 - RNA, 13 nt, Escherichia coli CFT073
agcgaccaaccau

SEQ ID NO: 2625931 - RNA, 12 nt, Escherichia coli CFT073
agcgaccaccac

SEQ ID NO: 2625932 - RNA, 12 nt, Escherichia coli CFT073
agcgaccauaac

SEQ ID NO: 2625933 - RNA, 21 nt, Escherichia coli CFT073
agcgacggaguugacacugaa

SEQ ID NO: 2625934 - RNA, 21 nt, Escherichia coli CFT073
agcgacgggcgacaaacgcug

SEQ ID NO: 2625935 - RNA, 22 nt, Escherichia coli CFT073
agcgacgugcaguagcagcagg

SEQ ID NO: 2625936 - RNA, 14 nt, Escherichia coli CFT073
agcgacuccaguuc

SEQ ID NO: 2625937 - RNA, 13 nt, Escherichia coli CFT073
agcgagaguaauu

SEQ ID NO: 2625938 - RNA, 17 nt, Escherichia coli CFT073
agcgagauaaugcgcca

SEQ ID NO: 2625939 - RNA, 21 nt, Escherichia coli CFT073
agcgagauaaugcgccagacg

SEQ ID NO: 2625940 - RNA, 13 nt, Escherichia coli CFT073
agcgagcaguaca

SEQ ID NO: 2625941 - RNA, 22 nt, Escherichia coli CFT073
agcgaggcaaucagcaguauca

SEQ ID NO: 2625942 - RNA, 14 nt, Escherichia coli CFT073
agcgaggccagcca

SEQ ID NO: 2625943 - RNA, 16 nt, Escherichia coli CFT073
agcgagugccggggcc

SEQ ID NO: 2625944 - RNA, 16 nt, Escherichia coli CFT073
agcgaguuaccacgcc

SEQ ID NO: 2625945 - RNA, 15 nt, Escherichia coli CFT073
agcgaguuauugaua

SEQ ID NO: 2625946 - RNA, 11 nt, Escherichia coli CFT073
agcgaguugau

SEQ ID NO: 2625947 - RNA, 19 nt, Escherichia coli CFT073
agcgauaaaaauaccgagc

SEQ ID NO: 2625948 - RNA, 20 nt, Escherichia coli CFT073
agcgauaacguguuccaguu

SEQ ID NO: 2625949 - RNA, 14 nt, Escherichia coli CFT073
agcgauacgccaga

SEQ ID NO: 2625950 - RNA, 15 nt, Escherichia coli CFT073
agcgauacucucgcg

SEQ ID NO: 2625951 - RNA, 22 nt, Escherichia coli CFT073
agcgauaugccccagcccgcca

SEQ ID NO: 2625952 - RNA, 14 nt, Escherichia coli CFT073
agcgauccaguucc

SEQ ID NO: 2625953 - RNA, 20 nt, Escherichia coli CFT073
agcgauccggguaauaaacc

SEQ ID NO: 2625954 - RNA, 14 nt, Escherichia coli CFT073
agcgaucuguucau

SEQ ID NO: 2625955 - RNA, 20 nt, Escherichia coli CFT073
agcgaucuuugcccauaccc

SEQ ID NO: 2625956 - RNA, 12 nt, Escherichia coli CFT073
agcgaugaagua

SEQ ID NO: 2625957 - RNA, 13 nt, Escherichia coli CFT073
agcgaugaaguaa

SEQ ID NO: 2625958 - RNA, 16 nt, Escherichia coli CFT073
agcgaugagagaucga

SEQ ID NO: 2625959 - RNA, 23 nt, Escherichia coli CFT073
agcgaugguacuucaaucgccac

SEQ ID NO: 2625960 - RNA, 21 nt, Escherichia coli CFT073
agcgauucccguuuauggucg

SEQ ID NO: 2625961 - RNA, 23 nt, Escherichia coli CFT073
agcgauuugucggcaauuucacu

SEQ ID NO: 2625962 - RNA, 22 nt, Escherichia coli CFT073
agcgcaaaauaccagcaauuug

SEQ ID NO: 2625963 - RNA, 17 nt, Escherichia coli CFT073
agcgcaaaggccagcaa

SEQ ID NO: 2625964 - RNA, 19 nt, Escherichia coli CFT073
agcgcaaaggccagcaauc

SEQ ID NO: 2625965 - RNA, 18 nt, Escherichia coli CFT073
agcgcaaaucaacuaaaa

SEQ ID NO: 2625966 - RNA, 15 nt, Escherichia coli CFT073
agcgcaaauugcugg

SEQ ID NO: 2625967 - RNA, 16 nt, Escherichia coli CFT073
agcgcaacuugugcuc

SEQ ID NO: 2625968 - RNA, 23 nt, Escherichia coli CFT073
agcgcaacuuuacucauccccug

SEQ ID NO: 2625969 - RNA, 13 nt, Escherichia coli CFT073
agcgcaagccacg

SEQ ID NO: 2625970 - RNA, 19 nt, Escherichia coli CFT073
agcgcaauagccugaugua

SEQ ID NO: 2625971 - RNA, 21 nt, Escherichia coli CFT073
agcgcaauagugauguucugg

SEQ ID NO: 2625972 - RNA, 13 nt, Escherichia coli CFT073
agcgcaaucgccu

SEQ ID NO: 2625973 - RNA, 17 nt, Escherichia coli CFT073
agcgcacagagcacuaa

SEQ ID NO: 2625974 - RNA, 19 nt, Escherichia coli CFT073
agcgcacagagcacuaaca

SEQ ID NO: 2625975 - RNA, 11 nt, Escherichia coli CFT073
agcgcacaugc

SEQ ID NO: 2625976 - RNA, 16 nt, Escherichia coli CFT073
agcgcaccaaccacug

SEQ ID NO: 2625977 - RNA, 17 nt, Escherichia coli CFT073
agcgcaccagaaacaau

SEQ ID NO: 2625978 - RNA, 14 nt, Escherichia coli CFT073
agcgcaccauaguc

SEQ ID NO: 2625979 - RNA, 14 nt, Escherichia coli CFT073
agcgcacgccgcgu

SEQ ID NO: 2625980 - RNA, 14 nt, Escherichia coli CFT073
agcgcacugcgcga

SEQ ID NO: 2625981 - RNA, 15 nt, Escherichia coli CFT073
agcgcacuuugcugg

SEQ ID NO: 2625982 - RNA, 14 nt, Escherichia coli CFT073
agcgcagacaccag

SEQ ID NO: 2625983 - RNA, 14 nt, Escherichia coli CFT073
agcgcagcaacauc

SEQ ID NO: 2625984 - RNA, 15 nt, Escherichia coli CFT073
agcgcagcaacauca

SEQ ID NO: 2625985 - RNA, 13 nt, Escherichia coli CFT073
agcgcagcaccca

SEQ ID NO: 2625986 - RNA, 14 nt, Escherichia coli CFT073
agcgcagcagauaa

SEQ ID NO: 2625987 - RNA, 15 nt, Escherichia coli CFT073
agcgcagcagauaaa

SEQ ID NO: 2625988 - RNA, 15 nt, Escherichia coli CFT073
agcgcagcgcaucag

SEQ ID NO: 2625989 - RNA, 20 nt, Escherichia coli CFT073
agcgcagcuuccggccagca

SEQ ID NO: 2625990 - RNA, 21 nt, Escherichia coli CFT073
agcgcaggaaagauaagcgaa

SEQ ID NO: 2625991 - RNA, 24 nt, Escherichia coli CFT073
agcgcaggaaagauaagcgaacau

SEQ ID NO: 2625992 - RNA, 21 nt, Escherichia coli CFT073
agcgcaggggcaaucagcacu

SEQ ID NO: 2625993 - RNA, 15 nt, Escherichia coli CFT073
agcgcagucaccagc

SEQ ID NO: 2625994 - RNA, 20 nt, Escherichia coli CFT073
agcgcagugacauucaccuc

SEQ ID NO: 2625995 - RNA, 19 nt, Escherichia coli CFT073
agcgcauaaaagauaaacg

SEQ ID NO: 2625996 - RNA, 14 nt, Escherichia coli CFT073
agcgcauaaaagcu

SEQ ID NO: 2625997 - RNA, 16 nt, Escherichia coli CFT073
agcgcauaagccacaa

SEQ ID NO: 2625998 - RNA, 14 nt, Escherichia coli CFT073
agcgcaucaggcaa

SEQ ID NO: 2625999 - RNA, 21 nt, Escherichia coli CFT073
agcgcaucaggcaaucuuguu

SEQ ID NO: 2626000 - RNA, 16 nt, Escherichia coli CFT073
agcgcaucgacgccau

SEQ ID NO: 2626001 - RNA, 22 nt, Escherichia coli CFT073
agcgcaucguagauuucauccg

SEQ ID NO: 2626002 - RNA, 14 nt, Escherichia coli CFT073
agcgcaugacaugc

SEQ ID NO: 2626003 - RNA, 14 nt, Escherichia coli CFT073
agcgcaugauuuuc

SEQ ID NO: 2626004 - RNA, 16 nt, Escherichia coli CFT073
agcgcaugauuuucau

SEQ ID NO: 2626005 - RNA, 20 nt, Escherichia coli CFT073
agcgcauguuccucaucguc

SEQ ID NO: 2626006 - RNA, 18 nt, Escherichia coli CFT073
agcgcauuucauggcgga

SEQ ID NO: 2626007 - RNA, 19 nt, Escherichia coli CFT073
agcgcauuucauggcggaa

SEQ ID NO: 2626008 - RNA, 19 nt, Escherichia coli CFT073
agcgcauuuccaagauuaa

SEQ ID NO: 2626009 - RNA, 14 nt, Escherichia coli CFT073
agcgccaaagccag

SEQ ID NO: 2626010 - RNA, 23 nt, Escherichia coli CFT073
agcgccaacgcaacgcgcuuuga

SEQ ID NO: 2626011 - RNA, 17 nt, Escherichia coli CFT073
agcgccaauaccaaaaa

SEQ ID NO: 2626012 - RNA, 14 nt, Escherichia coli CFT073
agcgccaccacaaa

SEQ ID NO: 2626013 - RNA, 20 nt, Escherichia coli CFT073
agcgccaccacaaaagcggu

SEQ ID NO: 2626014 - RNA, 16 nt, Escherichia coli CFT073
agcgccaccacccaga

SEQ ID NO: 2626015 - RNA, 15 nt, Escherichia coli CFT073
agcgccaccagcgcc

SEQ ID NO: 2626016 - RNA, 22 nt, Escherichia coli CFT073
agcgccacgccaaccaccggaa

SEQ ID NO: 2626017 - RNA, 18 nt, Escherichia coli CFT073
agcgccagacacuggaaa

SEQ ID NO: 2626018 - RNA, 15 nt, Escherichia coli CFT073
agcgccagacugaca

SEQ ID NO: 2626019 - RNA, 23 nt, Escherichia coli CFT073
agcgccagauaugaucgaaaaug

SEQ ID NO: 2626020 - RNA, 22 nt, Escherichia coli CFT073
agcgccagcaagagcaaauaaa

SEQ ID NO: 2626021 - RNA, 17 nt, Escherichia coli CFT073
agcgccagccagauggg

SEQ ID NO: 2626022 - RNA, 15 nt, Escherichia coli CFT073
agcgccagccauuca

SEQ ID NO: 2626023 - RNA, 15 nt, Escherichia coli CFT073
agcgccauaaaacuc

SEQ ID NO: 2626024 - RNA, 19 nt, Escherichia coli CFT073
agcgccaucgccaggaaca

SEQ ID NO: 2626025 - RNA, 21 nt, Escherichia coli CFT073
agcgccaugcuguucgcaacc

SEQ ID NO: 2626026 - RNA, 23 nt, Escherichia coli CFT073
agcgccauuacccggugccgccg

SEQ ID NO: 2626027 - RNA, 17 nt, Escherichia coli CFT073
agcgcccauaaagaugu

SEQ ID NO: 2626028 - RNA, 20 nt, Escherichia coli CFT073
agcgcccauaaagauguaau

SEQ ID NO: 2626029 - RNA, 16 nt, Escherichia coli CFT073
agcgcccguaaaccaa

SEQ ID NO: 2626030 - RNA, 17 nt, Escherichia coli CFT073
agcgcccguaaaccaag

SEQ ID NO: 2626031 - RNA, 19 nt, Escherichia coli CFT073
agcgcccguaaaccaagcu

SEQ ID NO: 2626032 - RNA, 22 nt, Escherichia coli CFT073
agcgccgaguaaaaaaacauca

SEQ ID NO: 2626033 - RNA, 20 nt, Escherichia coli CFT073
agcgccgcaacuaccagcag

SEQ ID NO: 2626034 - RNA, 16 nt, Escherichia coli CFT073
agcgccgcauccgaca

SEQ ID NO: 2626035 - RNA, 13 nt, Escherichia coli CFT073
agcgccgccucag

SEQ ID NO: 2626036 - RNA, 17 nt, Escherichia coli CFT073
agcgccgcgauaaaauc

SEQ ID NO: 2626037 - RNA, 18 nt, Escherichia coli CFT073
agcgccgcgauaaaaucc

SEQ ID NO: 2626038 - RNA, 12 nt, Escherichia coli CFT073
agcgccgggaau

SEQ ID NO: 2626039 - RNA, 16 nt, Escherichia coli CFT073
agcgccgguugggcga

SEQ ID NO: 2626040 - RNA, 22 nt, Escherichia coli CFT073
agcgccgucaguuuuucacccg

SEQ ID NO: 2626041 - RNA, 17 nt, Escherichia coli CFT073
agcgccguccaguaaug

SEQ ID NO: 2626042 - RNA, 23 nt, Escherichia coli CFT073
agcgccucuuuauaaauaucaaa

SEQ ID NO: 2626043 - RNA, 18 nt, Escherichia coli CFT073
agcgccugauacagccaa

SEQ ID NO: 2626044 - RNA, 16 nt, Escherichia coli CFT073
agcgccugcagucagc

SEQ ID NO: 2626045 - RNA, 12 nt, Escherichia coli CFT073
agcgccugcugc

SEQ ID NO: 2626046 - RNA, 19 nt, Escherichia coli CFT073
agcgccuggcgaaucgccu

SEQ ID NO: 2626047 - RNA, 19 nt, Escherichia coli CFT073
agcgccugucugcaaaaau

SEQ ID NO: 2626048 - RNA, 15 nt, Escherichia coli CFT073
agcgccuuaucccac

SEQ ID NO: 2626049 - RNA, 20 nt, Escherichia coli CFT073
agcgccuuuacugacaugca

SEQ ID NO: 2626050 - RNA, 17 nt, Escherichia coli CFT073
agcgccuuuauaagaua

SEQ ID NO: 2626051 - RNA, 15 nt, Escherichia coli CFT073
agcgcgaaaucgccc

SEQ ID NO: 2626052 - RNA, 19 nt, Escherichia coli CFT073
agcgcgaccggcggcgacu

SEQ ID NO: 2626053 - RNA, 20 nt, Escherichia coli CFT073
agcgcgcgaauauggcggcg

SEQ ID NO: 2626054 - RNA, 16 nt, Escherichia coli CFT073
agcgcgcgcagcacgg

SEQ ID NO: 2626055 - RNA, 16 nt, Escherichia coli CFT073
agcgcgcgcgggaaua

SEQ ID NO: 2626056 - RNA, 13 nt, Escherichia coli CFT073
agcgcgcggcugg

SEQ ID NO: 2626057 - RNA, 14 nt, Escherichia coli CFT073
agcgcgcggcuggc

SEQ ID NO: 2626058 - RNA, 17 nt, Escherichia coli CFT073
agcgcgcguuacgcagc

SEQ ID NO: 2626059 - RNA, 13 nt, Escherichia coli CFT073
agcgcgcugacau

SEQ ID NO: 2626060 - RNA, 12 nt, Escherichia coli CFT073
agcgcggcagcg

SEQ ID NO: 2626061 - RNA, 14 nt, Escherichia coli CFT073
agcgcggcagugac

SEQ ID NO: 2626062 - RNA, 18 nt, Escherichia coli CFT073
agcgcggcgacaauaauc

SEQ ID NO: 2626063 - RNA, 21 nt, Escherichia coli CFT073
agcgcgguauuccacuccagu

SEQ ID NO: 2626064 - RNA, 19 nt, Escherichia coli CFT073
agcgcguaguucaggauaa

SEQ ID NO: 2626065 - RNA, 19 nt, Escherichia coli CFT073
agcgcguaguuugucuuca

SEQ ID NO: 2626066 - RNA, 17 nt, Escherichia coli CFT073
agcgcgucuggaacggc

SEQ ID NO: 2626067 - RNA, 15 nt, Escherichia coli CFT073
agcgcguucauccca

SEQ ID NO: 2626068 - RNA, 13 nt, Escherichia coli CFT073
agcgcguugcgcc

SEQ ID NO: 2626069 - RNA, 15 nt, Escherichia coli CFT073
agcgcguuugucagc

SEQ ID NO: 2626070 - RNA, 18 nt, Escherichia coli CFT073
agcgcguuugucagcaaa

SEQ ID NO: 2626071 - RNA, 21 nt, Escherichia coli CFT073
agcgcuaauacgaugcaaccg

SEQ ID NO: 2626072 - RNA, 17 nt, Escherichia coli CFT073
agcgcuaccaucgacac

SEQ ID NO: 2626073 - RNA, 22 nt, Escherichia coli CFT073
agcgcugaauaucuuucucgcg

SEQ ID NO: 2626074 - RNA, 21 nt, Escherichia coli CFT073
agcgcuggagagcgccgggca

SEQ ID NO: 2626075 - RNA, 12 nt, Escherichia coli CFT073
agcgcugugaaa

SEQ ID NO: 2626076 - RNA, 15 nt, Escherichia coli CFT073
agcgcuuccagaaug

SEQ ID NO: 2626077 - RNA, 16 nt, Escherichia coli CFT073
agcgcuuuuggcgcgu

SEQ ID NO: 2626078 - RNA, 18 nt, Escherichia coli CFT073
agcgcuuuuuccugccgc

SEQ ID NO: 2626079 - RNA, 16 nt, Escherichia coli CFT073
agcggaaaaucgggcg

SEQ ID NO: 2626080 - RNA, 19 nt, Escherichia coli CFT073
agcggaaaaucgggcgaca

SEQ ID NO: 2626081 - RNA, 22 nt, Escherichia coli CFT073
agcggaaacaauaauauugcua

SEQ ID NO: 2626082 - RNA, 15 nt, Escherichia coli CFT073
agcggaaacagcggc

SEQ ID NO: 2626083 - RNA, 17 nt, Escherichia coli CFT073
agcggaaaucuccagau

SEQ ID NO: 2626084 - RNA, 23 nt, Escherichia coli CFT073
agcggaacuuuuuucauccagcu

SEQ ID NO: 2626085 - RNA, 14 nt, Escherichia coli CFT073
agcggaauaucaga

SEQ ID NO: 2626086 - RNA, 21 nt, Escherichia coli CFT073
agcggaauaucagaggcgagc

SEQ ID NO: 2626087 - RNA, 21 nt, Escherichia coli CFT073
agcggacaaacggaccgcaug

SEQ ID NO: 2626088 - RNA, 13 nt, Escherichia coli CFT073
agcggaccgcuuu

SEQ ID NO: 2626089 - RNA, 12 nt, Escherichia coli CFT073
agcggacucacc

SEQ ID NO: 2626090 - RNA, 21 nt, Escherichia coli CFT073
agcggacucaccgagcagcac

SEQ ID NO: 2626091 - RNA, 22 nt, Escherichia coli CFT073
agcggaucgccgccggagaggg

SEQ ID NO: 2626092 - RNA, 14 nt, Escherichia coli CFT073
agcggcaaaacggu

SEQ ID NO: 2626093 - RNA, 12 nt, Escherichia coli CFT073
agcggcaaaccg

SEQ ID NO: 2626094 - RNA, 18 nt, Escherichia coli CFT073
agcggcaaccagcagcau

SEQ ID NO: 2626095 - RNA, 20 nt, Escherichia coli CFT073
agcggcaaccagcagcauca

SEQ ID NO: 2626096 - RNA, 12 nt, Escherichia coli CFT073
agcggcaacuuu

SEQ ID NO: 2626097 - RNA, 20 nt, Escherichia coli CFT073
agcggcaaugcguuccagca

SEQ ID NO: 2626098 - RNA, 22 nt, Escherichia coli CFT073
agcggcagaucaaauucaauga

SEQ ID NO: 2626099 - RNA, 16 nt, Escherichia coli CFT073
agcggcagcucuuucu

SEQ ID NO: 2626100 - RNA, 18 nt, Escherichia coli CFT073
agcggcagcuuaacgguu

SEQ ID NO: 2626101 - RNA, 23 nt, Escherichia coli CFT073
agcggcaggccguggaucacauc

SEQ ID NO: 2626102 - RNA, 16 nt, Escherichia coli CFT073
agcggcauaugaccau

SEQ ID NO: 2626103 - RNA, 12 nt, Escherichia coli CFT073
agcggccagaca

SEQ ID NO: 2626104 - RNA, 16 nt, Escherichia coli CFT073
agcggcgagcuuuucu

SEQ ID NO: 2626105 - RNA, 21 nt, Escherichia coli CFT073
agcggcgcgauaguaaucacc

SEQ ID NO: 2626106 - RNA, 18 nt, Escherichia coli CFT073
agcggcgcggucgaucac

SEQ ID NO: 2626107 - RNA, 21 nt, Escherichia coli CFT073
agcggcggcagauugagcguc

SEQ ID NO: 2626108 - RNA, 13 nt, Escherichia coli CFT073
agcggcgggcuuu

SEQ ID NO: 2626109 - RNA, 21 nt, Escherichia coli CFT073
agcggcgggcuuuaaucaccc

SEQ ID NO: 2626110 - RNA, 19 nt, Escherichia coli CFT073
agcggcguacccuccggga

SEQ ID NO: 2626111 - RNA, 22 nt, Escherichia coli CFT073
agcggcguguuauugccgagaa

SEQ ID NO: 2626112 - RNA, 14 nt, Escherichia coli CFT073
agcggcguuccggc

SEQ ID NO: 2626113 - RNA, 22 nt, Escherichia coli CFT073
agcggcguuccggcaaccggau

SEQ ID NO: 2626114 - RNA, 23 nt, Escherichia coli CFT073
agcggcguuuuguagagcagcac

SEQ ID NO: 2626115 - RNA, 19 nt, Escherichia coli CFT073
agcggcuaacaacgccgcu

SEQ ID NO: 2626116 - RNA, 23 nt, Escherichia coli CFT073
agcggcuacugauguucgccaga

SEQ ID NO: 2626117 - RNA, 13 nt, Escherichia coli CFT073
agcggcugcgcag

SEQ ID NO: 2626118 - RNA, 18 nt, Escherichia coli CFT073
agcgggaugucgcggaaa

SEQ ID NO: 2626119 - RNA, 23 nt, Escherichia coli CFT073
agcgggauuuccggcaucgccag

SEQ ID NO: 2626120 - RNA, 14 nt, Escherichia coli CFT073
agcgggcaauaucg

SEQ ID NO: 2626121 - RNA, 16 nt, Escherichia coli CFT073
agcgggcagacaaaac

SEQ ID NO: 2626122 - RNA, 21 nt, Escherichia coli CFT073
agcgggcagacaaaacauacc

SEQ ID NO: 2626123 - RNA, 13 nt, Escherichia coli CFT073
agcgggccaguaa

SEQ ID NO: 2626124 - RNA, 14 nt, Escherichia coli CFT073
agcgggccaguaaa

SEQ ID NO: 2626125 - RNA, 21 nt, Escherichia coli CFT073
agcggguuuuuacguuauuug

SEQ ID NO: 2626126 - RNA, 22 nt, Escherichia coli CFT073
agcgguaaaauggucagccagc

SEQ ID NO: 2626127 - RNA, 22 nt, Escherichia coli CFT073
agcgguaaaccguuaucaccag

SEQ ID NO: 2626128 - RNA, 23 nt, Escherichia coli CFT073
agcgguaaagaacugagcgccgu

SEQ ID NO: 2626129 - RNA, 15 nt, Escherichia coli CFT073
agcgguaauuccggc

SEQ ID NO: 2626130 - RNA, 17 nt, Escherichia coli CFT073
agcgguauugagcuucu

SEQ ID NO: 2626131 - RNA, 20 nt, Escherichia coli CFT073
agcggucggagguucgaauc

SEQ ID NO: 2626132 - RNA, 13 nt, Escherichia coli CFT073
agcggugaaaacg

SEQ ID NO: 2626133 - RNA, 18 nt, Escherichia coli CFT073
agcggugaaaacggcaau

SEQ ID NO: 2626134 - RNA, 19 nt, Escherichia coli CFT073
agcggugcaccugccagca

SEQ ID NO: 2626135 - RNA, 20 nt, Escherichia coli CFT073
agcgguggugaaaagagcgg

SEQ ID NO: 2626136 - RNA, 14 nt, Escherichia coli CFT073
agcgguuggagcac

SEQ ID NO: 2626137 - RNA, 21 nt, Escherichia coli CFT073
agcgguuguagccacgucugc

SEQ ID NO: 2626138 - RNA, 17 nt, Escherichia coli CFT073
agcgguuucuccccuuc

SEQ ID NO: 2626139 - RNA, 14 nt, Escherichia coli CFT073
agcgguuugaaguu

SEQ ID NO: 2626140 - RNA, 14 nt, Escherichia coli CFT073
agcgguuuugccag

SEQ ID NO: 2626141 - RNA, 15 nt, Escherichia coli CFT073
agcguaaagccagcg

SEQ ID NO: 2626142 - RNA, 20 nt, Escherichia coli CFT073
agcguaacgaucgcccggca

SEQ ID NO: 2626143 - RNA, 18 nt, Escherichia coli CFT073
agcguaacggguccccag

SEQ ID NO: 2626144 - RNA, 16 nt, Escherichia coli CFT073
agcguaauaggcgcga

SEQ ID NO: 2626145 - RNA, 18 nt, Escherichia coli CFT073
agcguaauaggcgcgaca

SEQ ID NO: 2626146 - RNA, 14 nt, Escherichia coli CFT073
agcguaaugccaaa

SEQ ID NO: 2626147 - RNA, 20 nt, Escherichia coli CFT073
agcguaaugccaaauccuuc

SEQ ID NO: 2626148 - RNA, 16 nt, Escherichia coli CFT073
agcguacaaucgccac

SEQ ID NO: 2626149 - RNA, 19 nt, Escherichia coli CFT073
agcguacaaucgccacauu

SEQ ID NO: 2626150 - RNA, 15 nt, Escherichia coli CFT073
agcguacugucugcu

SEQ ID NO: 2626151 - RNA, 17 nt, Escherichia coli CFT073
agcguagugaaggcaaa

SEQ ID NO: 2626152 - RNA, 17 nt, Escherichia coli CFT073
agcguagugauaccccg

SEQ ID NO: 2626153 - RNA, 19 nt, Escherichia coli CFT073
agcguagugauaccccgca

SEQ ID NO: 2626154 - RNA, 22 nt, Escherichia coli CFT073
agcguagugauaccccgcaucg

SEQ ID NO: 2626155 - RNA, 15 nt, Escherichia coli CFT073
agcguauagagcagc

SEQ ID NO: 2626156 - RNA, 17 nt, Escherichia coli CFT073
agcguauccagcauacc

SEQ ID NO: 2626157 - RNA, 15 nt, Escherichia coli CFT073
agcgucaaacuuuua

SEQ ID NO: 2626158 - RNA, 17 nt, Escherichia coli CFT073
agcgucaaacuuuuaaa

SEQ ID NO: 2626159 - RNA, 18 nt, Escherichia coli CFT073
agcgucaaggucaacagu

SEQ ID NO: 2626160 - RNA, 19 nt, Escherichia coli CFT073
agcgucacuuccuucgccg

SEQ ID NO: 2626161 - RNA, 13 nt, Escherichia coli CFT073
agcgucaguucuc

SEQ ID NO: 2626162 - RNA, 13 nt, Escherichia coli CFT073
agcguccagcgug

SEQ ID NO: 2626163 - RNA, 18 nt, Escherichia coli CFT073
agcguccaguccacacug

SEQ ID NO: 2626164 - RNA, 20 nt, Escherichia coli CFT073
agcguccauuuacccacaga

SEQ ID NO: 2626165 - RNA, 14 nt, Escherichia coli CFT073
agcgucccuaauac

SEQ ID NO: 2626166 - RNA, 20 nt, Escherichia coli CFT073
agcgucccuaauaccguucc

SEQ ID NO: 2626167 - RNA, 17 nt, Escherichia coli CFT073
agcguccggcugccagc

SEQ ID NO: 2626168 - RNA, 16 nt, Escherichia coli CFT073
agcguccgggaaaucc

SEQ ID NO: 2626169 - RNA, 22 nt, Escherichia coli CFT073
agcgucgcauccaacaauaaaa

SEQ ID NO: 2626170 - RNA, 15 nt, Escherichia coli CFT073
agcgucgccagcaga

SEQ ID NO: 2626171 - RNA, 22 nt, Escherichia coli CFT073
agcgucgccagcagcucacgca

SEQ ID NO: 2626172 - RNA, 20 nt, Escherichia coli CFT073
agcgucgccgccgccagcgc

SEQ ID NO: 2626173 - RNA, 22 nt, Escherichia coli CFT073
agcgucgguguagccuuugccu

SEQ ID NO: 2626174 - RNA, 14 nt, Escherichia coli CFT073
agcgucguucgcgc

SEQ ID NO: 2626175 - RNA, 19 nt, Escherichia coli CFT073
agcgucucacuaucgccga

SEQ ID NO: 2626176 - RNA, 14 nt, Escherichia coli CFT073
agcgucuggcucga

SEQ ID NO: 2626177 - RNA, 18 nt, Escherichia coli CFT073
agcgucuuaucagcauac

SEQ ID NO: 2626178 - RNA, 18 nt, Escherichia coli CFT073
agcgugaaacaaaucacu

SEQ ID NO: 2626179 - RNA, 20 nt, Escherichia coli CFT073
agcgugaaccgccucacgcg

SEQ ID NO: 2626180 - RNA, 19 nt, Escherichia coli CFT073
agcgugaagcuaccguaga

SEQ ID NO: 2626181 - RNA, 15 nt, Escherichia coli CFT073
agcgugacaccagca

SEQ ID NO: 2626182 - RNA, 17 nt, Escherichia coli CFT073
agcgugagcagggugaa

SEQ ID NO: 2626183 - RNA, 16 nt, Escherichia coli CFT073
agcgugagguuaucgc

SEQ ID NO: 2626184 - RNA, 14 nt, Escherichia coli CFT073
agcgugauuuugua

SEQ ID NO: 2626185 - RNA, 16 nt, Escherichia coli CFT073
agcgugccgaagaaca

SEQ ID NO: 2626186 - RNA, 22 nt, Escherichia coli CFT073
agcgugccgcgaucccagacca

SEQ ID NO: 2626187 - RNA, 14 nt, Escherichia coli CFT073
agcgugcggcggcu

SEQ ID NO: 2626188 - RNA, 19 nt, Escherichia coli CFT073
agcgugcggcggcugacau

SEQ ID NO: 2626189 - RNA, 11 nt, Escherichia coli CFT073
agcgugcuggu

SEQ ID NO: 2626190 - RNA, 14 nt, Escherichia coli CFT073
agcguggucauggc

SEQ ID NO: 2626191 - RNA, 15 nt, Escherichia coli CFT073
agcgugguuugcuca

SEQ ID NO: 2626192 - RNA, 17 nt, Escherichia coli CFT073
agcguguugcggcgcuu

SEQ ID NO: 2626193 - RNA, 20 nt, Escherichia coli CFT073
agcguuacccagacaaaauu

SEQ ID NO: 2626194 - RNA, 18 nt, Escherichia coli CFT073
agcguuauaaaacacauu

SEQ ID NO: 2626195 - RNA, 16 nt, Escherichia coli CFT073
agcguuauagcgcaug

SEQ ID NO: 2626196 - RNA, 19 nt, Escherichia coli CFT073
agcguucaaacaccaguuc

SEQ ID NO: 2626197 - RNA, 23 nt, Escherichia coli CFT073
agcguucagugaucgccugcaug

SEQ ID NO: 2626198 - RNA, 18 nt, Escherichia coli CFT073
agcguucaucugaccacg

SEQ ID NO: 2626199 - RNA, 19 nt, Escherichia coli CFT073
agcguuccacgucacaggc

SEQ ID NO: 2626200 - RNA, 14 nt, Escherichia coli CFT073
agcguuccagcagc

SEQ ID NO: 2626201 - RNA, 13 nt, Escherichia coli CFT073
agcguucccuucc

SEQ ID NO: 2626202 - RNA, 21 nt, Escherichia coli CFT073
agcguucggugauauuuucac

SEQ ID NO: 2626203 - RNA, 15 nt, Escherichia coli CFT073
agcguugcagagagu

SEQ ID NO: 2626204 - RNA, 21 nt, Escherichia coli CFT073
agcguugcccgauugguucag

SEQ ID NO: 2626205 - RNA, 23 nt, Escherichia coli CFT073
agcguugccggaugacgccucag

SEQ ID NO: 2626206 - RNA, 13 nt, Escherichia coli CFT073
agcguugcgccaa

SEQ ID NO: 2626207 - RNA, 13 nt, Escherichia coli CFT073
agcguuucaagug

SEQ ID NO: 2626208 - RNA, 20 nt, Escherichia coli CFT073
agcguuucauuacuauaacc

SEQ ID NO: 2626209 - RNA, 23 nt, Escherichia coli CFT073
agcguuucgccauaaaacagcag

SEQ ID NO: 2626210 - RNA, 15 nt, Escherichia coli CFT073
agcguuugcggcgcu

SEQ ID NO: 2626211 - RNA, 15 nt, Escherichia coli CFT073
agcguuugcggcugu

SEQ ID NO: 2626212 - RNA, 14 nt, Escherichia coli CFT073
agcguuuucugcca

SEQ ID NO: 2626213 - RNA, 15 nt, Escherichia coli CFT073
agcguuuucugccag

SEQ ID NO: 2626214 - RNA, 17 nt, Escherichia coli CFT073
agcguuuucugccagac

SEQ ID NO: 2626215 - RNA, 13 nt, Escherichia coli CFT073
agcguuuucuuca

SEQ ID NO: 2626216 - RNA, 14 nt, Escherichia coli CFT073
agcguuuuuucauu

SEQ ID NO: 2626217 - RNA, 23 nt, Escherichia coli CFT073
  misc_feature (4)..(4): n is a, c, g or u
agcnuuaucgugccuacacauua

SEQ ID NO: 2626218 - RNA, 13 nt, Escherichia coli CFT073
agcuaaacagagc

SEQ ID NO: 2626219 - RNA, 17 nt, Escherichia coli CFT073
agcuaaacagagcugca

SEQ ID NO: 2626220 - RNA, 20 nt, Escherichia coli CFT073
agcuaaacugaucuuuauca

SEQ ID NO: 2626221 - RNA, 17 nt, Escherichia coli CFT073
agcuaaccauccacauu

SEQ ID NO: 2626222 - RNA, 15 nt, Escherichia coli CFT073
agcuaacgcguuauc

SEQ ID NO: 2626223 - RNA, 15 nt, Escherichia coli CFT073
agcuaauauucuuuu

SEQ ID NO: 2626224 - RNA, 16 nt, Escherichia coli CFT073
agcuaauauucuuuuu

SEQ ID NO: 2626225 - RNA, 22 nt, Escherichia coli CFT073
agcuaauggcugcggacgacca

SEQ ID NO: 2626226 - RNA, 17 nt, Escherichia coli CFT073
agcuacaccgaucaccc

SEQ ID NO: 2626227 - RNA, 14 nt, Escherichia coli CFT073
agcuaccacgccga

SEQ ID NO: 2626228 - RNA, 20 nt, Escherichia coli CFT073
agcuacgaaggugcauugaa

SEQ ID NO: 2626229 - RNA, 12 nt, Escherichia coli CFT073
agcuaucagcga

SEQ ID NO: 2626230 - RNA, 12 nt, Escherichia coli CFT073
agcuaucccuug

SEQ ID NO: 2626231 - RNA, 19 nt, Escherichia coli CFT073
agcuauguuugaaccagau

SEQ ID NO: 2626232 - RNA, 21 nt, Escherichia coli CFT073
agcuauguuugaaccagauau

SEQ ID NO: 2626233 - RNA, 14 nt, Escherichia coli CFT073
agcuauuaauccau

SEQ ID NO: 2626234 - RNA, 14 nt, Escherichia coli CFT073
agcucaaacuggcu

SEQ ID NO: 2626235 - RNA, 19 nt, Escherichia coli CFT073
agcucaaagcaguauuucu

SEQ ID NO: 2626236 - RNA, 15 nt, Escherichia coli CFT073
agcucaacaguaagg

SEQ ID NO: 2626237 - RNA, 14 nt, Escherichia coli CFT073
agcucaaucgccuc

SEQ ID NO: 2626238 - RNA, 15 nt, Escherichia coli CFT073
agcucaaugaaacgc

SEQ ID NO: 2626239 - RNA, 14 nt, Escherichia coli CFT073
agcucaccagcagg

SEQ ID NO: 2626240 - RNA, 21 nt, Escherichia coli CFT073
agcucaccucaccuuucgguu

SEQ ID NO: 2626241 - RNA, 12 nt, Escherichia coli CFT073
agcucacgcagc

SEQ ID NO: 2626242 - RNA, 15 nt, Escherichia coli CFT073
agcucacgcgccagc

SEQ ID NO: 2626243 - RNA, 18 nt, Escherichia coli CFT073
agcucacggccagucauu

SEQ ID NO: 2626244 - RNA, 14 nt, Escherichia coli CFT073
agcucacugauaau

SEQ ID NO: 2626245 - RNA, 16 nt, Escherichia coli CFT073
agcucacuucgaucca

SEQ ID NO: 2626246 - RNA, 17 nt, Escherichia coli CFT073
agcucaguugguagagc

SEQ ID NO: 2626247 - RNA, 21 nt, Escherichia coli CFT073
agcucaguugguagagcacga

SEQ ID NO: 2626248 - RNA, 23 nt, Escherichia coli CFT073
agcucaguugguuagagcacauc

SEQ ID NO: 2626249 - RNA, 19 nt, Escherichia coli CFT073
agcucauaaccguccaguu

SEQ ID NO: 2626250 - RNA, 15 nt, Escherichia coli CFT073
agcucaucaaugaua

SEQ ID NO: 2626251 - RNA, 11 nt, Escherichia coli CFT073
agcucaucguu

SEQ ID NO: 2626252 - RNA, 13 nt, Escherichia coli CFT073
agcucauuuccca

SEQ ID NO: 2626253 - RNA, 13 nt, Escherichia coli CFT073
agcuccacaagaa

SEQ ID NO: 2626254 - RNA, 18 nt, Escherichia coli CFT073
agcuccacaagaaugccu

SEQ ID NO: 2626255 - RNA, 21 nt, Escherichia coli CFT073
agcuccacaagaaugccugcc

SEQ ID NO: 2626256 - RNA, 19 nt, Escherichia coli CFT073
agcuccagggcuuuauuca

SEQ ID NO: 2626257 - RNA, 13 nt, Escherichia coli CFT073
agcuccccacacc

SEQ ID NO: 2626258 - RNA, 21 nt, Escherichia coli CFT073
agcuccccacaccaccaugcu

SEQ ID NO: 2626259 - RNA, 19 nt, Escherichia coli CFT073
agcuccgccgguugccccg

SEQ ID NO: 2626260 - RNA, 19 nt, Escherichia coli CFT073
agcuccgggcugguuuuca

SEQ ID NO: 2626261 - RNA, 18 nt, Escherichia coli CFT073
agcuccguccagccaccg

SEQ ID NO: 2626262 - RNA, 16 nt, Escherichia coli CFT073
agcucgacaccaaaca

SEQ ID NO: 2626263 - RNA, 17 nt, Escherichia coli CFT073
agcucgacaccaaacag

SEQ ID NO: 2626264 - RNA, 20 nt, Escherichia coli CFT073
agcucgcacgccacgccgaa

SEQ ID NO: 2626265 - RNA, 15 nt, Escherichia coli CFT073
agcucgcagagauca

SEQ ID NO: 2626266 - RNA, 17 nt, Escherichia coli CFT073
agcucgcguucugucag

SEQ ID NO: 2626267 - RNA, 13 nt, Escherichia coli CFT073
agcucggcgcacc

SEQ ID NO: 2626268 - RNA, 16 nt, Escherichia coli CFT073
agcucugaauaaacgg

SEQ ID NO: 2626269 - RNA, 17 nt, Escherichia coli CFT073
agcucugcuaauaaugu

SEQ ID NO: 2626270 - RNA, 18 nt, Escherichia coli CFT073
agcucugguguggagugc

SEQ ID NO: 2626271 - RNA, 17 nt, Escherichia coli CFT073
agcucuuccgacuugcu

SEQ ID NO: 2626272 - RNA, 14 nt, Escherichia coli CFT073
agcucuucuacauu

SEQ ID NO: 2626273 - RNA, 19 nt, Escherichia coli CFT073
agcucuucuacauuucugu

SEQ ID NO: 2626274 - RNA, 18 nt, Escherichia coli CFT073
agcucuuuauccagcagc

SEQ ID NO: 2626275 - RNA, 19 nt, Escherichia coli CFT073
agcucuuucgacagcgauu

SEQ ID NO: 2626276 - RNA, 23 nt, Escherichia coli CFT073
agcucuuuuaacuuacgcgucag

SEQ ID NO: 2626277 - RNA, 20 nt, Escherichia coli CFT073
agcucuuuugacgcccccag

SEQ ID NO: 2626278 - RNA, 16 nt, Escherichia coli CFT073
agcugaaaaucagauc

SEQ ID NO: 2626279 - RNA, 20 nt, Escherichia coli CFT073
agcugaaaucaccgccacca

SEQ ID NO: 2626280 - RNA, 14 nt, Escherichia coli CFT073
agcugaacagucgc

SEQ ID NO: 2626281 - RNA, 18 nt, Escherichia coli CFT073
agcugaagcucguuguuu

SEQ ID NO: 2626282 - RNA, 17 nt, Escherichia coli CFT073
agcugaauaucacgggc

SEQ ID NO: 2626283 - RNA, 20 nt, Escherichia coli CFT073
agcugaguauuaaccgguug

SEQ ID NO: 2626284 - RNA, 13 nt, Escherichia coli CFT073
agcugagugcgaa

SEQ ID NO: 2626285 - RNA, 21 nt, Escherichia coli CFT073
agcugagugcgaaaaucaaua

SEQ ID NO: 2626286 - RNA, 19 nt, Escherichia coli CFT073
agcugauaucaccugcuuc

SEQ ID NO: 2626287 - RNA, 15 nt, Escherichia coli CFT073
agcugauuuccggga

SEQ ID NO: 2626288 - RNA, 20 nt, Escherichia coli CFT073
agcugcaaaaguaccauuga

SEQ ID NO: 2626289 - RNA, 21 nt, Escherichia coli CFT073
agcugcaacuggcggcggcga

SEQ ID NO: 2626290 - RNA, 16 nt, Escherichia coli CFT073
agcugcagccaguugc

SEQ ID NO: 2626291 - RNA, 17 nt, Escherichia coli CFT073
agcugcagccaguugcu

SEQ ID NO: 2626292 - RNA, 22 nt, Escherichia coli CFT073
agcugcauccgggguucgaauc

SEQ ID NO: 2626293 - RNA, 15 nt, Escherichia coli CFT073
agcugcaucuggcga

SEQ ID NO: 2626294 - RNA, 13 nt, Escherichia coli CFT073
agcugccagcccc

SEQ ID NO: 2626295 - RNA, 22 nt, Escherichia coli CFT073
agcugccagccccucagcgguc

SEQ ID NO: 2626296 - RNA, 20 nt, Escherichia coli CFT073
agcugcccacgcgguauggu

SEQ ID NO: 2626297 - RNA, 21 nt, Escherichia coli CFT073
agcugccugccaguaaauggc

SEQ ID NO: 2626298 - RNA, 13 nt, Escherichia coli CFT073
agcugccugcgga

SEQ ID NO: 2626299 - RNA, 21 nt, Escherichia coli CFT073
agcugccugcggcgaucuuca

SEQ ID NO: 2626300 - RNA, 17 nt, Escherichia coli CFT073
agcugcgcguuaucuac

SEQ ID NO: 2626301 - RNA, 23 nt, Escherichia coli CFT073
agcugcgggaaauaacaaauaau

SEQ ID NO: 2626302 - RNA, 23 nt, Escherichia coli CFT073
agcugcuacaccgucauuagcgc

SEQ ID NO: 2626303 - RNA, 17 nt, Escherichia coli CFT073
agcugcucggcaauuug

SEQ ID NO: 2626304 - RNA, 18 nt, Escherichia coli CFT073
agcugcugaccaccagca

SEQ ID NO: 2626305 - RNA, 20 nt, Escherichia coli CFT073
agcugcugacggugauaauc

SEQ ID NO: 2626306 - RNA, 20 nt, Escherichia coli CFT073
agcugcugcucaaucugcgc

SEQ ID NO: 2626307 - RNA, 23 nt, Escherichia coli CFT073
agcuggaagccacaaucgcagcg

SEQ ID NO: 2626308 - RNA, 17 nt, Escherichia coli CFT073
agcuggcaccgcaucaa

SEQ ID NO: 2626309 - RNA, 15 nt, Escherichia coli CFT073
agcuggcgaacaagu

SEQ ID NO: 2626310 - RNA, 16 nt, Escherichia coli CFT073
agcuggcgcaggagcc

SEQ ID NO: 2626311 - RNA, 11 nt, Escherichia coli CFT073
agcuggcggac

SEQ ID NO: 2626312 - RNA, 23 nt, Escherichia coli CFT073
agcuggguuaauaccgagcguuc

SEQ ID NO: 2626313 - RNA, 21 nt, Escherichia coli CFT073
agcugguguaacugcgccaga

SEQ ID NO: 2626314 - RNA, 15 nt, Escherichia coli CFT073
agcuguaccuggccc

SEQ ID NO: 2626315 - RNA, 15 nt, Escherichia coli CFT073
agcuguagaggcguu

SEQ ID NO: 2626316 - RNA, 16 nt, Escherichia coli CFT073
agcugucaccucugca

SEQ ID NO: 2626317 - RNA, 15 nt, Escherichia coli CFT073
agcugucgaaaagau

SEQ ID NO: 2626318 - RNA, 19 nt, Escherichia coli CFT073
agcugucugucaaauucac

SEQ ID NO: 2626319 - RNA, 23 nt, Escherichia coli CFT073
agcuguuaucgauauacaaacau

SEQ ID NO: 2626320 - RNA, 15 nt, Escherichia coli CFT073
agcuguugcgccagc

SEQ ID NO: 2626321 - RNA, 18 nt, Escherichia coli CFT073
agcuguugcgccagcaca

SEQ ID NO: 2626322 - RNA, 14 nt, Escherichia coli CFT073
agcuguuggcaacg

SEQ ID NO: 2626323 - RNA, 17 nt, Escherichia coli CFT073
agcuguuggcaacgcaa

SEQ ID NO: 2626324 - RNA, 22 nt, Escherichia coli CFT073
agcuguuucaguaacuggcgca

SEQ ID NO: 2626325 - RNA, 22 nt, Escherichia coli CFT073
agcuguuucaguguuuccccac

SEQ ID NO: 2626326 - RNA, 14 nt, Escherichia coli CFT073
agcuguuuggccug

SEQ ID NO: 2626327 - RNA, 14 nt, Escherichia coli CFT073
agcuguuuugguaa

SEQ ID NO: 2626328 - RNA, 16 nt, Escherichia coli CFT073
agcuuaacuacugcuu

SEQ ID NO: 2626329 - RNA, 14 nt, Escherichia coli CFT073
agcuuaagaauuac

SEQ ID NO: 2626330 - RNA, 13 nt, Escherichia coli CFT073
agcuuaaucacca

SEQ ID NO: 2626331 - RNA, 18 nt, Escherichia coli CFT073
agcuuaaucaccagcgca

SEQ ID NO: 2626332 - RNA, 14 nt, Escherichia coli CFT073
agcuuagaaaggaa

SEQ ID NO: 2626333 - RNA, 15 nt, Escherichia coli CFT073
agcuuagcggcgcga

SEQ ID NO: 2626334 - RNA, 18 nt, Escherichia coli CFT073
agcuuauauacucuaaau

SEQ ID NO: 2626335 - RNA, 18 nt, Escherichia coli CFT073
agcuuaucaaucucugca

SEQ ID NO: 2626336 - RNA, 22 nt, Escherichia coli CFT073
agcuuaucacagaggaagaggu

SEQ ID NO: 2626337 - RNA, 15 nt, Escherichia coli CFT073
agcuuauccagcaaa

SEQ ID NO: 2626338 - RNA, 20 nt, Escherichia coli CFT073
agcuuaucgggccuacaauu

SEQ ID NO: 2626339 - RNA, 14 nt, Escherichia coli CFT073
agcuuaucuuuuuc

SEQ ID NO: 2626340 - RNA, 18 nt, Escherichia coli CFT073
agcuuauuaacagucagu

SEQ ID NO: 2626341 - RNA, 17 nt, Escherichia coli CFT073
agcuucaauaucaucau

SEQ ID NO: 2626342 - RNA, 21 nt, Escherichia coli CFT073
agcuucacaaaggcuugcugc

SEQ ID NO: 2626343 - RNA, 12 nt, Escherichia coli CFT073
agcuucacgcgc

SEQ ID NO: 2626344 - RNA, 14 nt, Escherichia coli CFT073
agcuucacuuucca

SEQ ID NO: 2626345 - RNA, 18 nt, Escherichia coli CFT073
agcuucacuuuccaguuc

SEQ ID NO: 2626346 - RNA, 19 nt, Escherichia coli CFT073
agcuucacuuuccaguuca

SEQ ID NO: 2626347 - RNA, 20 nt, Escherichia coli CFT073
agcuucacuuuccaguucaa

SEQ ID NO: 2626348 - RNA, 22 nt, Escherichia coli CFT073
agcuucagauucagcgucgcca

SEQ ID NO: 2626349 - RNA, 18 nt, Escherichia coli CFT073
agcuucaucaucgcagau

SEQ ID NO: 2626350 - RNA, 18 nt, Escherichia coli CFT073
agcuuccaggcaaucagu

SEQ ID NO: 2626351 - RNA, 15 nt, Escherichia coli CFT073
agcuuccuugcugau

SEQ ID NO: 2626352 - RNA, 17 nt, Escherichia coli CFT073
agcuuccuugcugauuu

SEQ ID NO: 2626353 - RNA, 20 nt, Escherichia coli CFT073
agcuucgcuucccaacgcag

SEQ ID NO: 2626354 - RNA, 17 nt, Escherichia coli CFT073
agcuucucgugaaauuc

SEQ ID NO: 2626355 - RNA, 13 nt, Escherichia coli CFT073
agcuucucuggcu

SEQ ID NO: 2626356 - RNA, 16 nt, Escherichia coli CFT073
agcuucuucuccagcu

SEQ ID NO: 2626357 - RNA, 18 nt, Escherichia coli CFT073
agcuucuucuccagcugc

SEQ ID NO: 2626358 - RNA, 12 nt, Escherichia coli CFT073
agcuugaaauca

SEQ ID NO: 2626359 - RNA, 14 nt, Escherichia coli CFT073
agcuugagaaaauc

SEQ ID NO: 2626360 - RNA, 19 nt, Escherichia coli CFT073
agcuugagccguaggugaa

SEQ ID NO: 2626361 - RNA, 20 nt, Escherichia coli CFT073
agcuugagguuggagauccc

SEQ ID NO: 2626362 - RNA, 12 nt, Escherichia coli CFT073
agcuugcagaau

SEQ ID NO: 2626363 - RNA, 16 nt, Escherichia coli CFT073
agcuugcgauccugca

SEQ ID NO: 2626364 - RNA, 17 nt, Escherichia coli CFT073
agcuugcuuuccagcuu

SEQ ID NO: 2626365 - RNA, 18 nt, Escherichia coli CFT073
agcuuggcagagcgacau

SEQ ID NO: 2626366 - RNA, 22 nt, Escherichia coli CFT073
agcuugucauuaccacaacaaa

SEQ ID NO: 2626367 - RNA, 13 nt, Escherichia coli CFT073
agcuuuaaacacg

SEQ ID NO: 2626368 - RNA, 22 nt, Escherichia coli CFT073
agcuuuaacauccgcaauuucg

SEQ ID NO: 2626369 - RNA, 14 nt, Escherichia coli CFT073
agcuuuauccugcc

SEQ ID NO: 2626370 - RNA, 17 nt, Escherichia coli CFT073
agcuuucaccugcgcgu

SEQ ID NO: 2626371 - RNA, 16 nt, Escherichia coli CFT073
agcuuucgaccagcca

SEQ ID NO: 2626372 - RNA, 18 nt, Escherichia coli CFT073
agcuuucgaccagccagg

SEQ ID NO: 2626373 - RNA, 14 nt, Escherichia coli CFT073
agcuuucgcaucag

SEQ ID NO: 2626374 - RNA, 19 nt, Escherichia coli CFT073
agcuuugcccgaucaucaa

SEQ ID NO: 2626375 - RNA, 22 nt, Escherichia coli CFT073
agcuuugcccgaucaucaaaaa

SEQ ID NO: 2626376 - RNA, 13 nt, Escherichia coli CFT073
agcuuuggcggca

SEQ ID NO: 2626377 - RNA, 20 nt, Escherichia coli CFT073
agcuuuggugccagauuuaa

SEQ ID NO: 2626378 - RNA, 22 nt, Escherichia coli CFT073
agcuuuguugaccuaacuccug

SEQ ID NO: 2626379 - RNA, 15 nt, Escherichia coli CFT073
agcuuuucuccugcu

SEQ ID NO: 2626380 - RNA, 13 nt, Escherichia coli CFT073
agcuuuucuggau

SEQ ID NO: 2626381 - RNA, 16 nt, Escherichia coli CFT073
agcuuuuuauuacucu

SEQ ID NO: 2626382 - RNA, 13 nt, Escherichia coli CFT073
aggaaaauacagc

SEQ ID NO: 2626383 - RNA, 15 nt, Escherichia coli CFT073
aggaaaauacagcaa

SEQ ID NO: 2626384 - RNA, 13 nt, Escherichia coli CFT073
aggaaaauaggug

SEQ ID NO: 2626385 - RNA, 12 nt, Escherichia coli CFT073
aggaaaaucagc

SEQ ID NO: 2626386 - RNA, 16 nt, Escherichia coli CFT073
aggaaaaugagauggu

SEQ ID NO: 2626387 - RNA, 19 nt, Escherichia coli CFT073
aggaaaaugaucaauaauu

SEQ ID NO: 2626388 - RNA, 14 nt, Escherichia coli CFT073
aggaaauaaauaau

SEQ ID NO: 2626389 - RNA, 15 nt, Escherichia coli CFT073
aggaaauaaauaauc

SEQ ID NO: 2626390 - RNA, 21 nt, Escherichia coli CFT073
aggaaauauacacgaaaugaa

SEQ ID NO: 2626391 - RNA, 18 nt, Escherichia coli CFT073
aggaacagaaugguggcc

SEQ ID NO: 2626392 - RNA, 14 nt, Escherichia coli CFT073
aggaacagauacug

SEQ ID NO: 2626393 - RNA, 16 nt, Escherichia coli CFT073
aggaacagugaaaucg

SEQ ID NO: 2626394 - RNA, 13 nt, Escherichia coli CFT073
aggaaccaaaugc

SEQ ID NO: 2626395 - RNA, 21 nt, Escherichia coli CFT073
aggaacgagaacucggaagca

SEQ ID NO: 2626396 - RNA, 11 nt, Escherichia coli CFT073
aggaacgccau

SEQ ID NO: 2626397 - RNA, 23 nt, Escherichia coli CFT073
aggaacgcgccaagauagaacca

SEQ ID NO: 2626398 - RNA, 11 nt, Escherichia coli CFT073
aggaacgcugc

SEQ ID NO: 2626399 - RNA, 21 nt, Escherichia coli CFT073
aggaacgggauugccagcaua

SEQ ID NO: 2626400 - RNA, 19 nt, Escherichia coli CFT073
aggaacugcaaggagagcc

SEQ ID NO: 2626401 - RNA, 15 nt, Escherichia coli CFT073
aggaagaagcuugcu

SEQ ID NO: 2626402 - RNA, 19 nt, Escherichia coli CFT073
aggaagagguaagcuucag

SEQ ID NO: 2626403 - RNA, 17 nt, Escherichia coli CFT073
aggaagcgcaacagcgc

SEQ ID NO: 2626404 - RNA, 21 nt, Escherichia coli CFT073
aggaagcugauuuuauuucaa

SEQ ID NO: 2626405 - RNA, 20 nt, Escherichia coli CFT073
aggaauagcgaaccgguaug

SEQ ID NO: 2626406 - RNA, 19 nt, Escherichia coli CFT073
aggaauccagcacgaagag

SEQ ID NO: 2626407 - RNA, 22 nt, Escherichia coli CFT073
aggaauccagcacgaagaggcc

SEQ ID NO: 2626408 - RNA, 16 nt, Escherichia coli CFT073
aggaauuaaucccuua

SEQ ID NO: 2626409 - RNA, 22 nt, Escherichia coli CFT073
aggacaucccggcagagaaaau

SEQ ID NO: 2626410 - RNA, 19 nt, Escherichia coli CFT073
aggaccccauuaauaccgc

SEQ ID NO: 2626411 - RNA, 18 nt, Escherichia coli CFT073
aggaccgguuucaaaacu

SEQ ID NO: 2626412 - RNA, 16 nt, Escherichia coli CFT073
aggaccugcgucugau

SEQ ID NO: 2626413 - RNA, 17 nt, Escherichia coli CFT073
aggacgauuccggcaaa

SEQ ID NO: 2626414 - RNA, 18 nt, Escherichia coli CFT073
aggacggaauuugcugcu

SEQ ID NO: 2626415 - RNA, 22 nt, Escherichia coli CFT073
aggacggaauuugcugcuggca

SEQ ID NO: 2626416 - RNA, 19 nt, Escherichia coli CFT073
aggacuggcgauaucaaua

SEQ ID NO: 2626417 - RNA, 21 nt, Escherichia coli CFT073
aggacuggcgauaucaauauu

SEQ ID NO: 2626418 - RNA, 17 nt, Escherichia coli CFT073
aggacugguugauaacc

SEQ ID NO: 2626419 - RNA, 15 nt, Escherichia coli CFT073
aggagaccaaaccau

SEQ ID NO: 2626420 - RNA, 16 nt, Escherichia coli CFT073
aggagagauuuuacaa

SEQ ID NO: 2626421 - RNA, 14 nt, Escherichia coli CFT073
aggagagccaguac

SEQ ID NO: 2626422 - RNA, 15 nt, Escherichia coli CFT073
aggagagccaguaca

SEQ ID NO: 2626423 - RNA, 18 nt, Escherichia coli CFT073
aggagaguaugcgcguca

SEQ ID NO: 2626424 - RNA, 19 nt, Escherichia coli CFT073
aggagauauuuaacaucau

SEQ ID NO: 2626425 - RNA, 18 nt, Escherichia coli CFT073
aggagcaauaaucagugc

SEQ ID NO: 2626426 - RNA, 12 nt, Escherichia coli CFT073
aggagcagaaca

SEQ ID NO: 2626427 - RNA, 20 nt, Escherichia coli CFT073
aggagccaacacuuucacua

SEQ ID NO: 2626428 - RNA, 16 nt, Escherichia coli CFT073
aggagccgcauagacg

SEQ ID NO: 2626429 - RNA, 15 nt, Escherichia coli CFT073
aggaggagagcaggc

SEQ ID NO: 2626430 - RNA, 21 nt, Escherichia coli CFT073
aggaggcguucugcgggagaa

SEQ ID NO: 2626431 - RNA, 22 nt, Escherichia coli CFT073
aggaggucgcacugcucuuuuu

SEQ ID NO: 2626432 - RNA, 16 nt, Escherichia coli CFT073
aggagguuuccggguc

SEQ ID NO: 2626433 - RNA, 19 nt, Escherichia coli CFT073
aggaguauggcccagccuu

SEQ ID NO: 2626434 - RNA, 20 nt, Escherichia coli CFT073
aggaguuugaacauaucagc

SEQ ID NO: 2626435 - RNA, 12 nt, Escherichia coli CFT073
aggauaaaaaag

SEQ ID NO: 2626436 - RNA, 15 nt, Escherichia coli CFT073
aggauaaauaaaaua

SEQ ID NO: 2626437 - RNA, 14 nt, Escherichia coli CFT073
aggauaaccuucca

SEQ ID NO: 2626438 - RNA, 14 nt, Escherichia coli CFT073
aggauauauuucau

SEQ ID NO: 2626439 - RNA, 15 nt, Escherichia coli CFT073
aggauauucugcggc

SEQ ID NO: 2626440 - RNA, 23 nt, Escherichia coli CFT073
aggauauucugcggcuucagcga

SEQ ID NO: 2626441 - RNA, 20 nt, Escherichia coli CFT073
aggaucaccaauaccagcau

SEQ ID NO: 2626442 - RNA, 13 nt, Escherichia coli CFT073
aggaucagaccgc

SEQ ID NO: 2626443 - RNA, 13 nt, Escherichia coli CFT073
aggaucagcaaaa

SEQ ID NO: 2626444 - RNA, 18 nt, Escherichia coli CFT073
aggaucagccauuuugca

SEQ ID NO: 2626445 - RNA, 20 nt, Escherichia coli CFT073
aggauccaugacaucuccag

SEQ ID NO: 2626446 - RNA, 16 nt, Escherichia coli CFT073
aggaucgauggugaag

SEQ ID NO: 2626447 - RNA, 19 nt, Escherichia coli CFT073
aggaucgauggugaagugg

SEQ ID NO: 2626448 - RNA, 17 nt, Escherichia coli CFT073
aggaucgcgacaaaaua

SEQ ID NO: 2626449 - RNA, 16 nt, Escherichia coli CFT073
aggaucggugcugcca

SEQ ID NO: 2626450 - RNA, 20 nt, Escherichia coli CFT073
aggaucguugagcagcagau

SEQ ID NO: 2626451 - RNA, 17 nt, Escherichia coli CFT073
aggaucuggauaaauau

SEQ ID NO: 2626452 - RNA, 15 nt, Escherichia coli CFT073
aggaugacauaaccu

SEQ ID NO: 2626453 - RNA, 13 nt, Escherichia coli CFT073
aggaugagaaaag

SEQ ID NO: 2626454 - RNA, 17 nt, Escherichia coli CFT073
aggaugcccaugccaau

SEQ ID NO: 2626455 - RNA, 18 nt, Escherichia coli CFT073
aggaugccguuaauaaua

SEQ ID NO: 2626456 - RNA, 23 nt, Escherichia coli CFT073
aggaugcugcaauaaaauaucuu

SEQ ID NO: 2626457 - RNA, 18 nt, Escherichia coli CFT073
aggauguugaucagguga

SEQ ID NO: 2626458 - RNA, 15 nt, Escherichia coli CFT073
aggauuauuuauuca

SEQ ID NO: 2626459 - RNA, 21 nt, Escherichia coli CFT073
aggauuuacuaaaacuucauu

SEQ ID NO: 2626460 - RNA, 20 nt, Escherichia coli CFT073
aggauuugauggucucgccg

SEQ ID NO: 2626461 - RNA, 23 nt, Escherichia coli CFT073
aggcaaaagaugucggaugcggc

SEQ ID NO: 2626462 - RNA, 19 nt, Escherichia coli CFT073
aggcaaaaucaucacaacu

SEQ ID NO: 2626463 - RNA, 14 nt, Escherichia coli CFT073
aggcaaaaugccag

SEQ ID NO: 2626464 - RNA, 19 nt, Escherichia coli CFT073
aggcaaacagaauuaucau

SEQ ID NO: 2626465 - RNA, 20 nt, Escherichia coli CFT073
aggcaaacagaauuaucauu

SEQ ID NO: 2626466 - RNA, 20 nt, Escherichia coli CFT073
aggcaaacuucucaccauca

SEQ ID NO: 2626467 - RNA, 14 nt, Escherichia coli CFT073
aggcaaaguacaca

SEQ ID NO: 2626468 - RNA, 18 nt, Escherichia coli CFT073
aggcaaauucuguuucau

SEQ ID NO: 2626469 - RNA, 19 nt, Escherichia coli CFT073
aggcaaauucuguuucauu

SEQ ID NO: 2626470 - RNA, 13 nt, Escherichia coli CFT073
aggcaacaaaaaa

SEQ ID NO: 2626471 - RNA, 13 nt, Escherichia coli CFT073
aggcaaccagcac

SEQ ID NO: 2626472 - RNA, 15 nt, Escherichia coli CFT073
aggcaaccagcacgc

SEQ ID NO: 2626473 - RNA, 16 nt, Escherichia coli CFT073
aggcaacccagaagaa

SEQ ID NO: 2626474 - RNA, 14 nt, Escherichia coli CFT073
aggcaagaauccgc

SEQ ID NO: 2626475 - RNA, 20 nt, Escherichia coli CFT073
aggcaagccgcuaacagcag

SEQ ID NO: 2626476 - RNA, 16 nt, Escherichia coli CFT073
aggcaaggaugcguuu

SEQ ID NO: 2626477 - RNA, 20 nt, Escherichia coli CFT073
aggcaaggaugcguuuuucg

SEQ ID NO: 2626478 - RNA, 19 nt, Escherichia coli CFT073
aggcaaguaauuguuucau

SEQ ID NO: 2626479 - RNA, 16 nt, Escherichia coli CFT073
aggcaaguuuccuccg

SEQ ID NO: 2626480 - RNA, 14 nt, Escherichia coli CFT073
aggcaauaaacauc

SEQ ID NO: 2626481 - RNA, 23 nt, Escherichia coli CFT073
aggcaauucuuuccguuuucacc

SEQ ID NO: 2626482 - RNA, 15 nt, Escherichia coli CFT073
aggcacaaaaccugc

SEQ ID NO: 2626483 - RNA, 14 nt, Escherichia coli CFT073
aggcacaacugcga

SEQ ID NO: 2626484 - RNA, 15 nt, Escherichia coli CFT073
aggcacaccagcaau

SEQ ID NO: 2626485 - RNA, 16 nt, Escherichia coli CFT073
aggcacacugccagug

SEQ ID NO: 2626486 - RNA, 15 nt, Escherichia coli CFT073
aggcacaucaacacc

SEQ ID NO: 2626487 - RNA, 13 nt, Escherichia coli CFT073
aggcaccaaaaau

SEQ ID NO: 2626488 - RNA, 20 nt, Escherichia coli CFT073
aggcaccguguuccugaacg

SEQ ID NO: 2626489 - RNA, 19 nt, Escherichia coli CFT073
aggcaccugaaucuggcuu

SEQ ID NO: 2626490 - RNA, 21 nt, Escherichia coli CFT073
aggcacguacaugcagggcaa

SEQ ID NO: 2626491 - RNA, 16 nt, Escherichia coli CFT073
aggcacucauuuucuc

SEQ ID NO: 2626492 - RNA, 21 nt, Escherichia coli CFT073
aggcacucauuuucucuuuua

SEQ ID NO: 2626493 - RNA, 17 nt, Escherichia coli CFT073
aggcacuucuuccgcca

SEQ ID NO: 2626494 - RNA, 21 nt, Escherichia coli CFT073
aggcacuugucaccaaucuga

SEQ ID NO: 2626495 - RNA, 15 nt, Escherichia coli CFT073
aggcagaaacaucau

SEQ ID NO: 2626496 - RNA, 21 nt, Escherichia coli CFT073
aggcagaacaccggcagcggg

SEQ ID NO: 2626497 - RNA, 16 nt, Escherichia coli CFT073
aggcagaacgccaugc

SEQ ID NO: 2626498 - RNA, 16 nt, Escherichia coli CFT073
aggcagacgaugaugc

SEQ ID NO: 2626499 - RNA, 22 nt, Escherichia coli CFT073
aggcagacuggauacgcugacg

SEQ ID NO: 2626500 - RNA, 16 nt, Escherichia coli CFT073
aggcagagccaaauaa

SEQ ID NO: 2626501 - RNA, 18 nt, Escherichia coli CFT073
aggcagauaauagucagc

SEQ ID NO: 2626502 - RNA, 15 nt, Escherichia coli CFT073
aggcagauacaacca

SEQ ID NO: 2626503 - RNA, 20 nt, Escherichia coli CFT073
aggcagauacaaccaaucgc

SEQ ID NO: 2626504 - RNA, 19 nt, Escherichia coli CFT073
aggcagcaaucacugccag

SEQ ID NO: 2626505 - RNA, 20 nt, Escherichia coli CFT073
aggcagcuuagaaaggaaca

SEQ ID NO: 2626506 - RNA, 14 nt, Escherichia coli CFT073
aggcaggauuuucu

SEQ ID NO: 2626507 - RNA, 16 nt, Escherichia coli CFT073
aggcagucgugcccaa

SEQ ID NO: 2626508 - RNA, 14 nt, Escherichia coli CFT073
aggcaguggaauau

SEQ ID NO: 2626509 - RNA, 20 nt, Escherichia coli CFT073
aggcaucacuuuaccgguuu

SEQ ID NO: 2626510 - RNA, 14 nt, Escherichia coli CFT073
aggcaucagcaauu

SEQ ID NO: 2626511 - RNA, 20 nt, Escherichia coli CFT073
aggcaucagcaauuguaaau

SEQ ID NO: 2626512 - RNA, 17 nt, Escherichia coli CFT073
aggcaucggcuuuuuac

SEQ ID NO: 2626513 - RNA, 15 nt, Escherichia coli CFT073
aggcaucgugcacca

SEQ ID NO: 2626514 - RNA, 13 nt, Escherichia coli CFT073
aggcaugaucagc

SEQ ID NO: 2626515 - RNA, 18 nt, Escherichia coli CFT073
aggcauuccuuuacuuag

SEQ ID NO: 2626516 - RNA, 20 nt, Escherichia coli CFT073
aggcauuguguagggcagcg

SEQ ID NO: 2626517 - RNA, 15 nt, Escherichia coli CFT073
aggccaaaaccacag

SEQ ID NO: 2626518 - RNA, 16 nt, Escherichia coli CFT073
aggccaaaagcuaaca

SEQ ID NO: 2626519 - RNA, 21 nt, Escherichia coli CFT073
aggccaaaagcuaacagcgcc

SEQ ID NO: 2626520 - RNA, 12 nt, Escherichia coli CFT073
aggccaaagccg

SEQ ID NO: 2626521 - RNA, 14 nt, Escherichia coli CFT073
aggccaacauccau

SEQ ID NO: 2626522 - RNA, 15 nt, Escherichia coli CFT073
aggccaccgcccacc

SEQ ID NO: 2626523 - RNA, 19 nt, Escherichia coli CFT073
aggccaccucgcaacaaug

SEQ ID NO: 2626524 - RNA, 21 nt, Escherichia coli CFT073
aggccaccucgcaacaauguc

SEQ ID NO: 2626525 - RNA, 16 nt, Escherichia coli CFT073
aggccagauaaaacac

SEQ ID NO: 2626526 - RNA, 19 nt, Escherichia coli CFT073
aggccagauaaggcguuca

SEQ ID NO: 2626527 - RNA, 22 nt, Escherichia coli CFT073
aggccagauacugccgaccaga

SEQ ID NO: 2626528 - RNA, 12 nt, Escherichia coli CFT073
aggccagcaauc

SEQ ID NO: 2626529 - RNA, 12 nt, Escherichia coli CFT073
aggccagccaga

SEQ ID NO: 2626530 - RNA, 16 nt, Escherichia coli CFT073
aggccagccagaagaa

SEQ ID NO: 2626531 - RNA, 13 nt, Escherichia coli CFT073
aggccagccugau

SEQ ID NO: 2626532 - RNA, 15 nt, Escherichia coli CFT073
aggccaggguaaaaa

SEQ ID NO: 2626533 - RNA, 14 nt, Escherichia coli CFT073
aggccaguauuuca

SEQ ID NO: 2626534 - RNA, 16 nt, Escherichia coli CFT073
aggccaguauuucaua

SEQ ID NO: 2626535 - RNA, 18 nt, Escherichia coli CFT073
aggccauaaucaaauaaa

SEQ ID NO: 2626536 - RNA, 15 nt, Escherichia coli CFT073
aggccauaugacacc

SEQ ID NO: 2626537 - RNA, 17 nt, Escherichia coli CFT073
aggccauuuccccaauc

SEQ ID NO: 2626538 - RNA, 21 nt, Escherichia coli CFT073
aggccauuugcucuaccagcc

SEQ ID NO: 2626539 - RNA, 21 nt, Escherichia coli CFT073
aggccauuuuuucgauaauca

SEQ ID NO: 2626540 - RNA, 23 nt, Escherichia coli CFT073
aggccauuuuuucgauaaucaaa

SEQ ID NO: 2626541 - RNA, 12 nt, Escherichia coli CFT073
aggccccagccu

SEQ ID NO: 2626542 - RNA, 14 nt, Escherichia coli CFT073
aggccccagccuca

SEQ ID NO: 2626543 - RNA, 18 nt, Escherichia coli CFT073
aggcccgcguagagaaaa

SEQ ID NO: 2626544 - RNA, 16 nt, Escherichia coli CFT073
aggcccgcgugccgga

SEQ ID NO: 2626545 - RNA, 19 nt, Escherichia coli CFT073
aggcccgucacgcagucag

SEQ ID NO: 2626546 - RNA, 18 nt, Escherichia coli CFT073
aggccgauacggacucgg

SEQ ID NO: 2626547 - RNA, 22 nt, Escherichia coli CFT073
aggccgcaggcuguuaccccug

SEQ ID NO: 2626548 - RNA, 13 nt, Escherichia coli CFT073
aggccgccaggca

SEQ ID NO: 2626549 - RNA, 18 nt, Escherichia coli CFT073
aggccgccguaggagugc

SEQ ID NO: 2626550 - RNA, 20 nt, Escherichia coli CFT073
aggccgcgaaccagaccagc

SEQ ID NO: 2626551 - RNA, 18 nt, Escherichia coli CFT073
aggccgcggcucaggcgc

SEQ ID NO: 2626552 - RNA, 20 nt, Escherichia coli CFT073
aggccggaaccggcaacggc

SEQ ID NO: 2626553 - RNA, 22 nt, Escherichia coli CFT073
aggccggaaccggcaacggcgu

SEQ ID NO: 2626554 - RNA, 20 nt, Escherichia coli CFT073
aggccggacaaggcgcucgc

SEQ ID NO: 2626555 - RNA, 17 nt, Escherichia coli CFT073
aggccuaaagcauacaa

SEQ ID NO: 2626556 - RNA, 19 nt, Escherichia coli CFT073
aggccuaacaccaucagug

SEQ ID NO: 2626557 - RNA, 16 nt, Escherichia coli CFT073
aggccuacaaucccgu

SEQ ID NO: 2626558 - RNA, 22 nt, Escherichia coli CFT073
aggccuacaggugcaccgcauc

SEQ ID NO: 2626559 - RNA, 21 nt, Escherichia coli CFT073
aggccuacauagccccugcaa

SEQ ID NO: 2626560 - RNA, 17 nt, Escherichia coli CFT073
aggccuacaugccauca

SEQ ID NO: 2626561 - RNA, 20 nt, Escherichia coli CFT073
aggccuacauuggugccgga

SEQ ID NO: 2626562 - RNA, 16 nt, Escherichia coli CFT073
aggccuaccagagaua

SEQ ID NO: 2626563 - RNA, 14 nt, Escherichia coli CFT073
aggccugauaagac

SEQ ID NO: 2626564 - RNA, 15 nt, Escherichia coli CFT073
aggccugauaagacg

SEQ ID NO: 2626565 - RNA, 12 nt, Escherichia coli CFT073
aggccugcugaa

SEQ ID NO: 2626566 - RNA, 22 nt, Escherichia coli CFT073
aggccuugaacucugaaucgcu

SEQ ID NO: 2626567 - RNA, 20 nt, Escherichia coli CFT073
aggcgaaaacgcugaccguc

SEQ ID NO: 2626568 - RNA, 18 nt, Escherichia coli CFT073
aggcgaagacaaaaccaa

SEQ ID NO: 2626569 - RNA, 14 nt, Escherichia coli CFT073
aggcgacaaagccu

SEQ ID NO: 2626570 - RNA, 14 nt, Escherichia coli CFT073
aggcgacaaggcuu

SEQ ID NO: 2626571 - RNA, 21 nt, Escherichia coli CFT073
aggcgacacuucguuaaccac

SEQ ID NO: 2626572 - RNA, 21 nt, Escherichia coli CFT073
aggcgaccguuuucaccaguu

SEQ ID NO: 2626573 - RNA, 21 nt, Escherichia coli CFT073
aggcgacgguuuccaggcagc

SEQ ID NO: 2626574 - RNA, 20 nt, Escherichia coli CFT073
aggcgacucgguugcacaga

SEQ ID NO: 2626575 - RNA, 12 nt, Escherichia coli CFT073
aggcgagcugcc

SEQ ID NO: 2626576 - RNA, 17 nt, Escherichia coli CFT073
aggcgaucccagcgccu

SEQ ID NO: 2626577 - RNA, 13 nt, Escherichia coli CFT073
aggcgcacugccc

SEQ ID NO: 2626578 - RNA, 22 nt, Escherichia coli CFT073
aggcgcgaagcuggucagcauc

SEQ ID NO: 2626579 - RNA, 14 nt, Escherichia coli CFT073
aggcgcgacacggc

SEQ ID NO: 2626580 - RNA, 21 nt, Escherichia coli CFT073
aggcgcgcgggugaugugcca

SEQ ID NO: 2626581 - RNA, 18 nt, Escherichia coli CFT073
aggcgcgucaaauaaaga

SEQ ID NO: 2626582 - RNA, 14 nt, Escherichia coli CFT073
aggcgcuaaaagca

SEQ ID NO: 2626583 - RNA, 18 nt, Escherichia coli CFT073
aggcgcucgcgccgcauc

SEQ ID NO: 2626584 - RNA, 23 nt, Escherichia coli CFT073
aggcgcucgcgccgcauccgaca

SEQ ID NO: 2626585 - RNA, 17 nt, Escherichia coli CFT073
aggcgcugacgacaucg

SEQ ID NO: 2626586 - RNA, 23 nt, Escherichia coli CFT073
aggcgcugcuggagcaggugaau

SEQ ID NO: 2626587 - RNA, 21 nt, Escherichia coli CFT073
aggcgcugguaaucaccaccc

SEQ ID NO: 2626588 - RNA, 21 nt, Escherichia coli CFT073
aggcgcuguaagccucuuuca

SEQ ID NO: 2626589 - RNA, 21 nt, Escherichia coli CFT073
aggcgcuuaucgucccaggca

SEQ ID NO: 2626590 - RNA, 15 nt, Escherichia coli CFT073
aggcggcucaccugc

SEQ ID NO: 2626591 - RNA, 22 nt, Escherichia coli CFT073
aggcggcucuggcggcgcgaua

SEQ ID NO: 2626592 - RNA, 15 nt, Escherichia coli CFT073
aggcggcuucgcauc

SEQ ID NO: 2626593 - RNA, 22 nt, Escherichia coli CFT073
aggcggguacguuucgccugca

SEQ ID NO: 2626594 - RNA, 18 nt, Escherichia coli CFT073
aggcggucauaaaaucaa

SEQ ID NO: 2626595 - RNA, 15 nt, Escherichia coli CFT073
aggcguaauauaaaa

SEQ ID NO: 2626596 - RNA, 17 nt, Escherichia coli CFT073
aggcguuaacagcgcau

SEQ ID NO: 2626597 - RNA, 21 nt, Escherichia coli CFT073
aggcguucaagcugcaucugg

SEQ ID NO: 2626598 - RNA, 15 nt, Escherichia coli CFT073
aggcguucacgccgc

SEQ ID NO: 2626599 - RNA, 18 nt, Escherichia coli CFT073
aggcguucacgccgcauc

SEQ ID NO: 2626600 - RNA, 20 nt, Escherichia coli CFT073
aggcguucacgccgcauccg

SEQ ID NO: 2626601 - RNA, 23 nt, Escherichia coli CFT073
aggcguucacgccgcauccggca

SEQ ID NO: 2626602 - RNA, 20 nt, Escherichia coli CFT073
aggcguucacgccgcaucug

SEQ ID NO: 2626603 - RNA, 16 nt, Escherichia coli CFT073
aggcguucgcgccgca

SEQ ID NO: 2626604 - RNA, 16 nt, Escherichia coli CFT073
aggcguuguccuugcc

SEQ ID NO: 2626605 - RNA, 18 nt, Escherichia coli CFT073
aggcguuuacgccgcauc

SEQ ID NO: 2626606 - RNA, 23 nt, Escherichia coli CFT073
aggcguuuacgccgcauccgaca

SEQ ID NO: 2626607 - RNA, 12 nt, Escherichia coli CFT073
aggcguuuaugc

SEQ ID NO: 2626608 - RNA, 18 nt, Escherichia coli CFT073
aggcguuuaugccgcauc

SEQ ID NO: 2626609 - RNA, 13 nt, Escherichia coli CFT073
aggcuagccgcca

SEQ ID NO: 2626610 - RNA, 14 nt, Escherichia coli CFT073
aggcuagccgccag

SEQ ID NO: 2626611 - RNA, 20 nt, Escherichia coli CFT073
aggcuauagcagguaaaacg

SEQ ID NO: 2626612 - RNA, 16 nt, Escherichia coli CFT073
aggcuaucggccaggu

SEQ ID NO: 2626613 - RNA, 17 nt, Escherichia coli CFT073
aggcucaggcuggcuga

SEQ ID NO: 2626614 - RNA, 16 nt, Escherichia coli CFT073
aggcucauuaauuuuc

SEQ ID NO: 2626615 - RNA, 15 nt, Escherichia coli CFT073
aggcuccagauaaca

SEQ ID NO: 2626616 - RNA, 16 nt, Escherichia coli CFT073
aggcucucauuuuuca

SEQ ID NO: 2626617 - RNA, 19 nt, Escherichia coli CFT073
aggcugauguugauaaaga

SEQ ID NO: 2626618 - RNA, 17 nt, Escherichia coli CFT073
aggcugccagagucagc

SEQ ID NO: 2626619 - RNA, 17 nt, Escherichia coli CFT073
aggcugcuugagccagu

SEQ ID NO: 2626620 - RNA, 14 nt, Escherichia coli CFT073
aggcuggagcaaac

SEQ ID NO: 2626621 - RNA, 22 nt, Escherichia coli CFT073
aggcugucaguagcaaacacug

SEQ ID NO: 2626622 - RNA, 15 nt, Escherichia coli CFT073
aggcuuacacuuccu

SEQ ID NO: 2626623 - RNA, 17 nt, Escherichia coli CFT073
aggcuuacacuuccuuu

SEQ ID NO: 2626624 - RNA, 12 nt, Escherichia coli CFT073
aggcuuauccgg

SEQ ID NO: 2626625 - RNA, 15 nt, Escherichia coli CFT073
aggcuucaaucaaua

SEQ ID NO: 2626626 - RNA, 14 nt, Escherichia coli CFT073
aggcuugcugaugc

SEQ ID NO: 2626627 - RNA, 13 nt, Escherichia coli CFT073
aggcuugcugcau

SEQ ID NO: 2626628 - RNA, 14 nt, Escherichia coli CFT073
aggcuuuaaacccg

SEQ ID NO: 2626629 - RNA, 12 nt, Escherichia coli CFT073
aggcuuuccaga

SEQ ID NO: 2626630 - RNA, 21 nt, Escherichia coli CFT073
aggcuuuccgucagcggcagc

SEQ ID NO: 2626631 - RNA, 17 nt, Escherichia coli CFT073
aggcuuugcuuauaacc

SEQ ID NO: 2626632 - RNA, 15 nt, Escherichia coli CFT073
aggcuuuugguguuu

SEQ ID NO: 2626633 - RNA, 13 nt, Escherichia coli CFT073
agggaaauaaucg

SEQ ID NO: 2626634 - RNA, 19 nt, Escherichia coli CFT073
agggaaauaaucgggaaua

SEQ ID NO: 2626635 - RNA, 20 nt, Escherichia coli CFT073
agggaagcgaguuaccacgc

SEQ ID NO: 2626636 - RNA, 20 nt, Escherichia coli CFT073
agggaaucgauaacugcucu

SEQ ID NO: 2626637 - RNA, 16 nt, Escherichia coli CFT073
agggaauuggcguaua

SEQ ID NO: 2626638 - RNA, 21 nt, Escherichia coli CFT073
agggacuccggauucaagcau

SEQ ID NO: 2626639 - RNA, 22 nt, Escherichia coli CFT073
agggagcaggccaguaaaaagc

SEQ ID NO: 2626640 - RNA, 18 nt, Escherichia coli CFT073
agggaguuggaguaaaac

SEQ ID NO: 2626641 - RNA, 13 nt, Escherichia coli CFT073
agggauauuucac

SEQ ID NO: 2626642 - RNA, 14 nt, Escherichia coli CFT073
agggauauuucacc

SEQ ID NO: 2626643 - RNA, 15 nt, Escherichia coli CFT073
agggauauuucaccg

SEQ ID NO: 2626644 - RNA, 14 nt, Escherichia coli CFT073
agggcaaacagcac

SEQ ID NO: 2626645 - RNA, 13 nt, Escherichia coli CFT073
agggcaacuucag

SEQ ID NO: 2626646 - RNA, 16 nt, Escherichia coli CFT073
agggcagacgccccug

SEQ ID NO: 2626647 - RNA, 15 nt, Escherichia coli CFT073
agggcagcaggauca

SEQ ID NO: 2626648 - RNA, 17 nt, Escherichia coli CFT073
agggcagcaggaucaga

SEQ ID NO: 2626649 - RNA, 14 nt, Escherichia coli CFT073
agggccuccugcag

SEQ ID NO: 2626650 - RNA, 20 nt, Escherichia coli CFT073
agggcgaaaccauauuaaau

SEQ ID NO: 2626651 - RNA, 17 nt, Escherichia coli CFT073
agggcgaacgagauaau

SEQ ID NO: 2626652 - RNA, 22 nt, Escherichia coli CFT073
agggcgaauuuccgcgaccuga

SEQ ID NO: 2626653 - RNA, 22 nt, Escherichia coli CFT073
agggcgaucuuccgaccgcccu

SEQ ID NO: 2626654 - RNA, 20 nt, Escherichia coli CFT073
agggcgauuauccgccagcg

SEQ ID NO: 2626655 - RNA, 16 nt, Escherichia coli CFT073
agggcgcacgcacggc

SEQ ID NO: 2626656 - RNA, 16 nt, Escherichia coli CFT073
agggcgcagcugugcc

SEQ ID NO: 2626657 - RNA, 12 nt, Escherichia coli CFT073
agggcggacuga

SEQ ID NO: 2626658 - RNA, 20 nt, Escherichia coli CFT073
agggcggcgguggcaaaggu

SEQ ID NO: 2626659 - RNA, 17 nt, Escherichia coli CFT073
agggcggcuaucccaaa

SEQ ID NO: 2626660 - RNA, 14 nt, Escherichia coli CFT073
agggcgucaccggu

SEQ ID NO: 2626661 - RNA, 20 nt, Escherichia coli CFT073
agggcgugaagacugcgacg

SEQ ID NO: 2626662 - RNA, 18 nt, Escherichia coli CFT073
agggcuuuuuuauuucau

SEQ ID NO: 2626663 - RNA, 14 nt, Escherichia coli CFT073
aggggaaaaauuca

SEQ ID NO: 2626664 - RNA, 18 nt, Escherichia coli CFT073
aggggaacacggcuuucu

SEQ ID NO: 2626665 - RNA, 14 nt, Escherichia coli CFT073
aggggaacagacca

SEQ ID NO: 2626666 - RNA, 16 nt, Escherichia coli CFT073
aggggaacugcaggca

SEQ ID NO: 2626667 - RNA, 13 nt, Escherichia coli CFT073
aggggacauuuag

SEQ ID NO: 2626668 - RNA, 16 nt, Escherichia coli CFT073
aggggauggaugcccc

SEQ ID NO: 2626669 - RNA, 13 nt, Escherichia coli CFT073
aggggcagaaaca

SEQ ID NO: 2626670 - RNA, 17 nt, Escherichia coli CFT073
aggggcauuuuccagug

SEQ ID NO: 2626671 - RNA, 11 nt, Escherichia coli CFT073
aggggcgaggg

SEQ ID NO: 2626672 - RNA, 22 nt, Escherichia coli CFT073
aggggcggguuuuuuuauaucu

SEQ ID NO: 2626673 - RNA, 20 nt, Escherichia coli CFT073
aggggcuuauauaggugaua

SEQ ID NO: 2626674 - RNA, 19 nt, Escherichia coli CFT073
agggguaaugccagucagu

SEQ ID NO: 2626675 - RNA, 14 nt, Escherichia coli CFT073
aggguaagaugaau

SEQ ID NO: 2626676 - RNA, 14 nt, Escherichia coli CFT073
aggguauccaggcc

SEQ ID NO: 2626677 - RNA, 17 nt, Escherichia coli CFT073
agggugaauaaaagaaa

SEQ ID NO: 2626678 - RNA, 16 nt, Escherichia coli CFT073
agggugauaagcgagg

SEQ ID NO: 2626679 - RNA, 18 nt, Escherichia coli CFT073
agggugcagaaucaaucu

SEQ ID NO: 2626680 - RNA, 20 nt, Escherichia coli CFT073
aggguggcgucaaaaagcuc

SEQ ID NO: 2626681 - RNA, 17 nt, Escherichia coli CFT073
aggguggggaaaaaaca

SEQ ID NO: 2626682 - RNA, 21 nt, Escherichia coli CFT073
aggguuuaauaaucgcaucaa

SEQ ID NO: 2626683 - RNA, 19 nt, Escherichia coli CFT073
aggguuucgacggcaccaa

SEQ ID NO: 2626684 - RNA, 12 nt, Escherichia coli CFT073
agguaaaacaag

SEQ ID NO: 2626685 - RNA, 14 nt, Escherichia coli CFT073
agguaaagaccaua

SEQ ID NO: 2626686 - RNA, 12 nt, Escherichia coli CFT073
agguaacaggga

SEQ ID NO: 2626687 - RNA, 17 nt, Escherichia coli CFT073
agguaacccaguaacgg

SEQ ID NO: 2626688 - RNA, 19 nt, Escherichia coli CFT073
agguaacgccuggggggga

SEQ ID NO: 2626689 - RNA, 18 nt, Escherichia coli CFT073
agguaacgucgguuucau

SEQ ID NO: 2626690 - RNA, 19 nt, Escherichia coli CFT073
agguaagaguuucaacauc

SEQ ID NO: 2626691 - RNA, 13 nt, Escherichia coli CFT073
agguaagcaacag

SEQ ID NO: 2626692 - RNA, 15 nt, Escherichia coli CFT073
agguaaggauaaaaa

SEQ ID NO: 2626693 - RNA, 19 nt, Escherichia coli CFT073
agguaaugguuaguacacc

SEQ ID NO: 2626694 - RNA, 16 nt, Escherichia coli CFT073
agguaauugcuuucuu

SEQ ID NO: 2626695 - RNA, 21 nt, Escherichia coli CFT073
agguaauuuugcuuauuuaaa

SEQ ID NO: 2626696 - RNA, 17 nt, Escherichia coli CFT073
agguacagacuaaaugu

SEQ ID NO: 2626697 - RNA, 14 nt, Escherichia coli CFT073
agguagcagcagcg

SEQ ID NO: 2626698 - RNA, 18 nt, Escherichia coli CFT073
agguagcgauagaaauca

SEQ ID NO: 2626699 - RNA, 19 nt, Escherichia coli CFT073
agguagcgauagaaaucag

SEQ ID NO: 2626700 - RNA, 13 nt, Escherichia coli CFT073
agguaguagaaau

SEQ ID NO: 2626701 - RNA, 17 nt, Escherichia coli CFT073
agguagucaaaagcacu

SEQ ID NO: 2626702 - RNA, 17 nt, Escherichia coli CFT073
agguaucgcgaaaaaaa

SEQ ID NO: 2626703 - RNA, 17 nt, Escherichia coli CFT073
agguaucguuacgccag

SEQ ID NO: 2626704 - RNA, 23 nt, Escherichia coli CFT073
agguauugcuaagcucucagcau

SEQ ID NO: 2626705 - RNA, 17 nt, Escherichia coli CFT073
agguauuuagcgaauaa

SEQ ID NO: 2626706 - RNA, 17 nt, Escherichia coli CFT073
agguauuugcguagccg

SEQ ID NO: 2626707 - RNA, 19 nt, Escherichia coli CFT073
aggucaagaaggauauaaa

SEQ ID NO: 2626708 - RNA, 13 nt, Escherichia coli CFT073
aggucaauaacga

SEQ ID NO: 2626709 - RNA, 15 nt, Escherichia coli CFT073
aggucaaucccagga

SEQ ID NO: 2626710 - RNA, 17 nt, Escherichia coli CFT073
aggucagagagccagcc

SEQ ID NO: 2626711 - RNA, 20 nt, Escherichia coli CFT073
aggucagagagccagcccca

SEQ ID NO: 2626712 - RNA, 16 nt, Escherichia coli CFT073
aggucagguucucuga

SEQ ID NO: 2626713 - RNA, 18 nt, Escherichia coli CFT073
aggucagguuugacauaa

SEQ ID NO: 2626714 - RNA, 14 nt, Escherichia coli CFT073
aggucauaucauca

SEQ ID NO: 2626715 - RNA, 17 nt, Escherichia coli CFT073
aggucaucacaucccag

SEQ ID NO: 2626716 - RNA, 15 nt, Escherichia coli CFT073
agguccagccgccug

SEQ ID NO: 2626717 - RNA, 18 nt, Escherichia coli CFT073
agguccaucacuugcugc

SEQ ID NO: 2626718 - RNA, 12 nt, Escherichia coli CFT073
aggucgccaguc

SEQ ID NO: 2626719 - RNA, 22 nt, Escherichia coli CFT073
aggucggauaaggcguuuacgc

SEQ ID NO: 2626720 - RNA, 22 nt, Escherichia coli CFT073
aggucguucaguuuaccgucuu

SEQ ID NO: 2626721 - RNA, 15 nt, Escherichia coli CFT073
aggucugcaauauca

SEQ ID NO: 2626722 - RNA, 20 nt, Escherichia coli CFT073
aggucuuugacgucgaaacu

SEQ ID NO: 2626723 - RNA, 12 nt, Escherichia coli CFT073
aggucuuuucuc

SEQ ID NO: 2626724 - RNA, 17 nt, Escherichia coli CFT073
aggugaaauccggcuuc

SEQ ID NO: 2626725 - RNA, 21 nt, Escherichia coli CFT073
aggugaacgccaccaacgcac

SEQ ID NO: 2626726 - RNA, 14 nt, Escherichia coli CFT073
aggugaagguaagu

SEQ ID NO: 2626727 - RNA, 19 nt, Escherichia coli CFT073
aggugacauuaaagcuuua

SEQ ID NO: 2626728 - RNA, 18 nt, Escherichia coli CFT073
aggugacgcuggcagcag

SEQ ID NO: 2626729 - RNA, 18 nt, Escherichia coli CFT073
aggugacguccagaaccg

SEQ ID NO: 2626730 - RNA, 17 nt, Escherichia coli CFT073
aggugauucccagcaac

SEQ ID NO: 2626731 - RNA, 17 nt, Escherichia coli CFT073
aggugauuuuacccccg

SEQ ID NO: 2626732 - RNA, 21 nt, Escherichia coli CFT073
aggugcagcccauaagcaaaa

SEQ ID NO: 2626733 - RNA, 16 nt, Escherichia coli CFT073
aggugcaucggggaau

SEQ ID NO: 2626734 - RNA, 18 nt, Escherichia coli CFT073
aggugcaucggggaauug

SEQ ID NO: 2626735 - RNA, 19 nt, Escherichia coli CFT073
aggugcgugcgcccaucau

SEQ ID NO: 2626736 - RNA, 18 nt, Escherichia coli CFT073
aggugcuaugcauacaca

SEQ ID NO: 2626737 - RNA, 16 nt, Escherichia coli CFT073
agguggcaguuacugc

SEQ ID NO: 2626738 - RNA, 22 nt, Escherichia coli CFT073
aggugguauagaaugcagcagc

SEQ ID NO: 2626739 - RNA, 23 nt, Escherichia coli CFT073
aggugguauagaaugcagcagca

SEQ ID NO: 2626740 - RNA, 18 nt, Escherichia coli CFT073
aggugguuaccgccagca

SEQ ID NO: 2626741 - RNA, 19 nt, Escherichia coli CFT073
aggugguuaccgccagcac

SEQ ID NO: 2626742 - RNA, 17 nt, Escherichia coli CFT073
agguguaaauaucagga

SEQ ID NO: 2626743 - RNA, 14 nt, Escherichia coli CFT073
agguguacuggcaa

SEQ ID NO: 2626744 - RNA, 17 nt, Escherichia coli CFT073
agguguauugcccgccg

SEQ ID NO: 2626745 - RNA, 20 nt, Escherichia coli CFT073
aggugucaauaauauuugua

SEQ ID NO: 2626746 - RNA, 14 nt, Escherichia coli CFT073
aggugucaauccuu

SEQ ID NO: 2626747 - RNA, 20 nt, Escherichia coli CFT073
aggugucgcgcacucuacuc

SEQ ID NO: 2626748 - RNA, 16 nt, Escherichia coli CFT073
agguguugaaaugaga

SEQ ID NO: 2626749 - RNA, 13 nt, Escherichia coli CFT073
agguuaacccaca

SEQ ID NO: 2626750 - RNA, 19 nt, Escherichia coli CFT073
agguuaacccacagcgcac

SEQ ID NO: 2626751 - RNA, 17 nt, Escherichia coli CFT073
agguuaacgaaggugaa

SEQ ID NO: 2626752 - RNA, 12 nt, Escherichia coli CFT073
agguuaacugug

SEQ ID NO: 2626753 - RNA, 14 nt, Escherichia coli CFT073
agguuaagccucac

SEQ ID NO: 2626754 - RNA, 17 nt, Escherichia coli CFT073
agguuaauauuuucgcc

SEQ ID NO: 2626755 - RNA, 22 nt, Escherichia coli CFT073
agguuaggcugagaaccgcaca

SEQ ID NO: 2626756 - RNA, 20 nt, Escherichia coli CFT073
agguuaucgcccugccagcg

SEQ ID NO: 2626757 - RNA, 18 nt, Escherichia coli CFT073
agguucagcaaccacaac

SEQ ID NO: 2626758 - RNA, 21 nt, Escherichia coli CFT073
agguucaguccguugcaguuu

SEQ ID NO: 2626759 - RNA, 17 nt, Escherichia coli CFT073
agguuccaauauugguc

SEQ ID NO: 2626760 - RNA, 21 nt, Escherichia coli CFT073
agguuccacggaauauuucac

SEQ ID NO: 2626761 - RNA, 13 nt, Escherichia coli CFT073
agguugaaauaaa

SEQ ID NO: 2626762 - RNA, 16 nt, Escherichia coli CFT073
agguugaaauaaaccg

SEQ ID NO: 2626763 - RNA, 17 nt, Escherichia coli CFT073
agguugcagaucuuucu

SEQ ID NO: 2626764 - RNA, 19 nt, Escherichia coli CFT073
agguugccggucuuucuuu

SEQ ID NO: 2626765 - RNA, 16 nt, Escherichia coli CFT073
agguuggaucaacagg

SEQ ID NO: 2626766 - RNA, 15 nt, Escherichia coli CFT073
agguuguaucaccac

SEQ ID NO: 2626767 - RNA, 19 nt, Escherichia coli CFT073
agguuuagccaaaaaucga

SEQ ID NO: 2626768 - RNA, 16 nt, Escherichia coli CFT073
agguuucccgccguaa

SEQ ID NO: 2626769 - RNA, 13 nt, Escherichia coli CFT073
agguuuccggguc

SEQ ID NO: 2626770 - RNA, 17 nt, Escherichia coli CFT073
agguuucgaccacaccu

SEQ ID NO: 2626771 - RNA, 11 nt, Escherichia coli CFT073
agguuucugcc

SEQ ID NO: 2626772 - RNA, 16 nt, Escherichia coli CFT073
agguuuguacaacgua

SEQ ID NO: 2626773 - RNA, 19 nt, Escherichia coli CFT073
agguuuucuuucaccucuu

SEQ ID NO: 2626774 - RNA, 20 nt, Escherichia coli CFT073
agguuuucuuucaccucuuc

SEQ ID NO: 2626775 - RNA, 20 nt, Escherichia coli CFT073
agguuuuuacccaacucuuu

SEQ ID NO: 2626776 - RNA, 16 nt, Escherichia coli CFT073
agguuuuucagcugcc

SEQ ID NO: 2626777 - RNA, 17 nt, Escherichia coli CFT073
aguaaaaagauuucugc

SEQ ID NO: 2626778 - RNA, 20 nt, Escherichia coli CFT073
aguaaaacgguggccacagc

SEQ ID NO: 2626779 - RNA, 18 nt, Escherichia coli CFT073
aguaaacaaacaugaauc

SEQ ID NO: 2626780 - RNA, 13 nt, Escherichia coli CFT073
aguaaaccacauc

SEQ ID NO: 2626781 - RNA, 16 nt, Escherichia coli CFT073
aguaaacccggcauca

SEQ ID NO: 2626782 - RNA, 12 nt, Escherichia coli CFT073
aguaaacgguga

SEQ ID NO: 2626783 - RNA, 23 nt, Escherichia coli CFT073
aguaaacuucaacgcugcggcgu

SEQ ID NO: 2626784 - RNA, 20 nt, Escherichia coli CFT073
aguaaagcccgccaucgccc

SEQ ID NO: 2626785 - RNA, 13 nt, Escherichia coli CFT073
aguaaauaaaaaa

SEQ ID NO: 2626786 - RNA, 14 nt, Escherichia coli CFT073
aguaaauaaaaaau

SEQ ID NO: 2626787 - RNA, 13 nt, Escherichia coli CFT073
aguaaauccauaa

SEQ ID NO: 2626788 - RNA, 20 nt, Escherichia coli CFT073
aguaaaucgucuguuugcgu

SEQ ID NO: 2626789 - RNA, 10 nt, Escherichia coli CFT073
aguaaauggu

SEQ ID NO: 2626790 - RNA, 13 nt, Escherichia coli CFT073
aguaaauucaucc

SEQ ID NO: 2626791 - RNA, 21 nt, Escherichia coli CFT073
aguaaauuucgcgcuccggca

SEQ ID NO: 2626792 - RNA, 17 nt, Escherichia coli CFT073
aguaacagucaguuauc

SEQ ID NO: 2626793 - RNA, 15 nt, Escherichia coli CFT073
aguaacccagcacca

SEQ ID NO: 2626794 - RNA, 19 nt, Escherichia coli CFT073
aguaaccugcgaaaaucag

SEQ ID NO: 2626795 - RNA, 22 nt, Escherichia coli CFT073
aguaaccuucgcggcacuggua

SEQ ID NO: 2626796 - RNA, 22 nt, Escherichia coli CFT073
aguaaccuuuaucacgcagcag

SEQ ID NO: 2626797 - RNA, 20 nt, Escherichia coli CFT073
aguaaccuuugaacagccag

SEQ ID NO: 2626798 - RNA, 17 nt, Escherichia coli CFT073
aguaacgcggcaauaaa

SEQ ID NO: 2626799 - RNA, 18 nt, Escherichia coli CFT073
aguaacgguugaugccgu

SEQ ID NO: 2626800 - RNA, 18 nt, Escherichia coli CFT073
aguaacguuguaccacug

SEQ ID NO: 2626801 - RNA, 15 nt, Escherichia coli CFT073
aguaacucauugcca

SEQ ID NO: 2626802 - RNA, 13 nt, Escherichia coli CFT073
aguaacugcugua

SEQ ID NO: 2626803 - RNA, 20 nt, Escherichia coli CFT073
aguaacuuccccuuucacau

SEQ ID NO: 2626804 - RNA, 12 nt, Escherichia coli CFT073
aguaagcccagg

SEQ ID NO: 2626805 - RNA, 15 nt, Escherichia coli CFT073
aguaagccggauaau

SEQ ID NO: 2626806 - RNA, 21 nt, Escherichia coli CFT073
aguaagccuaaauguagcgaa

SEQ ID NO: 2626807 - RNA, 14 nt, Escherichia coli CFT073
aguaagcguuuucu

SEQ ID NO: 2626808 - RNA, 17 nt, Escherichia coli CFT073
aguaagcguuuucucaa

SEQ ID NO: 2626809 - RNA, 15 nt, Escherichia coli CFT073
aguaaggcugcgagg

SEQ ID NO: 2626810 - RNA, 16 nt, Escherichia coli CFT073
aguaagggaucacgcg

SEQ ID NO: 2626811 - RNA, 21 nt, Escherichia coli CFT073
aguaagucuuccggugcauca

SEQ ID NO: 2626812 - RNA, 15 nt, Escherichia coli CFT073
aguaauaaagacggu

SEQ ID NO: 2626813 - RNA, 22 nt, Escherichia coli CFT073
aguaauaaagacgguggcacau

SEQ ID NO: 2626814 - RNA, 14 nt, Escherichia coli CFT073
aguaauagccugau

SEQ ID NO: 2626815 - RNA, 15 nt, Escherichia coli CFT073
aguaaucaaucaccu

SEQ ID NO: 2626816 - RNA, 20 nt, Escherichia coli CFT073
aguaaugacgaccgggagau

SEQ ID NO: 2626817 - RNA, 19 nt, Escherichia coli CFT073
aguaaugaucacuggaaga

SEQ ID NO: 2626818 - RNA, 16 nt, Escherichia coli CFT073
aguaaugcgcccaugc

SEQ ID NO: 2626819 - RNA, 22 nt, Escherichia coli CFT073
aguaaugguuuuauugcccugu

SEQ ID NO: 2626820 - RNA, 15 nt, Escherichia coli CFT073
aguaauuaaacugau

SEQ ID NO: 2626821 - RNA, 14 nt, Escherichia coli CFT073
aguaauuguuucau

SEQ ID NO: 2626822 - RNA, 16 nt, Escherichia coli CFT073
aguaauuuugcucacc

SEQ ID NO: 2626823 - RNA, 21 nt, Escherichia coli CFT073
aguacaccgccguugauuuca

SEQ ID NO: 2626824 - RNA, 21 nt, Escherichia coli CFT073
aguacacgcugaagaucuuca

SEQ ID NO: 2626825 - RNA, 13 nt, Escherichia coli CFT073
aguacaggcggca

SEQ ID NO: 2626826 - RNA, 21 nt, Escherichia coli CFT073
aguacaugaagcacggcauca

SEQ ID NO: 2626827 - RNA, 17 nt, Escherichia coli CFT073
aguaccaaagccucaau

SEQ ID NO: 2626828 - RNA, 12 nt, Escherichia coli CFT073
aguaccagcacc

SEQ ID NO: 2626829 - RNA, 18 nt, Escherichia coli CFT073
aguaccaucguccagcag

SEQ ID NO: 2626830 - RNA, 23 nt, Escherichia coli CFT073
aguaccaucguccagcagcaaug

SEQ ID NO: 2626831 - RNA, 14 nt, Escherichia coli CFT073
aguaccgccgcagu

SEQ ID NO: 2626832 - RNA, 23 nt, Escherichia coli CFT073
aguaccgccgccauaaacagcag

SEQ ID NO: 2626833 - RNA, 14 nt, Escherichia coli CFT073
aguaccuugcugag

SEQ ID NO: 2626834 - RNA, 14 nt, Escherichia coli CFT073
aguacgaaauaacu

SEQ ID NO: 2626835 - RNA, 23 nt, Escherichia coli CFT073
aguacgaccggaaguaagaggag

SEQ ID NO: 2626836 - RNA, 19 nt, Escherichia coli CFT073
aguacgauacaaaagcacc

SEQ ID NO: 2626837 - RNA, 17 nt, Escherichia coli CFT073
aguacgcaguugcugac

SEQ ID NO: 2626838 - RNA, 19 nt, Escherichia coli CFT073
aguacgccaaucugcaaaa

SEQ ID NO: 2626839 - RNA, 23 nt, Escherichia coli CFT073
aguacgccgccgccaaucgcccg

SEQ ID NO: 2626840 - RNA, 20 nt, Escherichia coli CFT073
aguacgcgggaauagcucag

SEQ ID NO: 2626841 - RNA, 15 nt, Escherichia coli CFT073
aguacgcgguuuuug

SEQ ID NO: 2626842 - RNA, 15 nt, Escherichia coli CFT073
aguacgcuuucccuu

SEQ ID NO: 2626843 - RNA, 17 nt, Escherichia coli CFT073
aguacggcaaagauauu

SEQ ID NO: 2626844 - RNA, 20 nt, Escherichia coli CFT073
aguacggcuauauacagcgc

SEQ ID NO: 2626845 - RNA, 13 nt, Escherichia coli CFT073
aguacguucacuu

SEQ ID NO: 2626846 - RNA, 15 nt, Escherichia coli CFT073
aguacguucacuuuu

SEQ ID NO: 2626847 - RNA, 18 nt, Escherichia coli CFT073
aguacguucacuuuucuu

SEQ ID NO: 2626848 - RNA, 16 nt, Escherichia coli CFT073
aguacuaaauaauuug

SEQ ID NO: 2626849 - RNA, 22 nt, Escherichia coli CFT073
aguacugacuauccacuggaau

SEQ ID NO: 2626850 - RNA, 16 nt, Escherichia coli CFT073
aguacugccgggaaga

SEQ ID NO: 2626851 - RNA, 19 nt, Escherichia coli CFT073
aguacugccgggaagaagu

SEQ ID NO: 2626852 - RNA, 17 nt, Escherichia coli CFT073
aguacuggaagaaaaca

SEQ ID NO: 2626853 - RNA, 18 nt, Escherichia coli CFT073
aguacuggaagaaaacau

SEQ ID NO: 2626854 - RNA, 17 nt, Escherichia coli CFT073
aguacuggaagccauuu

SEQ ID NO: 2626855 - RNA, 13 nt, Escherichia coli CFT073
aguacuuuaacuc

SEQ ID NO: 2626856 - RNA, 23 nt, Escherichia coli CFT073
aguacuuuccauuuuggaauagu

SEQ ID NO: 2626857 - RNA, 22 nt, Escherichia coli CFT073
aguagaauaaucuguuucucau

SEQ ID NO: 2626858 - RNA, 21 nt, Escherichia coli CFT073
aguagcaaaacucaccauccu

SEQ ID NO: 2626859 - RNA, 18 nt, Escherichia coli CFT073
aguagcaaccggauuuuu

SEQ ID NO: 2626860 - RNA, 20 nt, Escherichia coli CFT073
aguagcaaccggauuuuuau

SEQ ID NO: 2626861 - RNA, 23 nt, Escherichia coli CFT073
aguagcaaccggauuuuuaugac

SEQ ID NO: 2626862 - RNA, 13 nt, Escherichia coli CFT073
aguagcaccucuc

SEQ ID NO: 2626863 - RNA, 17 nt, Escherichia coli CFT073
aguagcagcaggaauaa

SEQ ID NO: 2626864 - RNA, 18 nt, Escherichia coli CFT073
aguagcagcaggaauaau

SEQ ID NO: 2626865 - RNA, 21 nt, Escherichia coli CFT073
aguagcaugaacauugcugcu

SEQ ID NO: 2626866 - RNA, 20 nt, Escherichia coli CFT073
aguagccaauaccaaaauca

SEQ ID NO: 2626867 - RNA, 16 nt, Escherichia coli CFT073
aguagccccgcgggga

SEQ ID NO: 2626868 - RNA, 18 nt, Escherichia coli CFT073
aguagcccuucagcuugu

SEQ ID NO: 2626869 - RNA, 22 nt, Escherichia coli CFT073
aguagccucugcguuauuuuca

SEQ ID NO: 2626870 - RNA, 14 nt, Escherichia coli CFT073
aguagcgccagacu

SEQ ID NO: 2626871 - RNA, 22 nt, Escherichia coli CFT073
aguagcguaaaggcugccagag

SEQ ID NO: 2626872 - RNA, 17 nt, Escherichia coli CFT073
aguagcucaccagcagg

SEQ ID NO: 2626873 - RNA, 18 nt, Escherichia coli CFT073
aguagcucaccagcaggc

SEQ ID NO: 2626874 - RNA, 19 nt, Escherichia coli CFT073
aguagcucaccagcaggca

SEQ ID NO: 2626875 - RNA, 14 nt, Escherichia coli CFT073
aguagcuugaaauc

SEQ ID NO: 2626876 - RNA, 14 nt, Escherichia coli CFT073
aguaggucauaucg

SEQ ID NO: 2626877 - RNA, 13 nt, Escherichia coli CFT073
aguaguaaugauc

SEQ ID NO: 2626878 - RNA, 22 nt, Escherichia coli CFT073
aguaguacgcgggaauagcuca

SEQ ID NO: 2626879 - RNA, 14 nt, Escherichia coli CFT073
aguagugaaaaaag

SEQ ID NO: 2626880 - RNA, 17 nt, Escherichia coli CFT073
aguaguggaugaaucuc

SEQ ID NO: 2626881 - RNA, 16 nt, Escherichia coli CFT073
aguaguucauccccuc

SEQ ID NO: 2626882 - RNA, 15 nt, Escherichia coli CFT073
aguaguuccagcaug

SEQ ID NO: 2626883 - RNA, 16 nt, Escherichia coli CFT073
aguaguugcugucgac

SEQ ID NO: 2626884 - RNA, 19 nt, Escherichia coli CFT073
aguaguuuuugcagaugga

SEQ ID NO: 2626885 - RNA, 16 nt, Escherichia coli CFT073
aguauagaaggugacg

SEQ ID NO: 2626886 - RNA, 14 nt, Escherichia coli CFT073
aguauagcggcaug

SEQ ID NO: 2626887 - RNA, 14 nt, Escherichia coli CFT073
aguauauauucguc

SEQ ID NO: 2626888 - RNA, 16 nt, Escherichia coli CFT073
aguauauugcagaaau

SEQ ID NO: 2626889 - RNA, 14 nt, Escherichia coli CFT073
aguauauugcugau

SEQ ID NO: 2626890 - RNA, 19 nt, Escherichia coli CFT073
aguauauuucgggaugacc

SEQ ID NO: 2626891 - RNA, 17 nt, Escherichia coli CFT073
aguaucaaacagaaaaa

SEQ ID NO: 2626892 - RNA, 22 nt, Escherichia coli CFT073
aguauccacgcagacaauaaac

SEQ ID NO: 2626893 - RNA, 22 nt, Escherichia coli CFT073
aguauccgcuauugaccagcgc

SEQ ID NO: 2626894 - RNA, 21 nt, Escherichia coli CFT073
aguaucgcucaauauccugac

SEQ ID NO: 2626895 - RNA, 21 nt, Escherichia coli CFT073
aguaucguguccggcaauaaa

SEQ ID NO: 2626896 - RNA, 21 nt, Escherichia coli CFT073
aguaucuuauugaaagaucac

SEQ ID NO: 2626897 - RNA, 14 nt, Escherichia coli CFT073
aguaucuucacugc

SEQ ID NO: 2626898 - RNA, 17 nt, Escherichia coli CFT073
aguaugacgaguauauu

SEQ ID NO: 2626899 - RNA, 15 nt, Escherichia coli CFT073
aguaugcgcgucaga

SEQ ID NO: 2626900 - RNA, 20 nt, Escherichia coli CFT073
aguauggacgugcucugguu

SEQ ID NO: 2626901 - RNA, 21 nt, Escherichia coli CFT073
aguaugugacuggaaaucaaa

SEQ ID NO: 2626902 - RNA, 11 nt, Escherichia coli CFT073
aguauuaaaug

SEQ ID NO: 2626903 - RNA, 14 nt, Escherichia coli CFT073
aguauuaaccgguu

SEQ ID NO: 2626904 - RNA, 22 nt, Escherichia coli CFT073
aguauuauucuugacuaucacu

SEQ ID NO: 2626905 - RNA, 13 nt, Escherichia coli CFT073
aguauuuccagcu

SEQ ID NO: 2626906 - RNA, 16 nt, Escherichia coli CFT073
aguauuuccagcucaa

SEQ ID NO: 2626907 - RNA, 17 nt, Escherichia coli CFT073
aguauuuucagaaggau

SEQ ID NO: 2626908 - RNA, 19 nt, Escherichia coli CFT073
agucaaaagccuccgaccg

SEQ ID NO: 2626909 - RNA, 14 nt, Escherichia coli CFT073
agucaaaauucaac

SEQ ID NO: 2626910 - RNA, 16 nt, Escherichia coli CFT073
agucaaggaaugaaau

SEQ ID NO: 2626911 - RNA, 20 nt, Escherichia coli CFT073
agucaaggaaugaaauauua

SEQ ID NO: 2626912 - RNA, 13 nt, Escherichia coli CFT073
agucaauaaaaag

SEQ ID NO: 2626913 - RNA, 20 nt, Escherichia coli CFT073
agucacaggggaggaacaau

SEQ ID NO: 2626914 - RNA, 14 nt, Escherichia coli CFT073
agucaccagcauca

SEQ ID NO: 2626915 - RNA, 14 nt, Escherichia coli CFT073
agucacccugcccg

SEQ ID NO: 2626916 - RNA, 16 nt, Escherichia coli CFT073
agucaccugcggugca

SEQ ID NO: 2626917 - RNA, 19 nt, Escherichia coli CFT073
agucaccuuucagccacuu

SEQ ID NO: 2626918 - RNA, 21 nt, Escherichia coli CFT073
agucaccuuucagccacuuca

SEQ ID NO: 2626919 - RNA, 16 nt, Escherichia coli CFT073
agucacgacaaagacg

SEQ ID NO: 2626920 - RNA, 15 nt, Escherichia coli CFT073
agucacgcagcaggg

SEQ ID NO: 2626921 - RNA, 17 nt, Escherichia coli CFT073
agucacgcgguuauccc

SEQ ID NO: 2626922 - RNA, 20 nt, Escherichia coli CFT073
agucacggaaucccguaauc

SEQ ID NO: 2626923 - RNA, 16 nt, Escherichia coli CFT073
agucacgggcgguuga

SEQ ID NO: 2626924 - RNA, 20 nt, Escherichia coli CFT073
agucacgguuaaucagauaa

SEQ ID NO: 2626925 - RNA, 22 nt, Escherichia coli CFT073
agucacgguuaaucagauaauc

SEQ ID NO: 2626926 - RNA, 18 nt, Escherichia coli CFT073
agucacugugacgcggug

SEQ ID NO: 2626927 - RNA, 20 nt, Escherichia coli CFT073
agucacuuucgagcaauuuu

SEQ ID NO: 2626928 - RNA, 15 nt, Escherichia coli CFT073
agucacuuuuuuucc

SEQ ID NO: 2626929 - RNA, 16 nt, Escherichia coli CFT073
agucagauaccaguug

SEQ ID NO: 2626930 - RNA, 22 nt, Escherichia coli CFT073
agucagaugccucguuggucag

SEQ ID NO: 2626931 - RNA, 16 nt, Escherichia coli CFT073
agucagauuagaacug

SEQ ID NO: 2626932 - RNA, 22 nt, Escherichia coli CFT073
agucagauuagaacugauaaac

SEQ ID NO: 2626933 - RNA, 21 nt, Escherichia coli CFT073
agucagcaaugccagagugau

SEQ ID NO: 2626934 - RNA, 21 nt, Escherichia coli CFT073
agucagcaguguccaguaaug

SEQ ID NO: 2626935 - RNA, 16 nt, Escherichia coli CFT073
agucagcgaacaccag

SEQ ID NO: 2626936 - RNA, 19 nt, Escherichia coli CFT073
agucagcgcgaaaucgccc

SEQ ID NO: 2626937 - RNA, 21 nt, Escherichia coli CFT073
agucaggcaauucuuuccguu

SEQ ID NO: 2626938 - RNA, 17 nt, Escherichia coli CFT073
agucaggggagugaggu

SEQ ID NO: 2626939 - RNA, 15 nt, Escherichia coli CFT073
agucaguacggcaaa

SEQ ID NO: 2626940 - RNA, 17 nt, Escherichia coli CFT073
agucaucacuuucagac

SEQ ID NO: 2626941 - RNA, 14 nt, Escherichia coli CFT073
agucaucaguugca

SEQ ID NO: 2626942 - RNA, 20 nt, Escherichia coli CFT073
agucaucaguugcaccugau

SEQ ID NO: 2626943 - RNA, 13 nt, Escherichia coli CFT073
agucauccggcgu

SEQ ID NO: 2626944 - RNA, 19 nt, Escherichia coli CFT073
agucauccggcgucaucuu

SEQ ID NO: 2626945 - RNA, 18 nt, Escherichia coli CFT073
agucauuaacucaguugc

SEQ ID NO: 2626946 - RNA, 13 nt, Escherichia coli CFT073
agucauuccuuca

SEQ ID NO: 2626947 - RNA, 12 nt, Escherichia coli CFT073
agucauuguaaa

SEQ ID NO: 2626948 - RNA, 17 nt, Escherichia coli CFT073
aguccacccccauaauc

SEQ ID NO: 2626949 - RNA, 24 nt, Escherichia coli CFT073
aguccagccccgcgcggcgcaggc

SEQ ID NO: 2626950 - RNA, 14 nt, Escherichia coli CFT073
aguccagcgccuga

SEQ ID NO: 2626951 - RNA, 16 nt, Escherichia coli CFT073
aguccaggccugauua

SEQ ID NO: 2626952 - RNA, 14 nt, Escherichia coli CFT073
aguccagguuuuag

SEQ ID NO: 2626953 - RNA, 11 nt, Escherichia coli CFT073
agucccaacug

SEQ ID NO: 2626954 - RNA, 12 nt, Escherichia coli CFT073
agucccaguuca

SEQ ID NO: 2626955 - RNA, 16 nt, Escherichia coli CFT073
agucccaucuucugaa

SEQ ID NO: 2626956 - RNA, 19 nt, Escherichia coli CFT073
agucccgcgacaaucgccc

SEQ ID NO: 2626957 - RNA, 19 nt, Escherichia coli CFT073
agucccguacccagcaaga

SEQ ID NO: 2626958 - RNA, 16 nt, Escherichia coli CFT073
agucccuacugcuccu

SEQ ID NO: 2626959 - RNA, 17 nt, Escherichia coli CFT073
agucccugaaucgccac

SEQ ID NO: 2626960 - RNA, 19 nt, Escherichia coli CFT073
agucccugcucuuucagca

SEQ ID NO: 2626961 - RNA, 21 nt, Escherichia coli CFT073
agucccugcucuuucagcacc

SEQ ID NO: 2626962 - RNA, 14 nt, Escherichia coli CFT073
agucccuuucaggu

SEQ ID NO: 2626963 - RNA, 18 nt, Escherichia coli CFT073
agucccuuucaggucagu

SEQ ID NO: 2626964 - RNA, 11 nt, Escherichia coli CFT073
aguccgaugcc

SEQ ID NO: 2626965 - RNA, 16 nt, Escherichia coli CFT073
aguccgccauuauuac

SEQ ID NO: 2626966 - RNA, 17 nt, Escherichia coli CFT073
aguccgcuuccgcugaa

SEQ ID NO: 2626967 - RNA, 11 nt, Escherichia coli CFT073
aguccggauaa

SEQ ID NO: 2626968 - RNA, 17 nt, Escherichia coli CFT073
aguccgucguucaacaa

SEQ ID NO: 2626969 - RNA, 14 nt, Escherichia coli CFT073
aguccucaucaucc

SEQ ID NO: 2626970 - RNA, 15 nt, Escherichia coli CFT073
aguccucaucauccu

SEQ ID NO: 2626971 - RNA, 16 nt, Escherichia coli CFT073
aguccugaauuaaaca

SEQ ID NO: 2626972 - RNA, 16 nt, Escherichia coli CFT073
aguccuuccuggcugg

SEQ ID NO: 2626973 - RNA, 14 nt, Escherichia coli CFT073
agucgccaguaauc

SEQ ID NO: 2626974 - RNA, 20 nt, Escherichia coli CFT073
agucgcccgaccaucgccag

SEQ ID NO: 2626975 - RNA, 17 nt, Escherichia coli CFT073
agucgccggcggauuca

SEQ ID NO: 2626976 - RNA, 15 nt, Escherichia coli CFT073
agucgccugcuuuau

SEQ ID NO: 2626977 - RNA, 20 nt, Escherichia coli CFT073
agucgcgcaauugccagaca

SEQ ID NO: 2626978 - RNA, 14 nt, Escherichia coli CFT073
agucgcgcgcggug

SEQ ID NO: 2626979 - RNA, 18 nt, Escherichia coli CFT073
agucgcgcucaucagcgg

SEQ ID NO: 2626980 - RNA, 23 nt, Escherichia coli CFT073
agucgcgcuucguuuuccgccac

SEQ ID NO: 2626981 - RNA, 20 nt, Escherichia coli CFT073
agucgcgguccgggccgcaa

SEQ ID NO: 2626982 - RNA, 23 nt, Escherichia coli CFT073
agucgcgguccgggccgcaaacc

SEQ ID NO: 2626983 - RNA, 16 nt, Escherichia coli CFT073
agucgcguuaaagcgu

SEQ ID NO: 2626984 - RNA, 18 nt, Escherichia coli CFT073
agucgcugugacauccag

SEQ ID NO: 2626985 - RNA, 18 nt, Escherichia coli CFT073
agucgcuuucauucagaa

SEQ ID NO: 2626986 - RNA, 23 nt, Escherichia coli CFT073
agucggaaccgguuuagaaaaga

SEQ ID NO: 2626987 - RNA, 16 nt, Escherichia coli CFT073
agucggcuuucucauu

SEQ ID NO: 2626988 - RNA, 20 nt, Escherichia coli CFT073
agucgggucgccguaagcaa

SEQ ID NO: 2626989 - RNA, 14 nt, Escherichia coli CFT073
agucgggugcugcc

SEQ ID NO: 2626990 - RNA, 17 nt, Escherichia coli CFT073
agucggugccauggcug

SEQ ID NO: 2626991 - RNA, 18 nt, Escherichia coli CFT073
agucguauccucagaaau

SEQ ID NO: 2626992 - RNA, 20 nt, Escherichia coli CFT073
agucguauuaucgcgcugaa

SEQ ID NO: 2626993 - RNA, 14 nt, Escherichia coli CFT073
agucgucaucccag

SEQ ID NO: 2626994 - RNA, 16 nt, Escherichia coli CFT073
agucguugccggaucu

SEQ ID NO: 2626995 - RNA, 22 nt, Escherichia coli CFT073
agucguuucgcccguucuuccu

SEQ ID NO: 2626996 - RNA, 16 nt, Escherichia coli CFT073
agucucaaaccggcuc

SEQ ID NO: 2626997 - RNA, 21 nt, Escherichia coli CFT073
agucucaagagugaacacgua

SEQ ID NO: 2626998 - RNA, 18 nt, Escherichia coli CFT073
agucucauauauuuucgc

SEQ ID NO: 2626999 - RNA, 11 nt, Escherichia coli CFT073
agucucccuuu

SEQ ID NO: 2627000 - RNA, 23 nt, Escherichia coli CFT073
agucuccuuuauagugugcaauc

SEQ ID NO: 2627001 - RNA, 23 nt, Escherichia coli CFT073
agucucguuucccgcuccaaaau

SEQ ID NO: 2627002 - RNA, 19 nt, Escherichia coli CFT073
agucucuucuuugcaggga

SEQ ID NO: 2627003 - RNA, 18 nt, Escherichia coli CFT073
agucucuuuauguaauaa

SEQ ID NO: 2627004 - RNA, 20 nt, Escherichia coli CFT073
agucugaccacuaucgccuu

SEQ ID NO: 2627005 - RNA, 21 nt, Escherichia coli CFT073
agucugauaguaguuugauga

SEQ ID NO: 2627006 - RNA, 13 nt, Escherichia coli CFT073
agucugcaccuuu

SEQ ID NO: 2627007 - RNA, 13 nt, Escherichia coli CFT073
agucugcauuuuc

SEQ ID NO: 2627008 - RNA, 23 nt, Escherichia coli CFT073
agucugcauuuucucgcgaaccg

SEQ ID NO: 2627009 - RNA, 12 nt, Escherichia coli CFT073
agucugcugacg

SEQ ID NO: 2627010 - RNA, 18 nt, Escherichia coli CFT073
agucuggaagaccagcga

SEQ ID NO: 2627011 - RNA, 15 nt, Escherichia coli CFT073
agucuggcaggaaau

SEQ ID NO: 2627012 - RNA, 19 nt, Escherichia coli CFT073
agucuggccguuugcugcu

SEQ ID NO: 2627013 - RNA, 14 nt, Escherichia coli CFT073
agucuggugcugcg

SEQ ID NO: 2627014 - RNA, 20 nt, Escherichia coli CFT073
agucuguggugcgguuuuug

SEQ ID NO: 2627015 - RNA, 24 nt, Escherichia coli CFT073
agucuugcgcgauuugcccaucag

SEQ ID NO: 2627016 - RNA, 20 nt, Escherichia coli CFT073
agugaaaucgccgggauaua

SEQ ID NO: 2627017 - RNA, 22 nt, Escherichia coli CFT073
agugaaauguugccggauggca

SEQ ID NO: 2627018 - RNA, 13 nt, Escherichia coli CFT073
agugaaguaauaa

SEQ ID NO: 2627019 - RNA, 20 nt, Escherichia coli CFT073
agugaaguaauaaucaacgc

SEQ ID NO: 2627020 - RNA, 17 nt, Escherichia coli CFT073
agugaauaacguagccc

SEQ ID NO: 2627021 - RNA, 15 nt, Escherichia coli CFT073
agugaauccagcaug

SEQ ID NO: 2627022 - RNA, 20 nt, Escherichia coli CFT073
agugaauccccaggagcuua

SEQ ID NO: 2627023 - RNA, 17 nt, Escherichia coli CFT073
agugaaucucaggcaaa

SEQ ID NO: 2627024 - RNA, 16 nt, Escherichia coli CFT073
agugaauucaucguaa

SEQ ID NO: 2627025 - RNA, 12 nt, Escherichia coli CFT073
agugacagcccc

SEQ ID NO: 2627026 - RNA, 21 nt, Escherichia coli CFT073
agugacaugaaugucauacca

SEQ ID NO: 2627027 - RNA, 16 nt, Escherichia coli CFT073
agugacauucaccuca

SEQ ID NO: 2627028 - RNA, 21 nt, Escherichia coli CFT073
agugaccaccaauaaccggca

SEQ ID NO: 2627029 - RNA, 20 nt, Escherichia coli CFT073
agugacccgcagccagcacu

SEQ ID NO: 2627030 - RNA, 22 nt, Escherichia coli CFT073
agugaccgaaccuguuuucacc

SEQ ID NO: 2627031 - RNA, 18 nt, Escherichia coli CFT073
agugacgaccuuuuccau

SEQ ID NO: 2627032 - RNA, 16 nt, Escherichia coli CFT073
agugacgcagcgauac

SEQ ID NO: 2627033 - RNA, 21 nt, Escherichia coli CFT073
agugacucggguucuacaacg

SEQ ID NO: 2627034 - RNA, 19 nt, Escherichia coli CFT073
agugaggcguggcgcccca

SEQ ID NO: 2627035 - RNA, 14 nt, Escherichia coli CFT073
agugauaaccacgc

SEQ ID NO: 2627036 - RNA, 12 nt, Escherichia coli CFT073
agugaucagcca

SEQ ID NO: 2627037 - RNA, 15 nt, Escherichia coli CFT073
agugaucgccugcau

SEQ ID NO: 2627038 - RNA, 17 nt, Escherichia coli CFT073
agugaucuggcuggcaa

SEQ ID NO: 2627039 - RNA, 13 nt, Escherichia coli CFT073
agugauuguccua

SEQ ID NO: 2627040 - RNA, 17 nt, Escherichia coli CFT073
agugauuuauuuuuacu

SEQ ID NO: 2627041 - RNA, 18 nt, Escherichia coli CFT073
agugcaacagagagcaaa

SEQ ID NO: 2627042 - RNA, 14 nt, Escherichia coli CFT073
agugcaacuuuacu

SEQ ID NO: 2627043 - RNA, 17 nt, Escherichia coli CFT073
agugcaacuuuacuaaa

SEQ ID NO: 2627044 - RNA, 14 nt, Escherichia coli CFT073
agugcagacucacc

SEQ ID NO: 2627045 - RNA, 16 nt, Escherichia coli CFT073
agugcagauaccacca

SEQ ID NO: 2627046 - RNA, 20 nt, Escherichia coli CFT073
agugcagauaccaccagcgc

SEQ ID NO: 2627047 - RNA, 15 nt, Escherichia coli CFT073
agugcagaugcacaa

SEQ ID NO: 2627048 - RNA, 14 nt, Escherichia coli CFT073
agugcagccauuuu

SEQ ID NO: 2627049 - RNA, 16 nt, Escherichia coli CFT073
agugcagccauuuuac

SEQ ID NO: 2627050 - RNA, 12 nt, Escherichia coli CFT073
agugcagcgaag

SEQ ID NO: 2627051 - RNA, 20 nt, Escherichia coli CFT073
agugcagcgcaugauuuuca

SEQ ID NO: 2627052 - RNA, 22 nt, Escherichia coli CFT073
agugcaggaugcgacauaaacg

SEQ ID NO: 2627053 - RNA, 22 nt, Escherichia coli CFT073
agugcauccaguugcgccgcau

SEQ ID NO: 2627054 - RNA, 16 nt, Escherichia coli CFT073
agugccagaacagaaa

SEQ ID NO: 2627055 - RNA, 15 nt, Escherichia coli CFT073
agugccagauugaag

SEQ ID NO: 2627056 - RNA, 17 nt, Escherichia coli CFT073
agugccccaaaugucgg

SEQ ID NO: 2627057 - RNA, 20 nt, Escherichia coli CFT073
agugccccaaaugucggaug

SEQ ID NO: 2627058 - RNA, 21 nt, Escherichia coli CFT073
agugccccucacgcuuuauuu

SEQ ID NO: 2627059 - RNA, 18 nt, Escherichia coli CFT073
agugcccgaccacuucau

SEQ ID NO: 2627060 - RNA, 19 nt, Escherichia coli CFT073
agugcccgaccacuucaug

SEQ ID NO: 2627061 - RNA, 22 nt, Escherichia coli CFT073
agugccgcagcggcgguuucuu

SEQ ID NO: 2627062 - RNA, 14 nt, Escherichia coli CFT073
agugccgccagcuu

SEQ ID NO: 2627063 - RNA, 20 nt, Escherichia coli CFT073
agugccgccagcuucgcuuc

SEQ ID NO: 2627064 - RNA, 17 nt, Escherichia coli CFT073
agugccgccugcgccag

SEQ ID NO: 2627065 - RNA, 20 nt, Escherichia coli CFT073
agugccggacggugcgggga

SEQ ID NO: 2627066 - RNA, 21 nt, Escherichia coli CFT073
agugccggaugaugugaauca

SEQ ID NO: 2627067 - RNA, 17 nt, Escherichia coli CFT073
agugccggaugauucac

SEQ ID NO: 2627068 - RNA, 18 nt, Escherichia coli CFT073
agugccggaugauucaca

SEQ ID NO: 2627069 - RNA, 20 nt, Escherichia coli CFT073
agugccggaugcgaugcuga

SEQ ID NO: 2627070 - RNA, 17 nt, Escherichia coli CFT073
agugccguggcaggcaa

SEQ ID NO: 2627071 - RNA, 19 nt, Escherichia coli CFT073
agugccugcacaaccggaa

SEQ ID NO: 2627072 - RNA, 15 nt, Escherichia coli CFT073
agugccuguugcaua

SEQ ID NO: 2627073 - RNA, 15 nt, Escherichia coli CFT073
agugcgaaaaucaau

SEQ ID NO: 2627074 - RNA, 20 nt, Escherichia coli CFT073
agugcgaaacuucuuaaaau

SEQ ID NO: 2627075 - RNA, 12 nt, Escherichia coli CFT073
agugcgccaguc

SEQ ID NO: 2627076 - RNA, 22 nt, Escherichia coli CFT073
agugcgcgccaguaaucagcgc

SEQ ID NO: 2627077 - RNA, 23 nt, Escherichia coli CFT073
agugcgcucuucaacuucagcag

SEQ ID NO: 2627078 - RNA, 15 nt, Escherichia coli CFT073
agugcgcuuuauuca

SEQ ID NO: 2627079 - RNA, 13 nt, Escherichia coli CFT073
agugcgggcgaga

SEQ ID NO: 2627080 - RNA, 17 nt, Escherichia coli CFT073
agugcgguaaauuuuuu

SEQ ID NO: 2627081 - RNA, 22 nt, Escherichia coli CFT073
agugcgguaaauuuuuugauca

SEQ ID NO: 2627082 - RNA, 22 nt, Escherichia coli CFT073
agugcguaagcgcggauuuuau

SEQ ID NO: 2627083 - RNA, 13 nt, Escherichia coli CFT073
agugcguuacaca

SEQ ID NO: 2627084 - RNA, 14 nt, Escherichia coli CFT073
agugcuaaacgcuu

SEQ ID NO: 2627085 - RNA, 15 nt, Escherichia coli CFT073
agugcuacccacuuc

SEQ ID NO: 2627086 - RNA, 19 nt, Escherichia coli CFT073
agugcucguagaagccaga

SEQ ID NO: 2627087 - RNA, 23 nt, Escherichia coli CFT073
agugcucuuuguaggccugauaa

SEQ ID NO: 2627088 - RNA, 20 nt, Escherichia coli CFT073
agugcugaguuucagaccaa

SEQ ID NO: 2627089 - RNA, 12 nt, Escherichia coli CFT073
agugcugcaacc

SEQ ID NO: 2627090 - RNA, 16 nt, Escherichia coli CFT073
agugcugccaucuucu

SEQ ID NO: 2627091 - RNA, 17 nt, Escherichia coli CFT073
agugcugcuggaaaagg

SEQ ID NO: 2627092 - RNA, 22 nt, Escherichia coli CFT073
agugcuucgcggacaucgucca

SEQ ID NO: 2627093 - RNA, 17 nt, Escherichia coli CFT073
agugcuucuaacaucau

SEQ ID NO: 2627094 - RNA, 17 nt, Escherichia coli CFT073
agugcuuuaaucagcac

SEQ ID NO: 2627095 - RNA, 11 nt, Escherichia coli CFT073
agugcuuucag

SEQ ID NO: 2627096 - RNA, 23 nt, Escherichia coli CFT073
agugcuuuuugugggccugauaa

SEQ ID NO: 2627097 - RNA, 14 nt, Escherichia coli CFT073
aguggaaaucccca

SEQ ID NO: 2627098 - RNA, 16 nt, Escherichia coli CFT073
aguggauuaucuucac

SEQ ID NO: 2627099 - RNA, 17 nt, Escherichia coli CFT073
aguggauuaucuucacc

SEQ ID NO: 2627100 - RNA, 23 nt, Escherichia coli CFT073
aguggauuuuuguuucacacuga

SEQ ID NO: 2627101 - RNA, 15 nt, Escherichia coli CFT073
aguggcaaauucuug

SEQ ID NO: 2627102 - RNA, 15 nt, Escherichia coli CFT073
aguggcaaccagcag

SEQ ID NO: 2627103 - RNA, 14 nt, Escherichia coli CFT073
aguggcaauauauu

SEQ ID NO: 2627104 - RNA, 22 nt, Escherichia coli CFT073
aguggcacuaauuaagacugau

SEQ ID NO: 2627105 - RNA, 21 nt, Escherichia coli CFT073
aguggcgcagagccugaauaa

SEQ ID NO: 2627106 - RNA, 19 nt, Escherichia coli CFT073
aguggcgggacagaaagug

SEQ ID NO: 2627107 - RNA, 12 nt, Escherichia coli CFT073
aguggcugacca

SEQ ID NO: 2627108 - RNA, 16 nt, Escherichia coli CFT073
aguggcuuugccguuc

SEQ ID NO: 2627109 - RNA, 19 nt, Escherichia coli CFT073
agugggcaacaagccgcuu

SEQ ID NO: 2627110 - RNA, 19 nt, Escherichia coli CFT073
agugggcgacaaaguugaa

SEQ ID NO: 2627111 - RNA, 15 nt, Escherichia coli CFT073
aguggggcggugaug

SEQ ID NO: 2627112 - RNA, 14 nt, Escherichia coli CFT073
agugguauugaauc

SEQ ID NO: 2627113 - RNA, 22 nt, Escherichia coli CFT073
aguggucaaauuucuucagcca

SEQ ID NO: 2627114 - RNA, 22 nt, Escherichia coli CFT073
agugguuaccgaauccagcaag

SEQ ID NO: 2627115 - RNA, 15 nt, Escherichia coli CFT073
aguguaaaccaaagc

SEQ ID NO: 2627116 - RNA, 12 nt, Escherichia coli CFT073
aguguaaucagc

SEQ ID NO: 2627117 - RNA, 17 nt, Escherichia coli CFT073
aguguaaucagccccgg

SEQ ID NO: 2627118 - RNA, 15 nt, Escherichia coli CFT073
aguguaauccugcca

SEQ ID NO: 2627119 - RNA, 21 nt, Escherichia coli CFT073
aguguaauccugccagugcaa

SEQ ID NO: 2627120 - RNA, 19 nt, Escherichia coli CFT073
aguguaggaaaucagcaca

SEQ ID NO: 2627121 - RNA, 16 nt, Escherichia coli CFT073
aguguccagaugcugu

SEQ ID NO: 2627122 - RNA, 19 nt, Escherichia coli CFT073
agugugaauauucagaaua

SEQ ID NO: 2627123 - RNA, 20 nt, Escherichia coli CFT073
agugugauuacagccaggcg

SEQ ID NO: 2627124 - RNA, 17 nt, Escherichia coli CFT073
agugugcaucgccgggc

SEQ ID NO: 2627125 - RNA, 16 nt, Escherichia coli CFT073
agugugggaaaaauug

SEQ ID NO: 2627126 - RNA, 20 nt, Escherichia coli CFT073
aguguggggaaugauauuuu

SEQ ID NO: 2627127 - RNA, 12 nt, Escherichia coli CFT073
aguguucuuccg

SEQ ID NO: 2627128 - RNA, 20 nt, Escherichia coli CFT073
aguguugcguuuuuaucuuc

SEQ ID NO: 2627129 - RNA, 22 nt, Escherichia coli CFT073
aguguugcguuuuuaucuucac

SEQ ID NO: 2627130 - RNA, 17 nt, Escherichia coli CFT073
aguguuggauggcggcu

SEQ ID NO: 2627131 - RNA, 15 nt, Escherichia coli CFT073
aguguuggcgucaga

SEQ ID NO: 2627132 - RNA, 19 nt, Escherichia coli CFT073
aguguuucgacaauaauca

SEQ ID NO: 2627133 - RNA, 19 nt, Escherichia coli CFT073
aguuaaaaaaugcagcaaa

SEQ ID NO: 2627134 - RNA, 21 nt, Escherichia coli CFT073
aguuaaaaaaugcagcaaaga

SEQ ID NO: 2627135 - RNA, 23 nt, Escherichia coli CFT073
aguuaacuggucgauauugaccu

SEQ ID NO: 2627136 - RNA, 16 nt, Escherichia coli CFT073
aguuaagauucagccc

SEQ ID NO: 2627137 - RNA, 20 nt, Escherichia coli CFT073
aguuaauaaucggugaggau

SEQ ID NO: 2627138 - RNA, 13 nt, Escherichia coli CFT073
aguuaaucagcgc

SEQ ID NO: 2627139 - RNA, 15 nt, Escherichia coli CFT073
aguuaaucaguuuau

SEQ ID NO: 2627140 - RNA, 14 nt, Escherichia coli CFT073
aguuaauccacagc

SEQ ID NO: 2627141 - RNA, 21 nt, Escherichia coli CFT073
aguuaaucgccgcauaauauc

SEQ ID NO: 2627142 - RNA, 20 nt, Escherichia coli CFT073
aguuaauuagcuuaucaauc

SEQ ID NO: 2627143 - RNA, 17 nt, Escherichia coli CFT073
aguuacagcucucacuu

SEQ ID NO: 2627144 - RNA, 21 nt, Escherichia coli CFT073
aguuacaucagaguacagauu

SEQ ID NO: 2627145 - RNA, 16 nt, Escherichia coli CFT073
aguuacauuuuuaucg

SEQ ID NO: 2627146 - RNA, 14 nt, Escherichia coli CFT073
aguuacccagcgga

SEQ ID NO: 2627147 - RNA, 17 nt, Escherichia coli CFT073
aguuacccagcggauaa

SEQ ID NO: 2627148 - RNA, 22 nt, Escherichia coli CFT073
aguuaccgccggcuucaucuuu

SEQ ID NO: 2627149 - RNA, 18 nt, Escherichia coli CFT073
aguuacuaaaaguaaaua

SEQ ID NO: 2627150 - RNA, 18 nt, Escherichia coli CFT073
aguuacugccaucuuccg

SEQ ID NO: 2627151 - RNA, 17 nt, Escherichia coli CFT073
aguuacugcccgcacac

SEQ ID NO: 2627152 - RNA, 22 nt, Escherichia coli CFT073
aguuacuggggcgcuuguugau

SEQ ID NO: 2627153 - RNA, 14 nt, Escherichia coli CFT073
aguuagcguccggc

SEQ ID NO: 2627154 - RNA, 16 nt, Escherichia coli CFT073
aguuagcuuuucuccu

SEQ ID NO: 2627155 - RNA, 18 nt, Escherichia coli CFT073
aguuauagagcugaauaa

SEQ ID NO: 2627156 - RNA, 19 nt, Escherichia coli CFT073
aguuaucaaauucauugcg

SEQ ID NO: 2627157 - RNA, 17 nt, Escherichia coli CFT073
aguuauguauucguuaa

SEQ ID NO: 2627158 - RNA, 16 nt, Escherichia coli CFT073
aguuauuaaaaauggg

SEQ ID NO: 2627159 - RNA, 16 nt, Escherichia coli CFT073
aguuauuaaugacaau

SEQ ID NO: 2627160 - RNA, 11 nt, Escherichia coli CFT073
aguuauucauu

SEQ ID NO: 2627161 - RNA, 15 nt, Escherichia coli CFT073
aguucaaacggcguu

SEQ ID NO: 2627162 - RNA, 17 nt, Escherichia coli CFT073
aguucaaccucaagcac

SEQ ID NO: 2627163 - RNA, 18 nt, Escherichia coli CFT073
aguucaaccucaagcaca

SEQ ID NO: 2627164 - RNA, 17 nt, Escherichia coli CFT073
aguucaacggugucgau

SEQ ID NO: 2627165 - RNA, 13 nt, Escherichia coli CFT073
aguucaaggaugu

SEQ ID NO: 2627166 - RNA, 23 nt, Escherichia coli CFT073
aguucaauugaccugauaagaca

SEQ ID NO: 2627167 - RNA, 22 nt, Escherichia coli CFT073
aguucacacaagguauccagac

SEQ ID NO: 2627168 - RNA, 20 nt, Escherichia coli CFT073
aguucaccaccuggcggcgu

SEQ ID NO: 2627169 - RNA, 22 nt, Escherichia coli CFT073
aguucaccaccuggcggcgugu

SEQ ID NO: 2627170 - RNA, 19 nt, Escherichia coli CFT073
aguucacguccggcagcag

SEQ ID NO: 2627171 - RNA, 12 nt, Escherichia coli CFT073
aguucacugccg

SEQ ID NO: 2627172 - RNA, 17 nt, Escherichia coli CFT073
aguucaucaagcuguuc

SEQ ID NO: 2627173 - RNA, 16 nt, Escherichia coli CFT073
aguucauccccucuuc

SEQ ID NO: 2627174 - RNA, 13 nt, Escherichia coli CFT073
aguucauguauuu

SEQ ID NO: 2627175 - RNA, 23 nt, Escherichia coli CFT073
aguucauuggucuccugaccguu

SEQ ID NO: 2627176 - RNA, 20 nt, Escherichia coli CFT073
aguuccacauaaaguagcca

SEQ ID NO: 2627177 - RNA, 12 nt, Escherichia coli CFT073
aguuccaccagu

SEQ ID NO: 2627178 - RNA, 14 nt, Escherichia coli CFT073
aguuccacuucugc

SEQ ID NO: 2627179 - RNA, 18 nt, Escherichia coli CFT073
aguuccacuuugcuuuca

SEQ ID NO: 2627180 - RNA, 19 nt, Escherichia coli CFT073
aguuccacuuugcuuucag

SEQ ID NO: 2627181 - RNA, 18 nt, Escherichia coli CFT073
aguuccauccaccagccc

SEQ ID NO: 2627182 - RNA, 20 nt, Escherichia coli CFT073
aguucccagggcuuucgcaa

SEQ ID NO: 2627183 - RNA, 15 nt, Escherichia coli CFT073
aguucccuacucucg

SEQ ID NO: 2627184 - RNA, 23 nt, Escherichia coli CFT073
aguuccgcaaagcccaucaccgc

SEQ ID NO: 2627185 - RNA, 20 nt, Escherichia coli CFT073
aguuccugcauaucggcaua

SEQ ID NO: 2627186 - RNA, 17 nt, Escherichia coli CFT073
aguucgaacgccgccag

SEQ ID NO: 2627187 - RNA, 13 nt, Escherichia coli CFT073
aguucgagaaaaa

SEQ ID NO: 2627188 - RNA, 14 nt, Escherichia coli CFT073
aguucgcaaucgcg

SEQ ID NO: 2627189 - RNA, 15 nt, Escherichia coli CFT073
aguucgcaaucgcgc

SEQ ID NO: 2627190 - RNA, 15 nt, Escherichia coli CFT073
aguucgccaucaaau

SEQ ID NO: 2627191 - RNA, 21 nt, Escherichia coli CFT073
aguucgccuucauucaccagu

SEQ ID NO: 2627192 - RNA, 19 nt, Escherichia coli CFT073
aguucgccuuccagcagcu

SEQ ID NO: 2627193 - RNA, 23 nt, Escherichia coli CFT073
aguucgcuuaacaguuccagcaa

SEQ ID NO: 2627194 - RNA, 14 nt, Escherichia coli CFT073
aguucgcuuuccgu

SEQ ID NO: 2627195 - RNA, 20 nt, Escherichia coli CFT073
aguucggcguucaccagcgc

SEQ ID NO: 2627196 - RNA, 17 nt, Escherichia coli CFT073
aguucguccccaccagu

SEQ ID NO: 2627197 - RNA, 21 nt, Escherichia coli CFT073
aguucgucuuuggguucaccg

SEQ ID NO: 2627198 - RNA, 16 nt, Escherichia coli CFT073
aguucugccaggcugg

SEQ ID NO: 2627199 - RNA, 20 nt, Escherichia coli CFT073
aguucugcgguugugcaaaa

SEQ ID NO: 2627200 - RNA, 16 nt, Escherichia coli CFT073
aguucuuaaggcauau

SEQ ID NO: 2627201 - RNA, 20 nt, Escherichia coli CFT073
aguucuuaaggcauauauga

SEQ ID NO: 2627202 - RNA, 14 nt, Escherichia coli CFT073
aguucuucaaaaau

SEQ ID NO: 2627203 - RNA, 17 nt, Escherichia coli CFT073
aguucuuccgccagaca

SEQ ID NO: 2627204 - RNA, 19 nt, Escherichia coli CFT073
aguucuuccggcagccagg

SEQ ID NO: 2627205 - RNA, 20 nt, Escherichia coli CFT073
aguucuuccggcagccagga

SEQ ID NO: 2627206 - RNA, 20 nt, Escherichia coli CFT073
aguucuucgguggucauuuu

SEQ ID NO: 2627207 - RNA, 19 nt, Escherichia coli CFT073
aguucuuuuguuuuguccg

SEQ ID NO: 2627208 - RNA, 20 nt, Escherichia coli CFT073
aguugaagccgaacagucgc

SEQ ID NO: 2627209 - RNA, 21 nt, Escherichia coli CFT073
aguugagcaguccccacauca

SEQ ID NO: 2627210 - RNA, 15 nt, Escherichia coli CFT073
aguugagcuuuuucc

SEQ ID NO: 2627211 - RNA, 17 nt, Escherichia coli CFT073
aguugaguaucagagaa

SEQ ID NO: 2627212 - RNA, 16 nt, Escherichia coli CFT073
aguugauacucauugu

SEQ ID NO: 2627213 - RNA, 19 nt, Escherichia coli CFT073
aguugauauacaccugaua

SEQ ID NO: 2627214 - RNA, 13 nt, Escherichia coli CFT073
aguugaucgccag

SEQ ID NO: 2627215 - RNA, 15 nt, Escherichia coli CFT073
aguugaucgccagag

SEQ ID NO: 2627216 - RNA, 20 nt, Escherichia coli CFT073
aguugaugauguucaacuuu

SEQ ID NO: 2627217 - RNA, 23 nt, Escherichia coli CFT073
aguugauuacacaaguccagcac

SEQ ID NO: 2627218 - RNA, 21 nt, Escherichia coli CFT073
aguugauuggcgcgaaccauc

SEQ ID NO: 2627219 - RNA, 21 nt, Escherichia coli CFT073
aguugauuuuguaaucaacaa

SEQ ID NO: 2627220 - RNA, 16 nt, Escherichia coli CFT073
aguugcaccagcaaua

SEQ ID NO: 2627221 - RNA, 13 nt, Escherichia coli CFT073
aguugccagcagc

SEQ ID NO: 2627222 - RNA, 17 nt, Escherichia coli CFT073
aguugccguucuucccg

SEQ ID NO: 2627223 - RNA, 16 nt, Escherichia coli CFT073
aguugcgguuucaacu

SEQ ID NO: 2627224 - RNA, 14 nt, Escherichia coli CFT073
aguugcuccacugc

SEQ ID NO: 2627225 - RNA, 21 nt, Escherichia coli CFT073
aguugcuccacugcucaccgc

SEQ ID NO: 2627226 - RNA, 21 nt, Escherichia coli CFT073
aguugcugacgaucggcaucg

SEQ ID NO: 2627227 - RNA, 15 nt, Escherichia coli CFT073
aguuggcagaauuug

SEQ ID NO: 2627228 - RNA, 19 nt, Escherichia coli CFT073
aguuggcagagauucuuca

SEQ ID NO: 2627229 - RNA, 14 nt, Escherichia coli CFT073
aguuggcagcaagc

SEQ ID NO: 2627230 - RNA, 16 nt, Escherichia coli CFT073
aguuggcguucacugc

SEQ ID NO: 2627231 - RNA, 22 nt, Escherichia coli CFT073
aguuggcugugguacugccgac

SEQ ID NO: 2627232 - RNA, 19 nt, Escherichia coli CFT073
aguugguagagcacgaccu

SEQ ID NO: 2627233 - RNA, 15 nt, Escherichia coli CFT073
aguugguauggcugu

SEQ ID NO: 2627234 - RNA, 24 nt, Escherichia coli CFT073
aguuggucagcaagaaacugauca

SEQ ID NO: 2627235 - RNA, 16 nt, Escherichia coli CFT073
aguuguaauaagaggu

SEQ ID NO: 2627236 - RNA, 18 nt, Escherichia coli CFT073
aguuguaugucauaaaaa

SEQ ID NO: 2627237 - RNA, 18 nt, Escherichia coli CFT073
aguuguccauuaauaccc

SEQ ID NO: 2627238 - RNA, 21 nt, Escherichia coli CFT073
aguuguccauugcgucgcuga

SEQ ID NO: 2627239 - RNA, 17 nt, Escherichia coli CFT073
aguugugauugugacaa

SEQ ID NO: 2627240 - RNA, 16 nt, Escherichia coli CFT073
aguugugcaaugucuu

SEQ ID NO: 2627241 - RNA, 16 nt, Escherichia coli CFT073
aguugugugccaguaa

SEQ ID NO: 2627242 - RNA, 16 nt, Escherichia coli CFT073
aguuguucaacaguaa

SEQ ID NO: 2627243 - RNA, 15 nt, Escherichia coli CFT073
aguuguuuuuuuaac

SEQ ID NO: 2627244 - RNA, 18 nt, Escherichia coli CFT073
aguuguuuuuuuaacaua

SEQ ID NO: 2627245 - RNA, 17 nt, Escherichia coli CFT073
aguuuacgaaccuucac

SEQ ID NO: 2627246 - RNA, 15 nt, Escherichia coli CFT073
aguuuagcucagaau

SEQ ID NO: 2627247 - RNA, 16 nt, Escherichia coli CFT073
aguuuagcucagaauu

SEQ ID NO: 2627248 - RNA, 17 nt, Escherichia coli CFT073
aguuuauagcaagguga

SEQ ID NO: 2627249 - RNA, 16 nt, Escherichia coli CFT073
aguuuauaucuuucuc

SEQ ID NO: 2627250 - RNA, 22 nt, Escherichia coli CFT073
aguuuauaucuuucucagucau

SEQ ID NO: 2627251 - RNA, 12 nt, Escherichia coli CFT073
aguuuaugcagu

SEQ ID NO: 2627252 - RNA, 21 nt, Escherichia coli CFT073
aguuuauucuuuacugccaac

SEQ ID NO: 2627253 - RNA, 15 nt, Escherichia coli CFT073
aguuucaacaucauu

SEQ ID NO: 2627254 - RNA, 17 nt, Escherichia coli CFT073
aguuucaccagcaguaa

SEQ ID NO: 2627255 - RNA, 18 nt, Escherichia coli CFT073
aguuucaccagcaguaaa

SEQ ID NO: 2627256 - RNA, 23 nt, Escherichia coli CFT073
aguuucagaccaauaauccccaa

SEQ ID NO: 2627257 - RNA, 16 nt, Escherichia coli CFT073
aguuucagccccauca

SEQ ID NO: 2627258 - RNA, 13 nt, Escherichia coli CFT073
aguuucagcggcg

SEQ ID NO: 2627259 - RNA, 16 nt, Escherichia coli CFT073
aguuuccuguuucuca

SEQ ID NO: 2627260 - RNA, 13 nt, Escherichia coli CFT073
aguuucgacauca

SEQ ID NO: 2627261 - RNA, 17 nt, Escherichia coli CFT073
aguuucgaucagcaauu

SEQ ID NO: 2627262 - RNA, 13 nt, Escherichia coli CFT073
aguuucgggauca

SEQ ID NO: 2627263 - RNA, 21 nt, Escherichia coli CFT073
aguuucguuaaacgccaaacu

SEQ ID NO: 2627264 - RNA, 15 nt, Escherichia coli CFT073
aguuucuccagugaa

SEQ ID NO: 2627265 - RNA, 22 nt, Escherichia coli CFT073
aguuucucgcggguaucgguga

SEQ ID NO: 2627266 - RNA, 20 nt, Escherichia coli CFT073
aguuucugcccaaucaaacu

SEQ ID NO: 2627267 - RNA, 14 nt, Escherichia coli CFT073
aguuugaaagaugc

SEQ ID NO: 2627268 - RNA, 15 nt, Escherichia coli CFT073
aguuugaucaguucu

SEQ ID NO: 2627269 - RNA, 19 nt, Escherichia coli CFT073
aguuugaugagaacaccaa

SEQ ID NO: 2627270 - RNA, 19 nt, Escherichia coli CFT073
aguuugcccgucugcugcu

SEQ ID NO: 2627271 - RNA, 20 nt, Escherichia coli CFT073
aguuugcccgucugcugcug

SEQ ID NO: 2627272 - RNA, 19 nt, Escherichia coli CFT073
aguuugccguuaaucucuc

SEQ ID NO: 2627273 - RNA, 18 nt, Escherichia coli CFT073
aguuugcgggacaacuug

SEQ ID NO: 2627274 - RNA, 20 nt, Escherichia coli CFT073
aguuugcucaaauccaucag

SEQ ID NO: 2627275 - RNA, 22 nt, Escherichia coli CFT073
aguuuggucuggcaaaaauaag

SEQ ID NO: 2627276 - RNA, 17 nt, Escherichia coli CFT073
aguuuggugacgccaca

SEQ ID NO: 2627277 - RNA, 17 nt, Escherichia coli CFT073
aguuuguuaaccaccag

SEQ ID NO: 2627278 - RNA, 15 nt, Escherichia coli CFT073
aguuuuaaauuacug

SEQ ID NO: 2627279 - RNA, 17 nt, Escherichia coli CFT073
aguuuuaucuccauccg

SEQ ID NO: 2627280 - RNA, 12 nt, Escherichia coli CFT073
aguuuucauaua

SEQ ID NO: 2627281 - RNA, 21 nt, Escherichia coli CFT073
aguuuucauauaccgcaucag

SEQ ID NO: 2627282 - RNA, 15 nt, Escherichia coli CFT073
aguuuucaugaauaa

SEQ ID NO: 2627283 - RNA, 23 nt, Escherichia coli CFT073
aguuuucaugaauaaccccgucu

SEQ ID NO: 2627284 - RNA, 15 nt, Escherichia coli CFT073
aguuuucgcccccag

SEQ ID NO: 2627285 - RNA, 12 nt, Escherichia coli CFT073
aguuuucuuugc

SEQ ID NO: 2627286 - RNA, 14 nt, Escherichia coli CFT073
aguuuucuuugcca

SEQ ID NO: 2627287 - RNA, 16 nt, Escherichia coli CFT073
aguuuuggggagaugu

SEQ ID NO: 2627288 - RNA, 22 nt, Escherichia coli CFT073
aguuuuucaaagcugguggcaa

SEQ ID NO: 2627289 - RNA, 15 nt, Escherichia coli CFT073
aguuuuuccccugcc

SEQ ID NO: 2627290 - RNA, 13 nt, Escherichia coli CFT073
aguuuuuccgccg

SEQ ID NO: 2627291 - RNA, 15 nt, Escherichia coli CFT073
aguuuuuccgccgcc

SEQ ID NO: 2627292 - RNA, 16 nt, Escherichia coli CFT073
aguuuuucuacuaacu

SEQ ID NO: 2627293 - RNA, 21 nt, Escherichia coli CFT073
aguuuuugcagauggaugagc

SEQ ID NO: 2627294 - RNA, 15 nt, Escherichia coli CFT073
aguuuuugcccauca

SEQ ID NO: 2627295 - RNA, 17 nt, Escherichia coli CFT073
aguuuuugcccaucaug

SEQ ID NO: 2627296 - RNA, 13 nt, Escherichia coli CFT073
aguuuuugcuucu

SEQ ID NO: 2627297 - RNA, 20 nt, Escherichia coli CFT073
aguuuuuguccccgcaucag

SEQ ID NO: 2627298 - RNA, 22 nt, Escherichia coli CFT073
aguuuuuucgcuugaucuuccu

SEQ ID NO: 2627299 - RNA, 17 nt, Escherichia coli CFT073
aguuuuuugcgaaaaau

SEQ ID NO: 2627300 - RNA, 13 nt, Escherichia coli CFT073
auaaaaaaacgcc

SEQ ID NO: 2627301 - RNA, 15 nt, Escherichia coli CFT073
auaaaaacucaaaaa

SEQ ID NO: 2627302 - RNA, 16 nt, Escherichia coli CFT073
auaaaaagaagaucau

SEQ ID NO: 2627303 - RNA, 18 nt, Escherichia coli CFT073
auaaaaagaagaucauca

SEQ ID NO: 2627304 - RNA, 21 nt, Escherichia coli CFT073
auaaaaagaagaucaucacca

SEQ ID NO: 2627305 - RNA, 16 nt, Escherichia coli CFT073
auaaaaauugcggccu

SEQ ID NO: 2627306 - RNA, 23 nt, Escherichia coli CFT073
auaaaacacugagguaacucuca

SEQ ID NO: 2627307 - RNA, 15 nt, Escherichia coli CFT073
auaaaacaucaccaa

SEQ ID NO: 2627308 - RNA, 20 nt, Escherichia coli CFT073
auaaaacgagcgauccaacu

SEQ ID NO: 2627309 - RNA, 22 nt, Escherichia coli CFT073
auaaaacgggauagcguaguga

SEQ ID NO: 2627310 - RNA, 17 nt, Escherichia coli CFT073
auaaaacucgauggcgu

SEQ ID NO: 2627311 - RNA, 16 nt, Escherichia coli CFT073
auaaaacuucugcaac

SEQ ID NO: 2627312 - RNA, 20 nt, Escherichia coli CFT073
auaaaagcuuuccggaaaaa

SEQ ID NO: 2627313 - RNA, 19 nt, Escherichia coli CFT073
auaaaaggcaccuggaaau

SEQ ID NO: 2627314 - RNA, 20 nt, Escherichia coli CFT073
auaaaaguguaggaaaucag

SEQ ID NO: 2627315 - RNA, 11 nt, Escherichia coli CFT073
auaaaaucaca

SEQ ID NO: 2627316 - RNA, 23 nt, Escherichia coli CFT073
auaaaaucagcuuccuugcugau

SEQ ID NO: 2627317 - RNA, 21 nt, Escherichia coli CFT073
auaaaaugcgaaaaaaacucg

SEQ ID NO: 2627318 - RNA, 14 nt, Escherichia coli CFT073
auaaaauuauccaa

SEQ ID NO: 2627319 - RNA, 18 nt, Escherichia coli CFT073
auaaacaaccccaucgcg

SEQ ID NO: 2627320 - RNA, 23 nt, Escherichia coli CFT073
auaaacaacggcaagaucagcau

SEQ ID NO: 2627321 - RNA, 17 nt, Escherichia coli CFT073
auaaacaaugauuacuc

SEQ ID NO: 2627322 - RNA, 14 nt, Escherichia coli CFT073
auaaacaccagcaa

SEQ ID NO: 2627323 - RNA, 14 nt, Escherichia coli CFT073
auaaacaccagcag

SEQ ID NO: 2627324 - RNA, 15 nt, Escherichia coli CFT073
auaaacaccagcagc

SEQ ID NO: 2627325 - RNA, 15 nt, Escherichia coli CFT073
auaaacacggcgaac

SEQ ID NO: 2627326 - RNA, 19 nt, Escherichia coli CFT073
auaaacagcagauggcagc

SEQ ID NO: 2627327 - RNA, 12 nt, Escherichia coli CFT073
auaaacagcagg

SEQ ID NO: 2627328 - RNA, 19 nt, Escherichia coli CFT073
auaaacagcguaaauaugc

SEQ ID NO: 2627329 - RNA, 22 nt, Escherichia coli CFT073
auaaacaguuccgcaaagccca

SEQ ID NO: 2627330 - RNA, 16 nt, Escherichia coli CFT073
auaaacauccuuuuca

SEQ ID NO: 2627331 - RNA, 19 nt, Escherichia coli CFT073
auaaacauccuuuucaccu

SEQ ID NO: 2627332 - RNA, 19 nt, Escherichia coli CFT073
auaaacaucgggacaugau

SEQ ID NO: 2627333 - RNA, 20 nt, Escherichia coli CFT073
auaaacaucgggacaugaua

SEQ ID NO: 2627334 - RNA, 20 nt, Escherichia coli CFT073
auaaacauugguccgauugu

SEQ ID NO: 2627335 - RNA, 15 nt, Escherichia coli CFT073
auaaaccaaagcccc

SEQ ID NO: 2627336 - RNA, 23 nt, Escherichia coli CFT073
auaaaccacaccgccuaccgcca

SEQ ID NO: 2627337 - RNA, 23 nt, Escherichia coli CFT073
auaaacccggauacgcucauuuu

SEQ ID NO: 2627338 - RNA, 16 nt, Escherichia coli CFT073
auaaaccgagccaaac

SEQ ID NO: 2627339 - RNA, 19 nt, Escherichia coli CFT073
auaaaccgcaucauguaaa

SEQ ID NO: 2627340 - RNA, 19 nt, Escherichia coli CFT073
auaaaccguccccaaaaaa

SEQ ID NO: 2627341 - RNA, 23 nt, Escherichia coli CFT073
auaaaccguccccaaaaaagcca

SEQ ID NO: 2627342 - RNA, 14 nt, Escherichia coli CFT073
auaaaccguggcaa

SEQ ID NO: 2627343 - RNA, 15 nt, Escherichia coli CFT073
auaaaccuccagcau

SEQ ID NO: 2627344 - RNA, 21 nt, Escherichia coli CFT073
auaaacgccaauaaucugccc

SEQ ID NO: 2627345 - RNA, 14 nt, Escherichia coli CFT073
auaaacgccagguu

SEQ ID NO: 2627346 - RNA, 22 nt, Escherichia coli CFT073
auaaacgccagguucaucaauu

SEQ ID NO: 2627347 - RNA, 22 nt, Escherichia coli CFT073
auaaacgccauauucugaucgu

SEQ ID NO: 2627348 - RNA, 15 nt, Escherichia coli CFT073
auaaacgccugacga

SEQ ID NO: 2627349 - RNA, 16 nt, Escherichia coli CFT073
auaaacgcucggcaac

SEQ ID NO: 2627350 - RNA, 19 nt, Escherichia coli CFT073
auaaacggcacgaucaaga

SEQ ID NO: 2627351 - RNA, 20 nt, Escherichia coli CFT073
auaaacgguuucagcagugg

SEQ ID NO: 2627352 - RNA, 19 nt, Escherichia coli CFT073
auaaacuacagaugaaaua

SEQ ID NO: 2627353 - RNA, 16 nt, Escherichia coli CFT073
auaaacucaugggucu

SEQ ID NO: 2627354 - RNA, 20 nt, Escherichia coli CFT073
auaaacugcgaccagggaua

SEQ ID NO: 2627355 - RNA, 23 nt, Escherichia coli CFT073
auaaagaagugcucuuugccguc

SEQ ID NO: 2627356 - RNA, 19 nt, Escherichia coli CFT073
auaaagaaugaaauucgag

SEQ ID NO: 2627357 - RNA, 21 nt, Escherichia coli CFT073
auaaagacgguggcacauaau

SEQ ID NO: 2627358 - RNA, 17 nt, Escherichia coli CFT073
auaaagaugaaaacgcc

SEQ ID NO: 2627359 - RNA, 23 nt, Escherichia coli CFT073
auaaagaugaaaacgccaccaga

SEQ ID NO: 2627360 - RNA, 21 nt, Escherichia coli CFT073
auaaagcacccuguuugucua

SEQ ID NO: 2627361 - RNA, 12 nt, Escherichia coli CFT073
auaaagcagaau

SEQ ID NO: 2627362 - RNA, 21 nt, Escherichia coli CFT073
auaaagcccaucguugaaaaa

SEQ ID NO: 2627363 - RNA, 23 nt, Escherichia coli CFT073
auaaagcccgcuucaaacgcuga

SEQ ID NO: 2627364 - RNA, 15 nt, Escherichia coli CFT073
auaaagcgaccaacc

SEQ ID NO: 2627365 - RNA, 22 nt, Escherichia coli CFT073
auaaagcgaccaaccaucaucc

SEQ ID NO: 2627366 - RNA, 13 nt, Escherichia coli CFT073
auaaagcgauaaa

SEQ ID NO: 2627367 - RNA, 14 nt, Escherichia coli CFT073
auaaagcgauaaau

SEQ ID NO: 2627368 - RNA, 22 nt, Escherichia coli CFT073
auaaagcguuuaucaauuaacu

SEQ ID NO: 2627369 - RNA, 19 nt, Escherichia coli CFT073
auaaagcuauuaauccaua

SEQ ID NO: 2627370 - RNA, 13 nt, Escherichia coli CFT073
auaaagcucagau

SEQ ID NO: 2627371 - RNA, 16 nt, Escherichia coli CFT073
auaaagcuuuuuauua

SEQ ID NO: 2627372 - RNA, 14 nt, Escherichia coli CFT073
auaaaggaguaaca

SEQ ID NO: 2627373 - RNA, 20 nt, Escherichia coli CFT073
auaaaggaguaacagauugu

SEQ ID NO: 2627374 - RNA, 13 nt, Escherichia coli CFT073
auaaagguaccga

SEQ ID NO: 2627375 - RNA, 23 nt, Escherichia coli CFT073
auaaaggucaucacaucccagca

SEQ ID NO: 2627376 - RNA, 12 nt, Escherichia coli CFT073
auaaaguaaaac

SEQ ID NO: 2627377 - RNA, 20 nt, Escherichia coli CFT073
auaaaguuggguagcugcau

SEQ ID NO: 2627378 - RNA, 18 nt, Escherichia coli CFT073
auaaaguuuuuauauuuu

SEQ ID NO: 2627379 - RNA, 19 nt, Escherichia coli CFT073
auaaauaauaaguaaacaa

SEQ ID NO: 2627380 - RNA, 14 nt, Escherichia coli CFT073
auaaauauccuccg

SEQ ID NO: 2627381 - RNA, 19 nt, Escherichia coli CFT073
auaaaucaaagucagauca

SEQ ID NO: 2627382 - RNA, 15 nt, Escherichia coli CFT073
auaaaucaauacguu

SEQ ID NO: 2627383 - RNA, 14 nt, Escherichia coli CFT073
auaaaugaagaaaa

SEQ ID NO: 2627384 - RNA, 19 nt, Escherichia coli CFT073
auaaaugacucacguuacu

SEQ ID NO: 2627385 - RNA, 13 nt, Escherichia coli CFT073
auaaauggcgaac

SEQ ID NO: 2627386 - RNA, 20 nt, Escherichia coli CFT073
auaaauggguuuuuuguugc

SEQ ID NO: 2627387 - RNA, 21 nt, Escherichia coli CFT073
auaaauuaccaccagcgacag

SEQ ID NO: 2627388 - RNA, 13 nt, Escherichia coli CFT073
auaaauuccgcuc

SEQ ID NO: 2627389 - RNA, 21 nt, Escherichia coli CFT073
auaaauugccugcgugcauau

SEQ ID NO: 2627390 - RNA, 15 nt, Escherichia coli CFT073
auaaauuggcugggg

SEQ ID NO: 2627391 - RNA, 18 nt, Escherichia coli CFT073
auaaauuuuuucugacca

SEQ ID NO: 2627392 - RNA, 14 nt, Escherichia coli CFT073
auaacaaauaauug

SEQ ID NO: 2627393 - RNA, 14 nt, Escherichia coli CFT073
auaacaaucaccaa

SEQ ID NO: 2627394 - RNA, 18 nt, Escherichia coli CFT073
auaacaaucaccaaacca

SEQ ID NO: 2627395 - RNA, 14 nt, Escherichia coli CFT073
auaacaaucaucaa

SEQ ID NO: 2627396 - RNA, 18 nt, Escherichia coli CFT073
auaacacaccguaauugc

SEQ ID NO: 2627397 - RNA, 19 nt, Escherichia coli CFT073
auaacacccauaaaaaaac

SEQ ID NO: 2627398 - RNA, 14 nt, Escherichia coli CFT073
auaacacugagcgu

SEQ ID NO: 2627399 - RNA, 22 nt, Escherichia coli CFT073
auaacacuuggcgucaaacgac

SEQ ID NO: 2627400 - RNA, 19 nt, Escherichia coli CFT073
auaacagcgggacaacaaa

SEQ ID NO: 2627401 - RNA, 17 nt, Escherichia coli CFT073
auaacaggcuaccgcag

SEQ ID NO: 2627402 - RNA, 14 nt, Escherichia coli CFT073
auaaccaaaugacu

SEQ ID NO: 2627403 - RNA, 21 nt, Escherichia coli CFT073
auaaccaauguggguguuaag

SEQ ID NO: 2627404 - RNA, 14 nt, Escherichia coli CFT073
auaaccaccacgac

SEQ ID NO: 2627405 - RNA, 21 nt, Escherichia coli CFT073
auaaccacuggcacaagacug

SEQ ID NO: 2627406 - RNA, 21 nt, Escherichia coli CFT073
auaaccagcguuuccagcacc

SEQ ID NO: 2627407 - RNA, 18 nt, Escherichia coli CFT073
auaaccauaauuugugau

SEQ ID NO: 2627408 - RNA, 13 nt, Escherichia coli CFT073
auaaccaucagcu

SEQ ID NO: 2627409 - RNA, 20 nt, Escherichia coli CFT073
auaaccauccgagcagcaau

SEQ ID NO: 2627410 - RNA, 21 nt, Escherichia coli CFT073
auaaccaucgcuacauaacgc

SEQ ID NO: 2627411 - RNA, 20 nt, Escherichia coli CFT073
auaaccauggcuggcaccug

SEQ ID NO: 2627412 - RNA, 18 nt, Escherichia coli CFT073
auaaccauuccacgggca

SEQ ID NO: 2627413 - RNA, 13 nt, Escherichia coli CFT073
auaacccacacca

SEQ ID NO: 2627414 - RNA, 10 nt, Escherichia coli CFT073
auaacccagc

SEQ ID NO: 2627415 - RNA, 17 nt, Escherichia coli CFT073
auaacccagcagcccga

SEQ ID NO: 2627416 - RNA, 15 nt, Escherichia coli CFT073
auaacccaguacaac

SEQ ID NO: 2627417 - RNA, 19 nt, Escherichia coli CFT073
auaacccggacaaauaacc

SEQ ID NO: 2627418 - RNA, 23 nt, Escherichia coli CFT073
auaacccgucagcagauccauug

SEQ ID NO: 2627419 - RNA, 20 nt, Escherichia coli CFT073
auaacccguuguaaaugcug

SEQ ID NO: 2627420 - RNA, 21 nt, Escherichia coli CFT073
auaacccguuguaaaugcugc

SEQ ID NO: 2627421 - RNA, 17 nt, Escherichia coli CFT073
auaacccuaaagcaccc

SEQ ID NO: 2627422 - RNA, 13 nt, Escherichia coli CFT073
auaacccugaccc

SEQ ID NO: 2627423 - RNA, 22 nt, Escherichia coli CFT073
auaaccgaagaagcuuuucggg

SEQ ID NO: 2627424 - RNA, 14 nt, Escherichia coli CFT073
auaaccgagaauuu

SEQ ID NO: 2627425 - RNA, 23 nt, Escherichia coli CFT073
auaaccgagcagauacugaugaa

SEQ ID NO: 2627426 - RNA, 15 nt, Escherichia coli CFT073
auaaccgccagcaca

SEQ ID NO: 2627427 - RNA, 16 nt, Escherichia coli CFT073
auaaccgccagcacag

SEQ ID NO: 2627428 - RNA, 22 nt, Escherichia coli CFT073
auaaccgccgccaaacugugca

SEQ ID NO: 2627429 - RNA, 14 nt, Escherichia coli CFT073
auaaccgcugccag

SEQ ID NO: 2627430 - RNA, 17 nt, Escherichia coli CFT073
auaaccgcugccaggca

SEQ ID NO: 2627431 - RNA, 18 nt, Escherichia coli CFT073
auaaccgcugccaggcac

SEQ ID NO: 2627432 - RNA, 12 nt, Escherichia coli CFT073
auaaccucaugg

SEQ ID NO: 2627433 - RNA, 18 nt, Escherichia coli CFT073
auaaccucaugguuuuua

SEQ ID NO: 2627434 - RNA, 21 nt, Escherichia coli CFT073
auaaccucaugguuuuuaugg

SEQ ID NO: 2627435 - RNA, 15 nt, Escherichia coli CFT073
auaaccugccagcag

SEQ ID NO: 2627436 - RNA, 18 nt, Escherichia coli CFT073
auaaccuguuuauuaugc

SEQ ID NO: 2627437 - RNA, 15 nt, Escherichia coli CFT073
auaacgagcgagaau

SEQ ID NO: 2627438 - RNA, 22 nt, Escherichia coli CFT073
auaacgccaauucauuccuuga

SEQ ID NO: 2627439 - RNA, 23 nt, Escherichia coli CFT073
auaacgcccucuaaaauaacgaa

SEQ ID NO: 2627440 - RNA, 16 nt, Escherichia coli CFT073
auaacgcguucacccg

SEQ ID NO: 2627441 - RNA, 14 nt, Escherichia coli CFT073
auaacggcucaaac

SEQ ID NO: 2627442 - RNA, 16 nt, Escherichia coli CFT073
auaacggcuguccauu

SEQ ID NO: 2627443 - RNA, 19 nt, Escherichia coli CFT073
auaacgguaguggcaacca

SEQ ID NO: 2627444 - RNA, 17 nt, Escherichia coli CFT073
auaacgguauugcuuuc

SEQ ID NO: 2627445 - RNA, 13 nt, Escherichia coli CFT073
auaacguaaacca

SEQ ID NO: 2627446 - RNA, 15 nt, Escherichia coli CFT073
auaacguccaguuga

SEQ ID NO: 2627447 - RNA, 20 nt, Escherichia coli CFT073
auaacgucggcauauuuaaa

SEQ ID NO: 2627448 - RNA, 21 nt, Escherichia coli CFT073
auaacgucggcauauuuaaaa

SEQ ID NO: 2627449 - RNA, 19 nt, Escherichia coli CFT073
auaacguugaugcaggcag

SEQ ID NO: 2627450 - RNA, 19 nt, Escherichia coli CFT073
auaacuaaucacuucauca

SEQ ID NO: 2627451 - RNA, 19 nt, Escherichia coli CFT073
auaacuaauuccgcugacg

SEQ ID NO: 2627452 - RNA, 21 nt, Escherichia coli CFT073
auaacuauaugacucauaaaa

SEQ ID NO: 2627453 - RNA, 23 nt, Escherichia coli CFT073
auaacuauaugacucauaaaaau

SEQ ID NO: 2627454 - RNA, 21 nt, Escherichia coli CFT073
auaacucaaguuguaauuccu

SEQ ID NO: 2627455 - RNA, 14 nt, Escherichia coli CFT073
auaacucaccauca

SEQ ID NO: 2627456 - RNA, 17 nt, Escherichia coli CFT073
auaacucccuauaaugc

SEQ ID NO: 2627457 - RNA, 18 nt, Escherichia coli CFT073
auaacucuucccuuuggu

SEQ ID NO: 2627458 - RNA, 21 nt, Escherichia coli CFT073
auaacucuugaaucggcguag

SEQ ID NO: 2627459 - RNA, 16 nt, Escherichia coli CFT073
auaacugaauaauaca

SEQ ID NO: 2627460 - RNA, 16 nt, Escherichia coli CFT073
auaacuggcaaaaaca

SEQ ID NO: 2627461 - RNA, 17 nt, Escherichia coli CFT073
auaacuuccuguaacca

SEQ ID NO: 2627462 - RNA, 15 nt, Escherichia coli CFT073
auaacuucuaccuga

SEQ ID NO: 2627463 - RNA, 23 nt, Escherichia coli CFT073
auaacuucuaccugaugcuuuuu

SEQ ID NO: 2627464 - RNA, 20 nt, Escherichia coli CFT073
auaacuucuauucaccagca

SEQ ID NO: 2627465 - RNA, 14 nt, Escherichia coli CFT073
auaacuuuuaguaa

SEQ ID NO: 2627466 - RNA, 15 nt, Escherichia coli CFT073
auaagaaacacacuu

SEQ ID NO: 2627467 - RNA, 18 nt, Escherichia coli CFT073
auaagaaacacacuuucc

SEQ ID NO: 2627468 - RNA, 21 nt, Escherichia coli CFT073
auaagaaaguucgacaacuuu

SEQ ID NO: 2627469 - RNA, 19 nt, Escherichia coli CFT073
auaagacagcgucacauca

SEQ ID NO: 2627470 - RNA, 12 nt, Escherichia coli CFT073
auaagaccaauc

SEQ ID NO: 2627471 - RNA, 18 nt, Escherichia coli CFT073
auaagaccgugagcaaug

SEQ ID NO: 2627472 - RNA, 19 nt, Escherichia coli CFT073
auaagaccgugagcaaugc

SEQ ID NO: 2627473 - RNA, 13 nt, Escherichia coli CFT073
auaagacgcaacc

SEQ ID NO: 2627474 - RNA, 23 nt, Escherichia coli CFT073
auaagacgcggcaagcgucgcau

SEQ ID NO: 2627475 - RNA, 23 nt, Escherichia coli CFT073
auaagacgcggcaggcgucgcau

SEQ ID NO: 2627476 - RNA, 23 nt, Escherichia coli CFT073
auaagacgcggcccgcgucgcau

SEQ ID NO: 2627477 - RNA, 21 nt, Escherichia coli CFT073
auaagacgcgucagcgccgca

SEQ ID NO: 2627478 - RNA, 22 nt, Escherichia coli CFT073
auaagacgcgucugcgucgcau

SEQ ID NO: 2627479 - RNA, 21 nt, Escherichia coli CFT073
auaagacgcguggcgucgcau

SEQ ID NO: 2627480 - RNA, 22 nt, Escherichia coli CFT073
auaagacgcguuagcgucgcau

SEQ ID NO: 2627481 - RNA, 22 nt, Escherichia coli CFT073
auaagagaugaauuuauaauca

SEQ ID NO: 2627482 - RNA, 17 nt, Escherichia coli CFT073
auaagauacgccagcau

SEQ ID NO: 2627483 - RNA, 23 nt, Escherichia coli CFT073
auaagaugcguuaagcgucgcau

SEQ ID NO: 2627484 - RNA, 17 nt, Escherichia coli CFT073
auaagcaacaaacucau

SEQ ID NO: 2627485 - RNA, 17 nt, Escherichia coli CFT073
auaagcgaggccagcca

SEQ ID NO: 2627486 - RNA, 13 nt, Escherichia coli CFT073
auaagcgcaugaa

SEQ ID NO: 2627487 - RNA, 17 nt, Escherichia coli CFT073
auaagcguagcgcagca

SEQ ID NO: 2627488 - RNA, 20 nt, Escherichia coli CFT073
auaagcguagcgcaucaggc

SEQ ID NO: 2627489 - RNA, 15 nt, Escherichia coli CFT073
auaagcugagcacaa

SEQ ID NO: 2627490 - RNA, 16 nt, Escherichia coli CFT073
auaagcuuagucuuau

SEQ ID NO: 2627491 - RNA, 15 nt, Escherichia coli CFT073
auaaggagcaauaau

SEQ ID NO: 2627492 - RNA, 14 nt, Escherichia coli CFT073
auaaggcauuuacg

SEQ ID NO: 2627493 - RNA, 15 nt, Escherichia coli CFT073
auaaggccaccagcg

SEQ ID NO: 2627494 - RNA, 23 nt, Escherichia coli CFT073
auaaggcgcgucaagcgucgcau

SEQ ID NO: 2627495 - RNA, 16 nt, Escherichia coli CFT073
auaaggcgguuacgcc

SEQ ID NO: 2627496 - RNA, 20 nt, Escherichia coli CFT073
auaaggcguuuaugccgcau

SEQ ID NO: 2627497 - RNA, 13 nt, Escherichia coli CFT073
auaaggguacgaa

SEQ ID NO: 2627498 - RNA, 15 nt, Escherichia coli CFT073
auaaggguugcugac

SEQ ID NO: 2627499 - RNA, 20 nt, Escherichia coli CFT073
auaagguaucgcgaaaaaaa

SEQ ID NO: 2627500 - RNA, 22 nt, Escherichia coli CFT073
auaaggucacgcccccugggga

SEQ ID NO: 2627501 - RNA, 20 nt, Escherichia coli CFT073
auaaguaaacaaacaugaau

SEQ ID NO: 2627502 - RNA, 16 nt, Escherichia coli CFT073
auaaguaaggcagagc

SEQ ID NO: 2627503 - RNA, 20 nt, Escherichia coli CFT073
auaaguacguuuucuucucu

SEQ ID NO: 2627504 - RNA, 16 nt, Escherichia coli CFT073
auaaguacuaaauaau

SEQ ID NO: 2627505 - RNA, 19 nt, Escherichia coli CFT073
auaaguaucugcuaauauu

SEQ ID NO: 2627506 - RNA, 18 nt, Escherichia coli CFT073
auaagucccgaccacaca

SEQ ID NO: 2627507 - RNA, 21 nt, Escherichia coli CFT073
auaagucccgaccacacaaag

SEQ ID NO: 2627508 - RNA, 12 nt, Escherichia coli CFT073
auaagucucaga

SEQ ID NO: 2627509 - RNA, 13 nt, Escherichia coli CFT073
auaagugaagacc

SEQ ID NO: 2627510 - RNA, 15 nt, Escherichia coli CFT073
auaaguggagcccuc

SEQ ID NO: 2627511 - RNA, 12 nt, Escherichia coli CFT073
auaaguuuuuug

SEQ ID NO: 2627512 - RNA, 22 nt, Escherichia coli CFT073
auaaguuuuuugcgaaaaauaa

SEQ ID NO: 2627513 - RNA, 23 nt, Escherichia coli CFT073
auaaguuuuuugcgaaaaauaaa

SEQ ID NO: 2627514 - RNA, 15 nt, Escherichia coli CFT073
auaauaaaaaagaaa

SEQ ID NO: 2627515 - RNA, 21 nt, Escherichia coli CFT073
auaauaaaaaguuguuaauaa

SEQ ID NO: 2627516 - RNA, 14 nt, Escherichia coli CFT073
auaauaaagcuaca

SEQ ID NO: 2627517 - RNA, 19 nt, Escherichia coli CFT073
auaauaaccucaugguuuu

SEQ ID NO: 2627518 - RNA, 21 nt, Escherichia coli CFT073
auaauacaugcgaacuuuacu

SEQ ID NO: 2627519 - RNA, 19 nt, Escherichia coli CFT073
auaauacccagcaacgaaa

SEQ ID NO: 2627520 - RNA, 19 nt, Escherichia coli CFT073
auaauacgcgcguuuucaa

SEQ ID NO: 2627521 - RNA, 19 nt, Escherichia coli CFT073
auaauacgucggcaucagg

SEQ ID NO: 2627522 - RNA, 16 nt, Escherichia coli CFT073
auaauacugacaaaac

SEQ ID NO: 2627523 - RNA, 19 nt, Escherichia coli CFT073
auaauagagcuugugcacc

SEQ ID NO: 2627524 - RNA, 16 nt, Escherichia coli CFT073
auaauagauuugcgaa

SEQ ID NO: 2627525 - RNA, 19 nt, Escherichia coli CFT073
auaauagguaaacauccgu

SEQ ID NO: 2627526 - RNA, 20 nt, Escherichia coli CFT073
auaauagugcuucaaauauu

SEQ ID NO: 2627527 - RNA, 14 nt, Escherichia coli CFT073
auaauauaaauuaa

SEQ ID NO: 2627528 - RNA, 15 nt, Escherichia coli CFT073
auaauauaaggagcc

SEQ ID NO: 2627529 - RNA, 22 nt, Escherichia coli CFT073
auaauaucccaacgcaaaacca

SEQ ID NO: 2627530 - RNA, 21 nt, Escherichia coli CFT073
auaauauuuaucuucccagcc

SEQ ID NO: 2627531 - RNA, 22 nt, Escherichia coli CFT073
auaauauuuguacugucuaaug

SEQ ID NO: 2627532 - RNA, 18 nt, Escherichia coli CFT073
auaaucaaauacaccaca

SEQ ID NO: 2627533 - RNA, 16 nt, Escherichia coli CFT073
auaaucaacaggaaca

SEQ ID NO: 2627534 - RNA, 17 nt, Escherichia coli CFT073
auaaucaacaggaacau

SEQ ID NO: 2627535 - RNA, 22 nt, Escherichia coli CFT073
auaaucaagguugcacaaccaa

SEQ ID NO: 2627536 - RNA, 20 nt, Escherichia coli CFT073
auaaucaaucuuuacacaca

SEQ ID NO: 2627537 - RNA, 15 nt, Escherichia coli CFT073
auaaucaaugccagg

SEQ ID NO: 2627538 - RNA, 15 nt, Escherichia coli CFT073
auaaucacaaugguc

SEQ ID NO: 2627539 - RNA, 20 nt, Escherichia coli CFT073
auaaucacaauggucaacau

SEQ ID NO: 2627540 - RNA, 16 nt, Escherichia coli CFT073
auaaucacgcuguuca

SEQ ID NO: 2627541 - RNA, 19 nt, Escherichia coli CFT073
auaaucaucagacuggcgu

SEQ ID NO: 2627542 - RNA, 19 nt, Escherichia coli CFT073
auaaucauuucgccugaaa

SEQ ID NO: 2627543 - RNA, 17 nt, Escherichia coli CFT073
auaauccacggcguggu

SEQ ID NO: 2627544 - RNA, 21 nt, Escherichia coli CFT073
auaauccagauauguaucuac

SEQ ID NO: 2627545 - RNA, 12 nt, Escherichia coli CFT073
auaauccagcag

SEQ ID NO: 2627546 - RNA, 22 nt, Escherichia coli CFT073
auaauccaucccgcucuguaag

SEQ ID NO: 2627547 - RNA, 13 nt, Escherichia coli CFT073
auaauccaugcca

SEQ ID NO: 2627548 - RNA, 14 nt, Escherichia coli CFT073
auaauccaugccaa

SEQ ID NO: 2627549 - RNA, 16 nt, Escherichia coli CFT073
auaauccaugccaacg

SEQ ID NO: 2627550 - RNA, 16 nt, Escherichia coli CFT073
auaauccccaauacga

SEQ ID NO: 2627551 - RNA, 15 nt, Escherichia coli CFT073
auaauccccacauca

SEQ ID NO: 2627552 - RNA, 21 nt, Escherichia coli CFT073
auaauccccacaucaggccca

SEQ ID NO: 2627553 - RNA, 15 nt, Escherichia coli CFT073
auaaucccggcacca

SEQ ID NO: 2627554 - RNA, 16 nt, Escherichia coli CFT073
auaaucccggcaccaa

SEQ ID NO: 2627555 - RNA, 23 nt, Escherichia coli CFT073
auaauccgccuuuuuaauuugcc

SEQ ID NO: 2627556 - RNA, 21 nt, Escherichia coli CFT073
auaauccuggcagcaucagac

SEQ ID NO: 2627557 - RNA, 14 nt, Escherichia coli CFT073
auaaucgaaaacau

SEQ ID NO: 2627558 - RNA, 18 nt, Escherichia coli CFT073
auaaucgaaaacaucaug

SEQ ID NO: 2627559 - RNA, 14 nt, Escherichia coli CFT073
auaaucgaaaccuu

SEQ ID NO: 2627560 - RNA, 15 nt, Escherichia coli CFT073
auaaucgaaccaaac

SEQ ID NO: 2627561 - RNA, 18 nt, Escherichia coli CFT073
auaaucgacgaggaaaau

SEQ ID NO: 2627562 - RNA, 21 nt, Escherichia coli CFT073
auaaucgaucacguaauaaaa

SEQ ID NO: 2627563 - RNA, 17 nt, Escherichia coli CFT073
auaaucgauugcacauu

SEQ ID NO: 2627564 - RNA, 20 nt, Escherichia coli CFT073
auaaucguucccgcggcgca

SEQ ID NO: 2627565 - RNA, 13 nt, Escherichia coli CFT073
auaaucuacuaau

SEQ ID NO: 2627566 - RNA, 15 nt, Escherichia coli CFT073
auaaucucaucggcg

SEQ ID NO: 2627567 - RNA, 21 nt, Escherichia coli CFT073
auaaucucgccuuaucagaaa

SEQ ID NO: 2627568 - RNA, 18 nt, Escherichia coli CFT073
auaaucucuuuacccagc

SEQ ID NO: 2627569 - RNA, 23 nt, Escherichia coli CFT073
auaaucuguugauuuaacagcaa

SEQ ID NO: 2627570 - RNA, 16 nt, Escherichia coli CFT073
auaaucuguuucucau

SEQ ID NO: 2627571 - RNA, 18 nt, Escherichia coli CFT073
auaaucuguuucucaugc

SEQ ID NO: 2627572 - RNA, 15 nt, Escherichia coli CFT073
auaaucuucaaauaa

SEQ ID NO: 2627573 - RNA, 13 nt, Escherichia coli CFT073
auaaugaaccaau

SEQ ID NO: 2627574 - RNA, 19 nt, Escherichia coli CFT073
auaaugaacgccaccccac

SEQ ID NO: 2627575 - RNA, 19 nt, Escherichia coli CFT073
auaaugacgcugaauaauc

SEQ ID NO: 2627576 - RNA, 17 nt, Escherichia coli CFT073
auaaugacggacaguac

SEQ ID NO: 2627577 - RNA, 15 nt, Escherichia coli CFT073
auaaugaucccuuca

SEQ ID NO: 2627578 - RNA, 13 nt, Escherichia coli CFT073
auaaugaugccga

SEQ ID NO: 2627579 - RNA, 23 nt, Escherichia coli CFT073
auaaugauggugaaagcaaaaaa

SEQ ID NO: 2627580 - RNA, 16 nt, Escherichia coli CFT073
auaaugccaccagugc

SEQ ID NO: 2627581 - RNA, 14 nt, Escherichia coli CFT073
auaaugcgccacca

SEQ ID NO: 2627582 - RNA, 20 nt, Escherichia coli CFT073
auaauggcuaucgaaaucaa

SEQ ID NO: 2627583 - RNA, 11 nt, Escherichia coli CFT073
auaauggcugu

SEQ ID NO: 2627584 - RNA, 17 nt, Escherichia coli CFT073
auaaugggaauuggcgu

SEQ ID NO: 2627585 - RNA, 19 nt, Escherichia coli CFT073
auaaugguauuaagccagu

SEQ ID NO: 2627586 - RNA, 17 nt, Escherichia coli CFT073
auaauguaaacaagaca

SEQ ID NO: 2627587 - RNA, 24 nt, Escherichia coli CFT073
auaauguaaacaagacaucacuca

SEQ ID NO: 2627588 - RNA, 12 nt, Escherichia coli CFT073
auaaugucagac

SEQ ID NO: 2627589 - RNA, 19 nt, Escherichia coli CFT073
auaaugucggcauaaagcu

SEQ ID NO: 2627590 - RNA, 16 nt, Escherichia coli CFT073
auaauuacuuacaucu

SEQ ID NO: 2627591 - RNA, 16 nt, Escherichia coli CFT073
auaauuccucccguua

SEQ ID NO: 2627592 - RNA, 17 nt, Escherichia coli CFT073
auaauuccucccguuau

SEQ ID NO: 2627593 - RNA, 13 nt, Escherichia coli CFT073
auaauugccguuu

SEQ ID NO: 2627594 - RNA, 17 nt, Escherichia coli CFT073
auaauugucaacggcac

SEQ ID NO: 2627595 - RNA, 14 nt, Escherichia coli CFT073
auaauugugcaauu

SEQ ID NO: 2627596 - RNA, 17 nt, Escherichia coli CFT073
auaauuuccaucgacuc

SEQ ID NO: 2627597 - RNA, 24 nt, Escherichia coli CFT073
auaauuucggcagcgcgcucgcca

SEQ ID NO: 2627598 - RNA, 15 nt, Escherichia coli CFT073
auaauuugaacuggu

SEQ ID NO: 2627599 - RNA, 16 nt, Escherichia coli CFT073
auaauuuugaaauaaa

SEQ ID NO: 2627600 - RNA, 20 nt, Escherichia coli CFT073
auaauuuugaaauaaaauca

SEQ ID NO: 2627601 - RNA, 19 nt, Escherichia coli CFT073
auaauuuugcagucccauc

SEQ ID NO: 2627602 - RNA, 15 nt, Escherichia coli CFT073
auacaaacauaaagc

SEQ ID NO: 2627603 - RNA, 14 nt, Escherichia coli CFT073
auacaaccaaucgc

SEQ ID NO: 2627604 - RNA, 19 nt, Escherichia coli CFT073
auacaagccacaucgccau

SEQ ID NO: 2627605 - RNA, 13 nt, Escherichia coli CFT073
auacaaucuggau

SEQ ID NO: 2627606 - RNA, 16 nt, Escherichia coli CFT073
auacacagauaaacua

SEQ ID NO: 2627607 - RNA, 17 nt, Escherichia coli CFT073
auacacauuuuuuacuc

SEQ ID NO: 2627608 - RNA, 21 nt, Escherichia coli CFT073
auacaccgcgaagcagcucca

SEQ ID NO: 2627609 - RNA, 17 nt, Escherichia coli CFT073
auacaccggcaucaacg

SEQ ID NO: 2627610 - RNA, 22 nt, Escherichia coli CFT073
auacaccguuagagaauguaaa

SEQ ID NO: 2627611 - RNA, 11 nt, Escherichia coli CFT073
auacaccuuca

SEQ ID NO: 2627612 - RNA, 19 nt, Escherichia coli CFT073
auacacggcaggaucugcg

SEQ ID NO: 2627613 - RNA, 14 nt, Escherichia coli CFT073
auacagagcacgca

SEQ ID NO: 2627614 - RNA, 22 nt, Escherichia coli CFT073
auacagaugcugcucuucacgc

SEQ ID NO: 2627615 - RNA, 19 nt, Escherichia coli CFT073
auacagcaauggaaaaagu

SEQ ID NO: 2627616 - RNA, 11 nt, Escherichia coli CFT073
auacagcagcc

SEQ ID NO: 2627617 - RNA, 12 nt, Escherichia coli CFT073
auacagccgaag

SEQ ID NO: 2627618 - RNA, 17 nt, Escherichia coli CFT073
auacagcgaauagugga

SEQ ID NO: 2627619 - RNA, 18 nt, Escherichia coli CFT073
auacagcgccucuuuuga

SEQ ID NO: 2627620 - RNA, 20 nt, Escherichia coli CFT073
auacagcgucgguuccugau

SEQ ID NO: 2627621 - RNA, 22 nt, Escherichia coli CFT073
auacaggcgcuguaagccucuu

SEQ ID NO: 2627622 - RNA, 17 nt, Escherichia coli CFT073
auacaggcuacucccag

SEQ ID NO: 2627623 - RNA, 20 nt, Escherichia coli CFT073
auacagguucguaagcgaua

SEQ ID NO: 2627624 - RNA, 17 nt, Escherichia coli CFT073
auacagugauuccagau

SEQ ID NO: 2627625 - RNA, 14 nt, Escherichia coli CFT073
auacauaacagaau

SEQ ID NO: 2627626 - RNA, 13 nt, Escherichia coli CFT073
auacauaauaauc

SEQ ID NO: 2627627 - RNA, 18 nt, Escherichia coli CFT073
auacauagcgccucuuua

SEQ ID NO: 2627628 - RNA, 22 nt, Escherichia coli CFT073
auacauagcgccucuuuauaaa

SEQ ID NO: 2627629 - RNA, 21 nt, Escherichia coli CFT073
auacaucgcgcuuaucgccag

SEQ ID NO: 2627630 - RNA, 22 nt, Escherichia coli CFT073
auacaucgcgcuuaucgccagc

SEQ ID NO: 2627631 - RNA, 19 nt, Escherichia coli CFT073
auacaucugcaaauccugu

SEQ ID NO: 2627632 - RNA, 17 nt, Escherichia coli CFT073
auacauguauaaaaaga

SEQ ID NO: 2627633 - RNA, 18 nt, Escherichia coli CFT073
auacauguauaaaaagaa

SEQ ID NO: 2627634 - RNA, 13 nt, Escherichia coli CFT073
auacauugccgca

SEQ ID NO: 2627635 - RNA, 19 nt, Escherichia coli CFT073
auacauugcggaccagcgg

SEQ ID NO: 2627636 - RNA, 21 nt, Escherichia coli CFT073
auacauuuauuucaacgacau

SEQ ID NO: 2627637 - RNA, 12 nt, Escherichia coli CFT073
auaccaaaauca

SEQ ID NO: 2627638 - RNA, 18 nt, Escherichia coli CFT073
auaccaaaaucaucaauu

SEQ ID NO: 2627639 - RNA, 19 nt, Escherichia coli CFT073
auaccaaaaucuaccagcg

SEQ ID NO: 2627640 - RNA, 22 nt, Escherichia coli CFT073
auaccaagccaagccagagcag

SEQ ID NO: 2627641 - RNA, 20 nt, Escherichia coli CFT073
auaccaagcccgaugaucau

SEQ ID NO: 2627642 - RNA, 20 nt, Escherichia coli CFT073
auaccaaugaauuuucgccc

SEQ ID NO: 2627643 - RNA, 19 nt, Escherichia coli CFT073
auaccacaaacgccgugca

SEQ ID NO: 2627644 - RNA, 12 nt, Escherichia coli CFT073
auaccacacccg

SEQ ID NO: 2627645 - RNA, 15 nt, Escherichia coli CFT073
auaccaccacagcac

SEQ ID NO: 2627646 - RNA, 16 nt, Escherichia coli CFT073
auaccaccagcgccau

SEQ ID NO: 2627647 - RNA, 13 nt, Escherichia coli CFT073
auaccacccgcag

SEQ ID NO: 2627648 - RNA, 14 nt, Escherichia coli CFT073
auaccacccgcagu

SEQ ID NO: 2627649 - RNA, 21 nt, Escherichia coli CFT073
auaccacccgcagugauugcc

SEQ ID NO: 2627650 - RNA, 15 nt, Escherichia coli CFT073
auaccacgucugaag

SEQ ID NO: 2627651 - RNA, 20 nt, Escherichia coli CFT073
auaccacguucucugauacu

SEQ ID NO: 2627652 - RNA, 17 nt, Escherichia coli CFT073
auaccacuuccagcaga

SEQ ID NO: 2627653 - RNA, 15 nt, Escherichia coli CFT073
auaccagaacugaag

SEQ ID NO: 2627654 - RNA, 12 nt, Escherichia coli CFT073
auaccagcagca

SEQ ID NO: 2627655 - RNA, 19 nt, Escherichia coli CFT073
auaccagcaggaaucccau

SEQ ID NO: 2627656 - RNA, 14 nt, Escherichia coli CFT073
auaccagcaucagg

SEQ ID NO: 2627657 - RNA, 11 nt, Escherichia coli CFT073
auaccagccuu

SEQ ID NO: 2627658 - RNA, 17 nt, Escherichia coli CFT073
auaccagccuucuucau

SEQ ID NO: 2627659 - RNA, 23 nt, Escherichia coli CFT073
auaccagguaccgagauaacguu

SEQ ID NO: 2627660 - RNA, 13 nt, Escherichia coli CFT073
auaccauaagaga

SEQ ID NO: 2627661 - RNA, 21 nt, Escherichia coli CFT073
auaccauauuguuucaacaca

SEQ ID NO: 2627662 - RNA, 22 nt, Escherichia coli CFT073
auaccauccggcauaaacgcua

SEQ ID NO: 2627663 - RNA, 18 nt, Escherichia coli CFT073
auaccauccggccauuuu

SEQ ID NO: 2627664 - RNA, 23 nt, Escherichia coli CFT073
auaccaucggcagcgccaaucgc

SEQ ID NO: 2627665 - RNA, 14 nt, Escherichia coli CFT073
auacccaaaaaaua

SEQ ID NO: 2627666 - RNA, 19 nt, Escherichia coli CFT073
auacccaaaaaauagcaaa

SEQ ID NO: 2627667 - RNA, 21 nt, Escherichia coli CFT073
auacccagaaucucuuuuguu

SEQ ID NO: 2627668 - RNA, 16 nt, Escherichia coli CFT073
auacccagacaucggu

SEQ ID NO: 2627669 - RNA, 17 nt, Escherichia coli CFT073
auacccaguuucaugau

SEQ ID NO: 2627670 - RNA, 15 nt, Escherichia coli CFT073
auaccccagcggcaa

SEQ ID NO: 2627671 - RNA, 22 nt, Escherichia coli CFT073
auaccccagcggcaaccagcag

SEQ ID NO: 2627672 - RNA, 15 nt, Escherichia coli CFT073
auaccccaucagcgu

SEQ ID NO: 2627673 - RNA, 14 nt, Escherichia coli CFT073
auaccccgcaucgu

SEQ ID NO: 2627674 - RNA, 16 nt, Escherichia coli CFT073
auaccccgccagcaga

SEQ ID NO: 2627675 - RNA, 22 nt, Escherichia coli CFT073
auacccgaagcgccaauaccaa

SEQ ID NO: 2627676 - RNA, 16 nt, Escherichia coli CFT073
auacccgacagauaaa

SEQ ID NO: 2627677 - RNA, 19 nt, Escherichia coli CFT073
auacccgacagauaaauca

SEQ ID NO: 2627678 - RNA, 23 nt, Escherichia coli CFT073
auacccgcacaaauagccagcag

SEQ ID NO: 2627679 - RNA, 15 nt, Escherichia coli CFT073
auacccgguccuuca

SEQ ID NO: 2627680 - RNA, 16 nt, Escherichia coli CFT073
auacccgguccuucau

SEQ ID NO: 2627681 - RNA, 15 nt, Escherichia coli CFT073
auacccucaacggaa

SEQ ID NO: 2627682 - RNA, 12 nt, Escherichia coli CFT073
auacccugccag

SEQ ID NO: 2627683 - RNA, 16 nt, Escherichia coli CFT073
auaccgaaaucgccau

SEQ ID NO: 2627684 - RNA, 14 nt, Escherichia coli CFT073
auaccgacgaucgg

SEQ ID NO: 2627685 - RNA, 22 nt, Escherichia coli CFT073
auaccgagcagccacugcggca

SEQ ID NO: 2627686 - RNA, 17 nt, Escherichia coli CFT073
auaccgcacgcucaaag

SEQ ID NO: 2627687 - RNA, 14 nt, Escherichia coli CFT073
auaccgcaucagca

SEQ ID NO: 2627688 - RNA, 15 nt, Escherichia coli CFT073
auaccgccaacaugc

SEQ ID NO: 2627689 - RNA, 20 nt, Escherichia coli CFT073
auaccgcccacuaccagcug

SEQ ID NO: 2627690 - RNA, 21 nt, Escherichia coli CFT073
auaccgccgaggaacauaaag

SEQ ID NO: 2627691 - RNA, 18 nt, Escherichia coli CFT073
auaccgccgcacaauaca

SEQ ID NO: 2627692 - RNA, 18 nt, Escherichia coli CFT073
auaccgccugcaaauaaa

SEQ ID NO: 2627693 - RNA, 13 nt, Escherichia coli CFT073
auaccgcgguucc

SEQ ID NO: 2627694 - RNA, 19 nt, Escherichia coli CFT073
auaccggacgacggcaucg

SEQ ID NO: 2627695 - RNA, 17 nt, Escherichia coli CFT073
auaccggcguuucuggc

SEQ ID NO: 2627696 - RNA, 15 nt, Escherichia coli CFT073
auaccgguacggaag

SEQ ID NO: 2627697 - RNA, 20 nt, Escherichia coli CFT073
auaccgucagcgaucagcau

SEQ ID NO: 2627698 - RNA, 16 nt, Escherichia coli CFT073
auaccguccaccagag

SEQ ID NO: 2627699 - RNA, 23 nt, Escherichia coli CFT073
auaccgucugcaccgagagaaau

SEQ ID NO: 2627700 - RNA, 17 nt, Escherichia coli CFT073
auaccguugaccauauc

SEQ ID NO: 2627701 - RNA, 21 nt, Escherichia coli CFT073
auaccguugaccauaucauca

SEQ ID NO: 2627702 - RNA, 14 nt, Escherichia coli CFT073
auaccuaaaagcac

SEQ ID NO: 2627703 - RNA, 12 nt, Escherichia coli CFT073
auaccugaaacu

SEQ ID NO: 2627704 - RNA, 13 nt, Escherichia coli CFT073
auaccugacgcaa

SEQ ID NO: 2627705 - RNA, 19 nt, Escherichia coli CFT073
auaccuggucugaaccaau

SEQ ID NO: 2627706 - RNA, 20 nt, Escherichia coli CFT073
auaccuguuaauucucccug

SEQ ID NO: 2627707 - RNA, 22 nt, Escherichia coli CFT073
auaccuguuaauucucccugcg

SEQ ID NO: 2627708 - RNA, 23 nt, Escherichia coli CFT073
auaccuucacaaaaugccagcaa

SEQ ID NO: 2627709 - RNA, 20 nt, Escherichia coli CFT073
auaccuuccggcguuucgcc

SEQ ID NO: 2627710 - RNA, 15 nt, Escherichia coli CFT073
auacgaucaguuacu

SEQ ID NO: 2627711 - RNA, 19 nt, Escherichia coli CFT073
auacgauccgacaucccgc

SEQ ID NO: 2627712 - RNA, 21 nt, Escherichia coli CFT073
auacgauccugagcagcaacc

SEQ ID NO: 2627713 - RNA, 15 nt, Escherichia coli CFT073
auacgaugccugcaa

SEQ ID NO: 2627714 - RNA, 19 nt, Escherichia coli CFT073
auacgcaaugugcagcagu

SEQ ID NO: 2627715 - RNA, 17 nt, Escherichia coli CFT073
auacgcaccacaccguc

SEQ ID NO: 2627716 - RNA, 17 nt, Escherichia coli CFT073
auacgcauaaugcgccc

SEQ ID NO: 2627717 - RNA, 20 nt, Escherichia coli CFT073
auacgcaucgcgcaccagcg

SEQ ID NO: 2627718 - RNA, 17 nt, Escherichia coli CFT073
auacgcggaucuccggc

SEQ ID NO: 2627719 - RNA, 21 nt, Escherichia coli CFT073
auacgcgucccggaauccuuc

SEQ ID NO: 2627720 - RNA, 15 nt, Escherichia coli CFT073
auacgcucgaacagc

SEQ ID NO: 2627721 - RNA, 18 nt, Escherichia coli CFT073
auacgcuguggcgcuggc

SEQ ID NO: 2627722 - RNA, 13 nt, Escherichia coli CFT073
auacgcuucaacc

SEQ ID NO: 2627723 - RNA, 16 nt, Escherichia coli CFT073
auacggcaacagccga

SEQ ID NO: 2627724 - RNA, 15 nt, Escherichia coli CFT073
auacggcauuuuccc

SEQ ID NO: 2627725 - RNA, 24 nt, Escherichia coli CFT073
auacggcgguucuuucaugguacu

SEQ ID NO: 2627726 - RNA, 20 nt, Escherichia coli CFT073
auacgggaggucaucagcgc

SEQ ID NO: 2627727 - RNA, 22 nt, Escherichia coli CFT073
auacgggccuagugcgguaaau

SEQ ID NO: 2627728 - RNA, 17 nt, Escherichia coli CFT073
auacgggucgcaaacaa

SEQ ID NO: 2627729 - RNA, 23 nt, Escherichia coli CFT073
auacgggucgcaaacaacgccac

SEQ ID NO: 2627730 - RNA, 20 nt, Escherichia coli CFT073
auacgguuuuuugaacagac

SEQ ID NO: 2627731 - RNA, 23 nt, Escherichia coli CFT073
auacguucgcccauccgcucguc

SEQ ID NO: 2627732 - RNA, 22 nt, Escherichia coli CFT073
auacguugcauaaaugccgcaa

SEQ ID NO: 2627733 - RNA, 19 nt, Escherichia coli CFT073
auacguuucuuccacacca

SEQ ID NO: 2627734 - RNA, 23 nt, Escherichia coli CFT073
auacuacgcagacggcuuucuuc

SEQ ID NO: 2627735 - RNA, 16 nt, Escherichia coli CFT073
auacucaacucacaca

SEQ ID NO: 2627736 - RNA, 15 nt, Escherichia coli CFT073
auacucaucuuccau

SEQ ID NO: 2627737 - RNA, 20 nt, Escherichia coli CFT073
auacucauuguuaucagcaa

SEQ ID NO: 2627738 - RNA, 20 nt, Escherichia coli CFT073
auacuccagccgacgaccgg

SEQ ID NO: 2627739 - RNA, 18 nt, Escherichia coli CFT073
auacucgccgaaccaaac

SEQ ID NO: 2627740 - RNA, 19 nt, Escherichia coli CFT073
auacucguugacgaccagu

SEQ ID NO: 2627741 - RNA, 15 nt, Escherichia coli CFT073
auacucuaaauaauu

SEQ ID NO: 2627742 - RNA, 13 nt, Escherichia coli CFT073
auacucuccucca

SEQ ID NO: 2627743 - RNA, 14 nt, Escherichia coli CFT073
auacucuccuccag

SEQ ID NO: 2627744 - RNA, 17 nt, Escherichia coli CFT073
auacucuucgcggcugu

SEQ ID NO: 2627745 - RNA, 15 nt, Escherichia coli CFT073
auacucuuucccggc

SEQ ID NO: 2627746 - RNA, 17 nt, Escherichia coli CFT073
auacucuuugguauuca

SEQ ID NO: 2627747 - RNA, 17 nt, Escherichia coli CFT073
auacugagcaaggcaua

SEQ ID NO: 2627748 - RNA, 14 nt, Escherichia coli CFT073
auacugaucaucau

SEQ ID NO: 2627749 - RNA, 18 nt, Escherichia coli CFT073
auacugaucgucaucaaa

SEQ ID NO: 2627750 - RNA, 23 nt, Escherichia coli CFT073
auacugauuguacuguuacucau

SEQ ID NO: 2627751 - RNA, 14 nt, Escherichia coli CFT073
auacugcaaauauu

SEQ ID NO: 2627752 - RNA, 17 nt, Escherichia coli CFT073
auacugcaaauauuguc

SEQ ID NO: 2627753 - RNA, 16 nt, Escherichia coli CFT073
auacugcaauuucauu

SEQ ID NO: 2627754 - RNA, 20 nt, Escherichia coli CFT073
auacugccgaccagagccaa

SEQ ID NO: 2627755 - RNA, 22 nt, Escherichia coli CFT073
auacugccgaccagagccaauc

SEQ ID NO: 2627756 - RNA, 14 nt, Escherichia coli CFT073
auacugccgcccau

SEQ ID NO: 2627757 - RNA, 17 nt, Escherichia coli CFT073
auacugccuauugcucu

SEQ ID NO: 2627758 - RNA, 18 nt, Escherichia coli CFT073
auacuggcguuacccagc

SEQ ID NO: 2627759 - RNA, 20 nt, Escherichia coli CFT073
auacuguaaauaguauuauu

SEQ ID NO: 2627760 - RNA, 23 nt, Escherichia coli CFT073
auacuguuuaccggugccagcaa

SEQ ID NO: 2627761 - RNA, 16 nt, Escherichia coli CFT073
auacuuaaauaaugcu

SEQ ID NO: 2627762 - RNA, 21 nt, Escherichia coli CFT073
auacuuaaccccagaccaauc

SEQ ID NO: 2627763 - RNA, 21 nt, Escherichia coli CFT073
auacuuaaugccaguucagua

SEQ ID NO: 2627764 - RNA, 16 nt, Escherichia coli CFT073
auacuuauugaaagca

SEQ ID NO: 2627765 - RNA, 21 nt, Escherichia coli CFT073
auacuucacaugauaauaaaa

SEQ ID NO: 2627766 - RNA, 23 nt, Escherichia coli CFT073
auacuucagcgauggcgucauca

SEQ ID NO: 2627767 - RNA, 15 nt, Escherichia coli CFT073
auacuuuccagcaua

SEQ ID NO: 2627768 - RNA, 12 nt, Escherichia coli CFT073
auacuuucucau

SEQ ID NO: 2627769 - RNA, 17 nt, Escherichia coli CFT073
auagaaagugacagccc

SEQ ID NO: 2627770 - RNA, 15 nt, Escherichia coli CFT073
auagaaagugacugc

SEQ ID NO: 2627771 - RNA, 18 nt, Escherichia coli CFT073
auagaacauaauguaaac

SEQ ID NO: 2627772 - RNA, 12 nt, Escherichia coli CFT073
auagaacauguc

SEQ ID NO: 2627773 - RNA, 13 nt, Escherichia coli CFT073
auagaacauguca

SEQ ID NO: 2627774 - RNA, 14 nt, Escherichia coli CFT073
auagaaccacgcaa

SEQ ID NO: 2627775 - RNA, 19 nt, Escherichia coli CFT073
auagaagcucauaugcagc

SEQ ID NO: 2627776 - RNA, 14 nt, Escherichia coli CFT073
auagaauacgccac

SEQ ID NO: 2627777 - RNA, 11 nt, Escherichia coli CFT073
auagaauagcc

SEQ ID NO: 2627778 - RNA, 14 nt, Escherichia coli CFT073
auagaaucaccgcc

SEQ ID NO: 2627779 - RNA, 16 nt, Escherichia coli CFT073
auagaaugcagcagca

SEQ ID NO: 2627780 - RNA, 17 nt, Escherichia coli CFT073
auagaaugcagcagcaa

SEQ ID NO: 2627781 - RNA, 13 nt, Escherichia coli CFT073
auagaauggcauu

SEQ ID NO: 2627782 - RNA, 19 nt, Escherichia coli CFT073
auagaauggcauugggugc

SEQ ID NO: 2627783 - RNA, 20 nt, Escherichia coli CFT073
auagacacugccgccgucau

SEQ ID NO: 2627784 - RNA, 12 nt, Escherichia coli CFT073
auagaccauugc

SEQ ID NO: 2627785 - RNA, 20 nt, Escherichia coli CFT073
auagacggugacacuuugug

SEQ ID NO: 2627786 - RNA, 16 nt, Escherichia coli CFT073
auagacuguugaaaua

SEQ ID NO: 2627787 - RNA, 21 nt, Escherichia coli CFT073
auagacuuuacuaauagcaaa

SEQ ID NO: 2627788 - RNA, 22 nt, Escherichia coli CFT073
auagacuuuacuaauagcaaaa

SEQ ID NO: 2627789 - RNA, 21 nt, Escherichia coli CFT073
auagagccuggcugcgugagg

SEQ ID NO: 2627790 - RNA, 13 nt, Escherichia coli CFT073
auagaguauccug

SEQ ID NO: 2627791 - RNA, 18 nt, Escherichia coli CFT073
auagaguguuccucugcc

SEQ ID NO: 2627792 - RNA, 16 nt, Escherichia coli CFT073
auagauaauuuugaaa

SEQ ID NO: 2627793 - RNA, 17 nt, Escherichia coli CFT073
auagauaucaugcucug

SEQ ID NO: 2627794 - RNA, 12 nt, Escherichia coli CFT073
auagaucagcgg

SEQ ID NO: 2627795 - RNA, 12 nt, Escherichia coli CFT073
auagauuaaaau

SEQ ID NO: 2627796 - RNA, 14 nt, Escherichia coli CFT073
auagauuaugaaau

SEQ ID NO: 2627797 - RNA, 15 nt, Escherichia coli CFT073
auagauuuucagaau

SEQ ID NO: 2627798 - RNA, 19 nt, Escherichia coli CFT073
auagcaaaguaguaaugau

SEQ ID NO: 2627799 - RNA, 18 nt, Escherichia coli CFT073
auagcaagcgcugugaaa

SEQ ID NO: 2627800 - RNA, 21 nt, Escherichia coli CFT073
auagcaaucuguaacaaggug

SEQ ID NO: 2627801 - RNA, 17 nt, Escherichia coli CFT073
auagcacccgccagcgc

SEQ ID NO: 2627802 - RNA, 16 nt, Escherichia coli CFT073
auagcagcacaccaca

SEQ ID NO: 2627803 - RNA, 19 nt, Escherichia coli CFT073
auagcauccaguuccacac

SEQ ID NO: 2627804 - RNA, 20 nt, Escherichia coli CFT073
auagcauccaguuccacacc

SEQ ID NO: 2627805 - RNA, 19 nt, Escherichia coli CFT073
auagccaccuggcugcguu

SEQ ID NO: 2627806 - RNA, 15 nt, Escherichia coli CFT073
auagccagacguugu

SEQ ID NO: 2627807 - RNA, 15 nt, Escherichia coli CFT073
auagccagcaacauu

SEQ ID NO: 2627808 - RNA, 19 nt, Escherichia coli CFT073
auagccagcagagcaaaaa

SEQ ID NO: 2627809 - RNA, 12 nt, Escherichia coli CFT073
auagccagccuc

SEQ ID NO: 2627810 - RNA, 20 nt, Escherichia coli CFT073
auagccagguuuaccagcag

SEQ ID NO: 2627811 - RNA, 17 nt, Escherichia coli CFT073
auagcccggcaauggug

SEQ ID NO: 2627812 - RNA, 20 nt, Escherichia coli CFT073
auagccuaacacagcaauaa

SEQ ID NO: 2627813 - RNA, 15 nt, Escherichia coli CFT073
auagccuauaccuaa

SEQ ID NO: 2627814 - RNA, 19 nt, Escherichia coli CFT073
auagccucaaauuccuuau

SEQ ID NO: 2627815 - RNA, 19 nt, Escherichia coli CFT073
auagccuuuauuaaugaca

SEQ ID NO: 2627816 - RNA, 17 nt, Escherichia coli CFT073
auagccuuucucgcggu

SEQ ID NO: 2627817 - RNA, 17 nt, Escherichia coli CFT073
auagcgaagaauacgcc

SEQ ID NO: 2627818 - RNA, 19 nt, Escherichia coli CFT073
auagcgaagguguugaaau

SEQ ID NO: 2627819 - RNA, 18 nt, Escherichia coli CFT073
auagcgaauaaucccggc

SEQ ID NO: 2627820 - RNA, 14 nt, Escherichia coli CFT073
auagcgauuuuuca

SEQ ID NO: 2627821 - RNA, 22 nt, Escherichia coli CFT073
auagcgauuuuucaucacugcc

SEQ ID NO: 2627822 - RNA, 20 nt, Escherichia coli CFT073
auagcgcaccaaccacugcu

SEQ ID NO: 2627823 - RNA, 12 nt, Escherichia coli CFT073
auagcgcagcga

SEQ ID NO: 2627824 - RNA, 18 nt, Escherichia coli CFT073
auagcgcauggcagccag

SEQ ID NO: 2627825 - RNA, 15 nt, Escherichia coli CFT073
auagcgcauugcggc

SEQ ID NO: 2627826 - RNA, 16 nt, Escherichia coli CFT073
auagcgcauugcggca

SEQ ID NO: 2627827 - RNA, 14 nt, Escherichia coli CFT073
auagcgccaucgcg

SEQ ID NO: 2627828 - RNA, 16 nt, Escherichia coli CFT073
auagcgccugcugcug

SEQ ID NO: 2627829 - RNA, 17 nt, Escherichia coli CFT073
auagcgggcaaucagcg

SEQ ID NO: 2627830 - RNA, 22 nt, Escherichia coli CFT073
auagcgguaaaugacgggccaa

SEQ ID NO: 2627831 - RNA, 14 nt, Escherichia coli CFT073
auagcuaaucaucu

SEQ ID NO: 2627832 - RNA, 19 nt, Escherichia coli CFT073
auagcuaaucaucuguugu

SEQ ID NO: 2627833 - RNA, 13 nt, Escherichia coli CFT073
auagcucaacagu

SEQ ID NO: 2627834 - RNA, 16 nt, Escherichia coli CFT073
auagcucaguugguag

SEQ ID NO: 2627835 - RNA, 20 nt, Escherichia coli CFT073
auagcucaguugguagagca

SEQ ID NO: 2627836 - RNA, 17 nt, Escherichia coli CFT073
auagcuuauucuuauua

SEQ ID NO: 2627837 - RNA, 22 nt, Escherichia coli CFT073
auagcuuuggcggcaucugcca

SEQ ID NO: 2627838 - RNA, 23 nt, Escherichia coli CFT073
auagcuuuucgcgucaaucacac

SEQ ID NO: 2627839 - RNA, 17 nt, Escherichia coli CFT073
auaggcaaaaaaaugcc

SEQ ID NO: 2627840 - RNA, 18 nt, Escherichia coli CFT073
auaggcaaaaaaaugccc

SEQ ID NO: 2627841 - RNA, 17 nt, Escherichia coli CFT073
auaggcaggcaucauca

SEQ ID NO: 2627842 - RNA, 19 nt, Escherichia coli CFT073
auaggcuucaaccguuucu

SEQ ID NO: 2627843 - RNA, 18 nt, Escherichia coli CFT073
auagggggguaacacucu

SEQ ID NO: 2627844 - RNA, 14 nt, Escherichia coli CFT073
auagguaaacaucc

SEQ ID NO: 2627845 - RNA, 21 nt, Escherichia coli CFT073
auagguggcaaagaaaucaac

SEQ ID NO: 2627846 - RNA, 17 nt, Escherichia coli CFT073
auaggugguauagaaug

SEQ ID NO: 2627847 - RNA, 19 nt, Escherichia coli CFT073
auagguguaaauaucagga

SEQ ID NO: 2627848 - RNA, 20 nt, Escherichia coli CFT073
auagguguaaauaucaggau

SEQ ID NO: 2627849 - RNA, 18 nt, Escherichia coli CFT073
auagguugaaauaaaccg

SEQ ID NO: 2627850 - RNA, 22 nt, Escherichia coli CFT073
auaguaaaaggcaccauaacua

SEQ ID NO: 2627851 - RNA, 14 nt, Escherichia coli CFT073
auaguacgggcaau

SEQ ID NO: 2627852 - RNA, 21 nt, Escherichia coli CFT073
auaguacuggaagaaaacauu

SEQ ID NO: 2627853 - RNA, 23 nt, Escherichia coli CFT073
auaguauuauucuugacuaucac

SEQ ID NO: 2627854 - RNA, 21 nt, Escherichia coli CFT073
auagucagugaagccauuacc

SEQ ID NO: 2627855 - RNA, 13 nt, Escherichia coli CFT073
auagucaguucac

SEQ ID NO: 2627856 - RNA, 14 nt, Escherichia coli CFT073
auaguccgccagaa

SEQ ID NO: 2627857 - RNA, 16 nt, Escherichia coli CFT073
auaguccgccagaaua

SEQ ID NO: 2627858 - RNA, 16 nt, Escherichia coli CFT073
auaguccggcaccagc

SEQ ID NO: 2627859 - RNA, 17 nt, Escherichia coli CFT073
auaguccggcaccagcg

SEQ ID NO: 2627860 - RNA, 13 nt, Escherichia coli CFT073
auagugcccggca

SEQ ID NO: 2627861 - RNA, 19 nt, Escherichia coli CFT073
auagugcuucaaauauuga

SEQ ID NO: 2627862 - RNA, 14 nt, Escherichia coli CFT073
auaguggaguauga

SEQ ID NO: 2627863 - RNA, 15 nt, Escherichia coli CFT073
auaguguugccgcca

SEQ ID NO: 2627864 - RNA, 16 nt, Escherichia coli CFT073
auaguuacgaaaagga

SEQ ID NO: 2627865 - RNA, 19 nt, Escherichia coli CFT073
auauaaaaaauacgcauca

SEQ ID NO: 2627866 - RNA, 13 nt, Escherichia coli CFT073
auauaaaaucaua

SEQ ID NO: 2627867 - RNA, 17 nt, Escherichia coli CFT073
auauaaaccguccccaa

SEQ ID NO: 2627868 - RNA, 22 nt, Escherichia coli CFT073
auauaaaccguccccaaaaaag

SEQ ID NO: 2627869 - RNA, 14 nt, Escherichia coli CFT073
auauaaaccuucug

SEQ ID NO: 2627870 - RNA, 20 nt, Escherichia coli CFT073
auauaaagcccaucguugaa

SEQ ID NO: 2627871 - RNA, 12 nt, Escherichia coli CFT073
auauaaccaugg

SEQ ID NO: 2627872 - RNA, 17 nt, Escherichia coli CFT073
auauaagcauguucuuu

SEQ ID NO: 2627873 - RNA, 15 nt, Escherichia coli CFT073
auauacaaauagauc

SEQ ID NO: 2627874 - RNA, 15 nt, Escherichia coli CFT073
auauacacgaaauga

SEQ ID NO: 2627875 - RNA, 18 nt, Escherichia coli CFT073
auauacagcgccucuuuu

SEQ ID NO: 2627876 - RNA, 22 nt, Escherichia coli CFT073
auauaccauaucugguuaaaaa

SEQ ID NO: 2627877 - RNA, 14 nt, Escherichia coli CFT073
auauaccgcaucag

SEQ ID NO: 2627878 - RNA, 23 nt, Escherichia coli CFT073
auauaccgcaucagcaucgguga

SEQ ID NO: 2627879 - RNA, 22 nt, Escherichia coli CFT073
auauacgaucuucgccugaaac

SEQ ID NO: 2627880 - RNA, 12 nt, Escherichia coli CFT073
auauacgccacu

SEQ ID NO: 2627881 - RNA, 16 nt, Escherichia coli CFT073
auauacucuaaauaau

SEQ ID NO: 2627882 - RNA, 22 nt, Escherichia coli CFT073
auauacuucuggguuccuucca

SEQ ID NO: 2627883 - RNA, 13 nt, Escherichia coli CFT073
auauagauaucau

SEQ ID NO: 2627884 - RNA, 15 nt, Escherichia coli CFT073
auauagaucauaucg

SEQ ID NO: 2627885 - RNA, 18 nt, Escherichia coli CFT073
auauagccuaacacagca

SEQ ID NO: 2627886 - RNA, 16 nt, Escherichia coli CFT073
auauagcguaaagcca

SEQ ID NO: 2627887 - RNA, 13 nt, Escherichia coli CFT073
auauaggcaccgu

SEQ ID NO: 2627888 - RNA, 20 nt, Escherichia coli CFT073
auauaggcaccguguuccug

SEQ ID NO: 2627889 - RNA, 15 nt, Escherichia coli CFT073
auauauaaaaucaua

SEQ ID NO: 2627890 - RNA, 18 nt, Escherichia coli CFT073
auauauaaagauacacag

SEQ ID NO: 2627891 - RNA, 13 nt, Escherichia coli CFT073
auauauaacagaa

SEQ ID NO: 2627892 - RNA, 15 nt, Escherichia coli CFT073
auauauaacagaagg

SEQ ID NO: 2627893 - RNA, 16 nt, Escherichia coli CFT073
auauauaauagugcuu

SEQ ID NO: 2627894 - RNA, 19 nt, Escherichia coli CFT073
auauauccguggcuuuuua

SEQ ID NO: 2627895 - RNA, 21 nt, Escherichia coli CFT073
auauaugccaucgccagcagc

SEQ ID NO: 2627896 - RNA, 17 nt, Escherichia coli CFT073
auauaugucaccagcau

SEQ ID NO: 2627897 - RNA, 15 nt, Escherichia coli CFT073
auauauuacccuuua

SEQ ID NO: 2627898 - RNA, 23 nt, Escherichia coli CFT073
auauauuauaucuucacgauuau

SEQ ID NO: 2627899 - RNA, 15 nt, Escherichia coli CFT073
auauauucauauuuu

SEQ ID NO: 2627900 - RNA, 14 nt, Escherichia coli CFT073
auauauuccuauau

SEQ ID NO: 2627901 - RNA, 20 nt, Escherichia coli CFT073
auauauuuaguucauauaau

SEQ ID NO: 2627902 - RNA, 17 nt, Escherichia coli CFT073
auauauuucaucaacug

SEQ ID NO: 2627903 - RNA, 14 nt, Escherichia coli CFT073
auaucaacaaaacc

SEQ ID NO: 2627904 - RNA, 17 nt, Escherichia coli CFT073
auaucaaccaguugugc

SEQ ID NO: 2627905 - RNA, 19 nt, Escherichia coli CFT073
auaucaacgcccauacuca

SEQ ID NO: 2627906 - RNA, 21 nt, Escherichia coli CFT073
auaucaacgcccauacucauc

SEQ ID NO: 2627907 - RNA, 19 nt, Escherichia coli CFT073
auaucaacgcuauuugcug

SEQ ID NO: 2627908 - RNA, 23 nt, Escherichia coli CFT073
auaucaacgcuauuugcugaauu

SEQ ID NO: 2627909 - RNA, 12 nt, Escherichia coli CFT073
auaucaagcaug

SEQ ID NO: 2627910 - RNA, 16 nt, Escherichia coli CFT073
auaucaauaacauacc

SEQ ID NO: 2627911 - RNA, 11 nt, Escherichia coli CFT073
auaucaauaug

SEQ ID NO: 2627912 - RNA, 23 nt, Escherichia coli CFT073
auaucaauuagaauuauuagcaa

SEQ ID NO: 2627913 - RNA, 13 nt, Escherichia coli CFT073
auaucaccugcuu

SEQ ID NO: 2627914 - RNA, 16 nt, Escherichia coli CFT073
auaucaccuuccagaa

SEQ ID NO: 2627915 - RNA, 20 nt, Escherichia coli CFT073
auaucacgcgcgguauuuuc

SEQ ID NO: 2627916 - RNA, 20 nt, Escherichia coli CFT073
auaucacuggugaaagagcc

SEQ ID NO: 2627917 - RNA, 22 nt, Escherichia coli CFT073
auaucacuuuuauauaaugaaa

SEQ ID NO: 2627918 - RNA, 22 nt, Escherichia coli CFT073
auaucagcaaugguucgugcaa

SEQ ID NO: 2627919 - RNA, 22 nt, Escherichia coli CFT073
auaucagccugaaugcuuucau

SEQ ID NO: 2627920 - RNA, 16 nt, Escherichia coli CFT073
auaucaggcaaacaga

SEQ ID NO: 2627921 - RNA, 18 nt, Escherichia coli CFT073
auaucaggcaaacagaau

SEQ ID NO: 2627922 - RNA, 21 nt, Escherichia coli CFT073
auaucaguuauugacgccgua

SEQ ID NO: 2627923 - RNA, 11 nt, Escherichia coli CFT073
auaucaucaag

SEQ ID NO: 2627924 - RNA, 14 nt, Escherichia coli CFT073
auaucaucauccgc

SEQ ID NO: 2627925 - RNA, 14 nt, Escherichia coli CFT073
auaucauugaaguu

SEQ ID NO: 2627926 - RNA, 22 nt, Escherichia coli CFT073
auaucauuuugcugccauguca

SEQ ID NO: 2627927 - RNA, 18 nt, Escherichia coli CFT073
auauccaccgucaaaucc

SEQ ID NO: 2627928 - RNA, 14 nt, Escherichia coli CFT073
auauccacuggggu

SEQ ID NO: 2627929 - RNA, 23 nt, Escherichia coli CFT073
auauccagccaacgccuuuacca

SEQ ID NO: 2627930 - RNA, 17 nt, Escherichia coli CFT073
auauccagcgccugagc

SEQ ID NO: 2627931 - RNA, 12 nt, Escherichia coli CFT073
auauccaggcua

SEQ ID NO: 2627932 - RNA, 19 nt, Escherichia coli CFT073
auauccagguuacgcaugg

SEQ ID NO: 2627933 - RNA, 21 nt, Escherichia coli CFT073
auauccauagucacuaccugu

SEQ ID NO: 2627934 - RNA, 20 nt, Escherichia coli CFT073
auauccauguaccagacuga

SEQ ID NO: 2627935 - RNA, 20 nt, Escherichia coli CFT073
auaucccaacgcaaaaccaa

SEQ ID NO: 2627936 - RNA, 13 nt, Escherichia coli CFT073
auaucccaccagc

SEQ ID NO: 2627937 - RNA, 20 nt, Escherichia coli CFT073
auaucccagguuuaucaugc

SEQ ID NO: 2627938 - RNA, 13 nt, Escherichia coli CFT073
auaucccauuuac

SEQ ID NO: 2627939 - RNA, 20 nt, Escherichia coli CFT073
auauccccagggaagauguu

SEQ ID NO: 2627940 - RNA, 17 nt, Escherichia coli CFT073
auaucccgccagcacca

SEQ ID NO: 2627941 - RNA, 23 nt, Escherichia coli CFT073
auauccgccguauggacguuaau

SEQ ID NO: 2627942 - RNA, 18 nt, Escherichia coli CFT073
auauccgggcaaaaauua

SEQ ID NO: 2627943 - RNA, 19 nt, Escherichia coli CFT073
auauccgucgcguuucucc

SEQ ID NO: 2627944 - RNA, 20 nt, Escherichia coli CFT073
auauccucauuucauugucc

SEQ ID NO: 2627945 - RNA, 19 nt, Escherichia coli CFT073
auauccugagucggaacuu

SEQ ID NO: 2627946 - RNA, 14 nt, Escherichia coli CFT073
auaucgaauggcgu

SEQ ID NO: 2627947 - RNA, 21 nt, Escherichia coli CFT073
auaucgauaaagaacgcaccg

SEQ ID NO: 2627948 - RNA, 16 nt, Escherichia coli CFT073
auaucgcaucuuuuuu

SEQ ID NO: 2627949 - RNA, 17 nt, Escherichia coli CFT073
auaucgccauuaaacaa

SEQ ID NO: 2627950 - RNA, 19 nt, Escherichia coli CFT073
auaucgcgauggaaaacaa

SEQ ID NO: 2627951 - RNA, 17 nt, Escherichia coli CFT073
auaucgcggauaugcag

SEQ ID NO: 2627952 - RNA, 14 nt, Escherichia coli CFT073
auaucgcggcacag

SEQ ID NO: 2627953 - RNA, 16 nt, Escherichia coli CFT073
auaucgcguaaugcuu

SEQ ID NO: 2627954 - RNA, 21 nt, Escherichia coli CFT073
auaucgcuggcugcaguggua

SEQ ID NO: 2627955 - RNA, 19 nt, Escherichia coli CFT073
auaucggaggcuuguucaa

SEQ ID NO: 2627956 - RNA, 19 nt, Escherichia coli CFT073
auaucggcccggcuuucuu

SEQ ID NO: 2627957 - RNA, 19 nt, Escherichia coli CFT073
auaucggcucauaaaaacu

SEQ ID NO: 2627958 - RNA, 16 nt, Escherichia coli CFT073
auaucguucucgacac

SEQ ID NO: 2627959 - RNA, 15 nt, Escherichia coli CFT073
auaucuaaugccauu

SEQ ID NO: 2627960 - RNA, 20 nt, Escherichia coli CFT073
auaucuaaugccauuaacau

SEQ ID NO: 2627961 - RNA, 21 nt, Escherichia coli CFT073
auaucuaaugccauuaacauc

SEQ ID NO: 2627962 - RNA, 12 nt, Escherichia coli CFT073
auaucucgccuu

SEQ ID NO: 2627963 - RNA, 15 nt, Escherichia coli CFT073
auaucugguuaaaaa

SEQ ID NO: 2627964 - RNA, 17 nt, Escherichia coli CFT073
auaucugguuaaaaaaa

SEQ ID NO: 2627965 - RNA, 15 nt, Escherichia coli CFT073
auaucuucacgauua

SEQ ID NO: 2627966 - RNA, 21 nt, Escherichia coli CFT073
auaucuucacgauuauuaagc

SEQ ID NO: 2627967 - RNA, 11 nt, Escherichia coli CFT073
auaucuucccg

SEQ ID NO: 2627968 - RNA, 18 nt, Escherichia coli CFT073
auaucuucuguugcaggg

SEQ ID NO: 2627969 - RNA, 13 nt, Escherichia coli CFT073
auaucuuucuugc

SEQ ID NO: 2627970 - RNA, 17 nt, Escherichia coli CFT073
auaucuuuuaaaucauc

SEQ ID NO: 2627971 - RNA, 18 nt, Escherichia coli CFT073
auaugaacaaagcaaaua

SEQ ID NO: 2627972 - RNA, 22 nt, Escherichia coli CFT073
auaugaacaaagcaaauaaugu

SEQ ID NO: 2627973 - RNA, 15 nt, Escherichia coli CFT073
auaugaacuugcuca

SEQ ID NO: 2627974 - RNA, 16 nt, Escherichia coli CFT073
auaugaauauugcuga

SEQ ID NO: 2627975 - RNA, 23 nt, Escherichia coli CFT073
auaugaauccaggccagauacug

SEQ ID NO: 2627976 - RNA, 16 nt, Escherichia coli CFT073
auaugaaugccagcca

SEQ ID NO: 2627977 - RNA, 13 nt, Escherichia coli CFT073
auaugaauuaacg

SEQ ID NO: 2627978 - RNA, 12 nt, Escherichia coli CFT073
auaugacaccaa

SEQ ID NO: 2627979 - RNA, 21 nt, Escherichia coli CFT073
auaugaccauugguaauggga

SEQ ID NO: 2627980 - RNA, 21 nt, Escherichia coli CFT073
auaugacccacgccuuuuucu

SEQ ID NO: 2627981 - RNA, 18 nt, Escherichia coli CFT073
auaugaccguuuucccca

SEQ ID NO: 2627982 - RNA, 14 nt, Escherichia coli CFT073
auaugacucauaaa

SEQ ID NO: 2627983 - RNA, 14 nt, Escherichia coli CFT073
auaugaucgaaaau

SEQ ID NO: 2627984 - RNA, 23 nt, Escherichia coli CFT073
auaugcaaaucgguuuguaagcg

SEQ ID NO: 2627985 - RNA, 16 nt, Escherichia coli CFT073
auaugcacaaucagcg

SEQ ID NO: 2627986 - RNA, 22 nt, Escherichia coli CFT073
auaugcacaugaugauggcuau

SEQ ID NO: 2627987 - RNA, 15 nt, Escherichia coli CFT073
auaugccaucgccag

SEQ ID NO: 2627988 - RNA, 20 nt, Escherichia coli CFT073
auaugccaucgccagcagcc

SEQ ID NO: 2627989 - RNA, 21 nt, Escherichia coli CFT073
auaugccaugcgauggcggca

SEQ ID NO: 2627990 - RNA, 12 nt, Escherichia coli CFT073
auaugcccaccg

SEQ ID NO: 2627991 - RNA, 18 nt, Escherichia coli CFT073
auaugccccagcccgcca

SEQ ID NO: 2627992 - RNA, 17 nt, Escherichia coli CFT073
auaugcgccuuuugcuu

SEQ ID NO: 2627993 - RNA, 19 nt, Escherichia coli CFT073
auaugcgcugucauucauu

SEQ ID NO: 2627994 - RNA, 22 nt, Escherichia coli CFT073
auaugcggugccauuaaaccaa

SEQ ID NO: 2627995 - RNA, 23 nt, Escherichia coli CFT073
auaugcuuuuauucauguugauu

SEQ ID NO: 2627996 - RNA, 18 nt, Escherichia coli CFT073
auauggaagaaacgcuua

SEQ ID NO: 2627997 - RNA, 14 nt, Escherichia coli CFT073
auauggccuucuuc

SEQ ID NO: 2627998 - RNA, 15 nt, Escherichia coli CFT073
auauggcggcggcuu

SEQ ID NO: 2627999 - RNA, 19 nt, Escherichia coli CFT073
auauggcuugaagcaauag

SEQ ID NO: 2628000 - RNA, 15 nt, Escherichia coli CFT073
auaugggcaaacaaa

SEQ ID NO: 2628001 - RNA, 21 nt, Escherichia coli CFT073
auaugggcaaacaaaaaaccu

SEQ ID NO: 2628002 - RNA, 21 nt, Escherichia coli CFT073
auauguauuauaaguacuuuc

SEQ ID NO: 2628003 - RNA, 14 nt, Escherichia coli CFT073
auaugucaccagca

SEQ ID NO: 2628004 - RNA, 13 nt, Escherichia coli CFT073
auaugucgcgcca

SEQ ID NO: 2628005 - RNA, 15 nt, Escherichia coli CFT073
auaugucgcgccagg

SEQ ID NO: 2628006 - RNA, 20 nt, Escherichia coli CFT073
auaugugaucgaauauauca

SEQ ID NO: 2628007 - RNA, 15 nt, Escherichia coli CFT073
auauguuuuaaagcg

SEQ ID NO: 2628008 - RNA, 14 nt, Escherichia coli CFT073
auauguuuuuaaac

SEQ ID NO: 2628009 - RNA, 18 nt, Escherichia coli CFT073
auauguuuuuaaaccaac

SEQ ID NO: 2628010 - RNA, 14 nt, Escherichia coli CFT073
auauuaacaacauu

SEQ ID NO: 2628011 - RNA, 18 nt, Escherichia coli CFT073
auauuaaccucucagaau

SEQ ID NO: 2628012 - RNA, 14 nt, Escherichia coli CFT073
auauuaacgcagca

SEQ ID NO: 2628013 - RNA, 18 nt, Escherichia coli CFT073
auauuaacgcagcaaaag

SEQ ID NO: 2628014 - RNA, 20 nt, Escherichia coli CFT073
auauuacgugccgcguuaau

SEQ ID NO: 2628015 - RNA, 16 nt, Escherichia coli CFT073
auauuaucccccgaua

SEQ ID NO: 2628016 - RNA, 14 nt, Escherichia coli CFT073
auauuauuauuccu

SEQ ID NO: 2628017 - RNA, 16 nt, Escherichia coli CFT073
auauucaccgucacaa

SEQ ID NO: 2628018 - RNA, 21 nt, Escherichia coli CFT073
auauucacguuuuucauccag

SEQ ID NO: 2628019 - RNA, 23 nt, Escherichia coli CFT073
auauucacguuuuucauccagcg

SEQ ID NO: 2628020 - RNA, 20 nt, Escherichia coli CFT073
auauucacuugccugcugug

SEQ ID NO: 2628021 - RNA, 13 nt, Escherichia coli CFT073
auauucagcgcca

SEQ ID NO: 2628022 - RNA, 15 nt, Escherichia coli CFT073
auauucagcgcccug

SEQ ID NO: 2628023 - RNA, 15 nt, Escherichia coli CFT073
auauucauagcacau

SEQ ID NO: 2628024 - RNA, 18 nt, Escherichia coli CFT073
auauucauagcacauccu

SEQ ID NO: 2628025 - RNA, 20 nt, Escherichia coli CFT073
auauucaucaaaaugaacau

SEQ ID NO: 2628026 - RNA, 16 nt, Escherichia coli CFT073
auauucaucagcauca

SEQ ID NO: 2628027 - RNA, 12 nt, Escherichia coli CFT073
auauucaugaau

SEQ ID NO: 2628028 - RNA, 16 nt, Escherichia coli CFT073
auauucaugaauaaaa

SEQ ID NO: 2628029 - RNA, 19 nt, Escherichia coli CFT073
auauucauuuccggcggcg

SEQ ID NO: 2628030 - RNA, 16 nt, Escherichia coli CFT073
auauuccagucagcac

SEQ ID NO: 2628031 - RNA, 18 nt, Escherichia coli CFT073
auauuccagucagcacca

SEQ ID NO: 2628032 - RNA, 21 nt, Escherichia coli CFT073
auauucccuagucgauacugc

SEQ ID NO: 2628033 - RNA, 22 nt, Escherichia coli CFT073
auauucccuugcucugguuccc

SEQ ID NO: 2628034 - RNA, 18 nt, Escherichia coli CFT073
auauuccgcaccugccag

SEQ ID NO: 2628035 - RNA, 15 nt, Escherichia coli CFT073
auauuccuauauauu

SEQ ID NO: 2628036 - RNA, 18 nt, Escherichia coli CFT073
auauuccuauauauuuag

SEQ ID NO: 2628037 - RNA, 20 nt, Escherichia coli CFT073
auauuccugaauggugaccu

SEQ ID NO: 2628038 - RNA, 15 nt, Escherichia coli CFT073
auauuccugacccag

SEQ ID NO: 2628039 - RNA, 16 nt, Escherichia coli CFT073
auauuccugacccagc

SEQ ID NO: 2628040 - RNA, 22 nt, Escherichia coli CFT073
auauuccugcauugcuuuugug

SEQ ID NO: 2628041 - RNA, 17 nt, Escherichia coli CFT073
auauucgccgcccugca

SEQ ID NO: 2628042 - RNA, 16 nt, Escherichia coli CFT073
auauucguuaucguac

SEQ ID NO: 2628043 - RNA, 23 nt, Escherichia coli CFT073
auauucuugcggcguauauuggu

SEQ ID NO: 2628044 - RNA, 19 nt, Escherichia coli CFT073
auauugagauccauuauga

SEQ ID NO: 2628045 - RNA, 22 nt, Escherichia coli CFT073
auauugauaauaaaaagaauga

SEQ ID NO: 2628046 - RNA, 13 nt, Escherichia coli CFT073
auauugaugcaca

SEQ ID NO: 2628047 - RNA, 16 nt, Escherichia coli CFT073
auauugccaucacggc

SEQ ID NO: 2628048 - RNA, 22 nt, Escherichia coli CFT073
auauugcccguuauucccacuu

SEQ ID NO: 2628049 - RNA, 23 nt, Escherichia coli CFT073
auauugcccuucacuucaccuuu

SEQ ID NO: 2628050 - RNA, 18 nt, Escherichia coli CFT073
auauugccgcgauagcaa

SEQ ID NO: 2628051 - RNA, 18 nt, Escherichia coli CFT073
auauugcgagcucaauau

SEQ ID NO: 2628052 - RNA, 14 nt, Escherichia coli CFT073
auauugcguaccug

SEQ ID NO: 2628053 - RNA, 16 nt, Escherichia coli CFT073
auauugcguaccugca

SEQ ID NO: 2628054 - RNA, 17 nt, Escherichia coli CFT073
auauugcuauagcucau

SEQ ID NO: 2628055 - RNA, 21 nt, Escherichia coli CFT073
auauugcuguaaaguaacgaa

SEQ ID NO: 2628056 - RNA, 20 nt, Escherichia coli CFT073
auauuggagagcgauaauuu

SEQ ID NO: 2628057 - RNA, 21 nt, Escherichia coli CFT073
auauuggagaguugcaccagc

SEQ ID NO: 2628058 - RNA, 18 nt, Escherichia coli CFT073
auauugguguugugaagu

SEQ ID NO: 2628059 - RNA, 20 nt, Escherichia coli CFT073
auauuguaauacaaacucac

SEQ ID NO: 2628060 - RNA, 22 nt, Escherichia coli CFT073
auauuguaauacaaacucacug

SEQ ID NO: 2628061 - RNA, 13 nt, Escherichia coli CFT073
auauuuaaaaacg

SEQ ID NO: 2628062 - RNA, 23 nt, Escherichia coli CFT073
auauuuaacaucauugccgccug

SEQ ID NO: 2628063 - RNA, 15 nt, Escherichia coli CFT073
auauuuaaugacgaa

SEQ ID NO: 2628064 - RNA, 17 nt, Escherichia coli CFT073
auauuuaccggaucugc

SEQ ID NO: 2628065 - RNA, 14 nt, Escherichia coli CFT073
auauuuauucauca

SEQ ID NO: 2628066 - RNA, 17 nt, Escherichia coli CFT073
auauuuauucaucagcg

SEQ ID NO: 2628067 - RNA, 11 nt, Escherichia coli CFT073
auauuucacau

SEQ ID NO: 2628068 - RNA, 18 nt, Escherichia coli CFT073
auauuucacauaacugcc

SEQ ID NO: 2628069 - RNA, 21 nt, Escherichia coli CFT073
auauuucagagcuuuguugcg

SEQ ID NO: 2628070 - RNA, 15 nt, Escherichia coli CFT073
auauuucaggccaac

SEQ ID NO: 2628071 - RNA, 12 nt, Escherichia coli CFT073
auauuuccccaa

SEQ ID NO: 2628072 - RNA, 18 nt, Escherichia coli CFT073
auauuucgucgcaucaca

SEQ ID NO: 2628073 - RNA, 22 nt, Escherichia coli CFT073
auauuucugcggcauucccagc

SEQ ID NO: 2628074 - RNA, 21 nt, Escherichia coli CFT073
auauuucuuuaucaccaauga

SEQ ID NO: 2628075 - RNA, 17 nt, Escherichia coli CFT073
auauuuguuauaaacgc

SEQ ID NO: 2628076 - RNA, 18 nt, Escherichia coli CFT073
auauuuguuuuuguuaau

SEQ ID NO: 2628077 - RNA, 22 nt, Escherichia coli CFT073
auauuuguuuuuguuaauugcu

SEQ ID NO: 2628078 - RNA, 17 nt, Escherichia coli CFT073
auauuuuauugauuguu

SEQ ID NO: 2628079 - RNA, 13 nt, Escherichia coli CFT073
auauuuucagggg

SEQ ID NO: 2628080 - RNA, 15 nt, Escherichia coli CFT073
auauuuuccagcaac

SEQ ID NO: 2628081 - RNA, 12 nt, Escherichia coli CFT073
auauuuucgcca

SEQ ID NO: 2628082 - RNA, 23 nt, Escherichia coli CFT073
auauuuugaaucgguggcggcag

SEQ ID NO: 2628083 - RNA, 19 nt, Escherichia coli CFT073
auauuuugcgacccguuua

SEQ ID NO: 2628084 - RNA, 13 nt, Escherichia coli CFT073
auauuuugugauu

SEQ ID NO: 2628085 - RNA, 22 nt, Escherichia coli CFT073
auauuuugugauuuauuuucca

SEQ ID NO: 2628086 - RNA, 21 nt, Escherichia coli CFT073
auauuuuuuauagucagugaa

SEQ ID NO: 2628087 - RNA, 16 nt, Escherichia coli CFT073
auauuuuuugaaaaau

SEQ ID NO: 2628088 - RNA, 21 nt, Escherichia coli CFT073
aucaaaaaaaucuucacugaa

SEQ ID NO: 2628089 - RNA, 21 nt, Escherichia coli CFT073
aucaaaaacaaauuuugaaca

SEQ ID NO: 2628090 - RNA, 14 nt, Escherichia coli CFT073
aucaaaaccuaacu

SEQ ID NO: 2628091 - RNA, 15 nt, Escherichia coli CFT073
aucaaaaucaccgau

SEQ ID NO: 2628092 - RNA, 20 nt, Escherichia coli CFT073
aucaaaaucaccgaugacag

SEQ ID NO: 2628093 - RNA, 18 nt, Escherichia coli CFT073
aucaaaaugaacauuggc

SEQ ID NO: 2628094 - RNA, 12 nt, Escherichia coli CFT073
aucaaaauggua

SEQ ID NO: 2628095 - RNA, 21 nt, Escherichia coli CFT073
aucaaacaaccguucacgcau

SEQ ID NO: 2628096 - RNA, 21 nt, Escherichia coli CFT073
aucaaacaacggcacuucaau

SEQ ID NO: 2628097 - RNA, 14 nt, Escherichia coli CFT073
aucaaacagaaaaa

SEQ ID NO: 2628098 - RNA, 14 nt, Escherichia coli CFT073
aucaaacagaauau

SEQ ID NO: 2628099 - RNA, 22 nt, Escherichia coli CFT073
aucaaacagaauauugugcuca

SEQ ID NO: 2628100 - RNA, 14 nt, Escherichia coli CFT073
aucaaacccauuuu

SEQ ID NO: 2628101 - RNA, 18 nt, Escherichia coli CFT073
aucaaacgccagaucacc

SEQ ID NO: 2628102 - RNA, 22 nt, Escherichia coli CFT073
aucaaacgccugaccguugauu

SEQ ID NO: 2628103 - RNA, 20 nt, Escherichia coli CFT073
aucaaacgugacauucugac

SEQ ID NO: 2628104 - RNA, 19 nt, Escherichia coli CFT073
aucaaacuuuuaaauugaa

SEQ ID NO: 2628105 - RNA, 21 nt, Escherichia coli CFT073
aucaaacuuuuaaauugaaga

SEQ ID NO: 2628106 - RNA, 13 nt, Escherichia coli CFT073
aucaaagucucug

SEQ ID NO: 2628107 - RNA, 16 nt, Escherichia coli CFT073
aucaaaguuaguaaaa

SEQ ID NO: 2628108 - RNA, 18 nt, Escherichia coli CFT073
aucaaauaaauaaucucu

SEQ ID NO: 2628109 - RNA, 22 nt, Escherichia coli CFT073
aucaaauaaccgguauugcucc

SEQ ID NO: 2628110 - RNA, 22 nt, Escherichia coli CFT073
aucaaauacagcuuaaucacca

SEQ ID NO: 2628111 - RNA, 22 nt, Escherichia coli CFT073
aucaaauagccugccaguggag

SEQ ID NO: 2628112 - RNA, 18 nt, Escherichia coli CFT073
aucaaaucaaccaggccu

SEQ ID NO: 2628113 - RNA, 11 nt, Escherichia coli CFT073
aucaaaucaca

SEQ ID NO: 2628114 - RNA, 22 nt, Escherichia coli CFT073
aucaaaucaccauauucagcag

SEQ ID NO: 2628115 - RNA, 23 nt, Escherichia coli CFT073
aucaaaucaccauauucagcagc

SEQ ID NO: 2628116 - RNA, 13 nt, Escherichia coli CFT073
aucaaauccccac

SEQ ID NO: 2628117 - RNA, 12 nt, Escherichia coli CFT073
aucaaaucugcc

SEQ ID NO: 2628118 - RNA, 14 nt, Escherichia coli CFT073
aucaaaugcgccug

SEQ ID NO: 2628119 - RNA, 18 nt, Escherichia coli CFT073
aucaaaugcguuaucggc

SEQ ID NO: 2628120 - RNA, 16 nt, Escherichia coli CFT073
aucaaauuauuaccau

SEQ ID NO: 2628121 - RNA, 23 nt, Escherichia coli CFT073
aucaaauucaaugacaguaucac

SEQ ID NO: 2628122 - RNA, 19 nt, Escherichia coli CFT073
aucaacaaacgcugacaua

SEQ ID NO: 2628123 - RNA, 15 nt, Escherichia coli CFT073
aucaacaaccugcau

SEQ ID NO: 2628124 - RNA, 14 nt, Escherichia coli CFT073
aucaacaauuccca

SEQ ID NO: 2628125 - RNA, 13 nt, Escherichia coli CFT073
aucaacagaauga

SEQ ID NO: 2628126 - RNA, 21 nt, Escherichia coli CFT073
aucaacagauaaauggcacag

SEQ ID NO: 2628127 - RNA, 15 nt, Escherichia coli CFT073
aucaacaggaacaug

SEQ ID NO: 2628128 - RNA, 18 nt, Escherichia coli CFT073
aucaacauucagaucggu

SEQ ID NO: 2628129 - RNA, 23 nt, Escherichia coli CFT073
aucaaccagaucgcucaucugcu

SEQ ID NO: 2628130 - RNA, 11 nt, Escherichia coli CFT073
aucaaccagca

SEQ ID NO: 2628131 - RNA, 12 nt, Escherichia coli CFT073
aucaaccaggcc

SEQ ID NO: 2628132 - RNA, 22 nt, Escherichia coli CFT073
aucaaccaguugugcaccacca

SEQ ID NO: 2628133 - RNA, 19 nt, Escherichia coli CFT073
aucaaccaugguuucaaac

SEQ ID NO: 2628134 - RNA, 21 nt, Escherichia coli CFT073
aucaacccgcgcgcuaacgga

SEQ ID NO: 2628135 - RNA, 20 nt, Escherichia coli CFT073
aucaacccugcccuucaggg

SEQ ID NO: 2628136 - RNA, 12 nt, Escherichia coli CFT073
aucaaccgccgg

SEQ ID NO: 2628137 - RNA, 15 nt, Escherichia coli CFT073
aucaacgccaccauc

SEQ ID NO: 2628138 - RNA, 12 nt, Escherichia coli CFT073
aucaacgccuga

SEQ ID NO: 2628139 - RNA, 20 nt, Escherichia coli CFT073
aucaacgcuauuugcugaau

SEQ ID NO: 2628140 - RNA, 15 nt, Escherichia coli CFT073
aucaacggcaacaau

SEQ ID NO: 2628141 - RNA, 17 nt, Escherichia coli CFT073
aucaacggugccaucac

SEQ ID NO: 2628142 - RNA, 14 nt, Escherichia coli CFT073
aucaacguagaaua

SEQ ID NO: 2628143 - RNA, 23 nt, Escherichia coli CFT073
aucaacguaguaucguaaucagc

SEQ ID NO: 2628144 - RNA, 16 nt, Escherichia coli CFT073
aucaacucaggaacau

SEQ ID NO: 2628145 - RNA, 18 nt, Escherichia coli CFT073
aucaacucaggaacauca

SEQ ID NO: 2628146 - RNA, 18 nt, Escherichia coli CFT073
aucaacuccgccagcaac

SEQ ID NO: 2628147 - RNA, 19 nt, Escherichia coli CFT073
aucaacuucaacaguggcg

SEQ ID NO: 2628148 - RNA, 22 nt, Escherichia coli CFT073
aucaagaaacucugcggcauca

SEQ ID NO: 2628149 - RNA, 15 nt, Escherichia coli CFT073
aucaagaaagcuuug

SEQ ID NO: 2628150 - RNA, 13 nt, Escherichia coli CFT073
aucaagacaugau

SEQ ID NO: 2628151 - RNA, 16 nt, Escherichia coli CFT073
aucaagacccggcgca

SEQ ID NO: 2628152 - RNA, 12 nt, Escherichia coli CFT073
aucaagcaccaa

SEQ ID NO: 2628153 - RNA, 18 nt, Escherichia coli CFT073
aucaagcauuuucucacu

SEQ ID NO: 2628154 - RNA, 23 nt, Escherichia coli CFT073
aucaagcauuuucucacuggcgu

SEQ ID NO: 2628155 - RNA, 20 nt, Escherichia coli CFT073
aucaagcccugguaacugcc

SEQ ID NO: 2628156 - RNA, 16 nt, Escherichia coli CFT073
aucaagcgaaaaugcu

SEQ ID NO: 2628157 - RNA, 15 nt, Escherichia coli CFT073
aucaagcgaaaucaa

SEQ ID NO: 2628158 - RNA, 20 nt, Escherichia coli CFT073
aucaagcgccgaguaaaaaa

SEQ ID NO: 2628159 - RNA, 17 nt, Escherichia coli CFT073
aucaagcggcgcaugca

SEQ ID NO: 2628160 - RNA, 19 nt, Escherichia coli CFT073
aucaaggcaguugcccuug

SEQ ID NO: 2628161 - RNA, 19 nt, Escherichia coli CFT073
aucaaggcauauaccacac

SEQ ID NO: 2628162 - RNA, 21 nt, Escherichia coli CFT073
aucaaggcugauguugauaaa

SEQ ID NO: 2628163 - RNA, 12 nt, Escherichia coli CFT073
aucaagguaauu

SEQ ID NO: 2628164 - RNA, 18 nt, Escherichia coli CFT073
aucaagguugcacaacca

SEQ ID NO: 2628165 - RNA, 14 nt, Escherichia coli CFT073
aucaagucagaugc

SEQ ID NO: 2628166 - RNA, 17 nt, Escherichia coli CFT073
aucaagugaacuuucuc

SEQ ID NO: 2628167 - RNA, 20 nt, Escherichia coli CFT073
aucaagugaacuuucucugu

SEQ ID NO: 2628168 - RNA, 14 nt, Escherichia coli CFT073
aucaaguuacgaua

SEQ ID NO: 2628169 - RNA, 14 nt, Escherichia coli CFT073
aucaaguugauuuu

SEQ ID NO: 2628170 - RNA, 17 nt, Escherichia coli CFT073
aucaauaacacugagcg

SEQ ID NO: 2628171 - RNA, 14 nt, Escherichia coli CFT073
aucaauaacauacc

SEQ ID NO: 2628172 - RNA, 12 nt, Escherichia coli CFT073
aucaauaaucac

SEQ ID NO: 2628173 - RNA, 16 nt, Escherichia coli CFT073
aucaauaccauuauca

SEQ ID NO: 2628174 - RNA, 17 nt, Escherichia coli CFT073
aucaauaccauuaucau

SEQ ID NO: 2628175 - RNA, 20 nt, Escherichia coli CFT073
aucaauaccauuaucauuga

SEQ ID NO: 2628176 - RNA, 23 nt, Escherichia coli CFT073
aucaauacccgguccuucaucuu

SEQ ID NO: 2628177 - RNA, 18 nt, Escherichia coli CFT073
aucaauagugaacugacu

SEQ ID NO: 2628178 - RNA, 14 nt, Escherichia coli CFT073
aucaaucaccgcuu

SEQ ID NO: 2628179 - RNA, 15 nt, Escherichia coli CFT073
aucaaucagccccuu

SEQ ID NO: 2628180 - RNA, 16 nt, Escherichia coli CFT073
aucaauccccagaugc

SEQ ID NO: 2628181 - RNA, 18 nt, Escherichia coli CFT073
aucaauccggcaaucaac

SEQ ID NO: 2628182 - RNA, 19 nt, Escherichia coli CFT073
aucaauccggcaaucaaca

SEQ ID NO: 2628183 - RNA, 20 nt, Escherichia coli CFT073
aucaauccggcaaucaacau

SEQ ID NO: 2628184 - RNA, 18 nt, Escherichia coli CFT073
aucaaucgaccgacuuua

SEQ ID NO: 2628185 - RNA, 22 nt, Escherichia coli CFT073
aucaaucgcagccacguuaaua

SEQ ID NO: 2628186 - RNA, 18 nt, Escherichia coli CFT073
aucaaucuuuacacacaa

SEQ ID NO: 2628187 - RNA, 15 nt, Escherichia coli CFT073
aucaaucuuuuucau

SEQ ID NO: 2628188 - RNA, 13 nt, Escherichia coli CFT073
aucaaugauaauc

SEQ ID NO: 2628189 - RNA, 13 nt, Escherichia coli CFT073
aucaaugccagca

SEQ ID NO: 2628190 - RNA, 17 nt, Escherichia coli CFT073
aucaauggauucaugau

SEQ ID NO: 2628191 - RNA, 22 nt, Escherichia coli CFT073
aucaaugugcugagaacaagau

SEQ ID NO: 2628192 - RNA, 14 nt, Escherichia coli CFT073
aucaauuaauccag

SEQ ID NO: 2628193 - RNA, 19 nt, Escherichia coli CFT073
aucaauuaauccagacugc

SEQ ID NO: 2628194 - RNA, 22 nt, Escherichia coli CFT073
aucaauuaauccuuucgaaaaa

SEQ ID NO: 2628195 - RNA, 13 nt, Escherichia coli CFT073
aucaauuaaugcc

SEQ ID NO: 2628196 - RNA, 19 nt, Escherichia coli CFT073
aucaauuaccuuuuuacca

SEQ ID NO: 2628197 - RNA, 22 nt, Escherichia coli CFT073
aucaauucagaaauaaucaccu

SEQ ID NO: 2628198 - RNA, 14 nt, Escherichia coli CFT073
aucaauucaucgcu

SEQ ID NO: 2628199 - RNA, 22 nt, Escherichia coli CFT073
aucaauucucgccaguguucuu

SEQ ID NO: 2628200 - RNA, 18 nt, Escherichia coli CFT073
aucaauucuuuuucugaa

SEQ ID NO: 2628201 - RNA, 21 nt, Escherichia coli CFT073
aucaauugaugcuuuuugccc

SEQ ID NO: 2628202 - RNA, 13 nt, Escherichia coli CFT073
aucaauugcaauc

SEQ ID NO: 2628203 - RNA, 15 nt, Escherichia coli CFT073
aucaauugcaggaag

SEQ ID NO: 2628204 - RNA, 20 nt, Escherichia coli CFT073
aucaauugcguucugucgau

SEQ ID NO: 2628205 - RNA, 23 nt, Escherichia coli CFT073
aucaauugcguucugucgauaaa

SEQ ID NO: 2628206 - RNA, 19 nt, Escherichia coli CFT073
aucaauuugcuucuggcug

SEQ ID NO: 2628207 - RNA, 20 nt, Escherichia coli CFT073
aucaauuugcuucuggcugg

SEQ ID NO: 2628208 - RNA, 21 nt, Escherichia coli CFT073
aucaauuuucccuucugagau

SEQ ID NO: 2628209 - RNA, 17 nt, Escherichia coli CFT073
aucacaaaauuuaucca

SEQ ID NO: 2628210 - RNA, 18 nt, Escherichia coli CFT073
aucacaaaauuuauccag

SEQ ID NO: 2628211 - RNA, 21 nt, Escherichia coli CFT073
aucacaaaauuuauccagcgc

SEQ ID NO: 2628212 - RNA, 18 nt, Escherichia coli CFT073
aucacaaucggcuuucac

SEQ ID NO: 2628213 - RNA, 19 nt, Escherichia coli CFT073
aucacaaugccgccaauaa

SEQ ID NO: 2628214 - RNA, 14 nt, Escherichia coli CFT073
aucacacagcgguu

SEQ ID NO: 2628215 - RNA, 23 nt, Escherichia coli CFT073
aucacacagcgguuuaccgaugc

SEQ ID NO: 2628216 - RNA, 20 nt, Escherichia coli CFT073
aucacaccauauccagcgca

SEQ ID NO: 2628217 - RNA, 17 nt, Escherichia coli CFT073
aucacaccauccagcaa

SEQ ID NO: 2628218 - RNA, 18 nt, Escherichia coli CFT073
aucacaccauccagcaac

SEQ ID NO: 2628219 - RNA, 20 nt, Escherichia coli CFT073
aucacaccauccagcaacaa

SEQ ID NO: 2628220 - RNA, 16 nt, Escherichia coli CFT073
aucacacggccaucac

SEQ ID NO: 2628221 - RNA, 19 nt, Escherichia coli CFT073
aucacacggccaucacgga

SEQ ID NO: 2628222 - RNA, 14 nt, Escherichia coli CFT073
aucacagcaccuua

SEQ ID NO: 2628223 - RNA, 13 nt, Escherichia coli CFT073
aucacaggcgcga

SEQ ID NO: 2628224 - RNA, 13 nt, Escherichia coli CFT073
aucacaucaccau

SEQ ID NO: 2628225 - RNA, 15 nt, Escherichia coli CFT073
aucacaucagcgcau

SEQ ID NO: 2628226 - RNA, 15 nt, Escherichia coli CFT073
aucacaucaggcuga

SEQ ID NO: 2628227 - RNA, 13 nt, Escherichia coli CFT073
aucacaucccagc

SEQ ID NO: 2628228 - RNA, 16 nt, Escherichia coli CFT073
aucacaucccagcaga

SEQ ID NO: 2628229 - RNA, 20 nt, Escherichia coli CFT073
aucacauccggcaauaucca

SEQ ID NO: 2628230 - RNA, 19 nt, Escherichia coli CFT073
aucacaucguagacauaac

SEQ ID NO: 2628231 - RNA, 22 nt, Escherichia coli CFT073
aucacaugcggcgugccuucac

SEQ ID NO: 2628232 - RNA, 21 nt, Escherichia coli CFT073
aucacaugcuggaaccacagc

SEQ ID NO: 2628233 - RNA, 23 nt, Escherichia coli CFT073
aucacaugcuggaaccacagcgc

SEQ ID NO: 2628234 - RNA, 14 nt, Escherichia coli CFT073
aucacauuaaauuu

SEQ ID NO: 2628235 - RNA, 18 nt, Escherichia coli CFT073
aucacauuaaauuuaugu

SEQ ID NO: 2628236 - RNA, 13 nt, Escherichia coli CFT073
aucaccaaacugc

SEQ ID NO: 2628237 - RNA, 18 nt, Escherichia coli CFT073
aucaccaacgauuuuuuc

SEQ ID NO: 2628238 - RNA, 15 nt, Escherichia coli CFT073
aucaccaauaccagc

SEQ ID NO: 2628239 - RNA, 17 nt, Escherichia coli CFT073
aucaccaauaccagcau

SEQ ID NO: 2628240 - RNA, 18 nt, Escherichia coli CFT073
aucaccaauaccagcauc

SEQ ID NO: 2628241 - RNA, 19 nt, Escherichia coli CFT073
aucaccaauaccagcauca

SEQ ID NO: 2628242 - RNA, 12 nt, Escherichia coli CFT073
aucaccacauac

SEQ ID NO: 2628243 - RNA, 15 nt, Escherichia coli CFT073
aucaccacauacugc

SEQ ID NO: 2628244 - RNA, 14 nt, Escherichia coli CFT073
aucaccaccagcac

SEQ ID NO: 2628245 - RNA, 22 nt, Escherichia coli CFT073
aucaccaccgucaucacgcagc

SEQ ID NO: 2628246 - RNA, 11 nt, Escherichia coli CFT073
aucaccagcaa

SEQ ID NO: 2628247 - RNA, 14 nt, Escherichia coli CFT073
aucaccagcaacac

SEQ ID NO: 2628248 - RNA, 16 nt, Escherichia coli CFT073
aucaccaggccauaga

SEQ ID NO: 2628249 - RNA, 12 nt, Escherichia coli CFT073
aucaccaguacc

SEQ ID NO: 2628250 - RNA, 12 nt, Escherichia coli CFT073
aucaccagucca

SEQ ID NO: 2628251 - RNA, 18 nt, Escherichia coli CFT073
aucaccaguccaucggca

SEQ ID NO: 2628252 - RNA, 18 nt, Escherichia coli CFT073
aucaccauauucagcagc

SEQ ID NO: 2628253 - RNA, 17 nt, Escherichia coli CFT073
aucacccagcgaagcaa

SEQ ID NO: 2628254 - RNA, 22 nt, Escherichia coli CFT073
aucacccgagagaacugcugca

SEQ ID NO: 2628255 - RNA, 23 nt, Escherichia coli CFT073
aucacccgagagaacugcugcau

SEQ ID NO: 2628256 - RNA, 16 nt, Escherichia coli CFT073
aucacccgauacucca

SEQ ID NO: 2628257 - RNA, 16 nt, Escherichia coli CFT073
aucacccgccuucacu

SEQ ID NO: 2628258 - RNA, 20 nt, Escherichia coli CFT073
aucacccugcgauugugaca

SEQ ID NO: 2628259 - RNA, 15 nt, Escherichia coli CFT073
aucaccgaucguuac

SEQ ID NO: 2628260 - RNA, 17 nt, Escherichia coli CFT073
aucaccgccagcggcgu

SEQ ID NO: 2628261 - RNA, 17 nt, Escherichia coli CFT073
aucaccggaggccugau

SEQ ID NO: 2628262 - RNA, 16 nt, Escherichia coli CFT073
aucaccggcaaaacca

SEQ ID NO: 2628263 - RNA, 16 nt, Escherichia coli CFT073
aucaccggcaucugcu

SEQ ID NO: 2628264 - RNA, 13 nt, Escherichia coli CFT073
aucaccggucgac

SEQ ID NO: 2628265 - RNA, 20 nt, Escherichia coli CFT073
aucaccguaacgaacacgaa

SEQ ID NO: 2628266 - RNA, 21 nt, Escherichia coli CFT073
aucaccgucguuaaugcgccc

SEQ ID NO: 2628267 - RNA, 17 nt, Escherichia coli CFT073
aucaccucaucaccaca

SEQ ID NO: 2628268 - RNA, 23 nt, Escherichia coli CFT073
aucaccucaucaccacagacaaa

SEQ ID NO: 2628269 - RNA, 12 nt, Escherichia coli CFT073
aucaccucuuca

SEQ ID NO: 2628270 - RNA, 14 nt, Escherichia coli CFT073
aucaccucuucacc

SEQ ID NO: 2628271 - RNA, 14 nt, Escherichia coli CFT073
aucaccugacagca

SEQ ID NO: 2628272 - RNA, 19 nt, Escherichia coli CFT073
aucaccugauugaccgcca

SEQ ID NO: 2628273 - RNA, 20 nt, Escherichia coli CFT073
aucaccugauugaccgccag

SEQ ID NO: 2628274 - RNA, 22 nt, Escherichia coli CFT073
aucaccugcgcuggcaggccug

SEQ ID NO: 2628275 - RNA, 16 nt, Escherichia coli CFT073
aucacgaauagcuucg

SEQ ID NO: 2628276 - RNA, 14 nt, Escherichia coli CFT073
aucacgaauuccgc

SEQ ID NO: 2628277 - RNA, 19 nt, Escherichia coli CFT073
aucacgacauaauuuuucu

SEQ ID NO: 2628278 - RNA, 17 nt, Escherichia coli CFT073
aucacgaccgcuucagg

SEQ ID NO: 2628279 - RNA, 15 nt, Escherichia coli CFT073
aucacgcaacauucc

SEQ ID NO: 2628280 - RNA, 18 nt, Escherichia coli CFT073
aucacgcacucgacgcag

SEQ ID NO: 2628281 - RNA, 19 nt, Escherichia coli CFT073
aucacgcacucgacgcagc

SEQ ID NO: 2628282 - RNA, 12 nt, Escherichia coli CFT073
aucacgcagcug

SEQ ID NO: 2628283 - RNA, 17 nt, Escherichia coli CFT073
aucacgcaguuucgcgu

SEQ ID NO: 2628284 - RNA, 13 nt, Escherichia coli CFT073
aucacgcaucacc

SEQ ID NO: 2628285 - RNA, 15 nt, Escherichia coli CFT073
aucacgccgcuggca

SEQ ID NO: 2628286 - RNA, 16 nt, Escherichia coli CFT073
aucacgccgcuggcau

SEQ ID NO: 2628287 - RNA, 22 nt, Escherichia coli CFT073
aucacgccugcuucuacgcagg

SEQ ID NO: 2628288 - RNA, 15 nt, Escherichia coli CFT073
aucacgcgccugcca

SEQ ID NO: 2628289 - RNA, 18 nt, Escherichia coli CFT073
aucacgcucaacuuccug

SEQ ID NO: 2628290 - RNA, 17 nt, Escherichia coli CFT073
aucacggcaaacugcgc

SEQ ID NO: 2628291 - RNA, 21 nt, Escherichia coli CFT073
aucacgggcgcggaaagcacc

SEQ ID NO: 2628292 - RNA, 18 nt, Escherichia coli CFT073
aucacgguaccuaccggu

SEQ ID NO: 2628293 - RNA, 23 nt, Escherichia coli CFT073
aucacgucgagauugugcucaau

SEQ ID NO: 2628294 - RNA, 14 nt, Escherichia coli CFT073
aucacguuuuccuu

SEQ ID NO: 2628295 - RNA, 24 nt, Escherichia coli CFT073
aucacuaccugauucgcaccacgu

SEQ ID NO: 2628296 - RNA, 15 nt, Escherichia coli CFT073
aucacuauaaauaua

SEQ ID NO: 2628297 - RNA, 19 nt, Escherichia coli CFT073
aucacuauaaauauacaua

SEQ ID NO: 2628298 - RNA, 18 nt, Escherichia coli CFT073
aucacuauuaaagaaagu

SEQ ID NO: 2628299 - RNA, 14 nt, Escherichia coli CFT073
aucacuauucagau

SEQ ID NO: 2628300 - RNA, 18 nt, Escherichia coli CFT073
aucacucccuuucugcca

SEQ ID NO: 2628301 - RNA, 19 nt, Escherichia coli CFT073
aucacucggggcuuuucuc

SEQ ID NO: 2628302 - RNA, 16 nt, Escherichia coli CFT073
aucacucgugauaacc

SEQ ID NO: 2628303 - RNA, 23 nt, Escherichia coli CFT073
aucacugaaauuguaggccugau

SEQ ID NO: 2628304 - RNA, 18 nt, Escherichia coli CFT073
aucacugaugaucuccau

SEQ ID NO: 2628305 - RNA, 22 nt, Escherichia coli CFT073
aucacugauuaacaggcggcua

SEQ ID NO: 2628306 - RNA, 15 nt, Escherichia coli CFT073
aucacugccaccagg

SEQ ID NO: 2628307 - RNA, 19 nt, Escherichia coli CFT073
aucacugccaccaggaacg

SEQ ID NO: 2628308 - RNA, 14 nt, Escherichia coli CFT073
aucacugccgacca

SEQ ID NO: 2628309 - RNA, 16 nt, Escherichia coli CFT073
aucacuggcagggaaa

SEQ ID NO: 2628310 - RNA, 14 nt, Escherichia coli CFT073
aucacuggccucuu

SEQ ID NO: 2628311 - RNA, 19 nt, Escherichia coli CFT073
aucacuggugaaagagcca

SEQ ID NO: 2628312 - RNA, 19 nt, Escherichia coli CFT073
aucacuuacgauuuuaaua

SEQ ID NO: 2628313 - RNA, 22 nt, Escherichia coli CFT073
aucacuuaggccuacuaccagu

SEQ ID NO: 2628314 - RNA, 16 nt, Escherichia coli CFT073
aucacuucaucgccgc

SEQ ID NO: 2628315 - RNA, 15 nt, Escherichia coli CFT073
aucacuuccagcagu

SEQ ID NO: 2628316 - RNA, 22 nt, Escherichia coli CFT073
aucacuucuguuugcgccacgc

SEQ ID NO: 2628317 - RNA, 23 nt, Escherichia coli CFT073
aucacuuguaguuacauuuuuau

SEQ ID NO: 2628318 - RNA, 16 nt, Escherichia coli CFT073
aucacuuucaccggug

SEQ ID NO: 2628319 - RNA, 13 nt, Escherichia coli CFT073
aucacuuucagac

SEQ ID NO: 2628320 - RNA, 17 nt, Escherichia coli CFT073
aucacuuugcagaaaau

SEQ ID NO: 2628321 - RNA, 18 nt, Escherichia coli CFT073
aucagaaacaaauacaug

SEQ ID NO: 2628322 - RNA, 22 nt, Escherichia coli CFT073
aucagaaaugccaguaacucau

SEQ ID NO: 2628323 - RNA, 20 nt, Escherichia coli CFT073
aucagaacgcagcauuuccu

SEQ ID NO: 2628324 - RNA, 22 nt, Escherichia coli CFT073
aucagaagauuaagagaaccag

SEQ ID NO: 2628325 - RNA, 17 nt, Escherichia coli CFT073
aucagaauccggugccu

SEQ ID NO: 2628326 - RNA, 15 nt, Escherichia coli CFT073
aucagaaucgcgccc

SEQ ID NO: 2628327 - RNA, 19 nt, Escherichia coli CFT073
aucagaaugcgcucuuccg

SEQ ID NO: 2628328 - RNA, 21 nt, Escherichia coli CFT073
aucagacccacccaacauggu

SEQ ID NO: 2628329 - RNA, 13 nt, Escherichia coli CFT073
aucagaccgccaa

SEQ ID NO: 2628330 - RNA, 20 nt, Escherichia coli CFT073
aucagaccgccaaucagcau

SEQ ID NO: 2628331 - RNA, 20 nt, Escherichia coli CFT073
aucagaccuacggauucaau

SEQ ID NO: 2628332 - RNA, 23 nt, Escherichia coli CFT073
aucagaccuacggauucaaugca

SEQ ID NO: 2628333 - RNA, 16 nt, Escherichia coli CFT073
aucagacgacccacga

SEQ ID NO: 2628334 - RNA, 22 nt, Escherichia coli CFT073
aucagacuaagcugcgggaaau

SEQ ID NO: 2628335 - RNA, 20 nt, Escherichia coli CFT073
aucagacugugauugcgcag

SEQ ID NO: 2628336 - RNA, 14 nt, Escherichia coli CFT073
aucagagaacgugg

SEQ ID NO: 2628337 - RNA, 21 nt, Escherichia coli CFT073
aucagaguauguauacaaaau

SEQ ID NO: 2628338 - RNA, 20 nt, Escherichia coli CFT073
aucagauaaucaacccccac

SEQ ID NO: 2628339 - RNA, 16 nt, Escherichia coli CFT073
aucagauaaucgccau

SEQ ID NO: 2628340 - RNA, 22 nt, Escherichia coli CFT073
aucagauaugcgcugucauuca

SEQ ID NO: 2628341 - RNA, 17 nt, Escherichia coli CFT073
aucagaucacgcaucac

SEQ ID NO: 2628342 - RNA, 23 nt, Escherichia coli CFT073
aucagaucgacgccgaugcccga

SEQ ID NO: 2628343 - RNA, 14 nt, Escherichia coli CFT073
aucagaucgcgacc

SEQ ID NO: 2628344 - RNA, 19 nt, Escherichia coli CFT073
aucagauggcggcuggcgc

SEQ ID NO: 2628345 - RNA, 23 nt, Escherichia coli CFT073
aucagauggcggcuggcgcaaua

SEQ ID NO: 2628346 - RNA, 20 nt, Escherichia coli CFT073
aucagauucgauagagaacg

SEQ ID NO: 2628347 - RNA, 16 nt, Escherichia coli CFT073
aucagauuggcuucac

SEQ ID NO: 2628348 - RNA, 13 nt, Escherichia coli CFT073
aucagcaaaaugg

SEQ ID NO: 2628349 - RNA, 13 nt, Escherichia coli CFT073
aucagcaacgccg

SEQ ID NO: 2628350 - RNA, 16 nt, Escherichia coli CFT073
aucagcaauaaaaaaa

SEQ ID NO: 2628351 - RNA, 15 nt, Escherichia coli CFT073
aucagcaauuucucc

SEQ ID NO: 2628352 - RNA, 22 nt, Escherichia coli CFT073
aucagcagauaccaacccuggu

SEQ ID NO: 2628353 - RNA, 18 nt, Escherichia coli CFT073
aucagcagauaucccgcc

SEQ ID NO: 2628354 - RNA, 13 nt, Escherichia coli CFT073
aucagcagaucca

SEQ ID NO: 2628355 - RNA, 15 nt, Escherichia coli CFT073
aucagcagcacaaac

SEQ ID NO: 2628356 - RNA, 14 nt, Escherichia coli CFT073
aucagcagcggcac

SEQ ID NO: 2628357 - RNA, 17 nt, Escherichia coli CFT073
aucagcagcguucccag

SEQ ID NO: 2628358 - RNA, 19 nt, Escherichia coli CFT073
aucagcagcguucccagcc

SEQ ID NO: 2628359 - RNA, 21 nt, Escherichia coli CFT073
aucagcagcguucccagccag

SEQ ID NO: 2628360 - RNA, 12 nt, Escherichia coli CFT073
aucagcaguauc

SEQ ID NO: 2628361 - RNA, 16 nt, Escherichia coli CFT073
aucagcauaaucacca

SEQ ID NO: 2628362 - RNA, 17 nt, Escherichia coli CFT073
aucagcauacuccagcc

SEQ ID NO: 2628363 - RNA, 18 nt, Escherichia coli CFT073
aucagcaucaacccgcuc

SEQ ID NO: 2628364 - RNA, 18 nt, Escherichia coli CFT073
aucagcaucccaccugaa

SEQ ID NO: 2628365 - RNA, 19 nt, Escherichia coli CFT073
aucagcaucccaccugaaa

SEQ ID NO: 2628366 - RNA, 17 nt, Escherichia coli CFT073
aucagcaucucauccau

SEQ ID NO: 2628367 - RNA, 19 nt, Escherichia coli CFT073
aucagcaucucauccauca

SEQ ID NO: 2628368 - RNA, 17 nt, Escherichia coli CFT073
aucagccacuucaacca

SEQ ID NO: 2628369 - RNA, 20 nt, Escherichia coli CFT073
aucagccacuucaaccagcg

SEQ ID NO: 2628370 - RNA, 22 nt, Escherichia coli CFT073
aucagccauaauaaccucaugg

SEQ ID NO: 2628371 - RNA, 22 nt, Escherichia coli CFT073
aucagccauuuugcacauucca

SEQ ID NO: 2628372 - RNA, 16 nt, Escherichia coli CFT073
aucagcccagcccuga

SEQ ID NO: 2628373 - RNA, 19 nt, Escherichia coli CFT073
aucagccguuucaccacga

SEQ ID NO: 2628374 - RNA, 19 nt, Escherichia coli CFT073
aucagccuuaaucuucacu

SEQ ID NO: 2628375 - RNA, 16 nt, Escherichia coli CFT073
aucagcgaagcgcauc

SEQ ID NO: 2628376 - RNA, 20 nt, Escherichia coli CFT073
aucagcgaagcgcaucaggc

SEQ ID NO: 2628377 - RNA, 24 nt, Escherichia coli CFT073
aucagcgaagcgcaucaggcaacg

SEQ ID NO: 2628378 - RNA, 14 nt, Escherichia coli CFT073
aucagcgcaccaua

SEQ ID NO: 2628379 - RNA, 19 nt, Escherichia coli CFT073
aucagcgcagcacccagaa

SEQ ID NO: 2628380 - RNA, 22 nt, Escherichia coli CFT073
aucagcgccaucgccaggaaca

SEQ ID NO: 2628381 - RNA, 16 nt, Escherichia coli CFT073
aucagcgccuuaccaa

SEQ ID NO: 2628382 - RNA, 24 nt, Escherichia coli CFT073
aucagcgcggcgauaauacccagc

SEQ ID NO: 2628383 - RNA, 23 nt, Escherichia coli CFT073
aucagcggcggcgcaaccaucag

SEQ ID NO: 2628384 - RNA, 19 nt, Escherichia coli CFT073
aucagcguaaaggccggaa

SEQ ID NO: 2628385 - RNA, 12 nt, Escherichia coli CFT073
aucagcgucagu

SEQ ID NO: 2628386 - RNA, 15 nt, Escherichia coli CFT073
aucagcguccagccc

SEQ ID NO: 2628387 - RNA, 19 nt, Escherichia coli CFT073
aucagcguccagcccuccu

SEQ ID NO: 2628388 - RNA, 16 nt, Escherichia coli CFT073
aucagcguuucgccau

SEQ ID NO: 2628389 - RNA, 21 nt, Escherichia coli CFT073
aucagcguuucuuccagccac

SEQ ID NO: 2628390 - RNA, 15 nt, Escherichia coli CFT073
aucagcuccggcagc

SEQ ID NO: 2628391 - RNA, 19 nt, Escherichia coli CFT073
aucagcuccgggcuaacac

SEQ ID NO: 2628392 - RNA, 22 nt, Escherichia coli CFT073
aucagcuuaccgccaaguuuca

SEQ ID NO: 2628393 - RNA, 15 nt, Escherichia coli CFT073
aucagcuuauccagc

SEQ ID NO: 2628394 - RNA, 17 nt, Escherichia coli CFT073
aucagcuuauccagcaa

SEQ ID NO: 2628395 - RNA, 23 nt, Escherichia coli CFT073
aucagcuucugcacgaugcugcg

SEQ ID NO: 2628396 - RNA, 18 nt, Escherichia coli CFT073
aucaggaaaaacggaaug

SEQ ID NO: 2628397 - RNA, 13 nt, Escherichia coli CFT073
aucaggcaacauc

SEQ ID NO: 2628398 - RNA, 18 nt, Escherichia coli CFT073
aucaggcaacccgcacaa

SEQ ID NO: 2628399 - RNA, 19 nt, Escherichia coli CFT073
aucaggcaacccgcacaag

SEQ ID NO: 2628400 - RNA, 16 nt, Escherichia coli CFT073
aucaggcaaucggcgc

SEQ ID NO: 2628401 - RNA, 13 nt, Escherichia coli CFT073
aucaggcagaaca

SEQ ID NO: 2628402 - RNA, 17 nt, Escherichia coli CFT073
aucaggcagaacgccau

SEQ ID NO: 2628403 - RNA, 20 nt, Escherichia coli CFT073
aucaggcagaacgccaugcc

SEQ ID NO: 2628404 - RNA, 22 nt, Escherichia coli CFT073
aucaggcagauacaaccaaucg

SEQ ID NO: 2628405 - RNA, 20 nt, Escherichia coli CFT073
aucaggcagugaauuucuac

SEQ ID NO: 2628406 - RNA, 16 nt, Escherichia coli CFT073
aucaggcaucgugcac

SEQ ID NO: 2628407 - RNA, 22 nt, Escherichia coli CFT073
aucaggcauuagugcgcaguug

SEQ ID NO: 2628408 - RNA, 12 nt, Escherichia coli CFT073
aucaggcauuau

SEQ ID NO: 2628409 - RNA, 22 nt, Escherichia coli CFT073
aucaggcauuauggcgcaguug

SEQ ID NO: 2628410 - RNA, 17 nt, Escherichia coli CFT073
aucaggccaaacagacc

SEQ ID NO: 2628411 - RNA, 18 nt, Escherichia coli CFT073
aucaggccaaacagacca

SEQ ID NO: 2628412 - RNA, 23 nt, Escherichia coli CFT073
aucaggccaccucgcaacaaugu

SEQ ID NO: 2628413 - RNA, 13 nt, Escherichia coli CFT073
aucaggccaggcg

SEQ ID NO: 2628414 - RNA, 14 nt, Escherichia coli CFT073
aucaggcccacuac

SEQ ID NO: 2628415 - RNA, 13 nt, Escherichia coli CFT073
aucaggcccgcgu

SEQ ID NO: 2628416 - RNA, 17 nt, Escherichia coli CFT073
aucaggccuacaauccc

SEQ ID NO: 2628417 - RNA, 19 nt, Escherichia coli CFT073
aucaggccuacaggugcac

SEQ ID NO: 2628418 - RNA, 18 nt, Escherichia coli CFT073
aucaggccuacaugccau

SEQ ID NO: 2628419 - RNA, 18 nt, Escherichia coli CFT073
aucaggccuacauuggug

SEQ ID NO: 2628420 - RNA, 16 nt, Escherichia coli CFT073
aucaggccuccgguga

SEQ ID NO: 2628421 - RNA, 13 nt, Escherichia coli CFT073
aucaggccugcaa

SEQ ID NO: 2628422 - RNA, 22 nt, Escherichia coli CFT073
aucaggcgaauaaauuccgcuc

SEQ ID NO: 2628423 - RNA, 14 nt, Escherichia coli CFT073
aucaggcuaucuuc

SEQ ID NO: 2628424 - RNA, 21 nt, Escherichia coli CFT073
aucaggcugaaaaucuucucu

SEQ ID NO: 2628425 - RNA, 13 nt, Escherichia coli CFT073
aucaggcugcugg

SEQ ID NO: 2628426 - RNA, 13 nt, Escherichia coli CFT073
aucaggcuggugu

SEQ ID NO: 2628427 - RNA, 22 nt, Escherichia coli CFT073
aucagggcgaugcgggauguau

SEQ ID NO: 2628428 - RNA, 15 nt, Escherichia coli CFT073
aucaggguguaggca

SEQ ID NO: 2628429 - RNA, 14 nt, Escherichia coli CFT073
aucagguaagcgaa

SEQ ID NO: 2628430 - RNA, 20 nt, Escherichia coli CFT073
aucagguaagcgauaaaaau

SEQ ID NO: 2628431 - RNA, 17 nt, Escherichia coli CFT073
aucagguaauuuugcuu

SEQ ID NO: 2628432 - RNA, 22 nt, Escherichia coli CFT073
aucaggucaucaaucaguucau

SEQ ID NO: 2628433 - RNA, 13 nt, Escherichia coli CFT073
aucaggucgaaaa

SEQ ID NO: 2628434 - RNA, 14 nt, Escherichia coli CFT073
aucaggucgaaaau

SEQ ID NO: 2628435 - RNA, 15 nt, Escherichia coli CFT073
aucagguguaauaaa

SEQ ID NO: 2628436 - RNA, 19 nt, Escherichia coli CFT073
aucagguguaauaaaguca

SEQ ID NO: 2628437 - RNA, 20 nt, Escherichia coli CFT073
aucagguugaggaacuucca

SEQ ID NO: 2628438 - RNA, 13 nt, Escherichia coli CFT073
aucaguaccaaag

SEQ ID NO: 2628439 - RNA, 22 nt, Escherichia coli CFT073
aucaguaccagcccgccgagaa

SEQ ID NO: 2628440 - RNA, 18 nt, Escherichia coli CFT073
aucaguacgcacaaugcc

SEQ ID NO: 2628441 - RNA, 16 nt, Escherichia coli CFT073
aucaguagcauccccg

SEQ ID NO: 2628442 - RNA, 13 nt, Escherichia coli CFT073
aucagucccugaa

SEQ ID NO: 2628443 - RNA, 15 nt, Escherichia coli CFT073
aucaguccguugucu

SEQ ID NO: 2628444 - RNA, 19 nt, Escherichia coli CFT073
aucaguccguugucuguaa

SEQ ID NO: 2628445 - RNA, 18 nt, Escherichia coli CFT073
aucagugcaaucagcggc

SEQ ID NO: 2628446 - RNA, 13 nt, Escherichia coli CFT073
aucaguuuaucaa

SEQ ID NO: 2628447 - RNA, 15 nt, Escherichia coli CFT073
aucaguuuaucaauc

SEQ ID NO: 2628448 - RNA, 14 nt, Escherichia coli CFT073
aucaguuuauccau

SEQ ID NO: 2628449 - RNA, 12 nt, Escherichia coli CFT073
aucaguuucaga

SEQ ID NO: 2628450 - RNA, 13 nt, Escherichia coli CFT073
aucaguuucagag

SEQ ID NO: 2628451 - RNA, 12 nt, Escherichia coli CFT073
aucaguuucauu

SEQ ID NO: 2628452 - RNA, 17 nt, Escherichia coli CFT073
aucauaaccaacaaaac

SEQ ID NO: 2628453 - RNA, 15 nt, Escherichia coli CFT073
aucauacugaacuua

SEQ ID NO: 2628454 - RNA, 18 nt, Escherichia coli CFT073
aucauagcgaauaauccc

SEQ ID NO: 2628455 - RNA, 19 nt, Escherichia coli CFT073
aucauagcgaauaaucccg

SEQ ID NO: 2628456 - RNA, 21 nt, Escherichia coli CFT073
aucauagcgaauaaucccggc

SEQ ID NO: 2628457 - RNA, 23 nt, Escherichia coli CFT073
aucauaguaaguguuguauuaua

SEQ ID NO: 2628458 - RNA, 19 nt, Escherichia coli CFT073
aucauaucccggcugaaua

SEQ ID NO: 2628459 - RNA, 16 nt, Escherichia coli CFT073
aucauaugcacaauca

SEQ ID NO: 2628460 - RNA, 18 nt, Escherichia coli CFT073
aucauaugcacaaucagc

SEQ ID NO: 2628461 - RNA, 17 nt, Escherichia coli CFT073
aucauauuguccuguac

SEQ ID NO: 2628462 - RNA, 14 nt, Escherichia coli CFT073
aucaucaaagccaa

SEQ ID NO: 2628463 - RNA, 12 nt, Escherichia coli CFT073
aucaucaagcac

SEQ ID NO: 2628464 - RNA, 14 nt, Escherichia coli CFT073
aucaucaagcacuu

SEQ ID NO: 2628465 - RNA, 12 nt, Escherichia coli CFT073
aucaucaauaug

SEQ ID NO: 2628466 - RNA, 14 nt, Escherichia coli CFT073
aucaucacccugcg

SEQ ID NO: 2628467 - RNA, 16 nt, Escherichia coli CFT073
aucaucacccugcgau

SEQ ID NO: 2628468 - RNA, 20 nt, Escherichia coli CFT073
aucaucacgcagagcaucau

SEQ ID NO: 2628469 - RNA, 13 nt, Escherichia coli CFT073
aucaucagaaaug

SEQ ID NO: 2628470 - RNA, 17 nt, Escherichia coli CFT073
aucaucaggcaugaggg

SEQ ID NO: 2628471 - RNA, 16 nt, Escherichia coli CFT073
aucaucaugcuuaaau

SEQ ID NO: 2628472 - RNA, 19 nt, Escherichia coli CFT073
aucaucaugcuuaaauauu

SEQ ID NO: 2628473 - RNA, 23 nt, Escherichia coli CFT073
aucaucauucccuacgcgauaaa

SEQ ID NO: 2628474 - RNA, 15 nt, Escherichia coli CFT073
aucaucauuguuggu

SEQ ID NO: 2628475 - RNA, 24 nt, Escherichia coli CFT073
aucaucauuguugguuaaauaaua

SEQ ID NO: 2628476 - RNA, 14 nt, Escherichia coli CFT073
aucauccacccgca

SEQ ID NO: 2628477 - RNA, 13 nt, Escherichia coli CFT073
aucauccagcacg

SEQ ID NO: 2628478 - RNA, 18 nt, Escherichia coli CFT073
aucauccaggcuuuaaac

SEQ ID NO: 2628479 - RNA, 17 nt, Escherichia coli CFT073
aucauccccguaucuuc

SEQ ID NO: 2628480 - RNA, 22 nt, Escherichia coli CFT073
aucauccccguaucuucaugcu

SEQ ID NO: 2628481 - RNA, 22 nt, Escherichia coli CFT073
aucaucccuaaugucgacauaa

SEQ ID NO: 2628482 - RNA, 15 nt, Escherichia coli CFT073
aucauccggcacuuu

SEQ ID NO: 2628483 - RNA, 19 nt, Escherichia coli CFT073
aucauccggcacuuuuuca

SEQ ID NO: 2628484 - RNA, 13 nt, Escherichia coli CFT073
aucauccgugaau

SEQ ID NO: 2628485 - RNA, 13 nt, Escherichia coli CFT073
aucauccucuuca

SEQ ID NO: 2628486 - RNA, 11 nt, Escherichia coli CFT073
aucauccugau

SEQ ID NO: 2628487 - RNA, 18 nt, Escherichia coli CFT073
aucaucgacauugaccag

SEQ ID NO: 2628488 - RNA, 16 nt, Escherichia coli CFT073
aucaucgacuccagcg

SEQ ID NO: 2628489 - RNA, 22 nt, Escherichia coli CFT073
aucaucgccccgcucacgcagc

SEQ ID NO: 2628490 - RNA, 19 nt, Escherichia coli CFT073
aucaucgccuuaugcugcu

SEQ ID NO: 2628491 - RNA, 23 nt, Escherichia coli CFT073
aucaucgcgaucccccagaaaau

SEQ ID NO: 2628492 - RNA, 17 nt, Escherichia coli CFT073
aucaucgcggcacacag

SEQ ID NO: 2628493 - RNA, 15 nt, Escherichia coli CFT073
aucaucgcuuucaaa

SEQ ID NO: 2628494 - RNA, 21 nt, Escherichia coli CFT073
aucaucggcaccgccagcagg

SEQ ID NO: 2628495 - RNA, 15 nt, Escherichia coli CFT073
aucaucggcugcgcu

SEQ ID NO: 2628496 - RNA, 13 nt, Escherichia coli CFT073
aucaucgggaaga

SEQ ID NO: 2628497 - RNA, 22 nt, Escherichia coli CFT073
aucaucgucguuucuuuuuuau

SEQ ID NO: 2628498 - RNA, 22 nt, Escherichia coli CFT073
aucaucucacgcaguuuaucca

SEQ ID NO: 2628499 - RNA, 17 nt, Escherichia coli CFT073
aucaucuggcugugauc

SEQ ID NO: 2628500 - RNA, 22 nt, Escherichia coli CFT073
aucaucugguuccuaaauaacc

SEQ ID NO: 2628501 - RNA, 23 nt, Escherichia coli CFT073
aucaucuguugugccacauccag

SEQ ID NO: 2628502 - RNA, 15 nt, Escherichia coli CFT073
aucaugaaacgccca

SEQ ID NO: 2628503 - RNA, 17 nt, Escherichia coli CFT073
aucaugaaacuggguau

SEQ ID NO: 2628504 - RNA, 16 nt, Escherichia coli CFT073
aucaugaugaugccaa

SEQ ID NO: 2628505 - RNA, 17 nt, Escherichia coli CFT073
aucaugaugaugccaaa

SEQ ID NO: 2628506 - RNA, 19 nt, Escherichia coli CFT073
aucaugcagcgcagaccau

SEQ ID NO: 2628507 - RNA, 19 nt, Escherichia coli CFT073
aucaugccggccagcgcca

SEQ ID NO: 2628508 - RNA, 22 nt, Escherichia coli CFT073
aucaugccggccagcgccacca

SEQ ID NO: 2628509 - RNA, 17 nt, Escherichia coli CFT073
aucaugcggauuaauaa

SEQ ID NO: 2628510 - RNA, 20 nt, Escherichia coli CFT073
aucaugcuccuguaauggcu

SEQ ID NO: 2628511 - RNA, 20 nt, Escherichia coli CFT073
aucaugcugccgagcgcaag

SEQ ID NO: 2628512 - RNA, 17 nt, Escherichia coli CFT073
aucauggcauccuguuu

SEQ ID NO: 2628513 - RNA, 23 nt, Escherichia coli CFT073
aucauggcgggcgucgaucucuu

SEQ ID NO: 2628514 - RNA, 14 nt, Escherichia coli CFT073
aucauggcucagau

SEQ ID NO: 2628515 - RNA, 16 nt, Escherichia coli CFT073
aucauguaguaaugcu

SEQ ID NO: 2628516 - RNA, 13 nt, Escherichia coli CFT073
aucauguggcugg

SEQ ID NO: 2628517 - RNA, 14 nt, Escherichia coli CFT073
aucauguggcugga

SEQ ID NO: 2628518 - RNA, 14 nt, Escherichia coli CFT073
aucauuaacugcug

SEQ ID NO: 2628519 - RNA, 15 nt, Escherichia coli CFT073
aucauuacaacgcaa

SEQ ID NO: 2628520 - RNA, 16 nt, Escherichia coli CFT073
aucauuaccggcacug

SEQ ID NO: 2628521 - RNA, 16 nt, Escherichia coli CFT073
aucauuaccugagccu

SEQ ID NO: 2628522 - RNA, 23 nt, Escherichia coli CFT073
aucauuagcccuauaaucaccgu

SEQ ID NO: 2628523 - RNA, 15 nt, Escherichia coli CFT073
aucauuagucacaaa

SEQ ID NO: 2628524 - RNA, 21 nt, Escherichia coli CFT073
aucauuagucacaaaucuccc

SEQ ID NO: 2628525 - RNA, 22 nt, Escherichia coli CFT073
aucauuaugccggguuauccaa

SEQ ID NO: 2628526 - RNA, 23 nt, Escherichia coli CFT073
aucauucccuacgcgauaaaaaa

SEQ ID NO: 2628527 - RNA, 22 nt, Escherichia coli CFT073
aucauuccguagcguuuuuuca

SEQ ID NO: 2628528 - RNA, 15 nt, Escherichia coli CFT073
aucauucgcagcugc

SEQ ID NO: 2628529 - RNA, 16 nt, Escherichia coli CFT073
aucauucgcagcugca

SEQ ID NO: 2628530 - RNA, 17 nt, Escherichia coli CFT073
aucauucgcagcugcag

SEQ ID NO: 2628531 - RNA, 18 nt, Escherichia coli CFT073
aucauucgcccgccgaga

SEQ ID NO: 2628532 - RNA, 20 nt, Escherichia coli CFT073
aucauugccgguuggcgacu

SEQ ID NO: 2628533 - RNA, 20 nt, Escherichia coli CFT073
aucauugcgccgaacaacag

SEQ ID NO: 2628534 - RNA, 16 nt, Escherichia coli CFT073
aucauugguuaacucc

SEQ ID NO: 2628535 - RNA, 23 nt, Escherichia coli CFT073
aucauuucauuuggauggaaaau

SEQ ID NO: 2628536 - RNA, 17 nt, Escherichia coli CFT073
aucauuuucaugcuguu

SEQ ID NO: 2628537 - RNA, 15 nt, Escherichia coli CFT073
auccaaacauggcac

SEQ ID NO: 2628538 - RNA, 17 nt, Escherichia coli CFT073
auccaaacuuacccuuc

SEQ ID NO: 2628539 - RNA, 19 nt, Escherichia coli CFT073
auccaacuccacgaucuuu

SEQ ID NO: 2628540 - RNA, 20 nt, Escherichia coli CFT073
auccaacugauuuucaucuu

SEQ ID NO: 2628541 - RNA, 14 nt, Escherichia coli CFT073
auccaacugugaau

SEQ ID NO: 2628542 - RNA, 20 nt, Escherichia coli CFT073
auccaacuuuucccagcgcg

SEQ ID NO: 2628543 - RNA, 12 nt, Escherichia coli CFT073
auccacaccuga

SEQ ID NO: 2628544 - RNA, 19 nt, Escherichia coli CFT073
auccacacugguucccaga

SEQ ID NO: 2628545 - RNA, 13 nt, Escherichia coli CFT073
auccacagcaaug

SEQ ID NO: 2628546 - RNA, 16 nt, Escherichia coli CFT073
auccacagcaaugcau

SEQ ID NO: 2628547 - RNA, 14 nt, Escherichia coli CFT073
auccaccagugacu

SEQ ID NO: 2628548 - RNA, 13 nt, Escherichia coli CFT073
auccacccgcagc

SEQ ID NO: 2628549 - RNA, 16 nt, Escherichia coli CFT073
auccacccgcagcaag

SEQ ID NO: 2628550 - RNA, 21 nt, Escherichia coli CFT073
auccaccgacacuacaaauuu

SEQ ID NO: 2628551 - RNA, 22 nt, Escherichia coli CFT073
auccaccgacacuacaaauuua

SEQ ID NO: 2628552 - RNA, 22 nt, Escherichia coli CFT073
auccaccgcguuuagcaguuca

SEQ ID NO: 2628553 - RNA, 19 nt, Escherichia coli CFT073
auccaccguuggcagauaa

SEQ ID NO: 2628554 - RNA, 21 nt, Escherichia coli CFT073
auccaccguuggcagauaacc

SEQ ID NO: 2628555 - RNA, 22 nt, Escherichia coli CFT073
auccaccuucuguaacuggaag

SEQ ID NO: 2628556 - RNA, 19 nt, Escherichia coli CFT073
auccacgcauuaauaaggu

SEQ ID NO: 2628557 - RNA, 18 nt, Escherichia coli CFT073
auccacgccuuuuuucac

SEQ ID NO: 2628558 - RNA, 20 nt, Escherichia coli CFT073
auccacgcuguaaugcuaua

SEQ ID NO: 2628559 - RNA, 23 nt, Escherichia coli CFT073
auccacuacgcuguagccgccau

SEQ ID NO: 2628560 - RNA, 20 nt, Escherichia coli CFT073
auccacugaaacaugaacau

SEQ ID NO: 2628561 - RNA, 18 nt, Escherichia coli CFT073
auccagacccagcuucag

SEQ ID NO: 2628562 - RNA, 13 nt, Escherichia coli CFT073
auccagacggcgc

SEQ ID NO: 2628563 - RNA, 21 nt, Escherichia coli CFT073
auccagacugcgcauuaaaua

SEQ ID NO: 2628564 - RNA, 21 nt, Escherichia coli CFT073
auccagauaaaacaucucuuc

SEQ ID NO: 2628565 - RNA, 16 nt, Escherichia coli CFT073
auccagaucacgcagc

SEQ ID NO: 2628566 - RNA, 14 nt, Escherichia coli CFT073
auccagaugucuuu

SEQ ID NO: 2628567 - RNA, 10 nt, Escherichia coli CFT073
auccagcaac

SEQ ID NO: 2628568 - RNA, 16 nt, Escherichia coli CFT073
auccagcaacaacagc

SEQ ID NO: 2628569 - RNA, 12 nt, Escherichia coli CFT073
auccagcaacgu

SEQ ID NO: 2628570 - RNA, 19 nt, Escherichia coli CFT073
auccagcaccacuacagcg

SEQ ID NO: 2628571 - RNA, 22 nt, Escherichia coli CFT073
auccagcaccacuacagcggaa

SEQ ID NO: 2628572 - RNA, 13 nt, Escherichia coli CFT073
auccagcaccgcu

SEQ ID NO: 2628573 - RNA, 14 nt, Escherichia coli CFT073
auccagcaccgcuu

SEQ ID NO: 2628574 - RNA, 14 nt, Escherichia coli CFT073
auccagcagaugcu

SEQ ID NO: 2628575 - RNA, 19 nt, Escherichia coli CFT073
auccagcagcgacucacga

SEQ ID NO: 2628576 - RNA, 22 nt, Escherichia coli CFT073
auccagcaguggaucgaacucc

SEQ ID NO: 2628577 - RNA, 15 nt, Escherichia coli CFT073
auccagcauaccuuc

SEQ ID NO: 2628578 - RNA, 14 nt, Escherichia coli CFT073
auccagcaugcuca

SEQ ID NO: 2628579 - RNA, 13 nt, Escherichia coli CFT073
auccagccaaaca

SEQ ID NO: 2628580 - RNA, 14 nt, Escherichia coli CFT073
auccagccaaacau

SEQ ID NO: 2628581 - RNA, 14 nt, Escherichia coli CFT073
auccagccacggcu

SEQ ID NO: 2628582 - RNA, 17 nt, Escherichia coli CFT073
auccagccacggcucca

SEQ ID NO: 2628583 - RNA, 18 nt, Escherichia coli CFT073
auccagccacggcuccag

SEQ ID NO: 2628584 - RNA, 18 nt, Escherichia coli CFT073
auccagccagcgccgcgc

SEQ ID NO: 2628585 - RNA, 17 nt, Escherichia coli CFT073
auccagccccaccagca

SEQ ID NO: 2628586 - RNA, 18 nt, Escherichia coli CFT073
auccagccccaccagcaa

SEQ ID NO: 2628587 - RNA, 19 nt, Escherichia coli CFT073
auccagccccaccagcaaa

SEQ ID NO: 2628588 - RNA, 16 nt, Escherichia coli CFT073
auccagccgcccagcg

SEQ ID NO: 2628589 - RNA, 22 nt, Escherichia coli CFT073
auccagcgcacgggcaguuaau

SEQ ID NO: 2628590 - RNA, 12 nt, Escherichia coli CFT073
auccagcggcaa

SEQ ID NO: 2628591 - RNA, 12 nt, Escherichia coli CFT073
auccagcggcag

SEQ ID NO: 2628592 - RNA, 21 nt, Escherichia coli CFT073
auccagcggugcgcgauuaug

SEQ ID NO: 2628593 - RNA, 15 nt, Escherichia coli CFT073
auccagcguguucgu

SEQ ID NO: 2628594 - RNA, 18 nt, Escherichia coli CFT073
auccagcucaagugccag

SEQ ID NO: 2628595 - RNA, 20 nt, Escherichia coli CFT073
auccagcucaagugccagau

SEQ ID NO: 2628596 - RNA, 14 nt, Escherichia coli CFT073
auccagcucuuccu

SEQ ID NO: 2628597 - RNA, 22 nt, Escherichia coli CFT073
auccagcuucgccagcgcgcgg

SEQ ID NO: 2628598 - RNA, 13 nt, Escherichia coli CFT073
auccaggcacugg

SEQ ID NO: 2628599 - RNA, 13 nt, Escherichia coli CFT073
auccaggccaaaa

SEQ ID NO: 2628600 - RNA, 23 nt, Escherichia coli CFT073
auccaggccacucaugccuuuca

SEQ ID NO: 2628601 - RNA, 16 nt, Escherichia coli CFT073
auccaggccagauauc

SEQ ID NO: 2628602 - RNA, 22 nt, Escherichia coli CFT073
auccaggcccgcgugccggaag

SEQ ID NO: 2628603 - RNA, 19 nt, Escherichia coli CFT073
auccagggguuguuauuuc

SEQ ID NO: 2628604 - RNA, 16 nt, Escherichia coli CFT073
auccagguagcaaaca

SEQ ID NO: 2628605 - RNA, 17 nt, Escherichia coli CFT073
auccagguagcaaacaa

SEQ ID NO: 2628606 - RNA, 14 nt, Escherichia coli CFT073
auccaggugaaaaa

SEQ ID NO: 2628607 - RNA, 16 nt, Escherichia coli CFT073
auccagguuacgcaug

SEQ ID NO: 2628608 - RNA, 17 nt, Escherichia coli CFT073
auccagguuacgcaugg

SEQ ID NO: 2628609 - RNA, 14 nt, Escherichia coli CFT073
auccaguacaugaa

SEQ ID NO: 2628610 - RNA, 22 nt, Escherichia coli CFT073
auccaguacaugaagcacggca

SEQ ID NO: 2628611 - RNA, 14 nt, Escherichia coli CFT073
auccaguaccugau

SEQ ID NO: 2628612 - RNA, 13 nt, Escherichia coli CFT073
auccaguagaaua

SEQ ID NO: 2628613 - RNA, 21 nt, Escherichia coli CFT073
auccaguauauugcugauuuu

SEQ ID NO: 2628614 - RNA, 22 nt, Escherichia coli CFT073
auccaguauauugcugauuuuc

SEQ ID NO: 2628615 - RNA, 13 nt, Escherichia coli CFT073
auccagucagcgg

SEQ ID NO: 2628616 - RNA, 19 nt, Escherichia coli CFT073
auccagugccgcagcggcg

SEQ ID NO: 2628617 - RNA, 14 nt, Escherichia coli CFT073
auccagugccgccg

SEQ ID NO: 2628618 - RNA, 20 nt, Escherichia coli CFT073
auccagugcucauccuucag

SEQ ID NO: 2628619 - RNA, 13 nt, Escherichia coli CFT073
auccaguuccagu

SEQ ID NO: 2628620 - RNA, 17 nt, Escherichia coli CFT073
auccaguugcgccgcau

SEQ ID NO: 2628621 - RNA, 13 nt, Escherichia coli CFT073
auccauaccacag

SEQ ID NO: 2628622 - RNA, 16 nt, Escherichia coli CFT073
auccauaccagcacau

SEQ ID NO: 2628623 - RNA, 19 nt, Escherichia coli CFT073
auccauaccagcacauaac

SEQ ID NO: 2628624 - RNA, 22 nt, Escherichia coli CFT073
auccauaguguguuccucugcu

SEQ ID NO: 2628625 - RNA, 14 nt, Escherichia coli CFT073
auccauaucgccau

SEQ ID NO: 2628626 - RNA, 20 nt, Escherichia coli CFT073
auccauaucgccauugcugg

SEQ ID NO: 2628627 - RNA, 17 nt, Escherichia coli CFT073
auccauauucagcgcca

SEQ ID NO: 2628628 - RNA, 19 nt, Escherichia coli CFT073
auccauauuuuuugaaaaa

SEQ ID NO: 2628629 - RNA, 22 nt, Escherichia coli CFT073
auccauauuuuuugaaaaaugc

SEQ ID NO: 2628630 - RNA, 13 nt, Escherichia coli CFT073
auccaucaaaggu

SEQ ID NO: 2628631 - RNA, 14 nt, Escherichia coli CFT073
auccaucaaagguu

SEQ ID NO: 2628632 - RNA, 16 nt, Escherichia coli CFT073
auccaucagaccuucg

SEQ ID NO: 2628633 - RNA, 19 nt, Escherichia coli CFT073
auccaucagacuuugcgcc

SEQ ID NO: 2628634 - RNA, 18 nt, Escherichia coli CFT073
auccaucguugaauacau

SEQ ID NO: 2628635 - RNA, 16 nt, Escherichia coli CFT073
auccaugaagcaauga

SEQ ID NO: 2628636 - RNA, 23 nt, Escherichia coli CFT073
auccaugauauuggcaucgccag

SEQ ID NO: 2628637 - RNA, 18 nt, Escherichia coli CFT073
auccaugcgcauaagacc

SEQ ID NO: 2628638 - RNA, 23 nt, Escherichia coli CFT073
auccaugcggcagagaucgccgc

SEQ ID NO: 2628639 - RNA, 14 nt, Escherichia coli CFT073
auccaugcuuguuu

SEQ ID NO: 2628640 - RNA, 14 nt, Escherichia coli CFT073
auccauuacaucac

SEQ ID NO: 2628641 - RNA, 23 nt, Escherichia coli CFT073
auccauuacaucacgacgaccac

SEQ ID NO: 2628642 - RNA, 18 nt, Escherichia coli CFT073
auccauuaugauuaucag

SEQ ID NO: 2628643 - RNA, 21 nt, Escherichia coli CFT073
auccauucaucacgcacugca

SEQ ID NO: 2628644 - RNA, 20 nt, Escherichia coli CFT073
auccauucgaugagagcggu

SEQ ID NO: 2628645 - RNA, 12 nt, Escherichia coli CFT073
aucccacacugu

SEQ ID NO: 2628646 - RNA, 22 nt, Escherichia coli CFT073
aucccacauccgaccaaagaau

SEQ ID NO: 2628647 - RNA, 16 nt, Escherichia coli CFT073
aucccagcagagaucu

SEQ ID NO: 2628648 - RNA, 18 nt, Escherichia coli CFT073
aucccagccaaugcaggc

SEQ ID NO: 2628649 - RNA, 14 nt, Escherichia coli CFT073
aucccagcccagcg

SEQ ID NO: 2628650 - RNA, 19 nt, Escherichia coli CFT073
aucccagcguuuaucaaua

SEQ ID NO: 2628651 - RNA, 15 nt, Escherichia coli CFT073
aucccaggcauccag

SEQ ID NO: 2628652 - RNA, 12 nt, Escherichia coli CFT073
aucccagugcag

SEQ ID NO: 2628653 - RNA, 15 nt, Escherichia coli CFT073
aucccauuuacuggc

SEQ ID NO: 2628654 - RNA, 21 nt, Escherichia coli CFT073
aucccauuuacuggcaucaau

SEQ ID NO: 2628655 - RNA, 16 nt, Escherichia coli CFT073
aucccauuucuccacu

SEQ ID NO: 2628656 - RNA, 23 nt, Escherichia coli CFT073
auccccaauacgauuaacgccag

SEQ ID NO: 2628657 - RNA, 12 nt, Escherichia coli CFT073
auccccacaaac

SEQ ID NO: 2628658 - RNA, 18 nt, Escherichia coli CFT073
auccccagacaaaagcga

SEQ ID NO: 2628659 - RNA, 13 nt, Escherichia coli CFT073
auccccagccuaa

SEQ ID NO: 2628660 - RNA, 12 nt, Escherichia coli CFT073
aucccccacuuu

SEQ ID NO: 2628661 - RNA, 13 nt, Escherichia coli CFT073
aucccccagcacu

SEQ ID NO: 2628662 - RNA, 13 nt, Escherichia coli CFT073
auccccgauggug

SEQ ID NO: 2628663 - RNA, 19 nt, Escherichia coli CFT073
auccccgcgcggaacauga

SEQ ID NO: 2628664 - RNA, 20 nt, Escherichia coli CFT073
auccccgcgcggaacaugaa

SEQ ID NO: 2628665 - RNA, 15 nt, Escherichia coli CFT073
auccccggcaggaag

SEQ ID NO: 2628666 - RNA, 18 nt, Escherichia coli CFT073
auccccggcaggaaguaa

SEQ ID NO: 2628667 - RNA, 14 nt, Escherichia coli CFT073
auccccguaucuuc

SEQ ID NO: 2628668 - RNA, 13 nt, Escherichia coli CFT073
auccccucaauaa

SEQ ID NO: 2628669 - RNA, 14 nt, Escherichia coli CFT073
auccccugaaauau

SEQ ID NO: 2628670 - RNA, 14 nt, Escherichia coli CFT073
auccccugccccau

SEQ ID NO: 2628671 - RNA, 21 nt, Escherichia coli CFT073
auccccugcccgauaaaagca

SEQ ID NO: 2628672 - RNA, 20 nt, Escherichia coli CFT073
auccccuucauuaagaauca

SEQ ID NO: 2628673 - RNA, 13 nt, Escherichia coli CFT073
aucccgccgcuuc

SEQ ID NO: 2628674 - RNA, 15 nt, Escherichia coli CFT073
aucccgcgacggaag

SEQ ID NO: 2628675 - RNA, 19 nt, Escherichia coli CFT073
aucccgcgacggaagcuua

SEQ ID NO: 2628676 - RNA, 20 nt, Escherichia coli CFT073
aucccgcucuguaagacauu

SEQ ID NO: 2628677 - RNA, 23 nt, Escherichia coli CFT073
aucccggcaccaaucaccgccaa

SEQ ID NO: 2628678 - RNA, 22 nt, Escherichia coli CFT073
aucccggcagagaaaaugccgc

SEQ ID NO: 2628679 - RNA, 20 nt, Escherichia coli CFT073
aucccgguauaacuugccag

SEQ ID NO: 2628680 - RNA, 22 nt, Escherichia coli CFT073
aucccgguaucaaagcgccaga

SEQ ID NO: 2628681 - RNA, 21 nt, Escherichia coli CFT073
aucccggucaugauacagccg

SEQ ID NO: 2628682 - RNA, 14 nt, Escherichia coli CFT073
aucccguacaguuu

SEQ ID NO: 2628683 - RNA, 13 nt, Escherichia coli CFT073
aucccgugccugc

SEQ ID NO: 2628684 - RNA, 12 nt, Escherichia coli CFT073
aucccguucagc

SEQ ID NO: 2628685 - RNA, 18 nt, Escherichia coli CFT073
aucccguugaaaaugcug

SEQ ID NO: 2628686 - RNA, 14 nt, Escherichia coli CFT073
aucccuaacuggcg

SEQ ID NO: 2628687 - RNA, 17 nt, Escherichia coli CFT073
aucccucacgcuucuga

SEQ ID NO: 2628688 - RNA, 14 nt, Escherichia coli CFT073
aucccucuucggua

SEQ ID NO: 2628689 - RNA, 17 nt, Escherichia coli CFT073
aucccugaaaugugcgc

SEQ ID NO: 2628690 - RNA, 20 nt, Escherichia coli CFT073
aucccugaccuuaauaaacu

SEQ ID NO: 2628691 - RNA, 11 nt, Escherichia coli CFT073
aucccugcaac

SEQ ID NO: 2628692 - RNA, 15 nt, Escherichia coli CFT073
aucccugcaacauca

SEQ ID NO: 2628693 - RNA, 16 nt, Escherichia coli CFT073
aucccugcaccaauga

SEQ ID NO: 2628694 - RNA, 16 nt, Escherichia coli CFT073
aucccugccgccauca

SEQ ID NO: 2628695 - RNA, 15 nt, Escherichia coli CFT073
aucccugcuguccug

SEQ ID NO: 2628696 - RNA, 22 nt, Escherichia coli CFT073
aucccuguucauaugcuuguuu

SEQ ID NO: 2628697 - RNA, 14 nt, Escherichia coli CFT073
aucccuucaauuau

SEQ ID NO: 2628698 - RNA, 19 nt, Escherichia coli CFT073
aucccuucgcuggcaaagc

SEQ ID NO: 2628699 - RNA, 16 nt, Escherichia coli CFT073
aucccuuuguaagcag

SEQ ID NO: 2628700 - RNA, 20 nt, Escherichia coli CFT073
auccgaacgcugacaaacug

SEQ ID NO: 2628701 - RNA, 21 nt, Escherichia coli CFT073
auccgacaaaaugaugucaac

SEQ ID NO: 2628702 - RNA, 14 nt, Escherichia coli CFT073
auccgacaucaacg

SEQ ID NO: 2628703 - RNA, 20 nt, Escherichia coli CFT073
auccgaccuacacucggcac

SEQ ID NO: 2628704 - RNA, 17 nt, Escherichia coli CFT073
auccgaccuacagggaa

SEQ ID NO: 2628705 - RNA, 20 nt, Escherichia coli CFT073
auccgaccugcggggaugaa

SEQ ID NO: 2628706 - RNA, 20 nt, Escherichia coli CFT073
auccgacguuacgcgccaau

SEQ ID NO: 2628707 - RNA, 22 nt, Escherichia coli CFT073
auccgacuugucaggcggauaa

SEQ ID NO: 2628708 - RNA, 18 nt, Escherichia coli CFT073
auccgaucauuagcugga

SEQ ID NO: 2628709 - RNA, 13 nt, Escherichia coli CFT073
auccgauccucac

SEQ ID NO: 2628710 - RNA, 21 nt, Escherichia coli CFT073
auccgcaauuucuggccaugc

SEQ ID NO: 2628711 - RNA, 17 nt, Escherichia coli CFT073
auccgcacaaucccuua

SEQ ID NO: 2628712 - RNA, 19 nt, Escherichia coli CFT073
auccgcacccgcacgcuua

SEQ ID NO: 2628713 - RNA, 14 nt, Escherichia coli CFT073
auccgccacuucuu

SEQ ID NO: 2628714 - RNA, 23 nt, Escherichia coli CFT073
auccgccacuucuuuuugaacga

SEQ ID NO: 2628715 - RNA, 12 nt, Escherichia coli CFT073
auccgccagcag

SEQ ID NO: 2628716 - RNA, 19 nt, Escherichia coli CFT073
auccgccagccaauugcca

SEQ ID NO: 2628717 - RNA, 13 nt, Escherichia coli CFT073
auccgccaguuug

SEQ ID NO: 2628718 - RNA, 14 nt, Escherichia coli CFT073
auccgccauaucac

SEQ ID NO: 2628719 - RNA, 15 nt, Escherichia coli CFT073
auccgccccggcuuc

SEQ ID NO: 2628720 - RNA, 17 nt, Escherichia coli CFT073
auccgcgauuaucccau

SEQ ID NO: 2628721 - RNA, 21 nt, Escherichia coli CFT073
auccgcgucauugacgcuggc

SEQ ID NO: 2628722 - RNA, 18 nt, Escherichia coli CFT073
auccgcucgucaaaaaca

SEQ ID NO: 2628723 - RNA, 15 nt, Escherichia coli CFT073
auccgcucugcccug

SEQ ID NO: 2628724 - RNA, 17 nt, Escherichia coli CFT073
auccgcucugcccugcc

SEQ ID NO: 2628725 - RNA, 15 nt, Escherichia coli CFT073
auccgcuucacugau

SEQ ID NO: 2628726 - RNA, 18 nt, Escherichia coli CFT073
auccgcuucgguguauuu

SEQ ID NO: 2628727 - RNA, 18 nt, Escherichia coli CFT073
auccgcuuuugguuuuuc

SEQ ID NO: 2628728 - RNA, 17 nt, Escherichia coli CFT073
auccggaaacuggaugg

SEQ ID NO: 2628729 - RNA, 18 nt, Escherichia coli CFT073
auccggauucaaaccuaa

SEQ ID NO: 2628730 - RNA, 22 nt, Escherichia coli CFT073
auccggauuuuucgcgcgggca

SEQ ID NO: 2628731 - RNA, 14 nt, Escherichia coli CFT073
auccggcaaauaac

SEQ ID NO: 2628732 - RNA, 19 nt, Escherichia coli CFT073
auccggcaauaacucccag

SEQ ID NO: 2628733 - RNA, 12 nt, Escherichia coli CFT073
auccggcaccaa

SEQ ID NO: 2628734 - RNA, 16 nt, Escherichia coli CFT073
auccggcacuuucgga

SEQ ID NO: 2628735 - RNA, 20 nt, Escherichia coli CFT073
auccggcagcaaaucaaaua

SEQ ID NO: 2628736 - RNA, 16 nt, Escherichia coli CFT073
auccggcagcgcauaa

SEQ ID NO: 2628737 - RNA, 16 nt, Escherichia coli CFT073
auccggcauaauacau

SEQ ID NO: 2628738 - RNA, 16 nt, Escherichia coli CFT073
auccggcaugaacaaa

SEQ ID NO: 2628739 - RNA, 18 nt, Escherichia coli CFT073
auccggcauuaucacauc

SEQ ID NO: 2628740 - RNA, 16 nt, Escherichia coli CFT073
auccggcauuguucau

SEQ ID NO: 2628741 - RNA, 20 nt, Escherichia coli CFT073
auccggcauuugagcaggau

SEQ ID NO: 2628742 - RNA, 16 nt, Escherichia coli CFT073
auccggccaucaguau

SEQ ID NO: 2628743 - RNA, 17 nt, Escherichia coli CFT073
auccggccuaccgcauc

SEQ ID NO: 2628744 - RNA, 17 nt, Escherichia coli CFT073
auccggccuacggguga

SEQ ID NO: 2628745 - RNA, 17 nt, Escherichia coli CFT073
auccggccuacugguga

SEQ ID NO: 2628746 - RNA, 19 nt, Escherichia coli CFT073
auccggcgacaggaaccaa

SEQ ID NO: 2628747 - RNA, 20 nt, Escherichia coli CFT073
auccggcgaguuucguuaaa

SEQ ID NO: 2628748 - RNA, 18 nt, Escherichia coli CFT073
auccggcgcucaucaggc

SEQ ID NO: 2628749 - RNA, 18 nt, Escherichia coli CFT073
auccggcgucaucuuacu

SEQ ID NO: 2628750 - RNA, 19 nt, Escherichia coli CFT073
auccggcuauauugcagga

SEQ ID NO: 2628751 - RNA, 22 nt, Escherichia coli CFT073
auccggcuccaguuaacgccgc

SEQ ID NO: 2628752 - RNA, 19 nt, Escherichia coli CFT073
auccggcugauaaggcggc

SEQ ID NO: 2628753 - RNA, 21 nt, Escherichia coli CFT073
auccggcugcugcaaugccau

SEQ ID NO: 2628754 - RNA, 23 nt, Escherichia coli CFT073
auccgguaacccuucauauuccu

SEQ ID NO: 2628755 - RNA, 21 nt, Escherichia coli CFT073
auccggucccuucugccacca

SEQ ID NO: 2628756 - RNA, 23 nt, Escherichia coli CFT073
auccggugccaaagucaucaauu

SEQ ID NO: 2628757 - RNA, 20 nt, Escherichia coli CFT073
auccggugccuuaccgcuug

SEQ ID NO: 2628758 - RNA, 15 nt, Escherichia coli CFT073
auccgguuucaucag

SEQ ID NO: 2628759 - RNA, 19 nt, Escherichia coli CFT073
auccgguuucaucagccaa

SEQ ID NO: 2628760 - RNA, 13 nt, Escherichia coli CFT073
auccgguuuucca

SEQ ID NO: 2628761 - RNA, 22 nt, Escherichia coli CFT073
auccgguuuuccagaaccugag

SEQ ID NO: 2628762 - RNA, 13 nt, Escherichia coli CFT073
auccgguuuucug

SEQ ID NO: 2628763 - RNA, 15 nt, Escherichia coli CFT073
auccguaaaauacug

SEQ ID NO: 2628764 - RNA, 18 nt, Escherichia coli CFT073
auccguaaagcccauacc

SEQ ID NO: 2628765 - RNA, 22 nt, Escherichia coli CFT073
auccguaaucgcuuuuucugca

SEQ ID NO: 2628766 - RNA, 22 nt, Escherichia coli CFT073
auccguauuccugaaucagcca

SEQ ID NO: 2628767 - RNA, 18 nt, Escherichia coli CFT073
auccgucccaauucuucc

SEQ ID NO: 2628768 - RNA, 12 nt, Escherichia coli CFT073
auccguccgacg

SEQ ID NO: 2628769 - RNA, 20 nt, Escherichia coli CFT073
auccgucgccguaauuaaca

SEQ ID NO: 2628770 - RNA, 22 nt, Escherichia coli CFT073
auccgucucaaugguaccguga

SEQ ID NO: 2628771 - RNA, 21 nt, Escherichia coli CFT073
auccgugcauuccagcauuug

SEQ ID NO: 2628772 - RNA, 16 nt, Escherichia coli CFT073
auccguuauagggaaa

SEQ ID NO: 2628773 - RNA, 18 nt, Escherichia coli CFT073
auccguucagaucggcaa

SEQ ID NO: 2628774 - RNA, 18 nt, Escherichia coli CFT073
auccguucuggacuuccc

SEQ ID NO: 2628775 - RNA, 14 nt, Escherichia coli CFT073
auccuaaaggcaaa

SEQ ID NO: 2628776 - RNA, 14 nt, Escherichia coli CFT073
auccuaauccuggc

SEQ ID NO: 2628777 - RNA, 22 nt, Escherichia coli CFT073
auccuaauccuggccauaccau

SEQ ID NO: 2628778 - RNA, 14 nt, Escherichia coli CFT073
auccuacauccagu

SEQ ID NO: 2628779 - RNA, 15 nt, Escherichia coli CFT073
auccucaauaauaac

SEQ ID NO: 2628780 - RNA, 18 nt, Escherichia coli CFT073
auccucaaucggaaaaca

SEQ ID NO: 2628781 - RNA, 16 nt, Escherichia coli CFT073
auccucacugaccaca

SEQ ID NO: 2628782 - RNA, 17 nt, Escherichia coli CFT073
auccucagaaaucagau

SEQ ID NO: 2628783 - RNA, 20 nt, Escherichia coli CFT073
auccucagaaaucagauaaa

SEQ ID NO: 2628784 - RNA, 14 nt, Escherichia coli CFT073
auccucauaacgua

SEQ ID NO: 2628785 - RNA, 16 nt, Escherichia coli CFT073
auccucauaacguaaa

SEQ ID NO: 2628786 - RNA, 20 nt, Escherichia coli CFT073
auccuccgcagccaugagua

SEQ ID NO: 2628787 - RNA, 14 nt, Escherichia coli CFT073
auccucuaaacccc

SEQ ID NO: 2628788 - RNA, 18 nt, Escherichia coli CFT073
auccucuaaaccccaacc

SEQ ID NO: 2628789 - RNA, 21 nt, Escherichia coli CFT073
auccucuaaaccccaaccacu

SEQ ID NO: 2628790 - RNA, 20 nt, Escherichia coli CFT073
auccucuauaaaagaggcga

SEQ ID NO: 2628791 - RNA, 15 nt, Escherichia coli CFT073
auccucuucaagcug

SEQ ID NO: 2628792 - RNA, 12 nt, Escherichia coli CFT073
auccucuucagc

SEQ ID NO: 2628793 - RNA, 12 nt, Escherichia coli CFT073
auccucuucagg

SEQ ID NO: 2628794 - RNA, 21 nt, Escherichia coli CFT073
auccucuuuuaccaucagcgu

SEQ ID NO: 2628795 - RNA, 14 nt, Escherichia coli CFT073
auccugaaagcuga

SEQ ID NO: 2628796 - RNA, 22 nt, Escherichia coli CFT073
auccugaaagcugagaaaaugu

SEQ ID NO: 2628797 - RNA, 14 nt, Escherichia coli CFT073
auccugaauauccu

SEQ ID NO: 2628798 - RNA, 14 nt, Escherichia coli CFT073
auccugaaucaccu

SEQ ID NO: 2628799 - RNA, 14 nt, Escherichia coli CFT073
auccugaauuaacu

SEQ ID NO: 2628800 - RNA, 15 nt, Escherichia coli CFT073
auccugaauuaacuu

SEQ ID NO: 2628801 - RNA, 21 nt, Escherichia coli CFT073
auccugacaaggugcgaaaaa

SEQ ID NO: 2628802 - RNA, 23 nt, Escherichia coli CFT073
auccugaguaucgaaaacaucaa

SEQ ID NO: 2628803 - RNA, 14 nt, Escherichia coli CFT073
auccugaguuaauc

SEQ ID NO: 2628804 - RNA, 19 nt, Escherichia coli CFT073
auccugaguuaaucgccgc

SEQ ID NO: 2628805 - RNA, 20 nt, Escherichia coli CFT073
auccugaguuaaucgccgca

SEQ ID NO: 2628806 - RNA, 23 nt, Escherichia coli CFT073
auccugauacagaccgcgcagua

SEQ ID NO: 2628807 - RNA, 18 nt, Escherichia coli CFT073
auccugauagcacgucac

SEQ ID NO: 2628808 - RNA, 21 nt, Escherichia coli CFT073
auccugauccugcaacaacac

SEQ ID NO: 2628809 - RNA, 13 nt, Escherichia coli CFT073
auccugcaaauaa

SEQ ID NO: 2628810 - RNA, 15 nt, Escherichia coli CFT073
auccugcaacaacac

SEQ ID NO: 2628811 - RNA, 18 nt, Escherichia coli CFT073
auccugcaacaacaccag

SEQ ID NO: 2628812 - RNA, 13 nt, Escherichia coli CFT073
auccugcagugcg

SEQ ID NO: 2628813 - RNA, 21 nt, Escherichia coli CFT073
auccugccaggcugcaugccu

SEQ ID NO: 2628814 - RNA, 19 nt, Escherichia coli CFT073
auccugccaguaagcaguc

SEQ ID NO: 2628815 - RNA, 15 nt, Escherichia coli CFT073
auccugccagugcaa

SEQ ID NO: 2628816 - RNA, 18 nt, Escherichia coli CFT073
auccugccagugcaaaaa

SEQ ID NO: 2628817 - RNA, 18 nt, Escherichia coli CFT073
auccugccauuggcaggc

SEQ ID NO: 2628818 - RNA, 18 nt, Escherichia coli CFT073
auccugcccgcuccagcu

SEQ ID NO: 2628819 - RNA, 19 nt, Escherichia coli CFT073
auccugcccgcuccagcua

SEQ ID NO: 2628820 - RNA, 16 nt, Escherichia coli CFT073
auccugccgagauaca

SEQ ID NO: 2628821 - RNA, 20 nt, Escherichia coli CFT073
auccugcgguuugucaucau

SEQ ID NO: 2628822 - RNA, 22 nt, Escherichia coli CFT073
auccugcguuuguccgccagaa

SEQ ID NO: 2628823 - RNA, 21 nt, Escherichia coli CFT073
auccugcuuuuuuccagccau

SEQ ID NO: 2628824 - RNA, 23 nt, Escherichia coli CFT073
auccugcuuuuuuccagccauca

SEQ ID NO: 2628825 - RNA, 16 nt, Escherichia coli CFT073
auccuggacgcagaau

SEQ ID NO: 2628826 - RNA, 16 nt, Escherichia coli CFT073
auccuggacuuuaaac

SEQ ID NO: 2628827 - RNA, 20 nt, Escherichia coli CFT073
auccuggucaggaauggaaa

SEQ ID NO: 2628828 - RNA, 16 nt, Escherichia coli CFT073
auccugguuauuucac

SEQ ID NO: 2628829 - RNA, 17 nt, Escherichia coli CFT073
auccugguuauuucacu

SEQ ID NO: 2628830 - RNA, 12 nt, Escherichia coli CFT073
auccuguaucuu

SEQ ID NO: 2628831 - RNA, 24 nt, Escherichia coli CFT073
auccuguaugacaaaagaauggcu

SEQ ID NO: 2628832 - RNA, 23 nt, Escherichia coli CFT073
auccuguauuuuuuaauucaaau

SEQ ID NO: 2628833 - RNA, 13 nt, Escherichia coli CFT073
auccugucaguuc

SEQ ID NO: 2628834 - RNA, 14 nt, Escherichia coli CFT073
auccuguucauuuu

SEQ ID NO: 2628835 - RNA, 21 nt, Escherichia coli CFT073
auccuguucgaacauuagcgc

SEQ ID NO: 2628836 - RNA, 18 nt, Escherichia coli CFT073
auccuuccagcuccagcc

SEQ ID NO: 2628837 - RNA, 19 nt, Escherichia coli CFT073
auccuuccagcuccagccg

SEQ ID NO: 2628838 - RNA, 13 nt, Escherichia coli CFT073
auccuucccccac

SEQ ID NO: 2628839 - RNA, 21 nt, Escherichia coli CFT073
auccuucccccaccaccaucu

SEQ ID NO: 2628840 - RNA, 15 nt, Escherichia coli CFT073
auccuuccgccaguc

SEQ ID NO: 2628841 - RNA, 22 nt, Escherichia coli CFT073
auccuugcuaaccaacaauaca

SEQ ID NO: 2628842 - RNA, 20 nt, Escherichia coli CFT073
auccuuuccuuaagccagcg

SEQ ID NO: 2628843 - RNA, 12 nt, Escherichia coli CFT073
aucgaaaaugcc

SEQ ID NO: 2628844 - RNA, 21 nt, Escherichia coli CFT073
aucgaaaccaagaccaauccg

SEQ ID NO: 2628845 - RNA, 11 nt, Escherichia coli CFT073
aucgaaaucaa

SEQ ID NO: 2628846 - RNA, 17 nt, Escherichia coli CFT073
aucgaacagaccaaacu

SEQ ID NO: 2628847 - RNA, 15 nt, Escherichia coli CFT073
aucgaagacaucauc

SEQ ID NO: 2628848 - RNA, 13 nt, Escherichia coli CFT073
aucgaagcaaaga

SEQ ID NO: 2628849 - RNA, 20 nt, Escherichia coli CFT073
aucgaagcggucgagaaagg

SEQ ID NO: 2628850 - RNA, 19 nt, Escherichia coli CFT073
aucgaauaacuccgcgccg

SEQ ID NO: 2628851 - RNA, 18 nt, Escherichia coli CFT073
aucgacaaaaacccugcc

SEQ ID NO: 2628852 - RNA, 16 nt, Escherichia coli CFT073
aucgacaacguuuuca

SEQ ID NO: 2628853 - RNA, 15 nt, Escherichia coli CFT073
aucgacacagguauc

SEQ ID NO: 2628854 - RNA, 16 nt, Escherichia coli CFT073
aucgacaccaguucag

SEQ ID NO: 2628855 - RNA, 16 nt, Escherichia coli CFT073
aucgacaccgguaauc

SEQ ID NO: 2628856 - RNA, 19 nt, Escherichia coli CFT073
aucgacauaauugaccaga

SEQ ID NO: 2628857 - RNA, 13 nt, Escherichia coli CFT073
aucgacaucaacg

SEQ ID NO: 2628858 - RNA, 14 nt, Escherichia coli CFT073
aucgacauugacca

SEQ ID NO: 2628859 - RNA, 19 nt, Escherichia coli CFT073
aucgaccaggccaucagca

SEQ ID NO: 2628860 - RNA, 15 nt, Escherichia coli CFT073
aucgacccugaugaa

SEQ ID NO: 2628861 - RNA, 21 nt, Escherichia coli CFT073
aucgacgccaguuugaccaua

SEQ ID NO: 2628862 - RNA, 23 nt, Escherichia coli CFT073
aucgacguaguacccucugcacc

SEQ ID NO: 2628863 - RNA, 16 nt, Escherichia coli CFT073
aucgacucugaaugcc

SEQ ID NO: 2628864 - RNA, 20 nt, Escherichia coli CFT073
aucgagauucauccaguucc

SEQ ID NO: 2628865 - RNA, 12 nt, Escherichia coli CFT073
aucgagcagcuc

SEQ ID NO: 2628866 - RNA, 17 nt, Escherichia coli CFT073
aucgagcagcuccugcu

SEQ ID NO: 2628867 - RNA, 18 nt, Escherichia coli CFT073
aucgagcgcagcaacauc

SEQ ID NO: 2628868 - RNA, 19 nt, Escherichia coli CFT073
aucgagcgcagcaacauca

SEQ ID NO: 2628869 - RNA, 20 nt, Escherichia coli CFT073
aucgagcgcagcaacaucac

SEQ ID NO: 2628870 - RNA, 23 nt, Escherichia coli CFT073
aucgaggccauauuucacauaac

SEQ ID NO: 2628871 - RNA, 18 nt, Escherichia coli CFT073
aucgagugcaauaacguu

SEQ ID NO: 2628872 - RNA, 18 nt, Escherichia coli CFT073
aucgauaaagaacgcacc

SEQ ID NO: 2628873 - RNA, 22 nt, Escherichia coli CFT073
aucgauaacugcucucccauuu

SEQ ID NO: 2628874 - RNA, 15 nt, Escherichia coli CFT073
aucgauaaucaguaa

SEQ ID NO: 2628875 - RNA, 24 nt, Escherichia coli CFT073
aucgauaaucuucaaauaaacguc

SEQ ID NO: 2628876 - RNA, 14 nt, Escherichia coli CFT073
aucgauaucaccaa

SEQ ID NO: 2628877 - RNA, 15 nt, Escherichia coli CFT073
aucgauaucaccaau

SEQ ID NO: 2628878 - RNA, 18 nt, Escherichia coli CFT073
aucgauaugaccauuggu

SEQ ID NO: 2628879 - RNA, 13 nt, Escherichia coli CFT073
aucgauaugggca

SEQ ID NO: 2628880 - RNA, 19 nt, Escherichia coli CFT073
aucgauaugggcagcucua

SEQ ID NO: 2628881 - RNA, 12 nt, Escherichia coli CFT073
aucgauccccug

SEQ ID NO: 2628882 - RNA, 16 nt, Escherichia coli CFT073
aucgauccccugcccg

SEQ ID NO: 2628883 - RNA, 12 nt, Escherichia coli CFT073
aucgaugcugcu

SEQ ID NO: 2628884 - RNA, 19 nt, Escherichia coli CFT073
aucgauggcuucuggcugc

SEQ ID NO: 2628885 - RNA, 15 nt, Escherichia coli CFT073
aucgauggugaagug

SEQ ID NO: 2628886 - RNA, 18 nt, Escherichia coli CFT073
aucgauggugaaguggcu

SEQ ID NO: 2628887 - RNA, 14 nt, Escherichia coli CFT073
aucgaugugauaaa

SEQ ID NO: 2628888 - RNA, 17 nt, Escherichia coli CFT073
aucgauuaccgccagca

SEQ ID NO: 2628889 - RNA, 21 nt, Escherichia coli CFT073
aucgauugcacauucccugca

SEQ ID NO: 2628890 - RNA, 17 nt, Escherichia coli CFT073
aucgauuuucaaaauau

SEQ ID NO: 2628891 - RNA, 17 nt, Escherichia coli CFT073
aucgcaaauaugugauc

SEQ ID NO: 2628892 - RNA, 21 nt, Escherichia coli CFT073
aucgcaaauccacucaucgcc

SEQ ID NO: 2628893 - RNA, 15 nt, Escherichia coli CFT073
aucgcaaccagccac

SEQ ID NO: 2628894 - RNA, 16 nt, Escherichia coli CFT073
aucgcaacgcaucuuu

SEQ ID NO: 2628895 - RNA, 23 nt, Escherichia coli CFT073
aucgcaacgcaucuuuuucaauc

SEQ ID NO: 2628896 - RNA, 22 nt, Escherichia coli CFT073
aucgcaaucauuuuuuccccuu

SEQ ID NO: 2628897 - RNA, 15 nt, Escherichia coli CFT073
aucgcaauucuucau

SEQ ID NO: 2628898 - RNA, 14 nt, Escherichia coli CFT073
aucgcaccauucac

SEQ ID NO: 2628899 - RNA, 14 nt, Escherichia coli CFT073
aucgcacguugcca

SEQ ID NO: 2628900 - RNA, 18 nt, Escherichia coli CFT073
aucgcacguugccagcaa

SEQ ID NO: 2628901 - RNA, 19 nt, Escherichia coli CFT073
aucgcacguugccagcaac

SEQ ID NO: 2628902 - RNA, 21 nt, Escherichia coli CFT073
aucgcacguugccagcaacug

SEQ ID NO: 2628903 - RNA, 20 nt, Escherichia coli CFT073
aucgcagccuuaccggagaa

SEQ ID NO: 2628904 - RNA, 18 nt, Escherichia coli CFT073
aucgcaggcgagaacaug

SEQ ID NO: 2628905 - RNA, 17 nt, Escherichia coli CFT073
aucgcagguaagauaau

SEQ ID NO: 2628906 - RNA, 18 nt, Escherichia coli CFT073
aucgcagucuuugccguu

SEQ ID NO: 2628907 - RNA, 22 nt, Escherichia coli CFT073
aucgcagucuuugccguuggcg

SEQ ID NO: 2628908 - RNA, 19 nt, Escherichia coli CFT073
aucgcauacgguuucucca

SEQ ID NO: 2628909 - RNA, 17 nt, Escherichia coli CFT073
aucgcauauuucaacga

SEQ ID NO: 2628910 - RNA, 20 nt, Escherichia coli CFT073
aucgcauccggcaauaacuc

SEQ ID NO: 2628911 - RNA, 15 nt, Escherichia coli CFT073
aucgcaucguacauc

SEQ ID NO: 2628912 - RNA, 17 nt, Escherichia coli CFT073
aucgcaucguacaucac

SEQ ID NO: 2628913 - RNA, 15 nt, Escherichia coli CFT073
aucgcaucuucgccc

SEQ ID NO: 2628914 - RNA, 21 nt, Escherichia coli CFT073
aucgcauggcugcgaaucgcu

SEQ ID NO: 2628915 - RNA, 18 nt, Escherichia coli CFT073
aucgcauucggcauugaa

SEQ ID NO: 2628916 - RNA, 14 nt, Escherichia coli CFT073
aucgcauugcgcca

SEQ ID NO: 2628917 - RNA, 16 nt, Escherichia coli CFT073
aucgccaaagcggcag

SEQ ID NO: 2628918 - RNA, 15 nt, Escherichia coli CFT073
aucgccaacgccugc

SEQ ID NO: 2628919 - RNA, 21 nt, Escherichia coli CFT073
aucgccaacgccugcggcuga

SEQ ID NO: 2628920 - RNA, 17 nt, Escherichia coli CFT073
aucgccacauugcugca

SEQ ID NO: 2628921 - RNA, 21 nt, Escherichia coli CFT073
aucgccacgccaagaaacugg

SEQ ID NO: 2628922 - RNA, 17 nt, Escherichia coli CFT073
aucgccacuuucacgcc

SEQ ID NO: 2628923 - RNA, 18 nt, Escherichia coli CFT073
aucgccagacucaccagc

SEQ ID NO: 2628924 - RNA, 20 nt, Escherichia coli CFT073
aucgccagacucaccagcau

SEQ ID NO: 2628925 - RNA, 23 nt, Escherichia coli CFT073
aucgccagcaaaaucaccaucac

SEQ ID NO: 2628926 - RNA, 14 nt, Escherichia coli CFT073
aucgccagcucaag

SEQ ID NO: 2628927 - RNA, 18 nt, Escherichia coli CFT073
aucgccagcuugcagccg

SEQ ID NO: 2628928 - RNA, 15 nt, Escherichia coli CFT073
aucgccagguguuug

SEQ ID NO: 2628929 - RNA, 19 nt, Escherichia coli CFT073
aucgccauaaacaccagca

SEQ ID NO: 2628930 - RNA, 17 nt, Escherichia coli CFT073
aucgccauauccgcaau

SEQ ID NO: 2628931 - RNA, 15 nt, Escherichia coli CFT073
aucgccaucacaccc

SEQ ID NO: 2628932 - RNA, 19 nt, Escherichia coli CFT073
aucgccaucacacccugau

SEQ ID NO: 2628933 - RNA, 13 nt, Escherichia coli CFT073
aucgccaucagcg

SEQ ID NO: 2628934 - RNA, 14 nt, Escherichia coli CFT073
aucgccauccuuuc

SEQ ID NO: 2628935 - RNA, 20 nt, Escherichia coli CFT073
aucgccaugaugagcgccau

SEQ ID NO: 2628936 - RNA, 23 nt, Escherichia coli CFT073
aucgccauuuucugccgcaugga

SEQ ID NO: 2628937 - RNA, 19 nt, Escherichia coli CFT073
aucgcccacgcaccaccag

SEQ ID NO: 2628938 - RNA, 20 nt, Escherichia coli CFT073
aucgcccacgcaccaccagc

SEQ ID NO: 2628939 - RNA, 23 nt, Escherichia coli CFT073
aucgcccaguugaugaccagugc

SEQ ID NO: 2628940 - RNA, 14 nt, Escherichia coli CFT073
aucgcccccaucac

SEQ ID NO: 2628941 - RNA, 15 nt, Escherichia coli CFT073
aucgccccgcagccg

SEQ ID NO: 2628942 - RNA, 16 nt, Escherichia coli CFT073
aucgcccgcaaucagc

SEQ ID NO: 2628943 - RNA, 21 nt, Escherichia coli CFT073
aucgcccggauauccacccgc

SEQ ID NO: 2628944 - RNA, 15 nt, Escherichia coli CFT073
aucgcccggcaccag

SEQ ID NO: 2628945 - RNA, 16 nt, Escherichia coli CFT073
aucgcccggcguggug

SEQ ID NO: 2628946 - RNA, 13 nt, Escherichia coli CFT073
aucgcccucgccu

SEQ ID NO: 2628947 - RNA, 14 nt, Escherichia coli CFT073
aucgcccugccagc

SEQ ID NO: 2628948 - RNA, 16 nt, Escherichia coli CFT073
aucgcccugcuccagc

SEQ ID NO: 2628949 - RNA, 17 nt, Escherichia coli CFT073
aucgccgaacgccacga

SEQ ID NO: 2628950 - RNA, 13 nt, Escherichia coli CFT073
aucgccgagauac

SEQ ID NO: 2628951 - RNA, 19 nt, Escherichia coli CFT073
aucgccgcacccgccagaa

SEQ ID NO: 2628952 - RNA, 13 nt, Escherichia coli CFT073
aucgccgcaucau

SEQ ID NO: 2628953 - RNA, 17 nt, Escherichia coli CFT073
aucgccgcaucauccuc

SEQ ID NO: 2628954 - RNA, 20 nt, Escherichia coli CFT073
aucgccgcaucauccucuuc

SEQ ID NO: 2628955 - RNA, 20 nt, Escherichia coli CFT073
aucgccgccagugccaccag

SEQ ID NO: 2628956 - RNA, 19 nt, Escherichia coli CFT073
aucgccggaauaucaccac

SEQ ID NO: 2628957 - RNA, 17 nt, Escherichia coli CFT073
aucgccggggcgggcau

SEQ ID NO: 2628958 - RNA, 18 nt, Escherichia coli CFT073
aucgccguuaaccaugca

SEQ ID NO: 2628959 - RNA, 15 nt, Escherichia coli CFT073
aucgccuccagcgcu

SEQ ID NO: 2628960 - RNA, 16 nt, Escherichia coli CFT073
aucgccucccgcagua

SEQ ID NO: 2628961 - RNA, 21 nt, Escherichia coli CFT073
aucgccugaacaccagaacca

SEQ ID NO: 2628962 - RNA, 20 nt, Escherichia coli CFT073
aucgccugcgccaccacaac

SEQ ID NO: 2628963 - RNA, 21 nt, Escherichia coli CFT073
aucgccugcugaauauugcca

SEQ ID NO: 2628964 - RNA, 21 nt, Escherichia coli CFT073
aucgccuucgcaaaaaaccau

SEQ ID NO: 2628965 - RNA, 16 nt, Escherichia coli CFT073
aucgccuuuuuucacc

SEQ ID NO: 2628966 - RNA, 12 nt, Escherichia coli CFT073
aucgcgaaaaaa

SEQ ID NO: 2628967 - RNA, 21 nt, Escherichia coli CFT073
aucgcgaaaaaaaagauggcu

SEQ ID NO: 2628968 - RNA, 18 nt, Escherichia coli CFT073
aucgcgaaaccacgguga

SEQ ID NO: 2628969 - RNA, 18 nt, Escherichia coli CFT073
aucgcgacaaaauacagg

SEQ ID NO: 2628970 - RNA, 21 nt, Escherichia coli CFT073
aucgcgauagcgcaccaacca

SEQ ID NO: 2628971 - RNA, 15 nt, Escherichia coli CFT073
aucgcgcaaccacaa

SEQ ID NO: 2628972 - RNA, 17 nt, Escherichia coli CFT073
aucgcgccaaucagcgc

SEQ ID NO: 2628973 - RNA, 19 nt, Escherichia coli CFT073
aucgcgccaaucagcgcag

SEQ ID NO: 2628974 - RNA, 17 nt, Escherichia coli CFT073
aucgcgccaucaaaucu

SEQ ID NO: 2628975 - RNA, 19 nt, Escherichia coli CFT073
aucgcgccaucaaaucugc

SEQ ID NO: 2628976 - RNA, 16 nt, Escherichia coli CFT073
aucgcgcccgccgcca

SEQ ID NO: 2628977 - RNA, 21 nt, Escherichia coli CFT073
aucgcgcccgccgccauugaa

SEQ ID NO: 2628978 - RNA, 16 nt, Escherichia coli CFT073
aucgcgccggaaagca

SEQ ID NO: 2628979 - RNA, 21 nt, Escherichia coli CFT073
aucgcgcucaauguugcugcu

SEQ ID NO: 2628980 - RNA, 21 nt, Escherichia coli CFT073
aucgcgcuuaucgccagcgcg

SEQ ID NO: 2628981 - RNA, 21 nt, Escherichia coli CFT073
aucgcggcacagaaacgccau

SEQ ID NO: 2628982 - RNA, 12 nt, Escherichia coli CFT073
aucgcggcagcg

SEQ ID NO: 2628983 - RNA, 21 nt, Escherichia coli CFT073
aucgcggcugacguaaucaug

SEQ ID NO: 2628984 - RNA, 22 nt, Escherichia coli CFT073
aucgcggcugacguaaucauga

SEQ ID NO: 2628985 - RNA, 13 nt, Escherichia coli CFT073
aucgcgggaaaaa

SEQ ID NO: 2628986 - RNA, 22 nt, Escherichia coli CFT073
aucgcgguaacagaugaaugaa

SEQ ID NO: 2628987 - RNA, 20 nt, Escherichia coli CFT073
aucgcgguaauaaacgcccg

SEQ ID NO: 2628988 - RNA, 19 nt, Escherichia coli CFT073
aucgcgucgccggucagga

SEQ ID NO: 2628989 - RNA, 20 nt, Escherichia coli CFT073
aucgcgugcacuacaacggc

SEQ ID NO: 2628990 - RNA, 14 nt, Escherichia coli CFT073
aucgcguugucaua

SEQ ID NO: 2628991 - RNA, 13 nt, Escherichia coli CFT073
aucgcuacaccaa

SEQ ID NO: 2628992 - RNA, 12 nt, Escherichia coli CFT073
aucgcuaccagu

SEQ ID NO: 2628993 - RNA, 20 nt, Escherichia coli CFT073
aucgcuagauaggucaccag

SEQ ID NO: 2628994 - RNA, 17 nt, Escherichia coli CFT073
aucgcuagauauauauu

SEQ ID NO: 2628995 - RNA, 18 nt, Escherichia coli CFT073
aucgcucaucugcugcgu

SEQ ID NO: 2628996 - RNA, 19 nt, Escherichia coli CFT073
aucgcucugguugacgcgu

SEQ ID NO: 2628997 - RNA, 23 nt, Escherichia coli CFT073
aucgcucugguugacgcguaaau

SEQ ID NO: 2628998 - RNA, 18 nt, Escherichia coli CFT073
aucgcugaacgcaccuuc

SEQ ID NO: 2628999 - RNA, 17 nt, Escherichia coli CFT073
aucgcugacgaucauuc

SEQ ID NO: 2629000 - RNA, 15 nt, Escherichia coli CFT073
aucgcugcuaauuua

SEQ ID NO: 2629001 - RNA, 12 nt, Escherichia coli CFT073
aucgcuggcugc

SEQ ID NO: 2629002 - RNA, 22 nt, Escherichia coli CFT073
aucgcugggcgauaaaaucaga

SEQ ID NO: 2629003 - RNA, 15 nt, Escherichia coli CFT073
aucgcuguacucacc

SEQ ID NO: 2629004 - RNA, 21 nt, Escherichia coli CFT073
aucgcuguacucaccaacgca

SEQ ID NO: 2629005 - RNA, 14 nt, Escherichia coli CFT073
aucgcugugcugcu

SEQ ID NO: 2629006 - RNA, 21 nt, Escherichia coli CFT073
aucgcuguguguaggcguuau

SEQ ID NO: 2629007 - RNA, 16 nt, Escherichia coli CFT073
aucgcuucaaucagcg

SEQ ID NO: 2629008 - RNA, 19 nt, Escherichia coli CFT073
aucgcuugcucgcgcaccu

SEQ ID NO: 2629009 - RNA, 19 nt, Escherichia coli CFT073
aucgcuuucgcuuucucuu

SEQ ID NO: 2629010 - RNA, 17 nt, Escherichia coli CFT073
aucgcuuugugcucuuc

SEQ ID NO: 2629011 - RNA, 23 nt, Escherichia coli CFT073
aucgcuuuuacaucgauuucgcu

SEQ ID NO: 2629012 - RNA, 20 nt, Escherichia coli CFT073
aucgcuuuugcgguuuuucu

SEQ ID NO: 2629013 - RNA, 21 nt, Escherichia coli CFT073
aucgcuuuugcgguuuuucuc

SEQ ID NO: 2629014 - RNA, 23 nt, Escherichia coli CFT073
aucgcuuuugcgguuuuucucac

SEQ ID NO: 2629015 - RNA, 17 nt, Escherichia coli CFT073
aucggaaagccccgccu

SEQ ID NO: 2629016 - RNA, 23 nt, Escherichia coli CFT073
aucggaagacugucagugaccag

SEQ ID NO: 2629017 - RNA, 15 nt, Escherichia coli CFT073
aucggaaugcacagc

SEQ ID NO: 2629018 - RNA, 13 nt, Escherichia coli CFT073
aucggaccauugg

SEQ ID NO: 2629019 - RNA, 20 nt, Escherichia coli CFT073
aucggagaacaggaauaaau

SEQ ID NO: 2629020 - RNA, 15 nt, Escherichia coli CFT073
aucggaggcuuguuc

SEQ ID NO: 2629021 - RNA, 16 nt, Escherichia coli CFT073
aucggaugaucaucca

SEQ ID NO: 2629022 - RNA, 23 nt, Escherichia coli CFT073
aucggauuacccggcaucauuau

SEQ ID NO: 2629023 - RNA, 18 nt, Escherichia coli CFT073
aucggauuuaguaccgaa

SEQ ID NO: 2629024 - RNA, 23 nt, Escherichia coli CFT073
aucggcaaaaauaaucucaccau

SEQ ID NO: 2629025 - RNA, 14 nt, Escherichia coli CFT073
aucggcaaaacggu

SEQ ID NO: 2629026 - RNA, 16 nt, Escherichia coli CFT073
aucggcaaaaugggua

SEQ ID NO: 2629027 - RNA, 23 nt, Escherichia coli CFT073
aucggcaacgaaauagccaggca

SEQ ID NO: 2629028 - RNA, 14 nt, Escherichia coli CFT073
aucggcaacgccag

SEQ ID NO: 2629029 - RNA, 14 nt, Escherichia coli CFT073
aucggcaaucgccu

SEQ ID NO: 2629030 - RNA, 23 nt, Escherichia coli CFT073
aucggcacccaucgccagcacuu

SEQ ID NO: 2629031 - RNA, 12 nt, Escherichia coli CFT073
aucggcaccgcc

SEQ ID NO: 2629032 - RNA, 18 nt, Escherichia coli CFT073
aucggcaccgccagcagg

SEQ ID NO: 2629033 - RNA, 19 nt, Escherichia coli CFT073
aucggcacgaccaggaacg

SEQ ID NO: 2629034 - RNA, 13 nt, Escherichia coli CFT073
aucggcaggaaca

SEQ ID NO: 2629035 - RNA, 23 nt, Escherichia coli CFT073
aucggcaucaggccaaacagacc

SEQ ID NO: 2629036 - RNA, 18 nt, Escherichia coli CFT073
aucggcauugcucccugc

SEQ ID NO: 2629037 - RNA, 22 nt, Escherichia coli CFT073
aucggccaucucaacuuucuug

SEQ ID NO: 2629038 - RNA, 15 nt, Escherichia coli CFT073
aucggccaugauaaa

SEQ ID NO: 2629039 - RNA, 19 nt, Escherichia coli CFT073
aucggccuuuaacgccacg

SEQ ID NO: 2629040 - RNA, 21 nt, Escherichia coli CFT073
aucggcgaagagagcgccagu

SEQ ID NO: 2629041 - RNA, 19 nt, Escherichia coli CFT073
aucggcgcacaaccgccgg

SEQ ID NO: 2629042 - RNA, 21 nt, Escherichia coli CFT073
aucggcgcacaaccgccggau

SEQ ID NO: 2629043 - RNA, 16 nt, Escherichia coli CFT073
aucggcgcagcuaauu

SEQ ID NO: 2629044 - RNA, 19 nt, Escherichia coli CFT073
aucggcgcauucgaucacc

SEQ ID NO: 2629045 - RNA, 22 nt, Escherichia coli CFT073
aucggcgcuacggcguuucacu

SEQ ID NO: 2629046 - RNA, 17 nt, Escherichia coli CFT073
aucggcguuuucugacc

SEQ ID NO: 2629047 - RNA, 22 nt, Escherichia coli CFT073
aucggcucauaaaaacuccagu

SEQ ID NO: 2629048 - RNA, 22 nt, Escherichia coli CFT073
aucggcuuauucauaucaaacg

SEQ ID NO: 2629049 - RNA, 14 nt, Escherichia coli CFT073
aucgggaauacaga

SEQ ID NO: 2629050 - RNA, 16 nt, Escherichia coli CFT073
aucgggaccaacgcgu

SEQ ID NO: 2629051 - RNA, 13 nt, Escherichia coli CFT073
aucgggcgauucg

SEQ ID NO: 2629052 - RNA, 16 nt, Escherichia coli CFT073
aucgguaucgaauaaa

SEQ ID NO: 2629053 - RNA, 18 nt, Escherichia coli CFT073
aucgguccggaaauugaa

SEQ ID NO: 2629054 - RNA, 19 nt, Escherichia coli CFT073
aucgguccggaaauugaaa

SEQ ID NO: 2629055 - RNA, 16 nt, Escherichia coli CFT073
aucggucgacugcgcu

SEQ ID NO: 2629056 - RNA, 19 nt, Escherichia coli CFT073
aucggucgccugacguaca

SEQ ID NO: 2629057 - RNA, 17 nt, Escherichia coli CFT073
aucggugaggaucacca

SEQ ID NO: 2629058 - RNA, 18 nt, Escherichia coli CFT073
aucggugaggaucaccag

SEQ ID NO: 2629059 - RNA, 12 nt, Escherichia coli CFT073
aucggugauaaa

SEQ ID NO: 2629060 - RNA, 17 nt, Escherichia coli CFT073
aucggugauauccaggu

SEQ ID NO: 2629061 - RNA, 21 nt, Escherichia coli CFT073
aucgguuuguaagcgggcaau

SEQ ID NO: 2629062 - RNA, 14 nt, Escherichia coli CFT073
aucguaauacccuu

SEQ ID NO: 2629063 - RNA, 14 nt, Escherichia coli CFT073
aucguaaucagcau

SEQ ID NO: 2629064 - RNA, 12 nt, Escherichia coli CFT073
aucguaccaggc

SEQ ID NO: 2629065 - RNA, 16 nt, Escherichia coli CFT073
aucguaguaguucauc

SEQ ID NO: 2629066 - RNA, 21 nt, Escherichia coli CFT073
aucguaguuuuugcccaucau

SEQ ID NO: 2629067 - RNA, 21 nt, Escherichia coli CFT073
aucguauuggugcauaacaca

SEQ ID NO: 2629068 - RNA, 15 nt, Escherichia coli CFT073
aucgucacaccauga

SEQ ID NO: 2629069 - RNA, 18 nt, Escherichia coli CFT073
aucgucacgauacgguua

SEQ ID NO: 2629070 - RNA, 21 nt, Escherichia coli CFT073
aucgucacgcgcgccaagccc

SEQ ID NO: 2629071 - RNA, 16 nt, Escherichia coli CFT073
aucgucagacgcucug

SEQ ID NO: 2629072 - RNA, 18 nt, Escherichia coli CFT073
aucgucagcacucacgcc

SEQ ID NO: 2629073 - RNA, 19 nt, Escherichia coli CFT073
aucgucagcucgcugccau

SEQ ID NO: 2629074 - RNA, 18 nt, Escherichia coli CFT073
aucgucaggaucagccau

SEQ ID NO: 2629075 - RNA, 21 nt, Escherichia coli CFT073
aucgucaggggcauuuuccag

SEQ ID NO: 2629076 - RNA, 22 nt, Escherichia coli CFT073
aucgucaucauucaucgccuuc

SEQ ID NO: 2629077 - RNA, 14 nt, Escherichia coli CFT073
aucguccagcugcc

SEQ ID NO: 2629078 - RNA, 21 nt, Escherichia coli CFT073
aucgucccaggcaaaucccau

SEQ ID NO: 2629079 - RNA, 22 nt, Escherichia coli CFT073
aucguccgucgaaagcccauca

SEQ ID NO: 2629080 - RNA, 16 nt, Escherichia coli CFT073
aucgucgccagaccaa

SEQ ID NO: 2629081 - RNA, 17 nt, Escherichia coli CFT073
aucgucgccgucauacg

SEQ ID NO: 2629082 - RNA, 23 nt, Escherichia coli CFT073
aucgucgcuaagcggcuccgguc

SEQ ID NO: 2629083 - RNA, 15 nt, Escherichia coli CFT073
aucgucgugcgguga

SEQ ID NO: 2629084 - RNA, 18 nt, Escherichia coli CFT073
aucgucugcggugcgcca

SEQ ID NO: 2629085 - RNA, 14 nt, Escherichia coli CFT073
aucgucuggcgcgu

SEQ ID NO: 2629086 - RNA, 18 nt, Escherichia coli CFT073
aucgucuucaaccgcagu

SEQ ID NO: 2629087 - RNA, 21 nt, Escherichia coli CFT073
aucgugacagcauaccuucac

SEQ ID NO: 2629088 - RNA, 16 nt, Escherichia coli CFT073
aucgugcagcaccgcc

SEQ ID NO: 2629089 - RNA, 22 nt, Escherichia coli CFT073
aucgugcgcgccgugaacguga

SEQ ID NO: 2629090 - RNA, 20 nt, Escherichia coli CFT073
aucgugcgggaccagcacgg

SEQ ID NO: 2629091 - RNA, 15 nt, Escherichia coli CFT073
aucgugcucgcuuuc

SEQ ID NO: 2629092 - RNA, 22 nt, Escherichia coli CFT073
aucgugcuggauuugugucaga

SEQ ID NO: 2629093 - RNA, 23 nt, Escherichia coli CFT073
aucgugcuggauuugugucagaa

SEQ ID NO: 2629094 - RNA, 16 nt, Escherichia coli CFT073
aucguggccaugacca

SEQ ID NO: 2629095 - RNA, 23 nt, Escherichia coli CFT073
aucguggccaugaccaccgcagc

SEQ ID NO: 2629096 - RNA, 22 nt, Escherichia coli CFT073
aucguguggauaauccaucccg

SEQ ID NO: 2629097 - RNA, 14 nt, Escherichia coli CFT073
aucguuaaugaucu

SEQ ID NO: 2629098 - RNA, 15 nt, Escherichia coli CFT073
aucguucauaccacg

SEQ ID NO: 2629099 - RNA, 14 nt, Escherichia coli CFT073
aucguucgcugccu

SEQ ID NO: 2629100 - RNA, 22 nt, Escherichia coli CFT073
aucguucugugccgucugcccc

SEQ ID NO: 2629101 - RNA, 19 nt, Escherichia coli CFT073
aucguugaacccggcauca

SEQ ID NO: 2629102 - RNA, 12 nt, Escherichia coli CFT073
aucuaaaagcaa

SEQ ID NO: 2629103 - RNA, 15 nt, Escherichia coli CFT073
aucuaacagugccug

SEQ ID NO: 2629104 - RNA, 16 nt, Escherichia coli CFT073
aucuaacgcccgagcc

SEQ ID NO: 2629105 - RNA, 18 nt, Escherichia coli CFT073
aucuaaugccauuaacau

SEQ ID NO: 2629106 - RNA, 22 nt, Escherichia coli CFT073
aucuaaugcuccuuuaaucaac

SEQ ID NO: 2629107 - RNA, 12 nt, Escherichia coli CFT073
aucuaccagcgg

SEQ ID NO: 2629108 - RNA, 13 nt, Escherichia coli CFT073
aucuaccagcgga

SEQ ID NO: 2629109 - RNA, 20 nt, Escherichia coli CFT073
aucuaccagcggacggcuga

SEQ ID NO: 2629110 - RNA, 19 nt, Escherichia coli CFT073
aucuacgcucucuucaaac

SEQ ID NO: 2629111 - RNA, 20 nt, Escherichia coli CFT073
aucuacggaagaguuuuuca

SEQ ID NO: 2629112 - RNA, 11 nt, Escherichia coli CFT073
aucuacugccu

SEQ ID NO: 2629113 - RNA, 14 nt, Escherichia coli CFT073
aucuauaaaauccu

SEQ ID NO: 2629114 - RNA, 17 nt, Escherichia coli CFT073
aucuaucacuauaaaua

SEQ ID NO: 2629115 - RNA, 20 nt, Escherichia coli CFT073
aucuaucuggcgcgcuauua

SEQ ID NO: 2629116 - RNA, 21 nt, Escherichia coli CFT073
aucucaaaucuucucacugcc

SEQ ID NO: 2629117 - RNA, 15 nt, Escherichia coli CFT073
aucucaaauugcucu

SEQ ID NO: 2629118 - RNA, 15 nt, Escherichia coli CFT073
aucucaacacacgua

SEQ ID NO: 2629119 - RNA, 20 nt, Escherichia coli CFT073
aucucaaccgcuucuuucuc

SEQ ID NO: 2629120 - RNA, 21 nt, Escherichia coli CFT073
aucucaaccgcuucuuucuca

SEQ ID NO: 2629121 - RNA, 20 nt, Escherichia coli CFT073
aucucaagaaugaccgccug

SEQ ID NO: 2629122 - RNA, 15 nt, Escherichia coli CFT073
aucucaauauccgga

SEQ ID NO: 2629123 - RNA, 13 nt, Escherichia coli CFT073
aucucaaucaaaa

SEQ ID NO: 2629124 - RNA, 14 nt, Escherichia coli CFT073
aucucaaucaaaag

SEQ ID NO: 2629125 - RNA, 17 nt, Escherichia coli CFT073
aucucaauccgcuuacc

SEQ ID NO: 2629126 - RNA, 17 nt, Escherichia coli CFT073
aucucaaucgcacccgc

SEQ ID NO: 2629127 - RNA, 19 nt, Escherichia coli CFT073
aucucaauguauucccgua

SEQ ID NO: 2629128 - RNA, 21 nt, Escherichia coli CFT073
aucucaauuuucacuuucggc

SEQ ID NO: 2629129 - RNA, 23 nt, Escherichia coli CFT073
aucucacccauagauaccuucuu

SEQ ID NO: 2629130 - RNA, 21 nt, Escherichia coli CFT073
aucucacgcaguuuauccauc

SEQ ID NO: 2629131 - RNA, 14 nt, Escherichia coli CFT073
aucucacguccacc

SEQ ID NO: 2629132 - RNA, 16 nt, Escherichia coli CFT073
aucucagucagauacc

SEQ ID NO: 2629133 - RNA, 13 nt, Escherichia coli CFT073
aucucauccauca

SEQ ID NO: 2629134 - RNA, 13 nt, Escherichia coli CFT073
aucucaucggcgu

SEQ ID NO: 2629135 - RNA, 16 nt, Escherichia coli CFT073
aucuccacccgcaaau

SEQ ID NO: 2629136 - RNA, 17 nt, Escherichia coli CFT073
aucuccagauaauuaug

SEQ ID NO: 2629137 - RNA, 16 nt, Escherichia coli CFT073
aucuccagcugcucgc

SEQ ID NO: 2629138 - RNA, 23 nt, Escherichia coli CFT073
aucuccgccucgcucaggugacg

SEQ ID NO: 2629139 - RNA, 21 nt, Escherichia coli CFT073
aucucgccagagagcggagca

SEQ ID NO: 2629140 - RNA, 21 nt, Escherichia coli CFT073
aucucgcccgcuucauagccg

SEQ ID NO: 2629141 - RNA, 15 nt, Escherichia coli CFT073
aucucgccuuugagc

SEQ ID NO: 2629142 - RNA, 20 nt, Escherichia coli CFT073
aucucgccuuugagcaguuu

SEQ ID NO: 2629143 - RNA, 20 nt, Escherichia coli CFT073
aucucgcgccaguaccgccg

SEQ ID NO: 2629144 - RNA, 20 nt, Escherichia coli CFT073
aucucgcgcucuucuucacg

SEQ ID NO: 2629145 - RNA, 20 nt, Escherichia coli CFT073
aucucggggcaaguuucgug

SEQ ID NO: 2629146 - RNA, 15 nt, Escherichia coli CFT073
aucucgguggaaaau

SEQ ID NO: 2629147 - RNA, 18 nt, Escherichia coli CFT073
aucucgucacuuuucuua

SEQ ID NO: 2629148 - RNA, 13 nt, Escherichia coli CFT073
aucucgucagcau

SEQ ID NO: 2629149 - RNA, 12 nt, Escherichia coli CFT073
aucucuccuuuc

SEQ ID NO: 2629150 - RNA, 19 nt, Escherichia coli CFT073
aucucugcaacgucuuccc

SEQ ID NO: 2629151 - RNA, 20 nt, Escherichia coli CFT073
aucucugcaacgucuucccg

SEQ ID NO: 2629152 - RNA, 11 nt, Escherichia coli CFT073
aucucugcaag

SEQ ID NO: 2629153 - RNA, 22 nt, Escherichia coli CFT073
aucucugccuugaguuuuucau

SEQ ID NO: 2629154 - RNA, 16 nt, Escherichia coli CFT073
aucucugcgcuaucca

SEQ ID NO: 2629155 - RNA, 23 nt, Escherichia coli CFT073
aucucugcgcuauccagcgcaua

SEQ ID NO: 2629156 - RNA, 19 nt, Escherichia coli CFT073
aucucuggcacgagaucgu

SEQ ID NO: 2629157 - RNA, 13 nt, Escherichia coli CFT073
aucucuggcggca

SEQ ID NO: 2629158 - RNA, 20 nt, Escherichia coli CFT073
aucucuggcggcaaaccuuu

SEQ ID NO: 2629159 - RNA, 14 nt, Escherichia coli CFT073
aucucuucaagcug

SEQ ID NO: 2629160 - RNA, 14 nt, Escherichia coli CFT073
aucucuucaauaug

SEQ ID NO: 2629161 - RNA, 13 nt, Escherichia coli CFT073
aucucuucaccau

SEQ ID NO: 2629162 - RNA, 14 nt, Escherichia coli CFT073
aucucuucaccaua

SEQ ID NO: 2629163 - RNA, 18 nt, Escherichia coli CFT073
aucucuucaccugccugc

SEQ ID NO: 2629164 - RNA, 14 nt, Escherichia coli CFT073
aucucuuccacuuc

SEQ ID NO: 2629165 - RNA, 14 nt, Escherichia coli CFT073
aucucuuccagcgu

SEQ ID NO: 2629166 - RNA, 20 nt, Escherichia coli CFT073
aucucuuccagcgucuccag

SEQ ID NO: 2629167 - RNA, 12 nt, Escherichia coli CFT073
aucucuucccac

SEQ ID NO: 2629168 - RNA, 18 nt, Escherichia coli CFT073
aucucuucgagaauaucu

SEQ ID NO: 2629169 - RNA, 21 nt, Escherichia coli CFT073
aucucuucuucaagccaggcu

SEQ ID NO: 2629170 - RNA, 13 nt, Escherichia coli CFT073
aucucuucuuccg

SEQ ID NO: 2629171 - RNA, 14 nt, Escherichia coli CFT073
aucucuuuccauuc

SEQ ID NO: 2629172 - RNA, 16 nt, Escherichia coli CFT073
aucucuuuccauucuu

SEQ ID NO: 2629173 - RNA, 18 nt, Escherichia coli CFT073
aucucuuuccauucuuuc

SEQ ID NO: 2629174 - RNA, 20 nt, Escherichia coli CFT073
aucucuuuccauucuuuccc

SEQ ID NO: 2629175 - RNA, 21 nt, Escherichia coli CFT073
aucucuuucucgucugaaaga

SEQ ID NO: 2629176 - RNA, 18 nt, Escherichia coli CFT073
aucucuuuuguuucccga

SEQ ID NO: 2629177 - RNA, 17 nt, Escherichia coli CFT073
aucugacuuccugccuc

SEQ ID NO: 2629178 - RNA, 18 nt, Escherichia coli CFT073
aucugacuuuccggggaa

SEQ ID NO: 2629179 - RNA, 14 nt, Escherichia coli CFT073
aucugauagaacug

SEQ ID NO: 2629180 - RNA, 22 nt, Escherichia coli CFT073
aucugaugauauuuuucccuga

SEQ ID NO: 2629181 - RNA, 13 nt, Escherichia coli CFT073
aucugauuccggg

SEQ ID NO: 2629182 - RNA, 19 nt, Escherichia coli CFT073
aucugauuccgggccacca

SEQ ID NO: 2629183 - RNA, 18 nt, Escherichia coli CFT073
aucugauuuaaaaaugcc

SEQ ID NO: 2629184 - RNA, 22 nt, Escherichia coli CFT073
aucugauuuaaaaaugccagcc

SEQ ID NO: 2629185 - RNA, 19 nt, Escherichia coli CFT073
aucugauuuucuuccagua

SEQ ID NO: 2629186 - RNA, 22 nt, Escherichia coli CFT073
aucugcaaaauaccaauaauca

SEQ ID NO: 2629187 - RNA, 16 nt, Escherichia coli CFT073
aucugccagccaguca

SEQ ID NO: 2629188 - RNA, 19 nt, Escherichia coli CFT073
aucugccauuaacuccacc

SEQ ID NO: 2629189 - RNA, 22 nt, Escherichia coli CFT073
aucugcccaaaauugacuaucu

SEQ ID NO: 2629190 - RNA, 23 nt, Escherichia coli CFT073
aucugccccauugcugaugcacc

SEQ ID NO: 2629191 - RNA, 21 nt, Escherichia coli CFT073
aucugcccggcauuaauauug

SEQ ID NO: 2629192 - RNA, 19 nt, Escherichia coli CFT073
aucugcccuuuaguaugcu

SEQ ID NO: 2629193 - RNA, 17 nt, Escherichia coli CFT073
aucugccugauccugag

SEQ ID NO: 2629194 - RNA, 15 nt, Escherichia coli CFT073
aucugcgacauagca

SEQ ID NO: 2629195 - RNA, 21 nt, Escherichia coli CFT073
aucugcgccacgaaaacccuc

SEQ ID NO: 2629196 - RNA, 11 nt, Escherichia coli CFT073
aucugcgccau

SEQ ID NO: 2629197 - RNA, 21 nt, Escherichia coli CFT073
aucugcgcccaauauccugag

SEQ ID NO: 2629198 - RNA, 23 nt, Escherichia coli CFT073
aucugcggccuccaacaacccug

SEQ ID NO: 2629199 - RNA, 14 nt, Escherichia coli CFT073
aucugcgggaacau

SEQ ID NO: 2629200 - RNA, 12 nt, Escherichia coli CFT073
aucugcuggaaa

SEQ ID NO: 2629201 - RNA, 12 nt, Escherichia coli CFT073
aucugcuggcaa

SEQ ID NO: 2629202 - RNA, 22 nt, Escherichia coli CFT073
aucugcuugcggcguucgguuu

SEQ ID NO: 2629203 - RNA, 19 nt, Escherichia coli CFT073
aucugcuuuucauacaauc

SEQ ID NO: 2629204 - RNA, 18 nt, Escherichia coli CFT073
aucuggaauggaaacagc

SEQ ID NO: 2629205 - RNA, 13 nt, Escherichia coli CFT073
aucuggacgccaa

SEQ ID NO: 2629206 - RNA, 14 nt, Escherichia coli CFT073
aucuggaggugacg

SEQ ID NO: 2629207 - RNA, 23 nt, Escherichia coli CFT073
aucuggcaccgguacacaaccgc

SEQ ID NO: 2629208 - RNA, 23 nt, Escherichia coli CFT073
aucuggcaucggcgcacaaccgc

SEQ ID NO: 2629209 - RNA, 20 nt, Escherichia coli CFT073
aucuggcggaucugaucagc

SEQ ID NO: 2629210 - RNA, 21 nt, Escherichia coli CFT073
aucuggcgucagcggcuggca

SEQ ID NO: 2629211 - RNA, 24 nt, Escherichia coli CFT073
aucuggcguuaaaaccaauucaca

SEQ ID NO: 2629212 - RNA, 23 nt, Escherichia coli CFT073
aucuggcuccuguuugcauuucu

SEQ ID NO: 2629213 - RNA, 17 nt, Escherichia coli CFT073
aucuggucaguuaacaa

SEQ ID NO: 2629214 - RNA, 20 nt, Escherichia coli CFT073
aucuggucuggugaaucccc

SEQ ID NO: 2629215 - RNA, 19 nt, Escherichia coli CFT073
aucuggugccagcgccagc

SEQ ID NO: 2629216 - RNA, 14 nt, Escherichia coli CFT073
aucuguaacagguc

SEQ ID NO: 2629217 - RNA, 20 nt, Escherichia coli CFT073
aucuguaagcaauuauucau

SEQ ID NO: 2629218 - RNA, 17 nt, Escherichia coli CFT073
aucuguaccuucugcac

SEQ ID NO: 2629219 - RNA, 12 nt, Escherichia coli CFT073
aucuguauguca

SEQ ID NO: 2629220 - RNA, 16 nt, Escherichia coli CFT073
aucugucagacuaucu

SEQ ID NO: 2629221 - RNA, 16 nt, Escherichia coli CFT073
aucuguccuuccagua

SEQ ID NO: 2629222 - RNA, 18 nt, Escherichia coli CFT073
aucugucugauaaaaaac

SEQ ID NO: 2629223 - RNA, 21 nt, Escherichia coli CFT073
aucugugcuuguaaaacagcc

SEQ ID NO: 2629224 - RNA, 20 nt, Escherichia coli CFT073
aucugugggcaugcuucacu

SEQ ID NO: 2629225 - RNA, 22 nt, Escherichia coli CFT073
aucugugugggcacucgaagau

SEQ ID NO: 2629226 - RNA, 13 nt, Escherichia coli CFT073
aucuguuaucuca

SEQ ID NO: 2629227 - RNA, 20 nt, Escherichia coli CFT073
aucuguugauuuaacagcaa

SEQ ID NO: 2629228 - RNA, 22 nt, Escherichia coli CFT073
aucuguugauuuaacagcaaaa

SEQ ID NO: 2629229 - RNA, 16 nt, Escherichia coli CFT073
aucuuacgcuuaagau

SEQ ID NO: 2629230 - RNA, 15 nt, Escherichia coli CFT073
aucuuacugcaacug

SEQ ID NO: 2629231 - RNA, 15 nt, Escherichia coli CFT073
aucuuagacaucaaa

SEQ ID NO: 2629232 - RNA, 22 nt, Escherichia coli CFT073
aucuuaucccuucgagcggggg

SEQ ID NO: 2629233 - RNA, 19 nt, Escherichia coli CFT073
aucuuaucuaacaaucuug

SEQ ID NO: 2629234 - RNA, 16 nt, Escherichia coli CFT073
aucuucacacacauca

SEQ ID NO: 2629235 - RNA, 14 nt, Escherichia coli CFT073
aucuucacaucauc

SEQ ID NO: 2629236 - RNA, 16 nt, Escherichia coli CFT073
aucuucacaucaucau

SEQ ID NO: 2629237 - RNA, 21 nt, Escherichia coli CFT073
aucuucaccaauguucaguuu

SEQ ID NO: 2629238 - RNA, 14 nt, Escherichia coli CFT073
aucuucacgauuau

SEQ ID NO: 2629239 - RNA, 14 nt, Escherichia coli CFT073
aucuucagucuuga

SEQ ID NO: 2629240 - RNA, 20 nt, Escherichia coli CFT073
aucuucauacggcccuucga

SEQ ID NO: 2629241 - RNA, 23 nt, Escherichia coli CFT073
aucuucaucaucugcgccacgaa

SEQ ID NO: 2629242 - RNA, 19 nt, Escherichia coli CFT073
aucuuccacaauaccaauc

SEQ ID NO: 2629243 - RNA, 14 nt, Escherichia coli CFT073
aucuuccagaucac

SEQ ID NO: 2629244 - RNA, 14 nt, Escherichia coli CFT073
aucuuccagcauca

SEQ ID NO: 2629245 - RNA, 17 nt, Escherichia coli CFT073
aucuuccagcauuucca

SEQ ID NO: 2629246 - RNA, 23 nt, Escherichia coli CFT073
aucuuccagcgcaucgccaaaau

SEQ ID NO: 2629247 - RNA, 15 nt, Escherichia coli CFT073
aucuuccagcggcca

SEQ ID NO: 2629248 - RNA, 15 nt, Escherichia coli CFT073
aucuuccagcugcac

SEQ ID NO: 2629249 - RNA, 21 nt, Escherichia coli CFT073
aucuuccagcugcacgccacg

SEQ ID NO: 2629250 - RNA, 15 nt, Escherichia coli CFT073
aucuuccccugcgau

SEQ ID NO: 2629251 - RNA, 17 nt, Escherichia coli CFT073
aucuuccccuuuugccu

SEQ ID NO: 2629252 - RNA, 23 nt, Escherichia coli CFT073
aucuuccccuuuugccuucugag

SEQ ID NO: 2629253 - RNA, 14 nt, Escherichia coli CFT073
aucuuccgggcaac

SEQ ID NO: 2629254 - RNA, 23 nt, Escherichia coli CFT073
aucuuccgggcaacaaucgcuca

SEQ ID NO: 2629255 - RNA, 15 nt, Escherichia coli CFT073
aucuuccugauaacc

SEQ ID NO: 2629256 - RNA, 19 nt, Escherichia coli CFT073
aucuucgaccgucaccagu

SEQ ID NO: 2629257 - RNA, 17 nt, Escherichia coli CFT073
aucuucgcacuuaccuu

SEQ ID NO: 2629258 - RNA, 17 nt, Escherichia coli CFT073
aucuucgccaucccggc

SEQ ID NO: 2629259 - RNA, 19 nt, Escherichia coli CFT073
aucuucgccaucccggcaa

SEQ ID NO: 2629260 - RNA, 21 nt, Escherichia coli CFT073
aucuucgccguguucuuaccc

SEQ ID NO: 2629261 - RNA, 23 nt, Escherichia coli CFT073
aucuucggcaauacuucaacaua

SEQ ID NO: 2629262 - RNA, 19 nt, Escherichia coli CFT073
aucuucggcgaaaaucauu

SEQ ID NO: 2629263 - RNA, 17 nt, Escherichia coli CFT073
aucuucuaggcuguguu

SEQ ID NO: 2629264 - RNA, 16 nt, Escherichia coli CFT073
aucuucuccugucaug

SEQ ID NO: 2629265 - RNA, 17 nt, Escherichia coli CFT073
aucuucucgaaacgcuu

SEQ ID NO: 2629266 - RNA, 20 nt, Escherichia coli CFT073
aucuucucuacccgcucgaa

SEQ ID NO: 2629267 - RNA, 12 nt, Escherichia coli CFT073
aucuucucucau

SEQ ID NO: 2629268 - RNA, 14 nt, Escherichia coli CFT073
aucuucucucaucc

SEQ ID NO: 2629269 - RNA, 13 nt, Escherichia coli CFT073
aucuucucuuaua

SEQ ID NO: 2629270 - RNA, 18 nt, Escherichia coli CFT073
aucuucucuuauauuuca

SEQ ID NO: 2629271 - RNA, 24 nt, Escherichia coli CFT073
aucuucugaaggugccuuuauugc

SEQ ID NO: 2629272 - RNA, 23 nt, Escherichia coli CFT073
aucuucugaaucagaucaaguuc

SEQ ID NO: 2629273 - RNA, 21 nt, Escherichia coli CFT073
aucuucugaccgggauuuuca

SEQ ID NO: 2629274 - RNA, 15 nt, Escherichia coli CFT073
aucuucugcuggcgu

SEQ ID NO: 2629275 - RNA, 18 nt, Escherichia coli CFT073
aucuugcucuaccagcac

SEQ ID NO: 2629276 - RNA, 22 nt, Escherichia coli CFT073
aucuuguugaagacuaaccaac

SEQ ID NO: 2629277 - RNA, 20 nt, Escherichia coli CFT073
aucuuuaacugcuccgccgc

SEQ ID NO: 2629278 - RNA, 14 nt, Escherichia coli CFT073
aucuuuaucaagca

SEQ ID NO: 2629279 - RNA, 16 nt, Escherichia coli CFT073
aucuuuaucaaucacc

SEQ ID NO: 2629280 - RNA, 11 nt, Escherichia coli CFT073
aucuuuauuca

SEQ ID NO: 2629281 - RNA, 12 nt, Escherichia coli CFT073
aucuuuauucau

SEQ ID NO: 2629282 - RNA, 16 nt, Escherichia coli CFT073
aucuuuauucauaauc

SEQ ID NO: 2629283 - RNA, 23 nt, Escherichia coli CFT073
aucuuucacaaagacgccaucaa

SEQ ID NO: 2629284 - RNA, 14 nt, Escherichia coli CFT073
aucuuucacgccca

SEQ ID NO: 2629285 - RNA, 21 nt, Escherichia coli CFT073
aucuuucagaguuguaccacc

SEQ ID NO: 2629286 - RNA, 19 nt, Escherichia coli CFT073
aucuuucaucuguuuucaa

SEQ ID NO: 2629287 - RNA, 14 nt, Escherichia coli CFT073
aucuuuccucacuc

SEQ ID NO: 2629288 - RNA, 20 nt, Escherichia coli CFT073
aucuuucuugcgcccgguua

SEQ ID NO: 2629289 - RNA, 21 nt, Escherichia coli CFT073
aucuuugaaauaauauugcuu

SEQ ID NO: 2629290 - RNA, 17 nt, Escherichia coli CFT073
aucuuugacugaaauuu

SEQ ID NO: 2629291 - RNA, 14 nt, Escherichia coli CFT073
aucuuugacugucc

SEQ ID NO: 2629292 - RNA, 17 nt, Escherichia coli CFT073
aucuuugauugaagaaa

SEQ ID NO: 2629293 - RNA, 21 nt, Escherichia coli CFT073
aucuuugauugaagaaaucag

SEQ ID NO: 2629294 - RNA, 17 nt, Escherichia coli CFT073
aucuuugcccauacccg

SEQ ID NO: 2629295 - RNA, 16 nt, Escherichia coli CFT073
aucuuuuauccgaaca

SEQ ID NO: 2629296 - RNA, 22 nt, Escherichia coli CFT073
augaaaaaaccagaaagggaag

SEQ ID NO: 2629297 - RNA, 14 nt, Escherichia coli CFT073
augaaaaacguugc

SEQ ID NO: 2629298 - RNA, 13 nt, Escherichia coli CFT073
augaaaacgccac

SEQ ID NO: 2629299 - RNA, 14 nt, Escherichia coli CFT073
augaaagcagcagc

SEQ ID NO: 2629300 - RNA, 16 nt, Escherichia coli CFT073
augaaagcagcagcug

SEQ ID NO: 2629301 - RNA, 14 nt, Escherichia coli CFT073
augaaauaaaacaa

SEQ ID NO: 2629302 - RNA, 18 nt, Escherichia coli CFT073
augaaauacuaaauauga

SEQ ID NO: 2629303 - RNA, 20 nt, Escherichia coli CFT073
augaaauacuaaauaugaaa

SEQ ID NO: 2629304 - RNA, 20 nt, Escherichia coli CFT073
augaaauaguugcauuccag

SEQ ID NO: 2629305 - RNA, 14 nt, Escherichia coli CFT073
augaaauauuaucu

SEQ ID NO: 2629306 - RNA, 11 nt, Escherichia coli CFT073
augaaaucaug

SEQ ID NO: 2629307 - RNA, 13 nt, Escherichia coli CFT073
augaaaugcaggc

SEQ ID NO: 2629308 - RNA, 17 nt, Escherichia coli CFT073
augaacaaagcaaauaa

SEQ ID NO: 2629309 - RNA, 19 nt, Escherichia coli CFT073
augaaccaguucaaggaug

SEQ ID NO: 2629310 - RNA, 20 nt, Escherichia coli CFT073
augaacggugcgcaggcuuu

SEQ ID NO: 2629311 - RNA, 14 nt, Escherichia coli CFT073
augaagaaaaaccg

SEQ ID NO: 2629312 - RNA, 22 nt, Escherichia coli CFT073
augaagccaaccgggccgcaga

SEQ ID NO: 2629313 - RNA, 21 nt, Escherichia coli CFT073
augaagucauugauaauaucc

SEQ ID NO: 2629314 - RNA, 16 nt, Escherichia coli CFT073
augaagucugccguug

SEQ ID NO: 2629315 - RNA, 12 nt, Escherichia coli CFT073
augaauaacccc

SEQ ID NO: 2629316 - RNA, 17 nt, Escherichia coli CFT073
augaauaacuuccugua

SEQ ID NO: 2629317 - RNA, 18 nt, Escherichia coli CFT073
augaauaaguuucagcau

SEQ ID NO: 2629318 - RNA, 23 nt, Escherichia coli CFT073
augaauaccaagucucaagagug

SEQ ID NO: 2629319 - RNA, 19 nt, Escherichia coli CFT073
augaauacgcgauuuuucu

SEQ ID NO: 2629320 - RNA, 20 nt, Escherichia coli CFT073
augaauagucgccagcucug

SEQ ID NO: 2629321 - RNA, 15 nt, Escherichia coli CFT073
augaauauugcugaa

SEQ ID NO: 2629322 - RNA, 17 nt, Escherichia coli CFT073
augaaucaaaucaacca

SEQ ID NO: 2629323 - RNA, 16 nt, Escherichia coli CFT073
augaaucgucggaaug

SEQ ID NO: 2629324 - RNA, 15 nt, Escherichia coli CFT073
augaaugaaaacgaa

SEQ ID NO: 2629325 - RNA, 23 nt, Escherichia coli CFT073
augaaugcaacugcccaggcaaa

SEQ ID NO: 2629326 - RNA, 15 nt, Escherichia coli CFT073
augaauggaguuguc

SEQ ID NO: 2629327 - RNA, 16 nt, Escherichia coli CFT073
augaauuaccccuggu

SEQ ID NO: 2629328 - RNA, 22 nt, Escherichia coli CFT073
augaauuucaccacugccuuua

SEQ ID NO: 2629329 - RNA, 15 nt, Escherichia coli CFT073
augaauuuugaagga

SEQ ID NO: 2629330 - RNA, 18 nt, Escherichia coli CFT073
augacaaaaaagccaauu

SEQ ID NO: 2629331 - RNA, 14 nt, Escherichia coli CFT073
augacaauguggcc

SEQ ID NO: 2629332 - RNA, 18 nt, Escherichia coli CFT073
augacaauuacaaaauga

SEQ ID NO: 2629333 - RNA, 19 nt, Escherichia coli CFT073
augacaauuacaaaaugac

SEQ ID NO: 2629334 - RNA, 21 nt, Escherichia coli CFT073
augacaauuacaaaaugacau

SEQ ID NO: 2629335 - RNA, 13 nt, Escherichia coli CFT073
augacacacucug

SEQ ID NO: 2629336 - RNA, 14 nt, Escherichia coli CFT073
augacaccaagcac

SEQ ID NO: 2629337 - RNA, 15 nt, Escherichia coli CFT073
augacaccaagcacc

SEQ ID NO: 2629338 - RNA, 16 nt, Escherichia coli CFT073
augacaccaagcacca

SEQ ID NO: 2629339 - RNA, 18 nt, Escherichia coli CFT073
augacaccaagcaccaua

SEQ ID NO: 2629340 - RNA, 16 nt, Escherichia coli CFT073
augacacuuucagcgc

SEQ ID NO: 2629341 - RNA, 13 nt, Escherichia coli CFT073
augacagcggcgu

SEQ ID NO: 2629342 - RNA, 20 nt, Escherichia coli CFT073
augacagcgugguuuucuca

SEQ ID NO: 2629343 - RNA, 15 nt, Escherichia coli CFT073
augacaggcagacga

SEQ ID NO: 2629344 - RNA, 13 nt, Escherichia coli CFT073
augacaguaucac

SEQ ID NO: 2629345 - RNA, 13 nt, Escherichia coli CFT073
augacauccccau

SEQ ID NO: 2629346 - RNA, 19 nt, Escherichia coli CFT073
augacaucgcccucuuuca

SEQ ID NO: 2629347 - RNA, 19 nt, Escherichia coli CFT073
augacauuaaguaacaaua

SEQ ID NO: 2629348 - RNA, 22 nt, Escherichia coli CFT073
augacauucacgcugucggcac

SEQ ID NO: 2629349 - RNA, 21 nt, Escherichia coli CFT073
augaccaccaaauaaaaaaac

SEQ ID NO: 2629350 - RNA, 14 nt, Escherichia coli CFT073
augaccaccgcagc

SEQ ID NO: 2629351 - RNA, 14 nt, Escherichia coli CFT073
augaccagaucggg

SEQ ID NO: 2629352 - RNA, 17 nt, Escherichia coli CFT073
augaccagugaggaugc

SEQ ID NO: 2629353 - RNA, 16 nt, Escherichia coli CFT073
augaccauaaaaggca

SEQ ID NO: 2629354 - RNA, 16 nt, Escherichia coli CFT073
augaccgacagaggau

SEQ ID NO: 2629355 - RNA, 19 nt, Escherichia coli CFT073
augaccgacguuaugcucg

SEQ ID NO: 2629356 - RNA, 17 nt, Escherichia coli CFT073
augaccgcuaauagcgc

SEQ ID NO: 2629357 - RNA, 19 nt, Escherichia coli CFT073
augaccgguucuacaucag

SEQ ID NO: 2629358 - RNA, 13 nt, Escherichia coli CFT073
augaccuucuacc

SEQ ID NO: 2629359 - RNA, 18 nt, Escherichia coli CFT073
augacgaagccggaauau

SEQ ID NO: 2629360 - RNA, 16 nt, Escherichia coli CFT073
augacgaauaauugcc

SEQ ID NO: 2629361 - RNA, 13 nt, Escherichia coli CFT073
augacgcccugug

SEQ ID NO: 2629362 - RNA, 21 nt, Escherichia coli CFT073
augacgccggaugacuuuuca

SEQ ID NO: 2629363 - RNA, 22 nt, Escherichia coli CFT073
augacgcgcucaccgcucuuca

SEQ ID NO: 2629364 - RNA, 18 nt, Escherichia coli CFT073
augacgcugaauaauccc

SEQ ID NO: 2629365 - RNA, 18 nt, Escherichia coli CFT073
augacgcuggaaguacgc

SEQ ID NO: 2629366 - RNA, 13 nt, Escherichia coli CFT073
augacggacgcaa

SEQ ID NO: 2629367 - RNA, 21 nt, Escherichia coli CFT073
augacggaucuuccagcgcau

SEQ ID NO: 2629368 - RNA, 17 nt, Escherichia coli CFT073
augacggccaguugcgc

SEQ ID NO: 2629369 - RNA, 20 nt, Escherichia coli CFT073
augacucauaaaaauauauu

SEQ ID NO: 2629370 - RNA, 14 nt, Escherichia coli CFT073
augacucgccgcaa

SEQ ID NO: 2629371 - RNA, 19 nt, Escherichia coli CFT073
augacucgccgcaaaaccc

SEQ ID NO: 2629372 - RNA, 23 nt, Escherichia coli CFT073
augacucguuauuguuugucgcc

SEQ ID NO: 2629373 - RNA, 19 nt, Escherichia coli CFT073
augacuguccacgacagaa

SEQ ID NO: 2629374 - RNA, 14 nt, Escherichia coli CFT073
augacuuccaacga

SEQ ID NO: 2629375 - RNA, 17 nt, Escherichia coli CFT073
augacuuucaaagagag

SEQ ID NO: 2629376 - RNA, 17 nt, Escherichia coli CFT073
augagaaaacuaucuga

SEQ ID NO: 2629377 - RNA, 15 nt, Escherichia coli CFT073
augagaacaucaucc

SEQ ID NO: 2629378 - RNA, 23 nt, Escherichia coli CFT073
augagacgguuaaaaacagccag

SEQ ID NO: 2629379 - RNA, 16 nt, Escherichia coli CFT073
augagauccagcgagc

SEQ ID NO: 2629380 - RNA, 14 nt, Escherichia coli CFT073
augagauucaacau

SEQ ID NO: 2629381 - RNA, 18 nt, Escherichia coli CFT073
augagcguauagagcagc

SEQ ID NO: 2629382 - RNA, 20 nt, Escherichia coli CFT073
augaggcguuaacagcgcau

SEQ ID NO: 2629383 - RNA, 17 nt, Escherichia coli CFT073
augagguucagccgagc

SEQ ID NO: 2629384 - RNA, 15 nt, Escherichia coli CFT073
augagguuucccgcc

SEQ ID NO: 2629385 - RNA, 17 nt, Escherichia coli CFT073
augaguaaacuucaacg

SEQ ID NO: 2629386 - RNA, 21 nt, Escherichia coli CFT073
augaguaaacuucaacgcugc

SEQ ID NO: 2629387 - RNA, 14 nt, Escherichia coli CFT073
augaguaacaguca

SEQ ID NO: 2629388 - RNA, 15 nt, Escherichia coli CFT073
augaguaauuuuucu

SEQ ID NO: 2629389 - RNA, 12 nt, Escherichia coli CFT073
augaguacagcg

SEQ ID NO: 2629390 - RNA, 18 nt, Escherichia coli CFT073
augaguauuucauccggc

SEQ ID NO: 2629391 - RNA, 13 nt, Escherichia coli CFT073
augaguuaucacu

SEQ ID NO: 2629392 - RNA, 16 nt, Escherichia coli CFT073
augaguucgcggcgca

SEQ ID NO: 2629393 - RNA, 19 nt, Escherichia coli CFT073
augaguugaaauugauggg

SEQ ID NO: 2629394 - RNA, 20 nt, Escherichia coli CFT073
augaguugaaauugaugggu

SEQ ID NO: 2629395 - RNA, 17 nt, Escherichia coli CFT073
augaguuggauaauugc

SEQ ID NO: 2629396 - RNA, 21 nt, Escherichia coli CFT073
augauaaauugccugcgugca

SEQ ID NO: 2629397 - RNA, 14 nt, Escherichia coli CFT073
augauaaccccgca

SEQ ID NO: 2629398 - RNA, 23 nt, Escherichia coli CFT073
augauaaucucgcccaugcgauu

SEQ ID NO: 2629399 - RNA, 18 nt, Escherichia coli CFT073
augauacaaaacagauac

SEQ ID NO: 2629400 - RNA, 15 nt, Escherichia coli CFT073
augauacggaaaucc

SEQ ID NO: 2629401 - RNA, 16 nt, Escherichia coli CFT073
augauacuccacauca

SEQ ID NO: 2629402 - RNA, 14 nt, Escherichia coli CFT073
augauagagaucac

SEQ ID NO: 2629403 - RNA, 16 nt, Escherichia coli CFT073
augauaggcuucaacc

SEQ ID NO: 2629404 - RNA, 21 nt, Escherichia coli CFT073
augauaucccugcuguccuga

SEQ ID NO: 2629405 - RNA, 13 nt, Escherichia coli CFT073
augauauuuuucc

SEQ ID NO: 2629406 - RNA, 14 nt, Escherichia coli CFT073
augaucaaaaaaau

SEQ ID NO: 2629407 - RNA, 13 nt, Escherichia coli CFT073
augaucagaacau

SEQ ID NO: 2629408 - RNA, 18 nt, Escherichia coli CFT073
augaucagaacaucgcca

SEQ ID NO: 2629409 - RNA, 13 nt, Escherichia coli CFT073
augaucaucaccu

SEQ ID NO: 2629410 - RNA, 15 nt, Escherichia coli CFT073
augaucaucaucgcg

SEQ ID NO: 2629411 - RNA, 13 nt, Escherichia coli CFT073
augaucauccgcc

SEQ ID NO: 2629412 - RNA, 21 nt, Escherichia coli CFT073
augaucaucgcgucaucguca

SEQ ID NO: 2629413 - RNA, 19 nt, Escherichia coli CFT073
augaucauuaacgcagaau

SEQ ID NO: 2629414 - RNA, 14 nt, Escherichia coli CFT073
augauccagcuugu

SEQ ID NO: 2629415 - RNA, 14 nt, Escherichia coli CFT073
augaucccagaacc

SEQ ID NO: 2629416 - RNA, 16 nt, Escherichia coli CFT073
augaucccuucacuuc

SEQ ID NO: 2629417 - RNA, 23 nt, Escherichia coli CFT073
augauccugcaauaccgccguua

SEQ ID NO: 2629418 - RNA, 19 nt, Escherichia coli CFT073
augaucgaagcaaagaguu

SEQ ID NO: 2629419 - RNA, 16 nt, Escherichia coli CFT073
augaucgccgccagug

SEQ ID NO: 2629420 - RNA, 19 nt, Escherichia coli CFT073
augaucgccguaacgccuu

SEQ ID NO: 2629421 - RNA, 13 nt, Escherichia coli CFT073
augaucgcggcgu

SEQ ID NO: 2629422 - RNA, 20 nt, Escherichia coli CFT073
augaucgucauaucaucauc

SEQ ID NO: 2629423 - RNA, 15 nt, Escherichia coli CFT073
augaucuaaaagcaa

SEQ ID NO: 2629424 - RNA, 16 nt, Escherichia coli CFT073
augaucuaaaagcaaa

SEQ ID NO: 2629425 - RNA, 17 nt, Escherichia coli CFT073
augaucuaaaagcaaac

SEQ ID NO: 2629426 - RNA, 20 nt, Escherichia coli CFT073
augaucugcgcccaauaucc

SEQ ID NO: 2629427 - RNA, 19 nt, Escherichia coli CFT073
augaugaacgguugcaaua

SEQ ID NO: 2629428 - RNA, 15 nt, Escherichia coli CFT073
augaugacgggcaag

SEQ ID NO: 2629429 - RNA, 20 nt, Escherichia coli CFT073
augaugacuugccuccagcg

SEQ ID NO: 2629430 - RNA, 13 nt, Escherichia coli CFT073
augaugagcgcca

SEQ ID NO: 2629431 - RNA, 13 nt, Escherichia coli CFT073
augaugauaucac

SEQ ID NO: 2629432 - RNA, 15 nt, Escherichia coli CFT073
augaugauugaccau

SEQ ID NO: 2629433 - RNA, 16 nt, Escherichia coli CFT073
augaugauugaccaua

SEQ ID NO: 2629434 - RNA, 18 nt, Escherichia coli CFT073
augaugccacaaacuggc

SEQ ID NO: 2629435 - RNA, 16 nt, Escherichia coli CFT073
augaugccgacggcgc

SEQ ID NO: 2629436 - RNA, 17 nt, Escherichia coli CFT073
augaugccgacggcgca

SEQ ID NO: 2629437 - RNA, 18 nt, Escherichia coli CFT073
augaugccgacggcgcac

SEQ ID NO: 2629438 - RNA, 20 nt, Escherichia coli CFT073
augaugcgacuugucaucau

SEQ ID NO: 2629439 - RNA, 15 nt, Escherichia coli CFT073
augaugcugauggcu

SEQ ID NO: 2629440 - RNA, 17 nt, Escherichia coli CFT073
augauggcgauacugcc

SEQ ID NO: 2629441 - RNA, 18 nt, Escherichia coli CFT073
augauggcgugaaagaaa

SEQ ID NO: 2629442 - RNA, 17 nt, Escherichia coli CFT073
augauggcuaucaagau

SEQ ID NO: 2629443 - RNA, 19 nt, Escherichia coli CFT073
augauggugaaagcaaaaa

SEQ ID NO: 2629444 - RNA, 23 nt, Escherichia coli CFT073
augauggugaaagcaaaaaagaa

SEQ ID NO: 2629445 - RNA, 16 nt, Escherichia coli CFT073
augauguucaacuuuc

SEQ ID NO: 2629446 - RNA, 13 nt, Escherichia coli CFT073
augauuaccagca

SEQ ID NO: 2629447 - RNA, 16 nt, Escherichia coli CFT073
augauuaccagcauca

SEQ ID NO: 2629448 - RNA, 21 nt, Escherichia coli CFT073
augauuaccggagcugcagcc

SEQ ID NO: 2629449 - RNA, 18 nt, Escherichia coli CFT073
augauuaucaugcccuuu

SEQ ID NO: 2629450 - RNA, 16 nt, Escherichia coli CFT073
augauucccagucagg

SEQ ID NO: 2629451 - RNA, 12 nt, Escherichia coli CFT073
augauugaccau

SEQ ID NO: 2629452 - RNA, 14 nt, Escherichia coli CFT073
augauugccacaag

SEQ ID NO: 2629453 - RNA, 20 nt, Escherichia coli CFT073
augauuucaucaucaggcau

SEQ ID NO: 2629454 - RNA, 12 nt, Escherichia coli CFT073
augauuuuccug

SEQ ID NO: 2629455 - RNA, 14 nt, Escherichia coli CFT073
augcaaaugagaau

SEQ ID NO: 2629456 - RNA, 22 nt, Escherichia coli CFT073
augcaacauuaucugaugcgcu

SEQ ID NO: 2629457 - RNA, 12 nt, Escherichia coli CFT073
augcaacgugau

SEQ ID NO: 2629458 - RNA, 14 nt, Escherichia coli CFT073
augcaacugcccag

SEQ ID NO: 2629459 - RNA, 18 nt, Escherichia coli CFT073
augcaagaggguuauuug

SEQ ID NO: 2629460 - RNA, 20 nt, Escherichia coli CFT073
augcaagaggguuauuuguu

SEQ ID NO: 2629461 - RNA, 22 nt, Escherichia coli CFT073
augcaagaggguuauuuguuca

SEQ ID NO: 2629462 - RNA, 19 nt, Escherichia coli CFT073
augcaauuaucauugcucu

SEQ ID NO: 2629463 - RNA, 13 nt, Escherichia coli CFT073
augcacaccaucg

SEQ ID NO: 2629464 - RNA, 16 nt, Escherichia coli CFT073
augcacacgcagcuga

SEQ ID NO: 2629465 - RNA, 20 nt, Escherichia coli CFT073
augcacacgcggagccaguu

SEQ ID NO: 2629466 - RNA, 14 nt, Escherichia coli CFT073
augcacauccacgc

SEQ ID NO: 2629467 - RNA, 21 nt, Escherichia coli CFT073
augcaccggaucgaugccaaa

SEQ ID NO: 2629468 - RNA, 21 nt, Escherichia coli CFT073
augcaccuuuaccagacgggc

SEQ ID NO: 2629469 - RNA, 23 nt, Escherichia coli CFT073
augcacgauauaccgugcugacu

SEQ ID NO: 2629470 - RNA, 17 nt, Escherichia coli CFT073
augcacgcccgcagcgg

SEQ ID NO: 2629471 - RNA, 22 nt, Escherichia coli CFT073
augcacggcagauaaacaaccc

SEQ ID NO: 2629472 - RNA, 17 nt, Escherichia coli CFT073
augcacuccgccgcaca

SEQ ID NO: 2629473 - RNA, 18 nt, Escherichia coli CFT073
augcacugcaacgccuuu

SEQ ID NO: 2629474 - RNA, 19 nt, Escherichia coli CFT073
augcacuuauaugccggau

SEQ ID NO: 2629475 - RNA, 16 nt, Escherichia coli CFT073
augcacuuccagcggc

SEQ ID NO: 2629476 - RNA, 18 nt, Escherichia coli CFT073
augcacuuuuacugacgu

SEQ ID NO: 2629477 - RNA, 16 nt, Escherichia coli CFT073
augcagacucauugua

SEQ ID NO: 2629478 - RNA, 15 nt, Escherichia coli CFT073
augcagcaaccagag

SEQ ID NO: 2629479 - RNA, 16 nt, Escherichia coli CFT073
augcagcaaccagagc

SEQ ID NO: 2629480 - RNA, 15 nt, Escherichia coli CFT073
augcagcagcaaacg

SEQ ID NO: 2629481 - RNA, 20 nt, Escherichia coli CFT073
augcagcauagucagguauu

SEQ ID NO: 2629482 - RNA, 14 nt, Escherichia coli CFT073
augcagcgcaugac

SEQ ID NO: 2629483 - RNA, 15 nt, Escherichia coli CFT073
augcaggcagcacug

SEQ ID NO: 2629484 - RNA, 20 nt, Escherichia coli CFT073
augcaggcaugcaauauucu

SEQ ID NO: 2629485 - RNA, 22 nt, Escherichia coli CFT073
augcagguccacgaccagcgca

SEQ ID NO: 2629486 - RNA, 13 nt, Escherichia coli CFT073
augcaguaccaga

SEQ ID NO: 2629487 - RNA, 14 nt, Escherichia coli CFT073
augcaguaccagau

SEQ ID NO: 2629488 - RNA, 14 nt, Escherichia coli CFT073
augcaguacgucga

SEQ ID NO: 2629489 - RNA, 15 nt, Escherichia coli CFT073
augcagucacgccag

SEQ ID NO: 2629490 - RNA, 21 nt, Escherichia coli CFT073
augcagucacgccaguaacuc

SEQ ID NO: 2629491 - RNA, 20 nt, Escherichia coli CFT073
augcaguuuuggugcgaauc

SEQ ID NO: 2629492 - RNA, 22 nt, Escherichia coli CFT073
augcauacacagauaaacuaca

SEQ ID NO: 2629493 - RNA, 21 nt, Escherichia coli CFT073
augcauacggcgauaaggcgu

SEQ ID NO: 2629494 - RNA, 16 nt, Escherichia coli CFT073
augcauauccaggcua

SEQ ID NO: 2629495 - RNA, 18 nt, Escherichia coli CFT073
augcauaugaaugccagc

SEQ ID NO: 2629496 - RNA, 15 nt, Escherichia coli CFT073
augcaucaacaucau

SEQ ID NO: 2629497 - RNA, 18 nt, Escherichia coli CFT073
augcaucaacaucauuaa

SEQ ID NO: 2629498 - RNA, 18 nt, Escherichia coli CFT073
augcaucauaugcgccag

SEQ ID NO: 2629499 - RNA, 16 nt, Escherichia coli CFT073
augcauucuuauccgu

SEQ ID NO: 2629500 - RNA, 19 nt, Escherichia coli CFT073
augcauuuuuguccucacc

SEQ ID NO: 2629501 - RNA, 14 nt, Escherichia coli CFT073
augccaaacagaau

SEQ ID NO: 2629502 - RNA, 20 nt, Escherichia coli CFT073
augccaaagaaggaaggcau

SEQ ID NO: 2629503 - RNA, 16 nt, Escherichia coli CFT073
augccaaauauuucuu

SEQ ID NO: 2629504 - RNA, 22 nt, Escherichia coli CFT073
augccaaauguauccaucacca

SEQ ID NO: 2629505 - RNA, 21 nt, Escherichia coli CFT073
augccaaccgcgacaauauca

SEQ ID NO: 2629506 - RNA, 22 nt, Escherichia coli CFT073
augccaacggggccagcacaua

SEQ ID NO: 2629507 - RNA, 18 nt, Escherichia coli CFT073
augccaacuaccuucugg

SEQ ID NO: 2629508 - RNA, 17 nt, Escherichia coli CFT073
augccaaucggcggcac

SEQ ID NO: 2629509 - RNA, 22 nt, Escherichia coli CFT073
augccaaucggcggcacucgcu

SEQ ID NO: 2629510 - RNA, 15 nt, Escherichia coli CFT073
augccaaucuucaca

SEQ ID NO: 2629511 - RNA, 22 nt, Escherichia coli CFT073
augccaaucuucacaucaucau

SEQ ID NO: 2629512 - RNA, 17 nt, Escherichia coli CFT073
augccacaaucucgccc

SEQ ID NO: 2629513 - RNA, 21 nt, Escherichia coli CFT073
augccaccacaccagaccaga

SEQ ID NO: 2629514 - RNA, 20 nt, Escherichia coli CFT073
augccaccagaaacagagua

SEQ ID NO: 2629515 - RNA, 14 nt, Escherichia coli CFT073
augccaccaggcag

SEQ ID NO: 2629516 - RNA, 18 nt, Escherichia coli CFT073
augccaccaggcagcaca

SEQ ID NO: 2629517 - RNA, 14 nt, Escherichia coli CFT073
augccacuggaugu

SEQ ID NO: 2629518 - RNA, 16 nt, Escherichia coli CFT073
augccagaaaaggagu

SEQ ID NO: 2629519 - RNA, 19 nt, Escherichia coli CFT073
augccagaaacaucggcag

SEQ ID NO: 2629520 - RNA, 17 nt, Escherichia coli CFT073
augccagacuuuguuga

SEQ ID NO: 2629521 - RNA, 19 nt, Escherichia coli CFT073
augccagcacagaucgcac

SEQ ID NO: 2629522 - RNA, 22 nt, Escherichia coli CFT073
augccagccacgacgucgggcg

SEQ ID NO: 2629523 - RNA, 15 nt, Escherichia coli CFT073
augccagccugcaac

SEQ ID NO: 2629524 - RNA, 13 nt, Escherichia coli CFT073
augccagcgcccc

SEQ ID NO: 2629525 - RNA, 21 nt, Escherichia coli CFT073
augccaggaccacuggcgacg

SEQ ID NO: 2629526 - RNA, 14 nt, Escherichia coli CFT073
augccagucaguua

SEQ ID NO: 2629527 - RNA, 15 nt, Escherichia coli CFT073
augccaguucaguaa

SEQ ID NO: 2629528 - RNA, 15 nt, Escherichia coli CFT073
augccaucaccaacg

SEQ ID NO: 2629529 - RNA, 13 nt, Escherichia coli CFT073
augccauccgcau

SEQ ID NO: 2629530 - RNA, 23 nt, Escherichia coli CFT073
augccauccggcucgcaucaauu

SEQ ID NO: 2629531 - RNA, 22 nt, Escherichia coli CFT073
augccaucgcaugacgcaacaa

SEQ ID NO: 2629532 - RNA, 15 nt, Escherichia coli CFT073
augccaucgccagca

SEQ ID NO: 2629533 - RNA, 16 nt, Escherichia coli CFT073
augccaucgccagcag

SEQ ID NO: 2629534 - RNA, 18 nt, Escherichia coli CFT073
augccaucugccagcaag

SEQ ID NO: 2629535 - RNA, 20 nt, Escherichia coli CFT073
augccauuaacaucccuuca

SEQ ID NO: 2629536 - RNA, 15 nt, Escherichia coli CFT073
augccauuuugcacc

SEQ ID NO: 2629537 - RNA, 20 nt, Escherichia coli CFT073
augccauuuugcaccuucag

SEQ ID NO: 2629538 - RNA, 12 nt, Escherichia coli CFT073
augcccaaaaaa

SEQ ID NO: 2629539 - RNA, 21 nt, Escherichia coli CFT073
augcccaaugagcugaacguc

SEQ ID NO: 2629540 - RNA, 15 nt, Escherichia coli CFT073
augcccaguguugua

SEQ ID NO: 2629541 - RNA, 18 nt, Escherichia coli CFT073
augcccaugccaauuaaa

SEQ ID NO: 2629542 - RNA, 17 nt, Escherichia coli CFT073
augccccgggaagucac

SEQ ID NO: 2629543 - RNA, 21 nt, Escherichia coli CFT073
augccccuguaucaugcagua

SEQ ID NO: 2629544 - RNA, 14 nt, Escherichia coli CFT073
augcccgcaccacc

SEQ ID NO: 2629545 - RNA, 15 nt, Escherichia coli CFT073
augcccgcuauccuc

SEQ ID NO: 2629546 - RNA, 21 nt, Escherichia coli CFT073
augcccggcgaaccgggcgga

SEQ ID NO: 2629547 - RNA, 14 nt, Escherichia coli CFT073
augcccucaauauc

SEQ ID NO: 2629548 - RNA, 19 nt, Escherichia coli CFT073
augccgaagugaaucggau

SEQ ID NO: 2629549 - RNA, 14 nt, Escherichia coli CFT073
augccgacaaacag

SEQ ID NO: 2629550 - RNA, 20 nt, Escherichia coli CFT073
augccgacggcgcacaggca

SEQ ID NO: 2629551 - RNA, 17 nt, Escherichia coli CFT073
augccgcacaucaccgc

SEQ ID NO: 2629552 - RNA, 10 nt, Escherichia coli CFT073
augccgccaa

SEQ ID NO: 2629553 - RNA, 16 nt, Escherichia coli CFT073
augccgcccagcagca

SEQ ID NO: 2629554 - RNA, 18 nt, Escherichia coli CFT073
augccgccgacaguuauc

SEQ ID NO: 2629555 - RNA, 18 nt, Escherichia coli CFT073
augccgcuacaaaaugcg

SEQ ID NO: 2629556 - RNA, 19 nt, Escherichia coli CFT073
augccggauccagcgguug

SEQ ID NO: 2629557 - RNA, 15 nt, Escherichia coli CFT073
augccggaugcgacg

SEQ ID NO: 2629558 - RNA, 20 nt, Escherichia coli CFT073
augccggaugcgcuugcauc

SEQ ID NO: 2629559 - RNA, 16 nt, Escherichia coli CFT073
augccggcaucaaacg

SEQ ID NO: 2629560 - RNA, 17 nt, Escherichia coli CFT073
augccggccagcgccac

SEQ ID NO: 2629561 - RNA, 20 nt, Escherichia coli CFT073
augccggccagcgccaccac

SEQ ID NO: 2629562 - RNA, 23 nt, Escherichia coli CFT073
augccggccagcgccaccaccag

SEQ ID NO: 2629563 - RNA, 22 nt, Escherichia coli CFT073
augccggguuuaagcccggcau

SEQ ID NO: 2629564 - RNA, 11 nt, Escherichia coli CFT073
augccggugau

SEQ ID NO: 2629565 - RNA, 16 nt, Escherichia coli CFT073
augccguaaccagcgc

SEQ ID NO: 2629566 - RNA, 21 nt, Escherichia coli CFT073
augccgucaauccagccgccc

SEQ ID NO: 2629567 - RNA, 16 nt, Escherichia coli CFT073
augccgucaccagcau

SEQ ID NO: 2629568 - RNA, 16 nt, Escherichia coli CFT073
augccguuaaggccaa

SEQ ID NO: 2629569 - RNA, 16 nt, Escherichia coli CFT073
augccguuugcugcau

SEQ ID NO: 2629570 - RNA, 21 nt, Escherichia coli CFT073
augccucucgcgaggagaggc

SEQ ID NO: 2629571 - RNA, 22 nt, Escherichia coli CFT073
augccucuugucucguuucagu

SEQ ID NO: 2629572 - RNA, 16 nt, Escherichia coli CFT073
augccucuuucauccg

SEQ ID NO: 2629573 - RNA, 22 nt, Escherichia coli CFT073
augccugaucaaagaccgguuu

SEQ ID NO: 2629574 - RNA, 23 nt, Escherichia coli CFT073
augccugaugguguugcaccauc

SEQ ID NO: 2629575 - RNA, 23 nt, Escherichia coli CFT073
augccugauuguuuguagccgcc

SEQ ID NO: 2629576 - RNA, 19 nt, Escherichia coli CFT073
augccugcaaugccguuug

SEQ ID NO: 2629577 - RNA, 15 nt, Escherichia coli CFT073
augccuguccucuuc

SEQ ID NO: 2629578 - RNA, 20 nt, Escherichia coli CFT073
augccuugauauguauuaua

SEQ ID NO: 2629579 - RNA, 22 nt, Escherichia coli CFT073
augccuugugggccugaaagcu

SEQ ID NO: 2629580 - RNA, 20 nt, Escherichia coli CFT073
augccuuucuuuguucuucu

SEQ ID NO: 2629581 - RNA, 18 nt, Escherichia coli CFT073
augccuuuugacuccuga

SEQ ID NO: 2629582 - RNA, 18 nt, Escherichia coli CFT073
augcgaagaccgcaucac

SEQ ID NO: 2629583 - RNA, 15 nt, Escherichia coli CFT073
augcgaaugccgggc

SEQ ID NO: 2629584 - RNA, 20 nt, Escherichia coli CFT073
augcgacgcagguuucgauu

SEQ ID NO: 2629585 - RNA, 15 nt, Escherichia coli CFT073
augcgacgccgauaa

SEQ ID NO: 2629586 - RNA, 14 nt, Escherichia coli CFT073
augcgacgcugaua

SEQ ID NO: 2629587 - RNA, 13 nt, Escherichia coli CFT073
augcgacgcuugc

SEQ ID NO: 2629588 - RNA, 15 nt, Escherichia coli CFT073
augcgacgcuugccg

SEQ ID NO: 2629589 - RNA, 12 nt, Escherichia coli CFT073
augcgacggcac

SEQ ID NO: 2629590 - RNA, 20 nt, Escherichia coli CFT073
augcgacguuacaaccacau

SEQ ID NO: 2629591 - RNA, 15 nt, Escherichia coli CFT073
augcgagugucauuc

SEQ ID NO: 2629592 - RNA, 16 nt, Escherichia coli CFT073
augcgauaaccaggca

SEQ ID NO: 2629593 - RNA, 13 nt, Escherichia coli CFT073
augcgaugaaacg

SEQ ID NO: 2629594 - RNA, 12 nt, Escherichia coli CFT073
augcgaugcuga

SEQ ID NO: 2629595 - RNA, 12 nt, Escherichia coli CFT073
augcgaugcugg

SEQ ID NO: 2629596 - RNA, 15 nt, Escherichia coli CFT073
augcgcaacaccgua

SEQ ID NO: 2629597 - RNA, 22 nt, Escherichia coli CFT073
augcgcaacaccguaagaaagg

SEQ ID NO: 2629598 - RNA, 16 nt, Escherichia coli CFT073
augcgcaccuuuacca

SEQ ID NO: 2629599 - RNA, 13 nt, Escherichia coli CFT073
augcgcagcauaa

SEQ ID NO: 2629600 - RNA, 18 nt, Escherichia coli CFT073
augcgcauaagaccguga

SEQ ID NO: 2629601 - RNA, 23 nt, Escherichia coli CFT073
augcgcaucaaggccaggcagaa

SEQ ID NO: 2629602 - RNA, 20 nt, Escherichia coli CFT073
augcgcaugaugccggguuu

SEQ ID NO: 2629603 - RNA, 14 nt, Escherichia coli CFT073
augcgccacuccac

SEQ ID NO: 2629604 - RNA, 12 nt, Escherichia coli CFT073
augcgccagacu

SEQ ID NO: 2629605 - RNA, 15 nt, Escherichia coli CFT073
augcgccagguaacg

SEQ ID NO: 2629606 - RNA, 23 nt, Escherichia coli CFT073
augcgccagguaacgaagauggc

SEQ ID NO: 2629607 - RNA, 16 nt, Escherichia coli CFT073
augcgccauaccaugc

SEQ ID NO: 2629608 - RNA, 17 nt, Escherichia coli CFT073
augcgcccaugccgccu

SEQ ID NO: 2629609 - RNA, 15 nt, Escherichia coli CFT073
augcgccgccaaacg

SEQ ID NO: 2629610 - RNA, 16 nt, Escherichia coli CFT073
augcgcgaggaauaug

SEQ ID NO: 2629611 - RNA, 14 nt, Escherichia coli CFT073
augcgcucaauaua

SEQ ID NO: 2629612 - RNA, 22 nt, Escherichia coli CFT073
augcgcucgaucaguucagcag

SEQ ID NO: 2629613 - RNA, 22 nt, Escherichia coli CFT073
augcgcucgcauccugccagga

SEQ ID NO: 2629614 - RNA, 18 nt, Escherichia coli CFT073
augcgcuggcgcaacugc

SEQ ID NO: 2629615 - RNA, 14 nt, Escherichia coli CFT073
augcgcugucauuc

SEQ ID NO: 2629616 - RNA, 20 nt, Escherichia coli CFT073
augcggcaucuucuccacgc

SEQ ID NO: 2629617 - RNA, 21 nt, Escherichia coli CFT073
augcggcgaaggcaucggcaa

SEQ ID NO: 2629618 - RNA, 12 nt, Escherichia coli CFT073
augcggcgagga

SEQ ID NO: 2629619 - RNA, 14 nt, Escherichia coli CFT073
augcggcgcugacg

SEQ ID NO: 2629620 - RNA, 16 nt, Escherichia coli CFT073
augcggcgugaacacc

SEQ ID NO: 2629621 - RNA, 13 nt, Escherichia coli CFT073
augcggcgugacc

SEQ ID NO: 2629622 - RNA, 15 nt, Escherichia coli CFT073
augcggcgugauaaa

SEQ ID NO: 2629623 - RNA, 21 nt, Escherichia coli CFT073
augcggcgugauaaaagucag

SEQ ID NO: 2629624 - RNA, 20 nt, Escherichia coli CFT073
augcggcgugccuucacggg

SEQ ID NO: 2629625 - RNA, 13 nt, Escherichia coli CFT073
augcgggcgaggg

SEQ ID NO: 2629626 - RNA, 16 nt, Escherichia coli CFT073
augcggguaacgccca

SEQ ID NO: 2629627 - RNA, 16 nt, Escherichia coli CFT073
augcgggugaacgcgu

SEQ ID NO: 2629628 - RNA, 16 nt, Escherichia coli CFT073
augcggucgcugccgc

SEQ ID NO: 2629629 - RNA, 18 nt, Escherichia coli CFT073
augcguaccauuucuucu

SEQ ID NO: 2629630 - RNA, 20 nt, Escherichia coli CFT073
augcguagcugggcaacaaa

SEQ ID NO: 2629631 - RNA, 21 nt, Escherichia coli CFT073
augcgucuuccgugccugacg

SEQ ID NO: 2629632 - RNA, 18 nt, Escherichia coli CFT073
augcgucuugccaucaua

SEQ ID NO: 2629633 - RNA, 13 nt, Escherichia coli CFT073
augcguuaagcgu

SEQ ID NO: 2629634 - RNA, 14 nt, Escherichia coli CFT073
augcguuaucgcca

SEQ ID NO: 2629635 - RNA, 16 nt, Escherichia coli CFT073
augcguuaucgccauc

SEQ ID NO: 2629636 - RNA, 22 nt, Escherichia coli CFT073
augcguuccaguucgcuggcau

SEQ ID NO: 2629637 - RNA, 22 nt, Escherichia coli CFT073
augcguuggccaaaguuccggg

SEQ ID NO: 2629638 - RNA, 20 nt, Escherichia coli CFT073
augcguuguagcuuuuuccu

SEQ ID NO: 2629639 - RNA, 19 nt, Escherichia coli CFT073
augcguuuggagccgcugg

SEQ ID NO: 2629640 - RNA, 18 nt, Escherichia coli CFT073
augcucaacaauaaacug

SEQ ID NO: 2629641 - RNA, 15 nt, Escherichia coli CFT073
augcucauaccauuc

SEQ ID NO: 2629642 - RNA, 12 nt, Escherichia coli CFT073
augcuccccaga

SEQ ID NO: 2629643 - RNA, 23 nt, Escherichia coli CFT073
augcuccccuuucuuauuuuucu

SEQ ID NO: 2629644 - RNA, 23 nt, Escherichia coli CFT073
augcucucuucgccaaugaccgc

SEQ ID NO: 2629645 - RNA, 16 nt, Escherichia coli CFT073
augcucugccagcgua

SEQ ID NO: 2629646 - RNA, 19 nt, Escherichia coli CFT073
augcucuuaauacgaguuu

SEQ ID NO: 2629647 - RNA, 13 nt, Escherichia coli CFT073
augcucuuuacgc

SEQ ID NO: 2629648 - RNA, 19 nt, Escherichia coli CFT073
augcugacacaucuuuucc

SEQ ID NO: 2629649 - RNA, 22 nt, Escherichia coli CFT073
augcugacuacuuucaugcuca

SEQ ID NO: 2629650 - RNA, 20 nt, Escherichia coli CFT073
augcugagcuucuucaaaaa

SEQ ID NO: 2629651 - RNA, 22 nt, Escherichia coli CFT073
augcugagcuucuucaaaaaag

SEQ ID NO: 2629652 - RNA, 16 nt, Escherichia coli CFT073
augcugauucaucuau

SEQ ID NO: 2629653 - RNA, 14 nt, Escherichia coli CFT073
augcugcaauaaaa

SEQ ID NO: 2629654 - RNA, 21 nt, Escherichia coli CFT073
augcugcaauaaaauaucuuc

SEQ ID NO: 2629655 - RNA, 14 nt, Escherichia coli CFT073
augcugcaaucauu

SEQ ID NO: 2629656 - RNA, 23 nt, Escherichia coli CFT073
augcugcaccccacaaacagaau

SEQ ID NO: 2629657 - RNA, 14 nt, Escherichia coli CFT073
augcugccacacug

SEQ ID NO: 2629658 - RNA, 20 nt, Escherichia coli CFT073
augcugccuucggugggaaa

SEQ ID NO: 2629659 - RNA, 20 nt, Escherichia coli CFT073
augcugcgccaguugcuuau

SEQ ID NO: 2629660 - RNA, 21 nt, Escherichia coli CFT073
augcugcgggucaaucggcgc

SEQ ID NO: 2629661 - RNA, 16 nt, Escherichia coli CFT073
augcugcuccagcgua

SEQ ID NO: 2629662 - RNA, 19 nt, Escherichia coli CFT073
augcugcucgcaaaauaaa

SEQ ID NO: 2629663 - RNA, 14 nt, Escherichia coli CFT073
augcugcuuacaua

SEQ ID NO: 2629664 - RNA, 15 nt, Escherichia coli CFT073
augcugcuuucugcg

SEQ ID NO: 2629665 - RNA, 14 nt, Escherichia coli CFT073
augcugcuuuuacg

SEQ ID NO: 2629666 - RNA, 13 nt, Escherichia coli CFT073
augcuggaaccac

SEQ ID NO: 2629667 - RNA, 22 nt, Escherichia coli CFT073
augcuggcgcaucuuaucaggc

SEQ ID NO: 2629668 - RNA, 21 nt, Escherichia coli CFT073
augcuggcuuuuggaccgcca

SEQ ID NO: 2629669 - RNA, 18 nt, Escherichia coli CFT073
augcugguuuugaaaaga

SEQ ID NO: 2629670 - RNA, 14 nt, Escherichia coli CFT073
augcuguaaacaac

SEQ ID NO: 2629671 - RNA, 14 nt, Escherichia coli CFT073
augcuguauguucc

SEQ ID NO: 2629672 - RNA, 21 nt, Escherichia coli CFT073
augcuguugcugauugguguc

SEQ ID NO: 2629673 - RNA, 18 nt, Escherichia coli CFT073
augcuuaaauauuuuuua

SEQ ID NO: 2629674 - RNA, 13 nt, Escherichia coli CFT073
augcuuacuugcc

SEQ ID NO: 2629675 - RNA, 16 nt, Escherichia coli CFT073
augcuucagauaccaa

SEQ ID NO: 2629676 - RNA, 21 nt, Escherichia coli CFT073
augcuucaucgugacaaucuc

SEQ ID NO: 2629677 - RNA, 23 nt, Escherichia coli CFT073
augcuucuucugugaagcaugag

SEQ ID NO: 2629678 - RNA, 16 nt, Escherichia coli CFT073
augcuugacucuguag

SEQ ID NO: 2629679 - RNA, 16 nt, Escherichia coli CFT073
augcuuuacguauccg

SEQ ID NO: 2629680 - RNA, 19 nt, Escherichia coli CFT073
augcuuuacguauccguuc

SEQ ID NO: 2629681 - RNA, 17 nt, Escherichia coli CFT073
augcuuuacguuccuga

SEQ ID NO: 2629682 - RNA, 19 nt, Escherichia coli CFT073
augcuuugaccucccgcug

SEQ ID NO: 2629683 - RNA, 14 nt, Escherichia coli CFT073
augcuuuuuuaaaa

SEQ ID NO: 2629684 - RNA, 13 nt, Escherichia coli CFT073
auggaaaaacagc

SEQ ID NO: 2629685 - RNA, 13 nt, Escherichia coli CFT073
auggaaaucaccc

SEQ ID NO: 2629686 - RNA, 12 nt, Escherichia coli CFT073
auggaacaacac

SEQ ID NO: 2629687 - RNA, 19 nt, Escherichia coli CFT073
auggaacucuuucugacga

SEQ ID NO: 2629688 - RNA, 15 nt, Escherichia coli CFT073
auggaauagaaucac

SEQ ID NO: 2629689 - RNA, 19 nt, Escherichia coli CFT073
auggaauggucaauggugg

SEQ ID NO: 2629690 - RNA, 14 nt, Escherichia coli CFT073
auggacaaaagccc

SEQ ID NO: 2629691 - RNA, 13 nt, Escherichia coli CFT073
auggacgcagacc

SEQ ID NO: 2629692 - RNA, 17 nt, Escherichia coli CFT073
auggacgcagaccaaag

SEQ ID NO: 2629693 - RNA, 18 nt, Escherichia coli CFT073
auggacgucaaaaggcuc

SEQ ID NO: 2629694 - RNA, 15 nt, Escherichia coli CFT073
auggacgucgauaaa

SEQ ID NO: 2629695 - RNA, 17 nt, Escherichia coli CFT073
auggacguuaauccgcu

SEQ ID NO: 2629696 - RNA, 22 nt, Escherichia coli CFT073
auggacguuaauccgcucugcc

SEQ ID NO: 2629697 - RNA, 23 nt, Escherichia coli CFT073
auggacuuuuacugucugcucgg

SEQ ID NO: 2629698 - RNA, 16 nt, Escherichia coli CFT073
auggagcuaaacagag

SEQ ID NO: 2629699 - RNA, 12 nt, Escherichia coli CFT073
auggaucaccau

SEQ ID NO: 2629700 - RNA, 14 nt, Escherichia coli CFT073
auggaucaccaucg

SEQ ID NO: 2629701 - RNA, 17 nt, Escherichia coli CFT073
auggauccccgcagcaa

SEQ ID NO: 2629702 - RNA, 20 nt, Escherichia coli CFT073
auggaucuuugacugaaauu

SEQ ID NO: 2629703 - RNA, 15 nt, Escherichia coli CFT073
auggaugagcaaacg

SEQ ID NO: 2629704 - RNA, 18 nt, Escherichia coli CFT073
auggaugcaucuucauua

SEQ ID NO: 2629705 - RNA, 20 nt, Escherichia coli CFT073
auggauggugcuaauugcac

SEQ ID NO: 2629706 - RNA, 13 nt, Escherichia coli CFT073
auggauucaagca

SEQ ID NO: 2629707 - RNA, 16 nt, Escherichia coli CFT073
auggauucaugauacu

SEQ ID NO: 2629708 - RNA, 16 nt, Escherichia coli CFT073
auggcaaaauccagaa

SEQ ID NO: 2629709 - RNA, 13 nt, Escherichia coli CFT073
auggcaacagcag

SEQ ID NO: 2629710 - RNA, 20 nt, Escherichia coli CFT073
auggcacaccauagaccaug

SEQ ID NO: 2629711 - RNA, 21 nt, Escherichia coli CFT073
auggcacaugacuuccaacga

SEQ ID NO: 2629712 - RNA, 18 nt, Escherichia coli CFT073
auggcacgcauccggcaa

SEQ ID NO: 2629713 - RNA, 15 nt, Escherichia coli CFT073
auggcacuucaagau

SEQ ID NO: 2629714 - RNA, 15 nt, Escherichia coli CFT073
auggcagaccaaacg

SEQ ID NO: 2629715 - RNA, 15 nt, Escherichia coli CFT073
auggcagaguugcca

SEQ ID NO: 2629716 - RNA, 22 nt, Escherichia coli CFT073
auggcagccauuuguuggcgcu

SEQ ID NO: 2629717 - RNA, 20 nt, Escherichia coli CFT073
auggcagugcgccauauaag

SEQ ID NO: 2629718 - RNA, 12 nt, Escherichia coli CFT073
auggcauaaccg

SEQ ID NO: 2629719 - RNA, 20 nt, Escherichia coli CFT073
auggcauaccauccggcaua

SEQ ID NO: 2629720 - RNA, 20 nt, Escherichia coli CFT073
auggcauccaagcugguggc

SEQ ID NO: 2629721 - RNA, 13 nt, Escherichia coli CFT073
auggcauccagcg

SEQ ID NO: 2629722 - RNA, 13 nt, Escherichia coli CFT073
auggcauccuguu

SEQ ID NO: 2629723 - RNA, 19 nt, Escherichia coli CFT073
auggcauccuugcuaacca

SEQ ID NO: 2629724 - RNA, 22 nt, Escherichia coli CFT073
auggccaaugcggucgcgauaa

SEQ ID NO: 2629725 - RNA, 20 nt, Escherichia coli CFT073
auggcccaugacauccccau

SEQ ID NO: 2629726 - RNA, 15 nt, Escherichia coli CFT073
auggccccagguauc

SEQ ID NO: 2629727 - RNA, 22 nt, Escherichia coli CFT073
auggcccgcuugccagauggca

SEQ ID NO: 2629728 - RNA, 23 nt, Escherichia coli CFT073
auggccgggugauuuuucagcau

SEQ ID NO: 2629729 - RNA, 16 nt, Escherichia coli CFT073
auggccucugccagcu

SEQ ID NO: 2629730 - RNA, 20 nt, Escherichia coli CFT073
auggccugaugugacgcugu

SEQ ID NO: 2629731 - RNA, 21 nt, Escherichia coli CFT073
auggccuuuaacacgcaacac

SEQ ID NO: 2629732 - RNA, 13 nt, Escherichia coli CFT073
auggccuuucugg

SEQ ID NO: 2629733 - RNA, 23 nt, Escherichia coli CFT073
auggcgaaaaaccuaauacucug

SEQ ID NO: 2629734 - RNA, 17 nt, Escherichia coli CFT073
auggcgaacauaaggau

SEQ ID NO: 2629735 - RNA, 14 nt, Escherichia coli CFT073
auggcgaauggcac

SEQ ID NO: 2629736 - RNA, 17 nt, Escherichia coli CFT073
auggcgacguaccagcg

SEQ ID NO: 2629737 - RNA, 15 nt, Escherichia coli CFT073
auggcgaucgugaua

SEQ ID NO: 2629738 - RNA, 17 nt, Escherichia coli CFT073
auggcgcaguugccgga

SEQ ID NO: 2629739 - RNA, 17 nt, Escherichia coli CFT073
auggcgcccaucggcgc

SEQ ID NO: 2629740 - RNA, 20 nt, Escherichia coli CFT073
auggcgcgccaccucuuuca

SEQ ID NO: 2629741 - RNA, 23 nt, Escherichia coli CFT073
auggcgcggaacucgcugcgcgg

SEQ ID NO: 2629742 - RNA, 15 nt, Escherichia coli CFT073
auggcgcuaaaaccg

SEQ ID NO: 2629743 - RNA, 11 nt, Escherichia coli CFT073
auggcggcugg

SEQ ID NO: 2629744 - RNA, 23 nt, Escherichia coli CFT073
auggcggcuuggcugcaaauauu

SEQ ID NO: 2629745 - RNA, 22 nt, Escherichia coli CFT073
auggcggucgcagggacgcgca

SEQ ID NO: 2629746 - RNA, 19 nt, Escherichia coli CFT073
auggcggugagggggggau

SEQ ID NO: 2629747 - RNA, 16 nt, Escherichia coli CFT073
auggcgugaaagaaaa

SEQ ID NO: 2629748 - RNA, 16 nt, Escherichia coli CFT073
auggcguuaggcggaa

SEQ ID NO: 2629749 - RNA, 14 nt, Escherichia coli CFT073
auggcguuaucacg

SEQ ID NO: 2629750 - RNA, 16 nt, Escherichia coli CFT073
auggcguuaucacggu

SEQ ID NO: 2629751 - RNA, 13 nt, Escherichia coli CFT073
auggcguuuccuu

SEQ ID NO: 2629752 - RNA, 20 nt, Escherichia coli CFT073
auggcuaaaguacguaaaac

SEQ ID NO: 2629753 - RNA, 20 nt, Escherichia coli CFT073
auggcuaucgaaaucaaagu

SEQ ID NO: 2629754 - RNA, 21 nt, Escherichia coli CFT073
auggcuaucgaaaucaaagua

SEQ ID NO: 2629755 - RNA, 15 nt, Escherichia coli CFT073
auggcucagauugaa

SEQ ID NO: 2629756 - RNA, 13 nt, Escherichia coli CFT073
auggcuccgggug

SEQ ID NO: 2629757 - RNA, 22 nt, Escherichia coli CFT073
auggcuccgggugugacaacaa

SEQ ID NO: 2629758 - RNA, 19 nt, Escherichia coli CFT073
auggcugaaagcgccggga

SEQ ID NO: 2629759 - RNA, 22 nt, Escherichia coli CFT073
auggcugaaagcgccgggaaug

SEQ ID NO: 2629760 - RNA, 18 nt, Escherichia coli CFT073
auggcugaguuaccagcg

SEQ ID NO: 2629761 - RNA, 12 nt, Escherichia coli CFT073
auggcugauuac

SEQ ID NO: 2629762 - RNA, 23 nt, Escherichia coli CFT073
auggcugccuuuuuuacaggugu

SEQ ID NO: 2629763 - RNA, 17 nt, Escherichia coli CFT073
auggcuggaaucaucaa

SEQ ID NO: 2629764 - RNA, 20 nt, Escherichia coli CFT073
auggcuguaggguggggaaa

SEQ ID NO: 2629765 - RNA, 18 nt, Escherichia coli CFT073
auggcuuaaccccguauc

SEQ ID NO: 2629766 - RNA, 16 nt, Escherichia coli CFT073
auggcuucuggcugcu

SEQ ID NO: 2629767 - RNA, 21 nt, Escherichia coli CFT073
auggcuucuggcugcuccaga

SEQ ID NO: 2629768 - RNA, 15 nt, Escherichia coli CFT073
auggcuucuuccccg

SEQ ID NO: 2629769 - RNA, 23 nt, Escherichia coli CFT073
auggcuugaagcaauagcauuac

SEQ ID NO: 2629770 - RNA, 15 nt, Escherichia coli CFT073
auggcuugcgccaug

SEQ ID NO: 2629771 - RNA, 13 nt, Escherichia coli CFT073
auggcuuuccacc

SEQ ID NO: 2629772 - RNA, 15 nt, Escherichia coli CFT073
auggcuuuccaccug

SEQ ID NO: 2629773 - RNA, 14 nt, Escherichia coli CFT073
auggcuuugcccuu

SEQ ID NO: 2629774 - RNA, 18 nt, Escherichia coli CFT073
augggaaaugacauucac

SEQ ID NO: 2629775 - RNA, 11 nt, Escherichia coli CFT073
augggagcaga

SEQ ID NO: 2629776 - RNA, 14 nt, Escherichia coli CFT073
augggaggaaaagu

SEQ ID NO: 2629777 - RNA, 21 nt, Escherichia coli CFT073
augggaggaaaaguaaucaau

SEQ ID NO: 2629778 - RNA, 19 nt, Escherichia coli CFT073
augggcaaacaaaaaaccu

SEQ ID NO: 2629779 - RNA, 20 nt, Escherichia coli CFT073
augggcaaacaaaaaaccua

SEQ ID NO: 2629780 - RNA, 18 nt, Escherichia coli CFT073
augggcaauuucuuucgc

SEQ ID NO: 2629781 - RNA, 14 nt, Escherichia coli CFT073
augggcauccacag

SEQ ID NO: 2629782 - RNA, 22 nt, Escherichia coli CFT073
augggcgaccguaaauucuccc

SEQ ID NO: 2629783 - RNA, 23 nt, Escherichia coli CFT073
augggcggucccacaacagguau

SEQ ID NO: 2629784 - RNA, 12 nt, Escherichia coli CFT073
augggcgugaua

SEQ ID NO: 2629785 - RNA, 21 nt, Escherichia coli CFT073
augggcgugauaaugcguucg

SEQ ID NO: 2629786 - RNA, 22 nt, Escherichia coli CFT073
augggcgugauaaugcguucgc

SEQ ID NO: 2629787 - RNA, 17 nt, Escherichia coli CFT073
augggcuccacaaaaug

SEQ ID NO: 2629788 - RNA, 19 nt, Escherichia coli CFT073
augggcuuaaugagauaau

SEQ ID NO: 2629789 - RNA, 19 nt, Escherichia coli CFT073
auggggacaucaaagaaaa

SEQ ID NO: 2629790 - RNA, 23 nt, Escherichia coli CFT073
auggggucaggugggaccaccgc

SEQ ID NO: 2629791 - RNA, 11 nt, Escherichia coli CFT073
augggguggaa

SEQ ID NO: 2629792 - RNA, 14 nt, Escherichia coli CFT073
augggugugcugac

SEQ ID NO: 2629793 - RNA, 21 nt, Escherichia coli CFT073
auggguuacgcgaaccaauca

SEQ ID NO: 2629794 - RNA, 13 nt, Escherichia coli CFT073
auggguuguugag

SEQ ID NO: 2629795 - RNA, 14 nt, Escherichia coli CFT073
augguaaagcaccu

SEQ ID NO: 2629796 - RNA, 20 nt, Escherichia coli CFT073
augguaaagcaccugauuag

SEQ ID NO: 2629797 - RNA, 16 nt, Escherichia coli CFT073
augguaacaccagagu

SEQ ID NO: 2629798 - RNA, 18 nt, Escherichia coli CFT073
augguacuggcgacugcc

SEQ ID NO: 2629799 - RNA, 23 nt, Escherichia coli CFT073
augguagaaacgcugaaugcugc

SEQ ID NO: 2629800 - RNA, 14 nt, Escherichia coli CFT073
augguagcgugaug

SEQ ID NO: 2629801 - RNA, 14 nt, Escherichia coli CFT073
augguaucggcauc

SEQ ID NO: 2629802 - RNA, 14 nt, Escherichia coli CFT073
augguaucuaucac

SEQ ID NO: 2629803 - RNA, 22 nt, Escherichia coli CFT073
augguaucuaucacuauaaaua

SEQ ID NO: 2629804 - RNA, 13 nt, Escherichia coli CFT073
augguauucaucg

SEQ ID NO: 2629805 - RNA, 17 nt, Escherichia coli CFT073
auggucaacauucccug

SEQ ID NO: 2629806 - RNA, 12 nt, Escherichia coli CFT073
auggucaccaca

SEQ ID NO: 2629807 - RNA, 12 nt, Escherichia coli CFT073
auggucaucauc

SEQ ID NO: 2629808 - RNA, 17 nt, Escherichia coli CFT073
auggucauuccagucug

SEQ ID NO: 2629809 - RNA, 17 nt, Escherichia coli CFT073
auggucgccccggaacg

SEQ ID NO: 2629810 - RNA, 20 nt, Escherichia coli CFT073
auggucucgccgauagucag

SEQ ID NO: 2629811 - RNA, 22 nt, Escherichia coli CFT073
auggucugcgccgcauucaggg

SEQ ID NO: 2629812 - RNA, 19 nt, Escherichia coli CFT073
auggucuguaccaccagaa

SEQ ID NO: 2629813 - RNA, 17 nt, Escherichia coli CFT073
auggugaaaccgcagca

SEQ ID NO: 2629814 - RNA, 17 nt, Escherichia coli CFT073
auggugaaagcaaaaaa

SEQ ID NO: 2629815 - RNA, 22 nt, Escherichia coli CFT073
auggugaaguuauuaaugacaa

SEQ ID NO: 2629816 - RNA, 14 nt, Escherichia coli CFT073
auggugacaaacac

SEQ ID NO: 2629817 - RNA, 13 nt, Escherichia coli CFT073
auggugaccugca

SEQ ID NO: 2629818 - RNA, 13 nt, Escherichia coli CFT073
auggugcagcaga

SEQ ID NO: 2629819 - RNA, 14 nt, Escherichia coli CFT073
auggugcagcagac

SEQ ID NO: 2629820 - RNA, 15 nt, Escherichia coli CFT073
auggugcuaauugca

SEQ ID NO: 2629821 - RNA, 21 nt, Escherichia coli CFT073
auggugcuaauugcaccaucc

SEQ ID NO: 2629822 - RNA, 19 nt, Escherichia coli CFT073
augguggaguggcccaggu

SEQ ID NO: 2629823 - RNA, 18 nt, Escherichia coli CFT073
augguggucgcaucaucc

SEQ ID NO: 2629824 - RNA, 22 nt, Escherichia coli CFT073
augguguaagaaugcuccccag

SEQ ID NO: 2629825 - RNA, 14 nt, Escherichia coli CFT073
augguguacucauc

SEQ ID NO: 2629826 - RNA, 21 nt, Escherichia coli CFT073
auggugucuucguugugaaua

SEQ ID NO: 2629827 - RNA, 14 nt, Escherichia coli CFT073
augguguucacuca

SEQ ID NO: 2629828 - RNA, 20 nt, Escherichia coli CFT073
augguguugcaccaucaggc

SEQ ID NO: 2629829 - RNA, 17 nt, Escherichia coli CFT073
augguuaaauugaaauu

SEQ ID NO: 2629830 - RNA, 21 nt, Escherichia coli CFT073
augguuaaauugaaauuugca

SEQ ID NO: 2629831 - RNA, 14 nt, Escherichia coli CFT073
augguuauuaccaa

SEQ ID NO: 2629832 - RNA, 13 nt, Escherichia coli CFT073
augguucaagacg

SEQ ID NO: 2629833 - RNA, 21 nt, Escherichia coli CFT073
augguucccggaccggcggua

SEQ ID NO: 2629834 - RNA, 22 nt, Escherichia coli CFT073
augguugagaggggaacacggc

SEQ ID NO: 2629835 - RNA, 16 nt, Escherichia coli CFT073
augguuucgcccaccu

SEQ ID NO: 2629836 - RNA, 17 nt, Escherichia coli CFT073
augguuucgcuuugccc

SEQ ID NO: 2629837 - RNA, 16 nt, Escherichia coli CFT073
augguuuuaauacugc

SEQ ID NO: 2629838 - RNA, 11 nt, Escherichia coli CFT073
augguuuucaa

SEQ ID NO: 2629839 - RNA, 21 nt, Escherichia coli CFT073
auguaaaaguugcaguccgcu

SEQ ID NO: 2629840 - RNA, 17 nt, Escherichia coli CFT073
auguaaacaagacauca

SEQ ID NO: 2629841 - RNA, 18 nt, Escherichia coli CFT073
auguaaacaagacaucac

SEQ ID NO: 2629842 - RNA, 16 nt, Escherichia coli CFT073
auguaaccguuuguuu

SEQ ID NO: 2629843 - RNA, 17 nt, Escherichia coli CFT073
auguaacugccuuuccc

SEQ ID NO: 2629844 - RNA, 16 nt, Escherichia coli CFT073
auguaagaugaaauag

SEQ ID NO: 2629845 - RNA, 21 nt, Escherichia coli CFT073
auguaagcgcauaaucaaucg

SEQ ID NO: 2629846 - RNA, 17 nt, Escherichia coli CFT073
auguaagucugaaucag

SEQ ID NO: 2629847 - RNA, 13 nt, Escherichia coli CFT073
auguaauaaaccu

SEQ ID NO: 2629848 - RNA, 16 nt, Escherichia coli CFT073
auguacuaaccaugcg

SEQ ID NO: 2629849 - RNA, 14 nt, Escherichia coli CFT073
auguacucgcuguu

SEQ ID NO: 2629850 - RNA, 16 nt, Escherichia coli CFT073
auguacucgcuguuga

SEQ ID NO: 2629851 - RNA, 19 nt, Escherichia coli CFT073
auguagcggaucgccgccg

SEQ ID NO: 2629852 - RNA, 20 nt, Escherichia coli CFT073
auguagcggaucgccgccgg

SEQ ID NO: 2629853 - RNA, 23 nt, Escherichia coli CFT073
auguagcgugauuuuguaggucg

SEQ ID NO: 2629854 - RNA, 16 nt, Escherichia coli CFT073
auguagucaucugcac

SEQ ID NO: 2629855 - RNA, 14 nt, Escherichia coli CFT073
auguauccggcaug

SEQ ID NO: 2629856 - RNA, 12 nt, Escherichia coli CFT073
auguaucgauau

SEQ ID NO: 2629857 - RNA, 23 nt, Escherichia coli CFT073
auguaucgcccuuaccauuccca

SEQ ID NO: 2629858 - RNA, 18 nt, Escherichia coli CFT073
auguauuuguccacgccg

SEQ ID NO: 2629859 - RNA, 20 nt, Escherichia coli CFT073
augucacaaucccuuccacc

SEQ ID NO: 2629860 - RNA, 22 nt, Escherichia coli CFT073
augucacaaucccuuccaccga

SEQ ID NO: 2629861 - RNA, 18 nt, Escherichia coli CFT073
augucaccagccggucau

SEQ ID NO: 2629862 - RNA, 16 nt, Escherichia coli CFT073
augucagaaagaaauu

SEQ ID NO: 2629863 - RNA, 21 nt, Escherichia coli CFT073
augucagagcuguagauauau

SEQ ID NO: 2629864 - RNA, 12 nt, Escherichia coli CFT073
augucaggcguc

SEQ ID NO: 2629865 - RNA, 21 nt, Escherichia coli CFT073
augucaguaguuuuugcagau

SEQ ID NO: 2629866 - RNA, 14 nt, Escherichia coli CFT073
augucagugguggc

SEQ ID NO: 2629867 - RNA, 14 nt, Escherichia coli CFT073
augucaguugcaua

SEQ ID NO: 2629868 - RNA, 17 nt, Escherichia coli CFT073
augucauaaaaaugagg

SEQ ID NO: 2629869 - RNA, 13 nt, Escherichia coli CFT073
augucauagcaau

SEQ ID NO: 2629870 - RNA, 17 nt, Escherichia coli CFT073
augucaucgcguuaauc

SEQ ID NO: 2629871 - RNA, 12 nt, Escherichia coli CFT073
augucaucucug

SEQ ID NO: 2629872 - RNA, 20 nt, Escherichia coli CFT073
augucauuacgaucaagaau

SEQ ID NO: 2629873 - RNA, 18 nt, Escherichia coli CFT073
auguccgagcuuaaugaa

SEQ ID NO: 2629874 - RNA, 17 nt, Escherichia coli CFT073
auguccgccaccgccaa

SEQ ID NO: 2629875 - RNA, 16 nt, Escherichia coli CFT073
auguccugcggacagu

SEQ ID NO: 2629876 - RNA, 16 nt, Escherichia coli CFT073
augucgcauccggcaa

SEQ ID NO: 2629877 - RNA, 15 nt, Escherichia coli CFT073
augucgcgccaggcg

SEQ ID NO: 2629878 - RNA, 13 nt, Escherichia coli CFT073
augucgcugcacu

SEQ ID NO: 2629879 - RNA, 16 nt, Escherichia coli CFT073
augucgcugcacuuuc

SEQ ID NO: 2629880 - RNA, 21 nt, Escherichia coli CFT073
augucgcugcacuuucucgac

SEQ ID NO: 2629881 - RNA, 20 nt, Escherichia coli CFT073
augucggcagugauuuuccc

SEQ ID NO: 2629882 - RNA, 17 nt, Escherichia coli CFT073
augucgugguacugccg

SEQ ID NO: 2629883 - RNA, 19 nt, Escherichia coli CFT073
augucucgguagagaaaac

SEQ ID NO: 2629884 - RNA, 24 nt, Escherichia coli CFT073
augucucucagagaaucaugucag

SEQ ID NO: 2629885 - RNA, 13 nt, Escherichia coli CFT073
augucugcauaug

SEQ ID NO: 2629886 - RNA, 21 nt, Escherichia coli CFT073
augucuggcugagcaaacagu

SEQ ID NO: 2629887 - RNA, 16 nt, Escherichia coli CFT073
augucuucacaaccgc

SEQ ID NO: 2629888 - RNA, 21 nt, Escherichia coli CFT073
augucuucccggcucaguaaa

SEQ ID NO: 2629889 - RNA, 22 nt, Escherichia coli CFT073
augucuuugcguuuggcaucag

SEQ ID NO: 2629890 - RNA, 15 nt, Escherichia coli CFT073
augucuuuuauggua

SEQ ID NO: 2629891 - RNA, 22 nt, Escherichia coli CFT073
augugaaauaaaaucagcaagg

SEQ ID NO: 2629892 - RNA, 15 nt, Escherichia coli CFT073
augugaaaucagcga

SEQ ID NO: 2629893 - RNA, 19 nt, Escherichia coli CFT073
augugaaggugauucccag

SEQ ID NO: 2629894 - RNA, 20 nt, Escherichia coli CFT073
augugaaggugauucccagc

SEQ ID NO: 2629895 - RNA, 14 nt, Escherichia coli CFT073
augugacgcugucu

SEQ ID NO: 2629896 - RNA, 15 nt, Escherichia coli CFT073
augugauaaauacga

SEQ ID NO: 2629897 - RNA, 12 nt, Escherichia coli CFT073
augugaucgaau

SEQ ID NO: 2629898 - RNA, 16 nt, Escherichia coli CFT073
augugcagcagugcca

SEQ ID NO: 2629899 - RNA, 22 nt, Escherichia coli CFT073
augugccagcgauuuugccagc

SEQ ID NO: 2629900 - RNA, 11 nt, Escherichia coli CFT073
augugccauua

SEQ ID NO: 2629901 - RNA, 19 nt, Escherichia coli CFT073
augugcccccugcaauaaa

SEQ ID NO: 2629902 - RNA, 20 nt, Escherichia coli CFT073
augugcguugucaucgcggc

SEQ ID NO: 2629903 - RNA, 17 nt, Escherichia coli CFT073
augugcucuaacccuuc

SEQ ID NO: 2629904 - RNA, 19 nt, Escherichia coli CFT073
augugcucuaacccuucca

SEQ ID NO: 2629905 - RNA, 18 nt, Escherichia coli CFT073
auguggcucagccagacg

SEQ ID NO: 2629906 - RNA, 15 nt, Escherichia coli CFT073
auguggcugggguac

SEQ ID NO: 2629907 - RNA, 15 nt, Escherichia coli CFT073
auguggugaaaugcc

SEQ ID NO: 2629908 - RNA, 18 nt, Escherichia coli CFT073
auguguaagaaaggcaga

SEQ ID NO: 2629909 - RNA, 19 nt, Escherichia coli CFT073
augugugacugcacuguuu

SEQ ID NO: 2629910 - RNA, 16 nt, Escherichia coli CFT073
auguguucagcgacag

SEQ ID NO: 2629911 - RNA, 20 nt, Escherichia coli CFT073
auguuaaauugccugugaag

SEQ ID NO: 2629912 - RNA, 15 nt, Escherichia coli CFT073
auguuaccaacacug

SEQ ID NO: 2629913 - RNA, 19 nt, Escherichia coli CFT073
auguuaucgagauauuuca

SEQ ID NO: 2629914 - RNA, 14 nt, Escherichia coli CFT073
auguuauugcagac

SEQ ID NO: 2629915 - RNA, 21 nt, Escherichia coli CFT073
auguucagaaagcgccagcaa

SEQ ID NO: 2629916 - RNA, 22 nt, Escherichia coli CFT073
auguucagaaagcgccagcaag

SEQ ID NO: 2629917 - RNA, 21 nt, Escherichia coli CFT073
auguucagucacuucaaauuu

SEQ ID NO: 2629918 - RNA, 13 nt, Escherichia coli CFT073
auguucaguuugc

SEQ ID NO: 2629919 - RNA, 20 nt, Escherichia coli CFT073
auguuccagggccuccugca

SEQ ID NO: 2629920 - RNA, 16 nt, Escherichia coli CFT073
auguuccaguucacga

SEQ ID NO: 2629921 - RNA, 17 nt, Escherichia coli CFT073
auguucccccagccaga

SEQ ID NO: 2629922 - RNA, 18 nt, Escherichia coli CFT073
auguuccgccauuucugg

SEQ ID NO: 2629923 - RNA, 19 nt, Escherichia coli CFT073
auguuccggcgacacaucu

SEQ ID NO: 2629924 - RNA, 21 nt, Escherichia coli CFT073
auguuccggcgacacaucuaa

SEQ ID NO: 2629925 - RNA, 22 nt, Escherichia coli CFT073
auguuccucaucgucaaaugaa

SEQ ID NO: 2629926 - RNA, 22 nt, Escherichia coli CFT073
auguucgccagauuguuaucca

SEQ ID NO: 2629927 - RNA, 20 nt, Escherichia coli CFT073
auguucggcgucuuguugaa

SEQ ID NO: 2629928 - RNA, 16 nt, Escherichia coli CFT073
auguucuuucggugca

SEQ ID NO: 2629929 - RNA, 16 nt, Escherichia coli CFT073
auguugacuucaaucu

SEQ ID NO: 2629930 - RNA, 13 nt, Escherichia coli CFT073
auguugagcggca

SEQ ID NO: 2629931 - RNA, 14 nt, Escherichia coli CFT073
auguugauaaaaag

SEQ ID NO: 2629932 - RNA, 13 nt, Escherichia coli CFT073
auguugauaauca

SEQ ID NO: 2629933 - RNA, 20 nt, Escherichia coli CFT073
auguugauaaucaacaggaa

SEQ ID NO: 2629934 - RNA, 16 nt, Escherichia coli CFT073
auguugauaaucaccg

SEQ ID NO: 2629935 - RNA, 16 nt, Escherichia coli CFT073
auguugaucgccacgu

SEQ ID NO: 2629936 - RNA, 22 nt, Escherichia coli CFT073
auguugaucgccacgucguucc

SEQ ID NO: 2629937 - RNA, 21 nt, Escherichia coli CFT073
auguugcagggcauuccaucg

SEQ ID NO: 2629938 - RNA, 20 nt, Escherichia coli CFT073
auguugcaguacucgcacuu

SEQ ID NO: 2629939 - RNA, 17 nt, Escherichia coli CFT073
auguugcgccucaagaa

SEQ ID NO: 2629940 - RNA, 19 nt, Escherichia coli CFT073
auguugcgcgguuagaaaa

SEQ ID NO: 2629941 - RNA, 16 nt, Escherichia coli CFT073
auguugcugcaccagg

SEQ ID NO: 2629942 - RNA, 10 nt, Escherichia coli CFT073
auguuggcgc

SEQ ID NO: 2629943 - RNA, 15 nt, Escherichia coli CFT073
auguugucgccagua

SEQ ID NO: 2629944 - RNA, 18 nt, Escherichia coli CFT073
auguuguugucacacccg

SEQ ID NO: 2629945 - RNA, 17 nt, Escherichia coli CFT073
auguuguuucucuuucu

SEQ ID NO: 2629946 - RNA, 21 nt, Escherichia coli CFT073
auguuguuuucaacuucccaa

SEQ ID NO: 2629947 - RNA, 16 nt, Escherichia coli CFT073
auguuuacgccugguu

SEQ ID NO: 2629948 - RNA, 18 nt, Escherichia coli CFT073
auguuucaacggaccaau

SEQ ID NO: 2629949 - RNA, 23 nt, Escherichia coli CFT073
auguuucauccaggcacuggccu

SEQ ID NO: 2629950 - RNA, 13 nt, Escherichia coli CFT073
auguuuccagcau

SEQ ID NO: 2629951 - RNA, 20 nt, Escherichia coli CFT073
auguuugacaacucauuacu

SEQ ID NO: 2629952 - RNA, 13 nt, Escherichia coli CFT073
auguuuuuauuaa

SEQ ID NO: 2629953 - RNA, 18 nt, Escherichia coli CFT073
auguuuuugaauuaacuc

SEQ ID NO: 2629954 - RNA, 15 nt, Escherichia coli CFT073
auguuuuuuuuauca

SEQ ID NO: 2629955 - RNA, 16 nt, Escherichia coli CFT073
auuaaaaugaauaacu

SEQ ID NO: 2629956 - RNA, 19 nt, Escherichia coli CFT073
auuaaaaugaauaacuucc

SEQ ID NO: 2629957 - RNA, 13 nt, Escherichia coli CFT073
auuaaacaaauaa

SEQ ID NO: 2629958 - RNA, 14 nt, Escherichia coli CFT073
auuaaacaaauaaa

SEQ ID NO: 2629959 - RNA, 20 nt, Escherichia coli CFT073
auuaaacagcccuuugauuu

SEQ ID NO: 2629960 - RNA, 20 nt, Escherichia coli CFT073
auuaaacgccucugucagaa

SEQ ID NO: 2629961 - RNA, 18 nt, Escherichia coli CFT073
auuaaagccgcgaaacug

SEQ ID NO: 2629962 - RNA, 20 nt, Escherichia coli CFT073
auuaaagccgcgaaacugcg

SEQ ID NO: 2629963 - RNA, 22 nt, Escherichia coli CFT073
auuaaagccgcgaaacugcgug

SEQ ID NO: 2629964 - RNA, 18 nt, Escherichia coli CFT073
auuaaagccggaugcuuu

SEQ ID NO: 2629965 - RNA, 15 nt, Escherichia coli CFT073
auuaaagguauuauu

SEQ ID NO: 2629966 - RNA, 14 nt, Escherichia coli CFT073
auuaaauaccaagc

SEQ ID NO: 2629967 - RNA, 14 nt, Escherichia coli CFT073
auuaaauauuauau

SEQ ID NO: 2629968 - RNA, 21 nt, Escherichia coli CFT073
auuaaauccgccaaauggaua

SEQ ID NO: 2629969 - RNA, 21 nt, Escherichia coli CFT073
auuaaaugcugguuuugaaaa

SEQ ID NO: 2629970 - RNA, 14 nt, Escherichia coli CFT073
auuaaauucagcaa

SEQ ID NO: 2629971 - RNA, 19 nt, Escherichia coli CFT073
auuaaauuguucauauuaa

SEQ ID NO: 2629972 - RNA, 15 nt, Escherichia coli CFT073
auuaaauuuaugugc

SEQ ID NO: 2629973 - RNA, 15 nt, Escherichia coli CFT073
auuaacaccaccagc

SEQ ID NO: 2629974 - RNA, 21 nt, Escherichia coli CFT073
auuaacaggcggcuaugcugg

SEQ ID NO: 2629975 - RNA, 12 nt, Escherichia coli CFT073
auuaacagguau

SEQ ID NO: 2629976 - RNA, 21 nt, Escherichia coli CFT073
auuaaccagccacugcgccau

SEQ ID NO: 2629977 - RNA, 11 nt, Escherichia coli CFT073
auuaaccauga

SEQ ID NO: 2629978 - RNA, 19 nt, Escherichia coli CFT073
auuaacccgcaacagcaau

SEQ ID NO: 2629979 - RNA, 22 nt, Escherichia coli CFT073
auuaacgaaacccgaaccacgc

SEQ ID NO: 2629980 - RNA, 23 nt, Escherichia coli CFT073
auuaacgaaacccgaaccacgca

SEQ ID NO: 2629981 - RNA, 15 nt, Escherichia coli CFT073
auuaacgaaaucuca

SEQ ID NO: 2629982 - RNA, 15 nt, Escherichia coli CFT073
auuaacgcagcaaaa

SEQ ID NO: 2629983 - RNA, 22 nt, Escherichia coli CFT073
auuaacgccagacucgccaggc

SEQ ID NO: 2629984 - RNA, 19 nt, Escherichia coli CFT073
auuaacgcuuguaaaugaa

SEQ ID NO: 2629985 - RNA, 17 nt, Escherichia coli CFT073
auuaacggccacgaugc

SEQ ID NO: 2629986 - RNA, 18 nt, Escherichia coli CFT073
auuaacggccacgaugca

SEQ ID NO: 2629987 - RNA, 14 nt, Escherichia coli CFT073
auuaacguuuccau

SEQ ID NO: 2629988 - RNA, 18 nt, Escherichia coli CFT073
auuaacuaaaugaaauau

SEQ ID NO: 2629989 - RNA, 16 nt, Escherichia coli CFT073
auuaacucacuggcgc

SEQ ID NO: 2629990 - RNA, 23 nt, Escherichia coli CFT073
auuaacuccggccugcacugcag

SEQ ID NO: 2629991 - RNA, 14 nt, Escherichia coli CFT073
auuaacugcuggaa

SEQ ID NO: 2629992 - RNA, 13 nt, Escherichia coli CFT073
auuaacugugguu

SEQ ID NO: 2629993 - RNA, 14 nt, Escherichia coli CFT073
auuaagaaugcgaa

SEQ ID NO: 2629994 - RNA, 14 nt, Escherichia coli CFT073
auuaagaucagaag

SEQ ID NO: 2629995 - RNA, 21 nt, Escherichia coli CFT073
auuaagccgaucguugaggcu

SEQ ID NO: 2629996 - RNA, 22 nt, Escherichia coli CFT073
auuaagcgcaaaggccagcaau

SEQ ID NO: 2629997 - RNA, 18 nt, Escherichia coli CFT073
auuaaggcauaagcgcgu

SEQ ID NO: 2629998 - RNA, 15 nt, Escherichia coli CFT073
auuaaggucauaucu

SEQ ID NO: 2629999 - RNA, 15 nt, Escherichia coli CFT073
auuaaguaacaauau

SEQ ID NO: 2630000 - RNA, 17 nt, Escherichia coli CFT073
auuaauaaaauuaucca

SEQ ID NO: 2630001 - RNA, 19 nt, Escherichia coli CFT073
auuaauaaggaugcaacac

SEQ ID NO: 2630002 - RNA, 21 nt, Escherichia coli CFT073
auuaauaaggaugcaacacau

SEQ ID NO: 2630003 - RNA, 15 nt, Escherichia coli CFT073
auuaauauauauuau

SEQ ID NO: 2630004 - RNA, 15 nt, Escherichia coli CFT073
auuaauauuaaacca

SEQ ID NO: 2630005 - RNA, 13 nt, Escherichia coli CFT073
auuaaucaccagu

SEQ ID NO: 2630006 - RNA, 14 nt, Escherichia coli CFT073
auuaaucagcagau

SEQ ID NO: 2630007 - RNA, 10 nt, Escherichia coli CFT073
auuaauccag

SEQ ID NO: 2630008 - RNA, 19 nt, Escherichia coli CFT073
auuaauccauaaccauaau

SEQ ID NO: 2630009 - RNA, 14 nt, Escherichia coli CFT073
auuaaucccggauc

SEQ ID NO: 2630010 - RNA, 21 nt, Escherichia coli CFT073
auuaaucccugcuucggucag

SEQ ID NO: 2630011 - RNA, 13 nt, Escherichia coli CFT073
auuaaucccuuaa

SEQ ID NO: 2630012 - RNA, 11 nt, Escherichia coli CFT073
auuaaugacau

SEQ ID NO: 2630013 - RNA, 21 nt, Escherichia coli CFT073
auuaaugccgcaacuuucgcc

SEQ ID NO: 2630014 - RNA, 14 nt, Escherichia coli CFT073
auuaaugccuucaa

SEQ ID NO: 2630015 - RNA, 13 nt, Escherichia coli CFT073
auuaaugcuuuca

SEQ ID NO: 2630016 - RNA, 23 nt, Escherichia coli CFT073
auuaauggugauggucgucaauc

SEQ ID NO: 2630017 - RNA, 16 nt, Escherichia coli CFT073
auuaauguuuucaguu

SEQ ID NO: 2630018 - RNA, 19 nt, Escherichia coli CFT073
auuaauuucccaccacuau

SEQ ID NO: 2630019 - RNA, 15 nt, Escherichia coli CFT073
auuaauuugccagcg

SEQ ID NO: 2630020 - RNA, 20 nt, Escherichia coli CFT073
auuaauuuuuuaauaaaaag

SEQ ID NO: 2630021 - RNA, 13 nt, Escherichia coli CFT073
auuacaaaauaca

SEQ ID NO: 2630022 - RNA, 15 nt, Escherichia coli CFT073
auuacaaaaugacau

SEQ ID NO: 2630023 - RNA, 22 nt, Escherichia coli CFT073
auuacaacgcaauauccgccac

SEQ ID NO: 2630024 - RNA, 16 nt, Escherichia coli CFT073
auuacacacaacacau

SEQ ID NO: 2630025 - RNA, 21 nt, Escherichia coli CFT073
auuacaggaacugcaaggaga

SEQ ID NO: 2630026 - RNA, 15 nt, Escherichia coli CFT073
auuacaggaugcggc

SEQ ID NO: 2630027 - RNA, 17 nt, Escherichia coli CFT073
auuacauaccagcagca

SEQ ID NO: 2630028 - RNA, 15 nt, Escherichia coli CFT073
auuacaucacgacga

SEQ ID NO: 2630029 - RNA, 16 nt, Escherichia coli CFT073
auuaccaaucugcucu

SEQ ID NO: 2630030 - RNA, 18 nt, Escherichia coli CFT073
auuaccacaacaaaucgu

SEQ ID NO: 2630031 - RNA, 16 nt, Escherichia coli CFT073
auuaccaccagcgaca

SEQ ID NO: 2630032 - RNA, 15 nt, Escherichia coli CFT073
auuaccagcaucacc

SEQ ID NO: 2630033 - RNA, 12 nt, Escherichia coli CFT073
auuaccauuuca

SEQ ID NO: 2630034 - RNA, 21 nt, Escherichia coli CFT073
auuaccccuggugggguuccc

SEQ ID NO: 2630035 - RNA, 12 nt, Escherichia coli CFT073
auuacccggcau

SEQ ID NO: 2630036 - RNA, 15 nt, Escherichia coli CFT073
auuacccuauuuaaa

SEQ ID NO: 2630037 - RNA, 16 nt, Escherichia coli CFT073
auuacccuauuuaaag

SEQ ID NO: 2630038 - RNA, 17 nt, Escherichia coli CFT073
auuaccgauaucaauaa

SEQ ID NO: 2630039 - RNA, 17 nt, Escherichia coli CFT073
auuaccggucagggcca

SEQ ID NO: 2630040 - RNA, 21 nt, Escherichia coli CFT073
auuaccguugcggcuccagac

SEQ ID NO: 2630041 - RNA, 19 nt, Escherichia coli CFT073
auuaccugagccugugcau

SEQ ID NO: 2630042 - RNA, 23 nt, Escherichia coli CFT073
auuaccugucgcgucaaucacuu

SEQ ID NO: 2630043 - RNA, 18 nt, Escherichia coli CFT073
auuacgaaagcaaaauua

SEQ ID NO: 2630044 - RNA, 13 nt, Escherichia coli CFT073
auuacgaaaucgg

SEQ ID NO: 2630045 - RNA, 16 nt, Escherichia coli CFT073
auuacgaaaucggcac

SEQ ID NO: 2630046 - RNA, 21 nt, Escherichia coli CFT073
auuacgacccgaccgagcugg

SEQ ID NO: 2630047 - RNA, 21 nt, Escherichia coli CFT073
auuacgcaguuguucggcgcu

SEQ ID NO: 2630048 - RNA, 12 nt, Escherichia coli CFT073
auuacgcaucag

SEQ ID NO: 2630049 - RNA, 16 nt, Escherichia coli CFT073
auuacgcgaucgcgaa

SEQ ID NO: 2630050 - RNA, 15 nt, Escherichia coli CFT073
auuacgcggcuucaa

SEQ ID NO: 2630051 - RNA, 20 nt, Escherichia coli CFT073
auuacgcucgcugcaaaaca

SEQ ID NO: 2630052 - RNA, 17 nt, Escherichia coli CFT073
auuacggcucaacccca

SEQ ID NO: 2630053 - RNA, 22 nt, Escherichia coli CFT073
auuacgggcaaucaucaccggu

SEQ ID NO: 2630054 - RNA, 19 nt, Escherichia coli CFT073
auuacgguaaggauauuca

SEQ ID NO: 2630055 - RNA, 13 nt, Escherichia coli CFT073
auuacguaccaga

SEQ ID NO: 2630056 - RNA, 16 nt, Escherichia coli CFT073
auuacguacugcaacg

SEQ ID NO: 2630057 - RNA, 21 nt, Escherichia coli CFT073
auuacguucgacugcgccuuc

SEQ ID NO: 2630058 - RNA, 24 nt, Escherichia coli CFT073
auuacguucgacugcgccuuccag

SEQ ID NO: 2630059 - RNA, 17 nt, Escherichia coli CFT073
auuacuauggauauaau

SEQ ID NO: 2630060 - RNA, 22 nt, Escherichia coli CFT073
auuacuauggauauaauuuuuu

SEQ ID NO: 2630061 - RNA, 16 nt, Escherichia coli CFT073
auuacucauuaaucaa

SEQ ID NO: 2630062 - RNA, 18 nt, Escherichia coli CFT073
auuacucauuaaucaauu

SEQ ID NO: 2630063 - RNA, 14 nt, Escherichia coli CFT073
auuacucauuaaug

SEQ ID NO: 2630064 - RNA, 16 nt, Escherichia coli CFT073
auuacuccacuuccug

SEQ ID NO: 2630065 - RNA, 16 nt, Escherichia coli CFT073
auuacucuaccuuccu

SEQ ID NO: 2630066 - RNA, 17 nt, Escherichia coli CFT073
auuacucucuuucgcuu

SEQ ID NO: 2630067 - RNA, 22 nt, Escherichia coli CFT073
auuacugacgccgacauuaaga

SEQ ID NO: 2630068 - RNA, 19 nt, Escherichia coli CFT073
auuacugccagcucaccuc

SEQ ID NO: 2630069 - RNA, 21 nt, Escherichia coli CFT073
auuacugccagcucaccucac

SEQ ID NO: 2630070 - RNA, 16 nt, Escherichia coli CFT073
auuacugcgaauuucc

SEQ ID NO: 2630071 - RNA, 16 nt, Escherichia coli CFT073
auuacuggauaaccug

SEQ ID NO: 2630072 - RNA, 15 nt, Escherichia coli CFT073
auuacuggcgauugu

SEQ ID NO: 2630073 - RNA, 13 nt, Escherichia coli CFT073
auuacuguaggcc

SEQ ID NO: 2630074 - RNA, 18 nt, Escherichia coli CFT073
auuacuguugucgagcaa

SEQ ID NO: 2630075 - RNA, 22 nt, Escherichia coli CFT073
auuacuucgccggaauuucuuu

SEQ ID NO: 2630076 - RNA, 14 nt, Escherichia coli CFT073
auuacuucuggcac

SEQ ID NO: 2630077 - RNA, 18 nt, Escherichia coli CFT073
auuacuuuaagccuuccg

SEQ ID NO: 2630078 - RNA, 18 nt, Escherichia coli CFT073
auuacuuuccaucuuucc

SEQ ID NO: 2630079 - RNA, 19 nt, Escherichia coli CFT073
auuagcaaauuauccccca

SEQ ID NO: 2630080 - RNA, 16 nt, Escherichia coli CFT073
auuagcacgauuuugu

SEQ ID NO: 2630081 - RNA, 18 nt, Escherichia coli CFT073
auuagcaucaagaaaaau

SEQ ID NO: 2630082 - RNA, 12 nt, Escherichia coli CFT073
auuagccaggca

SEQ ID NO: 2630083 - RNA, 22 nt, Escherichia coli CFT073
auuagccgguaaaucaccaucg

SEQ ID NO: 2630084 - RNA, 18 nt, Escherichia coli CFT073
auuagcgaugaaaucaug

SEQ ID NO: 2630085 - RNA, 16 nt, Escherichia coli CFT073
auuagcgguaaaccaa

SEQ ID NO: 2630086 - RNA, 17 nt, Escherichia coli CFT073
auuagcgguaaaccaac

SEQ ID NO: 2630087 - RNA, 13 nt, Escherichia coli CFT073
auuagcuuaucaa

SEQ ID NO: 2630088 - RNA, 21 nt, Escherichia coli CFT073
auuagcuuaucaaucucugca

SEQ ID NO: 2630089 - RNA, 16 nt, Escherichia coli CFT073
auuagucuuuaucugc

SEQ ID NO: 2630090 - RNA, 16 nt, Escherichia coli CFT073
auuagugcugcuggaa

SEQ ID NO: 2630091 - RNA, 23 nt, Escherichia coli CFT073
auuauaaaucccugccgccauca

SEQ ID NO: 2630092 - RNA, 21 nt, Escherichia coli CFT073
auuauaaguucaaguaaaaca

SEQ ID NO: 2630093 - RNA, 20 nt, Escherichia coli CFT073
auuauaucuuaguuauuacu

SEQ ID NO: 2630094 - RNA, 14 nt, Escherichia coli CFT073
auuaucaaaucacc

SEQ ID NO: 2630095 - RNA, 15 nt, Escherichia coli CFT073
auuaucacaucagcg

SEQ ID NO: 2630096 - RNA, 16 nt, Escherichia coli CFT073
auuaucacaucagcgc

SEQ ID NO: 2630097 - RNA, 23 nt, Escherichia coli CFT073
auuaucagacaccgauugccccu

SEQ ID NO: 2630098 - RNA, 15 nt, Escherichia coli CFT073
auuaucccccagcac

SEQ ID NO: 2630099 - RNA, 16 nt, Escherichia coli CFT073
auuaucgaaaccaacc

SEQ ID NO: 2630100 - RNA, 16 nt, Escherichia coli CFT073
auuaucgcuucgcuaa

SEQ ID NO: 2630101 - RNA, 21 nt, Escherichia coli CFT073
auuaucggagaaauucugcau

SEQ ID NO: 2630102 - RNA, 21 nt, Escherichia coli CFT073
auuaucuccccgccaaaaucu

SEQ ID NO: 2630103 - RNA, 20 nt, Escherichia coli CFT073
auuaucuggcaagccugaaa

SEQ ID NO: 2630104 - RNA, 21 nt, Escherichia coli CFT073
auuaucuggcaagccugaaaa

SEQ ID NO: 2630105 - RNA, 20 nt, Escherichia coli CFT073
auuaucuguucuuuuauauu

SEQ ID NO: 2630106 - RNA, 12 nt, Escherichia coli CFT073
auuaucuucacc

SEQ ID NO: 2630107 - RNA, 21 nt, Escherichia coli CFT073
auuaucuucuuucucggccac

SEQ ID NO: 2630108 - RNA, 21 nt, Escherichia coli CFT073
auuaugaaauucagugaacug

SEQ ID NO: 2630109 - RNA, 16 nt, Escherichia coli CFT073
auuaugcagccuucau

SEQ ID NO: 2630110 - RNA, 15 nt, Escherichia coli CFT073
auuaugccugauuac

SEQ ID NO: 2630111 - RNA, 16 nt, Escherichia coli CFT073
auuauggaucaccauc

SEQ ID NO: 2630112 - RNA, 18 nt, Escherichia coli CFT073
auuaugucauugaauguu

SEQ ID NO: 2630113 - RNA, 16 nt, Escherichia coli CFT073
auuauuaaaccaggaa

SEQ ID NO: 2630114 - RNA, 23 nt, Escherichia coli CFT073
auuauuaaaccaggaacagugaa

SEQ ID NO: 2630115 - RNA, 14 nt, Escherichia coli CFT073
auuauuaacaagau

SEQ ID NO: 2630116 - RNA, 15 nt, Escherichia coli CFT073
auuauucagaguaua

SEQ ID NO: 2630117 - RNA, 17 nt, Escherichia coli CFT073
auuauuccauccugcuc

SEQ ID NO: 2630118 - RNA, 20 nt, Escherichia coli CFT073
auuauugccuugaugaaaaa

SEQ ID NO: 2630119 - RNA, 23 nt, Escherichia coli CFT073
auuauugccuugaugaaaaaacc

SEQ ID NO: 2630120 - RNA, 13 nt, Escherichia coli CFT073
auuauuuauucag

SEQ ID NO: 2630121 - RNA, 12 nt, Escherichia coli CFT073
auuauuuuaaau

SEQ ID NO: 2630122 - RNA, 22 nt, Escherichia coli CFT073
auuauuuuugcuauaugcaagg

SEQ ID NO: 2630123 - RNA, 15 nt, Escherichia coli CFT073
auucaaaauccgcca

SEQ ID NO: 2630124 - RNA, 16 nt, Escherichia coli CFT073
auucaaaauccgccac

SEQ ID NO: 2630125 - RNA, 22 nt, Escherichia coli CFT073
auucaaagcgauuauagcuaac

SEQ ID NO: 2630126 - RNA, 19 nt, Escherichia coli CFT073
auucaacauauccagcgcc

SEQ ID NO: 2630127 - RNA, 16 nt, Escherichia coli CFT073
auucaacaucucuauu

SEQ ID NO: 2630128 - RNA, 16 nt, Escherichia coli CFT073
auucaaccucuguuca

SEQ ID NO: 2630129 - RNA, 14 nt, Escherichia coli CFT073
auucaacuaacuga

SEQ ID NO: 2630130 - RNA, 22 nt, Escherichia coli CFT073
auucaagauuggccugaauauc

SEQ ID NO: 2630131 - RNA, 15 nt, Escherichia coli CFT073
auucaaucucuucac

SEQ ID NO: 2630132 - RNA, 16 nt, Escherichia coli CFT073
auucaaucucuucaca

SEQ ID NO: 2630133 - RNA, 16 nt, Escherichia coli CFT073
auucacacucugccag

SEQ ID NO: 2630134 - RNA, 18 nt, Escherichia coli CFT073
auucacauccacacacag

SEQ ID NO: 2630135 - RNA, 16 nt, Escherichia coli CFT073
auucacauccugccag

SEQ ID NO: 2630136 - RNA, 23 nt, Escherichia coli CFT073
auucacaucucgauuucaauauc

SEQ ID NO: 2630137 - RNA, 21 nt, Escherichia coli CFT073
auucacauuuuuaagccgcgc

SEQ ID NO: 2630138 - RNA, 13 nt, Escherichia coli CFT073
auucaccaccgug

SEQ ID NO: 2630139 - RNA, 14 nt, Escherichia coli CFT073
auucaccagcaaau

SEQ ID NO: 2630140 - RNA, 21 nt, Escherichia coli CFT073
auucaccagcaaauccagcgg

SEQ ID NO: 2630141 - RNA, 13 nt, Escherichia coli CFT073
auucaccagccca

SEQ ID NO: 2630142 - RNA, 15 nt, Escherichia coli CFT073
auucaccucagaaau

SEQ ID NO: 2630143 - RNA, 23 nt, Escherichia coli CFT073
auucacgagagcgggaaaacaua

SEQ ID NO: 2630144 - RNA, 16 nt, Escherichia coli CFT073
auucacguaucagcau

SEQ ID NO: 2630145 - RNA, 12 nt, Escherichia coli CFT073
auucacuucaua

SEQ ID NO: 2630146 - RNA, 17 nt, Escherichia coli CFT073
auucacuucaucccuga

SEQ ID NO: 2630147 - RNA, 11 nt, Escherichia coli CFT073
auucacuuccg

SEQ ID NO: 2630148 - RNA, 16 nt, Escherichia coli CFT073
auucacuuucugaagg

SEQ ID NO: 2630149 - RNA, 20 nt, Escherichia coli CFT073
auucagaaccgcguaacuuu

SEQ ID NO: 2630150 - RNA, 19 nt, Escherichia coli CFT073
auucagaauuuuuaaccgu

SEQ ID NO: 2630151 - RNA, 21 nt, Escherichia coli CFT073
auucagacacgccgccagacc

SEQ ID NO: 2630152 - RNA, 20 nt, Escherichia coli CFT073
auucagacguccacgagacu

SEQ ID NO: 2630153 - RNA, 23 nt, Escherichia coli CFT073
auucagagggcaaagucuucacg

SEQ ID NO: 2630154 - RNA, 16 nt, Escherichia coli CFT073
auucagaguauauauu

SEQ ID NO: 2630155 - RNA, 14 nt, Escherichia coli CFT073
auucagaucgcuac

SEQ ID NO: 2630156 - RNA, 17 nt, Escherichia coli CFT073
auucagaucgguuuuuu

SEQ ID NO: 2630157 - RNA, 13 nt, Escherichia coli CFT073
auucagaugccau

SEQ ID NO: 2630158 - RNA, 15 nt, Escherichia coli CFT073
auucagauucaaauc

SEQ ID NO: 2630159 - RNA, 12 nt, Escherichia coli CFT073
auucagcaacau

SEQ ID NO: 2630160 - RNA, 17 nt, Escherichia coli CFT073
auucagcaacaucacca

SEQ ID NO: 2630161 - RNA, 16 nt, Escherichia coli CFT073
auucagcagcguggug

SEQ ID NO: 2630162 - RNA, 19 nt, Escherichia coli CFT073
auucagcauggaauagaau

SEQ ID NO: 2630163 - RNA, 21 nt, Escherichia coli CFT073
auucagcguaacgcccacgcu

SEQ ID NO: 2630164 - RNA, 17 nt, Escherichia coli CFT073
auucagcguaucaauua

SEQ ID NO: 2630165 - RNA, 15 nt, Escherichia coli CFT073
auucagcgucucacu

SEQ ID NO: 2630166 - RNA, 21 nt, Escherichia coli CFT073
auucagcgucucacuaucgcc

SEQ ID NO: 2630167 - RNA, 21 nt, Escherichia coli CFT073
auucaggaggcguucugcggg

SEQ ID NO: 2630168 - RNA, 19 nt, Escherichia coli CFT073
auucaggaugugagcuggc

SEQ ID NO: 2630169 - RNA, 20 nt, Escherichia coli CFT073
auucaggggaagccagacaa

SEQ ID NO: 2630170 - RNA, 17 nt, Escherichia coli CFT073
auucaguaccagcaccu

SEQ ID NO: 2630171 - RNA, 15 nt, Escherichia coli CFT073
auucagucuuaaaaa

SEQ ID NO: 2630172 - RNA, 12 nt, Escherichia coli CFT073
auucaguucauc

SEQ ID NO: 2630173 - RNA, 16 nt, Escherichia coli CFT073
auucaguucaucuacu

SEQ ID NO: 2630174 - RNA, 14 nt, Escherichia coli CFT073
auucaguuucuggc

SEQ ID NO: 2630175 - RNA, 16 nt, Escherichia coli CFT073
auucaguuuuugaaac

SEQ ID NO: 2630176 - RNA, 14 nt, Escherichia coli CFT073
auucauaaugccca

SEQ ID NO: 2630177 - RNA, 14 nt, Escherichia coli CFT073
auucauaucaaacg

SEQ ID NO: 2630178 - RNA, 20 nt, Escherichia coli CFT073
auucauaugcgccagcugca

SEQ ID NO: 2630179 - RNA, 14 nt, Escherichia coli CFT073
auucauauuuuuuc

SEQ ID NO: 2630180 - RNA, 16 nt, Escherichia coli CFT073
auucauauuuuuuccc

SEQ ID NO: 2630181 - RNA, 13 nt, Escherichia coli CFT073
auucaucaaaugg

SEQ ID NO: 2630182 - RNA, 15 nt, Escherichia coli CFT073
auucaucacgccaau

SEQ ID NO: 2630183 - RNA, 23 nt, Escherichia coli CFT073
auucaucuuucaucuguuuucaa

SEQ ID NO: 2630184 - RNA, 22 nt, Escherichia coli CFT073
auucaugcccugcccgcugcca

SEQ ID NO: 2630185 - RNA, 18 nt, Escherichia coli CFT073
auucauggcauuuucucg

SEQ ID NO: 2630186 - RNA, 22 nt, Escherichia coli CFT073
auucaugucgguuacuauccug

SEQ ID NO: 2630187 - RNA, 14 nt, Escherichia coli CFT073
auucauguucggua

SEQ ID NO: 2630188 - RNA, 14 nt, Escherichia coli CFT073
auucauuaauaacc

SEQ ID NO: 2630189 - RNA, 23 nt, Escherichia coli CFT073
auucauuacuuaucuaauaaaca

SEQ ID NO: 2630190 - RNA, 13 nt, Escherichia coli CFT073
auucauucagauu

SEQ ID NO: 2630191 - RNA, 13 nt, Escherichia coli CFT073
auucauuccuuga

SEQ ID NO: 2630192 - RNA, 17 nt, Escherichia coli CFT073
auucauuguucucccau

SEQ ID NO: 2630193 - RNA, 22 nt, Escherichia coli CFT073
auucauuuggcguaguugcugc

SEQ ID NO: 2630194 - RNA, 13 nt, Escherichia coli CFT073
auucauuuugcug

SEQ ID NO: 2630195 - RNA, 18 nt, Escherichia coli CFT073
auuccaacgaaaaugauu

SEQ ID NO: 2630196 - RNA, 21 nt, Escherichia coli CFT073
auuccaccacuucauacuccg

SEQ ID NO: 2630197 - RNA, 23 nt, Escherichia coli CFT073
auuccagacgggucauaaucaga

SEQ ID NO: 2630198 - RNA, 15 nt, Escherichia coli CFT073
auuccagcgccgcca

SEQ ID NO: 2630199 - RNA, 19 nt, Escherichia coli CFT073
auuccagcgguuguagcca

SEQ ID NO: 2630200 - RNA, 19 nt, Escherichia coli CFT073
auuccaggucaaucccagg

SEQ ID NO: 2630201 - RNA, 20 nt, Escherichia coli CFT073
auuccagucaaucauugaua

SEQ ID NO: 2630202 - RNA, 17 nt, Escherichia coli CFT073
auuccagucagcaccag

SEQ ID NO: 2630203 - RNA, 21 nt, Escherichia coli CFT073
auuccaguucaaucucuucac

SEQ ID NO: 2630204 - RNA, 14 nt, Escherichia coli CFT073
auuccaucaauagc

SEQ ID NO: 2630205 - RNA, 15 nt, Escherichia coli CFT073
auucccagcaacagc

SEQ ID NO: 2630206 - RNA, 18 nt, Escherichia coli CFT073
auucccagcaacagcaaa

SEQ ID NO: 2630207 - RNA, 22 nt, Escherichia coli CFT073
auucccagcaacagcaaagaga

SEQ ID NO: 2630208 - RNA, 19 nt, Escherichia coli CFT073
auucccagcaccgcagaga

SEQ ID NO: 2630209 - RNA, 18 nt, Escherichia coli CFT073
auucccaguaccuguugu

SEQ ID NO: 2630210 - RNA, 22 nt, Escherichia coli CFT073
auucccagucgcgcaauugcca

SEQ ID NO: 2630211 - RNA, 15 nt, Escherichia coli CFT073
auuccccugccagaa

SEQ ID NO: 2630212 - RNA, 20 nt, Escherichia coli CFT073
auuccccugccagaagcaga

SEQ ID NO: 2630213 - RNA, 21 nt, Escherichia coli CFT073
auuccccugccagaagcagaa

SEQ ID NO: 2630214 - RNA, 16 nt, Escherichia coli CFT073
auucccgcaagcggcc

SEQ ID NO: 2630215 - RNA, 23 nt, Escherichia coli CFT073
auucccgcgcuaccacuucccaa

SEQ ID NO: 2630216 - RNA, 16 nt, Escherichia coli CFT073
auucccggaaauugcc

SEQ ID NO: 2630217 - RNA, 16 nt, Escherichia coli CFT073
auucccggcuuugcaa

SEQ ID NO: 2630218 - RNA, 16 nt, Escherichia coli CFT073
auucccggucaccgga

SEQ ID NO: 2630219 - RNA, 16 nt, Escherichia coli CFT073
auucccguggccugca

SEQ ID NO: 2630220 - RNA, 24 nt, Escherichia coli CFT073
auucccugcagucaccugcccucc

SEQ ID NO: 2630221 - RNA, 12 nt, Escherichia coli CFT073
auucccugccug

SEQ ID NO: 2630222 - RNA, 19 nt, Escherichia coli CFT073
auucccuucuuucucuuuc

SEQ ID NO: 2630223 - RNA, 15 nt, Escherichia coli CFT073
auucccuugcucugg

SEQ ID NO: 2630224 - RNA, 18 nt, Escherichia coli CFT073
auucccuugucgcagcau

SEQ ID NO: 2630225 - RNA, 20 nt, Escherichia coli CFT073
auuccgaauuucauccugua

SEQ ID NO: 2630226 - RNA, 21 nt, Escherichia coli CFT073
auuccgcaccaacgcaaaaaa

SEQ ID NO: 2630227 - RNA, 22 nt, Escherichia coli CFT073
auuccgcaccugccagcgccga

SEQ ID NO: 2630228 - RNA, 18 nt, Escherichia coli CFT073
auuccgcgugaaaugcca

SEQ ID NO: 2630229 - RNA, 19 nt, Escherichia coli CFT073
auuccgcucuguaacccug

SEQ ID NO: 2630230 - RNA, 16 nt, Escherichia coli CFT073
auuccggcaaauaaca

SEQ ID NO: 2630231 - RNA, 23 nt, Escherichia coli CFT073
auuccgggaaacgagccauaaaa

SEQ ID NO: 2630232 - RNA, 18 nt, Escherichia coli CFT073
auuccgggccaccaugcc

SEQ ID NO: 2630233 - RNA, 20 nt, Escherichia coli CFT073
auuccgggccaccaugccca

SEQ ID NO: 2630234 - RNA, 19 nt, Escherichia coli CFT073
auuccguagcguuuuuuca

SEQ ID NO: 2630235 - RNA, 23 nt, Escherichia coli CFT073
auuccguagcguuuuuucauuuc

SEQ ID NO: 2630236 - RNA, 15 nt, Escherichia coli CFT073
auuccgugccagcac

SEQ ID NO: 2630237 - RNA, 18 nt, Escherichia coli CFT073
auuccgugccagcaccaa

SEQ ID NO: 2630238 - RNA, 12 nt, Escherichia coli CFT073
auuccguucagu

SEQ ID NO: 2630239 - RNA, 14 nt, Escherichia coli CFT073
auuccguucaguaa

SEQ ID NO: 2630240 - RNA, 18 nt, Escherichia coli CFT073
auuccguucaguaaucaa

SEQ ID NO: 2630241 - RNA, 17 nt, Escherichia coli CFT073
auuccguugccagaugc

SEQ ID NO: 2630242 - RNA, 18 nt, Escherichia coli CFT073
auuccuaaaccaucagca

SEQ ID NO: 2630243 - RNA, 14 nt, Escherichia coli CFT073
auuccuauauauuu

SEQ ID NO: 2630244 - RNA, 20 nt, Escherichia coli CFT073
auuccuauauauuuaguuca

SEQ ID NO: 2630245 - RNA, 14 nt, Escherichia coli CFT073
auuccuauuuuguu

SEQ ID NO: 2630246 - RNA, 19 nt, Escherichia coli CFT073
auuccugaauggugaccug

SEQ ID NO: 2630247 - RNA, 20 nt, Escherichia coli CFT073
auuccugacccagcaccagu

SEQ ID NO: 2630248 - RNA, 21 nt, Escherichia coli CFT073
auuccugcgcuuccaguucca

SEQ ID NO: 2630249 - RNA, 20 nt, Escherichia coli CFT073
auuccuggggucaucagcau

SEQ ID NO: 2630250 - RNA, 19 nt, Escherichia coli CFT073
auuccuuugcugcucuauu

SEQ ID NO: 2630251 - RNA, 12 nt, Escherichia coli CFT073
auucgaaaucug

SEQ ID NO: 2630252 - RNA, 19 nt, Escherichia coli CFT073
auucgaccacgcugcgcug

SEQ ID NO: 2630253 - RNA, 21 nt, Escherichia coli CFT073
auucgaccauugcguguuacg

SEQ ID NO: 2630254 - RNA, 19 nt, Escherichia coli CFT073
auucgaguagcguucuguu

SEQ ID NO: 2630255 - RNA, 16 nt, Escherichia coli CFT073
auucgaucaccgcaga

SEQ ID NO: 2630256 - RNA, 19 nt, Escherichia coli CFT073
auucgcaccacguucggug

SEQ ID NO: 2630257 - RNA, 19 nt, Escherichia coli CFT073
auucgcagaccgggaaucg

SEQ ID NO: 2630258 - RNA, 13 nt, Escherichia coli CFT073
auucgcagcugca

SEQ ID NO: 2630259 - RNA, 14 nt, Escherichia coli CFT073
auucgcagcugcag

SEQ ID NO: 2630260 - RNA, 16 nt, Escherichia coli CFT073
auucgccacugccagc

SEQ ID NO: 2630261 - RNA, 22 nt, Escherichia coli CFT073
auucgccacugccagcaaaaaa

SEQ ID NO: 2630262 - RNA, 12 nt, Escherichia coli CFT073
auucgccagcac

SEQ ID NO: 2630263 - RNA, 19 nt, Escherichia coli CFT073
auucgccccuucagaagau

SEQ ID NO: 2630264 - RNA, 21 nt, Escherichia coli CFT073
auucgccgaauuaaacaacgc

SEQ ID NO: 2630265 - RNA, 19 nt, Escherichia coli CFT073
auucgccugacgcaauaac

SEQ ID NO: 2630266 - RNA, 19 nt, Escherichia coli CFT073
auucgcgcacgaggaacag

SEQ ID NO: 2630267 - RNA, 17 nt, Escherichia coli CFT073
auucgcgccagguggca

SEQ ID NO: 2630268 - RNA, 15 nt, Escherichia coli CFT073
auucgcgguuuuaca

SEQ ID NO: 2630269 - RNA, 21 nt, Escherichia coli CFT073
auucgcuuccuccaccacuuu

SEQ ID NO: 2630270 - RNA, 17 nt, Escherichia coli CFT073
auucgcuugcaaaagca

SEQ ID NO: 2630271 - RNA, 15 nt, Escherichia coli CFT073
auucgcuuucacuca

SEQ ID NO: 2630272 - RNA, 22 nt, Escherichia coli CFT073
auucggcaagauaaaucgcacg

SEQ ID NO: 2630273 - RNA, 15 nt, Escherichia coli CFT073
auucggcaaucacaa

SEQ ID NO: 2630274 - RNA, 22 nt, Escherichia coli CFT073
auucggcgaccagcgcagcuuc

SEQ ID NO: 2630275 - RNA, 20 nt, Escherichia coli CFT073
auucggcgcuccugcgggag

SEQ ID NO: 2630276 - RNA, 11 nt, Escherichia coli CFT073
auucggcggca

SEQ ID NO: 2630277 - RNA, 14 nt, Escherichia coli CFT073
auucggcuccagau

SEQ ID NO: 2630278 - RNA, 17 nt, Escherichia coli CFT073
auucggcuucuuccucc

SEQ ID NO: 2630279 - RNA, 22 nt, Escherichia coli CFT073
auucguaagcgagaacugccuu

SEQ ID NO: 2630280 - RNA, 14 nt, Escherichia coli CFT073
auucguauuuaaaa

SEQ ID NO: 2630281 - RNA, 15 nt, Escherichia coli CFT073
auucguauuuaaaac

SEQ ID NO: 2630282 - RNA, 19 nt, Escherichia coli CFT073
auucguccauugaagacaa

SEQ ID NO: 2630283 - RNA, 15 nt, Escherichia coli CFT073
auucguugcuggcgu

SEQ ID NO: 2630284 - RNA, 24 nt, Escherichia coli CFT073
auucuacuuugcgagucugcucca

SEQ ID NO: 2630285 - RNA, 19 nt, Escherichia coli CFT073
auucucaccuacagccaca

SEQ ID NO: 2630286 - RNA, 23 nt, Escherichia coli CFT073
auucuccagcaucgaaaaugcca

SEQ ID NO: 2630287 - RNA, 14 nt, Escherichia coli CFT073
auucucccacagca

SEQ ID NO: 2630288 - RNA, 16 nt, Escherichia coli CFT073
auucuccggcaggaaa

SEQ ID NO: 2630289 - RNA, 21 nt, Escherichia coli CFT073
auucucgcuacccaugaagaa

SEQ ID NO: 2630290 - RNA, 17 nt, Escherichia coli CFT073
auucucuuuucacgcaa

SEQ ID NO: 2630291 - RNA, 23 nt, Escherichia coli CFT073
auucucuuuucacgcaauaccug

SEQ ID NO: 2630292 - RNA, 15 nt, Escherichia coli CFT073
auucugacgccacca

SEQ ID NO: 2630293 - RNA, 18 nt, Escherichia coli CFT073
auucugcgagcuuucgac

SEQ ID NO: 2630294 - RNA, 17 nt, Escherichia coli CFT073
auucugcgcugacucua

SEQ ID NO: 2630295 - RNA, 15 nt, Escherichia coli CFT073
auucugcggcuucag

SEQ ID NO: 2630296 - RNA, 18 nt, Escherichia coli CFT073
auucugcggcuucagcga

SEQ ID NO: 2630297 - RNA, 20 nt, Escherichia coli CFT073
auucuggccgcuucagauug

SEQ ID NO: 2630298 - RNA, 17 nt, Escherichia coli CFT073
auucuggcgcaacaccc

SEQ ID NO: 2630299 - RNA, 23 nt, Escherichia coli CFT073
auucuggcgcaacacccugaugu

SEQ ID NO: 2630300 - RNA, 16 nt, Escherichia coli CFT073
auucuggugagagcaa

SEQ ID NO: 2630301 - RNA, 21 nt, Escherichia coli CFT073
auucuguccuccaugaugacc

SEQ ID NO: 2630302 - RNA, 14 nt, Escherichia coli CFT073
auucuucgcuggau

SEQ ID NO: 2630303 - RNA, 15 nt, Escherichia coli CFT073
auucuucugaauauc

SEQ ID NO: 2630304 - RNA, 16 nt, Escherichia coli CFT073
auucuugacuaucacu

SEQ ID NO: 2630305 - RNA, 23 nt, Escherichia coli CFT073
auucuugacuaucacucccucau

SEQ ID NO: 2630306 - RNA, 16 nt, Escherichia coli CFT073
auucuuuuuugauucc

SEQ ID NO: 2630307 - RNA, 16 nt, Escherichia coli CFT073
auugaaaauuacucag

SEQ ID NO: 2630308 - RNA, 14 nt, Escherichia coli CFT073
auugaaagcaaaaa

SEQ ID NO: 2630309 - RNA, 17 nt, Escherichia coli CFT073
auugaaagcaaaaaaag

SEQ ID NO: 2630310 - RNA, 20 nt, Escherichia coli CFT073
auugaaagcaaaaaaagaau

SEQ ID NO: 2630311 - RNA, 15 nt, Escherichia coli CFT073
auugaaauuugcaua

SEQ ID NO: 2630312 - RNA, 18 nt, Escherichia coli CFT073
auugaagacaacauugau

SEQ ID NO: 2630313 - RNA, 22 nt, Escherichia coli CFT073
auugaagcaauccauaccagca

SEQ ID NO: 2630314 - RNA, 17 nt, Escherichia coli CFT073
auugaagcagcgcugga

SEQ ID NO: 2630315 - RNA, 18 nt, Escherichia coli CFT073
auugaagcccaaaaacua

SEQ ID NO: 2630316 - RNA, 16 nt, Escherichia coli CFT073
auugaaggcaauugca

SEQ ID NO: 2630317 - RNA, 17 nt, Escherichia coli CFT073
auugaaggcaauugcau

SEQ ID NO: 2630318 - RNA, 19 nt, Escherichia coli CFT073
auugaaucggcgcagcaau

SEQ ID NO: 2630319 - RNA, 21 nt, Escherichia coli CFT073
auugacaagguaguagaaauc

SEQ ID NO: 2630320 - RNA, 21 nt, Escherichia coli CFT073
auugaccauauuaacgcagca

SEQ ID NO: 2630321 - RNA, 17 nt, Escherichia coli CFT073
auugaccgccagcgcca

SEQ ID NO: 2630322 - RNA, 19 nt, Escherichia coli CFT073
auugacgaauauagcgcca

SEQ ID NO: 2630323 - RNA, 17 nt, Escherichia coli CFT073
auugacgccaucaacga

SEQ ID NO: 2630324 - RNA, 14 nt, Escherichia coli CFT073
auugacuacaaaaa

SEQ ID NO: 2630325 - RNA, 13 nt, Escherichia coli CFT073
auugacuaucuga

SEQ ID NO: 2630326 - RNA, 18 nt, Escherichia coli CFT073
auugagaauaaugccuuu

SEQ ID NO: 2630327 - RNA, 13 nt, Escherichia coli CFT073
auugagacaacuc

SEQ ID NO: 2630328 - RNA, 11 nt, Escherichia coli CFT073
auugagauaag

SEQ ID NO: 2630329 - RNA, 16 nt, Escherichia coli CFT073
auugagauaagcaaca

SEQ ID NO: 2630330 - RNA, 18 nt, Escherichia coli CFT073
auugagauccauuaugau

SEQ ID NO: 2630331 - RNA, 16 nt, Escherichia coli CFT073
auugagcagcaaaaug

SEQ ID NO: 2630332 - RNA, 17 nt, Escherichia coli CFT073
auugaggauauuacuga

SEQ ID NO: 2630333 - RNA, 23 nt, Escherichia coli CFT073
auugaguagccacgcgacauaaa

SEQ ID NO: 2630334 - RNA, 17 nt, Escherichia coli CFT073
auugauaaacaaaaguc

SEQ ID NO: 2630335 - RNA, 15 nt, Escherichia coli CFT073
auugauaauaaaaag

SEQ ID NO: 2630336 - RNA, 17 nt, Escherichia coli CFT073
auugauagauuucucua

SEQ ID NO: 2630337 - RNA, 23 nt, Escherichia coli CFT073
auugauagauuucucuaaaaacu

SEQ ID NO: 2630338 - RNA, 15 nt, Escherichia coli CFT073
auugaucucacaauc

SEQ ID NO: 2630339 - RNA, 17 nt, Escherichia coli CFT073
auugaucucacaaucau

SEQ ID NO: 2630340 - RNA, 18 nt, Escherichia coli CFT073
auugaugcugccaucauc

SEQ ID NO: 2630341 - RNA, 14 nt, Escherichia coli CFT073
auugauucacaucc

SEQ ID NO: 2630342 - RNA, 17 nt, Escherichia coli CFT073
auugauucacauccugc

SEQ ID NO: 2630343 - RNA, 15 nt, Escherichia coli CFT073
auugauuguuuuaaa

SEQ ID NO: 2630344 - RNA, 17 nt, Escherichia coli CFT073
auugauuguuuuaaaua

SEQ ID NO: 2630345 - RNA, 22 nt, Escherichia coli CFT073
auugauuguuuuaaauauuguu

SEQ ID NO: 2630346 - RNA, 18 nt, Escherichia coli CFT073
auugauuucuuauucaua

SEQ ID NO: 2630347 - RNA, 23 nt, Escherichia coli CFT073
auugauuucuuauucauaucuuc

SEQ ID NO: 2630348 - RNA, 12 nt, Escherichia coli CFT073
auugauuuuucc

SEQ ID NO: 2630349 - RNA, 18 nt, Escherichia coli CFT073
auugcaaacagagcgggc

SEQ ID NO: 2630350 - RNA, 19 nt, Escherichia coli CFT073
auugcaacuggcugccguu

SEQ ID NO: 2630351 - RNA, 18 nt, Escherichia coli CFT073
auugcacaugcuaaaaau

SEQ ID NO: 2630352 - RNA, 15 nt, Escherichia coli CFT073
auugcacauucccug

SEQ ID NO: 2630353 - RNA, 13 nt, Escherichia coli CFT073
auugcacuggcac

SEQ ID NO: 2630354 - RNA, 19 nt, Escherichia coli CFT073
auugcagauaccacaucaa

SEQ ID NO: 2630355 - RNA, 15 nt, Escherichia coli CFT073
auugcaggagcggug

SEQ ID NO: 2630356 - RNA, 14 nt, Escherichia coli CFT073
auugcauaucaauu

SEQ ID NO: 2630357 - RNA, 16 nt, Escherichia coli CFT073
auugcaucaucgacau

SEQ ID NO: 2630358 - RNA, 13 nt, Escherichia coli CFT073
auugcauuaaaaa

SEQ ID NO: 2630359 - RNA, 22 nt, Escherichia coli CFT073
auugcauuugaacuggaaaaac

SEQ ID NO: 2630360 - RNA, 21 nt, Escherichia coli CFT073
auugccaaucguuaucggaaa

SEQ ID NO: 2630361 - RNA, 14 nt, Escherichia coli CFT073
auugccacgccgua

SEQ ID NO: 2630362 - RNA, 14 nt, Escherichia coli CFT073
auugccagaaacca

SEQ ID NO: 2630363 - RNA, 19 nt, Escherichia coli CFT073
auugccagcaucagaguau

SEQ ID NO: 2630364 - RNA, 20 nt, Escherichia coli CFT073
auugccagcauuggcguuug

SEQ ID NO: 2630365 - RNA, 18 nt, Escherichia coli CFT073
auugccauaaaaacgaua

SEQ ID NO: 2630366 - RNA, 21 nt, Escherichia coli CFT073
auugccauguugaucccugca

SEQ ID NO: 2630367 - RNA, 20 nt, Escherichia coli CFT073
auugccauguuuuccuuuuc

SEQ ID NO: 2630368 - RNA, 19 nt, Escherichia coli CFT073
auugccauuacuacaaaca

SEQ ID NO: 2630369 - RNA, 17 nt, Escherichia coli CFT073
auugcccaagaugccag

SEQ ID NO: 2630370 - RNA, 16 nt, Escherichia coli CFT073
auugccgaagaccaga

SEQ ID NO: 2630371 - RNA, 17 nt, Escherichia coli CFT073
auugccgcagucuggug

SEQ ID NO: 2630372 - RNA, 11 nt, Escherichia coli CFT073
auugccgccau

SEQ ID NO: 2630373 - RNA, 15 nt, Escherichia coli CFT073
auugccgccucugcc

SEQ ID NO: 2630374 - RNA, 14 nt, Escherichia coli CFT073
auugccgcgagaac

SEQ ID NO: 2630375 - RNA, 18 nt, Escherichia coli CFT073
auugccgcgauagcaagc

SEQ ID NO: 2630376 - RNA, 17 nt, Escherichia coli CFT073
auugccggaagcgccac

SEQ ID NO: 2630377 - RNA, 21 nt, Escherichia coli CFT073
auugccggaagcgccaccagc

SEQ ID NO: 2630378 - RNA, 23 nt, Escherichia coli CFT073
auugccggauaaauuaaacgccu

SEQ ID NO: 2630379 - RNA, 20 nt, Escherichia coli CFT073
auugccgggcuaacuucuuu

SEQ ID NO: 2630380 - RNA, 16 nt, Escherichia coli CFT073
auugccguaaucgccu

SEQ ID NO: 2630381 - RNA, 22 nt, Escherichia coli CFT073
auugccucacgcaaauucuucg

SEQ ID NO: 2630382 - RNA, 22 nt, Escherichia coli CFT073
auugccugaucgcgcaaacagu

SEQ ID NO: 2630383 - RNA, 16 nt, Escherichia coli CFT073
auugccugaugcgcua

SEQ ID NO: 2630384 - RNA, 12 nt, Escherichia coli CFT073
auugccugaugg

SEQ ID NO: 2630385 - RNA, 15 nt, Escherichia coli CFT073
auugccugcgugcau

SEQ ID NO: 2630386 - RNA, 16 nt, Escherichia coli CFT073
auugccuguuaaaagc

SEQ ID NO: 2630387 - RNA, 17 nt, Escherichia coli CFT073
auugccuguucgccgcc

SEQ ID NO: 2630388 - RNA, 18 nt, Escherichia coli CFT073
auugccuguucgccgccg

SEQ ID NO: 2630389 - RNA, 22 nt, Escherichia coli CFT073
auugccuuccaccagauggcuu

SEQ ID NO: 2630390 - RNA, 19 nt, Escherichia coli CFT073
auugccuugaugaaaaaac

SEQ ID NO: 2630391 - RNA, 18 nt, Escherichia coli CFT073
auugcgaauauggacuuu

SEQ ID NO: 2630392 - RNA, 13 nt, Escherichia coli CFT073
auugcgagcucaa

SEQ ID NO: 2630393 - RNA, 17 nt, Escherichia coli CFT073
auugcgagcucaauaua

SEQ ID NO: 2630394 - RNA, 13 nt, Escherichia coli CFT073
auugcgcaacaga

SEQ ID NO: 2630395 - RNA, 19 nt, Escherichia coli CFT073
auugcgcaaccgcccggcc

SEQ ID NO: 2630396 - RNA, 17 nt, Escherichia coli CFT073
auugcgcaacuuuuucu

SEQ ID NO: 2630397 - RNA, 18 nt, Escherichia coli CFT073
auugcgcaacuuuuucuu

SEQ ID NO: 2630398 - RNA, 21 nt, Escherichia coli CFT073
auugcgcaccagcuugcgaca

SEQ ID NO: 2630399 - RNA, 13 nt, Escherichia coli CFT073
auugcgcauucua

SEQ ID NO: 2630400 - RNA, 17 nt, Escherichia coli CFT073
auugcgccgaacaacag

SEQ ID NO: 2630401 - RNA, 16 nt, Escherichia coli CFT073
auugcgccucaccgga

SEQ ID NO: 2630402 - RNA, 21 nt, Escherichia coli CFT073
auugcgcucgcgcucgccgua

SEQ ID NO: 2630403 - RNA, 16 nt, Escherichia coli CFT073
auugcggcaucauaaa

SEQ ID NO: 2630404 - RNA, 22 nt, Escherichia coli CFT073
auugcgguggauuuaaugccaa

SEQ ID NO: 2630405 - RNA, 19 nt, Escherichia coli CFT073
auugcguaaagccugcugg

SEQ ID NO: 2630406 - RNA, 15 nt, Escherichia coli CFT073
auugcguaaaucuuc

SEQ ID NO: 2630407 - RNA, 16 nt, Escherichia coli CFT073
auugcguaaucuuuuc

SEQ ID NO: 2630408 - RNA, 18 nt, Escherichia coli CFT073
auugcguaaucuuuucau

SEQ ID NO: 2630409 - RNA, 18 nt, Escherichia coli CFT073
auugcguucaaucugucc

SEQ ID NO: 2630410 - RNA, 19 nt, Escherichia coli CFT073
auugcguuuaagcugcucg

SEQ ID NO: 2630411 - RNA, 17 nt, Escherichia coli CFT073
auugcuaaaggcaacau

SEQ ID NO: 2630412 - RNA, 17 nt, Escherichia coli CFT073
auugcuaagcucucagc

SEQ ID NO: 2630413 - RNA, 14 nt, Escherichia coli CFT073
auugcuagcggguu

SEQ ID NO: 2630414 - RNA, 13 nt, Escherichia coli CFT073
auugcuaucaaca

SEQ ID NO: 2630415 - RNA, 15 nt, Escherichia coli CFT073
auugcuauuuaacaa

SEQ ID NO: 2630416 - RNA, 17 nt, Escherichia coli CFT073
auugcuauuucccccuc

SEQ ID NO: 2630417 - RNA, 19 nt, Escherichia coli CFT073
auugcucuuucacuuuacc

SEQ ID NO: 2630418 - RNA, 22 nt, Escherichia coli CFT073
auugcugaaaaggcuaaaauug

SEQ ID NO: 2630419 - RNA, 18 nt, Escherichia coli CFT073
auugcugaaaauugucuu

SEQ ID NO: 2630420 - RNA, 18 nt, Escherichia coli CFT073
auugcugacauggcaaua

SEQ ID NO: 2630421 - RNA, 17 nt, Escherichia coli CFT073
auugcugaugcaccuuc

SEQ ID NO: 2630422 - RNA, 21 nt, Escherichia coli CFT073
auugcugaugcaccuucaacu

SEQ ID NO: 2630423 - RNA, 14 nt, Escherichia coli CFT073
auugcugcaccagc

SEQ ID NO: 2630424 - RNA, 20 nt, Escherichia coli CFT073
auugcugcgcccgcagcggc

SEQ ID NO: 2630425 - RNA, 23 nt, Escherichia coli CFT073
auugcugcugauaaccgccgcca

SEQ ID NO: 2630426 - RNA, 18 nt, Escherichia coli CFT073
auugcugcugccgcgcca

SEQ ID NO: 2630427 - RNA, 19 nt, Escherichia coli CFT073
auugcuggccuagaugaau

SEQ ID NO: 2630428 - RNA, 20 nt, Escherichia coli CFT073
auugcuguaaauugccgucg

SEQ ID NO: 2630429 - RNA, 21 nt, Escherichia coli CFT073
auugcugugauuaagcagcgc

SEQ ID NO: 2630430 - RNA, 13 nt, Escherichia coli CFT073
auugcuucaagau

SEQ ID NO: 2630431 - RNA, 21 nt, Escherichia coli CFT073
auugcuuccaguaacacuucc

SEQ ID NO: 2630432 - RNA, 14 nt, Escherichia coli CFT073
auugcuugcgccuu

SEQ ID NO: 2630433 - RNA, 22 nt, Escherichia coli CFT073
auugcuuugaucaagcaccgcc

SEQ ID NO: 2630434 - RNA, 21 nt, Escherichia coli CFT073
auugcuuugguaaauggcuga

SEQ ID NO: 2630435 - RNA, 22 nt, Escherichia coli CFT073
auugcuuuuguggucaccauga

SEQ ID NO: 2630436 - RNA, 14 nt, Escherichia coli CFT073
auuggagaauaugu

SEQ ID NO: 2630437 - RNA, 20 nt, Escherichia coli CFT073
auuggagaguugcaccagca

SEQ ID NO: 2630438 - RNA, 14 nt, Escherichia coli CFT073
auuggagcgugaua

SEQ ID NO: 2630439 - RNA, 17 nt, Escherichia coli CFT073
auuggcaaaaccaaacc

SEQ ID NO: 2630440 - RNA, 20 nt, Escherichia coli CFT073
auuggcaaagccgccagaga

SEQ ID NO: 2630441 - RNA, 15 nt, Escherichia coli CFT073
auuggcaacagccau

SEQ ID NO: 2630442 - RNA, 20 nt, Escherichia coli CFT073
auuggcaauacgauccugag

SEQ ID NO: 2630443 - RNA, 19 nt, Escherichia coli CFT073
auuggcaauagugcgauug

SEQ ID NO: 2630444 - RNA, 21 nt, Escherichia coli CFT073
auuggcaaucacaucaccaua

SEQ ID NO: 2630445 - RNA, 20 nt, Escherichia coli CFT073
auuggcagugguaucaauau

SEQ ID NO: 2630446 - RNA, 23 nt, Escherichia coli CFT073
auuggcguuugaccgacaccggc

SEQ ID NO: 2630447 - RNA, 15 nt, Escherichia coli CFT073
auugggcgaucuccc

SEQ ID NO: 2630448 - RNA, 15 nt, Escherichia coli CFT073
auugggguuacgacc

SEQ ID NO: 2630449 - RNA, 17 nt, Escherichia coli CFT073
auugggugacuggaaca

SEQ ID NO: 2630450 - RNA, 23 nt, Escherichia coli CFT073
auugguaauacccagacuuuuca

SEQ ID NO: 2630451 - RNA, 19 nt, Escherichia coli CFT073
auugguacaacguccuuuc

SEQ ID NO: 2630452 - RNA, 16 nt, Escherichia coli CFT073
auugguacagagaaca

SEQ ID NO: 2630453 - RNA, 15 nt, Escherichia coli CFT073
auugguagacgcacc

SEQ ID NO: 2630454 - RNA, 18 nt, Escherichia coli CFT073
auuggucuggauggcuug

SEQ ID NO: 2630455 - RNA, 14 nt, Escherichia coli CFT073
auugguugcagcac

SEQ ID NO: 2630456 - RNA, 23 nt, Escherichia coli CFT073
auugguugcagcacgcuggacgu

SEQ ID NO: 2630457 - RNA, 24 nt, Escherichia coli CFT073
auugguuuuugaauuugccgaaca

SEQ ID NO: 2630458 - RNA, 12 nt, Escherichia coli CFT073
auuguaauacaa

SEQ ID NO: 2630459 - RNA, 17 nt, Escherichia coli CFT073
auuguacuuuccagcca

SEQ ID NO: 2630460 - RNA, 19 nt, Escherichia coli CFT073
auuguacuuuccagccaca

SEQ ID NO: 2630461 - RNA, 20 nt, Escherichia coli CFT073
auuguaggccagauaaaaca

SEQ ID NO: 2630462 - RNA, 14 nt, Escherichia coli CFT073
auuguaggccggau

SEQ ID NO: 2630463 - RNA, 12 nt, Escherichia coli CFT073
auuguauaccaa

SEQ ID NO: 2630464 - RNA, 23 nt, Escherichia coli CFT073
auuguauuagcccguucuucgcc

SEQ ID NO: 2630465 - RNA, 17 nt, Escherichia coli CFT073
auugucaauauccagca

SEQ ID NO: 2630466 - RNA, 18 nt, Escherichia coli CFT073
auugucaauauccagcag

SEQ ID NO: 2630467 - RNA, 18 nt, Escherichia coli CFT073
auugucaggaucaccaau

SEQ ID NO: 2630468 - RNA, 18 nt, Escherichia coli CFT073
auugucgcccuguaauuc

SEQ ID NO: 2630469 - RNA, 22 nt, Escherichia coli CFT073
auugucggaucgcugaacgcac

SEQ ID NO: 2630470 - RNA, 14 nt, Escherichia coli CFT073
auugugacaaacug

SEQ ID NO: 2630471 - RNA, 20 nt, Escherichia coli CFT073
auugugcauuuaagagaaac

SEQ ID NO: 2630472 - RNA, 15 nt, Escherichia coli CFT073
auugugcgccauuuu

SEQ ID NO: 2630473 - RNA, 19 nt, Escherichia coli CFT073
auugugcgguccaugcgaa

SEQ ID NO: 2630474 - RNA, 14 nt, Escherichia coli CFT073
auuguguaauuaau

SEQ ID NO: 2630475 - RNA, 18 nt, Escherichia coli CFT073
auugugugacacuucuuc

SEQ ID NO: 2630476 - RNA, 13 nt, Escherichia coli CFT073
auuguuagcaacg

SEQ ID NO: 2630477 - RNA, 13 nt, Escherichia coli CFT073
auuguuauaaugu

SEQ ID NO: 2630478 - RNA, 14 nt, Escherichia coli CFT073
auuguuaucagcaa

SEQ ID NO: 2630479 - RNA, 16 nt, Escherichia coli CFT073
auuguuuaaaaauaca

SEQ ID NO: 2630480 - RNA, 15 nt, Escherichia coli CFT073
auuguuuaaucaacu

SEQ ID NO: 2630481 - RNA, 10 nt, Escherichia coli CFT073
auuguuugac

SEQ ID NO: 2630482 - RNA, 23 nt, Escherichia coli CFT073
auuguuuuaaauauuguuuuuau

SEQ ID NO: 2630483 - RNA, 14 nt, Escherichia coli CFT073
auuuaaaaaugcca

SEQ ID NO: 2630484 - RNA, 14 nt, Escherichia coli CFT073
auuuaaaaucgcuu

SEQ ID NO: 2630485 - RNA, 18 nt, Escherichia coli CFT073
auuuaaacccuuucugcu

SEQ ID NO: 2630486 - RNA, 19 nt, Escherichia coli CFT073
auuuaaacccuuucugcug

SEQ ID NO: 2630487 - RNA, 21 nt, Escherichia coli CFT073
auuuaaacccuuucugcugcu

SEQ ID NO: 2630488 - RNA, 15 nt, Escherichia coli CFT073
auuuaaacucgcugc

SEQ ID NO: 2630489 - RNA, 16 nt, Escherichia coli CFT073
auuuaaacugaagacu

SEQ ID NO: 2630490 - RNA, 16 nt, Escherichia coli CFT073
auuuaaagcacaaaaa

SEQ ID NO: 2630491 - RNA, 20 nt, Escherichia coli CFT073
auuuaacacgaacuuuaucu

SEQ ID NO: 2630492 - RNA, 15 nt, Escherichia coli CFT073
auuuaacagcaaaac

SEQ ID NO: 2630493 - RNA, 12 nt, Escherichia coli CFT073
auuuaacaucau

SEQ ID NO: 2630494 - RNA, 16 nt, Escherichia coli CFT073
auuuaaguugaucgcc

SEQ ID NO: 2630495 - RNA, 16 nt, Escherichia coli CFT073
auuuaauguaaauauu

SEQ ID NO: 2630496 - RNA, 21 nt, Escherichia coli CFT073
auuuacaaucacuucauuccg

SEQ ID NO: 2630497 - RNA, 20 nt, Escherichia coli CFT073
auuuaccagagucuuugcuu

SEQ ID NO: 2630498 - RNA, 15 nt, Escherichia coli CFT073
auuuacccacagaca

SEQ ID NO: 2630499 - RNA, 23 nt, Escherichia coli CFT073
auuuaccgcuacuggcaauccug

SEQ ID NO: 2630500 - RNA, 18 nt, Escherichia coli CFT073
auuuacgccgcauccggc

SEQ ID NO: 2630501 - RNA, 16 nt, Escherichia coli CFT073
auuuacgguauaaccc

SEQ ID NO: 2630502 - RNA, 21 nt, Escherichia coli CFT073
auuuacuauucaccacuaccg

SEQ ID NO: 2630503 - RNA, 23 nt, Escherichia coli CFT073
auuuacugcauggccagacauua

SEQ ID NO: 2630504 - RNA, 15 nt, Escherichia coli CFT073
auuuacuuacuucug

SEQ ID NO: 2630505 - RNA, 16 nt, Escherichia coli CFT073
auuuacuuucuugcca

SEQ ID NO: 2630506 - RNA, 16 nt, Escherichia coli CFT073
auuuagaacugaucaa

SEQ ID NO: 2630507 - RNA, 17 nt, Escherichia coli CFT073
auuuagauaaacggaac

SEQ ID NO: 2630508 - RNA, 15 nt, Escherichia coli CFT073
auuuagcaaauuuuu

SEQ ID NO: 2630509 - RNA, 15 nt, Escherichia coli CFT073
auuuagccagcagcu

SEQ ID NO: 2630510 - RNA, 19 nt, Escherichia coli CFT073
auuuagccccggccaguac

SEQ ID NO: 2630511 - RNA, 17 nt, Escherichia coli CFT073
auuuagcgaauaacaaa

SEQ ID NO: 2630512 - RNA, 16 nt, Escherichia coli CFT073
auuuaguauuuuaugg

SEQ ID NO: 2630513 - RNA, 14 nt, Escherichia coli CFT073
auuuauagauucua

SEQ ID NO: 2630514 - RNA, 14 nt, Escherichia coli CFT073
auuuaucagauuuu

SEQ ID NO: 2630515 - RNA, 21 nt, Escherichia coli CFT073
auuuauccagcggcagccauu

SEQ ID NO: 2630516 - RNA, 18 nt, Escherichia coli CFT073
auuuaucgauuuucaaaa

SEQ ID NO: 2630517 - RNA, 21 nt, Escherichia coli CFT073
auuuaucgcagguaagauaau

SEQ ID NO: 2630518 - RNA, 22 nt, Escherichia coli CFT073
auuuaucuacuacccagcaauc

SEQ ID NO: 2630519 - RNA, 18 nt, Escherichia coli CFT073
auuuaucuucaccaaaug

SEQ ID NO: 2630520 - RNA, 15 nt, Escherichia coli CFT073
auuuaugggguggaa

SEQ ID NO: 2630521 - RNA, 20 nt, Escherichia coli CFT073
auuucaaacgcgcccaaacg

SEQ ID NO: 2630522 - RNA, 14 nt, Escherichia coli CFT073
auuucaaauugcuc

SEQ ID NO: 2630523 - RNA, 14 nt, Escherichia coli CFT073
auuucaaccacuca

SEQ ID NO: 2630524 - RNA, 15 nt, Escherichia coli CFT073
auuucaccacugccu

SEQ ID NO: 2630525 - RNA, 13 nt, Escherichia coli CFT073
auuucaccagcgc

SEQ ID NO: 2630526 - RNA, 20 nt, Escherichia coli CFT073
auuucacccagcguuugcug

SEQ ID NO: 2630527 - RNA, 19 nt, Escherichia coli CFT073
auuucacuucaaccacauu

SEQ ID NO: 2630528 - RNA, 18 nt, Escherichia coli CFT073
auuucagaccuguugccc

SEQ ID NO: 2630529 - RNA, 15 nt, Escherichia coli CFT073
auuucagcaucgcca

SEQ ID NO: 2630530 - RNA, 14 nt, Escherichia coli CFT073
auuucagccccagc

SEQ ID NO: 2630531 - RNA, 18 nt, Escherichia coli CFT073
auuucagcggcacuguuu

SEQ ID NO: 2630532 - RNA, 17 nt, Escherichia coli CFT073
auuucaggcaacaaaaa

SEQ ID NO: 2630533 - RNA, 18 nt, Escherichia coli CFT073
auuucagggguaggaaaa

SEQ ID NO: 2630534 - RNA, 21 nt, Escherichia coli CFT073
auuucagguucugaccagcca

SEQ ID NO: 2630535 - RNA, 22 nt, Escherichia coli CFT073
auuucagguucugaccagccag

SEQ ID NO: 2630536 - RNA, 22 nt, Escherichia coli CFT073
auuucauaauccuguagauauu

SEQ ID NO: 2630537 - RNA, 22 nt, Escherichia coli CFT073
auuucauauccggcauuuuuua

SEQ ID NO: 2630538 - RNA, 18 nt, Escherichia coli CFT073
auuucauaugcgccagac

SEQ ID NO: 2630539 - RNA, 14 nt, Escherichia coli CFT073
auuucaucaccagc

SEQ ID NO: 2630540 - RNA, 18 nt, Escherichia coli CFT073
auuucauccuguaugaca

SEQ ID NO: 2630541 - RNA, 16 nt, Escherichia coli CFT073
auuucaucgcccaggc

SEQ ID NO: 2630542 - RNA, 21 nt, Escherichia coli CFT073
auuucaucgcuacaccaaucg

SEQ ID NO: 2630543 - RNA, 17 nt, Escherichia coli CFT073
auuucaugaagcugaca

SEQ ID NO: 2630544 - RNA, 17 nt, Escherichia coli CFT073
auuucaugcucaccaau

SEQ ID NO: 2630545 - RNA, 23 nt, Escherichia coli CFT073
auuucauggcggaaaucagagau

SEQ ID NO: 2630546 - RNA, 21 nt, Escherichia coli CFT073
auuucauuaucaauugcuuca

SEQ ID NO: 2630547 - RNA, 22 nt, Escherichia coli CFT073
auuucauucacgccguuaacuu

SEQ ID NO: 2630548 - RNA, 23 nt, Escherichia coli CFT073
auuucauucaggcccgucacgca

SEQ ID NO: 2630549 - RNA, 21 nt, Escherichia coli CFT073
auuucauuguccgucugaaaa

SEQ ID NO: 2630550 - RNA, 15 nt, Escherichia coli CFT073
auuuccaagauuaaa

SEQ ID NO: 2630551 - RNA, 17 nt, Escherichia coli CFT073
auuuccaccgcuauuga

SEQ ID NO: 2630552 - RNA, 14 nt, Escherichia coli CFT073
auuuccagaaagug

SEQ ID NO: 2630553 - RNA, 15 nt, Escherichia coli CFT073
auuuccagaaaguga

SEQ ID NO: 2630554 - RNA, 17 nt, Escherichia coli CFT073
auuuccagaccuaaaaa

SEQ ID NO: 2630555 - RNA, 15 nt, Escherichia coli CFT073
auuuccagacgccau

SEQ ID NO: 2630556 - RNA, 10 nt, Escherichia coli CFT073
auuuccagcg

SEQ ID NO: 2630557 - RNA, 13 nt, Escherichia coli CFT073
auuuccaguuugc

SEQ ID NO: 2630558 - RNA, 17 nt, Escherichia coli CFT073
auuuccaguuugcguuc

SEQ ID NO: 2630559 - RNA, 21 nt, Escherichia coli CFT073
auuuccaucuccagcugcucg

SEQ ID NO: 2630560 - RNA, 14 nt, Escherichia coli CFT073
auuuccccaauuca

SEQ ID NO: 2630561 - RNA, 15 nt, Escherichia coli CFT073
auuuccccccggcag

SEQ ID NO: 2630562 - RNA, 21 nt, Escherichia coli CFT073
auuuccccccggcagcugcca

SEQ ID NO: 2630563 - RNA, 19 nt, Escherichia coli CFT073
auuuccccuaacucuuuca

SEQ ID NO: 2630564 - RNA, 20 nt, Escherichia coli CFT073
auuucccgggcgagcaaugu

SEQ ID NO: 2630565 - RNA, 22 nt, Escherichia coli CFT073
auuucccgugaagacuuugccc

SEQ ID NO: 2630566 - RNA, 19 nt, Escherichia coli CFT073
auuuccgcagcuccagccc

SEQ ID NO: 2630567 - RNA, 13 nt, Escherichia coli CFT073
auuuccgcuuuca

SEQ ID NO: 2630568 - RNA, 13 nt, Escherichia coli CFT073
auuuccguuugcg

SEQ ID NO: 2630569 - RNA, 22 nt, Escherichia coli CFT073
auuuccugccagaccuuaucac

SEQ ID NO: 2630570 - RNA, 23 nt, Escherichia coli CFT073
auuuccuucgcuuccuguauauc

SEQ ID NO: 2630571 - RNA, 17 nt, Escherichia coli CFT073
auuuccuucgcuuuaau

SEQ ID NO: 2630572 - RNA, 14 nt, Escherichia coli CFT073
auuucgauauguuc

SEQ ID NO: 2630573 - RNA, 15 nt, Escherichia coli CFT073
auuucgauauguucc

SEQ ID NO: 2630574 - RNA, 14 nt, Escherichia coli CFT073
auuucgaucauagu

SEQ ID NO: 2630575 - RNA, 22 nt, Escherichia coli CFT073
auuucgauuuguucugguguua

SEQ ID NO: 2630576 - RNA, 12 nt, Escherichia coli CFT073
auuucgccgcac

SEQ ID NO: 2630577 - RNA, 15 nt, Escherichia coli CFT073
auuucgcuaaaagua

SEQ ID NO: 2630578 - RNA, 18 nt, Escherichia coli CFT073
auuucggcacuuuuggug

SEQ ID NO: 2630579 - RNA, 12 nt, Escherichia coli CFT073
auuucggcggcu

SEQ ID NO: 2630580 - RNA, 19 nt, Escherichia coli CFT073
auuucguauacugcagcgg

SEQ ID NO: 2630581 - RNA, 14 nt, Escherichia coli CFT073
auuucguccagcga

SEQ ID NO: 2630582 - RNA, 20 nt, Escherichia coli CFT073
auuucguccauguuggagau

SEQ ID NO: 2630583 - RNA, 22 nt, Escherichia coli CFT073
auuucguccauguuggagauaa

SEQ ID NO: 2630584 - RNA, 18 nt, Escherichia coli CFT073
auuucguuaaguucagaa

SEQ ID NO: 2630585 - RNA, 13 nt, Escherichia coli CFT073
auuucguuagcaa

SEQ ID NO: 2630586 - RNA, 18 nt, Escherichia coli CFT073
auuucguuagcaaacgac

SEQ ID NO: 2630587 - RNA, 19 nt, Escherichia coli CFT073
auuucguuagcaaacgaca

SEQ ID NO: 2630588 - RNA, 20 nt, Escherichia coli CFT073
auuucguuagcaaacgacac

SEQ ID NO: 2630589 - RNA, 14 nt, Escherichia coli CFT073
auuucuaucaucau

SEQ ID NO: 2630590 - RNA, 13 nt, Escherichia coli CFT073
auuucucaucaau

SEQ ID NO: 2630591 - RNA, 19 nt, Escherichia coli CFT073
auuucucauuuugauuaau

SEQ ID NO: 2630592 - RNA, 13 nt, Escherichia coli CFT073
auuucuccuguuc

SEQ ID NO: 2630593 - RNA, 14 nt, Escherichia coli CFT073
auuucuccuguucc

SEQ ID NO: 2630594 - RNA, 20 nt, Escherichia coli CFT073
auuucucgccguucuccuca

SEQ ID NO: 2630595 - RNA, 17 nt, Escherichia coli CFT073
auuucucuggagaaaua

SEQ ID NO: 2630596 - RNA, 19 nt, Escherichia coli CFT073
auuucucuggagaaauaua

SEQ ID NO: 2630597 - RNA, 19 nt, Escherichia coli CFT073
auuucugacgaugguguuu

SEQ ID NO: 2630598 - RNA, 21 nt, Escherichia coli CFT073
auuucugacgaugguguuuau

SEQ ID NO: 2630599 - RNA, 17 nt, Escherichia coli CFT073
auuucugacuucccucc

SEQ ID NO: 2630600 - RNA, 20 nt, Escherichia coli CFT073
auuucugcaaucgucugcug

SEQ ID NO: 2630601 - RNA, 22 nt, Escherichia coli CFT073
auuucugcaaucgucugcugaa

SEQ ID NO: 2630602 - RNA, 23 nt, Escherichia coli CFT073
auuucugcgcggauagccagcau

SEQ ID NO: 2630603 - RNA, 20 nt, Escherichia coli CFT073
auuucugugcagccaaaaau

SEQ ID NO: 2630604 - RNA, 20 nt, Escherichia coli CFT073
auuucuucagccacauuuuu

SEQ ID NO: 2630605 - RNA, 17 nt, Escherichia coli CFT073
auuucuuuacugacagg

SEQ ID NO: 2630606 - RNA, 13 nt, Escherichia coli CFT073
auuucuuuaucac

SEQ ID NO: 2630607 - RNA, 20 nt, Escherichia coli CFT073
auuucuuuaugggcauuucu

SEQ ID NO: 2630608 - RNA, 18 nt, Escherichia coli CFT073
auuucuuuauugauaaac

SEQ ID NO: 2630609 - RNA, 22 nt, Escherichia coli CFT073
auuucuuucgcacugguuugca

SEQ ID NO: 2630610 - RNA, 23 nt, Escherichia coli CFT073
auuucuuucgcacugguuugcag

SEQ ID NO: 2630611 - RNA, 16 nt, Escherichia coli CFT073
auuucuuuuuuucauu

SEQ ID NO: 2630612 - RNA, 17 nt, Escherichia coli CFT073
auuucuuuuuuucauug

SEQ ID NO: 2630613 - RNA, 15 nt, Escherichia coli CFT073
auuugaaaccgucuu

SEQ ID NO: 2630614 - RNA, 14 nt, Escherichia coli CFT073
auuugaaaugacgc

SEQ ID NO: 2630615 - RNA, 12 nt, Escherichia coli CFT073
auuugaacaucg

SEQ ID NO: 2630616 - RNA, 15 nt, Escherichia coli CFT073
auuugaauuucaaau

SEQ ID NO: 2630617 - RNA, 18 nt, Escherichia coli CFT073
auuugacauuuuuucauc

SEQ ID NO: 2630618 - RNA, 15 nt, Escherichia coli CFT073
auuugagcuugcugc

SEQ ID NO: 2630619 - RNA, 18 nt, Escherichia coli CFT073
auuugaggaagcugcccu

SEQ ID NO: 2630620 - RNA, 14 nt, Escherichia coli CFT073
auuugaucaaauac

SEQ ID NO: 2630621 - RNA, 18 nt, Escherichia coli CFT073
auuugcaggcuaaaaacg

SEQ ID NO: 2630622 - RNA, 15 nt, Escherichia coli CFT073
auuugcaucaucaag

SEQ ID NO: 2630623 - RNA, 12 nt, Escherichia coli CFT073
auuugccaggcu

SEQ ID NO: 2630624 - RNA, 18 nt, Escherichia coli CFT073
auuugcccaucaggccag

SEQ ID NO: 2630625 - RNA, 20 nt, Escherichia coli CFT073
auuugccgauaagcaggagu

SEQ ID NO: 2630626 - RNA, 14 nt, Escherichia coli CFT073
auuugcgaguccgc

SEQ ID NO: 2630627 - RNA, 15 nt, Escherichia coli CFT073
auuugcgaguccgcu

SEQ ID NO: 2630628 - RNA, 14 nt, Escherichia coli CFT073
auuugcgccgccga

SEQ ID NO: 2630629 - RNA, 12 nt, Escherichia coli CFT073
auuugcggcaga

SEQ ID NO: 2630630 - RNA, 17 nt, Escherichia coli CFT073
auuugcggugaagccac

SEQ ID NO: 2630631 - RNA, 15 nt, Escherichia coli CFT073
auuugcucuaccagc

SEQ ID NO: 2630632 - RNA, 21 nt, Escherichia coli CFT073
auuugcugcuggcaucaccaa

SEQ ID NO: 2630633 - RNA, 20 nt, Escherichia coli CFT073
auuugcugguggcauuuuua

SEQ ID NO: 2630634 - RNA, 21 nt, Escherichia coli CFT073
auuugcugguggcauuuuuau

SEQ ID NO: 2630635 - RNA, 21 nt, Escherichia coli CFT073
auuugcuuguuucauuacucg

SEQ ID NO: 2630636 - RNA, 19 nt, Escherichia coli CFT073
auuuggauugcuauuuaac

SEQ ID NO: 2630637 - RNA, 12 nt, Escherichia coli CFT073
auuuggauuuuu

SEQ ID NO: 2630638 - RNA, 17 nt, Escherichia coli CFT073
auuuggcggggauuuuu

SEQ ID NO: 2630639 - RNA, 14 nt, Escherichia coli CFT073
auuuggcugccgag

SEQ ID NO: 2630640 - RNA, 15 nt, Escherichia coli CFT073
auuuguccacgccgc

SEQ ID NO: 2630641 - RNA, 19 nt, Escherichia coli CFT073
auuugucgauuuccaucuc

SEQ ID NO: 2630642 - RNA, 17 nt, Escherichia coli CFT073
auuugucgccaacuuca

SEQ ID NO: 2630643 - RNA, 15 nt, Escherichia coli CFT073
auuugugauuuguca

SEQ ID NO: 2630644 - RNA, 12 nt, Escherichia coli CFT073
auuugugucaga

SEQ ID NO: 2630645 - RNA, 19 nt, Escherichia coli CFT073
auuuguuaacaauauuaac

SEQ ID NO: 2630646 - RNA, 16 nt, Escherichia coli CFT073
auuuguucagcaaaug

SEQ ID NO: 2630647 - RNA, 12 nt, Escherichia coli CFT073
auuuguuuucau

SEQ ID NO: 2630648 - RNA, 14 nt, Escherichia coli CFT073
auuuuaaaauugua

SEQ ID NO: 2630649 - RNA, 15 nt, Escherichia coli CFT073
auuuuaaaauuguag

SEQ ID NO: 2630650 - RNA, 22 nt, Escherichia coli CFT073
auuuuaaacggcauaaauuuca

SEQ ID NO: 2630651 - RNA, 23 nt, Escherichia coli CFT073
auuuuaaaggauuuacuaaaacu

SEQ ID NO: 2630652 - RNA, 18 nt, Escherichia coli CFT073
auuuuaaauuuccucuug

SEQ ID NO: 2630653 - RNA, 21 nt, Escherichia coli CFT073
auuuuaaauuuccucuuguca

SEQ ID NO: 2630654 - RNA, 15 nt, Escherichia coli CFT073
auuuuaauaaaucac

SEQ ID NO: 2630655 - RNA, 17 nt, Escherichia coli CFT073
auuuuaccauauaaaca

SEQ ID NO: 2630656 - RNA, 19 nt, Escherichia coli CFT073
auuuuaccauauaaacaua

SEQ ID NO: 2630657 - RNA, 19 nt, Escherichia coli CFT073
auuuuacccgugcauccca

SEQ ID NO: 2630658 - RNA, 21 nt, Escherichia coli CFT073
auuuuacccgugcaucccaga

SEQ ID NO: 2630659 - RNA, 14 nt, Escherichia coli CFT073
auuuuacuucccag

SEQ ID NO: 2630660 - RNA, 16 nt, Escherichia coli CFT073
auuuuacuucccaguc

SEQ ID NO: 2630661 - RNA, 15 nt, Escherichia coli CFT073
auuuuauaaucaaca

SEQ ID NO: 2630662 - RNA, 20 nt, Escherichia coli CFT073
auuuuauugcguaaucuuuu

SEQ ID NO: 2630663 - RNA, 22 nt, Escherichia coli CFT073
auuuuauugcguaaucuuuuca

SEQ ID NO: 2630664 - RNA, 17 nt, Escherichia coli CFT073
auuuuauuucaaaauua

SEQ ID NO: 2630665 - RNA, 14 nt, Escherichia coli CFT073
auuuucaccacauu

SEQ ID NO: 2630666 - RNA, 22 nt, Escherichia coli CFT073
auuuucagaaggauaauuaauc

SEQ ID NO: 2630667 - RNA, 21 nt, Escherichia coli CFT073
auuuucagcgugcccacguuc

SEQ ID NO: 2630668 - RNA, 22 nt, Escherichia coli CFT073
auuuucagcgugcccacguuca

SEQ ID NO: 2630669 - RNA, 16 nt, Escherichia coli CFT073
auuuucaggucguuca

SEQ ID NO: 2630670 - RNA, 19 nt, Escherichia coli CFT073
auuuucauaguaggucaua

SEQ ID NO: 2630671 - RNA, 21 nt, Escherichia coli CFT073
auuuucauaguaggucauauc

SEQ ID NO: 2630672 - RNA, 23 nt, Escherichia coli CFT073
auuuuccagauucuccaccugcg

SEQ ID NO: 2630673 - RNA, 22 nt, Escherichia coli CFT073
auuuuccaucacgaucagcgga

SEQ ID NO: 2630674 - RNA, 22 nt, Escherichia coli CFT073
auuuucccuuccgccaucaauc

SEQ ID NO: 2630675 - RNA, 15 nt, Escherichia coli CFT073
auuuuccggguucuc

SEQ ID NO: 2630676 - RNA, 23 nt, Escherichia coli CFT073
auuuuccuguugcuguuguucca

SEQ ID NO: 2630677 - RNA, 18 nt, Escherichia coli CFT073
auuuuccuugaaaaagag

SEQ ID NO: 2630678 - RNA, 18 nt, Escherichia coli CFT073
auuuucgccaucucaaaa

SEQ ID NO: 2630679 - RNA, 15 nt, Escherichia coli CFT073
auuuucucacuggcg

SEQ ID NO: 2630680 - RNA, 13 nt, Escherichia coli CFT073
auuuucugacaag

SEQ ID NO: 2630681 - RNA, 21 nt, Escherichia coli CFT073
auuuucugcccguuuaacguu

SEQ ID NO: 2630682 - RNA, 19 nt, Escherichia coli CFT073
auuuucuucagcaguucag

SEQ ID NO: 2630683 - RNA, 14 nt, Escherichia coli CFT073
auuuucuucauucg

SEQ ID NO: 2630684 - RNA, 14 nt, Escherichia coli CFT073
auuuugaacagaac

SEQ ID NO: 2630685 - RNA, 14 nt, Escherichia coli CFT073
auuuugaaggaaaa

SEQ ID NO: 2630686 - RNA, 23 nt, Escherichia coli CFT073
auuuugaguggucgacaaccagc

SEQ ID NO: 2630687 - RNA, 14 nt, Escherichia coli CFT073
auuuugcagcauuc

SEQ ID NO: 2630688 - RNA, 18 nt, Escherichia coli CFT073
auuuugcagcuguugcgc

SEQ ID NO: 2630689 - RNA, 15 nt, Escherichia coli CFT073
auuuugcaggccuga

SEQ ID NO: 2630690 - RNA, 18 nt, Escherichia coli CFT073
auuuugcaggccugauaa

SEQ ID NO: 2630691 - RNA, 20 nt, Escherichia coli CFT073
auuuugcagucccaucuucu

SEQ ID NO: 2630692 - RNA, 20 nt, Escherichia coli CFT073
auuuugcgacccguuuacgg

SEQ ID NO: 2630693 - RNA, 13 nt, Escherichia coli CFT073
auuuugcgcuucu

SEQ ID NO: 2630694 - RNA, 15 nt, Escherichia coli CFT073
auuuugcucaccggc

SEQ ID NO: 2630695 - RNA, 20 nt, Escherichia coli CFT073
auuuugcugaugcagcgaug

SEQ ID NO: 2630696 - RNA, 18 nt, Escherichia coli CFT073
auuuugcugcuuccauug

SEQ ID NO: 2630697 - RNA, 16 nt, Escherichia coli CFT073
auuuugcuggaaaagu

SEQ ID NO: 2630698 - RNA, 18 nt, Escherichia coli CFT073
auuuugcugugcuuuaca

SEQ ID NO: 2630699 - RNA, 22 nt, Escherichia coli CFT073
auuuugcuuauuuaaacugaag

SEQ ID NO: 2630700 - RNA, 15 nt, Escherichia coli CFT073
auuuugcuuccggca

SEQ ID NO: 2630701 - RNA, 22 nt, Escherichia coli CFT073
auuuugggacagugcaggaugc

SEQ ID NO: 2630702 - RNA, 15 nt, Escherichia coli CFT073
auuuuguaggccuga

SEQ ID NO: 2630703 - RNA, 18 nt, Escherichia coli CFT073
auuuuguaggccugauaa

SEQ ID NO: 2630704 - RNA, 12 nt, Escherichia coli CFT073
auuuuguaugcg

SEQ ID NO: 2630705 - RNA, 16 nt, Escherichia coli CFT073
auuuuguucaauaaga

SEQ ID NO: 2630706 - RNA, 15 nt, Escherichia coli CFT073
auuuuuaacaguguu

SEQ ID NO: 2630707 - RNA, 15 nt, Escherichia coli CFT073
auuuuuacgaaacag

SEQ ID NO: 2630708 - RNA, 20 nt, Escherichia coli CFT073
auuuuuauauagccagccuc

SEQ ID NO: 2630709 - RNA, 22 nt, Escherichia coli CFT073
auuuuuauuaaauauuauaugu

SEQ ID NO: 2630710 - RNA, 13 nt, Escherichia coli CFT073
auuuuucagcauc

SEQ ID NO: 2630711 - RNA, 17 nt, Escherichia coli CFT073
auuuuucagcgccauaa

SEQ ID NO: 2630712 - RNA, 19 nt, Escherichia coli CFT073
auuuuucaggaucaagcug

SEQ ID NO: 2630713 - RNA, 13 nt, Escherichia coli CFT073
auuuuucaucacu

SEQ ID NO: 2630714 - RNA, 19 nt, Escherichia coli CFT073
auuuuuccacuggauaaag

SEQ ID NO: 2630715 - RNA, 17 nt, Escherichia coli CFT073
auuuuuccagcauuucu

SEQ ID NO: 2630716 - RNA, 22 nt, Escherichia coli CFT073
auuuuucgagggugcgaauaag

SEQ ID NO: 2630717 - RNA, 21 nt, Escherichia coli CFT073
auuuuucgcgcgggcagaugc

SEQ ID NO: 2630718 - RNA, 22 nt, Escherichia coli CFT073
auuuuucgcgcgggcagaugcc

SEQ ID NO: 2630719 - RNA, 16 nt, Escherichia coli CFT073
auuuuucgcucuuucg

SEQ ID NO: 2630720 - RNA, 15 nt, Escherichia coli CFT073
auuuuucgcuuuuca

SEQ ID NO: 2630721 - RNA, 16 nt, Escherichia coli CFT073
auuuuugugaagaaua

SEQ ID NO: 2630722 - RNA, 18 nt, Escherichia coli CFT073
auuuuuguuucacacuga

SEQ ID NO: 2630723 - RNA, 15 nt, Escherichia coli CFT073
auuuuuuaauaaaaa

SEQ ID NO: 2630724 - RNA, 21 nt, Escherichia coli CFT073
auuuuuuauuguccgguuuaa

SEQ ID NO: 2630725 - RNA, 18 nt, Escherichia coli CFT073
auuuuuucagauaaaagc

SEQ ID NO: 2630726 - RNA, 13 nt, Escherichia coli CFT073
auuuuuuccaaca

SEQ ID NO: 2630727 - RNA, 17 nt, Escherichia coli CFT073
auuuuuuccagcgcaug

SEQ ID NO: 2630728 - RNA, 22 nt, Escherichia coli CFT073
auuuuuucugaccaauagauau

SEQ ID NO: 2630729 - RNA, 13 nt, Escherichia coli CFT073
caaaaaaaauuuu

SEQ ID NO: 2630730 - RNA, 15 nt, Escherichia coli CFT073
caaaaaaagccacgg

SEQ ID NO: 2630731 - RNA, 13 nt, Escherichia coli CFT073
caaaaaaagcuau

SEQ ID NO: 2630732 - RNA, 16 nt, Escherichia coli CFT073
caaaaaaaucuucacu

SEQ ID NO: 2630733 - RNA, 14 nt, Escherichia coli CFT073
caaaaaaauuucau

SEQ ID NO: 2630734 - RNA, 11 nt, Escherichia coli CFT073
caaaaaaccua

SEQ ID NO: 2630735 - RNA, 19 nt, Escherichia coli CFT073
caaaaaagaaggaaaauac

SEQ ID NO: 2630736 - RNA, 21 nt, Escherichia coli CFT073
caaaaaagaaggaaaauacag

SEQ ID NO: 2630737 - RNA, 13 nt, Escherichia coli CFT073
caaaaaagcccag

SEQ ID NO: 2630738 - RNA, 19 nt, Escherichia coli CFT073
caaaaaaggccgcaggcug

SEQ ID NO: 2630739 - RNA, 18 nt, Escherichia coli CFT073
caaaaaauugaaaauuca

SEQ ID NO: 2630740 - RNA, 15 nt, Escherichia coli CFT073
caaaaacaaauuuug

SEQ ID NO: 2630741 - RNA, 13 nt, Escherichia coli CFT073
caaaaacccugcc

SEQ ID NO: 2630742 - RNA, 18 nt, Escherichia coli CFT073
caaaaaccggagucugug

SEQ ID NO: 2630743 - RNA, 18 nt, Escherichia coli CFT073
caaaaaccggcacgccgu

SEQ ID NO: 2630744 - RNA, 19 nt, Escherichia coli CFT073
caaaaacguugccguaagc

SEQ ID NO: 2630745 - RNA, 19 nt, Escherichia coli CFT073
caaaaacuggucaaacuga

SEQ ID NO: 2630746 - RNA, 12 nt, Escherichia coli CFT073
caaaaauaaaug

SEQ ID NO: 2630747 - RNA, 17 nt, Escherichia coli CFT073
caaaaauaaaugcuuga

SEQ ID NO: 2630748 - RNA, 15 nt, Escherichia coli CFT073
caaaaauaaucaucu

SEQ ID NO: 2630749 - RNA, 19 nt, Escherichia coli CFT073
caaaaaucaauggcccauu

SEQ ID NO: 2630750 - RNA, 17 nt, Escherichia coli CFT073
caaaaaucgacagcagg

SEQ ID NO: 2630751 - RNA, 14 nt, Escherichia coli CFT073
caaaaauuacucuc

SEQ ID NO: 2630752 - RNA, 22 nt, Escherichia coli CFT073
caaaaauugcccccagucgcca

SEQ ID NO: 2630753 - RNA, 15 nt, Escherichia coli CFT073
caaaacagccugcgu

SEQ ID NO: 2630754 - RNA, 16 nt, Escherichia coli CFT073
caaaacauacuuucuc

SEQ ID NO: 2630755 - RNA, 20 nt, Escherichia coli CFT073
caaaacauaucccaccagcg

SEQ ID NO: 2630756 - RNA, 22 nt, Escherichia coli CFT073
caaaacauaucccaccagcgcc

SEQ ID NO: 2630757 - RNA, 19 nt, Escherichia coli CFT073
caaaacaucgcuugcucgc

SEQ ID NO: 2630758 - RNA, 23 nt, Escherichia coli CFT073
caaaacauguggauuaaauugcg

SEQ ID NO: 2630759 - RNA, 15 nt, Escherichia coli CFT073
caaaaccaaaccagc

SEQ ID NO: 2630760 - RNA, 18 nt, Escherichia coli CFT073
caaaaccacauggagcuu

SEQ ID NO: 2630761 - RNA, 22 nt, Escherichia coli CFT073
caaaaccacauggagcuuuaaa

SEQ ID NO: 2630762 - RNA, 23 nt, Escherichia coli CFT073
caaaaccaucaauccacuucgcc

SEQ ID NO: 2630763 - RNA, 20 nt, Escherichia coli CFT073
caaaacccgcuucuuccagc

SEQ ID NO: 2630764 - RNA, 15 nt, Escherichia coli CFT073
caaaacccugcgcca

SEQ ID NO: 2630765 - RNA, 21 nt, Escherichia coli CFT073
caaaaccgaggagcaacaaca

SEQ ID NO: 2630766 - RNA, 22 nt, Escherichia coli CFT073
caaaaccgauuaauugccgcca

SEQ ID NO: 2630767 - RNA, 19 nt, Escherichia coli CFT073
caaaaccuggacaguuuca

SEQ ID NO: 2630768 - RNA, 18 nt, Escherichia coli CFT073
caaaacgcgcucacugca

SEQ ID NO: 2630769 - RNA, 20 nt, Escherichia coli CFT073
caaaacggacauguugcuua

SEQ ID NO: 2630770 - RNA, 15 nt, Escherichia coli CFT073
caaaacgucgccagc

SEQ ID NO: 2630771 - RNA, 17 nt, Escherichia coli CFT073
caaaacgugcagcugcc

SEQ ID NO: 2630772 - RNA, 21 nt, Escherichia coli CFT073
caaaacguggccuccaaaaaa

SEQ ID NO: 2630773 - RNA, 17 nt, Escherichia coli CFT073
caaaacucgcuggcggc

SEQ ID NO: 2630774 - RNA, 20 nt, Escherichia coli CFT073
caaaacugacgccauucuca

SEQ ID NO: 2630775 - RNA, 19 nt, Escherichia coli CFT073
caaaacuggugguaagaau

SEQ ID NO: 2630776 - RNA, 18 nt, Escherichia coli CFT073
caaaagacguuaacguuc

SEQ ID NO: 2630777 - RNA, 19 nt, Escherichia coli CFT073
caaaagagaggauaugcau

SEQ ID NO: 2630778 - RNA, 18 nt, Escherichia coli CFT073
caaaagcaauaauuucaa

SEQ ID NO: 2630779 - RNA, 18 nt, Escherichia coli CFT073
caaaagcacaauccgcca

SEQ ID NO: 2630780 - RNA, 21 nt, Escherichia coli CFT073
caaaagcaggcaccgcgccca

SEQ ID NO: 2630781 - RNA, 20 nt, Escherichia coli CFT073
caaaagcggugauaaaccca

SEQ ID NO: 2630782 - RNA, 14 nt, Escherichia coli CFT073
caaaagucaccagu

SEQ ID NO: 2630783 - RNA, 21 nt, Escherichia coli CFT073
caaaagugcgccgaggaaaca

SEQ ID NO: 2630784 - RNA, 16 nt, Escherichia coli CFT073
caaaauaaggcugcca

SEQ ID NO: 2630785 - RNA, 18 nt, Escherichia coli CFT073
caaaauaaguaucugcua

SEQ ID NO: 2630786 - RNA, 13 nt, Escherichia coli CFT073
caaaauaccaaua

SEQ ID NO: 2630787 - RNA, 17 nt, Escherichia coli CFT073
caaaauacggcauugac

SEQ ID NO: 2630788 - RNA, 20 nt, Escherichia coli CFT073
caaaauacguuuucaccucu

SEQ ID NO: 2630789 - RNA, 21 nt, Escherichia coli CFT073
caaaauacguuuucaccucug

SEQ ID NO: 2630790 - RNA, 18 nt, Escherichia coli CFT073
caaaauaucgacauucaa

SEQ ID NO: 2630791 - RNA, 21 nt, Escherichia coli CFT073
caaaauaucgacauucaauga

SEQ ID NO: 2630792 - RNA, 19 nt, Escherichia coli CFT073
caaaauaucgauauacacc

SEQ ID NO: 2630793 - RNA, 19 nt, Escherichia coli CFT073
caaaaucaauucaucgcuc

SEQ ID NO: 2630794 - RNA, 15 nt, Escherichia coli CFT073
caaaaucagaaacaa

SEQ ID NO: 2630795 - RNA, 16 nt, Escherichia coli CFT073
caaaaucagaaacaaa

SEQ ID NO: 2630796 - RNA, 21 nt, Escherichia coli CFT073
caaaaucaugcaaauucaaua

SEQ ID NO: 2630797 - RNA, 16 nt, Escherichia coli CFT073
caaaauccagaaaaaa

SEQ ID NO: 2630798 - RNA, 13 nt, Escherichia coli CFT073
caaaauccccuuc

SEQ ID NO: 2630799 - RNA, 14 nt, Escherichia coli CFT073
caaaauccccuuca

SEQ ID NO: 2630800 - RNA, 15 nt, Escherichia coli CFT073
caaaauccgccaccg

SEQ ID NO: 2630801 - RNA, 15 nt, Escherichia coli CFT073
caaaauccugccagc

SEQ ID NO: 2630802 - RNA, 17 nt, Escherichia coli CFT073
caaaauccuuccagcuc

SEQ ID NO: 2630803 - RNA, 17 nt, Escherichia coli CFT073
caaaaucuaccagcgga

SEQ ID NO: 2630804 - RNA, 14 nt, Escherichia coli CFT073
caaaaucuucguua

SEQ ID NO: 2630805 - RNA, 23 nt, Escherichia coli CFT073
caaaaugaucgaagguuccugca

SEQ ID NO: 2630806 - RNA, 18 nt, Escherichia coli CFT073
caaaaugaugucaaccau

SEQ ID NO: 2630807 - RNA, 19 nt, Escherichia coli CFT073
caaaaugcccgaucgagga

SEQ ID NO: 2630808 - RNA, 19 nt, Escherichia coli CFT073
caaaaugccguacagcaga

SEQ ID NO: 2630809 - RNA, 11 nt, Escherichia coli CFT073
caaaauggccg

SEQ ID NO: 2630810 - RNA, 19 nt, Escherichia coli CFT073
caaaauggguauauuugcc

SEQ ID NO: 2630811 - RNA, 21 nt, Escherichia coli CFT073
caaaauggguauauuugccaa

SEQ ID NO: 2630812 - RNA, 14 nt, Escherichia coli CFT073
caaaauguugcgcc

SEQ ID NO: 2630813 - RNA, 15 nt, Escherichia coli CFT073
caaaauguugcgccu

SEQ ID NO: 2630814 - RNA, 17 nt, Escherichia coli CFT073
caaaauuaaagccgcga

SEQ ID NO: 2630815 - RNA, 23 nt, Escherichia coli CFT073
caaaauuaccugaugcgcuccgc

SEQ ID NO: 2630816 - RNA, 18 nt, Escherichia coli CFT073
caaaauucauaaagcuau

SEQ ID NO: 2630817 - RNA, 13 nt, Escherichia coli CFT073
caaaauuccauuu

SEQ ID NO: 2630818 - RNA, 12 nt, Escherichia coli CFT073
caaaauugacua

SEQ ID NO: 2630819 - RNA, 16 nt, Escherichia coli CFT073
caaaauugccugaugc

SEQ ID NO: 2630820 - RNA, 22 nt, Escherichia coli CFT073
caaaauugccugaugcgcuacg

SEQ ID NO: 2630821 - RNA, 14 nt, Escherichia coli CFT073
caaaauuuaacauu

SEQ ID NO: 2630822 - RNA, 14 nt, Escherichia coli CFT073
caaaauuuauccag

SEQ ID NO: 2630823 - RNA, 15 nt, Escherichia coli CFT073
caaaauuuuugccaa

SEQ ID NO: 2630824 - RNA, 16 nt, Escherichia coli CFT073
caaaauuuuugccaau

SEQ ID NO: 2630825 - RNA, 18 nt, Escherichia coli CFT073
caaacaacgccacacgca

SEQ ID NO: 2630826 - RNA, 23 nt, Escherichia coli CFT073
caaacaauuugcuuaagccgcuc

SEQ ID NO: 2630827 - RNA, 16 nt, Escherichia coli CFT073
caaacaccagcugaau

SEQ ID NO: 2630828 - RNA, 22 nt, Escherichia coli CFT073
caaacacccgacgugcagcauc

SEQ ID NO: 2630829 - RNA, 15 nt, Escherichia coli CFT073
caaacaccgaaccag

SEQ ID NO: 2630830 - RNA, 22 nt, Escherichia coli CFT073
caaacaccgaaccgaaauggcu

SEQ ID NO: 2630831 - RNA, 15 nt, Escherichia coli CFT073
caaacacgcaauccc

SEQ ID NO: 2630832 - RNA, 16 nt, Escherichia coli CFT073
caaacagaaaaacgaa

SEQ ID NO: 2630833 - RNA, 16 nt, Escherichia coli CFT073
caaacagaauauugug

SEQ ID NO: 2630834 - RNA, 21 nt, Escherichia coli CFT073
caaacagaauuaucauuuuua

SEQ ID NO: 2630835 - RNA, 20 nt, Escherichia coli CFT073
caaacagcacggucaggcua

SEQ ID NO: 2630836 - RNA, 15 nt, Escherichia coli CFT073
caaacagcagaacga

SEQ ID NO: 2630837 - RNA, 16 nt, Escherichia coli CFT073
caaacagcagaacgac

SEQ ID NO: 2630838 - RNA, 16 nt, Escherichia coli CFT073
caaacagcgagaacac

SEQ ID NO: 2630839 - RNA, 13 nt, Escherichia coli CFT073
caaacagcgccag

SEQ ID NO: 2630840 - RNA, 15 nt, Escherichia coli CFT073
caaacagcgccagau

SEQ ID NO: 2630841 - RNA, 22 nt, Escherichia coli CFT073
caaacagcgccagauagccgac

SEQ ID NO: 2630842 - RNA, 17 nt, Escherichia coli CFT073
caaacagcgcgccagcu

SEQ ID NO: 2630843 - RNA, 19 nt, Escherichia coli CFT073
caaacagguuauugaccga

SEQ ID NO: 2630844 - RNA, 16 nt, Escherichia coli CFT073
caaacaguaacccagc

SEQ ID NO: 2630845 - RNA, 19 nt, Escherichia coli CFT073
caaacagucgcccgaccau

SEQ ID NO: 2630846 - RNA, 23 nt, Escherichia coli CFT073
caaacaguguuuugacauuggca

SEQ ID NO: 2630847 - RNA, 18 nt, Escherichia coli CFT073
caaacaguucugcagcgu

SEQ ID NO: 2630848 - RNA, 20 nt, Escherichia coli CFT073
caaacaucaugccggccagc

SEQ ID NO: 2630849 - RNA, 14 nt, Escherichia coli CFT073
caaacaucgacuca

SEQ ID NO: 2630850 - RNA, 23 nt, Escherichia coli CFT073
caaacaugacgcgcaucacgaca

SEQ ID NO: 2630851 - RNA, 22 nt, Escherichia coli CFT073
caaacauggcacugcgaucccg

SEQ ID NO: 2630852 - RNA, 16 nt, Escherichia coli CFT073
caaacauugcugccag

SEQ ID NO: 2630853 - RNA, 19 nt, Escherichia coli CFT073
caaacauugcugccagaaa

SEQ ID NO: 2630854 - RNA, 20 nt, Escherichia coli CFT073
caaaccaaaaccgcucgcgc

SEQ ID NO: 2630855 - RNA, 14 nt, Escherichia coli CFT073
caaaccaacaagca

SEQ ID NO: 2630856 - RNA, 14 nt, Escherichia coli CFT073
caaaccacugcgcc

SEQ ID NO: 2630857 - RNA, 14 nt, Escherichia coli CFT073
caaaccagacaaca

SEQ ID NO: 2630858 - RNA, 15 nt, Escherichia coli CFT073
caaaccagacaacag

SEQ ID NO: 2630859 - RNA, 18 nt, Escherichia coli CFT073
caaaccagcccgacugga

SEQ ID NO: 2630860 - RNA, 16 nt, Escherichia coli CFT073
caaaccagccgccaac

SEQ ID NO: 2630861 - RNA, 20 nt, Escherichia coli CFT073
caaaccagccgccaacucca

SEQ ID NO: 2630862 - RNA, 16 nt, Escherichia coli CFT073
caaaccagcuaauaaa

SEQ ID NO: 2630863 - RNA, 23 nt, Escherichia coli CFT073
caaaccagguaucguuacgccag

SEQ ID NO: 2630864 - RNA, 19 nt, Escherichia coli CFT073
caaaccauagaauacgcca

SEQ ID NO: 2630865 - RNA, 21 nt, Escherichia coli CFT073
caaaccauagaauacgccacg

SEQ ID NO: 2630866 - RNA, 22 nt, Escherichia coli CFT073
caaaccauagaauacgccacga

SEQ ID NO: 2630867 - RNA, 18 nt, Escherichia coli CFT073
caaaccaugauuccccag

SEQ ID NO: 2630868 - RNA, 18 nt, Escherichia coli CFT073
caaacccauuuucagccg

SEQ ID NO: 2630869 - RNA, 15 nt, Escherichia coli CFT073
caaaccgacugccug

SEQ ID NO: 2630870 - RNA, 17 nt, Escherichia coli CFT073
caaaccgacugccugca

SEQ ID NO: 2630871 - RNA, 16 nt, Escherichia coli CFT073
caaaccgcccagcagc

SEQ ID NO: 2630872 - RNA, 16 nt, Escherichia coli CFT073
caaaccggacgaucgg

SEQ ID NO: 2630873 - RNA, 20 nt, Escherichia coli CFT073
caaacgacacaugcugacua

SEQ ID NO: 2630874 - RNA, 21 nt, Escherichia coli CFT073
caaacgaccgcgggacaaaua

SEQ ID NO: 2630875 - RNA, 22 nt, Escherichia coli CFT073
caaacgaccgcgggacaaauaa

SEQ ID NO: 2630876 - RNA, 23 nt, Escherichia coli CFT073
caaacgagguagcgauagaaauc

SEQ ID NO: 2630877 - RNA, 15 nt, Escherichia coli CFT073
caaacgauaaaagug

SEQ ID NO: 2630878 - RNA, 19 nt, Escherichia coli CFT073
caaacgauuaucaacacau

SEQ ID NO: 2630879 - RNA, 13 nt, Escherichia coli CFT073
caaacgcaaaacu

SEQ ID NO: 2630880 - RNA, 17 nt, Escherichia coli CFT073
caaacgcccagaucacu

SEQ ID NO: 2630881 - RNA, 22 nt, Escherichia coli CFT073
caaacgccgcaugugccgggua

SEQ ID NO: 2630882 - RNA, 13 nt, Escherichia coli CFT073
caaacgccggaug

SEQ ID NO: 2630883 - RNA, 18 nt, Escherichia coli CFT073
caaacgcguuaagcccag

SEQ ID NO: 2630884 - RNA, 13 nt, Escherichia coli CFT073
caaacgcucccuu

SEQ ID NO: 2630885 - RNA, 19 nt, Escherichia coli CFT073
caaacgcugacauauuuuu

SEQ ID NO: 2630886 - RNA, 23 nt, Escherichia coli CFT073
caaacgcuuuacucaacuccccg

SEQ ID NO: 2630887 - RNA, 22 nt, Escherichia coli CFT073
caaacggaucgcguaaggcuuc

SEQ ID NO: 2630888 - RNA, 19 nt, Escherichia coli CFT073
caaacggcagcaugauaca

SEQ ID NO: 2630889 - RNA, 20 nt, Escherichia coli CFT073
caaacggugagacgccagaa

SEQ ID NO: 2630890 - RNA, 19 nt, Escherichia coli CFT073
caaacgguucgcggugcuc

SEQ ID NO: 2630891 - RNA, 16 nt, Escherichia coli CFT073
caaacguaaaugccag

SEQ ID NO: 2630892 - RNA, 18 nt, Escherichia coli CFT073
caaacgucagcugccagu

SEQ ID NO: 2630893 - RNA, 23 nt, Escherichia coli CFT073
caaacgucucuauuucacccacc

SEQ ID NO: 2630894 - RNA, 17 nt, Escherichia coli CFT073
caaacguggucgccagc

SEQ ID NO: 2630895 - RNA, 15 nt, Escherichia coli CFT073
caaacguucauacgc

SEQ ID NO: 2630896 - RNA, 17 nt, Escherichia coli CFT073
caaacuaucuguguaau

SEQ ID NO: 2630897 - RNA, 16 nt, Escherichia coli CFT073
caaacucacugccagc

SEQ ID NO: 2630898 - RNA, 15 nt, Escherichia coli CFT073
caaacucaucgccgc

SEQ ID NO: 2630899 - RNA, 22 nt, Escherichia coli CFT073
caaacuccgcgaccacacucaa

SEQ ID NO: 2630900 - RNA, 19 nt, Escherichia coli CFT073
caaacuccgugaagcucac

SEQ ID NO: 2630901 - RNA, 21 nt, Escherichia coli CFT073
caaacucuaccuggucaccga

SEQ ID NO: 2630902 - RNA, 15 nt, Escherichia coli CFT073
caaacugauauugug

SEQ ID NO: 2630903 - RNA, 19 nt, Escherichia coli CFT073
caaacugauuuagcaucag

SEQ ID NO: 2630904 - RNA, 22 nt, Escherichia coli CFT073
caaacugauuuagcaucagcgc

SEQ ID NO: 2630905 - RNA, 21 nt, Escherichia coli CFT073
caaacugccguuaacgacaaa

SEQ ID NO: 2630906 - RNA, 19 nt, Escherichia coli CFT073
caaacugcguagaguccag

SEQ ID NO: 2630907 - RNA, 18 nt, Escherichia coli CFT073
caaacugcgugugacaaa

SEQ ID NO: 2630908 - RNA, 21 nt, Escherichia coli CFT073
caaacugcucguucagcacuu

SEQ ID NO: 2630909 - RNA, 15 nt, Escherichia coli CFT073
caaacuggaauagcg

SEQ ID NO: 2630910 - RNA, 19 nt, Escherichia coli CFT073
caaacuggggcauuuuuuc

SEQ ID NO: 2630911 - RNA, 21 nt, Escherichia coli CFT073
caaacuggggcauuuuuucca

SEQ ID NO: 2630912 - RNA, 15 nt, Escherichia coli CFT073
caaacugguugaaau

SEQ ID NO: 2630913 - RNA, 18 nt, Escherichia coli CFT073
caaacugguugaaauaaa

SEQ ID NO: 2630914 - RNA, 23 nt, Escherichia coli CFT073
caaacugguugaaauaaaccagu

SEQ ID NO: 2630915 - RNA, 15 nt, Escherichia coli CFT073
caaacugugcaccgc

SEQ ID NO: 2630916 - RNA, 17 nt, Escherichia coli CFT073
caaacugugcaccgccc

SEQ ID NO: 2630917 - RNA, 18 nt, Escherichia coli CFT073
caaacugugcaccgcccu

SEQ ID NO: 2630918 - RNA, 12 nt, Escherichia coli CFT073
caaacuuaugca

SEQ ID NO: 2630919 - RNA, 15 nt, Escherichia coli CFT073
caaacuuccggcaag

SEQ ID NO: 2630920 - RNA, 22 nt, Escherichia coli CFT073
caaacuuccggcaagauuugca

SEQ ID NO: 2630921 - RNA, 19 nt, Escherichia coli CFT073
caaacuucucaccaucaaa

SEQ ID NO: 2630922 - RNA, 21 nt, Escherichia coli CFT073
caaacuugaacuuaucaucag

SEQ ID NO: 2630923 - RNA, 12 nt, Escherichia coli CFT073
caaacuugcgua

SEQ ID NO: 2630924 - RNA, 22 nt, Escherichia coli CFT073
caaacuugcguaucgaccagaa

SEQ ID NO: 2630925 - RNA, 23 nt, Escherichia coli CFT073
caaagaaaaacgggucgccagaa

SEQ ID NO: 2630926 - RNA, 20 nt, Escherichia coli CFT073
caaagaaacggaagccccag

SEQ ID NO: 2630927 - RNA, 18 nt, Escherichia coli CFT073
caaagaaaucaacaaauu

SEQ ID NO: 2630928 - RNA, 13 nt, Escherichia coli CFT073
caaagaacagccc

SEQ ID NO: 2630929 - RNA, 15 nt, Escherichia coli CFT073
caaagaauccgcccu

SEQ ID NO: 2630930 - RNA, 14 nt, Escherichia coli CFT073
caaagaaugccaua

SEQ ID NO: 2630931 - RNA, 20 nt, Escherichia coli CFT073
caaagacgcgguaaaagccc

SEQ ID NO: 2630932 - RNA, 24 nt, Escherichia coli CFT073
caaagagagaagccagguagauau

SEQ ID NO: 2630933 - RNA, 20 nt, Escherichia coli CFT073
caaagagcaagaaccccagc

SEQ ID NO: 2630934 - RNA, 13 nt, Escherichia coli CFT073
caaagauauuauu

SEQ ID NO: 2630935 - RNA, 21 nt, Escherichia coli CFT073
caaagauauucaguaccguag

SEQ ID NO: 2630936 - RNA, 23 nt, Escherichia coli CFT073
caaagcaaaggcgacaauaaaua

SEQ ID NO: 2630937 - RNA, 13 nt, Escherichia coli CFT073
caaagcaaauaau

SEQ ID NO: 2630938 - RNA, 14 nt, Escherichia coli CFT073
caaagcaaauaaug

SEQ ID NO: 2630939 - RNA, 15 nt, Escherichia coli CFT073
caaagcaaauaaugu

SEQ ID NO: 2630940 - RNA, 14 nt, Escherichia coli CFT073
caaagcagcaagaa

SEQ ID NO: 2630941 - RNA, 15 nt, Escherichia coli CFT073
caaagcaguauuucu

SEQ ID NO: 2630942 - RNA, 21 nt, Escherichia coli CFT073
caaagcagugaauacccagaa

SEQ ID NO: 2630943 - RNA, 20 nt, Escherichia coli CFT073
caaagcaucauaaccucugc

SEQ ID NO: 2630944 - RNA, 13 nt, Escherichia coli CFT073
caaagccaacagc

SEQ ID NO: 2630945 - RNA, 20 nt, Escherichia coli CFT073
caaagccacccacaccgcag

SEQ ID NO: 2630946 - RNA, 20 nt, Escherichia coli CFT073
caaagcccaucaccgccagg

SEQ ID NO: 2630947 - RNA, 15 nt, Escherichia coli CFT073
caaagcccgccgcca

SEQ ID NO: 2630948 - RNA, 17 nt, Escherichia coli CFT073
caaagcccgccgccaca

SEQ ID NO: 2630949 - RNA, 20 nt, Escherichia coli CFT073
caaagcccgggcacaucacc

SEQ ID NO: 2630950 - RNA, 14 nt, Escherichia coli CFT073
caaagccgccgagc

SEQ ID NO: 2630951 - RNA, 23 nt, Escherichia coli CFT073
caaagcgcacuuugcuggucugu

SEQ ID NO: 2630952 - RNA, 12 nt, Escherichia coli CFT073
caaagcgcauca

SEQ ID NO: 2630953 - RNA, 13 nt, Escherichia coli CFT073
caaagcgccagaa

SEQ ID NO: 2630954 - RNA, 12 nt, Escherichia coli CFT073
caaagcgcugaa

SEQ ID NO: 2630955 - RNA, 13 nt, Escherichia coli CFT073
caaagcgcugaau

SEQ ID NO: 2630956 - RNA, 23 nt, Escherichia coli CFT073
caaagcguucagugaucgccugc

SEQ ID NO: 2630957 - RNA, 21 nt, Escherichia coli CFT073
caaagcucauagcggcaacaa

SEQ ID NO: 2630958 - RNA, 16 nt, Escherichia coli CFT073
caaagcugucaccaau

SEQ ID NO: 2630959 - RNA, 18 nt, Escherichia coli CFT073
caaagcugucaccaauca

SEQ ID NO: 2630960 - RNA, 20 nt, Escherichia coli CFT073
caaaggacaucccggcagag

SEQ ID NO: 2630961 - RNA, 18 nt, Escherichia coli CFT073
caaaggcacaacugcgac

SEQ ID NO: 2630962 - RNA, 14 nt, Escherichia coli CFT073
caaaggccagccag

SEQ ID NO: 2630963 - RNA, 16 nt, Escherichia coli CFT073
caaagggagcagacug

SEQ ID NO: 2630964 - RNA, 18 nt, Escherichia coli CFT073
caaagggggcgacauuua

SEQ ID NO: 2630965 - RNA, 19 nt, Escherichia coli CFT073
caaagggggcgacauuuag

SEQ ID NO: 2630966 - RNA, 21 nt, Escherichia coli CFT073
caaaggugacguccagaaccg

SEQ ID NO: 2630967 - RNA, 19 nt, Escherichia coli CFT073
caaagguugcagcucccca

SEQ ID NO: 2630968 - RNA, 20 nt, Escherichia coli CFT073
caaaguaccaucguccagca

SEQ ID NO: 2630969 - RNA, 18 nt, Escherichia coli CFT073
caaaguagagcgaaacga

SEQ ID NO: 2630970 - RNA, 22 nt, Escherichia coli CFT073
caaaguaggccguacagcccag

SEQ ID NO: 2630971 - RNA, 21 nt, Escherichia coli CFT073
caaaguaguaaugaucacugg

SEQ ID NO: 2630972 - RNA, 18 nt, Escherichia coli CFT073
caaagucaauaaaaagcg

SEQ ID NO: 2630973 - RNA, 17 nt, Escherichia coli CFT073
caaagucaucaauugca

SEQ ID NO: 2630974 - RNA, 17 nt, Escherichia coli CFT073
caaagugggcgacaaag

SEQ ID NO: 2630975 - RNA, 19 nt, Escherichia coli CFT073
caaaguuccgggauauaaa

SEQ ID NO: 2630976 - RNA, 22 nt, Escherichia coli CFT073
caaaguuugcccgucugcugcu

SEQ ID NO: 2630977 - RNA, 13 nt, Escherichia coli CFT073
caaaguuuugugc

SEQ ID NO: 2630978 - RNA, 12 nt, Escherichia coli CFT073
caaauaaaacau

SEQ ID NO: 2630979 - RNA, 13 nt, Escherichia coli CFT073
caaauaaagaagu

SEQ ID NO: 2630980 - RNA, 20 nt, Escherichia coli CFT073
caaauaaauaaucucuuccg

SEQ ID NO: 2630981 - RNA, 18 nt, Escherichia coli CFT073
caaauaacguaaaaaccc

SEQ ID NO: 2630982 - RNA, 16 nt, Escherichia coli CFT073
caaauaaggaaaacug

SEQ ID NO: 2630983 - RNA, 20 nt, Escherichia coli CFT073
caaauaaggaaaacugggug

SEQ ID NO: 2630984 - RNA, 16 nt, Escherichia coli CFT073
caaauaaugacucaaa

SEQ ID NO: 2630985 - RNA, 14 nt, Escherichia coli CFT073
caaauaauucccca

SEQ ID NO: 2630986 - RNA, 17 nt, Escherichia coli CFT073
caaauaauuucuuauuu

SEQ ID NO: 2630987 - RNA, 22 nt, Escherichia coli CFT073
caaauacagcuuaaucaccagc

SEQ ID NO: 2630988 - RNA, 20 nt, Escherichia coli CFT073
caaauaccaccgugccgccg

SEQ ID NO: 2630989 - RNA, 18 nt, Escherichia coli CFT073
caaauaccuggagcagua

SEQ ID NO: 2630990 - RNA, 18 nt, Escherichia coli CFT073
caaauacugacuggcgag

SEQ ID NO: 2630991 - RNA, 20 nt, Escherichia coli CFT073
caaauagauaaaauauggcg

SEQ ID NO: 2630992 - RNA, 15 nt, Escherichia coli CFT073
caaauagaucgccag

SEQ ID NO: 2630993 - RNA, 17 nt, Escherichia coli CFT073
caaauagaucgccagaa

SEQ ID NO: 2630994 - RNA, 15 nt, Escherichia coli CFT073
caaauagccugccag

SEQ ID NO: 2630995 - RNA, 16 nt, Escherichia coli CFT073
caaauagccugccagu

SEQ ID NO: 2630996 - RNA, 17 nt, Escherichia coli CFT073
caaauagccugccagug

SEQ ID NO: 2630997 - RNA, 18 nt, Escherichia coli CFT073
caaauagcggaccaauac

SEQ ID NO: 2630998 - RNA, 13 nt, Escherichia coli CFT073
caaauaguaagaa

SEQ ID NO: 2630999 - RNA, 18 nt, Escherichia coli CFT073
caaauaguacacagacga

SEQ ID NO: 2631000 - RNA, 14 nt, Escherichia coli CFT073
caaauaucaacccg

SEQ ID NO: 2631001 - RNA, 17 nt, Escherichia coli CFT073
caaauauguugcuuuaa

SEQ ID NO: 2631002 - RNA, 14 nt, Escherichia coli CFT073
caaauauuucuuua

SEQ ID NO: 2631003 - RNA, 15 nt, Escherichia coli CFT073
caaaucaacaaccug

SEQ ID NO: 2631004 - RNA, 16 nt, Escherichia coli CFT073
caaaucaacuaaaauc

SEQ ID NO: 2631005 - RNA, 18 nt, Escherichia coli CFT073
caaaucaacuaaaaucaa

SEQ ID NO: 2631006 - RNA, 17 nt, Escherichia coli CFT073
caaaucaaugguguuau

SEQ ID NO: 2631007 - RNA, 17 nt, Escherichia coli CFT073
caaaucacagcaccuua

SEQ ID NO: 2631008 - RNA, 17 nt, Escherichia coli CFT073
caaaucaccaaacugcu

SEQ ID NO: 2631009 - RNA, 13 nt, Escherichia coli CFT073
caaaucacuauua

SEQ ID NO: 2631010 - RNA, 19 nt, Escherichia coli CFT073
caaaucacuauuaaagaaa

SEQ ID NO: 2631011 - RNA, 20 nt, Escherichia coli CFT073
caaaucacuauuaaagaaag

SEQ ID NO: 2631012 - RNA, 14 nt, Escherichia coli CFT073
caaaucagcggcag

SEQ ID NO: 2631013 - RNA, 22 nt, Escherichia coli CFT073
caaaucagcggcagauccacca

SEQ ID NO: 2631014 - RNA, 14 nt, Escherichia coli CFT073
caaaucauaaaaau

SEQ ID NO: 2631015 - RNA, 14 nt, Escherichia coli CFT073
caaaucaucaguac

SEQ ID NO: 2631016 - RNA, 19 nt, Escherichia coli CFT073
caaauccacguuccagauc

SEQ ID NO: 2631017 - RNA, 12 nt, Escherichia coli CFT073
caaauccagcac

SEQ ID NO: 2631018 - RNA, 15 nt, Escherichia coli CFT073
caaauccagccagcg

SEQ ID NO: 2631019 - RNA, 14 nt, Escherichia coli CFT073
caaauccauuuucg

SEQ ID NO: 2631020 - RNA, 20 nt, Escherichia coli CFT073
caaauccccacaggcgaugc

SEQ ID NO: 2631021 - RNA, 17 nt, Escherichia coli CFT073
caaauccccaguugugc

SEQ ID NO: 2631022 - RNA, 18 nt, Escherichia coli CFT073
caaauccuuccgccaguc

SEQ ID NO: 2631023 - RNA, 19 nt, Escherichia coli CFT073
caaauccuuccgccagucg

SEQ ID NO: 2631024 - RNA, 14 nt, Escherichia coli CFT073
caaaucgaaaucaa

SEQ ID NO: 2631025 - RNA, 20 nt, Escherichia coli CFT073
caaaucgacgccacuaucug

SEQ ID NO: 2631026 - RNA, 17 nt, Escherichia coli CFT073
caaaucgcccgucaguu

SEQ ID NO: 2631027 - RNA, 15 nt, Escherichia coli CFT073
caaaucgcggcagug

SEQ ID NO: 2631028 - RNA, 17 nt, Escherichia coli CFT073
caaaucgcucccucucc

SEQ ID NO: 2631029 - RNA, 23 nt, Escherichia coli CFT073
caaaucgucgguguccacuuccg

SEQ ID NO: 2631030 - RNA, 16 nt, Escherichia coli CFT073
caaaucgugacagcau

SEQ ID NO: 2631031 - RNA, 19 nt, Escherichia coli CFT073
caaaucgugacagcauacc

SEQ ID NO: 2631032 - RNA, 17 nt, Escherichia coli CFT073
caaaucgugcaucuccu

SEQ ID NO: 2631033 - RNA, 19 nt, Escherichia coli CFT073
caaaucucgugguucaaca

SEQ ID NO: 2631034 - RNA, 19 nt, Escherichia coli CFT073
caaaucugccguaacugcg

SEQ ID NO: 2631035 - RNA, 20 nt, Escherichia coli CFT073
caaaucugccguaacugcgc

SEQ ID NO: 2631036 - RNA, 12 nt, Escherichia coli CFT073
caaaucuuucac

SEQ ID NO: 2631037 - RNA, 21 nt, Escherichia coli CFT073
caaaugaaagcagcagcuguu

SEQ ID NO: 2631038 - RNA, 18 nt, Escherichia coli CFT073
caaaugaugcaccaccug

SEQ ID NO: 2631039 - RNA, 16 nt, Escherichia coli CFT073
caaaugcaacauuauc

SEQ ID NO: 2631040 - RNA, 13 nt, Escherichia coli CFT073
caaaugccggaug

SEQ ID NO: 2631041 - RNA, 15 nt, Escherichia coli CFT073
caaaugcgccgccaa

SEQ ID NO: 2631042 - RNA, 19 nt, Escherichia coli CFT073
caaaugcgccuauaaggcu

SEQ ID NO: 2631043 - RNA, 17 nt, Escherichia coli CFT073
caaauggaccaucuccg

SEQ ID NO: 2631044 - RNA, 15 nt, Escherichia coli CFT073
caaaugucaccagcc

SEQ ID NO: 2631045 - RNA, 17 nt, Escherichia coli CFT073
caaaugucaccagccgg

SEQ ID NO: 2631046 - RNA, 19 nt, Escherichia coli CFT073
caaaugucagaaagaaauu

SEQ ID NO: 2631047 - RNA, 15 nt, Escherichia coli CFT073
caaaugucggaugcg

SEQ ID NO: 2631048 - RNA, 22 nt, Escherichia coli CFT073
caaauguguucagcgacagauu

SEQ ID NO: 2631049 - RNA, 18 nt, Escherichia coli CFT073
caaauguugcaucgccug

SEQ ID NO: 2631050 - RNA, 16 nt, Escherichia coli CFT073
caaauuaaacgggcga

SEQ ID NO: 2631051 - RNA, 14 nt, Escherichia coli CFT073
caaauuauccccca

SEQ ID NO: 2631052 - RNA, 20 nt, Escherichia coli CFT073
caaauuaucccccagcacuu

SEQ ID NO: 2631053 - RNA, 16 nt, Escherichia coli CFT073
caaauuauuaauuaaa

SEQ ID NO: 2631054 - RNA, 23 nt, Escherichia coli CFT073
caaauuauuaauuaaacaaauaa

SEQ ID NO: 2631055 - RNA, 18 nt, Escherichia coli CFT073
caaauuauuaccaucggu

SEQ ID NO: 2631056 - RNA, 15 nt, Escherichia coli CFT073
caaauucaccgccug

SEQ ID NO: 2631057 - RNA, 19 nt, Escherichia coli CFT073
caaauucauugcguaacau

SEQ ID NO: 2631058 - RNA, 12 nt, Escherichia coli CFT073
caaauuccacac

SEQ ID NO: 2631059 - RNA, 16 nt, Escherichia coli CFT073
caaauugcugguauuu

SEQ ID NO: 2631060 - RNA, 19 nt, Escherichia coli CFT073
caaauuucuucagccacau

SEQ ID NO: 2631061 - RNA, 17 nt, Escherichia coli CFT073
caaauuugugcucuggc

SEQ ID NO: 2631062 - RNA, 18 nt, Escherichia coli CFT073
caaauuuuccccagaugc

SEQ ID NO: 2631063 - RNA, 18 nt, Escherichia coli CFT073
caaauuuugaacagaacu

SEQ ID NO: 2631064 - RNA, 15 nt, Escherichia coli CFT073
caacaaaccaaaacc

SEQ ID NO: 2631065 - RNA, 18 nt, Escherichia coli CFT073
caacaaaccaaaaccgcu

SEQ ID NO: 2631066 - RNA, 19 nt, Escherichia coli CFT073
caacaaacgcaaacaccag

SEQ ID NO: 2631067 - RNA, 12 nt, Escherichia coli CFT073
caacaaacucau

SEQ ID NO: 2631068 - RNA, 14 nt, Escherichia coli CFT073
caacaacaccagca

SEQ ID NO: 2631069 - RNA, 13 nt, Escherichia coli CFT073
caacaacccugca

SEQ ID NO: 2631070 - RNA, 22 nt, Escherichia coli CFT073
caacaaccuugcguuuuucauc

SEQ ID NO: 2631071 - RNA, 19 nt, Escherichia coli CFT073
caacaaccuuuguauuuuu

SEQ ID NO: 2631072 - RNA, 11 nt, Escherichia coli CFT073
caacaacgcaa

SEQ ID NO: 2631073 - RNA, 12 nt, Escherichia coli CFT073
caacaacugcgc

SEQ ID NO: 2631074 - RNA, 11 nt, Escherichia coli CFT073
caacaacuucu

SEQ ID NO: 2631075 - RNA, 18 nt, Escherichia coli CFT073
caacaagcagcuugagaa

SEQ ID NO: 2631076 - RNA, 14 nt, Escherichia coli CFT073
caacaagcccacgg

SEQ ID NO: 2631077 - RNA, 20 nt, Escherichia coli CFT073
caacaaguucgaaccaacaa

SEQ ID NO: 2631078 - RNA, 13 nt, Escherichia coli CFT073
caacaauaaaaag

SEQ ID NO: 2631079 - RNA, 15 nt, Escherichia coli CFT073
caacaauaaaaggug

SEQ ID NO: 2631080 - RNA, 22 nt, Escherichia coli CFT073
caacaauaaacugcgaccaggg

SEQ ID NO: 2631081 - RNA, 23 nt, Escherichia coli CFT073
caacaaugucuucacaaccgcca

SEQ ID NO: 2631082 - RNA, 23 nt, Escherichia coli CFT073
caacaauugcgggccaaagacca

SEQ ID NO: 2631083 - RNA, 22 nt, Escherichia coli CFT073
caacaauuucacgcgcuguaau

SEQ ID NO: 2631084 - RNA, 21 nt, Escherichia coli CFT073
caacaauuuucccuucccgca

SEQ ID NO: 2631085 - RNA, 13 nt, Escherichia coli CFT073
caacacauaaccg

SEQ ID NO: 2631086 - RNA, 19 nt, Escherichia coli CFT073
caacacauaaccguacaac

SEQ ID NO: 2631087 - RNA, 14 nt, Escherichia coli CFT073
caacacaugcacau

SEQ ID NO: 2631088 - RNA, 20 nt, Escherichia coli CFT073
caacacaugcacauccacgc

SEQ ID NO: 2631089 - RNA, 13 nt, Escherichia coli CFT073
caacacauuacuu

SEQ ID NO: 2631090 - RNA, 18 nt, Escherichia coli CFT073
caacaccacgcgguagcg

SEQ ID NO: 2631091 - RNA, 14 nt, Escherichia coli CFT073
caacaccagcaguc

SEQ ID NO: 2631092 - RNA, 18 nt, Escherichia coli CFT073
caacaccaucgaaauuag

SEQ ID NO: 2631093 - RNA, 16 nt, Escherichia coli CFT073
caacaccguguggcgu

SEQ ID NO: 2631094 - RNA, 16 nt, Escherichia coli CFT073
caacaccucagccagc

SEQ ID NO: 2631095 - RNA, 13 nt, Escherichia coli CFT073
caacacgccagcg

SEQ ID NO: 2631096 - RNA, 16 nt, Escherichia coli CFT073
caacacgccugcaagc

SEQ ID NO: 2631097 - RNA, 16 nt, Escherichia coli CFT073
caacacuacaccccag

SEQ ID NO: 2631098 - RNA, 17 nt, Escherichia coli CFT073
caacacucucugcagua

SEQ ID NO: 2631099 - RNA, 19 nt, Escherichia coli CFT073
caacacuucauuaucuucu

SEQ ID NO: 2631100 - RNA, 22 nt, Escherichia coli CFT073
caacacuucauuaucuucuuuc

SEQ ID NO: 2631101 - RNA, 15 nt, Escherichia coli CFT073
caacacuuccgcuuc

SEQ ID NO: 2631102 - RNA, 13 nt, Escherichia coli CFT073
caacacuucuuug

SEQ ID NO: 2631103 - RNA, 21 nt, Escherichia coli CFT073
caacacuuuaucugccauuaa

SEQ ID NO: 2631104 - RNA, 17 nt, Escherichia coli CFT073
caacacuuucacuacaa

SEQ ID NO: 2631105 - RNA, 16 nt, Escherichia coli CFT073
caacagaaacgccauc

SEQ ID NO: 2631106 - RNA, 16 nt, Escherichia coli CFT073
caacagagccaaagaa

SEQ ID NO: 2631107 - RNA, 15 nt, Escherichia coli CFT073
caacagauaaauggc

SEQ ID NO: 2631108 - RNA, 20 nt, Escherichia coli CFT073
caacagauuuugcaggccug

SEQ ID NO: 2631109 - RNA, 13 nt, Escherichia coli CFT073
caacagcgcgccc

SEQ ID NO: 2631110 - RNA, 22 nt, Escherichia coli CFT073
caacagcgcgcuaucggcagag

SEQ ID NO: 2631111 - RNA, 13 nt, Escherichia coli CFT073
caacagcggcauu

SEQ ID NO: 2631112 - RNA, 13 nt, Escherichia coli CFT073
caacagcggcgcg

SEQ ID NO: 2631113 - RNA, 19 nt, Escherichia coli CFT073
caacagcguuucuucgaca

SEQ ID NO: 2631114 - RNA, 17 nt, Escherichia coli CFT073
caacaggaacauguauu

SEQ ID NO: 2631115 - RNA, 22 nt, Escherichia coli CFT073
caacaggaacauguauuuguuu

SEQ ID NO: 2631116 - RNA, 15 nt, Escherichia coli CFT073
caacagguugcggac

SEQ ID NO: 2631117 - RNA, 15 nt, Escherichia coli CFT073
caacaguaauaaugc

SEQ ID NO: 2631118 - RNA, 16 nt, Escherichia coli CFT073
caacagugccgaugcc

SEQ ID NO: 2631119 - RNA, 14 nt, Escherichia coli CFT073
caacauaacgcauc

SEQ ID NO: 2631120 - RNA, 17 nt, Escherichia coli CFT073
caacauaaucaaccauu

SEQ ID NO: 2631121 - RNA, 23 nt, Escherichia coli CFT073
caacauaaucaaccauuaaacgu

SEQ ID NO: 2631122 - RNA, 22 nt, Escherichia coli CFT073
caacauaauccagccuucuaua

SEQ ID NO: 2631123 - RNA, 19 nt, Escherichia coli CFT073
caacauaaucggcgcggcg

SEQ ID NO: 2631124 - RNA, 18 nt, Escherichia coli CFT073
caacauaaugccgacauc

SEQ ID NO: 2631125 - RNA, 20 nt, Escherichia coli CFT073
caacauauaaguggagcccu

SEQ ID NO: 2631126 - RNA, 19 nt, Escherichia coli CFT073
caacauauaucgaaaaauc

SEQ ID NO: 2631127 - RNA, 15 nt, Escherichia coli CFT073
caacauauccagcgc

SEQ ID NO: 2631128 - RNA, 20 nt, Escherichia coli CFT073
caacauauuccgcaccugcc

SEQ ID NO: 2631129 - RNA, 23 nt, Escherichia coli CFT073
caacauauuccgcaccugccagc

SEQ ID NO: 2631130 - RNA, 17 nt, Escherichia coli CFT073
caacauauugcuccaua

SEQ ID NO: 2631131 - RNA, 12 nt, Escherichia coli CFT073
caacauauuucu

SEQ ID NO: 2631132 - RNA, 21 nt, Escherichia coli CFT073
caacaucaaaucacagcaccu

SEQ ID NO: 2631133 - RNA, 17 nt, Escherichia coli CFT073
caacaucacaccauauc

SEQ ID NO: 2631134 - RNA, 17 nt, Escherichia coli CFT073
caacaucacgcugacgc

SEQ ID NO: 2631135 - RNA, 14 nt, Escherichia coli CFT073
caacaucaucacgc

SEQ ID NO: 2631136 - RNA, 17 nt, Escherichia coli CFT073
caacaucgcauucggca

SEQ ID NO: 2631137 - RNA, 16 nt, Escherichia coli CFT073
caacaucguuagcggc

SEQ ID NO: 2631138 - RNA, 15 nt, Escherichia coli CFT073
caacaucucaauauc

SEQ ID NO: 2631139 - RNA, 14 nt, Escherichia coli CFT073
caacaucucuauua

SEQ ID NO: 2631140 - RNA, 13 nt, Escherichia coli CFT073
caacaucuucacc

SEQ ID NO: 2631141 - RNA, 16 nt, Escherichia coli CFT073
caacaugagaacaguu

SEQ ID NO: 2631142 - RNA, 20 nt, Escherichia coli CFT073
caacaugcggugauuuugcc

SEQ ID NO: 2631143 - RNA, 20 nt, Escherichia coli CFT073
caacaugcuauuacgccagc

SEQ ID NO: 2631144 - RNA, 22 nt, Escherichia coli CFT073
caacaugcuauuacgccagccu

SEQ ID NO: 2631145 - RNA, 21 nt, Escherichia coli CFT073
caacauggcgcggcacaccag

SEQ ID NO: 2631146 - RNA, 15 nt, Escherichia coli CFT073
caacauggucaucau

SEQ ID NO: 2631147 - RNA, 14 nt, Escherichia coli CFT073
caacauuaccgaau

SEQ ID NO: 2631148 - RNA, 14 nt, Escherichia coli CFT073
caacauuccggcgc

SEQ ID NO: 2631149 - RNA, 22 nt, Escherichia coli CFT073
caacauugcgccucaccggaua

SEQ ID NO: 2631150 - RNA, 15 nt, Escherichia coli CFT073
caacauuuccagcgc

SEQ ID NO: 2631151 - RNA, 12 nt, Escherichia coli CFT073
caaccaacgcgc

SEQ ID NO: 2631152 - RNA, 15 nt, Escherichia coli CFT073
caaccaacgcgccgc

SEQ ID NO: 2631153 - RNA, 19 nt, Escherichia coli CFT073
caaccaacgcgccgcaaca

SEQ ID NO: 2631154 - RNA, 13 nt, Escherichia coli CFT073
caaccaaugccgc

SEQ ID NO: 2631155 - RNA, 16 nt, Escherichia coli CFT073
caaccacaacgcacug

SEQ ID NO: 2631156 - RNA, 20 nt, Escherichia coli CFT073
caaccacacaggcaucguga

SEQ ID NO: 2631157 - RNA, 17 nt, Escherichia coli CFT073
caaccacacccacauca

SEQ ID NO: 2631158 - RNA, 12 nt, Escherichia coli CFT073
caaccacauuca

SEQ ID NO: 2631159 - RNA, 14 nt, Escherichia coli CFT073
caaccaccugaaga

SEQ ID NO: 2631160 - RNA, 17 nt, Escherichia coli CFT073
caaccaccugaagaaaa

SEQ ID NO: 2631161 - RNA, 15 nt, Escherichia coli CFT073
caaccacucaccgcu

SEQ ID NO: 2631162 - RNA, 21 nt, Escherichia coli CFT073
caaccacuucggcaucuuuua

SEQ ID NO: 2631163 - RNA, 18 nt, Escherichia coli CFT073
caaccacuuuacgcaaaa

SEQ ID NO: 2631164 - RNA, 13 nt, Escherichia coli CFT073
caaccagaaaguc

SEQ ID NO: 2631165 - RNA, 20 nt, Escherichia coli CFT073
caaccagagccggugccauu

SEQ ID NO: 2631166 - RNA, 19 nt, Escherichia coli CFT073
caaccagauuaccgccuuc

SEQ ID NO: 2631167 - RNA, 14 nt, Escherichia coli CFT073
caaccagcaaugcc

SEQ ID NO: 2631168 - RNA, 17 nt, Escherichia coli CFT073
caaccagcacaugcuuu

SEQ ID NO: 2631169 - RNA, 20 nt, Escherichia coli CFT073
caaccagcaccuuuuccagu

SEQ ID NO: 2631170 - RNA, 18 nt, Escherichia coli CFT073
caaccagcauaacguggc

SEQ ID NO: 2631171 - RNA, 21 nt, Escherichia coli CFT073
caaccagcgucgcaucaggcg

SEQ ID NO: 2631172 - RNA, 22 nt, Escherichia coli CFT073
caaccagcgucgcaucaggcgu

SEQ ID NO: 2631173 - RNA, 18 nt, Escherichia coli CFT073
caaccagugcaccagcuu

SEQ ID NO: 2631174 - RNA, 18 nt, Escherichia coli CFT073
caaccaguugagcggauu

SEQ ID NO: 2631175 - RNA, 22 nt, Escherichia coli CFT073
caaccauaucgcauaccaucca

SEQ ID NO: 2631176 - RNA, 17 nt, Escherichia coli CFT073
caaccaucaucccuaau

SEQ ID NO: 2631177 - RNA, 13 nt, Escherichia coli CFT073
caaccauccccaa

SEQ ID NO: 2631178 - RNA, 13 nt, Escherichia coli CFT073
caaccaucgccgu

SEQ ID NO: 2631179 - RNA, 20 nt, Escherichia coli CFT073
caaccaugccgcccagcagc

SEQ ID NO: 2631180 - RNA, 20 nt, Escherichia coli CFT073
caaccauggaacucuuucug

SEQ ID NO: 2631181 - RNA, 14 nt, Escherichia coli CFT073
caaccauucgcgca

SEQ ID NO: 2631182 - RNA, 17 nt, Escherichia coli CFT073
caacccaaacgguaucu

SEQ ID NO: 2631183 - RNA, 22 nt, Escherichia coli CFT073
caacccaaacgguaucuuucca

SEQ ID NO: 2631184 - RNA, 22 nt, Escherichia coli CFT073
caacccacaaaaacaccgcugu

SEQ ID NO: 2631185 - RNA, 16 nt, Escherichia coli CFT073
caacccagaaacaggc

SEQ ID NO: 2631186 - RNA, 14 nt, Escherichia coli CFT073
caacccagaagaaa

SEQ ID NO: 2631187 - RNA, 19 nt, Escherichia coli CFT073
caacccagcggaugaccca

SEQ ID NO: 2631188 - RNA, 16 nt, Escherichia coli CFT073
caacccauuucgucaa

SEQ ID NO: 2631189 - RNA, 12 nt, Escherichia coli CFT073
caacccgcgcgc

SEQ ID NO: 2631190 - RNA, 12 nt, Escherichia coli CFT073
caacccugcccu

SEQ ID NO: 2631191 - RNA, 15 nt, Escherichia coli CFT073
caacccugcccuuca

SEQ ID NO: 2631192 - RNA, 13 nt, Escherichia coli CFT073
caaccgacgacga

SEQ ID NO: 2631193 - RNA, 18 nt, Escherichia coli CFT073
caaccgagcgccccagac

SEQ ID NO: 2631194 - RNA, 20 nt, Escherichia coli CFT073
caaccgagcgccccagaccu

SEQ ID NO: 2631195 - RNA, 19 nt, Escherichia coli CFT073
caaccgcaacgacuacgcc

SEQ ID NO: 2631196 - RNA, 16 nt, Escherichia coli CFT073
caaccgccaacagcag

SEQ ID NO: 2631197 - RNA, 17 nt, Escherichia coli CFT073
caaccgccaguuccccc

SEQ ID NO: 2631198 - RNA, 11 nt, Escherichia coli CFT073
caaccgccauc

SEQ ID NO: 2631199 - RNA, 22 nt, Escherichia coli CFT073
caaccgccggaugcggcgugaa

SEQ ID NO: 2631200 - RNA, 16 nt, Escherichia coli CFT073
caaccgcgacauacuu

SEQ ID NO: 2631201 - RNA, 20 nt, Escherichia coli CFT073
caaccgcuuccggucugcga

SEQ ID NO: 2631202 - RNA, 18 nt, Escherichia coli CFT073
caaccggaaccagcgccu

SEQ ID NO: 2631203 - RNA, 18 nt, Escherichia coli CFT073
caaccggaaguccgagga

SEQ ID NO: 2631204 - RNA, 18 nt, Escherichia coli CFT073
caaccgggccgcagagau

SEQ ID NO: 2631205 - RNA, 17 nt, Escherichia coli CFT073
caaccgggccucgcagc

SEQ ID NO: 2631206 - RNA, 22 nt, Escherichia coli CFT073
caaccgggcuauuugaauuccu

SEQ ID NO: 2631207 - RNA, 16 nt, Escherichia coli CFT073
caaccggggcauucau

SEQ ID NO: 2631208 - RNA, 15 nt, Escherichia coli CFT073
caaccggugcugcgc

SEQ ID NO: 2631209 - RNA, 19 nt, Escherichia coli CFT073
caaccguaaacgaucaucg

SEQ ID NO: 2631210 - RNA, 23 nt, Escherichia coli CFT073
caaccgucgccucgccgagcagc

SEQ ID NO: 2631211 - RNA, 18 nt, Escherichia coli CFT073
caaccguucgggaaaaua

SEQ ID NO: 2631212 - RNA, 19 nt, Escherichia coli CFT073
caaccguucgggaaaauau

SEQ ID NO: 2631213 - RNA, 16 nt, Escherichia coli CFT073
caaccguuucuuuuuc

SEQ ID NO: 2631214 - RNA, 17 nt, Escherichia coli CFT073
caaccguuugauugaaa

SEQ ID NO: 2631215 - RNA, 21 nt, Escherichia coli CFT073
caaccuccuccggcaucuuua

SEQ ID NO: 2631216 - RNA, 17 nt, Escherichia coli CFT073
caaccucuggugugcgu

SEQ ID NO: 2631217 - RNA, 14 nt, Escherichia coli CFT073
caaccucuucuuuu

SEQ ID NO: 2631218 - RNA, 15 nt, Escherichia coli CFT073
caaccugaguaaauc

SEQ ID NO: 2631219 - RNA, 16 nt, Escherichia coli CFT073
caaccugaguaaauca

SEQ ID NO: 2631220 - RNA, 15 nt, Escherichia coli CFT073
caaccugaucgugcc

SEQ ID NO: 2631221 - RNA, 16 nt, Escherichia coli CFT073
caaccugaucgugcca

SEQ ID NO: 2631222 - RNA, 20 nt, Escherichia coli CFT073
caaccugcacguuaucagac

SEQ ID NO: 2631223 - RNA, 17 nt, Escherichia coli CFT073
caaccugcacugacagg

SEQ ID NO: 2631224 - RNA, 12 nt, Escherichia coli CFT073
caaccugccaga

SEQ ID NO: 2631225 - RNA, 16 nt, Escherichia coli CFT073
caaccugcgcuuuguu

SEQ ID NO: 2631226 - RNA, 15 nt, Escherichia coli CFT073
caaccuucgccagaa

SEQ ID NO: 2631227 - RNA, 21 nt, Escherichia coli CFT073
caaccuuuuccauugccgcag

SEQ ID NO: 2631228 - RNA, 16 nt, Escherichia coli CFT073
caacgaaccaaucacc

SEQ ID NO: 2631229 - RNA, 22 nt, Escherichia coli CFT073
caacgaaccaaucaccccgauc

SEQ ID NO: 2631230 - RNA, 17 nt, Escherichia coli CFT073
caacgaacuaaccgcac

SEQ ID NO: 2631231 - RNA, 15 nt, Escherichia coli CFT073
caacgaaucacuggu

SEQ ID NO: 2631232 - RNA, 21 nt, Escherichia coli CFT073
caacgaccgcgagcaaaaucg

SEQ ID NO: 2631233 - RNA, 15 nt, Escherichia coli CFT073
caacgacuacgccag

SEQ ID NO: 2631234 - RNA, 16 nt, Escherichia coli CFT073
caacgacuacgccaga

SEQ ID NO: 2631235 - RNA, 17 nt, Escherichia coli CFT073
caacgacuacgccagaa

SEQ ID NO: 2631236 - RNA, 14 nt, Escherichia coli CFT073
caacgauaauccag

SEQ ID NO: 2631237 - RNA, 15 nt, Escherichia coli CFT073
caacgauauccauau

SEQ ID NO: 2631238 - RNA, 18 nt, Escherichia coli CFT073
caacgaugcgaccgccgc

SEQ ID NO: 2631239 - RNA, 19 nt, Escherichia coli CFT073
caacgaugcgaccgccgcu

SEQ ID NO: 2631240 - RNA, 16 nt, Escherichia coli CFT073
caacgaugggugauca

SEQ ID NO: 2631241 - RNA, 15 nt, Escherichia coli CFT073
caacgcaacgcgcuu

SEQ ID NO: 2631242 - RNA, 17 nt, Escherichia coli CFT073
caacgcaauauccgcca

SEQ ID NO: 2631243 - RNA, 12 nt, Escherichia coli CFT073
caacgcaccaaa

SEQ ID NO: 2631244 - RNA, 18 nt, Escherichia coli CFT073
caacgcaucgcugcgcuu

SEQ ID NO: 2631245 - RNA, 14 nt, Escherichia coli CFT073
caacgcaucuuuuu

SEQ ID NO: 2631246 - RNA, 15 nt, Escherichia coli CFT073
caacgcaucuuuuuc

SEQ ID NO: 2631247 - RNA, 22 nt, Escherichia coli CFT073
caacgcauuuauuugacauuuu

SEQ ID NO: 2631248 - RNA, 15 nt, Escherichia coli CFT073
caacgccaccacuca

SEQ ID NO: 2631249 - RNA, 13 nt, Escherichia coli CFT073
caacgccaccauc

SEQ ID NO: 2631250 - RNA, 17 nt, Escherichia coli CFT073
caacgccaccaucacua

SEQ ID NO: 2631251 - RNA, 24 nt, Escherichia coli CFT073
caacgccagauaaauucgaccauu

SEQ ID NO: 2631252 - RNA, 16 nt, Escherichia coli CFT073
caacgccagcgaagcc

SEQ ID NO: 2631253 - RNA, 23 nt, Escherichia coli CFT073
caacgccagcgaagccagcuccc

SEQ ID NO: 2631254 - RNA, 20 nt, Escherichia coli CFT073
caacgcccauaaauacgucu

SEQ ID NO: 2631255 - RNA, 17 nt, Escherichia coli CFT073
caacgcccauacucauc

SEQ ID NO: 2631256 - RNA, 14 nt, Escherichia coli CFT073
caacgcccugcaac

SEQ ID NO: 2631257 - RNA, 21 nt, Escherichia coli CFT073
caacgccgauaagguaucgcg

SEQ ID NO: 2631258 - RNA, 12 nt, Escherichia coli CFT073
caacgccgccaa

SEQ ID NO: 2631259 - RNA, 23 nt, Escherichia coli CFT073
caacgccuaaacugaucgacagu

SEQ ID NO: 2631260 - RNA, 13 nt, Escherichia coli CFT073
caacgccugaugc

SEQ ID NO: 2631261 - RNA, 22 nt, Escherichia coli CFT073
caacgccugaugcgacgcuugc

SEQ ID NO: 2631262 - RNA, 17 nt, Escherichia coli CFT073
caacgccuuguucgccc

SEQ ID NO: 2631263 - RNA, 16 nt, Escherichia coli CFT073
caacgccuuucgcugu

SEQ ID NO: 2631264 - RNA, 12 nt, Escherichia coli CFT073
caacgcgccgac

SEQ ID NO: 2631265 - RNA, 13 nt, Escherichia coli CFT073
caacgcgguuucg

SEQ ID NO: 2631266 - RNA, 16 nt, Escherichia coli CFT073
caacgcgguuucgccg

SEQ ID NO: 2631267 - RNA, 17 nt, Escherichia coli CFT073
caacgcgguuucgccgc

SEQ ID NO: 2631268 - RNA, 15 nt, Escherichia coli CFT073
caacgcuagcagcag

SEQ ID NO: 2631269 - RNA, 17 nt, Escherichia coli CFT073
caacgcugaauggcgau

SEQ ID NO: 2631270 - RNA, 13 nt, Escherichia coli CFT073
caacgcugccaug

SEQ ID NO: 2631271 - RNA, 12 nt, Escherichia coli CFT073
caacgcuuaaua

SEQ ID NO: 2631272 - RNA, 21 nt, Escherichia coli CFT073
caacgcuucaaaccuucaucc

SEQ ID NO: 2631273 - RNA, 20 nt, Escherichia coli CFT073
caacggaaaagcaacaacca

SEQ ID NO: 2631274 - RNA, 15 nt, Escherichia coli CFT073
caacggaauaaacgc

SEQ ID NO: 2631275 - RNA, 22 nt, Escherichia coli CFT073
caacggaccaauaaacgccagg

SEQ ID NO: 2631276 - RNA, 15 nt, Escherichia coli CFT073
caacggcaaacacgc

SEQ ID NO: 2631277 - RNA, 17 nt, Escherichia coli CFT073
caacggcacggaaagca

SEQ ID NO: 2631278 - RNA, 16 nt, Escherichia coli CFT073
caacggcaucgccaac

SEQ ID NO: 2631279 - RNA, 16 nt, Escherichia coli CFT073
caacggccaaauaucc

SEQ ID NO: 2631280 - RNA, 15 nt, Escherichia coli CFT073
caacggcgucagcca

SEQ ID NO: 2631281 - RNA, 18 nt, Escherichia coli CFT073
caacggcgucagccacaa

SEQ ID NO: 2631282 - RNA, 20 nt, Escherichia coli CFT073
caacggcgucagccacaaca

SEQ ID NO: 2631283 - RNA, 16 nt, Escherichia coli CFT073
caacgggcaccgccgc

SEQ ID NO: 2631284 - RNA, 19 nt, Escherichia coli CFT073
caacgggcaccgccgccac

SEQ ID NO: 2631285 - RNA, 15 nt, Escherichia coli CFT073
caacggggccagcac

SEQ ID NO: 2631286 - RNA, 17 nt, Escherichia coli CFT073
caacggguaaggcgcga

SEQ ID NO: 2631287 - RNA, 22 nt, Escherichia coli CFT073
caacgguacgcguucaauaaua

SEQ ID NO: 2631288 - RNA, 17 nt, Escherichia coli CFT073
caacggucgauucgccg

SEQ ID NO: 2631289 - RNA, 20 nt, Escherichia coli CFT073
caacggugacuggcuuaaua

SEQ ID NO: 2631290 - RNA, 20 nt, Escherichia coli CFT073
caacggugcuuuaauuucau

SEQ ID NO: 2631291 - RNA, 16 nt, Escherichia coli CFT073
caacgguucugcugcc

SEQ ID NO: 2631292 - RNA, 19 nt, Escherichia coli CFT073
caacgguuuucaagacgcc

SEQ ID NO: 2631293 - RNA, 16 nt, Escherichia coli CFT073
caacguacaccgcagc

SEQ ID NO: 2631294 - RNA, 17 nt, Escherichia coli CFT073
caacguacucugccacu

SEQ ID NO: 2631295 - RNA, 13 nt, Escherichia coli CFT073
caacguagccugc

SEQ ID NO: 2631296 - RNA, 17 nt, Escherichia coli CFT073
caacguaggcacauucg

SEQ ID NO: 2631297 - RNA, 15 nt, Escherichia coli CFT073
caacguccucgucga

SEQ ID NO: 2631298 - RNA, 17 nt, Escherichia coli CFT073
caacgucguuuucgccg

SEQ ID NO: 2631299 - RNA, 20 nt, Escherichia coli CFT073
caacgugaccaguaccaccg

SEQ ID NO: 2631300 - RNA, 21 nt, Escherichia coli CFT073
caacgugaccaguaccaccgc

SEQ ID NO: 2631301 - RNA, 23 nt, Escherichia coli CFT073
caacgugcgauuuguucaugccc

SEQ ID NO: 2631302 - RNA, 17 nt, Escherichia coli CFT073
caacgugguuugcggca

SEQ ID NO: 2631303 - RNA, 16 nt, Escherichia coli CFT073
caacguuaccaagaaa

SEQ ID NO: 2631304 - RNA, 18 nt, Escherichia coli CFT073
caacguuaccaagaaaga

SEQ ID NO: 2631305 - RNA, 13 nt, Escherichia coli CFT073
caacguuccagca

SEQ ID NO: 2631306 - RNA, 17 nt, Escherichia coli CFT073
caacguucguacugccc

SEQ ID NO: 2631307 - RNA, 18 nt, Escherichia coli CFT073
caacguugccaguaccau

SEQ ID NO: 2631308 - RNA, 20 nt, Escherichia coli CFT073
caacguuuuaagcaaauaau

SEQ ID NO: 2631309 - RNA, 16 nt, Escherichia coli CFT073
caacguuuuucgcugu

SEQ ID NO: 2631310 - RNA, 18 nt, Escherichia coli CFT073
caacuaacugacuuucuu

SEQ ID NO: 2631311 - RNA, 24 nt, Escherichia coli CFT073
caacucacgauuguuaaucacauc

SEQ ID NO: 2631312 - RNA, 13 nt, Escherichia coli CFT073
caacucaggaaca

SEQ ID NO: 2631313 - RNA, 19 nt, Escherichia coli CFT073
caacucaggaacaucagca

SEQ ID NO: 2631314 - RNA, 18 nt, Escherichia coli CFT073
caacucauuccccggagc

SEQ ID NO: 2631315 - RNA, 14 nt, Escherichia coli CFT073
caacuccaccaaua

SEQ ID NO: 2631316 - RNA, 16 nt, Escherichia coli CFT073
caacuccagaauaccg

SEQ ID NO: 2631317 - RNA, 23 nt, Escherichia coli CFT073
caacuccagcuuaacauccccau

SEQ ID NO: 2631318 - RNA, 13 nt, Escherichia coli CFT073
caacuccgccagc

SEQ ID NO: 2631319 - RNA, 19 nt, Escherichia coli CFT073
caacuccgccagcaacuga

SEQ ID NO: 2631320 - RNA, 23 nt, Escherichia coli CFT073
caacuccggcgaaaaucccggca

SEQ ID NO: 2631321 - RNA, 14 nt, Escherichia coli CFT073
caacuccuguugca

SEQ ID NO: 2631322 - RNA, 15 nt, Escherichia coli CFT073
caacuccuguugcaa

SEQ ID NO: 2631323 - RNA, 18 nt, Escherichia coli CFT073
caacucuuuuaccaccgc

SEQ ID NO: 2631324 - RNA, 14 nt, Escherichia coli CFT073
caacugaaagaaca

SEQ ID NO: 2631325 - RNA, 18 nt, Escherichia coli CFT073
caacugaaagaacaccag

SEQ ID NO: 2631326 - RNA, 12 nt, Escherichia coli CFT073
caacugacugac

SEQ ID NO: 2631327 - RNA, 17 nt, Escherichia coli CFT073
caacugauacaccuuca

SEQ ID NO: 2631328 - RNA, 15 nt, Escherichia coli CFT073
caacugauauuuaaa

SEQ ID NO: 2631329 - RNA, 19 nt, Escherichia coli CFT073
caacugauuuucaucuucu

SEQ ID NO: 2631330 - RNA, 20 nt, Escherichia coli CFT073
caacugauuuucaucuucuu

SEQ ID NO: 2631331 - RNA, 23 nt, Escherichia coli CFT073
caacugcaaggccaucggcagcg

SEQ ID NO: 2631332 - RNA, 22 nt, Escherichia coli CFT073
caacugccaguaaagcagcgaa

SEQ ID NO: 2631333 - RNA, 23 nt, Escherichia coli CFT073
caacugcugcgguugaacgccaa

SEQ ID NO: 2631334 - RNA, 15 nt, Escherichia coli CFT073
caacugcuggacgau

SEQ ID NO: 2631335 - RNA, 20 nt, Escherichia coli CFT073
caacuggcaaucgacucuga

SEQ ID NO: 2631336 - RNA, 15 nt, Escherichia coli CFT073
caacuggcggcggcg

SEQ ID NO: 2631337 - RNA, 14 nt, Escherichia coli CFT073
caacuggcugccgu

SEQ ID NO: 2631338 - RNA, 19 nt, Escherichia coli CFT073
caacuggguuaacgucaua

SEQ ID NO: 2631339 - RNA, 22 nt, Escherichia coli CFT073
caacuguaacgcagaagguuau

SEQ ID NO: 2631340 - RNA, 22 nt, Escherichia coli CFT073
caacugugaauccugcauacca

SEQ ID NO: 2631341 - RNA, 17 nt, Escherichia coli CFT073
caacugugccgcgacca

SEQ ID NO: 2631342 - RNA, 11 nt, Escherichia coli CFT073
caacugugcgg

SEQ ID NO: 2631343 - RNA, 23 nt, Escherichia coli CFT073
caacuguggaauaugcgccacuc

SEQ ID NO: 2631344 - RNA, 18 nt, Escherichia coli CFT073
caacuuaagucuccauuu

SEQ ID NO: 2631345 - RNA, 12 nt, Escherichia coli CFT073
caacuucgcuua

SEQ ID NO: 2631346 - RNA, 21 nt, Escherichia coli CFT073
caacuucuaauuuuuccagca

SEQ ID NO: 2631347 - RNA, 22 nt, Escherichia coli CFT073
caacuucuuuaguugagcuuuu

SEQ ID NO: 2631348 - RNA, 16 nt, Escherichia coli CFT073
caacuugaaguaugac

SEQ ID NO: 2631349 - RNA, 16 nt, Escherichia coli CFT073
caacuugcucaagcca

SEQ ID NO: 2631350 - RNA, 17 nt, Escherichia coli CFT073
caacuuggagacgccgu

SEQ ID NO: 2631351 - RNA, 13 nt, Escherichia coli CFT073
caacuuuaaaauc

SEQ ID NO: 2631352 - RNA, 17 nt, Escherichia coli CFT073
caacuuuacuaaaaagu

SEQ ID NO: 2631353 - RNA, 23 nt, Escherichia coli CFT073
caacuuuacuaaaaagugauaaa

SEQ ID NO: 2631354 - RNA, 21 nt, Escherichia coli CFT073
caacuuuccgcacuuucuccg

SEQ ID NO: 2631355 - RNA, 18 nt, Escherichia coli CFT073
caacuuuguauucaguuc

SEQ ID NO: 2631356 - RNA, 17 nt, Escherichia coli CFT073
caacuuuucccagcgcg

SEQ ID NO: 2631357 - RNA, 18 nt, Escherichia coli CFT073
caacuuuugcaggaagcu

SEQ ID NO: 2631358 - RNA, 19 nt, Escherichia coli CFT073
caagaaaaauacugcugca

SEQ ID NO: 2631359 - RNA, 16 nt, Escherichia coli CFT073
caagaaaacuauuacu

SEQ ID NO: 2631360 - RNA, 22 nt, Escherichia coli CFT073
caagaaaacugguuauaugaau

SEQ ID NO: 2631361 - RNA, 22 nt, Escherichia coli CFT073
caagaaacaccagaaugcccca

SEQ ID NO: 2631362 - RNA, 19 nt, Escherichia coli CFT073
caagaaacgcuccaccacc

SEQ ID NO: 2631363 - RNA, 14 nt, Escherichia coli CFT073
caagaaaugcaugu

SEQ ID NO: 2631364 - RNA, 21 nt, Escherichia coli CFT073
caagaaaugcauguucaguca

SEQ ID NO: 2631365 - RNA, 21 nt, Escherichia coli CFT073
caagaaccaugcaaucacugc

SEQ ID NO: 2631366 - RNA, 18 nt, Escherichia coli CFT073
caagaaccccagccaggu

SEQ ID NO: 2631367 - RNA, 21 nt, Escherichia coli CFT073
caagaagaacgccgguugcga

SEQ ID NO: 2631368 - RNA, 19 nt, Escherichia coli CFT073
caagaaggauauaaaaaua

SEQ ID NO: 2631369 - RNA, 17 nt, Escherichia coli CFT073
caagaauaguuuccagu

SEQ ID NO: 2631370 - RNA, 22 nt, Escherichia coli CFT073
caagaaucgagcaauaaacacu

SEQ ID NO: 2631371 - RNA, 14 nt, Escherichia coli CFT073
caagaaucgucgcc

SEQ ID NO: 2631372 - RNA, 15 nt, Escherichia coli CFT073
caagaauuaaaauau

SEQ ID NO: 2631373 - RNA, 20 nt, Escherichia coli CFT073
caagaccaacacccacagcc

SEQ ID NO: 2631374 - RNA, 22 nt, Escherichia coli CFT073
caagaccaacacccacagccau

SEQ ID NO: 2631375 - RNA, 18 nt, Escherichia coli CFT073
caagaccaauccgccagc

SEQ ID NO: 2631376 - RNA, 14 nt, Escherichia coli CFT073
caagaccgcgacca

SEQ ID NO: 2631377 - RNA, 16 nt, Escherichia coli CFT073
caagacgaaaaaugaa

SEQ ID NO: 2631378 - RNA, 17 nt, Escherichia coli CFT073
caagacgaaaaaugaau

SEQ ID NO: 2631379 - RNA, 20 nt, Escherichia coli CFT073
caagacgaauaccuucuucc

SEQ ID NO: 2631380 - RNA, 22 nt, Escherichia coli CFT073
caagacgcauaauccaggcauc

SEQ ID NO: 2631381 - RNA, 19 nt, Escherichia coli CFT073
caagacuauuaauauauau

SEQ ID NO: 2631382 - RNA, 21 nt, Escherichia coli CFT073
caagacuauuaauauauauua

SEQ ID NO: 2631383 - RNA, 22 nt, Escherichia coli CFT073
caagacugaguuuuauucuuuu

SEQ ID NO: 2631384 - RNA, 15 nt, Escherichia coli CFT073
caagagcaaauaaaa

SEQ ID NO: 2631385 - RNA, 23 nt, Escherichia coli CFT073
caagaggguuauuuguucagcaa

SEQ ID NO: 2631386 - RNA, 18 nt, Escherichia coli CFT073
caagaguaaacaucuucu

SEQ ID NO: 2631387 - RNA, 14 nt, Escherichia coli CFT073
caagaguuuuaaaa

SEQ ID NO: 2631388 - RNA, 15 nt, Escherichia coli CFT073
caagauaaaucgcac

SEQ ID NO: 2631389 - RNA, 20 nt, Escherichia coli CFT073
caagauaacgccuggcagug

SEQ ID NO: 2631390 - RNA, 17 nt, Escherichia coli CFT073
caagauacgcaucgcgc

SEQ ID NO: 2631391 - RNA, 17 nt, Escherichia coli CFT073
caagauacggaacugcg

SEQ ID NO: 2631392 - RNA, 13 nt, Escherichia coli CFT073
caagauagaacca

SEQ ID NO: 2631393 - RNA, 20 nt, Escherichia coli CFT073
caagauauuccgucuccgga

SEQ ID NO: 2631394 - RNA, 14 nt, Escherichia coli CFT073
caagaucauacuga

SEQ ID NO: 2631395 - RNA, 17 nt, Escherichia coli CFT073
caagaucgcgaugaguc

SEQ ID NO: 2631396 - RNA, 18 nt, Escherichia coli CFT073
caagauggggaauaagcu

SEQ ID NO: 2631397 - RNA, 19 nt, Escherichia coli CFT073
caagauggggaauaagcug

SEQ ID NO: 2631398 - RNA, 14 nt, Escherichia coli CFT073
caagauuaaaauau

SEQ ID NO: 2631399 - RNA, 15 nt, Escherichia coli CFT073
caagauuaaaauaua

SEQ ID NO: 2631400 - RNA, 16 nt, Escherichia coli CFT073
caagauuaaaauauaa

SEQ ID NO: 2631401 - RNA, 17 nt, Escherichia coli CFT073
caagauuagccaucauu

SEQ ID NO: 2631402 - RNA, 15 nt, Escherichia coli CFT073
caagcaaauuaauua

SEQ ID NO: 2631403 - RNA, 16 nt, Escherichia coli CFT073
caagcaagagugguua

SEQ ID NO: 2631404 - RNA, 16 nt, Escherichia coli CFT073
caagcacagccgcauu

SEQ ID NO: 2631405 - RNA, 16 nt, Escherichia coli CFT073
caagcaccaacucgcc

SEQ ID NO: 2631406 - RNA, 16 nt, Escherichia coli CFT073
caagcaccauaaacac

SEQ ID NO: 2631407 - RNA, 17 nt, Escherichia coli CFT073
caagcacccguggcuau

SEQ ID NO: 2631408 - RNA, 16 nt, Escherichia coli CFT073
caagcaccuaaaucca

SEQ ID NO: 2631409 - RNA, 11 nt, Escherichia coli CFT073
caagcacuugc

SEQ ID NO: 2631410 - RNA, 12 nt, Escherichia coli CFT073
caagcagagaga

SEQ ID NO: 2631411 - RNA, 22 nt, Escherichia coli CFT073
caagcagcugccagacccggca

SEQ ID NO: 2631412 - RNA, 15 nt, Escherichia coli CFT073
caagcauaacaaaau

SEQ ID NO: 2631413 - RNA, 23 nt, Escherichia coli CFT073
caagcauauggauaugaucugca

SEQ ID NO: 2631414 - RNA, 21 nt, Escherichia coli CFT073
caagcaucauuuuguggguuu

SEQ ID NO: 2631415 - RNA, 18 nt, Escherichia coli CFT073
caagcaucggcauaccca

SEQ ID NO: 2631416 - RNA, 20 nt, Escherichia coli CFT073
caagcauuacgaaaucggca

SEQ ID NO: 2631417 - RNA, 15 nt, Escherichia coli CFT073
caagcauuauuuuug

SEQ ID NO: 2631418 - RNA, 16 nt, Escherichia coli CFT073
caagccaaauccagca

SEQ ID NO: 2631419 - RNA, 15 nt, Escherichia coli CFT073
caagccaaucugcug

SEQ ID NO: 2631420 - RNA, 19 nt, Escherichia coli CFT073
caagccaaucugcuggaaa

SEQ ID NO: 2631421 - RNA, 22 nt, Escherichia coli CFT073
caagccacuuccuuuagaagca

SEQ ID NO: 2631422 - RNA, 15 nt, Escherichia coli CFT073
caagccagguaaauc

SEQ ID NO: 2631423 - RNA, 13 nt, Escherichia coli CFT073
caagcccgccaga

SEQ ID NO: 2631424 - RNA, 14 nt, Escherichia coli CFT073
caagcccgccagac

SEQ ID NO: 2631425 - RNA, 20 nt, Escherichia coli CFT073
caagcccgccagaccagcua

SEQ ID NO: 2631426 - RNA, 20 nt, Escherichia coli CFT073
caagcccugguaacugccag

SEQ ID NO: 2631427 - RNA, 23 nt, Escherichia coli CFT073
caagccgaauaacggcucaaacu

SEQ ID NO: 2631428 - RNA, 20 nt, Escherichia coli CFT073
caagccgcuaacagcagcag

SEQ ID NO: 2631429 - RNA, 17 nt, Escherichia coli CFT073
caagccuugcagccaga

SEQ ID NO: 2631430 - RNA, 22 nt, Escherichia coli CFT073
caagcgaacccgcaguccugca

SEQ ID NO: 2631431 - RNA, 13 nt, Escherichia coli CFT073
caagcgccgccag

SEQ ID NO: 2631432 - RNA, 12 nt, Escherichia coli CFT073
caagcgccgccu

SEQ ID NO: 2631433 - RNA, 19 nt, Escherichia coli CFT073
caagcggcccggagacgcc

SEQ ID NO: 2631434 - RNA, 14 nt, Escherichia coli CFT073
caagcggcgcaugc

SEQ ID NO: 2631435 - RNA, 19 nt, Escherichia coli CFT073
caagcggcgcaugcaggca

SEQ ID NO: 2631436 - RNA, 15 nt, Escherichia coli CFT073
caagcgggaauagcu

SEQ ID NO: 2631437 - RNA, 18 nt, Escherichia coli CFT073
caagcggggggaucagac

SEQ ID NO: 2631438 - RNA, 15 nt, Escherichia coli CFT073
caagcgucauauccg

SEQ ID NO: 2631439 - RNA, 20 nt, Escherichia coli CFT073
caagcguuucaucuucaguc

SEQ ID NO: 2631440 - RNA, 13 nt, Escherichia coli CFT073
caagcuaaaccaa

SEQ ID NO: 2631441 - RNA, 17 nt, Escherichia coli CFT073
caagcuaaaccaauaaa

SEQ ID NO: 2631442 - RNA, 15 nt, Escherichia coli CFT073
caagcucgcagagau

SEQ ID NO: 2631443 - RNA, 15 nt, Escherichia coli CFT073
caagcucucuucauc

SEQ ID NO: 2631444 - RNA, 20 nt, Escherichia coli CFT073
caagcugaacgcaggccgcc

SEQ ID NO: 2631445 - RNA, 17 nt, Escherichia coli CFT073
caagcugcaucuggcga

SEQ ID NO: 2631446 - RNA, 17 nt, Escherichia coli CFT073
caagcuggcgcuggcga

SEQ ID NO: 2631447 - RNA, 18 nt, Escherichia coli CFT073
caagcuuacugagcagau

SEQ ID NO: 2631448 - RNA, 15 nt, Escherichia coli CFT073
caaggaacugugcau

SEQ ID NO: 2631449 - RNA, 19 nt, Escherichia coli CFT073
caaggaagcuuucgcagua

SEQ ID NO: 2631450 - RNA, 13 nt, Escherichia coli CFT073
caaggagagccag

SEQ ID NO: 2631451 - RNA, 14 nt, Escherichia coli CFT073
caaggagagccagu

SEQ ID NO: 2631452 - RNA, 15 nt, Escherichia coli CFT073
caaggauaucgucga

SEQ ID NO: 2631453 - RNA, 18 nt, Escherichia coli CFT073
caaggaugcguuuuucgg

SEQ ID NO: 2631454 - RNA, 15 nt, Escherichia coli CFT073
caaggcacaaagucg

SEQ ID NO: 2631455 - RNA, 13 nt, Escherichia coli CFT073
caaggccaauacc

SEQ ID NO: 2631456 - RNA, 23 nt, Escherichia coli CFT073
caaggcgcgacaucucuucuucg

SEQ ID NO: 2631457 - RNA, 20 nt, Escherichia coli CFT073
caaggcgcggguuucgacau

SEQ ID NO: 2631458 - RNA, 18 nt, Escherichia coli CFT073
caaggcgcucgcgccgca

SEQ ID NO: 2631459 - RNA, 15 nt, Escherichia coli CFT073
caaggcuacgccaca

SEQ ID NO: 2631460 - RNA, 23 nt, Escherichia coli CFT073
caaggcuauccucuaaaccccaa

SEQ ID NO: 2631461 - RNA, 11 nt, Escherichia coli CFT073
caaggcugaug

SEQ ID NO: 2631462 - RNA, 15 nt, Escherichia coli CFT073
caaggcugucgcaaa

SEQ ID NO: 2631463 - RNA, 18 nt, Escherichia coli CFT073
caaggcuucuauggaagu

SEQ ID NO: 2631464 - RNA, 16 nt, Escherichia coli CFT073
caagggguuuucagga

SEQ ID NO: 2631465 - RNA, 15 nt, Escherichia coli CFT073
caaggguugccggau

SEQ ID NO: 2631466 - RNA, 18 nt, Escherichia coli CFT073
caagguagugcuucuaaa

SEQ ID NO: 2631467 - RNA, 23 nt, Escherichia coli CFT073
caaggucaugaugcuccgccagc

SEQ ID NO: 2631468 - RNA, 17 nt, Escherichia coli CFT073
caaggucuuuaccuuuu

SEQ ID NO: 2631469 - RNA, 16 nt, Escherichia coli CFT073
caaggugcgaaaaaaa

SEQ ID NO: 2631470 - RNA, 22 nt, Escherichia coli CFT073
caaguaaaacagccuuguauua

SEQ ID NO: 2631471 - RNA, 13 nt, Escherichia coli CFT073
caaguaauaaagc

SEQ ID NO: 2631472 - RNA, 19 nt, Escherichia coli CFT073
caaguaaucaaucaccucu

SEQ ID NO: 2631473 - RNA, 14 nt, Escherichia coli CFT073
caaguacuuuugca

SEQ ID NO: 2631474 - RNA, 12 nt, Escherichia coli CFT073
caagucagcaac

SEQ ID NO: 2631475 - RNA, 22 nt, Escherichia coli CFT073
caagucagcaacgaugggugau

SEQ ID NO: 2631476 - RNA, 22 nt, Escherichia coli CFT073
caagucagcgcgaaaucgcccu

SEQ ID NO: 2631477 - RNA, 14 nt, Escherichia coli CFT073
caaguccagcaccg

SEQ ID NO: 2631478 - RNA, 15 nt, Escherichia coli CFT073
caaguccagcaccgu

SEQ ID NO: 2631479 - RNA, 16 nt, Escherichia coli CFT073
caaguccccacccggg

SEQ ID NO: 2631480 - RNA, 16 nt, Escherichia coli CFT073
caaguccugccagaaa

SEQ ID NO: 2631481 - RNA, 21 nt, Escherichia coli CFT073
caagucucaagagugaacacg

SEQ ID NO: 2631482 - RNA, 18 nt, Escherichia coli CFT073
caagucuggcaggaaaua

SEQ ID NO: 2631483 - RNA, 15 nt, Escherichia coli CFT073
caagugagucggcuu

SEQ ID NO: 2631484 - RNA, 21 nt, Escherichia coli CFT073
caagugcacuuugucagcaaa

SEQ ID NO: 2631485 - RNA, 18 nt, Escherichia coli CFT073
caaguguggccgccagug

SEQ ID NO: 2631486 - RNA, 22 nt, Escherichia coli CFT073
caaguuagaguagccaauacca

SEQ ID NO: 2631487 - RNA, 17 nt, Escherichia coli CFT073
caaguucgaacgccgcc

SEQ ID NO: 2631488 - RNA, 21 nt, Escherichia coli CFT073
caaguucgaacgccgccagua

SEQ ID NO: 2631489 - RNA, 19 nt, Escherichia coli CFT073
caaguucuucgaagcacuc

SEQ ID NO: 2631490 - RNA, 17 nt, Escherichia coli CFT073
caaguucuuuuguuuug

SEQ ID NO: 2631491 - RNA, 19 nt, Escherichia coli CFT073
caaguuguaauuccugaag

SEQ ID NO: 2631492 - RNA, 13 nt, Escherichia coli CFT073
caaguuucaauau

SEQ ID NO: 2631493 - RNA, 21 nt, Escherichia coli CFT073
caauaaaaaaucccgccgaug

SEQ ID NO: 2631494 - RNA, 23 nt, Escherichia coli CFT073
caauaaaacguugcccgcugcgc

SEQ ID NO: 2631495 - RNA, 13 nt, Escherichia coli CFT073
caauaaaauaucu

SEQ ID NO: 2631496 - RNA, 16 nt, Escherichia coli CFT073
caauaaaauaucuucu

SEQ ID NO: 2631497 - RNA, 19 nt, Escherichia coli CFT073
caauaaaauaucuucuacu

SEQ ID NO: 2631498 - RNA, 11 nt, Escherichia coli CFT073
caauaaacauc

SEQ ID NO: 2631499 - RNA, 23 nt, Escherichia coli CFT073
caauaaacgccgucgccuucaua

SEQ ID NO: 2631500 - RNA, 12 nt, Escherichia coli CFT073
caauaaacgccu

SEQ ID NO: 2631501 - RNA, 19 nt, Escherichia coli CFT073
caauaaagccgcccauucc

SEQ ID NO: 2631502 - RNA, 20 nt, Escherichia coli CFT073
caauaaagccgguauucaca

SEQ ID NO: 2631503 - RNA, 17 nt, Escherichia coli CFT073
caauaacaauuaucugg

SEQ ID NO: 2631504 - RNA, 18 nt, Escherichia coli CFT073
caauaacagaauuauccc

SEQ ID NO: 2631505 - RNA, 17 nt, Escherichia coli CFT073
caauaacaucggcuguu

SEQ ID NO: 2631506 - RNA, 18 nt, Escherichia coli CFT073
caauaaccaucagcuccg

SEQ ID NO: 2631507 - RNA, 15 nt, Escherichia coli CFT073
caauaacccccugcc

SEQ ID NO: 2631508 - RNA, 17 nt, Escherichia coli CFT073
caauaaccggcacuuca

SEQ ID NO: 2631509 - RNA, 16 nt, Escherichia coli CFT073
caauaaccgucagcgc

SEQ ID NO: 2631510 - RNA, 19 nt, Escherichia coli CFT073
caauaagcacucuggcgaa

SEQ ID NO: 2631511 - RNA, 17 nt, Escherichia coli CFT073
caauaagccaguccaga

SEQ ID NO: 2631512 - RNA, 14 nt, Escherichia coli CFT073
caauaagcuuaguc

SEQ ID NO: 2631513 - RNA, 19 nt, Escherichia coli CFT073
caauaaguaagcauuauau

SEQ ID NO: 2631514 - RNA, 19 nt, Escherichia coli CFT073
caauaauaauccgcugcac

SEQ ID NO: 2631515 - RNA, 21 nt, Escherichia coli CFT073
caauaauauuaaucccugcuu

SEQ ID NO: 2631516 - RNA, 23 nt, Escherichia coli CFT073
caauaauauuaaucccugcuucg

SEQ ID NO: 2631517 - RNA, 20 nt, Escherichia coli CFT073
caauaaucagcccaaccacg

SEQ ID NO: 2631518 - RNA, 15 nt, Escherichia coli CFT073
caauaaucaucucuc

SEQ ID NO: 2631519 - RNA, 16 nt, Escherichia coli CFT073
caauaaucauucgccc

SEQ ID NO: 2631520 - RNA, 17 nt, Escherichia coli CFT073
caauaaucguuccuuua

SEQ ID NO: 2631521 - RNA, 23 nt, Escherichia coli CFT073
caauaaucucuuuacccagcgga

SEQ ID NO: 2631522 - RNA, 22 nt, Escherichia coli CFT073
caauaaucugcccggcauuaau

SEQ ID NO: 2631523 - RNA, 17 nt, Escherichia coli CFT073
caauaaucuuuacacca

SEQ ID NO: 2631524 - RNA, 21 nt, Escherichia coli CFT073
caauaaucuuuacaccaacgc

SEQ ID NO: 2631525 - RNA, 22 nt, Escherichia coli CFT073
caauaaugcccgcaccaccgag

SEQ ID NO: 2631526 - RNA, 16 nt, Escherichia coli CFT073
caauaauggaaccuaa

SEQ ID NO: 2631527 - RNA, 14 nt, Escherichia coli CFT073
caauaauuucaaca

SEQ ID NO: 2631528 - RNA, 13 nt, Escherichia coli CFT073
caauacaaaauag

SEQ ID NO: 2631529 - RNA, 22 nt, Escherichia coli CFT073
caauacagccagccagcaccag

SEQ ID NO: 2631530 - RNA, 19 nt, Escherichia coli CFT073
caauacagcgaauagugga

SEQ ID NO: 2631531 - RNA, 12 nt, Escherichia coli CFT073
caauacauagaa

SEQ ID NO: 2631532 - RNA, 13 nt, Escherichia coli CFT073
caauacauagaag

SEQ ID NO: 2631533 - RNA, 17 nt, Escherichia coli CFT073
caauacaucaauuuucc

SEQ ID NO: 2631534 - RNA, 23 nt, Escherichia coli CFT073
caauaccacccuugcccaccagc

SEQ ID NO: 2631535 - RNA, 22 nt, Escherichia coli CFT073
caauaccagcuguuuugguaaa

SEQ ID NO: 2631536 - RNA, 18 nt, Escherichia coli CFT073
caauacccugacccagac

SEQ ID NO: 2631537 - RNA, 16 nt, Escherichia coli CFT073
caauaccgaucaguac

SEQ ID NO: 2631538 - RNA, 20 nt, Escherichia coli CFT073
caauaccgccugcaaauaaa

SEQ ID NO: 2631539 - RNA, 12 nt, Escherichia coli CFT073
caauaccgucug

SEQ ID NO: 2631540 - RNA, 22 nt, Escherichia coli CFT073
caauaccuucugcgcccgcccg

SEQ ID NO: 2631541 - RNA, 23 nt, Escherichia coli CFT073
caauaccuucugcgcccgcccgc

SEQ ID NO: 2631542 - RNA, 14 nt, Escherichia coli CFT073
caauacgauuaacg

SEQ ID NO: 2631543 - RNA, 15 nt, Escherichia coli CFT073
caauacguuucauau

SEQ ID NO: 2631544 - RNA, 15 nt, Escherichia coli CFT073
caauacugaucauca

SEQ ID NO: 2631545 - RNA, 18 nt, Escherichia coli CFT073
caauacuggcaaaaucaa

SEQ ID NO: 2631546 - RNA, 21 nt, Escherichia coli CFT073
caauacuggcaaaaucaaaaa

SEQ ID NO: 2631547 - RNA, 16 nt, Escherichia coli CFT073
caauacuuaaccccag

SEQ ID NO: 2631548 - RNA, 14 nt, Escherichia coli CFT073
caauacuucaacau

SEQ ID NO: 2631549 - RNA, 18 nt, Escherichia coli CFT073
caauacuugcgaaucauu

SEQ ID NO: 2631550 - RNA, 18 nt, Escherichia coli CFT073
caauagcgccugcugcug

SEQ ID NO: 2631551 - RNA, 16 nt, Escherichia coli CFT073
caauagucaguauuuu

SEQ ID NO: 2631552 - RNA, 15 nt, Escherichia coli CFT073
caauaguguugccgc

SEQ ID NO: 2631553 - RNA, 21 nt, Escherichia coli CFT073
caauaguuacgaaaaggauaa

SEQ ID NO: 2631554 - RNA, 12 nt, Escherichia coli CFT073
caauauaaacag

SEQ ID NO: 2631555 - RNA, 20 nt, Escherichia coli CFT073
caauauacaaauagaucgcc

SEQ ID NO: 2631556 - RNA, 20 nt, Escherichia coli CFT073
caauauagcgcguugcgcca

SEQ ID NO: 2631557 - RNA, 18 nt, Escherichia coli CFT073
caauauauugaauuugca

SEQ ID NO: 2631558 - RNA, 11 nt, Escherichia coli CFT073
caauauauuug

SEQ ID NO: 2631559 - RNA, 15 nt, Escherichia coli CFT073
caauaucaaagcguu

SEQ ID NO: 2631560 - RNA, 17 nt, Escherichia coli CFT073
caauaucaaagcguuuc

SEQ ID NO: 2631561 - RNA, 17 nt, Escherichia coli CFT073
caauaucauuacgccag

SEQ ID NO: 2631562 - RNA, 19 nt, Escherichia coli CFT073
caauauccagcagguuuug

SEQ ID NO: 2631563 - RNA, 19 nt, Escherichia coli CFT073
caauauccauuaaaacuga

SEQ ID NO: 2631564 - RNA, 19 nt, Escherichia coli CFT073
caauauccgguucacuuca

SEQ ID NO: 2631565 - RNA, 17 nt, Escherichia coli CFT073
caauaucgacgccaguu

SEQ ID NO: 2631566 - RNA, 15 nt, Escherichia coli CFT073
caauaucgcugugug

SEQ ID NO: 2631567 - RNA, 15 nt, Escherichia coli CFT073
caauaucguuaucgc

SEQ ID NO: 2631568 - RNA, 16 nt, Escherichia coli CFT073
caauaucuaaaauguc

SEQ ID NO: 2631569 - RNA, 17 nt, Escherichia coli CFT073
caauaugaauccaggcc

SEQ ID NO: 2631570 - RNA, 17 nt, Escherichia coli CFT073
caauaugaauuaccccu

SEQ ID NO: 2631571 - RNA, 17 nt, Escherichia coli CFT073
caauauguuuccgcgaa

SEQ ID NO: 2631572 - RNA, 18 nt, Escherichia coli CFT073
caauauuccagucagcac

SEQ ID NO: 2631573 - RNA, 23 nt, Escherichia coli CFT073
caauauuccagucagcaccagac

SEQ ID NO: 2631574 - RNA, 16 nt, Escherichia coli CFT073
caauauuggguuguug

SEQ ID NO: 2631575 - RNA, 13 nt, Escherichia coli CFT073
caaucaaacuucc

SEQ ID NO: 2631576 - RNA, 17 nt, Escherichia coli CFT073
caaucaaaugacugguu

SEQ ID NO: 2631577 - RNA, 16 nt, Escherichia coli CFT073
caaucaaauuugccag

SEQ ID NO: 2631578 - RNA, 16 nt, Escherichia coli CFT073
caaucaacgccaccau

SEQ ID NO: 2631579 - RNA, 19 nt, Escherichia coli CFT073
caaucaacgccaccaucac

SEQ ID NO: 2631580 - RNA, 21 nt, Escherichia coli CFT073
caaucaacgccaccaucacua

SEQ ID NO: 2631581 - RNA, 13 nt, Escherichia coli CFT073
caaucaauaacag

SEQ ID NO: 2631582 - RNA, 17 nt, Escherichia coli CFT073
caaucacaaaaccgucg

SEQ ID NO: 2631583 - RNA, 20 nt, Escherichia coli CFT073
caaucacaacacgaauacca

SEQ ID NO: 2631584 - RNA, 14 nt, Escherichia coli CFT073
caaucacacugacu

SEQ ID NO: 2631585 - RNA, 14 nt, Escherichia coli CFT073
caaucacauccacc

SEQ ID NO: 2631586 - RNA, 22 nt, Escherichia coli CFT073
caaucaccaaaccaacaagcac

SEQ ID NO: 2631587 - RNA, 12 nt, Escherichia coli CFT073
caaucaccacca

SEQ ID NO: 2631588 - RNA, 13 nt, Escherichia coli CFT073
caaucaccgcuuc

SEQ ID NO: 2631589 - RNA, 23 nt, Escherichia coli CFT073
caaucaccgggccgaugcggcug

SEQ ID NO: 2631590 - RNA, 20 nt, Escherichia coli CFT073
caaucaccucuuuaccgguc

SEQ ID NO: 2631591 - RNA, 14 nt, Escherichia coli CFT073
caaucacgcccgcc

SEQ ID NO: 2631592 - RNA, 20 nt, Escherichia coli CFT073
caaucacuacuacaucugca

SEQ ID NO: 2631593 - RNA, 17 nt, Escherichia coli CFT073
caaucacugccaccagg

SEQ ID NO: 2631594 - RNA, 20 nt, Escherichia coli CFT073
caaucacuuucugcgccagc

SEQ ID NO: 2631595 - RNA, 22 nt, Escherichia coli CFT073
caaucacuuuuuaccguaacag

SEQ ID NO: 2631596 - RNA, 12 nt, Escherichia coli CFT073
caaucagaugug

SEQ ID NO: 2631597 - RNA, 20 nt, Escherichia coli CFT073
caaucagcacacauaacagc

SEQ ID NO: 2631598 - RNA, 14 nt, Escherichia coli CFT073
caaucagcaccgcg

SEQ ID NO: 2631599 - RNA, 18 nt, Escherichia coli CFT073
caaucagcaguaucauug

SEQ ID NO: 2631600 - RNA, 12 nt, Escherichia coli CFT073
caaucagccaga

SEQ ID NO: 2631601 - RNA, 22 nt, Escherichia coli CFT073
caaucagccccuucgccagugc

SEQ ID NO: 2631602 - RNA, 18 nt, Escherichia coli CFT073
caaucagcccugcccaga

SEQ ID NO: 2631603 - RNA, 20 nt, Escherichia coli CFT073
caaucagccgagcuucaaua

SEQ ID NO: 2631604 - RNA, 21 nt, Escherichia coli CFT073
caaucagcgcagcacccagaa

SEQ ID NO: 2631605 - RNA, 23 nt, Escherichia coli CFT073
caaucagcggaaaugcagaggca

SEQ ID NO: 2631606 - RNA, 17 nt, Escherichia coli CFT073
caaucagcggcucaugu

SEQ ID NO: 2631607 - RNA, 20 nt, Escherichia coli CFT073
caaucagcggugccgcgaua

SEQ ID NO: 2631608 - RNA, 15 nt, Escherichia coli CFT073
caaucagcgucgcgu

SEQ ID NO: 2631609 - RNA, 14 nt, Escherichia coli CFT073
caaucaggcuaucg

SEQ ID NO: 2631610 - RNA, 15 nt, Escherichia coli CFT073
caaucaguaaucgcg

SEQ ID NO: 2631611 - RNA, 17 nt, Escherichia coli CFT073
caaucaguaaucgcgcc

SEQ ID NO: 2631612 - RNA, 13 nt, Escherichia coli CFT073
caaucauaaacgc

SEQ ID NO: 2631613 - RNA, 18 nt, Escherichia coli CFT073
caaucauaaacgccugac

SEQ ID NO: 2631614 - RNA, 12 nt, Escherichia coli CFT073
caaucaucaucg

SEQ ID NO: 2631615 - RNA, 14 nt, Escherichia coli CFT073
caaucaugcgcaua

SEQ ID NO: 2631616 - RNA, 16 nt, Escherichia coli CFT073
caaucauuuuuucccc

SEQ ID NO: 2631617 - RNA, 15 nt, Escherichia coli CFT073
caauccagcuaacca

SEQ ID NO: 2631618 - RNA, 20 nt, Escherichia coli CFT073
caauccaguacaugaagcac

SEQ ID NO: 2631619 - RNA, 13 nt, Escherichia coli CFT073
caauccaguccac

SEQ ID NO: 2631620 - RNA, 20 nt, Escherichia coli CFT073
caaucccguugaaaaugcug

SEQ ID NO: 2631621 - RNA, 23 nt, Escherichia coli CFT073
caaucccguugaaaaugcugguu

SEQ ID NO: 2631622 - RNA, 23 nt, Escherichia coli CFT073
caaucccguugccacucaggcaa

SEQ ID NO: 2631623 - RNA, 18 nt, Escherichia coli CFT073
caaucccuuaguaacgcc

SEQ ID NO: 2631624 - RNA, 23 nt, Escherichia coli CFT073
caauccgccagccaauugccaua

SEQ ID NO: 2631625 - RNA, 16 nt, Escherichia coli CFT073
caauccgccaggacau

SEQ ID NO: 2631626 - RNA, 18 nt, Escherichia coli CFT073
caauccgccaggacauca

SEQ ID NO: 2631627 - RNA, 15 nt, Escherichia coli CFT073
caauccggaaaccaa

SEQ ID NO: 2631628 - RNA, 18 nt, Escherichia coli CFT073
caaucgaaauacgacuga

SEQ ID NO: 2631629 - RNA, 14 nt, Escherichia coli CFT073
caaucgaccaggcc

SEQ ID NO: 2631630 - RNA, 18 nt, Escherichia coli CFT073
caaucgacucugaaugcc

SEQ ID NO: 2631631 - RNA, 21 nt, Escherichia coli CFT073
caaucgaucuguuuaucgcgc

SEQ ID NO: 2631632 - RNA, 13 nt, Escherichia coli CFT073
caaucgauuugaa

SEQ ID NO: 2631633 - RNA, 15 nt, Escherichia coli CFT073
caaucgcacccgcca

SEQ ID NO: 2631634 - RNA, 20 nt, Escherichia coli CFT073
caaucgcacgauagcuaacu

SEQ ID NO: 2631635 - RNA, 18 nt, Escherichia coli CFT073
caaucgcagcgcaagcug

SEQ ID NO: 2631636 - RNA, 19 nt, Escherichia coli CFT073
caaucgcauauuucaacga

SEQ ID NO: 2631637 - RNA, 12 nt, Escherichia coli CFT073
caaucgccagac

SEQ ID NO: 2631638 - RNA, 12 nt, Escherichia coli CFT073
caaucgccagag

SEQ ID NO: 2631639 - RNA, 12 nt, Escherichia coli CFT073
caaucgccagau

SEQ ID NO: 2631640 - RNA, 14 nt, Escherichia coli CFT073
caaucgccccacuu

SEQ ID NO: 2631641 - RNA, 21 nt, Escherichia coli CFT073
caaucgcccccaucaccggca

SEQ ID NO: 2631642 - RNA, 22 nt, Escherichia coli CFT073
caaucgccgccaguuccaggca

SEQ ID NO: 2631643 - RNA, 14 nt, Escherichia coli CFT073
caaucgcgccagaa

SEQ ID NO: 2631644 - RNA, 14 nt, Escherichia coli CFT073
caaucgcggcagcg

SEQ ID NO: 2631645 - RNA, 19 nt, Escherichia coli CFT073
caaucgcggugguuaccag

SEQ ID NO: 2631646 - RNA, 21 nt, Escherichia coli CFT073
caaucgcucacaacaauauca

SEQ ID NO: 2631647 - RNA, 13 nt, Escherichia coli CFT073
caaucgcucccag

SEQ ID NO: 2631648 - RNA, 16 nt, Escherichia coli CFT073
caaucgcucccagccc

SEQ ID NO: 2631649 - RNA, 15 nt, Escherichia coli CFT073
caaucgcuucaucgc

SEQ ID NO: 2631650 - RNA, 14 nt, Escherichia coli CFT073
caaucgcuuucugu

SEQ ID NO: 2631651 - RNA, 19 nt, Escherichia coli CFT073
caaucggaucgauaucgau

SEQ ID NO: 2631652 - RNA, 15 nt, Escherichia coli CFT073
caaucggcccgccca

SEQ ID NO: 2631653 - RNA, 17 nt, Escherichia coli CFT073
caaucggcguaccgcac

SEQ ID NO: 2631654 - RNA, 18 nt, Escherichia coli CFT073
caaucggcguaccgcaca

SEQ ID NO: 2631655 - RNA, 15 nt, Escherichia coli CFT073
caaucgggaaaaucu

SEQ ID NO: 2631656 - RNA, 15 nt, Escherichia coli CFT073
caaucgggcaguaug

SEQ ID NO: 2631657 - RNA, 16 nt, Escherichia coli CFT073
caaucgguaacgcuug

SEQ ID NO: 2631658 - RNA, 21 nt, Escherichia coli CFT073
caaucguaugaucauccgccu

SEQ ID NO: 2631659 - RNA, 22 nt, Escherichia coli CFT073
caaucgucagcucgcugccauc

SEQ ID NO: 2631660 - RNA, 14 nt, Escherichia coli CFT073
caaucuacaaaaga

SEQ ID NO: 2631661 - RNA, 18 nt, Escherichia coli CFT073
caaucuacaaaagauuau

SEQ ID NO: 2631662 - RNA, 12 nt, Escherichia coli CFT073
caaucucagcga

SEQ ID NO: 2631663 - RNA, 22 nt, Escherichia coli CFT073
caaucuccuucggugcucccug

SEQ ID NO: 2631664 - RNA, 17 nt, Escherichia coli CFT073
caaucucugacauaaaa

SEQ ID NO: 2631665 - RNA, 12 nt, Escherichia coli CFT073
caaucucugcaa

SEQ ID NO: 2631666 - RNA, 15 nt, Escherichia coli CFT073
caaucucuucaagcu

SEQ ID NO: 2631667 - RNA, 14 nt, Escherichia coli CFT073
caaucucuucacag

SEQ ID NO: 2631668 - RNA, 15 nt, Escherichia coli CFT073
caaucucuucaccug

SEQ ID NO: 2631669 - RNA, 17 nt, Escherichia coli CFT073
caaucucuucaccugcc

SEQ ID NO: 2631670 - RNA, 15 nt, Escherichia coli CFT073
caaucucuuccagcg

SEQ ID NO: 2631671 - RNA, 23 nt, Escherichia coli CFT073
caaucucuuccagcgucuccaga

SEQ ID NO: 2631672 - RNA, 22 nt, Escherichia coli CFT073
caaucugauagaacugcggcag

SEQ ID NO: 2631673 - RNA, 15 nt, Escherichia coli CFT073
caaucugaugacuga

SEQ ID NO: 2631674 - RNA, 21 nt, Escherichia coli CFT073
caaucugaugacugauaucca

SEQ ID NO: 2631675 - RNA, 13 nt, Escherichia coli CFT073
caaucugauuccg

SEQ ID NO: 2631676 - RNA, 14 nt, Escherichia coli CFT073
caaucugcaaaaua

SEQ ID NO: 2631677 - RNA, 14 nt, Escherichia coli CFT073
caaucugcccgacc

SEQ ID NO: 2631678 - RNA, 13 nt, Escherichia coli CFT073
caaucugcuucuu

SEQ ID NO: 2631679 - RNA, 20 nt, Escherichia coli CFT073
caaucugcuucuuaccaccu

SEQ ID NO: 2631680 - RNA, 23 nt, Escherichia coli CFT073
caaucuguccuuccaguaaccag

SEQ ID NO: 2631681 - RNA, 21 nt, Escherichia coli CFT073
caaucuguuuauuugacagcc

SEQ ID NO: 2631682 - RNA, 19 nt, Escherichia coli CFT073
caaucuuaggggacauuua

SEQ ID NO: 2631683 - RNA, 23 nt, Escherichia coli CFT073
caaucuuguucucagcacauuga

SEQ ID NO: 2631684 - RNA, 18 nt, Escherichia coli CFT073
caaucuuuacacacaagc

SEQ ID NO: 2631685 - RNA, 13 nt, Escherichia coli CFT073
caaucuuuccugc

SEQ ID NO: 2631686 - RNA, 20 nt, Escherichia coli CFT073
caaugaaacgcaaauacuga

SEQ ID NO: 2631687 - RNA, 21 nt, Escherichia coli CFT073
caaugaaugcuucgcucucuu

SEQ ID NO: 2631688 - RNA, 13 nt, Escherichia coli CFT073
caaugaauuaaaa

SEQ ID NO: 2631689 - RNA, 21 nt, Escherichia coli CFT073
caaugacagccccaccagcaa

SEQ ID NO: 2631690 - RNA, 18 nt, Escherichia coli CFT073
caaugacaguaucaccaa

SEQ ID NO: 2631691 - RNA, 19 nt, Escherichia coli CFT073
caaugacaguaucaccaac

SEQ ID NO: 2631692 - RNA, 12 nt, Escherichia coli CFT073
caaugacauaca

SEQ ID NO: 2631693 - RNA, 17 nt, Escherichia coli CFT073
caaugaccaccaaauaa

SEQ ID NO: 2631694 - RNA, 20 nt, Escherichia coli CFT073
caaugaccgcgccauccaua

SEQ ID NO: 2631695 - RNA, 22 nt, Escherichia coli CFT073
caaugacgucuuccaccggcug

SEQ ID NO: 2631696 - RNA, 20 nt, Escherichia coli CFT073
caaugacuauuugcgccgca

SEQ ID NO: 2631697 - RNA, 18 nt, Escherichia coli CFT073
caaugagcugaacgucgc

SEQ ID NO: 2631698 - RNA, 21 nt, Escherichia coli CFT073
caaugaguucgcgcgcugcca

SEQ ID NO: 2631699 - RNA, 11 nt, Escherichia coli CFT073
caaugauaaag

SEQ ID NO: 2631700 - RNA, 12 nt, Escherichia coli CFT073
caaugauaacgu

SEQ ID NO: 2631701 - RNA, 15 nt, Escherichia coli CFT073
caaugauaacgucgg

SEQ ID NO: 2631702 - RNA, 18 nt, Escherichia coli CFT073
caaugauaacgucggcau

SEQ ID NO: 2631703 - RNA, 13 nt, Escherichia coli CFT073
caaugauaagacu

SEQ ID NO: 2631704 - RNA, 19 nt, Escherichia coli CFT073
caaugauaucgcuggcagg

SEQ ID NO: 2631705 - RNA, 16 nt, Escherichia coli CFT073
caaugcaauauuuuga

SEQ ID NO: 2631706 - RNA, 23 nt, Escherichia coli CFT073
caaugcaaucaaauggcuggcgu

SEQ ID NO: 2631707 - RNA, 23 nt, Escherichia coli CFT073
caaugcacacaaaauugccgcua

SEQ ID NO: 2631708 - RNA, 15 nt, Escherichia coli CFT073
caaugcagguaccug

SEQ ID NO: 2631709 - RNA, 13 nt, Escherichia coli CFT073
caaugcauaucau

SEQ ID NO: 2631710 - RNA, 21 nt, Escherichia coli CFT073
caaugccaggcuccagauaac

SEQ ID NO: 2631711 - RNA, 15 nt, Escherichia coli CFT073
caaugccauccagcu

SEQ ID NO: 2631712 - RNA, 22 nt, Escherichia coli CFT073
caaugccauucacaaaaacagu

SEQ ID NO: 2631713 - RNA, 15 nt, Escherichia coli CFT073
caaugcccaaaaugg

SEQ ID NO: 2631714 - RNA, 21 nt, Escherichia coli CFT073
caaugcccaaaauggcgugaa

SEQ ID NO: 2631715 - RNA, 14 nt, Escherichia coli CFT073
caaugcccacugca

SEQ ID NO: 2631716 - RNA, 18 nt, Escherichia coli CFT073
caaugccgccaauaauga

SEQ ID NO: 2631717 - RNA, 14 nt, Escherichia coli CFT073
caaugccgcgcugu

SEQ ID NO: 2631718 - RNA, 17 nt, Escherichia coli CFT073
caaugccguaauccugc

SEQ ID NO: 2631719 - RNA, 16 nt, Escherichia coli CFT073
caaugccgucaccagc

SEQ ID NO: 2631720 - RNA, 19 nt, Escherichia coli CFT073
caaugccgucaccagcauc

SEQ ID NO: 2631721 - RNA, 23 nt, Escherichia coli CFT073
caaugccgucaccagcaucaaca

SEQ ID NO: 2631722 - RNA, 19 nt, Escherichia coli CFT073
caaugccugagacagacag

SEQ ID NO: 2631723 - RNA, 15 nt, Escherichia coli CFT073
caaugccugaugcga

SEQ ID NO: 2631724 - RNA, 12 nt, Escherichia coli CFT073
caaugcgccaac

SEQ ID NO: 2631725 - RNA, 19 nt, Escherichia coli CFT073
caaugcgcgccccugaugg

SEQ ID NO: 2631726 - RNA, 17 nt, Escherichia coli CFT073
caaugcggccuccggca

SEQ ID NO: 2631727 - RNA, 19 nt, Escherichia coli CFT073
caaugcgggacauauugau

SEQ ID NO: 2631728 - RNA, 22 nt, Escherichia coli CFT073
caaugcguagcugggcaacaaa

SEQ ID NO: 2631729 - RNA, 16 nt, Escherichia coli CFT073
caaugcguuguagcuu

SEQ ID NO: 2631730 - RNA, 22 nt, Escherichia coli CFT073
caaugcguuguagcuuuuuccu

SEQ ID NO: 2631731 - RNA, 14 nt, Escherichia coli CFT073
caaugcucacccgc

SEQ ID NO: 2631732 - RNA, 19 nt, Escherichia coli CFT073
caaugcuuuuugcauuucc

SEQ ID NO: 2631733 - RNA, 14 nt, Escherichia coli CFT073
caauggaccagaac

SEQ ID NO: 2631734 - RNA, 23 nt, Escherichia coli CFT073
caauggacgauuaucaaaggucu

SEQ ID NO: 2631735 - RNA, 19 nt, Escherichia coli CFT073
caauggagcacauugccug

SEQ ID NO: 2631736 - RNA, 21 nt, Escherichia coli CFT073
caauggagcuaaacagagcug

SEQ ID NO: 2631737 - RNA, 18 nt, Escherichia coli CFT073
caauggauaucggucauu

SEQ ID NO: 2631738 - RNA, 20 nt, Escherichia coli CFT073
caauggcaggaucugguguu

SEQ ID NO: 2631739 - RNA, 14 nt, Escherichia coli CFT073
caauggcauauucc

SEQ ID NO: 2631740 - RNA, 19 nt, Escherichia coli CFT073
caauggcauauuccgccac

SEQ ID NO: 2631741 - RNA, 20 nt, Escherichia coli CFT073
caauggccucuggugcaauu

SEQ ID NO: 2631742 - RNA, 23 nt, Escherichia coli CFT073
caauggcuccgggugugacaaca

SEQ ID NO: 2631743 - RNA, 15 nt, Escherichia coli CFT073
caauggcugccgcca

SEQ ID NO: 2631744 - RNA, 19 nt, Escherichia coli CFT073
caaugggcuuaaugagaua

SEQ ID NO: 2631745 - RNA, 21 nt, Escherichia coli CFT073
caaugggcuuaaugagauaau

SEQ ID NO: 2631746 - RNA, 23 nt, Escherichia coli CFT073
caauggucagcgccaggcuuucc

SEQ ID NO: 2631747 - RNA, 17 nt, Escherichia coli CFT073
caauggucccuugcugg

SEQ ID NO: 2631748 - RNA, 16 nt, Escherichia coli CFT073
caauggucgugguaau

SEQ ID NO: 2631749 - RNA, 20 nt, Escherichia coli CFT073
caauggugguggucugguaa

SEQ ID NO: 2631750 - RNA, 17 nt, Escherichia coli CFT073
caaugguguccaaaugc

SEQ ID NO: 2631751 - RNA, 23 nt, Escherichia coli CFT073
caaugguguuauaggccccagcc

SEQ ID NO: 2631752 - RNA, 13 nt, Escherichia coli CFT073
caaugguuucccu

SEQ ID NO: 2631753 - RNA, 17 nt, Escherichia coli CFT073
caauguaccagucaaua

SEQ ID NO: 2631754 - RNA, 18 nt, Escherichia coli CFT073
caauguacggaauaagua

SEQ ID NO: 2631755 - RNA, 18 nt, Escherichia coli CFT073
caauguaucuuucaucau

SEQ ID NO: 2631756 - RNA, 19 nt, Escherichia coli CFT073
caauguaucuuucaucauu

SEQ ID NO: 2631757 - RNA, 15 nt, Escherichia coli CFT073
caaugucaagugaau

SEQ ID NO: 2631758 - RNA, 15 nt, Escherichia coli CFT073
caaugucauaaaccg

SEQ ID NO: 2631759 - RNA, 19 nt, Escherichia coli CFT073
caaugucauggcagucuua

SEQ ID NO: 2631760 - RNA, 16 nt, Escherichia coli CFT073
caauguccguaacaua

SEQ ID NO: 2631761 - RNA, 22 nt, Escherichia coli CFT073
caaugugaaaacccugcgcaug

SEQ ID NO: 2631762 - RNA, 22 nt, Escherichia coli CFT073
caaugugcucuaacccuuccag

SEQ ID NO: 2631763 - RNA, 15 nt, Escherichia coli CFT073
caauguggaaagccc

SEQ ID NO: 2631764 - RNA, 17 nt, Escherichia coli CFT073
caauguggccuuaauug

SEQ ID NO: 2631765 - RNA, 13 nt, Escherichia coli CFT073
caauguugcuggc

SEQ ID NO: 2631766 - RNA, 13 nt, Escherichia coli CFT073
caauguuuuucuc

SEQ ID NO: 2631767 - RNA, 12 nt, Escherichia coli CFT073
caauuaaaaauu

SEQ ID NO: 2631768 - RNA, 16 nt, Escherichia coli CFT073
caauuaacgaaaucuc

SEQ ID NO: 2631769 - RNA, 18 nt, Escherichia coli CFT073
caauuaauccuuucgaaa

SEQ ID NO: 2631770 - RNA, 18 nt, Escherichia coli CFT073
caauuaauucuccgcacu

SEQ ID NO: 2631771 - RNA, 13 nt, Escherichia coli CFT073
caauuacaaaaag

SEQ ID NO: 2631772 - RNA, 15 nt, Escherichia coli CFT073
caauuacacacaaca

SEQ ID NO: 2631773 - RNA, 18 nt, Escherichia coli CFT073
caauuaccuuuuuaccaa

SEQ ID NO: 2631774 - RNA, 18 nt, Escherichia coli CFT073
caauuacgccgagcgcca

SEQ ID NO: 2631775 - RNA, 19 nt, Escherichia coli CFT073
caauuacgccgagcgccag

SEQ ID NO: 2631776 - RNA, 19 nt, Escherichia coli CFT073
caauuacgcggcuucaacu

SEQ ID NO: 2631777 - RNA, 15 nt, Escherichia coli CFT073
caauuagaauuauua

SEQ ID NO: 2631778 - RNA, 18 nt, Escherichia coli CFT073
caauuagcggccagcggg

SEQ ID NO: 2631779 - RNA, 20 nt, Escherichia coli CFT073
caauuauaauacgcuugauu

SEQ ID NO: 2631780 - RNA, 11 nt, Escherichia coli CFT073
caauuaucugg

SEQ ID NO: 2631781 - RNA, 14 nt, Escherichia coli CFT073
caauuaucuggcua

SEQ ID NO: 2631782 - RNA, 17 nt, Escherichia coli CFT073
caauuaucuguucuuuu

SEQ ID NO: 2631783 - RNA, 17 nt, Escherichia coli CFT073
caauucacacucugcca

SEQ ID NO: 2631784 - RNA, 14 nt, Escherichia coli CFT073
caauuccagcgcca

SEQ ID NO: 2631785 - RNA, 17 nt, Escherichia coli CFT073
caauuccagcgccagua

SEQ ID NO: 2631786 - RNA, 14 nt, Escherichia coli CFT073
caauuccugcgcga

SEQ ID NO: 2631787 - RNA, 14 nt, Escherichia coli CFT073
caauuccuggaacu

SEQ ID NO: 2631788 - RNA, 12 nt, Escherichia coli CFT073
caauuccuucug

SEQ ID NO: 2631789 - RNA, 16 nt, Escherichia coli CFT073
caauuccuucugggcg

SEQ ID NO: 2631790 - RNA, 22 nt, Escherichia coli CFT073
caauucgagcaucaucucacgc

SEQ ID NO: 2631791 - RNA, 22 nt, Escherichia coli CFT073
caauucgcgucggcgucagcgc

SEQ ID NO: 2631792 - RNA, 15 nt, Escherichia coli CFT073
caauucggcuuuuuu

SEQ ID NO: 2631793 - RNA, 15 nt, Escherichia coli CFT073
caauugaagaauauc

SEQ ID NO: 2631794 - RNA, 21 nt, Escherichia coli CFT073
caauugaccugauaagacagc

SEQ ID NO: 2631795 - RNA, 14 nt, Escherichia coli CFT073
caauugauaauaaa

SEQ ID NO: 2631796 - RNA, 16 nt, Escherichia coli CFT073
caauugauaauaaaaa

SEQ ID NO: 2631797 - RNA, 22 nt, Escherichia coli CFT073
caauugcaggaagguuuuaauc

SEQ ID NO: 2631798 - RNA, 12 nt, Escherichia coli CFT073
caauugcauuug

SEQ ID NO: 2631799 - RNA, 18 nt, Escherichia coli CFT073
caauugcauuugaacugg

SEQ ID NO: 2631800 - RNA, 22 nt, Escherichia coli CFT073
caauugccauaaaaacgauaaa

SEQ ID NO: 2631801 - RNA, 13 nt, Escherichia coli CFT073
caauugccggaug

SEQ ID NO: 2631802 - RNA, 20 nt, Escherichia coli CFT073
caauugccggaugcgacaua

SEQ ID NO: 2631803 - RNA, 16 nt, Escherichia coli CFT073
caauugcgggccaaag

SEQ ID NO: 2631804 - RNA, 20 nt, Escherichia coli CFT073
caauugcgggccaaagacca

SEQ ID NO: 2631805 - RNA, 21 nt, Escherichia coli CFT073
caauugcguuaaaaucagcgu

SEQ ID NO: 2631806 - RNA, 15 nt, Escherichia coli CFT073
caauugcugaaacgc

SEQ ID NO: 2631807 - RNA, 14 nt, Escherichia coli CFT073
caauugcuguaaau

SEQ ID NO: 2631808 - RNA, 19 nt, Escherichia coli CFT073
caauuguuagccacaucca

SEQ ID NO: 2631809 - RNA, 21 nt, Escherichia coli CFT073
caauuuccgcagcuccagccc

SEQ ID NO: 2631810 - RNA, 16 nt, Escherichia coli CFT073
caauuuccgcuacugu

SEQ ID NO: 2631811 - RNA, 16 nt, Escherichia coli CFT073
caauuucgccucgcuu

SEQ ID NO: 2631812 - RNA, 22 nt, Escherichia coli CFT073
caauuucugugcagccaaaaau

SEQ ID NO: 2631813 - RNA, 19 nt, Escherichia coli CFT073
caauuucuucaggauuggu

SEQ ID NO: 2631814 - RNA, 21 nt, Escherichia coli CFT073
caauuugcagccguuuguucu

SEQ ID NO: 2631815 - RNA, 23 nt, Escherichia coli CFT073
caauuugcggugaagccaccagc

SEQ ID NO: 2631816 - RNA, 15 nt, Escherichia coli CFT073
caauuugcuucuggc

SEQ ID NO: 2631817 - RNA, 16 nt, Escherichia coli CFT073
caauuugcuucuggcu

SEQ ID NO: 2631818 - RNA, 20 nt, Escherichia coli CFT073
caauuuguagucauuuuuug

SEQ ID NO: 2631819 - RNA, 21 nt, Escherichia coli CFT073
caauuuguucacaccaucauc

SEQ ID NO: 2631820 - RNA, 19 nt, Escherichia coli CFT073
caauuuuacccgugcaucc

SEQ ID NO: 2631821 - RNA, 13 nt, Escherichia coli CFT073
caauuuugcagca

SEQ ID NO: 2631822 - RNA, 14 nt, Escherichia coli CFT073
caauuuugcagcau

SEQ ID NO: 2631823 - RNA, 16 nt, Escherichia coli CFT073
caauuuugcccagccg

SEQ ID NO: 2631824 - RNA, 14 nt, Escherichia coli CFT073
caauuuuucaggau

SEQ ID NO: 2631825 - RNA, 14 nt, Escherichia coli CFT073
caauuuuuugcgcc

SEQ ID NO: 2631826 - RNA, 13 nt, Escherichia coli CFT073
cacaaaaacagua

SEQ ID NO: 2631827 - RNA, 15 nt, Escherichia coli CFT073
cacaaaaacaguaag

SEQ ID NO: 2631828 - RNA, 18 nt, Escherichia coli CFT073
cacaaaaacaguaagcaa

SEQ ID NO: 2631829 - RNA, 18 nt, Escherichia coli CFT073
cacaaaaccgucguugcu

SEQ ID NO: 2631830 - RNA, 13 nt, Escherichia coli CFT073
cacaaaaccugcc

SEQ ID NO: 2631831 - RNA, 19 nt, Escherichia coli CFT073
cacaaaacuguaucccagc

SEQ ID NO: 2631832 - RNA, 13 nt, Escherichia coli CFT073
cacaaaagcaaag

SEQ ID NO: 2631833 - RNA, 18 nt, Escherichia coli CFT073
cacaaaaugccagcaacu

SEQ ID NO: 2631834 - RNA, 21 nt, Escherichia coli CFT073
cacaaacaauuugcuuaagcc

SEQ ID NO: 2631835 - RNA, 12 nt, Escherichia coli CFT073
cacaaaccaccg

SEQ ID NO: 2631836 - RNA, 14 nt, Escherichia coli CFT073
cacaaaccaccgaa

SEQ ID NO: 2631837 - RNA, 12 nt, Escherichia coli CFT073
cacaaaccagcc

SEQ ID NO: 2631838 - RNA, 19 nt, Escherichia coli CFT073
cacaaacgauccuggucag

SEQ ID NO: 2631839 - RNA, 15 nt, Escherichia coli CFT073
cacaaacgcaaucca

SEQ ID NO: 2631840 - RNA, 15 nt, Escherichia coli CFT073
cacaaacgccgugca

SEQ ID NO: 2631841 - RNA, 18 nt, Escherichia coli CFT073
cacaaacggcgcauagcc

SEQ ID NO: 2631842 - RNA, 17 nt, Escherichia coli CFT073
cacaaagcaauauuaug

SEQ ID NO: 2631843 - RNA, 14 nt, Escherichia coli CFT073
cacaaaggcgcgaa

SEQ ID NO: 2631844 - RNA, 19 nt, Escherichia coli CFT073
cacaaaggcuugcugcauu

SEQ ID NO: 2631845 - RNA, 15 nt, Escherichia coli CFT073
cacaaauccccaguu

SEQ ID NO: 2631846 - RNA, 12 nt, Escherichia coli CFT073
cacaacaauacc

SEQ ID NO: 2631847 - RNA, 21 nt, Escherichia coli CFT073
cacaacauucccaucaguagc

SEQ ID NO: 2631848 - RNA, 14 nt, Escherichia coli CFT073
cacaacauugauaa

SEQ ID NO: 2631849 - RNA, 14 nt, Escherichia coli CFT073
cacaacauugcgcc

SEQ ID NO: 2631850 - RNA, 18 nt, Escherichia coli CFT073
cacaaccaauggccaaug

SEQ ID NO: 2631851 - RNA, 18 nt, Escherichia coli CFT073
cacaacccagacaaauaa

SEQ ID NO: 2631852 - RNA, 21 nt, Escherichia coli CFT073
cacaaccgccagaugcggcgu

SEQ ID NO: 2631853 - RNA, 16 nt, Escherichia coli CFT073
cacaaccgccggaugc

SEQ ID NO: 2631854 - RNA, 19 nt, Escherichia coli CFT073
cacaaccgccggaugcggc

SEQ ID NO: 2631855 - RNA, 21 nt, Escherichia coli CFT073
cacaaccgccggaugcggcgu

SEQ ID NO: 2631856 - RNA, 17 nt, Escherichia coli CFT073
cacaacgauaauccagc

SEQ ID NO: 2631857 - RNA, 16 nt, Escherichia coli CFT073
cacaacgcuuucaaca

SEQ ID NO: 2631858 - RNA, 18 nt, Escherichia coli CFT073
cacaacguacaccgcagc

SEQ ID NO: 2631859 - RNA, 19 nt, Escherichia coli CFT073
cacaacguacaccgcagcc

SEQ ID NO: 2631860 - RNA, 22 nt, Escherichia coli CFT073
cacaacugcgaccguacaacca

SEQ ID NO: 2631861 - RNA, 23 nt, Escherichia coli CFT073
cacaacugcgaccguacaaccaa

SEQ ID NO: 2631862 - RNA, 18 nt, Escherichia coli CFT073
cacaagacuguaaauacu

SEQ ID NO: 2631863 - RNA, 15 nt, Escherichia coli CFT073
cacaagcacagggca

SEQ ID NO: 2631864 - RNA, 14 nt, Escherichia coli CFT073
cacaagcauaugga

SEQ ID NO: 2631865 - RNA, 22 nt, Escherichia coli CFT073
cacaagccaaucugcuggaaag

SEQ ID NO: 2631866 - RNA, 16 nt, Escherichia coli CFT073
cacaagcgaacccgca

SEQ ID NO: 2631867 - RNA, 22 nt, Escherichia coli CFT073
cacaagcgucauauccgacacu

SEQ ID NO: 2631868 - RNA, 17 nt, Escherichia coli CFT073
cacaauacauagaagcu

SEQ ID NO: 2631869 - RNA, 11 nt, Escherichia coli CFT073
cacaauaccuu

SEQ ID NO: 2631870 - RNA, 17 nt, Escherichia coli CFT073
cacaauaccuucugcgc

SEQ ID NO: 2631871 - RNA, 23 nt, Escherichia coli CFT073
cacaauaccuucugcgcccgccc

SEQ ID NO: 2631872 - RNA, 19 nt, Escherichia coli CFT073
cacaaucaaauccugcauc

SEQ ID NO: 2631873 - RNA, 18 nt, Escherichia coli CFT073
cacaaucaacgccaccau

SEQ ID NO: 2631874 - RNA, 20 nt, Escherichia coli CFT073
cacaaucaacgccaccauca

SEQ ID NO: 2631875 - RNA, 14 nt, Escherichia coli CFT073
cacaauccgccagg

SEQ ID NO: 2631876 - RNA, 20 nt, Escherichia coli CFT073
cacaauccgccaggacauca

SEQ ID NO: 2631877 - RNA, 22 nt, Escherichia coli CFT073
cacaauccgcgagcgucuggcu

SEQ ID NO: 2631878 - RNA, 16 nt, Escherichia coli CFT073
cacaaucggcgggaaa

SEQ ID NO: 2631879 - RNA, 21 nt, Escherichia coli CFT073
cacaaucggcuuucaccgccu

SEQ ID NO: 2631880 - RNA, 15 nt, Escherichia coli CFT073
cacaaucucgcccgc

SEQ ID NO: 2631881 - RNA, 14 nt, Escherichia coli CFT073
cacaaucugauaga

SEQ ID NO: 2631882 - RNA, 14 nt, Escherichia coli CFT073
cacaaugccgccaa

SEQ ID NO: 2631883 - RNA, 19 nt, Escherichia coli CFT073
cacaaugccgccaauaaug

SEQ ID NO: 2631884 - RNA, 17 nt, Escherichia coli CFT073
cacaaugccguaaccag

SEQ ID NO: 2631885 - RNA, 15 nt, Escherichia coli CFT073
cacaaugccugaugc

SEQ ID NO: 2631886 - RNA, 22 nt, Escherichia coli CFT073
cacaaugccugaugcgaugcug

SEQ ID NO: 2631887 - RNA, 19 nt, Escherichia coli CFT073
cacaaugccugaugcgcuu

SEQ ID NO: 2631888 - RNA, 22 nt, Escherichia coli CFT073
cacaaugccuuuugacuccuga

SEQ ID NO: 2631889 - RNA, 23 nt, Escherichia coli CFT073
cacaauggcauauuccgccaccu

SEQ ID NO: 2631890 - RNA, 23 nt, Escherichia coli CFT073
cacaauggccagcacauuaaaau

SEQ ID NO: 2631891 - RNA, 17 nt, Escherichia coli CFT073
cacaaugggcaagcgac

SEQ ID NO: 2631892 - RNA, 12 nt, Escherichia coli CFT073
cacaauggucaa

SEQ ID NO: 2631893 - RNA, 12 nt, Escherichia coli CFT073
cacaauuaccuu

SEQ ID NO: 2631894 - RNA, 15 nt, Escherichia coli CFT073
cacacaaagugcgag

SEQ ID NO: 2631895 - RNA, 16 nt, Escherichia coli CFT073
cacacaaccauggaac

SEQ ID NO: 2631896 - RNA, 10 nt, Escherichia coli CFT073
cacacaccag

SEQ ID NO: 2631897 - RNA, 15 nt, Escherichia coli CFT073
cacacacgcccaguu

SEQ ID NO: 2631898 - RNA, 23 nt, Escherichia coli CFT073
cacacacgcccaguucaaacggc

SEQ ID NO: 2631899 - RNA, 15 nt, Escherichia coli CFT073
cacaccaaccgcuuc

SEQ ID NO: 2631900 - RNA, 14 nt, Escherichia coli CFT073
cacaccacaacagc

SEQ ID NO: 2631901 - RNA, 23 nt, Escherichia coli CFT073
cacaccacgcgccugcagcggcc

SEQ ID NO: 2631902 - RNA, 13 nt, Escherichia coli CFT073
cacaccacuucau

SEQ ID NO: 2631903 - RNA, 14 nt, Escherichia coli CFT073
cacaccacuucauu

SEQ ID NO: 2631904 - RNA, 19 nt, Escherichia coli CFT073
cacaccagaccagacaauc

SEQ ID NO: 2631905 - RNA, 11 nt, Escherichia coli CFT073
cacaccagauc

SEQ ID NO: 2631906 - RNA, 14 nt, Escherichia coli CFT073
cacaccaguaaagc

SEQ ID NO: 2631907 - RNA, 14 nt, Escherichia coli CFT073
cacaccagucagcg

SEQ ID NO: 2631908 - RNA, 17 nt, Escherichia coli CFT073
cacaccauaaugaccaa

SEQ ID NO: 2631909 - RNA, 13 nt, Escherichia coli CFT073
cacaccaucaucg

SEQ ID NO: 2631910 - RNA, 19 nt, Escherichia coli CFT073
cacaccccgcgccgcugag

SEQ ID NO: 2631911 - RNA, 21 nt, Escherichia coli CFT073
cacaccccggauuacgcauca

SEQ ID NO: 2631912 - RNA, 13 nt, Escherichia coli CFT073
cacacccugaugg

SEQ ID NO: 2631913 - RNA, 16 nt, Escherichia coli CFT073
cacaccgcccugcugu

SEQ ID NO: 2631914 - RNA, 20 nt, Escherichia coli CFT073
cacaccgccgccgccacugc

SEQ ID NO: 2631915 - RNA, 21 nt, Escherichia coli CFT073
cacaccgccgccgccacugca

SEQ ID NO: 2631916 - RNA, 13 nt, Escherichia coli CFT073
cacaccgcggaac

SEQ ID NO: 2631917 - RNA, 16 nt, Escherichia coli CFT073
cacaccgcugacuuuc

SEQ ID NO: 2631918 - RNA, 13 nt, Escherichia coli CFT073
cacaccggcacca

SEQ ID NO: 2631919 - RNA, 17 nt, Escherichia coli CFT073
cacaccguaauugccag

SEQ ID NO: 2631920 - RNA, 16 nt, Escherichia coli CFT073
cacaccgucagccagc

SEQ ID NO: 2631921 - RNA, 22 nt, Escherichia coli CFT073
cacaccgucagccagcacugac

SEQ ID NO: 2631922 - RNA, 17 nt, Escherichia coli CFT073
cacaccguugccgcauu

SEQ ID NO: 2631923 - RNA, 17 nt, Escherichia coli CFT073
cacaccuacgcccgcca

SEQ ID NO: 2631924 - RNA, 17 nt, Escherichia coli CFT073
cacaucgauguuugaca

SEQ ID NO: 2631925 - RNA, 23 nt, Escherichia coli CFT073
cacaucgccgaccgcaaccggcc

SEQ ID NO: 2631926 - RNA, 15 nt, Escherichia coli CFT073
cacaucgcugugcug

SEQ ID NO: 2631927 - RNA, 14 nt, Escherichia coli CFT073
cacaucucaaaucu

SEQ ID NO: 2631928 - RNA, 15 nt, Escherichia coli CFT073
cacaucucaauccgc

SEQ ID NO: 2631929 - RNA, 18 nt, Escherichia coli CFT073
cacaucucccacuuugau

SEQ ID NO: 2631930 - RNA, 11 nt, Escherichia coli CFT073
cacaucugaca

SEQ ID NO: 2631931 - RNA, 15 nt, Escherichia coli CFT073
cacaucugacaaaau

SEQ ID NO: 2631932 - RNA, 22 nt, Escherichia coli CFT073
cacaugaucauucaccagccca

SEQ ID NO: 2631933 - RNA, 17 nt, Escherichia coli CFT073
cacaugcagcuucgcca

SEQ ID NO: 2631934 - RNA, 14 nt, Escherichia coli CFT073
cacaugcccuucac

SEQ ID NO: 2631935 - RNA, 18 nt, Escherichia coli CFT073
cacaugcuggaaccacag

SEQ ID NO: 2631936 - RNA, 14 nt, Escherichia coli CFT073
cacaugcuucagca

SEQ ID NO: 2631937 - RNA, 14 nt, Escherichia coli CFT073
cacauggagcuuua

SEQ ID NO: 2631938 - RNA, 22 nt, Escherichia coli CFT073
cacaugguuuacggcggucugg

SEQ ID NO: 2631939 - RNA, 20 nt, Escherichia coli CFT073
cacaugucaguugcauacca

SEQ ID NO: 2631940 - RNA, 10 nt, Escherichia coli CFT073
cacauguugc

SEQ ID NO: 2631941 - RNA, 15 nt, Escherichia coli CFT073
cacauuaucaaacgu

SEQ ID NO: 2631942 - RNA, 13 nt, Escherichia coli CFT073
cacauucagcagc

SEQ ID NO: 2631943 - RNA, 20 nt, Escherichia coli CFT073
cacauuccagaugcgccagu

SEQ ID NO: 2631944 - RNA, 21 nt, Escherichia coli CFT073
cacauucuccgccgaagacaa

SEQ ID NO: 2631945 - RNA, 23 nt, Escherichia coli CFT073
cacauugauggcgcuuucguuuu

SEQ ID NO: 2631946 - RNA, 17 nt, Escherichia coli CFT073
cacauugccauuguugu

SEQ ID NO: 2631947 - RNA, 18 nt, Escherichia coli CFT073
cacauugccauuguugua

SEQ ID NO: 2631948 - RNA, 18 nt, Escherichia coli CFT073
cacauuuuccaucacgau

SEQ ID NO: 2631949 - RNA, 11 nt, Escherichia coli CFT073
cacauuuuuaa

SEQ ID NO: 2631950 - RNA, 13 nt, Escherichia coli CFT073
cacauuuuuuacu

SEQ ID NO: 2631951 - RNA, 16 nt, Escherichia coli CFT073
caccaaaaaucaccgc

SEQ ID NO: 2631952 - RNA, 17 nt, Escherichia coli CFT073
caccaaaaccgaggagc

SEQ ID NO: 2631953 - RNA, 17 nt, Escherichia coli CFT073
caccaaaccaacaagca

SEQ ID NO: 2631954 - RNA, 21 nt, Escherichia coli CFT073
caccaaacgggcaagccagca

SEQ ID NO: 2631955 - RNA, 18 nt, Escherichia coli CFT073
caccaaacugauuuagca

SEQ ID NO: 2631956 - RNA, 17 nt, Escherichia coli CFT073
caccaaacugcgcccgc

SEQ ID NO: 2631957 - RNA, 18 nt, Escherichia coli CFT073
caccaaagaagcguugau

SEQ ID NO: 2631958 - RNA, 12 nt, Escherichia coli CFT073
caccaaaggcac

SEQ ID NO: 2631959 - RNA, 13 nt, Escherichia coli CFT073
caccaaaugcagc

SEQ ID NO: 2631960 - RNA, 22 nt, Escherichia coli CFT073
caccaaaugccugcuguugcgg

SEQ ID NO: 2631961 - RNA, 18 nt, Escherichia coli CFT073
caccaaccaucaggcaga

SEQ ID NO: 2631962 - RNA, 19 nt, Escherichia coli CFT073
caccaacccaacuuauugu

SEQ ID NO: 2631963 - RNA, 19 nt, Escherichia coli CFT073
caccaacgauuuuuuccgc

SEQ ID NO: 2631964 - RNA, 16 nt, Escherichia coli CFT073
caccaacgcagacgca

SEQ ID NO: 2631965 - RNA, 15 nt, Escherichia coli CFT073
caccaacuuucacgc

SEQ ID NO: 2631966 - RNA, 22 nt, Escherichia coli CFT073
caccaagcacggcgcgacucag

SEQ ID NO: 2631967 - RNA, 15 nt, Escherichia coli CFT073
caccaaggaacugug

SEQ ID NO: 2631968 - RNA, 19 nt, Escherichia coli CFT073
caccaaggaacugugcauu

SEQ ID NO: 2631969 - RNA, 13 nt, Escherichia coli CFT073
caccaaggaagcu

SEQ ID NO: 2631970 - RNA, 12 nt, Escherichia coli CFT073
caccaaguucuu

SEQ ID NO: 2631971 - RNA, 14 nt, Escherichia coli CFT073
caccaaguucuuca

SEQ ID NO: 2631972 - RNA, 17 nt, Escherichia coli CFT073
caccaaguucuucacug

SEQ ID NO: 2631973 - RNA, 21 nt, Escherichia coli CFT073
caccaauaaccggcacuucaa

SEQ ID NO: 2631974 - RNA, 23 nt, Escherichia coli CFT073
caccaauaaugucgcugguaaca

SEQ ID NO: 2631975 - RNA, 22 nt, Escherichia coli CFT073
caccaauacuugcgaaucauua

SEQ ID NO: 2631976 - RNA, 23 nt, Escherichia coli CFT073
caccaaucaacaauugcgggcca

SEQ ID NO: 2631977 - RNA, 16 nt, Escherichia coli CFT073
caccaaucaccgccaa

SEQ ID NO: 2631978 - RNA, 15 nt, Escherichia coli CFT073
caccaaucagcccug

SEQ ID NO: 2631979 - RNA, 16 nt, Escherichia coli CFT073
caccaaucagcccugc

SEQ ID NO: 2631980 - RNA, 13 nt, Escherichia coli CFT073
caccaauccaggc

SEQ ID NO: 2631981 - RNA, 21 nt, Escherichia coli CFT073
caccaaucgucaaugccguca

SEQ ID NO: 2631982 - RNA, 15 nt, Escherichia coli CFT073
caccaaugacagccc

SEQ ID NO: 2631983 - RNA, 23 nt, Escherichia coli CFT073
caccaaugacagccccaccagca

SEQ ID NO: 2631984 - RNA, 15 nt, Escherichia coli CFT073
caccaaugacuauuu

SEQ ID NO: 2631985 - RNA, 19 nt, Escherichia coli CFT073
caccaaugauaaguuucac

SEQ ID NO: 2631986 - RNA, 19 nt, Escherichia coli CFT073
caccaauguaggccugaua

SEQ ID NO: 2631987 - RNA, 17 nt, Escherichia coli CFT073
caccaauguggaaagcc

SEQ ID NO: 2631988 - RNA, 18 nt, Escherichia coli CFT073
caccaauugugguacgcu

SEQ ID NO: 2631989 - RNA, 19 nt, Escherichia coli CFT073
caccaauuuuaaaaccacc

SEQ ID NO: 2631990 - RNA, 17 nt, Escherichia coli CFT073
caccacaaaccagcccg

SEQ ID NO: 2631991 - RNA, 19 nt, Escherichia coli CFT073
caccacaagccaccauccc

SEQ ID NO: 2631992 - RNA, 13 nt, Escherichia coli CFT073
caccacaccagac

SEQ ID NO: 2631993 - RNA, 15 nt, Escherichia coli CFT073
caccacaccagacca

SEQ ID NO: 2631994 - RNA, 19 nt, Escherichia coli CFT073
caccacaccagaccagaca

SEQ ID NO: 2631995 - RNA, 20 nt, Escherichia coli CFT073
caccacaccugccaccagca

SEQ ID NO: 2631996 - RNA, 17 nt, Escherichia coli CFT073
caccacacgacgcgcca

SEQ ID NO: 2631997 - RNA, 20 nt, Escherichia coli CFT073
caccacacgacgcgccagca

SEQ ID NO: 2631998 - RNA, 22 nt, Escherichia coli CFT073
caccacauaagaucaucggcca

SEQ ID NO: 2631999 - RNA, 16 nt, Escherichia coli CFT073
caccacaucgccgacc

SEQ ID NO: 2632000 - RNA, 19 nt, Escherichia coli CFT073
caccacaucgguuugcgca

SEQ ID NO: 2632001 - RNA, 23 nt, Escherichia coli CFT073
caccacauugccaaaccacggcc

SEQ ID NO: 2632002 - RNA, 19 nt, Escherichia coli CFT073
caccaccaaagguuaacug

SEQ ID NO: 2632003 - RNA, 12 nt, Escherichia coli CFT073
caccaccacuga

SEQ ID NO: 2632004 - RNA, 14 nt, Escherichia coli CFT073
caccaccagcaccg

SEQ ID NO: 2632005 - RNA, 13 nt, Escherichia coli CFT073
caccaccagcagc

SEQ ID NO: 2632006 - RNA, 14 nt, Escherichia coli CFT073
caccaccagcagcu

SEQ ID NO: 2632007 - RNA, 17 nt, Escherichia coli CFT073
caccaccagcgccacca

SEQ ID NO: 2632008 - RNA, 21 nt, Escherichia coli CFT073
caccaccagcgccaccacgcc

SEQ ID NO: 2632009 - RNA, 16 nt, Escherichia coli CFT073
caccaccagcgccugg

SEQ ID NO: 2632010 - RNA, 13 nt, Escherichia coli CFT073
caccaccaucaaa

SEQ ID NO: 2632011 - RNA, 13 nt, Escherichia coli CFT073
caccacccaacag

SEQ ID NO: 2632012 - RNA, 12 nt, Escherichia coli CFT073
caccacccagcg

SEQ ID NO: 2632013 - RNA, 19 nt, Escherichia coli CFT073
caccaccgacgggccugca

SEQ ID NO: 2632014 - RNA, 16 nt, Escherichia coli CFT073
caccaccgauaaaaua

SEQ ID NO: 2632015 - RNA, 21 nt, Escherichia coli CFT073
caccaccgauaaaauaaucac

SEQ ID NO: 2632016 - RNA, 15 nt, Escherichia coli CFT073
caccaccgcaaaaua

SEQ ID NO: 2632017 - RNA, 15 nt, Escherichia coli CFT073
caccaccgcaaagaa

SEQ ID NO: 2632018 - RNA, 18 nt, Escherichia coli CFT073
caccaccgcccgguuuuu

SEQ ID NO: 2632019 - RNA, 19 nt, Escherichia coli CFT073
caccaccgcccguuccacc

SEQ ID NO: 2632020 - RNA, 18 nt, Escherichia coli CFT073
caccaccgucaucacgca

SEQ ID NO: 2632021 - RNA, 14 nt, Escherichia coli CFT073
caccaccucacccg

SEQ ID NO: 2632022 - RNA, 17 nt, Escherichia coli CFT073
caccaccucuuccagcg

SEQ ID NO: 2632023 - RNA, 18 nt, Escherichia coli CFT073
caccaccugauugcugcu

SEQ ID NO: 2632024 - RNA, 22 nt, Escherichia coli CFT073
caccaccuuacauauauuacuc

SEQ ID NO: 2632025 - RNA, 17 nt, Escherichia coli CFT073
caccacgaccacgaacg

SEQ ID NO: 2632026 - RNA, 21 nt, Escherichia coli CFT073
caccacgaggaucgauaucac

SEQ ID NO: 2632027 - RNA, 13 nt, Escherichia coli CFT073
caccacgccaaga

SEQ ID NO: 2632028 - RNA, 14 nt, Escherichia coli CFT073
caccacgccaagaa

SEQ ID NO: 2632029 - RNA, 19 nt, Escherichia coli CFT073
caccacgccagccgccagc

SEQ ID NO: 2632030 - RNA, 22 nt, Escherichia coli CFT073
caccacgcgccugcagcggcca

SEQ ID NO: 2632031 - RNA, 21 nt, Escherichia coli CFT073
caccacggcuauaccccaccc

SEQ ID NO: 2632032 - RNA, 24 nt, Escherichia coli CFT073
caccacgguuuuuugcagcaacca

SEQ ID NO: 2632033 - RNA, 13 nt, Escherichia coli CFT073
caccauccccuuu

SEQ ID NO: 2632034 - RNA, 17 nt, Escherichia coli CFT073
caccauccugaucgcca

SEQ ID NO: 2632035 - RNA, 17 nt, Escherichia coli CFT073
caccaucgaaauuagcg

SEQ ID NO: 2632036 - RNA, 20 nt, Escherichia coli CFT073
caccaucgauuuacugccaa

SEQ ID NO: 2632037 - RNA, 18 nt, Escherichia coli CFT073
caccaucgcgauccacgc

SEQ ID NO: 2632038 - RNA, 12 nt, Escherichia coli CFT073
caccaucgcgcc

SEQ ID NO: 2632039 - RNA, 18 nt, Escherichia coli CFT073
caccaucgcuucaugccc

SEQ ID NO: 2632040 - RNA, 18 nt, Escherichia coli CFT073
caccaucucaagcauuac

SEQ ID NO: 2632041 - RNA, 20 nt, Escherichia coli CFT073
caccaucucaagcauuaccu

SEQ ID NO: 2632042 - RNA, 16 nt, Escherichia coli CFT073
caccaugccagaaaag

SEQ ID NO: 2632043 - RNA, 18 nt, Escherichia coli CFT073
caccaugccgauggcaaa

SEQ ID NO: 2632044 - RNA, 15 nt, Escherichia coli CFT073
caccauucugggcuc

SEQ ID NO: 2632045 - RNA, 18 nt, Escherichia coli CFT073
caccauugccggaugcgg

SEQ ID NO: 2632046 - RNA, 21 nt, Escherichia coli CFT073
caccauugccggaugcggcgu

SEQ ID NO: 2632047 - RNA, 14 nt, Escherichia coli CFT073
caccauuuaaugac

SEQ ID NO: 2632048 - RNA, 18 nt, Escherichia coli CFT073
caccauuuaaugacaaaa

SEQ ID NO: 2632049 - RNA, 15 nt, Escherichia coli CFT073
caccauuuccggaga

SEQ ID NO: 2632050 - RNA, 20 nt, Escherichia coli CFT073
caccauuuccggagacagcu

SEQ ID NO: 2632051 - RNA, 21 nt, Escherichia coli CFT073
caccauuuccggagacagcuu

SEQ ID NO: 2632052 - RNA, 12 nt, Escherichia coli CFT073
cacccaauccag

SEQ ID NO: 2632053 - RNA, 13 nt, Escherichia coli CFT073
cacccacagccau

SEQ ID NO: 2632054 - RNA, 14 nt, Escherichia coli CFT073
cacccaccagcgcc

SEQ ID NO: 2632055 - RNA, 15 nt, Escherichia coli CFT073
cacccaccagcgccg

SEQ ID NO: 2632056 - RNA, 17 nt, Escherichia coli CFT073
cacccaccagcgccgaa

SEQ ID NO: 2632057 - RNA, 17 nt, Escherichia coli CFT073
cacccagaacgccgaau

SEQ ID NO: 2632058 - RNA, 12 nt, Escherichia coli CFT073
cacccagcaauc

SEQ ID NO: 2632059 - RNA, 12 nt, Escherichia coli CFT073
cacccagcgaag

SEQ ID NO: 2632060 - RNA, 19 nt, Escherichia coli CFT073
cacccagcguuugcugcuu

SEQ ID NO: 2632061 - RNA, 12 nt, Escherichia coli CFT073
cacccaggccau

SEQ ID NO: 2632062 - RNA, 16 nt, Escherichia coli CFT073
cacccagucccaccau

SEQ ID NO: 2632063 - RNA, 12 nt, Escherichia coli CFT073
cacccagugcgg

SEQ ID NO: 2632064 - RNA, 18 nt, Escherichia coli CFT073
cacccauagauaccuucu

SEQ ID NO: 2632065 - RNA, 14 nt, Escherichia coli CFT073
cacccaucgccagc

SEQ ID NO: 2632066 - RNA, 13 nt, Escherichia coli CFT073
cacccaucgccgu

SEQ ID NO: 2632067 - RNA, 15 nt, Escherichia coli CFT073
cacccaugcgcgccg

SEQ ID NO: 2632068 - RNA, 13 nt, Escherichia coli CFT073
cacccauguugau

SEQ ID NO: 2632069 - RNA, 16 nt, Escherichia coli CFT073
cacccauuuauccagc

SEQ ID NO: 2632070 - RNA, 17 nt, Escherichia coli CFT073
cacccauuuauccagcg

SEQ ID NO: 2632071 - RNA, 19 nt, Escherichia coli CFT073
cacccauuuauccagcggc

SEQ ID NO: 2632072 - RNA, 22 nt, Escherichia coli CFT073
cacccauuuauccagcggcagc

SEQ ID NO: 2632073 - RNA, 23 nt, Escherichia coli CFT073
cacccauuuauccagcggcagcc

SEQ ID NO: 2632074 - RNA, 18 nt, Escherichia coli CFT073
caccccacaaacagaaug

SEQ ID NO: 2632075 - RNA, 16 nt, Escherichia coli CFT073
caccccagacuucccc

SEQ ID NO: 2632076 - RNA, 17 nt, Escherichia coli CFT073
caccccccauugggcca

SEQ ID NO: 2632077 - RNA, 20 nt, Escherichia coli CFT073
caccccgcgccgcugagaaa

SEQ ID NO: 2632078 - RNA, 16 nt, Escherichia coli CFT073
cacccgacgugcagca

SEQ ID NO: 2632079 - RNA, 17 nt, Escherichia coli CFT073
cacccgagagaacugcu

SEQ ID NO: 2632080 - RNA, 21 nt, Escherichia coli CFT073
cacccgagagaacugcugcau

SEQ ID NO: 2632081 - RNA, 21 nt, Escherichia coli CFT073
cacccgcaacgcccugcaacu

SEQ ID NO: 2632082 - RNA, 21 nt, Escherichia coli CFT073
cacccgcaagacgaaccggca

SEQ ID NO: 2632083 - RNA, 16 nt, Escherichia coli CFT073
cacccgcagcaagcgu

SEQ ID NO: 2632084 - RNA, 23 nt, Escherichia coli CFT073
cacccgcgccuaaauuuuuccac

SEQ ID NO: 2632085 - RNA, 12 nt, Escherichia coli CFT073
cacccgcggcga

SEQ ID NO: 2632086 - RNA, 14 nt, Escherichia coli CFT073
cacccgcggcgauc

SEQ ID NO: 2632087 - RNA, 20 nt, Escherichia coli CFT073
cacccgcguuacgccaucug

SEQ ID NO: 2632088 - RNA, 18 nt, Escherichia coli CFT073
cacccgcugcaacacuuc

SEQ ID NO: 2632089 - RNA, 13 nt, Escherichia coli CFT073
cacccgcugcgaa

SEQ ID NO: 2632090 - RNA, 17 nt, Escherichia coli CFT073
cacccgguaaacaaaaa

SEQ ID NO: 2632091 - RNA, 15 nt, Escherichia coli CFT073
cacccggucagccau

SEQ ID NO: 2632092 - RNA, 21 nt, Escherichia coli CFT073
cacccgucguugcaaucagcg

SEQ ID NO: 2632093 - RNA, 15 nt, Escherichia coli CFT073
cacccgugcagguuc

SEQ ID NO: 2632094 - RNA, 22 nt, Escherichia coli CFT073
cacccguugaucuucucuuaua

SEQ ID NO: 2632095 - RNA, 21 nt, Escherichia coli CFT073
cacccuaacccucuccccaga

SEQ ID NO: 2632096 - RNA, 12 nt, Escherichia coli CFT073
cacccuguuugu

SEQ ID NO: 2632097 - RNA, 23 nt, Escherichia coli CFT073
caccgaaaaauaguuacuaucuu

SEQ ID NO: 2632098 - RNA, 14 nt, Escherichia coli CFT073
caccgaaacuugcg

SEQ ID NO: 2632099 - RNA, 22 nt, Escherichia coli CFT073
caccgaaagcacuguucgccgc

SEQ ID NO: 2632100 - RNA, 17 nt, Escherichia coli CFT073
caccgaagcggccguca

SEQ ID NO: 2632101 - RNA, 17 nt, Escherichia coli CFT073
caccgaaugcgccuacc

SEQ ID NO: 2632102 - RNA, 20 nt, Escherichia coli CFT073
caccgacaucuuucugcgca

SEQ ID NO: 2632103 - RNA, 15 nt, Escherichia coli CFT073
caccgaccaucggca

SEQ ID NO: 2632104 - RNA, 18 nt, Escherichia coli CFT073
caccgacgggccugcagg

SEQ ID NO: 2632105 - RNA, 16 nt, Escherichia coli CFT073
caccgagauccugguc

SEQ ID NO: 2632106 - RNA, 16 nt, Escherichia coli CFT073
caccgagcagcacaau

SEQ ID NO: 2632107 - RNA, 17 nt, Escherichia coli CFT073
caccgagcguggcgaua

SEQ ID NO: 2632108 - RNA, 17 nt, Escherichia coli CFT073
caccgaggccaaaacca

SEQ ID NO: 2632109 - RNA, 17 nt, Escherichia coli CFT073
caccgauaaaauaauca

SEQ ID NO: 2632110 - RNA, 22 nt, Escherichia coli CFT073
caccgaugacagaaucagcagc

SEQ ID NO: 2632111 - RNA, 13 nt, Escherichia coli CFT073
caccgcaaaacgc

SEQ ID NO: 2632112 - RNA, 14 nt, Escherichia coli CFT073
caccgcaaacugcu

SEQ ID NO: 2632113 - RNA, 21 nt, Escherichia coli CFT073
caccgcaaagaaacgcgcggc

SEQ ID NO: 2632114 - RNA, 15 nt, Escherichia coli CFT073
caccgcaaucgcggc

SEQ ID NO: 2632115 - RNA, 20 nt, Escherichia coli CFT073
caccgcacggcgaguaucgu

SEQ ID NO: 2632116 - RNA, 12 nt, Escherichia coli CFT073
caccgcagaagc

SEQ ID NO: 2632117 - RNA, 17 nt, Escherichia coli CFT073
caccgcagagaucgccc

SEQ ID NO: 2632118 - RNA, 16 nt, Escherichia coli CFT073
caccgcagauaagacc

SEQ ID NO: 2632119 - RNA, 18 nt, Escherichia coli CFT073
caccgcagcaucgucauc

SEQ ID NO: 2632120 - RNA, 15 nt, Escherichia coli CFT073
caccgcagccgccac

SEQ ID NO: 2632121 - RNA, 19 nt, Escherichia coli CFT073
caccgcagccgccacaaua

SEQ ID NO: 2632122 - RNA, 13 nt, Escherichia coli CFT073
caccgcaggcggc

SEQ ID NO: 2632123 - RNA, 22 nt, Escherichia coli CFT073
caccgcauccggcaucaguaac

SEQ ID NO: 2632124 - RNA, 15 nt, Escherichia coli CFT073
caccgcaucggcauc

SEQ ID NO: 2632125 - RNA, 16 nt, Escherichia coli CFT073
caccgcaucggcauca

SEQ ID NO: 2632126 - RNA, 16 nt, Escherichia coli CFT073
caccgcauguugcucu

SEQ ID NO: 2632127 - RNA, 23 nt, Escherichia coli CFT073
caccgcauuccacggggacucca

SEQ ID NO: 2632128 - RNA, 17 nt, Escherichia coli CFT073
caccgccaaagauaaaa

SEQ ID NO: 2632129 - RNA, 14 nt, Escherichia coli CFT073
caccgccaccagcg

SEQ ID NO: 2632130 - RNA, 22 nt, Escherichia coli CFT073
caccgccagaagaaccgccacc

SEQ ID NO: 2632131 - RNA, 17 nt, Escherichia coli CFT073
caccgccagcagcagcg

SEQ ID NO: 2632132 - RNA, 20 nt, Escherichia coli CFT073
caccgccaggcacuucccag

SEQ ID NO: 2632133 - RNA, 18 nt, Escherichia coli CFT073
caccgccaggccuaacac

SEQ ID NO: 2632134 - RNA, 21 nt, Escherichia coli CFT073
caccgcccaccauaaucagcg

SEQ ID NO: 2632135 - RNA, 14 nt, Escherichia coli CFT073
caccgcccagagaa

SEQ ID NO: 2632136 - RNA, 21 nt, Escherichia coli CFT073
caccgcccagcgagcuggcgg

SEQ ID NO: 2632137 - RNA, 14 nt, Escherichia coli CFT073
caccgcccugcauc

SEQ ID NO: 2632138 - RNA, 15 nt, Escherichia coli CFT073
caccgccgaggccga

SEQ ID NO: 2632139 - RNA, 12 nt, Escherichia coli CFT073
caccgccgccac

SEQ ID NO: 2632140 - RNA, 13 nt, Escherichia coli CFT073
caccgccgccacu

SEQ ID NO: 2632141 - RNA, 14 nt, Escherichia coli CFT073
caccgccgccgcca

SEQ ID NO: 2632142 - RNA, 16 nt, Escherichia coli CFT073
caccuguaaagucaca

SEQ ID NO: 2632143 - RNA, 21 nt, Escherichia coli CFT073
caccuguaaagucacauuccc

SEQ ID NO: 2632144 - RNA, 21 nt, Escherichia coli CFT073
caccuguccauauuucgucgc

SEQ ID NO: 2632145 - RNA, 16 nt, Escherichia coli CFT073
caccuguguuguucug

SEQ ID NO: 2632146 - RNA, 22 nt, Escherichia coli CFT073
caccuucaacuugcuguuucgc

SEQ ID NO: 2632147 - RNA, 14 nt, Escherichia coli CFT073
caccuucagcgaag

SEQ ID NO: 2632148 - RNA, 22 nt, Escherichia coli CFT073
caccuucauucaggccaaagcc

SEQ ID NO: 2632149 - RNA, 18 nt, Escherichia coli CFT073
caccuuucagccacuuca

SEQ ID NO: 2632150 - RNA, 17 nt, Escherichia coli CFT073
caccuuuuuaaucucac

SEQ ID NO: 2632151 - RNA, 14 nt, Escherichia coli CFT073
cacgaaaacccuca

SEQ ID NO: 2632152 - RNA, 17 nt, Escherichia coli CFT073
cacgaaacgaaacccaa

SEQ ID NO: 2632153 - RNA, 14 nt, Escherichia coli CFT073
cacgaaaucuucca

SEQ ID NO: 2632154 - RNA, 13 nt, Escherichia coli CFT073
cacgaaaugaaua

SEQ ID NO: 2632155 - RNA, 16 nt, Escherichia coli CFT073
cacgaaaugaauaauc

SEQ ID NO: 2632156 - RNA, 16 nt, Escherichia coli CFT073
cacgaagcccauuuca

SEQ ID NO: 2632157 - RNA, 18 nt, Escherichia coli CFT073
cacgaauagucaguucac

SEQ ID NO: 2632158 - RNA, 13 nt, Escherichia coli CFT073
cacgaaucgauaa

SEQ ID NO: 2632159 - RNA, 15 nt, Escherichia coli CFT073
cacgaaucgccucac

SEQ ID NO: 2632160 - RNA, 14 nt, Escherichia coli CFT073
cacgaauuccgccu

SEQ ID NO: 2632161 - RNA, 15 nt, Escherichia coli CFT073
cacgaauugcuucca

SEQ ID NO: 2632162 - RNA, 12 nt, Escherichia coli CFT073
cacgacacagcu

SEQ ID NO: 2632163 - RNA, 17 nt, Escherichia coli CFT073
cacgacacauaaauaac

SEQ ID NO: 2632164 - RNA, 14 nt, Escherichia coli CFT073
cacgaccaggaacg

SEQ ID NO: 2632165 - RNA, 17 nt, Escherichia coli CFT073
cacgaccaggaacgcca

SEQ ID NO: 2632166 - RNA, 18 nt, Escherichia coli CFT073
cacgaccaggaacgccau

SEQ ID NO: 2632167 - RNA, 15 nt, Escherichia coli CFT073
cacgacgccagccaa

SEQ ID NO: 2632168 - RNA, 18 nt, Escherichia coli CFT073
cacgacgguuaaauugag

SEQ ID NO: 2632169 - RNA, 20 nt, Escherichia coli CFT073
cacgacguuucuuucgauug

SEQ ID NO: 2632170 - RNA, 21 nt, Escherichia coli CFT073
cacgacguuugguggaauguc

SEQ ID NO: 2632171 - RNA, 17 nt, Escherichia coli CFT073
cacgacucaaaucacgc

SEQ ID NO: 2632172 - RNA, 18 nt, Escherichia coli CFT073
cacgacucaaaucacgca

SEQ ID NO: 2632173 - RNA, 18 nt, Escherichia coli CFT073
cacgagauuguaucccuu

SEQ ID NO: 2632174 - RNA, 13 nt, Escherichia coli CFT073
cacgagcgcgauu

SEQ ID NO: 2632175 - RNA, 15 nt, Escherichia coli CFT073
cacgagguugcagau

SEQ ID NO: 2632176 - RNA, 23 nt, Escherichia coli CFT073
cacgagguugcagaucuuucugc

SEQ ID NO: 2632177 - RNA, 22 nt, Escherichia coli CFT073
cacgagugaguuaauuuuccug

SEQ ID NO: 2632178 - RNA, 18 nt, Escherichia coli CFT073
cacgauacaccagauggu

SEQ ID NO: 2632179 - RNA, 23 nt, Escherichia coli CFT073
cacgauacgguuauccugcaaau

SEQ ID NO: 2632180 - RNA, 18 nt, Escherichia coli CFT073
cacgauauucuguaccaa

SEQ ID NO: 2632181 - RNA, 19 nt, Escherichia coli CFT073
cacgaucgaugugauaaau

SEQ ID NO: 2632182 - RNA, 12 nt, Escherichia coli CFT073
cacgaugcacag

SEQ ID NO: 2632183 - RNA, 18 nt, Escherichia coli CFT073
cacgaugccauucaguuu

SEQ ID NO: 2632184 - RNA, 20 nt, Escherichia coli CFT073
cacgauuccaacgaaaauga

SEQ ID NO: 2632185 - RNA, 19 nt, Escherichia coli CFT073
cacgauuugcguaaaaccu

SEQ ID NO: 2632186 - RNA, 13 nt, Escherichia coli CFT073
cacgauuuuguag

SEQ ID NO: 2632187 - RNA, 17 nt, Escherichia coli CFT073
cacgcaacaccagcagu

SEQ ID NO: 2632188 - RNA, 15 nt, Escherichia coli CFT073
cacgcaacaugucag

SEQ ID NO: 2632189 - RNA, 19 nt, Escherichia coli CFT073
cacgcaagguuucaguaac

SEQ ID NO: 2632190 - RNA, 16 nt, Escherichia coli CFT073
cacgcaauugcugccc

SEQ ID NO: 2632191 - RNA, 19 nt, Escherichia coli CFT073
cacgcacagcccgccgcca

SEQ ID NO: 2632192 - RNA, 14 nt, Escherichia coli CFT073
cacgcaccaccagc

SEQ ID NO: 2632193 - RNA, 15 nt, Escherichia coli CFT073
cacgcaccaccagcg

SEQ ID NO: 2632194 - RNA, 13 nt, Escherichia coli CFT073
cacgcaccauaau

SEQ ID NO: 2632195 - RNA, 13 nt, Escherichia coli CFT073
cacgcaccauccc

SEQ ID NO: 2632196 - RNA, 18 nt, Escherichia coli CFT073
cacgcacugacugacaga

SEQ ID NO: 2632197 - RNA, 21 nt, Escherichia coli CFT073
cacgcacugacugacagacug

SEQ ID NO: 2632198 - RNA, 15 nt, Escherichia coli CFT073
cacgcacugcaauau

SEQ ID NO: 2632199 - RNA, 16 nt, Escherichia coli CFT073
cacgcagaccaaccgu

SEQ ID NO: 2632200 - RNA, 15 nt, Escherichia coli CFT073
cacgcagcaagccgu

SEQ ID NO: 2632201 - RNA, 19 nt, Escherichia coli CFT073
cacgcagcagggcaauacg

SEQ ID NO: 2632202 - RNA, 18 nt, Escherichia coli CFT073
cacgcagcggcggcacug

SEQ ID NO: 2632203 - RNA, 12 nt, Escherichia coli CFT073
cacgcagcucac

SEQ ID NO: 2632204 - RNA, 21 nt, Escherichia coli CFT073
cacgcagcugcgcguuaucua

SEQ ID NO: 2632205 - RNA, 21 nt, Escherichia coli CFT073
cacgcaggcaucuuuuucaau

SEQ ID NO: 2632206 - RNA, 18 nt, Escherichia coli CFT073
cacgcaggccacgaauca

SEQ ID NO: 2632207 - RNA, 16 nt, Escherichia coli CFT073
cacgcagggcauccag

SEQ ID NO: 2632208 - RNA, 21 nt, Escherichia coli CFT073
cacgcagugucagcaccagag

SEQ ID NO: 2632209 - RNA, 21 nt, Escherichia coli CFT073
cacgcauacaguaucgccugu

SEQ ID NO: 2632210 - RNA, 23 nt, Escherichia coli CFT073
cacgcaucacgacaaccgggauc

SEQ ID NO: 2632211 - RNA, 15 nt, Escherichia coli CFT073
cacgcauccggcaau

SEQ ID NO: 2632212 - RNA, 14 nt, Escherichia coli CFT073
cacgcaucugcugu

SEQ ID NO: 2632213 - RNA, 14 nt, Escherichia coli CFT073
cacgcauuucucgg

SEQ ID NO: 2632214 - RNA, 14 nt, Escherichia coli CFT073
cacgccaaccaccg

SEQ ID NO: 2632215 - RNA, 22 nt, Escherichia coli CFT073
cacgccaacguguugcugcaug

SEQ ID NO: 2632216 - RNA, 21 nt, Escherichia coli CFT073
cacgccaauguguuuauaagc

SEQ ID NO: 2632217 - RNA, 14 nt, Escherichia coli CFT073
cacgccaauuacgc

SEQ ID NO: 2632218 - RNA, 23 nt, Escherichia coli CFT073
cacgccacucacuaccagugcca

SEQ ID NO: 2632219 - RNA, 15 nt, Escherichia coli CFT073
cacgccagagauaac

SEQ ID NO: 2632220 - RNA, 18 nt, Escherichia coli CFT073
cacgccagugucgcauca

SEQ ID NO: 2632221 - RNA, 19 nt, Escherichia coli CFT073
cacgccagugucgcaucag

SEQ ID NO: 2632222 - RNA, 14 nt, Escherichia coli CFT073
cacgcccagcacau

SEQ ID NO: 2632223 - RNA, 14 nt, Escherichia coli CFT073
cacgcccagcgacc

SEQ ID NO: 2632224 - RNA, 14 nt, Escherichia coli CFT073
cacgcccgccagau

SEQ ID NO: 2632225 - RNA, 14 nt, Escherichia coli CFT073
cacgcccgcgaagc

SEQ ID NO: 2632226 - RNA, 15 nt, Escherichia coli CFT073
cacgccgaagugcgc

SEQ ID NO: 2632227 - RNA, 20 nt, Escherichia coli CFT073
cacgccgaagugcgcacagc

SEQ ID NO: 2632228 - RNA, 14 nt, Escherichia coli CFT073
cacgccgaccagac

SEQ ID NO: 2632229 - RNA, 19 nt, Escherichia coli CFT073
cacgccgaccagaccggca

SEQ ID NO: 2632230 - RNA, 23 nt, Escherichia coli CFT073
cacgccgauaaucaacgcgccgc

SEQ ID NO: 2632231 - RNA, 12 nt, Escherichia coli CFT073
cacgccgcauca

SEQ ID NO: 2632232 - RNA, 13 nt, Escherichia coli CFT073
cacgccgcaucag

SEQ ID NO: 2632233 - RNA, 17 nt, Escherichia coli CFT073
cacgccgcauccggcca

SEQ ID NO: 2632234 - RNA, 18 nt, Escherichia coli CFT073
cacgccgguucccagacc

SEQ ID NO: 2632235 - RNA, 17 nt, Escherichia coli CFT073
cacgccgucacgaccca

SEQ ID NO: 2632236 - RNA, 23 nt, Escherichia coli CFT073
cacgccguuuuuacccagcagca

SEQ ID NO: 2632237 - RNA, 18 nt, Escherichia coli CFT073
cacgccugcuucuacgca

SEQ ID NO: 2632238 - RNA, 12 nt, Escherichia coli CFT073
cacgccuucuuc

SEQ ID NO: 2632239 - RNA, 13 nt, Escherichia coli CFT073
cacgccuuguucu

SEQ ID NO: 2632240 - RNA, 16 nt, Escherichia coli CFT073
cacgcgacauuuuuau

SEQ ID NO: 2632241 - RNA, 23 nt, Escherichia coli CFT073
cacgcgaccgucuuuauccagca

SEQ ID NO: 2632242 - RNA, 14 nt, Escherichia coli CFT073
cacgcggcaacggc

SEQ ID NO: 2632243 - RNA, 19 nt, Escherichia coli CFT073
cacgcgguauggucacuga

SEQ ID NO: 2632244 - RNA, 17 nt, Escherichia coli CFT073
cacgcgguuacgcaccg

SEQ ID NO: 2632245 - RNA, 18 nt, Escherichia coli CFT073
cacgcguaauauccagcg

SEQ ID NO: 2632246 - RNA, 15 nt, Escherichia coli CFT073
cacgcuacucgccug

SEQ ID NO: 2632247 - RNA, 13 nt, Escherichia coli CFT073
cacgcucacccau

SEQ ID NO: 2632248 - RNA, 16 nt, Escherichia coli CFT073
cacgcucacucaucac

SEQ ID NO: 2632249 - RNA, 19 nt, Escherichia coli CFT073
cacgcucacucaucacucc

SEQ ID NO: 2632250 - RNA, 22 nt, Escherichia coli CFT073
cacgcucacucaucacuccccg

SEQ ID NO: 2632251 - RNA, 14 nt, Escherichia coli CFT073
cacuccucgcgcgu

SEQ ID NO: 2632252 - RNA, 14 nt, Escherichia coli CFT073
cacucgccgcugcg

SEQ ID NO: 2632253 - RNA, 17 nt, Escherichia coli CFT073
cacucggggcuuuucuc

SEQ ID NO: 2632254 - RNA, 19 nt, Escherichia coli CFT073
cacucggggcuuuucucua

SEQ ID NO: 2632255 - RNA, 18 nt, Escherichia coli CFT073
cacucguccagucgccug

SEQ ID NO: 2632256 - RNA, 18 nt, Escherichia coli CFT073
cacucgugauaaccuguu

SEQ ID NO: 2632257 - RNA, 14 nt, Escherichia coli CFT073
cacucguuucaaau

SEQ ID NO: 2632258 - RNA, 14 nt, Escherichia coli CFT073
cacucuauccagcc

SEQ ID NO: 2632259 - RNA, 21 nt, Escherichia coli CFT073
cacucucaaucgucaaacgca

SEQ ID NO: 2632260 - RNA, 16 nt, Escherichia coli CFT073
cacucugccaggcagc

SEQ ID NO: 2632261 - RNA, 15 nt, Escherichia coli CFT073
cacucugcugccaca

SEQ ID NO: 2632262 - RNA, 14 nt, Escherichia coli CFT073
cacucuuaaagcua

SEQ ID NO: 2632263 - RNA, 19 nt, Escherichia coli CFT073
cacucuuaacgccacucgc

SEQ ID NO: 2632264 - RNA, 16 nt, Escherichia coli CFT073
cacucuucaacacacu

SEQ ID NO: 2632265 - RNA, 14 nt, Escherichia coli CFT073
cacucuuccccgcu

SEQ ID NO: 2632266 - RNA, 16 nt, Escherichia coli CFT073
cacucuuggcaccgcc

SEQ ID NO: 2632267 - RNA, 14 nt, Escherichia coli CFT073
cacugaaaaucacc

SEQ ID NO: 2632268 - RNA, 21 nt, Escherichia coli CFT073
cacugaaacagauaaaaguua

SEQ ID NO: 2632269 - RNA, 20 nt, Escherichia coli CFT073
cacugaaacaugaacaucaa

SEQ ID NO: 2632270 - RNA, 18 nt, Escherichia coli CFT073
cacugaaaguggaaacac

SEQ ID NO: 2632271 - RNA, 22 nt, Escherichia coli CFT073
cacugaaauuguaggccugaua

SEQ ID NO: 2632272 - RNA, 19 nt, Escherichia coli CFT073
cacugaauaaaagugugca

SEQ ID NO: 2632273 - RNA, 21 nt, Escherichia coli CFT073
cacugaauucccccauugaaa

SEQ ID NO: 2632274 - RNA, 16 nt, Escherichia coli CFT073
cacugacaaucgccag

SEQ ID NO: 2632275 - RNA, 21 nt, Escherichia coli CFT073
cacugacaaucgccagugauu

SEQ ID NO: 2632276 - RNA, 17 nt, Escherichia coli CFT073
cacugacacaggcagca

SEQ ID NO: 2632277 - RNA, 18 nt, Escherichia coli CFT073
cacugacacggaacaacg

SEQ ID NO: 2632278 - RNA, 18 nt, Escherichia coli CFT073
cacugacaucacgccacu

SEQ ID NO: 2632279 - RNA, 14 nt, Escherichia coli CFT073
cacugacauccacg

SEQ ID NO: 2632280 - RNA, 15 nt, Escherichia coli CFT073
cacugacauccacgu

SEQ ID NO: 2632281 - RNA, 16 nt, Escherichia coli CFT073
cacugaccgcccggcc

SEQ ID NO: 2632282 - RNA, 20 nt, Escherichia coli CFT073
cacugacgcgucuuaucugg

SEQ ID NO: 2632283 - RNA, 15 nt, Escherichia coli CFT073
cacugacgggaaacu

SEQ ID NO: 2632284 - RNA, 16 nt, Escherichia coli CFT073
cacugacgggaaacuc

SEQ ID NO: 2632285 - RNA, 15 nt, Escherichia coli CFT073
cacugacugacagac

SEQ ID NO: 2632286 - RNA, 13 nt, Escherichia coli CFT073
cacugagcaccac

SEQ ID NO: 2632287 - RNA, 22 nt, Escherichia coli CFT073
cacugaggcgauagcauccagu

SEQ ID NO: 2632288 - RNA, 23 nt, Escherichia coli CFT073
cacugauauggugguaacuaccg

SEQ ID NO: 2632289 - RNA, 18 nt, Escherichia coli CFT073
cacugaugauccuggauu

SEQ ID NO: 2632290 - RNA, 15 nt, Escherichia coli CFT073
cacugauuacccuuc

SEQ ID NO: 2632291 - RNA, 17 nt, Escherichia coli CFT073
cacugauuguucagucg

SEQ ID NO: 2632292 - RNA, 18 nt, Escherichia coli CFT073
cacugauuuccccccggc

SEQ ID NO: 2632293 - RNA, 16 nt, Escherichia coli CFT073
cacugcaaaucaccac

SEQ ID NO: 2632294 - RNA, 22 nt, Escherichia coli CFT073
cacugcaaaucaccacaugccc

SEQ ID NO: 2632295 - RNA, 20 nt, Escherichia coli CFT073
cacugcagaauauccgccgu

SEQ ID NO: 2632296 - RNA, 21 nt, Escherichia coli CFT073
cacugcagaauauccgccgua

SEQ ID NO: 2632297 - RNA, 15 nt, Escherichia coli CFT073
cacugcaggcugaug

SEQ ID NO: 2632298 - RNA, 23 nt, Escherichia coli CFT073
cacugcauucggcgaccagcgca

SEQ ID NO: 2632299 - RNA, 13 nt, Escherichia coli CFT073
cacugccaccagg

SEQ ID NO: 2632300 - RNA, 14 nt, Escherichia coli CFT073
cacugccaccaucc

SEQ ID NO: 2632301 - RNA, 16 nt, Escherichia coli CFT073
cacugccacuuuuucc

SEQ ID NO: 2632302 - RNA, 20 nt, Escherichia coli CFT073
cacugccagaauagccgcag

SEQ ID NO: 2632303 - RNA, 22 nt, Escherichia coli CFT073
cacugccagaauagccgcagcu

SEQ ID NO: 2632304 - RNA, 17 nt, Escherichia coli CFT073
cacugccagcaaaaaau

SEQ ID NO: 2632305 - RNA, 16 nt, Escherichia coli CFT073
cacugccagcccggca

SEQ ID NO: 2632306 - RNA, 14 nt, Escherichia coli CFT073
cacugcccgcguaa

SEQ ID NO: 2632307 - RNA, 16 nt, Escherichia coli CFT073
cacugccgccaugcgg

SEQ ID NO: 2632308 - RNA, 21 nt, Escherichia coli CFT073
cacugccggggaaguaaaccc

SEQ ID NO: 2632309 - RNA, 19 nt, Escherichia coli CFT073
cacugccgggggcgaccug

SEQ ID NO: 2632310 - RNA, 16 nt, Escherichia coli CFT073
cacugccguacaggca

SEQ ID NO: 2632311 - RNA, 21 nt, Escherichia coli CFT073
cacugccuugcgauaucccau

SEQ ID NO: 2632312 - RNA, 23 nt, Escherichia coli CFT073
cacugcgaucgcccgcaaucagc

SEQ ID NO: 2632313 - RNA, 18 nt, Escherichia coli CFT073
cacugcgcauaauccacu

SEQ ID NO: 2632314 - RNA, 19 nt, Escherichia coli CFT073
cacugcgccaacgucugcc

SEQ ID NO: 2632315 - RNA, 21 nt, Escherichia coli CFT073
cacugcgccauuaaugccgca

SEQ ID NO: 2632316 - RNA, 14 nt, Escherichia coli CFT073
cacugcgcccgcca

SEQ ID NO: 2632317 - RNA, 16 nt, Escherichia coli CFT073
cacugcgcccgccagc

SEQ ID NO: 2632318 - RNA, 17 nt, Escherichia coli CFT073
cacugcgcccgccagca

SEQ ID NO: 2632319 - RNA, 18 nt, Escherichia coli CFT073
cacugcgcccgccagcau

SEQ ID NO: 2632320 - RNA, 19 nt, Escherichia coli CFT073
cacugcgcccgccagcauc

SEQ ID NO: 2632321 - RNA, 22 nt, Escherichia coli CFT073
cacugcgccgccagugugaaua

SEQ ID NO: 2632322 - RNA, 22 nt, Escherichia coli CFT073
cacugcgcgauaaucccaacgc

SEQ ID NO: 2632323 - RNA, 24 nt, Escherichia coli CFT073
cacugcggaagcuaccgaccagac

SEQ ID NO: 2632324 - RNA, 15 nt, Escherichia coli CFT073
cacugcggcauuucc

SEQ ID NO: 2632325 - RNA, 19 nt, Escherichia coli CFT073
cacugcgguguaaaccagc

SEQ ID NO: 2632326 - RNA, 14 nt, Escherichia coli CFT073
cacugcucaccgca

SEQ ID NO: 2632327 - RNA, 17 nt, Escherichia coli CFT073
cacugcucgcagaaaua

SEQ ID NO: 2632328 - RNA, 23 nt, Escherichia coli CFT073
cacuggcaacacuuuaucugcca

SEQ ID NO: 2632329 - RNA, 20 nt, Escherichia coli CFT073
cacuggcaagaaacgcucca

SEQ ID NO: 2632330 - RNA, 17 nt, Escherichia coli CFT073
cacuggcacaagacuga

SEQ ID NO: 2632331 - RNA, 18 nt, Escherichia coli CFT073
cacuggcacaagacugac

SEQ ID NO: 2632332 - RNA, 14 nt, Escherichia coli CFT073
cacuggcaccgcag

SEQ ID NO: 2632333 - RNA, 14 nt, Escherichia coli CFT073
cacuggccagcggc

SEQ ID NO: 2632334 - RNA, 14 nt, Escherichia coli CFT073
cacuggccucuucu

SEQ ID NO: 2632335 - RNA, 16 nt, Escherichia coli CFT073
cacuggccucuucucu

SEQ ID NO: 2632336 - RNA, 16 nt, Escherichia coli CFT073
cacuggcgaacucuga

SEQ ID NO: 2632337 - RNA, 13 nt, Escherichia coli CFT073
cacuggcgacacg

SEQ ID NO: 2632338 - RNA, 20 nt, Escherichia coli CFT073
cacuggcgacacgcaucacg

SEQ ID NO: 2632339 - RNA, 18 nt, Escherichia coli CFT073
cacuggcgauauugccgc

SEQ ID NO: 2632340 - RNA, 14 nt, Escherichia coli CFT073
cacuggcggcagca

SEQ ID NO: 2632341 - RNA, 18 nt, Escherichia coli CFT073
cacugggguaaauccacg

SEQ ID NO: 2632342 - RNA, 19 nt, Escherichia coli CFT073
cacugggguaaauccacgu

SEQ ID NO: 2632343 - RNA, 19 nt, Escherichia coli CFT073
cacuggguucaucuuccag

SEQ ID NO: 2632344 - RNA, 20 nt, Escherichia coli CFT073
cacuggucugacgcugaaua

SEQ ID NO: 2632345 - RNA, 23 nt, Escherichia coli CFT073
cacuggugugucuuuucaggccu

SEQ ID NO: 2632346 - RNA, 19 nt, Escherichia coli CFT073
cacugguuaacgcgccaau

SEQ ID NO: 2632347 - RNA, 15 nt, Escherichia coli CFT073
cacugguucccaaca

SEQ ID NO: 2632348 - RNA, 17 nt, Escherichia coli CFT073
cacugguucccaacaac

SEQ ID NO: 2632349 - RNA, 14 nt, Escherichia coli CFT073
cacugguucccaga

SEQ ID NO: 2632350 - RNA, 15 nt, Escherichia coli CFT073
cacuguagaccaguc

SEQ ID NO: 2632351 - RNA, 14 nt, Escherichia coli CFT073
cacuguaguuaucc

SEQ ID NO: 2632352 - RNA, 14 nt, Escherichia coli CFT073
cacuguaucaggug

SEQ ID NO: 2632353 - RNA, 14 nt, Escherichia coli CFT073
cacugucaaucgca

SEQ ID NO: 2632354 - RNA, 20 nt, Escherichia coli CFT073
cacugucccaaaaugucgga

SEQ ID NO: 2632355 - RNA, 15 nt, Escherichia coli CFT073
cacuguccgccagac

SEQ ID NO: 2632356 - RNA, 21 nt, Escherichia coli CFT073
cacuguggucaacccaacugg

SEQ ID NO: 2632357 - RNA, 23 nt, Escherichia coli CFT073
cacuguguuggguucacuuuccc

SEQ ID NO: 2632358 - RNA, 15 nt, Escherichia coli CFT073
cacuguuaccgcugc

SEQ ID NO: 2632359 - RNA, 17 nt, Escherichia coli CFT073
cagaaaguugcggauaa

SEQ ID NO: 2632360 - RNA, 16 nt, Escherichia coli CFT073
cagaaauaaucaccug

SEQ ID NO: 2632361 - RNA, 18 nt, Escherichia coli CFT073
cagaaauaaucaccugau

SEQ ID NO: 2632362 - RNA, 22 nt, Escherichia coli CFT073
cagaaauagaccggagaaaaga

SEQ ID NO: 2632363 - RNA, 16 nt, Escherichia coli CFT073
cagaaauagagaaaga

SEQ ID NO: 2632364 - RNA, 18 nt, Escherichia coli CFT073
cagaaauagagaaagagu

SEQ ID NO: 2632365 - RNA, 17 nt, Escherichia coli CFT073
cagaaaucagcagcuuu

SEQ ID NO: 2632366 - RNA, 19 nt, Escherichia coli CFT073
cagaaaucucuuccagcga

SEQ ID NO: 2632367 - RNA, 20 nt, Escherichia coli CFT073
cagaaaugccaguaacucau

SEQ ID NO: 2632368 - RNA, 21 nt, Escherichia coli CFT073
cagaaauggcuggcagcagac

SEQ ID NO: 2632369 - RNA, 12 nt, Escherichia coli CFT073
cagaaauuaaac

SEQ ID NO: 2632370 - RNA, 19 nt, Escherichia coli CFT073
cagaacaaugaucgacagg

SEQ ID NO: 2632371 - RNA, 15 nt, Escherichia coli CFT073
cagaacaauuccugu

SEQ ID NO: 2632372 - RNA, 11 nt, Escherichia coli CFT073
cagaacaccau

SEQ ID NO: 2632373 - RNA, 14 nt, Escherichia coli CFT073
cagaacacugcgcu

SEQ ID NO: 2632374 - RNA, 21 nt, Escherichia coli CFT073
cagaacacugcgcucuucugg

SEQ ID NO: 2632375 - RNA, 22 nt, Escherichia coli CFT073
cagaacacuguuaccgcugcug

SEQ ID NO: 2632376 - RNA, 23 nt, Escherichia coli CFT073
cagaacagaucccacauauguuu

SEQ ID NO: 2632377 - RNA, 18 nt, Escherichia coli CFT073
cagaacagguuacggucg

SEQ ID NO: 2632378 - RNA, 12 nt, Escherichia coli CFT073
cagaacauccag

SEQ ID NO: 2632379 - RNA, 14 nt, Escherichia coli CFT073
cagaaccagcaacc

SEQ ID NO: 2632380 - RNA, 20 nt, Escherichia coli CFT073
cagaaccagggaaaaaagcc

SEQ ID NO: 2632381 - RNA, 20 nt, Escherichia coli CFT073
cagaaccgcccagaccugcg

SEQ ID NO: 2632382 - RNA, 21 nt, Escherichia coli CFT073
cagaaccgccgcugucugaau

SEQ ID NO: 2632383 - RNA, 17 nt, Escherichia coli CFT073
cagaaccgcguaacuuu

SEQ ID NO: 2632384 - RNA, 19 nt, Escherichia coli CFT073
cagaaccggagucaguccc

SEQ ID NO: 2632385 - RNA, 23 nt, Escherichia coli CFT073
cagaaccguggguaaugccuuug

SEQ ID NO: 2632386 - RNA, 19 nt, Escherichia coli CFT073
cagaaccugaggcaauaaa

SEQ ID NO: 2632387 - RNA, 23 nt, Escherichia coli CFT073
cagaaccugaggcaauaaauaca

SEQ ID NO: 2632388 - RNA, 17 nt, Escherichia coli CFT073
cagaacgaccaguucac

SEQ ID NO: 2632389 - RNA, 15 nt, Escherichia coli CFT073
cagaacgacgaccgc

SEQ ID NO: 2632390 - RNA, 23 nt, Escherichia coli CFT073
cagaacgccgaauaacgcgcagc

SEQ ID NO: 2632391 - RNA, 24 nt, Escherichia coli CFT073
cagaacgccgaauaacgcgcagcg

SEQ ID NO: 2632392 - RNA, 21 nt, Escherichia coli CFT073
cagaacgcgccuuaaaaacca

SEQ ID NO: 2632393 - RNA, 14 nt, Escherichia coli CFT073
cagaacgcgugcgc

SEQ ID NO: 2632394 - RNA, 13 nt, Escherichia coli CFT073
cagaacggcgaug

SEQ ID NO: 2632395 - RNA, 19 nt, Escherichia coli CFT073
cagaacggugcgaccaaac

SEQ ID NO: 2632396 - RNA, 23 nt, Escherichia coli CFT073
cagaacggugcgaccaaacugcu

SEQ ID NO: 2632397 - RNA, 23 nt, Escherichia coli CFT073
cagaacguccgcaggaugagcgc

SEQ ID NO: 2632398 - RNA, 16 nt, Escherichia coli CFT073
cagaacuaaaaucggu

SEQ ID NO: 2632399 - RNA, 16 nt, Escherichia coli CFT073
cagaacuaaacuguga

SEQ ID NO: 2632400 - RNA, 17 nt, Escherichia coli CFT073
cagaacucacgcacuuc

SEQ ID NO: 2632401 - RNA, 14 nt, Escherichia coli CFT073
cagaacucaucuuc

SEQ ID NO: 2632402 - RNA, 18 nt, Escherichia coli CFT073
cagaacucaucuucuuuu

SEQ ID NO: 2632403 - RNA, 18 nt, Escherichia coli CFT073
cagaacugcugcgccagc

SEQ ID NO: 2632404 - RNA, 19 nt, Escherichia coli CFT073
cagaacugcugcgccagcg

SEQ ID NO: 2632405 - RNA, 23 nt, Escherichia coli CFT073
cagaacuucgcguuguauaacau

SEQ ID NO: 2632406 - RNA, 16 nt, Escherichia coli CFT073
cagaacuucugguaac

SEQ ID NO: 2632407 - RNA, 23 nt, Escherichia coli CFT073
cagaacuucugguaacagcggac

SEQ ID NO: 2632408 - RNA, 23 nt, Escherichia coli CFT073
cagaagaaaacguuccacgccgc

SEQ ID NO: 2632409 - RNA, 22 nt, Escherichia coli CFT073
cagaagagagauaauucagcag

SEQ ID NO: 2632410 - RNA, 14 nt, Escherichia coli CFT073
cagaagaggagagu

SEQ ID NO: 2632411 - RNA, 22 nt, Escherichia coli CFT073
cagaagaggagaguacgugagu

SEQ ID NO: 2632412 - RNA, 14 nt, Escherichia coli CFT073
cagaagaucaugcc

SEQ ID NO: 2632413 - RNA, 13 nt, Escherichia coli CFT073
cagaagaucggaa

SEQ ID NO: 2632414 - RNA, 22 nt, Escherichia coli CFT073
cagaagcagaaugaaugauaca

SEQ ID NO: 2632415 - RNA, 23 nt, Escherichia coli CFT073
cagaagugaagcauggcgcggaa

SEQ ID NO: 2632416 - RNA, 15 nt, Escherichia coli CFT073
cagaaguugcaccca

SEQ ID NO: 2632417 - RNA, 17 nt, Escherichia coli CFT073
cagaaguugugaaacga

SEQ ID NO: 2632418 - RNA, 21 nt, Escherichia coli CFT073
cagaauaacgcggcaggagag

SEQ ID NO: 2632419 - RNA, 21 nt, Escherichia coli CFT073
cagaauaacggcugauaacaa

SEQ ID NO: 2632420 - RNA, 21 nt, Escherichia coli CFT073
cagaauaacgugaucgaacau

SEQ ID NO: 2632421 - RNA, 13 nt, Escherichia coli CFT073
cagaauaagggca

SEQ ID NO: 2632422 - RNA, 17 nt, Escherichia coli CFT073
cagaauacccgaagcgc

SEQ ID NO: 2632423 - RNA, 18 nt, Escherichia coli CFT073
cagaauaccuugcugcuc

SEQ ID NO: 2632424 - RNA, 21 nt, Escherichia coli CFT073
cagaauaccuugcugcuccag

SEQ ID NO: 2632425 - RNA, 23 nt, Escherichia coli CFT073
cagaauaccuugcugcuccagcg

SEQ ID NO: 2632426 - RNA, 20 nt, Escherichia coli CFT073
cagaauagaaaguugccaga

SEQ ID NO: 2632427 - RNA, 17 nt, Escherichia coli CFT073
cagaauagcgccgccaa

SEQ ID NO: 2632428 - RNA, 21 nt, Escherichia coli CFT073
cagaauaguguuaaccgguac

SEQ ID NO: 2632429 - RNA, 17 nt, Escherichia coli CFT073
cagaauauacggaauga

SEQ ID NO: 2632430 - RNA, 22 nt, Escherichia coli CFT073
cagaauauauaaagauacacag

SEQ ID NO: 2632431 - RNA, 16 nt, Escherichia coli CFT073
cagaauauccggcacg

SEQ ID NO: 2632432 - RNA, 23 nt, Escherichia coli CFT073
cagaauaucgccaaggauaucgu

SEQ ID NO: 2632433 - RNA, 12 nt, Escherichia coli CFT073
cagaauaucugc

SEQ ID NO: 2632434 - RNA, 20 nt, Escherichia coli CFT073
cagaauauugccgaagacca

SEQ ID NO: 2632435 - RNA, 21 nt, Escherichia coli CFT073
cagaauauugccgaagaccag

SEQ ID NO: 2632436 - RNA, 23 nt, Escherichia coli CFT073
cagaauauugccgaagaccagau

SEQ ID NO: 2632437 - RNA, 21 nt, Escherichia coli CFT073
cagaaucaccggagcugccag

SEQ ID NO: 2632438 - RNA, 15 nt, Escherichia coli CFT073
cagaaucaccucuuu

SEQ ID NO: 2632439 - RNA, 15 nt, Escherichia coli CFT073
cagaaucaucauauc

SEQ ID NO: 2632440 - RNA, 15 nt, Escherichia coli CFT073
cagaauccccacaaa

SEQ ID NO: 2632441 - RNA, 14 nt, Escherichia coli CFT073
cagaauccggcgcu

SEQ ID NO: 2632442 - RNA, 24 nt, Escherichia coli CFT073
cagaauccggcgcucaucaggcca

SEQ ID NO: 2632443 - RNA, 18 nt, Escherichia coli CFT073
cagaauccggugauugcu

SEQ ID NO: 2632444 - RNA, 19 nt, Escherichia coli CFT073
cagaauccggugauugcug

SEQ ID NO: 2632445 - RNA, 15 nt, Escherichia coli CFT073
cagaaucgccaacgc

SEQ ID NO: 2632446 - RNA, 13 nt, Escherichia coli CFT073
cagaaucgccagc

SEQ ID NO: 2632447 - RNA, 14 nt, Escherichia coli CFT073
cagaaucgccagca

SEQ ID NO: 2632448 - RNA, 17 nt, Escherichia coli CFT073
cagaaucgccagcaucg

SEQ ID NO: 2632449 - RNA, 21 nt, Escherichia coli CFT073
cagaaucgccagcaucggcaa

SEQ ID NO: 2632450 - RNA, 13 nt, Escherichia coli CFT073
cagaaucguaaag

SEQ ID NO: 2632451 - RNA, 23 nt, Escherichia coli CFT073
cagaaucuaagaucccugccauu

SEQ ID NO: 2632452 - RNA, 21 nt, Escherichia coli CFT073
cagaaugaaugauacagaaag

SEQ ID NO: 2632453 - RNA, 17 nt, Escherichia coli CFT073
cagaaugacaucaucgc

SEQ ID NO: 2632454 - RNA, 20 nt, Escherichia coli CFT073
cagaaugacaucaucgcccc

SEQ ID NO: 2632455 - RNA, 14 nt, Escherichia coli CFT073
cagaaugccccauu

SEQ ID NO: 2632456 - RNA, 13 nt, Escherichia coli CFT073
cagaaugcgcgcg

SEQ ID NO: 2632457 - RNA, 19 nt, Escherichia coli CFT073
cagaaugcgcgcgaaaaca

SEQ ID NO: 2632458 - RNA, 20 nt, Escherichia coli CFT073
cagaaugcgcgcgaaaacau

SEQ ID NO: 2632459 - RNA, 16 nt, Escherichia coli CFT073
cagaauggcaucugau

SEQ ID NO: 2632460 - RNA, 20 nt, Escherichia coli CFT073
cagaauuccgugccagcacc

SEQ ID NO: 2632461 - RNA, 15 nt, Escherichia coli CFT073
cagaauucgggaagu

SEQ ID NO: 2632462 - RNA, 15 nt, Escherichia coli CFT073
cagaauuuccagaaa

SEQ ID NO: 2632463 - RNA, 19 nt, Escherichia coli CFT073
cagaauuucgacuuuuuuc

SEQ ID NO: 2632464 - RNA, 19 nt, Escherichia coli CFT073
cagaauuugagcuugcugc

SEQ ID NO: 2632465 - RNA, 20 nt, Escherichia coli CFT073
cagaauuugagcuugcugca

SEQ ID NO: 2632466 - RNA, 17 nt, Escherichia coli CFT073
cagacugaagcuccgcu

SEQ ID NO: 2632467 - RNA, 21 nt, Escherichia coli CFT073
cagacugacaaucaucgccgu

SEQ ID NO: 2632468 - RNA, 20 nt, Escherichia coli CFT073
cagacugaucaauaucagca

SEQ ID NO: 2632469 - RNA, 21 nt, Escherichia coli CFT073
cagacugaucaauaucagcaa

SEQ ID NO: 2632470 - RNA, 17 nt, Escherichia coli CFT073
cagacugaucaucgccc

SEQ ID NO: 2632471 - RNA, 21 nt, Escherichia coli CFT073
cagacugaucaucgcccaguu

SEQ ID NO: 2632472 - RNA, 15 nt, Escherichia coli CFT073
cagacugaugugcuc

SEQ ID NO: 2632473 - RNA, 16 nt, Escherichia coli CFT073
cagacugcgcauuaaa

SEQ ID NO: 2632474 - RNA, 14 nt, Escherichia coli CFT073
cagacugcuuuucc

SEQ ID NO: 2632475 - RNA, 21 nt, Escherichia coli CFT073
cagacugcuuuucccuuucag

SEQ ID NO: 2632476 - RNA, 22 nt, Escherichia coli CFT073
cagacugcuuuucccuuucaga

SEQ ID NO: 2632477 - RNA, 23 nt, Escherichia coli CFT073
cagacugcuuuucccuuucagau

SEQ ID NO: 2632478 - RNA, 17 nt, Escherichia coli CFT073
cagacuggauacgcuga

SEQ ID NO: 2632479 - RNA, 18 nt, Escherichia coli CFT073
cagacuguaaaucugccg

SEQ ID NO: 2632480 - RNA, 23 nt, Escherichia coli CFT073
cagacugugccguggcgcucgca

SEQ ID NO: 2632481 - RNA, 16 nt, Escherichia coli CFT073
cagacuuggucgguau

SEQ ID NO: 2632482 - RNA, 19 nt, Escherichia coli CFT073
cagacuugugcgcuuguuc

SEQ ID NO: 2632483 - RNA, 23 nt, Escherichia coli CFT073
cagacuuuuccuuugcgcgucac

SEQ ID NO: 2632484 - RNA, 22 nt, Escherichia coli CFT073
cagacuuuuugcggcagcaaug

SEQ ID NO: 2632485 - RNA, 14 nt, Escherichia coli CFT073
cagagaaaagauaa

SEQ ID NO: 2632486 - RNA, 14 nt, Escherichia coli CFT073
cagagaaaccacau

SEQ ID NO: 2632487 - RNA, 15 nt, Escherichia coli CFT073
cagagaaacgccagc

SEQ ID NO: 2632488 - RNA, 18 nt, Escherichia coli CFT073
cagagaaacgccagcagc

SEQ ID NO: 2632489 - RNA, 13 nt, Escherichia coli CFT073
cagagaaagcaaa

SEQ ID NO: 2632490 - RNA, 18 nt, Escherichia coli CFT073
cagagaaagcaaaaauaa

SEQ ID NO: 2632491 - RNA, 19 nt, Escherichia coli CFT073
cagagaaagcaaaaauaaa

SEQ ID NO: 2632492 - RNA, 13 nt, Escherichia coli CFT073
cagagaacguggu

SEQ ID NO: 2632493 - RNA, 21 nt, Escherichia coli CFT073
cagagaacgugguauggaguu

SEQ ID NO: 2632494 - RNA, 19 nt, Escherichia coli CFT073
cagagaaguguacgaacac

SEQ ID NO: 2632495 - RNA, 21 nt, Escherichia coli CFT073
cagagaaucaugucagagcug

SEQ ID NO: 2632496 - RNA, 13 nt, Escherichia coli CFT073
cagagacaacccg

SEQ ID NO: 2632497 - RNA, 16 nt, Escherichia coli CFT073
cagagacagaccaaaa

SEQ ID NO: 2632498 - RNA, 23 nt, Escherichia coli CFT073
cagagacucggugaccauccauu

SEQ ID NO: 2632499 - RNA, 12 nt, Escherichia coli CFT073
cagagagccagc

SEQ ID NO: 2632500 - RNA, 14 nt, Escherichia coli CFT073
cagagagcgaauau

SEQ ID NO: 2632501 - RNA, 18 nt, Escherichia coli CFT073
cagagagcgaauaucauu

SEQ ID NO: 2632502 - RNA, 20 nt, Escherichia coli CFT073
cagagaggacucugccggau

SEQ ID NO: 2632503 - RNA, 14 nt, Escherichia coli CFT073
cagagauacaggcc

SEQ ID NO: 2632504 - RNA, 20 nt, Escherichia coli CFT073
cagagauacaggccaccgcc

SEQ ID NO: 2632505 - RNA, 22 nt, Escherichia coli CFT073
cagagauacaggccaccgccca

SEQ ID NO: 2632506 - RNA, 14 nt, Escherichia coli CFT073
cagagauaccgcgc

SEQ ID NO: 2632507 - RNA, 15 nt, Escherichia coli CFT073
cagagauagaacugc

SEQ ID NO: 2632508 - RNA, 13 nt, Escherichia coli CFT073
cagagaucgcccc

SEQ ID NO: 2632509 - RNA, 23 nt, Escherichia coli CFT073
cagagaucgccccggcaagaaau

SEQ ID NO: 2632510 - RNA, 13 nt, Escherichia coli CFT073
cagagaucgccgc

SEQ ID NO: 2632511 - RNA, 13 nt, Escherichia coli CFT073
cagagaucuuuca

SEQ ID NO: 2632512 - RNA, 17 nt, Escherichia coli CFT073
cagagauuaacgucacu

SEQ ID NO: 2632513 - RNA, 16 nt, Escherichia coli CFT073
cagagcaaacaggcug

SEQ ID NO: 2632514 - RNA, 13 nt, Escherichia coli CFT073
cagagcagcaaca

SEQ ID NO: 2632515 - RNA, 14 nt, Escherichia coli CFT073
cagagcauccagca

SEQ ID NO: 2632516 - RNA, 14 nt, Escherichia coli CFT073
cagagcaucgguau

SEQ ID NO: 2632517 - RNA, 17 nt, Escherichia coli CFT073
cagagccaaagaauugg

SEQ ID NO: 2632518 - RNA, 22 nt, Escherichia coli CFT073
cagagccgcgguauccggcuca

SEQ ID NO: 2632519 - RNA, 12 nt, Escherichia coli CFT073
cagagccugaau

SEQ ID NO: 2632520 - RNA, 17 nt, Escherichia coli CFT073
cagagccugacauuucc

SEQ ID NO: 2632521 - RNA, 21 nt, Escherichia coli CFT073
cagagcgaauuaagaauuucu

SEQ ID NO: 2632522 - RNA, 15 nt, Escherichia coli CFT073
cagagcucaaccaga

SEQ ID NO: 2632523 - RNA, 20 nt, Escherichia coli CFT073
cagagcugcaaaaguaccau

SEQ ID NO: 2632524 - RNA, 18 nt, Escherichia coli CFT073
cagagcuuuguugcgcug

SEQ ID NO: 2632525 - RNA, 14 nt, Escherichia coli CFT073
cagaggaggagagc

SEQ ID NO: 2632526 - RNA, 22 nt, Escherichia coli CFT073
cagaggauauucugcggcuuca

SEQ ID NO: 2632527 - RNA, 17 nt, Escherichia coli CFT073
cagaggaucuccacccg

SEQ ID NO: 2632528 - RNA, 13 nt, Escherichia coli CFT073
cagaggaucugga

SEQ ID NO: 2632529 - RNA, 18 nt, Escherichia coli CFT073
cagaggaucuggacgcca

SEQ ID NO: 2632530 - RNA, 18 nt, Escherichia coli CFT073
cagaggcauaaagcugcc

SEQ ID NO: 2632531 - RNA, 12 nt, Escherichia coli CFT073
cagagggaaaga

SEQ ID NO: 2632532 - RNA, 13 nt, Escherichia coli CFT073
cagagguacauca

SEQ ID NO: 2632533 - RNA, 13 nt, Escherichia coli CFT073
cagaggugcgacc

SEQ ID NO: 2632534 - RNA, 16 nt, Escherichia coli CFT073
cagaggugcgaccagc

SEQ ID NO: 2632535 - RNA, 17 nt, Escherichia coli CFT073
cagaguaaaccgccugu

SEQ ID NO: 2632536 - RNA, 15 nt, Escherichia coli CFT073
cagaguaccgauaga

SEQ ID NO: 2632537 - RNA, 19 nt, Escherichia coli CFT073
cagaguacgcaguugcuga

SEQ ID NO: 2632538 - RNA, 12 nt, Escherichia coli CFT073
cagaguagaaau

SEQ ID NO: 2632539 - RNA, 18 nt, Escherichia coli CFT073
cagaguauuuccagcuca

SEQ ID NO: 2632540 - RNA, 15 nt, Escherichia coli CFT073
cagagucaucucugc

SEQ ID NO: 2632541 - RNA, 19 nt, Escherichia coli CFT073
cagagucuuugcuugcgaa

SEQ ID NO: 2632542 - RNA, 12 nt, Escherichia coli CFT073
cagagugcccac

SEQ ID NO: 2632543 - RNA, 18 nt, Escherichia coli CFT073
cagaguggauuaucuuca

SEQ ID NO: 2632544 - RNA, 18 nt, Escherichia coli CFT073
cagaguguauucaugccc

SEQ ID NO: 2632545 - RNA, 16 nt, Escherichia coli CFT073
cagaguugaaaaucuc

SEQ ID NO: 2632546 - RNA, 13 nt, Escherichia coli CFT073
cagauaaaacaca

SEQ ID NO: 2632547 - RNA, 13 nt, Escherichia coli CFT073
cagauaaaacagg

SEQ ID NO: 2632548 - RNA, 22 nt, Escherichia coli CFT073
cagauaaauggcacagugguca

SEQ ID NO: 2632549 - RNA, 14 nt, Escherichia coli CFT073
cagauaacccagca

SEQ ID NO: 2632550 - RNA, 15 nt, Escherichia coli CFT073
cagauaacccagcag

SEQ ID NO: 2632551 - RNA, 23 nt, Escherichia coli CFT073
cagauaacccaggggucaguucc

SEQ ID NO: 2632552 - RNA, 18 nt, Escherichia coli CFT073
cagauaaggcguuuacgc

SEQ ID NO: 2632553 - RNA, 22 nt, Escherichia coli CFT073
cagauaaguuugccguuaaucu

SEQ ID NO: 2632554 - RNA, 18 nt, Escherichia coli CFT073
cagauaauaaaaaaggca

SEQ ID NO: 2632555 - RNA, 22 nt, Escherichia coli CFT073
cagauaauaauguguucaacuu

SEQ ID NO: 2632556 - RNA, 14 nt, Escherichia coli CFT073
cagauaauagguaa

SEQ ID NO: 2632557 - RNA, 16 nt, Escherichia coli CFT073
cagauaauauuuaucu

SEQ ID NO: 2632558 - RNA, 18 nt, Escherichia coli CFT073
cagauaauauuuaucuuc

SEQ ID NO: 2632559 - RNA, 14 nt, Escherichia coli CFT073
cagauaaucaaccc

SEQ ID NO: 2632560 - RNA, 16 nt, Escherichia coli CFT073
cagauaaugagacaca

SEQ ID NO: 2632561 - RNA, 17 nt, Escherichia coli CFT073
cagauaccaauuuauuu

SEQ ID NO: 2632562 - RNA, 14 nt, Escherichia coli CFT073
cagauaccacauca

SEQ ID NO: 2632563 - RNA, 15 nt, Escherichia coli CFT073
cagauaccaccagcg

SEQ ID NO: 2632564 - RNA, 16 nt, Escherichia coli CFT073
cagauaccaccagcgc

SEQ ID NO: 2632565 - RNA, 22 nt, Escherichia coli CFT073
cagauaccaguugaucaaauaa

SEQ ID NO: 2632566 - RNA, 19 nt, Escherichia coli CFT073
cagauacccgacagauaaa

SEQ ID NO: 2632567 - RNA, 23 nt, Escherichia coli CFT073
cagauacccgacagauaaaucau

SEQ ID NO: 2632568 - RNA, 14 nt, Escherichia coli CFT073
cagauacggcgauc

SEQ ID NO: 2632569 - RNA, 14 nt, Escherichia coli CFT073
cagauacugaugaa

SEQ ID NO: 2632570 - RNA, 16 nt, Escherichia coli CFT073
cagauacugccgacca

SEQ ID NO: 2632571 - RNA, 22 nt, Escherichia coli CFT073
cagauacugccgaccagagcca

SEQ ID NO: 2632572 - RNA, 14 nt, Escherichia coli CFT073
cagauacuggaaaa

SEQ ID NO: 2632573 - RNA, 15 nt, Escherichia coli CFT073
cagauacuggaaaau

SEQ ID NO: 2632574 - RNA, 22 nt, Escherichia coli CFT073
cagauagccagguuuaccagca

SEQ ID NO: 2632575 - RNA, 22 nt, Escherichia coli CFT073
cagcacuucgcugguguacugc

SEQ ID NO: 2632576 - RNA, 14 nt, Escherichia coli CFT073
cagcagaacaucag

SEQ ID NO: 2632577 - RNA, 22 nt, Escherichia coli CFT073
cagcagaaugacaucaucgccc

SEQ ID NO: 2632578 - RNA, 16 nt, Escherichia coli CFT073
cagcagacgguuggca

SEQ ID NO: 2632579 - RNA, 19 nt, Escherichia coli CFT073
cagcagagauacaggccac

SEQ ID NO: 2632580 - RNA, 22 nt, Escherichia coli CFT073
cagcagauaaaagaccacaauc

SEQ ID NO: 2632581 - RNA, 16 nt, Escherichia coli CFT073
cagcagauaccaaccc

SEQ ID NO: 2632582 - RNA, 18 nt, Escherichia coli CFT073
cagcagauaccaacccug

SEQ ID NO: 2632583 - RNA, 18 nt, Escherichia coli CFT073
cagcagauccauugcgaa

SEQ ID NO: 2632584 - RNA, 12 nt, Escherichia coli CFT073
cagcagauccgg

SEQ ID NO: 2632585 - RNA, 21 nt, Escherichia coli CFT073
cagcagaucgaucuuguugaa

SEQ ID NO: 2632586 - RNA, 14 nt, Escherichia coli CFT073
cagcagauggcagc

SEQ ID NO: 2632587 - RNA, 17 nt, Escherichia coli CFT073
cagcagcaauauguuga

SEQ ID NO: 2632588 - RNA, 20 nt, Escherichia coli CFT073
cagcagcaaugcagguaccu

SEQ ID NO: 2632589 - RNA, 13 nt, Escherichia coli CFT073
cagcagcacaaac

SEQ ID NO: 2632590 - RNA, 17 nt, Escherichia coli CFT073
cagcagcaccaccgccc

SEQ ID NO: 2632591 - RNA, 24 nt, Escherichia coli CFT073
cagcagcacccgaugcggcagucg

SEQ ID NO: 2632592 - RNA, 14 nt, Escherichia coli CFT073
cagcagcagacagc

SEQ ID NO: 2632593 - RNA, 23 nt, Escherichia coli CFT073
cagcagcagacagccuaccagac

SEQ ID NO: 2632594 - RNA, 15 nt, Escherichia coli CFT073
cagcagcagcgcaau

SEQ ID NO: 2632595 - RNA, 15 nt, Escherichia coli CFT073
cagcagcagcgccaa

SEQ ID NO: 2632596 - RNA, 16 nt, Escherichia coli CFT073
cagcagcaucaccacg

SEQ ID NO: 2632597 - RNA, 22 nt, Escherichia coli CFT073
cagcagcccugccggaacgugc

SEQ ID NO: 2632598 - RNA, 19 nt, Escherichia coli CFT073
cagcagccgcgcuuucuuc

SEQ ID NO: 2632599 - RNA, 22 nt, Escherichia coli CFT073
cagcagccgcgcuuucuucuuc

SEQ ID NO: 2632600 - RNA, 16 nt, Escherichia coli CFT073
cagcagcgaauaauuc

SEQ ID NO: 2632601 - RNA, 23 nt, Escherichia coli CFT073
cagcagcgacucacgaaucgccu

SEQ ID NO: 2632602 - RNA, 13 nt, Escherichia coli CFT073
cagcagcgcaauu

SEQ ID NO: 2632603 - RNA, 11 nt, Escherichia coli CFT073
cagcagcgcca

SEQ ID NO: 2632604 - RNA, 16 nt, Escherichia coli CFT073
cagcagcgccaggcac

SEQ ID NO: 2632605 - RNA, 21 nt, Escherichia coli CFT073
cagcagcgccaggcacaccag

SEQ ID NO: 2632606 - RNA, 23 nt, Escherichia coli CFT073
cagcagcguucccagccaguccg

SEQ ID NO: 2632607 - RNA, 18 nt, Escherichia coli CFT073
cagcagcucaaucgccuc

SEQ ID NO: 2632608 - RNA, 15 nt, Escherichia coli CFT073
cagcagcucacgcag

SEQ ID NO: 2632609 - RNA, 19 nt, Escherichia coli CFT073
cagcagcuucacgccgcgc

SEQ ID NO: 2632610 - RNA, 18 nt, Escherichia coli CFT073
cagcagcuucgucaccug

SEQ ID NO: 2632611 - RNA, 17 nt, Escherichia coli CFT073
cagcagcuugcgccgcc

SEQ ID NO: 2632612 - RNA, 22 nt, Escherichia coli CFT073
cagcaggaauaaucagcaguga

SEQ ID NO: 2632613 - RNA, 21 nt, Escherichia coli CFT073
cagcaggaaucccaucagacg

SEQ ID NO: 2632614 - RNA, 16 nt, Escherichia coli CFT073
cagcaggaccauacug

SEQ ID NO: 2632615 - RNA, 23 nt, Escherichia coli CFT073
cagcaggaccuuauccccggucu

SEQ ID NO: 2632616 - RNA, 17 nt, Escherichia coli CFT073
cagcaggacguuggcga

SEQ ID NO: 2632617 - RNA, 16 nt, Escherichia coli CFT073
cagcaggaucagaccg

SEQ ID NO: 2632618 - RNA, 23 nt, Escherichia coli CFT073
cagcaggauuugcgguagcgggc

SEQ ID NO: 2632619 - RNA, 12 nt, Escherichia coli CFT073
cagcaggcagau

SEQ ID NO: 2632620 - RNA, 16 nt, Escherichia coli CFT073
cagcaggcgagcugcc

SEQ ID NO: 2632621 - RNA, 19 nt, Escherichia coli CFT073
cagcagggcaaacagcacg

SEQ ID NO: 2632622 - RNA, 19 nt, Escherichia coli CFT073
cagcagggcaaucgcgcca

SEQ ID NO: 2632623 - RNA, 22 nt, Escherichia coli CFT073
cagcagggcaaucgcgccaacc

SEQ ID NO: 2632624 - RNA, 17 nt, Escherichia coli CFT073
cagcagguccaucacuu

SEQ ID NO: 2632625 - RNA, 22 nt, Escherichia coli CFT073
cagcaguaaaccacccaccagc

SEQ ID NO: 2632626 - RNA, 14 nt, Escherichia coli CFT073
cagcaguaaaccgc

SEQ ID NO: 2632627 - RNA, 16 nt, Escherichia coli CFT073
cagcaguaaaccgcuc

SEQ ID NO: 2632628 - RNA, 14 nt, Escherichia coli CFT073
cagcagugcugcau

SEQ ID NO: 2632629 - RNA, 16 nt, Escherichia coli CFT073
cagcaguucacagcgc

SEQ ID NO: 2632630 - RNA, 15 nt, Escherichia coli CFT073
cagcaguuccagcau

SEQ ID NO: 2632631 - RNA, 15 nt, Escherichia coli CFT073
cagcaguucgcccgc

SEQ ID NO: 2632632 - RNA, 23 nt, Escherichia coli CFT073
cagcaguucgcccgcuucaucgu

SEQ ID NO: 2632633 - RNA, 20 nt, Escherichia coli CFT073
cagcaguugcugacuuuccg

SEQ ID NO: 2632634 - RNA, 21 nt, Escherichia coli CFT073
cagcaguuuuaccgaugcgcu

SEQ ID NO: 2632635 - RNA, 16 nt, Escherichia coli CFT073
cagcauaaauuucucg

SEQ ID NO: 2632636 - RNA, 18 nt, Escherichia coli CFT073
cagcauaaucaccaguac

SEQ ID NO: 2632637 - RNA, 20 nt, Escherichia coli CFT073
cagcauaaucaccaguaccg

SEQ ID NO: 2632638 - RNA, 17 nt, Escherichia coli CFT073
cagcauaaucaccauca

SEQ ID NO: 2632639 - RNA, 18 nt, Escherichia coli CFT073
cagcauaccuuccagcgc

SEQ ID NO: 2632640 - RNA, 17 nt, Escherichia coli CFT073
cagcauacgccacaucc

SEQ ID NO: 2632641 - RNA, 13 nt, Escherichia coli CFT073
cagcauacuccag

SEQ ID NO: 2632642 - RNA, 17 nt, Escherichia coli CFT073
cagcauaguacgggcaa

SEQ ID NO: 2632643 - RNA, 22 nt, Escherichia coli CFT073
cagcauauguuuacgcuggcgg

SEQ ID NO: 2632644 - RNA, 13 nt, Escherichia coli CFT073
cagcaucaacaac

SEQ ID NO: 2632645 - RNA, 20 nt, Escherichia coli CFT073
cagcaucacaucaaaucccc

SEQ ID NO: 2632646 - RNA, 20 nt, Escherichia coli CFT073
cagcaucacgcccgcuuuuu

SEQ ID NO: 2632647 - RNA, 22 nt, Escherichia coli CFT073
cagcaucacgguaccuaccggu

SEQ ID NO: 2632648 - RNA, 17 nt, Escherichia coli CFT073
cagcaucaggaugauac

SEQ ID NO: 2632649 - RNA, 13 nt, Escherichia coli CFT073
cagcaucccaccu

SEQ ID NO: 2632650 - RNA, 13 nt, Escherichia coli CFT073
cagcauccgcgca

SEQ ID NO: 2632651 - RNA, 12 nt, Escherichia coli CFT073
cagcaucgacca

SEQ ID NO: 2632652 - RNA, 23 nt, Escherichia coli CFT073
cagcaucgcauccggcaauaacu

SEQ ID NO: 2632653 - RNA, 17 nt, Escherichia coli CFT073
cagcaucgcaucgauaa

SEQ ID NO: 2632654 - RNA, 15 nt, Escherichia coli CFT073
cagcaucgcuuccau

SEQ ID NO: 2632655 - RNA, 17 nt, Escherichia coli CFT073
cagcaucgcuuugugcu

SEQ ID NO: 2632656 - RNA, 21 nt, Escherichia coli CFT073
cagcaucgcuuugugcucuuc

SEQ ID NO: 2632657 - RNA, 16 nt, Escherichia coli CFT073
cagcaucggccugcaa

SEQ ID NO: 2632658 - RNA, 17 nt, Escherichia coli CFT073
cagcaucgggaugagca

SEQ ID NO: 2632659 - RNA, 13 nt, Escherichia coli CFT073
cagcaucuccugc

SEQ ID NO: 2632660 - RNA, 14 nt, Escherichia coli CFT073
cagcaucucgcgcu

SEQ ID NO: 2632661 - RNA, 23 nt, Escherichia coli CFT073
cagcaucucgcgcucuucuucac

SEQ ID NO: 2632662 - RNA, 16 nt, Escherichia coli CFT073
cagcaucucugcaugu

SEQ ID NO: 2632663 - RNA, 13 nt, Escherichia coli CFT073
cagcaugauacaa

SEQ ID NO: 2632664 - RNA, 21 nt, Escherichia coli CFT073
cagcaugauacaaaacagaua

SEQ ID NO: 2632665 - RNA, 13 nt, Escherichia coli CFT073
cagcaugccgcca

SEQ ID NO: 2632666 - RNA, 14 nt, Escherichia coli CFT073
cagcaugccgccaa

SEQ ID NO: 2632667 - RNA, 24 nt, Escherichia coli CFT073
cagcaugccgccaagcauuacgaa

SEQ ID NO: 2632668 - RNA, 20 nt, Escherichia coli CFT073
cagcauggguaaagcccauc

SEQ ID NO: 2632669 - RNA, 16 nt, Escherichia coli CFT073
cagcauggucgcagcg

SEQ ID NO: 2632670 - RNA, 22 nt, Escherichia coli CFT073
cagcauggucgcagcggcuucc

SEQ ID NO: 2632671 - RNA, 20 nt, Escherichia coli CFT073
cagcaugucuugccucccug

SEQ ID NO: 2632672 - RNA, 12 nt, Escherichia coli CFT073
cagcauuagcau

SEQ ID NO: 2632673 - RNA, 13 nt, Escherichia coli CFT073
cagcauucagcuu

SEQ ID NO: 2632674 - RNA, 16 nt, Escherichia coli CFT073
cagcauucaucacaaa

SEQ ID NO: 2632675 - RNA, 13 nt, Escherichia coli CFT073
cagcauucccgcc

SEQ ID NO: 2632676 - RNA, 16 nt, Escherichia coli CFT073
cagcauucccgccacc

SEQ ID NO: 2632677 - RNA, 17 nt, Escherichia coli CFT073
cagcauucccgccacca

SEQ ID NO: 2632678 - RNA, 18 nt, Escherichia coli CFT073
cagcauucccgccaccau

SEQ ID NO: 2632679 - RNA, 16 nt, Escherichia coli CFT073
cagcauugcgccagcg

SEQ ID NO: 2632680 - RNA, 21 nt, Escherichia coli CFT073
cagcauugucaggaucaccaa

SEQ ID NO: 2632681 - RNA, 19 nt, Escherichia coli CFT073
cagcauuuguugguacacc

SEQ ID NO: 2632682 - RNA, 21 nt, Escherichia coli CFT073
cagcauuuguugguacaccug

SEQ ID NO: 2632683 - RNA, 15 nt, Escherichia coli CFT073
cagccgcuaacuucc

SEQ ID NO: 2632684 - RNA, 23 nt, Escherichia coli CFT073
cagccgcuaacuuccugcuggcu

SEQ ID NO: 2632685 - RNA, 22 nt, Escherichia coli CFT073
cagccggguaaucagcuuaucc

SEQ ID NO: 2632686 - RNA, 17 nt, Escherichia coli CFT073
cagccgguaauuuauug

SEQ ID NO: 2632687 - RNA, 21 nt, Escherichia coli CFT073
cagccgguaauuuauugugca

SEQ ID NO: 2632688 - RNA, 12 nt, Escherichia coli CFT073
cagccggucauu

SEQ ID NO: 2632689 - RNA, 17 nt, Escherichia coli CFT073
cagccgucgccaguacc

SEQ ID NO: 2632690 - RNA, 17 nt, Escherichia coli CFT073
cagccgucgcccacagu

SEQ ID NO: 2632691 - RNA, 19 nt, Escherichia coli CFT073
cagccgucgcccacagucu

SEQ ID NO: 2632692 - RNA, 22 nt, Escherichia coli CFT073
cagccguugucagucaucacuu

SEQ ID NO: 2632693 - RNA, 21 nt, Escherichia coli CFT073
cagccguuuaauugccucuuc

SEQ ID NO: 2632694 - RNA, 15 nt, Escherichia coli CFT073
cagccguuuguucug

SEQ ID NO: 2632695 - RNA, 22 nt, Escherichia coli CFT073
cagccuaagccauuuaacucac

SEQ ID NO: 2632696 - RNA, 20 nt, Escherichia coli CFT073
cagccuacagaacgcugcaa

SEQ ID NO: 2632697 - RNA, 15 nt, Escherichia coli CFT073
cagccuaugcagguu

SEQ ID NO: 2632698 - RNA, 21 nt, Escherichia coli CFT073
cagccucaagcacccgccgcu

SEQ ID NO: 2632699 - RNA, 16 nt, Escherichia coli CFT073
cagccucauccaugcg

SEQ ID NO: 2632700 - RNA, 14 nt, Escherichia coli CFT073
cagccucucucuga

SEQ ID NO: 2632701 - RNA, 16 nt, Escherichia coli CFT073
cagccucucucugagg

SEQ ID NO: 2632702 - RNA, 18 nt, Escherichia coli CFT073
cagccucuuccagagagg

SEQ ID NO: 2632703 - RNA, 17 nt, Escherichia coli CFT073
cagccugaaugccgcgc

SEQ ID NO: 2632704 - RNA, 19 nt, Escherichia coli CFT073
cagccugaaugccgcgccc

SEQ ID NO: 2632705 - RNA, 20 nt, Escherichia coli CFT073
cagccugaaugccgcgcccc

SEQ ID NO: 2632706 - RNA, 15 nt, Escherichia coli CFT073
cagccugauccacuu

SEQ ID NO: 2632707 - RNA, 21 nt, Escherichia coli CFT073
cagccugauccacuuuagaca

SEQ ID NO: 2632708 - RNA, 17 nt, Escherichia coli CFT073
cagccugcguucaguug

SEQ ID NO: 2632709 - RNA, 17 nt, Escherichia coli CFT073
cagccugugccugagcc

SEQ ID NO: 2632710 - RNA, 21 nt, Escherichia coli CFT073
cagccuuaccggagaaaaaca

SEQ ID NO: 2632711 - RNA, 12 nt, Escherichia coli CFT073
cagccuucuuca

SEQ ID NO: 2632712 - RNA, 19 nt, Escherichia coli CFT073
cagccuucuucauccagcg

SEQ ID NO: 2632713 - RNA, 14 nt, Escherichia coli CFT073
cagccuucuugcug

SEQ ID NO: 2632714 - RNA, 20 nt, Escherichia coli CFT073
cagccuucuugcuguccggu

SEQ ID NO: 2632715 - RNA, 16 nt, Escherichia coli CFT073
cagccuuuucauccuc

SEQ ID NO: 2632716 - RNA, 12 nt, Escherichia coli CFT073
cagccuuuuucu

SEQ ID NO: 2632717 - RNA, 13 nt, Escherichia coli CFT073
cagccuuuuucuc

SEQ ID NO: 2632718 - RNA, 22 nt, Escherichia coli CFT073
cagcgaaaaagucccuucccag

SEQ ID NO: 2632719 - RNA, 13 nt, Escherichia coli CFT073
cagcgaaaacgac

SEQ ID NO: 2632720 - RNA, 13 nt, Escherichia coli CFT073
cagcgaaaccuga

SEQ ID NO: 2632721 - RNA, 14 nt, Escherichia coli CFT073
cagcgaaaccugaa

SEQ ID NO: 2632722 - RNA, 18 nt, Escherichia coli CFT073
cagcgaaacgcaaaaccc

SEQ ID NO: 2632723 - RNA, 16 nt, Escherichia coli CFT073
cagcgaaacucgcuga

SEQ ID NO: 2632724 - RNA, 21 nt, Escherichia coli CFT073
cagcgaaacucgcugacugau
